United States Patent 7,745,391 (HUMAN THROMBOSPONDIN POLYPEPTIDE) - sequence listing, part 77

SEQ ID NO: 277697 - DNA, 3934 bp, Homo sapiens
  misc_feature (2291)..(2291): n is a, c, g, or t
gcgacgaggagggcgacgacgaggagacgggcagcggcgaggaggaggaagaggaggcggaggcggcggccgggtgggagcgcagcgaggacgcgcggctgctgcgcgcagggctgcctcctgccgctgtccccgccgcggccgcccgcgacaggagcggccgccgcccgccgaggccgccgcccggccgcccgaggatgcggccgtccggcgacgaggaccgcgcgcgtcgccgccgccgccgccgccgccggagggaccttctgctgagccagctctgcttcctggcctcggtggcgctgctgctctggtcgctgtcgagcctgcgagagcagaaggagcttgacctcatggacctcgtaggggaagacagaaagtggatgatggcgaggaagctgatgcaggtgaacgacactctgacttccgaagatgccggactccggaacagcaagaactgcaccgaaccagccctgcatgaattccccaatgacatcttcacaaacgaggatagaagacaaggtgcggtggtcctccatgtgctctgtgccatatacatgttctatgcgctggccattgtgtgtgatgacttcttcgtcccttccttggaaaagatctgtgagcgcctgcacctcagtgaagatgtggctggggccacattcatggcagcgggaagttcagccccagagctgttcacatcggtcataggggtcttcatcaccaaaggcgatgtgggagttggcaccatcgtgggctcagcggtattcaacatcctgtgcatcattggtgtctgtgggctctttgctgggcaggttgtggctctttcctcctggtgcctgctgagggattctatttactacacgctgtctgtgatcgcgctcatcgtgtttatttatgatgaaaaagtttcctggtgggagtctttagtccttgtgctgatgtatcttatctacattgtcatcatgaaatataacgcttgcatacatcagtgctttgagaggaggacaaaaggtgccgggaacatggtcaacggattggccaacaatgctgaaattgatgacagcagcaactgcgacgcaactgtggtgctacttaagaaagcaaatttccaccgcaaagcatcagtgatcatggtagacgagctgctgtcagcctacccacaccagctttccttctctgaggctggccttcgaatcatgataaccagccactttccccccaagacccggctctccatggccagtcgcatgttgatcaatgagagacaaagattgataaacagcagggcttataccaacggggaatctgaggtggccatcaaaatcccaattaagcacaccgtggagaatgggacagggcccagcagtgccccagacaggggcgtgaatgggacacggagggacgatgttgtggctgaggctggcaacgaaacagagaatgaaaatgaggacaatgagaatgatgaggaggaagaggaggacgaggatgatgatgaaggaccgtacacaccattcgacaccccctcgggtaaactggaaacagtgaaatgggcgttcacctggccgctgagtttcgtcttatacttcactgtacccaactgcaacaagccgcgctgggagaaatggttcatggtgacgtttgcttcctccacgctgtggatcgcagccttctcctacatgatggtgtggatggtcacaatcattggttacaccctggggattcctgacgtcatcatggggatcaccttcctggctgctgggaccagcgtgcctgactgcatggccagcctcattgtggccagacaagggatgggggacatggctgtgtccaactccattgggagcaacgtgtttgacatcctgattggcctcggtctcccctgggctctgcagaccctggctgtggattacggatcctacatccggctgaatagcagggggctgatctactccgtaggcttgctcctggcctctgtttttgtcacggtgttcggcgtccacctgaacaagtggcagctggacaagaagctgggctgtgggtgcctcctcctgtatggtgtgttcctgtgcttctccatcatgactgagttcaacgtgttcacctttgtgaacctgcccatgtgcggggaccactgagccgccgggtgcccacagaggctcagctccttcttttctgtgcaatacgagacccggccgcaccccgagtcacacaggcccccggggccacggcgttcgtctctcctgtgctgtcctcaggcctccgctcctgttttggtggcccaggctctcccctgncccatcctcgctcccccacctccttgggtcatgcccacccaccctttcctgcctcctccgtgtgaagacatccaacatccacgtgacttttccagctccatttttgaacagtgactgagattctagaaaaactggctgctaactggcctgagccaggcaacactgattccaatccctcctccttttttaagttatttgatggaagactcacctaatttgtgacctgaaactgttgaagaaatagagaggagggggcccgttgattacagagagcatttgggattttgtttggtttggagatgatgcctaggttactgggtttggggggattgttttcttttgggggccttccccttttactccttttcttccagagatcaagagcttctcttgcatcttcttccactgggctctggattaatcaattacccaaaggctgcacctgccgtgttgtctgggcttgcatcccagatgtgttggagtatgcatggatgtagtgctttttagaggagccactgggcaaggccaccaagaacaaatgcatgacattttatagccaaggacgcctcgctaaagtcttatgggcgtcccctggggttgggggggcacaaggttttggaggaagaagacaacttccctcattccatcatcaccatctctttctcactaggttctttctagttttcaagcaatagttctagcctgccttggacaagggggccccagttaaacaaactacccatccatgaggtgccaggcagtcaaaaacagaagcttccccgacttgtgagtccctgagatgtgctcttgttgtttggcatttggggtgacagggagtgacccagaggccaccactgcttttcatgcaggagttacagacactggtttcttggaaaatggagagaagcgcactttgcacagacgtcgtcaattaagtcccaatttgccacttggtattgagtacactggaccctgaccactggctcttgggcaaacgtccttcctcacggggcgcctccgccaagccggcccagctgcacccctcccttcctggagggatggccagggaaggagaaaacagagaactgacacctttgaaaccacagaatgtgttacatgcagactcgctcaagggcataagttattgtgaacgtttttgccaatcactgctcaacagccctgctagattttgtatgatgctgaattattatgcagactaattccacccagttgagacacaccatgcttgttcacttgtatttattgaaactgtggattcttgcccgtgctgtcccttgtatttactttaagcactgatcacttatcattcattcggtatggttttccctgtcccttgtacacattctggtatgaatttgtaaaaataacctgctacaaattggttgaatgtttctgtctgtggtgcgaaccagcattaacggatggggcacgtgcccaactgaggaacaggagaagaaatcaccaatttgggctctcagagctaagacacacttattgattctgttgcacattttgcactggtttatggcgattgttttcttggacggatagtgtaaaataaacttctctgttctctatccttcccagagcagagtgcattactttctcccctggaaagctgt

SEQ ID NO: 277698 - DNA, 3889 bp, Homo sapiens
  misc_feature (2291)..(2291): n is a, c, g, or t
gcgacgaggagggcgacgacgaggagacgggcagcggcgaggaggaggaagaggaggcggaggcggcggccgggtgggagcgcagcgaggacgcgcggctgctgcgcgcagggctgcctcctgccgctgtccccgccgcggccgcccgcgacaggagcggccgccgcccgccgaggccgccgcccggccgcccgaggatgcggccgtccggcgacgaggaccgcgcgcgtcgccgccgccgccgccgccgccggagggaccttctgctgagccagctctgcttcctggcctcggtggcgctgctgctctggtcgctgtcgagcctgcgagagcagaaggagcttgacctcatggacctcgtaggggaagacagaaagtggatgatggcgaggaagctgatgcaggtgaacgacactctgacttccgaagatgccggactccggaacagcaagaactgcaccgaaccagccctgcatgaattccccaatgacatcttcacaaacgaggatagaagacaaggtgcggtggtcctccatgtgctctgtgccatatacatgttctatgcgctggccattgtgtgtgatgacttcttcgtcccttccttggaaaagatctgtgagcgcctgcacctcagtgaagatgtggctggggccacattcatggcagcgggaagttcagccccagagctgttcacatcggtcataggggtcttcatcaccaaaggcgatgtgggagttggcaccatcgtgggctcagcggtattcaacatcctgtgcatcattggtgtctgtgggctctttgctgggcaggttgtggctctttcctcctggtgcctgctgagggattctatttactacacgctgtctgtgatcgcgctcatcgtgtttatttatgatgaaaaagtttcctggtgggagtctttagtccttgtgctgatgtatcttatctacattgtcatcatgaaatataacgcttgcatacatcagtgctttgagaggaggacaaaaggtgccgggaacatggtcaacggattggccaacaatgctgaaattgatgacagcagcaactgcgacgcaactgtggtgctacttaagaaagcaaatttccaccgcaaagcatcagtgatcatggtagacgagctgctgtcagcctacccacaccagctttccttctctgaggctggccttcgaatcatgataaccagccactttccccccaagacccggctctccatggccagtcgcatgttgatcaatgagagacaaagattgataaacagcagggcttataccaacggggaatctgaggtggccatcaaaatcccaattaagcacaccgtggagaatgggacagggcccagcagtgccccagacaggggcgtgaatgggacacggagggacgatgttgtggctgaggctggcaacgaaacagagaatgaaaatgaggacaatgagaatgatgaggaggaagaggaggacgaggatgatgatgaaggaccgtacacaccattcgacaccccctcgggtaaactggaaacagtgaaatgggcgttcacctggccgctgagtttcgtcttatacttcactgtacccaactgcaacaagccgcgctgggagaaatggttcatggtgacgtttgcttcctccacgctgtggatcgcagccttctcctacatgatggtgtggatggtcacaatcattggttacaccctggggattcctgacgtcatcatggggatcaccttcctggctgctgggaccagcgtgcctgactgcatggccagcctcattgtggccagacaagggatgggggacatggctgtgtccaactccattgggagcaacgtgtttgacatcctgattggcctcggtctcccctgggctctgcagaccctggctgtggattacggatcctacatccggctgaatagcagggggctgatctactccgtaggcttgctcctggcctctgtttttgtcacggtgttcggcgtccacctgaacaagtggcagctggacaagaagctgggctgtgggtgcctcctcctgtatggtgtgttcctgtgcttctccatcatgactgagttcaacgtgttcacctttgtgaacctgcccatgtgcggggaccactgagccgccgggtgcccacagaggctcagctccttcttttctgtgcaatacgagacccggccgcaccccgagtcacacaggcccccggggccacggcgttcgtctctcctgtgctgtcctcaggcctccgctcctgttttggtggcccaggctctcccctgncccatcctcgctcccccacctccttgggtcatgcccacccaccctttcctgcctcctccgtgtgaagacatccaacatccacgtgacttttccagctccatttttgaacagtgactgagattctagaaaaactggctgctaactggcctgagccaggcaacactgattccaatccctcctccttttttaagttatttgatggaagactcacctaatttgtgacctgaaactgttgaagaaatagagaggagggggcccgttgattacagagagcatttgggattttgtttggtttggagatgatgcctaggttactgggtttggggggattgttttcttttgggggccttccccttttactccttttcttccagagatcaagagcttctcttgcatcttcttccactgggctctggattaatcaattacccaaaggctgcacctgccgtgttgtctgggcttgcatcccagatgtgttggagtatgcatggatgtagtgctttttagaggagccactgggcaaggccaccaagaacaaatgcatgacattttatagccaaggacgcctcgctaaagtcttatgggcgtcccctggggttgggggggcacaaggttttggaggaagaagacaacttccctcattccatcatcaccatctctttctcactaggttctttctagttttcaagcaatagttctagcctgccttggacaagggggccccagttaaacaaactacccatccatgaggtgccaggcagtcaaaaacagaagcttccccgacttgtgagtccctgagatgtgctcttgttgtttggcatttggggtgacagggagtgacccagaggccaccactgcttttcatgcaggagttacagacactggtttcttggaaaatggagagaagcgcactttgcacagacgtcgtcaattaagtcccaatttgccacttggtattgagtacactggaccctgaccactggctcttgggcaaacgtccttcctcacggggcgcctccgccaagccggcccagctgcacccctcccttcctggagggatggccagggaaggagaaaacagagaactgacacctttgaaaccacagaatgtgttacatgcagactcgctcaagggcataagttattgtgaacgtttttgccaatcactgctcaacagccctgctagattttgtatgatgctgaattattatgcagactaattccacccagttgagacacaccatgcttgttcacttgtatttattgaaactgtggattcttgcccgtgctgtcccttgtatttactttaagcactgatcacttatcattcattcggtatggttttccctgtcccttgtacacattctggtatgaatttgtaaaaataacctgctacaaattggttgaatgtttctgtctgtggtgcgaaccagcattaacggatggggcacgtgcccaactgaggaacaggagaagaaatcaccaatttgggctctcagagctaagacacacttattgattctgttgcacattttgcactggtttatggcgattgttttcttggacggatagtgtaaaataaacttctctgttctcta

SEQ ID NO: 277699 - DNA, 588 bp, Homo sapiens
gcgacgaggagggcgacgacgaggagacgggcagcggcgaggaggaggaagaggaggcggaggcggcggccgggtgggagcgcagcgaggacgcgcggctgctgcgcgcagggctgcctcctgccgctgtccccgccgcggccgcccgcgacaggagcggccgccgcccgccgaggccgccgcccggccgcccgaggatgcggccgtccggcgacgaggaccgcgcgcgtcgccgccgccgccgccgccgccggagggaccttctgctgagccagctctgcttcctggcctcggtggcgctgctgctctggtcgctgtcgagcctgcgagagcagaaggctgtgcccgcctgtgcgctgcttactcgcgagctggaggtactgctggtggcggtggtggggagtcttactctccatcagcccccaaggccagggataaagttgtggtggtagacccggcacctgtgcaggtgaccacctgtatactccttggcttgctgaaggattcaaggggactgcttaacacacagttgtccgtatgttctccatccagagagcaggcgggatggcccgagtagagagctcttca

SEQ ID NO: 277700 - DNA, 3136 bp, Homo sapiens
  misc_feature (1538)..(1538): n is a, c, g, or t
ccttttggggctttgctcttttggggtctttgctttttggggtctttgctgggcaggttgtggctctttcctcctggtgcctgctgagggattctatttactacacgctgtctgtgatcgcgctcatcgtgtttatttatgatgaaaaagtttcctggtgggagtctttagtccttgtgctgatgtatcttatctacattgtcatcatgaaatataacgcttgcatacatcagtgctttgagaggaggacaaaaggtgccgggaacatggtcaacggattggccaacaatgctgaaattgatgacagcagcaactgcgacgcaactgtggtgctacttaagaaagcaaatttccaccgcaaagcatcagtgatcatggtagacgagctgctgtcagcctacccacaccagctttccttctctgaggctggccttcgaatcatgataaccagccactttccccccaagacccggctctccatggccagtcgcatgttgatcaatgagagacaaagattgataaacagcagggcttataccaacggggaatctgaggtggccatcaaaatcccaattaagcacaccgtggagaatgggacagggcccagcagtgccccagacaggggcgtgaatgggacacggagggacgatgttgtggctgaggctggcaacgaaacagagaatgaaaatgaggacaatgagaatgatgaggaggaagaggaggacgaggatgatgatgaaggaccgtacacaccattcgacaccccctcgggtaaactggaaacagtgaaatgggcgttcacctggccgctgagtttcgtcttatacttcactgtacccaactgcaacaagccgcgctgggagaaatggttcatggtgacgtttgcttcctccacgctgtggatcgcagccttctcctacatgatggtgtggatggtcacaatcattggttacaccctggggattcctgacgtcatcatggggatcaccttcctggctgctgggaccagcgtgcctgactgcatggccagcctcattgtggccagacaagggatgggggacatggctgtgtccaactccattgggagcaacgtgtttgacatcctgattggcctcggtctcccctgggctctgcagaccctggctgtggattacggatcctacatccggctgaatagcagggggctgatctactccgtaggcttgctcctggcctctgtttttgtcacggtgttcggcgtccacctgaacaagtggcagctggacaagaagctgggctgtgggtgcctcctcctgtatggtgtgttcctgtgcttctccatcatgactgagttcaacgtgttcacctttgtgaacctgcccatgtgcggggaccactgagccgccgggtgcccacagaggctcagctccttcttttctgtgcaatacgagacccggccgcaccccgagtcacacaggcccccggggccacggcgttcgtctctcctgtgctgtcctcaggcctccgctcctgttttggtggcccaggctctcccctgncccatcctcgctcccccacctccttgggtcatgcccacccaccctttcctgcctcctccgtgtgaagacatccaacatccacgtgacttttccagctccatttttgaacagtgactgagattctagaaaaactggctgctaactggcctgagccaggcaacactgattccaatccctcctccttttttaagttatttgatggaagactcacctaatttgtgacctgaaactgttgaagaaatagagaggagggggcccgttgattacagagagcatttgggattttgtttggtttggagatgatgcctaggttactgggtttggggggattgttttcttttgggggccttccccttttactccttttcttccagagatcaagagcttctcttgcatcttcttccactgggctctggattaatcaattacccaaaggctgcacctgccgtgttgtctgggcttgcatcccagatgtgttggagtatgcatggatgtagtgctttttagaggagccactgggcaaggccaccaagaacaaatgcatgacattttatagccaaggacgcctcgctaaagtcttatgggcgtcccctggggttgggggggcacaaggttttggaggaagaagacaacttccctcattccatcatcaccatctctttctcactaggttctttctagttttcaagcaatagttctagcctgccttggacaagggggccccagttaaacaaactacccatccatgaggtgccaggcagtcaaaaacagaagcttccccgacttgtgagtccctgagatgtgctcttgttgtttggcatttggggtgacagggagtgacccagaggccaccactgcttttcatgcaggagttacagacactggtttcttggaaaatggagagaagcgcactttgcacagacgtcgtcaattaagtcccaatttgccacttggtattgagtacactggaccctgaccactggctcttgggcaaacgtccttcctcacggggcgcctccgccaagccggcccagctgcacccctcccttcctggagggatggccagggaaggagaaaacagagaactgacacctttgaaaccacagaatgtgttacatgcagactcgctcaagggcataagttattgtgaacgtttttgccaatcactgctcaacagccctgctagattttgtatgatgctgaattattatgcagactaattccacccagttgagacacaccatgcttgttcacttgtatttattgaaactgtggattcttgcccgtgctgtcccttgtatttactttaagcactgatcacttatcattcattcggtatggttttccctgtcccttgtacacattctggtatgaatttgtaaaaataacctgctacaaattggttgaatgtttctgtctgtggtgcgaaccagcattaacggatggggcacgtgcccaactgaggaacaggagaagaaatcaccaatttgggctctcagagctaagacacacttattgattctgttgcacattttgcactggtttatggcgattgttttcttggacggatagtgtaaaataaacttctctgttctcta

SEQ ID NO: 277701 - DNA, 1951 bp, Homo sapiens
cccccagtcccgggcccggagccagcgcatgcgcccgcctgtgggcgctgtcccggctgcgagggccgtgagctcacggaccgacggaccgacgggcggccggccggacagacggggcagcgcagggagcggggacgcggcgggacagcgacatggccggccacacgcagcagccgagcgggcgcgggaaccccaggcctgcgccctcgccctccccagtcccagggaccgtccccggcgcctcggagcgggtggcgctcaagaaggagatcgggctgctgagcgcctgcaccatcatcatcgggaacatcatcggctcgggcatcttcatctcgcccaagggggtcctggagcactcaggctccgtgggtctggccctgttcgtctgggtcctgggtgggggcgtgacggctctgggctccctctgctatgcagagctgggagtcgccatccccaagtctggcggggactacgcctacgtcacagagatcttcgggggcctggctggctttctgctgctctggagcgccgtcctcatcatgtaccccaccagccttgctgtcatctccatgaccttctccaactacgtgctgcagcccgtgttccccaactgcatcccccccaccacagcctcccgggtgctgtccatggcctgcctgatgctcctgacatgggtgaacagctccagtgtgcgctgggccacgcgcatccaggacatgttcacaggcgggaagctgctggccttgtccctcatcatcggcgtgggccttctccagatcttccaaggacacttcgaggagctgaggcccagcaatgcctttgctttctggatgacgccctccgtgggacacctggccctggccttcctccagggctccttcgccttcagtggctggaacttcctcaactatgtcaccgaggagatggttgacgcccgaaagaacctacctcgcgccatcttcatctccatcccactggtgaccttcgtgtacacgttcaccaacattgcctacttcacggccatgtccccccaggagctgctctcctccaatgcggtggctgtgaccttcggggagaagctgctgggctacttttcttgggtcatgcctgtctccgtggctctgtcaaccttcggagggatcaatggttacctgttcacctactccaggctgtgcttctctggagcccgcgaggggcacctgcccagcctgctggccatgatccacgtcagacactgcacccccatccccgccctcctcgtctgttgcggggccacagccgtcatcatgctcgtgggcgacacgtacacgctcatcaactatgtgtccttcatcaactacctctgctacggcgtcaccatcctgggcctgctgctgctgcgctggaggcggcctgcactccacaggcccatcaaggtgaaccttctcatccccgtggcgtacttggtcttctgggccttcctgctggtcttcagcttcatctcagagcctatggtctgtggggtcggcgtcatcatcatccttacgggggtgcccattttctttctgggagtgttctggagaagcaaaccaaagtgtgtgcacagactcacagagtccatgacacactggggccaggagctgtgtttcgtggtctacccccaggacgcccccgaagaggaggagaatggcccctgcccaccctccctgctgcctgccacagacaagccctcgaagccacaatgagatttttgtagagactgaagcagttgtttctgtttacatgttgtttattgaggaggtgttttggcaaaaaagttttgttttgtttttttctggaaaaaaaagaaaaaagatacgactctcagaagcctgttttaaggaagccctaaaatgtggactgggtttcctgtcttagcactgccctgctagctcttcctgaaaaggcctataaataaacagggctggctgtt

SEQ ID NO: 277702 - DNA, 2070 bp, Homo sapiens
  misc_feature (2)..(2): n is a, c, g, or t
  misc_feature (5)..(5): n is a, c, g, or t
  misc_feature (8)..(8): n is a, c, g, or t
  misc_feature (12)..(12): n is a, c, g, or t
  misc_feature (359)..(359): n is a, c, g, or t
cnggntcnctgngtctcgggcagcaatgctgccccctttcctgccccaacatccccagcagacacaagagatggagactatgagctgctctcgtggctgggtctcgggggtcctgcaccctcaggagctgacgctgacgcactccactgcctgtcaccaggaacctacctcgcgccatcttcatctccatcccactggtgaccttcgtgtacacgttcaccaacattgcctacttcacggccatgtccccccaggagctgctctcctccaatgcggtggctgtggtgagtgggcccctgctcggtccctggctcctgcccaggcccctgccccggccttacacatggcctctctactgngcccacccagaccttcggggagaagctgctgggctacttttcttgggtcatgcctgtctccgtggctctgtcaaccttcggagggatcaatggttacctgttcacctactccaggtgactgcactggggagacgtgggcatggggagggaaggctggggtgcaggtgtgcaccagtcatgccgtgggccagaggaagggacacctgccgggggaggggtctgcctgaagctgggatgatgatcccacacggtaacaagtgtctgatcacaactgggaggcaaagaaagcaagaggcaggcaggctggatgagggggagaactgtccagtggggctgctgggcccggagcaggaggtcagaggcgacagcttaagagggacatcaggtccaaagctgagacccaggatgtggccagtgcccatatctgtccccaacgctaggctgtgcttctctggagcccgcgaggggcacctgcccagcctgctggccatgatccacgtcagacactgcacccccatccccgccctcctcgtctgttgcggggccacagccgtcatcatgctcgtgggcgacacgtacacgctcatcaactatgtgtccttcatcaactacctctgctacggcgtcaccatcctgggcctgctgctgctgcgctggaggcggcctgcactccacaggcccatcaaggtgaaccttctcatccccgtggcgtacttggtcttctgggccttcctgctggtcttcagcttcatctcagagcctatggtctgtggggtcggcgtcatcatcatccttacgggggtgcccattttctttctgggagtgttctggagaagcaaaccaaagtgtgtgcacagactcacagagtccatgacacactggggccaggagctgtgtttcgtggtctacccccaggacgcccccgaagaggaggagaatggcccctgcccaccctccctgctgcctgccacagacaagccctcgaagccacaatgagatttttgtagagactgaagcagttgtttctgtttacatgttgtttattgaggaggtgttttggcaaaaaagttttgttttgtttttttctggaaaaaaaagaaaaaagatacgactctcagaagcctgttttaaggaagccctaaaatgtggactgggtttcctgtcttagcactgccctgctagctcttcctgaaaaggcctataaataaacagggctggctgttcgctcgtgctatggggagtccctgatgggcacagacgggagtggctggggcgtacctcggtgggtgcacacatgttgctggccaggaagatgccgtggcaggccctggaggaggctcttgacattagggggctttgctgcttgacacaggcgctccctaccatggcacccagagtccccctgccctaaagggatgtcgaggatggggtagcagctcagtccgcccctaccccaggcccctcgatgccagtctgagctcggccacccaggagagctcaggggctccaggctgggattgtctttcttcccgtaaatcaccacagagtgaaggtcaggacttcagagcccacagtctcaccctggcttacaggtggggaaaccgaggccctgagataggatggaacagacgtggccactgctgttggtgcctcggcctctctgtccccagaaagcacagagcagcatgtcctgggggctttgaggcctgca

SEQ ID NO: 277703 - DNA, 2234 bp, Homo sapiens
cccccagtcccgggcccggagccagcgcatgcgcccgcctgtgggcgctgtcccggctgcgagggccgtgagctcacggaccgacggaccgacgggcggccggccggacagacggggcagcgcagggagcggggacgcggcgggacagcgacatggccggccacacgcagcagccgagcgggcgcgggaaccccaggcctgcgccctcgccctccccagtcccagggaccgtccccggcgcctcggagcgggtggcgctcaagaaggagatcgggctgctgagcgcctgcaccatcatcatcgctttctgctgctctggagcgccgtcctcatcatgtaccccaccagccttgctgtcatctccatgaccttctccaactacgtgctgcagcccgtgttccccaactgcatcccccccaccacagcctcccgggtgctgtccatggcctgcctgatgctcctgacatgggtgaacagctccagtgtgcgctgggccacgcgcatccaggacatgttcacaggcgggaagctgctggccttgtccctcatcatcggcgtgggccttctccagatcttccaaggacacttcgaggagctgaggcccagcaatgcctttgctttctggatgacgccctccgtgggacacctggccctggccttcctccagggctccttcgccttcagtggctggaacttcctcaactatgtcaccgaggagatggttgacgcccgaaagaacctacctcgcgccatcttcatctccatcccactggtgaccttcgtgtacacgttcaccaacattgcctacttcacggccatgtccccccaggagctgctctcctccaatgcggtggctgtgaccttcggggagaagctgctgggctacttttcttgggtcatgcctgtctccgtggctctgtcaaccttcggagggatcaatggttacctgttcacctactccaggctgtgcttctctggagcccgcgaggggcacctgcccagcctgctggccatgatccacgtcagacactgcacccccatccccgccctcctcgtctgttgcggggccacagccgtcatcatgctcgtgggcgacacgtacacgctcatcaactatgtgtccttcatcaactacctctgctacggcgtcaccatcctgggcctgctgctgctgcgctggaggcggcctgcactccacaggcccatcaaggtgaaccttctcatccccgtggcgtacttggtcttctgggccttcctgctggtcttcagcttcatctcagagcctatggtctgtggggtcggcgtcatcatcatccttacgggggtgcccattttctttctgggagtgttctggagaagcaaaccaaagtgtgtgcacagactcacagagtccatgacacactggggccaggagctgtgtttcgtggtctacccccaggacgcccccgaagaggaggagaatggcccctgcccaccctccctgctgcctgccacagacaagccctcgaagccacaatgagatttttgtagagactgaagcagttgtttctgtttacatgttgtttattgaggaggtgttttggcaaaaaagttttgttttgtttttttctggaaaaaaaagaaaaaagatacgactctcagaagcctgttttaaggaagccctaaaatgtggactgggtttcctgtcttagcactgccctgctagctcttcctgaaaaggcctataaataaacagggctggctgttcgctcgtgctatggggagtccctgatgggcacagacgggagtggctggggcgtacctcggtgggtgcacacatgttgctggccaggaagatgccgtggcaggccctggaggaggctcttgacattagggggctttgctgcttgacacaggcgctccctaccatggcacccagagtccccctgccctaaagggatgtcgaggatggggtagcagctcagtccgcccctaccccaggcccctcgatgccagtctgagctcggccacccaggagagctcaggggctccaggctgggattgtctttcttcccgtaaatcaccacagagtgaaggtcaggacttcagagcccacagtctcaccctggcttacaggtggggaaaccgaggccctgagataggatggaacagacgtggccactgctgttggtgcctcggcctctctgtccccagaaagcacagagcagcatgtcctgggggctttgaggcctgca

SEQ ID NO: 277704 - DNA, 430 bp, Homo sapiens
cgttgactgcagcaatgcgctatgagccagccaactctcatttcttcaaaacagagattcagtatgagaagttggcagatgctgttcgatttcttggctgcttctcagacctaagaaaaataagcgccatgaatgtcttcccctcaaatacacagccatttcaaagacttttagaggaagatgtaatctcaatagaatcagtgtcacccacgttacggcactgcagtaaactttttatttatctttacaaagtagccacagattcttttgacagtcgtgcagaacagatccctccttgcctgacaagtgagtcttctctcccctctccttggggtacaccagctttgtccaggaaaaggcatgcatatcattctgtttcaactccccctgtttaccctcctaaaaatgttgccgacctgaaactacatgt

SEQ ID NO: 277705 - DNA, 416 bp, Homo sapiens
ttgtagagacagggtcttgccatgttgcccatgctggtctccaactcctgggctcaagtgatcctcccacctcagtctccaaaacaaaatgctgggattacaggtgtgagccaccatgcccagcctcccatgttgtcttgttcactgtcatattctgaatgactcactcatattagaaacaagcactcaataaacaaacaagtaaatcttgacagaagaaaagttcttccttgcagacttttgctaatgaaagtcctgataaagaagatactaaatagcaacctctgagtgctaaatactgactggtaagaacagaaagagaaaattaaatactagaatataaccacatttataattacataattggaaaagaataaccatgctatcaactaagggaatatgactcaccatcatat

SEQ ID NO: 277706 - DNA, 954 bp, Homo sapiens
  misc_feature (949)..(949): n is a, c, g, or t
ttttcactgctgctcatgacgtgtgccagtaccgaacacgcactgcgctatcatgcccagtgatgccatctcccacactgctgcccgtgctcgcactgagagagagctgcacagtcactggccggcagactgggcctccctctgatcgatgaggtggtgagcccagagcccgagcccctcaacacgtctgacttctctgactggtctagttttaatgccagcagtacccctggaccagaggaggtagacagcgcctctgctgccccagccttctacagccaggccccccggcccccagcttccccaggccggcccgagcagcacacagtgatccacatgggcaatcctgagcccttgactcacgcccctaggaaggtgtatgatacgcgggatgatgaccggacaccaggcctccatggagactgtgacgatgacaagtaccgacgtcggccggccttgggttggctggcccggctgctaaggagccgggctgggtctcggaagcggccgctgaccctgctccagcgggcggggctgctgctactcttgggactgctgggcttcctggccctccttgccctcatgtctcgcctaggccgggccgcagctgacagcgatcccaacctggacccactcatgaaccctcacatccgcgtgggcccctcctgagcccccttgcttgtggctaggccagcctaggatgtgggttctgtggaggagaggcggggtaatggggaggctgagggcacctcttcactgcccctctccctcaagcctaagacactaagaccccagacccaaagccaagtccaccagagtggctgcaggccaggcctggagtccccgtgggtcaagcatttgtcttgacttgctttcctcccgggtctccagcctccgacccctcgccccatgaaggagctggcaggtggaaataaacaacaactttatnaaaaa

SEQ ID NO: 277707 - DNA, 548 bp, Homo sapiens
cgtcttcacctctagcggcagcggaggcgtggcccaggggcgcgatggcgtcatcagcgcgcgccgcacccggaagagacgtggcagcggagggataatcggggcggccggggctgaagggagaggcgcaggagccctggggagagtggtccctgcccttccgcgcctcgagccatcgctaccgcccttcggaaccagtgcagcggccgatcagtaaacacagagactggggatcgatcatggggctttgtaagtgccccaagagaaaggtgaccaacctgttctgcttcgaacatcgggtcaacgtctgcgagcactgcctggtagccaatcacgccaaggtggggccttcaggggagcgactgagcagggcactgggtgggcaaggcggtattggcttcctccaaatccatgaggggccccgcgctagaatgtaagccccacaagggcaaggacttgatttattttgttcactgatatatcccccgtccccaagagagagtctggtgcacagtatgtgctcaataaatatttattgattaaacaaa

SEQ ID NO: 277708 - DNA, 601 bp, Homo sapiens
cgtcttcacctctagcggcagcggaggcgtggcccaggggcgcgatggcgtcatcagcgcgcgccgcacccggaagagacgtggcagcggagggataatcggggcggccggggctgaagggagaggcgcaggagccctggggagagtggtccctgcccttccgcgcctcgagccatcgctaccgcccttcggaaccagtgcagcggccgatcagtaaacacagagactggggatcgatcatggggctttgtaagtgccccaagagaaaggtgaccaacctgttctgcttcgaacatcgggtcaacgtctgcgagcactgcctggtagccaatcacgccaaggtggggccttcaggggagcgactgagcagggcactgggtgggcaaggcggtattggcttcctccaaatccatgaggggccccgcgctagaatgtaagccccacaagggcaaggacttgatttattttgttcactgatatatcccccgtccccaagagagagtctggtgcacagtatgtgctcaataaatatttattgattaaacaaaaacaacacacaaaaacaccaggacacaaccaaacaaggagaagcaaagaaccg

SEQ ID NO: 277709 - DNA, 1398 bp, Homo sapiens
  misc_feature (1393)..(1393): n is a, c, g, or t
gggatttatgcagggggtgtttctccgcataaggagggacagtgggcaggaatctgagatcggggcgaatatgagaggtgtctgggggagttaagagtggaaactgggctggtgagagcgtagtggtggccaccagaacctgacttcctaccaactcatgcccctttcccaggatcgatcatggggctttgtaagtgccccaagagaaaggtgaccaacctgttctgcttcgaacatcgggtcaacgtctgcgagcactgcctggtagccaatcacgccaagtgcatcgtccagtcctacctgcaatggctccaagatagcgactacaaccccaattgccgcctgtgcaacatacccctggccagccgagagacgacccgccttgtctgctatgatctctttcactgggcctgcctcaatgaacgtgctgcccagctaccccgaaacacggcacctgccggctatcagtgccccagctgcaatggccccatcttccccccaaccaacctggctggccccgtggcctccgcactgagagagaagctggccacagtcaactgggcccgggcaggactgggcctccctctgatcgatgaggtggtgagcccagagcccgagcccctcaacacgtctgacttctctgactggtctagttttaatgccagcagtacccctggaccagaggaggtagacagcgcctctgctgccccagccttctacagccaggccccccggcccccagcttccccaggccggcccgagcagcacacagtgatccacatgggcaatcctgagcccttgactcacgcccctaggaaggtgtatgatacgcgggatgatgaccggacaccaggcctccatggagactgtgacgatgacaagtaccgacgtcggccggccttgggttggctggcccggctgctaaggagccgggctgggtctcggaagcggccgctgaccctgctccagcgggcggggctgctgctactcttgggactgctgggcttcctggccctccttgccctcatgtctcgcctaggccgggccgcagctgacagcgatcccaacctggacccactcatgaaccctcacatccgcgtgggcccctcctgagcccccttgcttgtggctaggccagcctaggatgtgggttctgtggaggagaggcggggtaatggggaggctgagggcacctcttcactgcccctctccctcaagcctaagacactaagaccccagacccaaagccaagtccaccagagtggctgcaggccaggcctggagtccccgtgggtcaagcatttgtcttgacttgctttcctcccgggtctccagcctccgacccctcgccccatgaaggagctggcaggtggaaataaacaacaactttatnaaaaa

SEQ ID NO: 277710 - DNA, 1439 bp, Homo sapiens
  misc_feature (1434)..(1434): n is a, c, g, or t
cgtcttcacctctagcggcagcggaggcgtggcccaggggcgcgatggcgtcatcagcgcgcgccgcacccggaagagacgtggcagcggagggataatcggggcggccggggctgaagggagaggcgcaggagccctggggagagtggtccctgcccttccgcgcctcgagccatcgctaccgcccttcggaaccagtgcagcggccgatcagtaaacacagagactggggatcgatcatggggctttgtaagtgccccaagagaaaggtgaccaacctgttctgcttcgaacatcgggtcaacgtctgcgagcactgcctgtgcatcgtccagtcctacctgcaatggctccaagatagcgactacaaccccaattgccgcctgtgcaacatacccctggccagccgagagacgacccgccttgtctgctatgatctctttcactgggcctgcctcaatgaacgtgctgcccagctaccccgaaacacggcacctgccggctatcagtgccccagctgcaatggccccatcttccccccaaccaacctggctggccccgtggcctccgcactgagagagaagctggccacagtcaactgggcccgggcaggactgggcctccctctgatcgatgaggtggtgagcccagagcccgagcccctcaacacgtctgacttctctgactggtctagttttaatgccagcagtacccctggaccagaggaggtagacagcgcctctgctgccccagccttctacagccaggccccccggcccccagcttccccaggccggcccgagcagcacacagtgatccacatgggcaatcctgagcccttgactcacgcccctaggaaggtgtatgatacgcgggatgatgaccggacaccaggcctccatggagactgtgacgatgacaagtaccgacgtcggccggccttgggttggctggcccggctgctaaggagccgggctgggtctcggaagcggccgctgaccctgctccagcgggcggggctgctgctactcttgggactgctgggcttcctggccctccttgccctcatgtctcgcctaggccgggccgcagctgacagcgatcccaacctggacccactcatgaaccctcacatccgcgtgggcccctcctgagcccccttgcttgtggctaggccagcctaggatgtgggttctgtggaggagaggcggggtaatggggaggctgagggcacctcttcactgcccctctccctcaagcctaagacactaagaccccagacccaaagccaagtccaccagagtggctgcaggccaggcctggagtccccgtgggtcaagcatttgtcttgacttgctttcctcccgggtctccagcctccgacccctcgccccatgaaggagctggcaggtggaaataaacaacaactttatnaaaaa

SEQ ID NO: 277711 - DNA, 1421 bp, Homo sapiens
  misc_feature (1416)..(1416): n is a, c, g, or t
cgtcttcacctctagcggcagcggaggcgtggcccaggggcgcgatggcgtcatcagcgcgcgccgcacccggaagagacgtggcagcggagggataatcggggcggccggggctgaagggagaggcgcaggagccctggggagagtggtccctgcccttccgcgcctcgagccatcgctaccgcccttcggaaccagtgcagcggccgatcagtaaacacagagactggggatcgatcatggggctttgtaagtgccccaagagaaaggtgaccaacctgttctgcttcgaacatcgggtcaacgtctgcgagcactgcctggtagccaatcacgccaagtgcatcgtccagtcctacctgcaatggctccaagatagcgactacaaccccaattgccgcctgtgcaacatacccctggccagccgagagacgacccgccttgtctgctatggtgaggccttggcacctcggggggatcaggccagcctcaggggccagcttggtgactggtttccaggccctcctcaagcagcaggacagtgagtcccccgagtctcagagcccagattctagtcctgttaaagttccttacctgctgtgtaagttcagatcgatgaggtggtgagcccagagcccgagcccctcaacacgtctgacttctctgactggtctagttttaatgccagcagtacccctggaccagaggaggtagacagcgcctctgctgccccagccttctacagccaggccccccggcccccagcttccccaggccggcccgagcagcacacagtgatccacatgggcaatcctgagcccttgactcacgcccctaggaaggtgtatgatacgcgggatgatgaccggacaccaggcctccatggagactgtgacgatgacaagtaccgacgtcggccggccttgggttggctggcccggctgctaaggagccgggctgggtctcggaagcggccgctgaccctgctccagcgggcggggctgctgctactcttgggactgctgggcttcctggccctccttgccctcatgtctcgcctaggccgggccgcagctgacagcgatcccaacctggacccactcatgaaccctcacatccgcgtgggcccctcctgagcccccttgcttgtggctaggccagcctaggatgtgggttctgtggaggagaggcggggtaatggggaggctgagggcacctcttcactgcccctctccctcaagcctaagacactaagaccccagacccaaagccaagtccaccagagtggctgcaggccaggcctggagtccccgtgggtcaagcatttgtcttgacttgctttcctcccgggtctccagcctccgacccctcgccccatgaaggagctggcaggtggaaataaacaacaactttatnaaaaa

SEQ ID NO: 277712 - DNA, 306 bp, Homo sapiens
aactcaggctctttgaggccccttcccgatctgacaccccctaatctttgtaattctccccgacgtctgacacactgtggtttccagaatacagtcgtgcgcctcagctggtttgagctgcacaataacgccctatggtggcaggtgcaggagtgatcatccctgaggcacagacgaggagatggaggctcaggaatgggtggtgaccagggcttctctccagccgcgggggccaccagggactggggcctgacctgattttcccctcatccccccaggagccgggctgggtctcggaagcggccg

SEQ ID NO: 277713 - DNA, 1457 bp, Homo sapiens
  misc_feature (1452)..(1452): n is a, c, g, or t
cgtcttcacctctagcggcagcggaggcgtggcccaggggcgcgatggcgtcatcagcgcgcgccgcacccggaagagacgtggcagcggagggataatcggggcggccggggctgaagggagaggcgcaggagccctggggagagtggtccctgcccttccgcgcctcgagccatcgctaccgcccttcggaaccagtgcagcggccgatcagtaaacacagagactggggatcgatcatggggctttgtaagtgccccaagagaaaggtgaccaacctgttctgcttcgaacatcgggtcaacgtctgcgagcactgcctggtagccaatcacgccaagtgcatcgtccagtcctacctgcaatggctccaagatagcgactacaaccccaattgccgcctgtgcaacatacccctggccagccgagagacgacccgccttgtctgctatgatctctttcactgggcctgcctcaatgaacgtgctgcccagctaccccgaaacacggcacctgccggctatcagtgccccagctgcaatggccccatcttccccccaaccaacctggctggccccgtggcctccgcactgagagagaagctggccacagtcaactgggcccgggcaggactgggcctccctctgatcgatgaggtggtgagcccagagcccgagcccctcaacacgtctgacttctctgactggtctagttttaatgccagcagtacccctggaccagaggaggtagacagcgcctctgctgccccagccttctacagccaggccccccggcccccagcttccccaggccggcccgagcagcacacagtgatccacatgggcaatcctgagcccttgactcacgcccctaggaaggtgtatgatacgcgggatgatgaccggacaccaggcctccatggagactgtgacgatgacaagtaccgacgtcggccggccttgggttggctggcccggctgctaaggagccgggctgggtctcggaagcggccgctgaccctgctccagcgggcggggctgctgctactcttgggactgctgggcttcctggccctccttgccctcatgtctcgcctaggccgggccgcagctgacagcgatcccaacctggacccactcatgaaccctcacatccgcgtgggcccctcctgagcccccttgcttgtggctaggccagcctaggatgtgggttctgtggaggagaggcggggtaatggggaggctgagggcacctcttcactgcccctctccctcaagcctaagacactaagaccccagacccaaagccaagtccaccagagtggctgcaggccaggcctggagtccccgtgggtcaagcatttgtcttgacttgctttcctcccgggtctccagcctccgacccctcgccccatgaaggagctggcaggtggaaataaacaacaactttatnaaaaa

SEQ ID NO: 277714 - DNA, 1227 bp, Homo sapiens
cgtcttcacctctagcggcagcggaggcgtggcccaggggcgcgatggcgtcatcagcgcgcgccgcacccggaagagacgtggcagcggagggataatcggggcggccggggctgaagggagaggcgcaggagccctggggagagtggtccctgcccttccgcgcctcgagccatcgctaccgcccttcggaaccagtgcagcggccgatcagtaaacacagagactggggatcgatcatggggctttgtaagtgccccaagagaaaggtgaccaacctgttctgcttcgaacatcgggtcaacgtctgcgagcactgcctggtagccaatcacgccaagtgcatcgtccagtcctacctgcaatggctccaagatagcgactacaaccccaattgccgcctgtgcaacatacccctggccagccgagagacgacccgccttgtctgctatggtgaggccttggcacctcggggggatcaggccagcctcaggggccagcttggtgactggtttccaggccctcctcaagcagcaggacagtgagtcccccgagtctcagagcccagattctagtcctgttaaagttccttacctgctgtgtaagttcaggcaagttattcttcctttctaggcctcactgtctttcctaaaaattaaagctcctagttcctctttcctaaaaattaagccctgccaatctggaggtttcagcgagaaccagtcaagcttacgggtatgctggtggccgtgactattagctagccagaccggcatgttgctttcagatattcaggatccaccactgattccaaggctaaacagagaggaagtgagtttcccacattaaagttagctaaaagaagtcagcagacatatgtgtcatgactttgacctgaatctggggtaagagccttagctccagtttttgaaggagctcatgcaagagtcagctccatatgtgtttctccttgtgagtgcatgtgtgtacttgcaggcacttaatgtacattgtgtgtttaaatgagtgttagtgtgttgatctgtacttggggtgaatgaatgggtaaatgtatgtatgtgaacatatgaacacaggtgtgttgtgggagtgcaagagaatgcatggttgagggtgcctgttagcaaacctgtgagtgtatagatgtgtatgtgtgagggctcctgtacccatagtgtagatatagggaatgccacttgtgtttga

SEQ ID NO: 277715 - DNA, 1352 bp, Homo sapiens
  misc_feature (1347)..(1347): n is a, c, g, or t
cgctagtacgaggctgggtgtaaatcggccgagggggagagtggtccctgcccttccgcgcctcgagccatcgctaccgcccttcggaaccagtgcagcggccgatcagtaaacacagagactggggatcgatcatggggctttgtaagtgccccaagagaaaggtgaccaacctgttctgcttcgaacatcgggtcaacgtctgcgagcactgcctggtagccaatcacgccaagtgcatcgtccagtcctacctgcaatggctccaagatagcgactacaaccccaattgccgcctgtgcaacatacccctggccagccgagagacgacccgccttgtctgctatgatctctttcactgggcctgcctcaatgaacgtgctgcccagctaccccgaaacacggcacctgccggctatcagtgccccagctgcaatggccccatcttccccccaaccaacctggctggccccgtggcctccgcactgagagagaagctggccacagtcaactgggcccgggcaggactgggcctccctctgatcgatgaggtggtgagcccagagcccgagcccctcaacacgtctgacttctctgactggtctagttttaatgccagcagtacccctggaccagaggaggtagacagcgcctctgctgccccagccttctacagccaggccccccggcccccagcttccccaggccggcccgagcagcacacagtgatccacatgggcaatcctgagcccttgactcacgcccctaggaaggtgtatgatacgcgggatgatgaccggacaccaggcctccatggagactgtgacgatgacaagtaccgacgtcggccggccttgggttggctggcccggctgctaaggagccgggctgggtctcggaagcggccgctgaccctgctccagcgggcggggctgctgctactcttgggactgctgggcttcctggccctccttgccctcatgtctcgcctaggccgggccgcagctgacagcgatcccaacctggacccactcatgaaccctcacatccgcgtgggcccctcctgagcccccttgcttgtggctaggccagcctaggatgtgggttctgtggaggagaggcggggtaatggggaggctgagggcacctcttcactgcccctctccctcaagcctaagacactaagaccccagacccaaagccaagtccaccagagtggctgcaggccaggcctggagtccccgtgggtcaagcatttgtcttgacttgctttcctcccgggtctccagcctccgacccctcgccccatgaaggagctggcaggtggaaataaacaacaactttatnaaaaa

SEQ ID NO: 277716 - DNA, 968 bp, Homo sapiens
  misc_feature (963)..(963): n is a, c, g, or t
aagaatatgatgagtgcaggcccagagaggactcattgaaaggactgaaaggggaggtggcgttttcttcctacccaaacttaccccccgtggcctccgcactgagagagaagctggccacagtcaactgggcccgggcaggactgggcctccctctgatcgatgaggtggtgagcccagagcccgagcccctcaacacgtctgacttctctgactggtctagttttaatgccagcagtacccctggaccagaggaggtagacagcgcctctgctgccccagccttctacagccaggccccccggcccccagcttccccaggccggcccgagcagcacacagtgatccacatgggcaatcctgagcccttgactcacgcccctaggaaggtgtatgatacgcgggatgatgaccggacaccaggcctccatggagactgtgacgatgacaagtaccgacgtcggccggccttgggttggctggcccggctgctaaggagccgggctgggtctcggaagcggccgctgaccctgctccagcgggcggggctgctgctactcttgggactgctgggcttcctggccctccttgccctcatgtctcgcctaggccgggccgcagctgacagcgatcccaacctggacccactcatgaaccctcacatccgcgtgggcccctcctgagcccccttgcttgtggctaggccagcctaggatgtgggttctgtggaggagaggcggggtaatggggaggctgagggcacctcttcactgcccctctccctcaagcctaagacactaagaccccagacccaaagccaagtccaccagagtggctgcaggccaggcctggagtccccgtgggtcaagcatttgtcttgacttgctttcctcccgggtctccagcctccgacccctcgccccatgaaggagctggcaggtggaaataaacaacaactttatnaaaaa

SEQ ID NO: 277717 - DNA, 425 bp, Homo sapiens
cgctagtacgaggctgggtgtaaatcggccgagggggagagtggtccctgcccttccgcgcctcgagccatcgctaccgcccttcggaaccagtgcagcggccgatcagatcgatcatggggctttgtaagtgccccaagagaaaggtgaccaacctgttctgcttcgaacatcgggtcaacgtctgcgagcactgcctggtagccaatcacgccaaggtggggccttcaggggagcgactgagcagggcactgggtgggcaaggcggtattggcttcctccaaatccatgaggggccccgcgctagaatgtaagccccacaagggcaaggacttgatttattttgttcactgatatatcccccgtccccaagagagagtctggtgcacagtatgtgctcaataaatatttattgattaaacaaa

SEQ ID NO: 277718 - DNA, 4445 bp, Homo sapiens
cccacctcggccacactgcttcgctcccccctccccaccttcagctggcaccgcaaacaagccttacctcgttgcatctgcgaggagaggtagcaacagcgagcctagccagccagaggcggtggagaggaggaaggggcggggtgggggggcagagagcgggccgaggccgcccttggtgggggtagcgggggcagagctgccgagcagacccggcagccgccctcctccgcccccaccctccagaagcactcttgcctgagaaccgaattattccactagtattatttcattttttattactccccctcctcactccccagccgcccccacccccacgccggcctcgcctctggttgcatggcagcgctgcccgggcgcggggctcagggctggccccagggaagggggaggaggaggaggatcatgaaggccggagtcgcgaccgccggacggcggcagcagccagaggacgagccggagcagcccccgccccggagacacccggacgccgagcagcagtcgcctccgccgccgcagcagctgcgggcgcgggccgacccggagccggaggaggagggcgaccgcgacccagaggaggaagaggaggagaaggcgaggccactcgcccgcccggacctgcccttctctcggctcttgcccctcgaccgaagggacctttgatggaaccgaggggagggcgccacggatttgccgactgcagcaggggtgggctgggggctgagataatgtaaccactcctttctcctgttctctcccacacgcccctctcctctacccctattctctgctccactgccctctcaccccggtacacacacccttcctctagccaggatcttcatgctcaggaaggaggcgcctctgcaagggttaaacgatcttttctttttctcccatcctttttccttcccaaacctctattttacctcccttctcctaattggctttcccctcttcggtgtaaccctttggctgcggaggcaaagcacaagcccctagcccagtttcacctgcaacacccctcccccacccaactgctctcttaaaagcaactctggtgcttctgggggttaattgccccagttttctgcccaggagaattaaaacttctcccaatcttctctcctcccctaccttgactcccccaacccctaccacctgagaaaaacgatcttttctctctcacacatgcagtcctcaattcttcattgagctagttttctctaagcccagctcaatccactccagatttgatttacaattgtccccacccttttatataaaagaaagatttctcactgcgtaggaatttgagaagaacccaataatcctttcctggggaacttttaaacaattcgacattgatttaaacaattcgacagaggctctagtggcccctccaccacgcttcttcaatccctctgctcctaccagtgtcctcaggtcaaaagcagaaaggagacacactgaacaaagttggaggttggggtgggtgtgtgagggcaagaaaaacttttttgttattgggctttccaggtggagttcagaaccagtgactcacacttctcagtcctgggagcaatttatttgctacttggaggggttgtaagaaaagccagtgagaaagcagactccccccacaacacagatccactgtggacccccaaaacctgtcctgtccccctcttttaagactccagccacccctcttgggctctctacttccacggggcacatgctgatgcccctgtgtgggctgctctggtggtggtggtgctgctgctccggctggtactgctatggattgtgtgccccagccccccagatgttgcgccaccagggtctcctcaagtgccgctgccgcatgctcttcaatgacctgaaggttttcttactgcggcgccctcctcaagcgcccctgcccatgcacggcgacccccagccccccggtttggcggccaacaacacccttccggctctgggcgccggggggtgggcaggctggaggggcccccgagaagtggtgggcagggagccccctcctgtgccacctccaccccccttgccaccttcttctgtggaagatgactggggtggcccagccacagagccacctgcctcgctgctcagcagtgcctcctcagatgacttctgtaaggagaagaccgaggatcgctactcactgggcagcagcttggacagtggtatgaggaccccactctgccgcatctgcttccaggggccagaacagggggagctgctgagcccatgccgctgtgatggctcggtcaagtgcacacaccagccttgcctcatcaagtggatcagcgagcggggctgctggagctgcgagctgtgctactacaagtaccacgtcatcgccataagcacaaaaaatcctctgcagtggcaggccatctctctgacggtcattgagaaggttcaggttgcagccgccatcctgggctccctcttcctcatcgccagtatttcttggctcatctggtcaactttcagcccctcggcaagatggcagcgccaagaccttctcttccagatctgctacgggatgtatggcttcatggacgtggtgtgcataggtctcatcatccatgaaggaccctcggtgtaccgcatctttaaacggtggcaggctgtcaaccagcagtggaaagtgctgaactatgacaagacaaaagacctggaggatcaaaaggcaggaggcaggaccaacccccggacctcctcatccacccaggccaatatcccctcctcggaagaggagaccgcaggcacccctgcccctgagcagggccctgcccaggctgccggccacccctcaggccctctgtcccatcaccactgtgcttataccatcctgcacatcctgagtcacttgagacctcatgaacagcgaagtcccccaggcagcagccgagagctggtcatgagagtcacgacagtgtgagagcagaggcccggaaggaaggccatgaccaccactgagggcccggagcagggtggggaggtgcagtggcacccccggagccaacagagggagcaggcagagggtgggggacctggcgggagccctggggtagtgtcagagcgggagtgaggctggtgcaggagcagttctgctatttccaatcagtcaatgccactctccacaacaacaatgaaaaccaacaccaactcaacaacaaagtgcaatacaggctgaacctggcccaacagaaaaaccctgccccaatgcacctgcaggcaaggtacccgaagaagcagaggctgagggcaggcaaagcctgtgtgactgtggcagtgccggaggccaagggggccaagaggaaaagcatctgtggtctgccctgctctcaccctgtttggttttgtttctcctggggctgtgttctgcaggcagccagaaaaggaggaggcacgggtgagctggcagggacacactgcctttggggctcctgggctcatttggatgggcaagattcgctgacaaatggctgtggggatggtggggtggatggtcagggagggatgctcagggagggatatgctggtgtgagcagccagagggagagtgtgtctccttcctgaaggaacttccaaatggaactcccgatttcaggtgggctaaaagagggcttaggtttggaaaagggtgtccttctgtgcccttgttaatttattttatagtgatttggttcaaagatgtttacaggacacacacacacacacacacacacacacacacacacccctagagaaaagtacagatttccagtggatatttcaagcacagttctgctgctgtggcttcagctttggaagctgtcaatcccggagcaactttcccaactacccaaccccaccatggccaggacatgtgcaatgccagccccttcttgtcttggcacatgcacagacccagtcccctcacggtagggcacccctgacctacgggcttccaagagagcagctgcagtggttgggaggagcttgaccagtgtgccccaaggagtggagtagagcccaatctaagtattccttgctgcttggaaccctccctgtttggaaccctccccaaagaggcagtcaggctgatgctcagtgctttgtgctccctgctccttcccgcgtagccaggtgggcccaagggtgcctggcagggagcactacccctggacccctcctgctcgctctggggaccctgccagggaaggccactgggtgttcacctgcaaagtttctggttgtcactgcacagtggtcgcgtcatccatgggtattaaaaggacactgtcaagtacttttttaaactagtttttagggttttttaaaactctctgttgtttgtaatattctcttaaaagcttgaaaataaaacttctttccctacaaaaaaagtc

SEQ ID NO: 277719 - DNA, 3893 bp, Homo sapiens
gggatctgggaagagaaacttgcggacgagggagttagagccgtggacccccggcccccgcccgggcgtcctgcgtcggaggagggtctctgggtcgggcaggggccacctcttggcccgccccttgtcgctggacgtccgaagattgggccatttcccttgccgcgcccttaccgcatatcggggtgcgcccggcccggcccggcccgccccacccagccctccgctcgcgcccggagaggaggggccgctggcgcagcgccccgggaccccgagaggccgccgcggcacatccagacctccgccgctcccgcgccctctcaaccatcctgggattcccgggcccacccgacccagcggcgcaaccctggccctccgggaccctccgctgactccaccgcgcacttcccgggacccccacacacatcccagccctccggccgatccctccctactcggtgccgggtgccccccgccctctccaggcccggatctcctcccccaggtccccggggcggccccagccaggcccccttcgaaccccgccggcggcccgggctggggcgcaccatgcggctgcggctccggcttctggcgctgctgcttctgctgctggcaccgcccgcgcgcgccccgaagccctcggcgcaggacgtgagcctgggcgtggactggctgactcgctatggttacctgccgccaccccaccctgcccaggcccagctgcagagccctgagaagttgcgcgatgccatcaaagtcatgcagaggttcgcggggctgccggagaccggccgcatggacccagggacagtggccaccatgcgtaagccccgctgctccctgcctgacgtgctgggggtggcggggctggtcaggcggcgtcgccggtacgctctgagcggcagcgtgtggaagaagcgaaccctgacatggagggtacgttccttcccccagagctcccagctgagccaggagaccgtgcgggtcctcatgagctatgccctgatggcctggggcatggagtcaggcctcacatttcatgaggtggattccccccagggccaggagcccgacatcctcatcgactttgcccgcgccttccaccaggacagctaccccttcgacgggttggggggcaccctagcccatgccttcttccctggggagcaccccatctccggggacactcactttgacgatgaggagacctggacttttgggtcaaaagacggcgaggggaccgacctgtttgccgtggctgtccatgagtttggccacgccctgggcctgggccactcctcagcccccaactccattatgaggcccttctaccagggtccggtgggcgaccctgacaagtaccgcctgtctcaggatgaccgcgatggcctgcagcaactctatgggaaggcgccccaaaccccatatgacaagcccacaaggaaacccctggctcctccgccccagcccccggcctcgcccacacacagcccatccttccccatccctgatcgatgtgagggcaattttgacgccatcgccaacatccgaggggaaactttcttcttcaaaggcccctggttctggcgcctccagccctccggacagctggtgtccccgcgacccgcacggctgcaccgcttctgggaggggctgcccgcccaggtgagggtggtgcaggccgcctatgctcggcaccgagacggccgaatcctcctctttagcgggccccagttctgggtgttccaggaccggcagctggagggcggggcgcggccgctcacggagctggggctgcccccgggagaggaggtggacgccgtgttctcgtggccacagaacgggaagacctacctggtccgcggccggcagtactggcgctacgacgaggcggcggcgcgcccggaccccggctaccctcgcgacctgagcctctgggaaggcgcgcccccctcccctgacgatgtcaccgtcagcaacgcaggtgacacctacttcttcaagggcgcccactactggcgcttccccaagaacagcatcaagaccgagccggacgccccccagcccatggggcccaactggctggactgccccgccccgagctctggtccccgcgcccccaggccccccaaagcgacccccgtgtccgaaacctgcgattgtcagtgcgagctcaaccaggccgcaggacgttggcctgctcccatcccgctgctcctcttgcccctgctggtggggggtgtagcctcccgctgatggggggagccatccagaccgaacagcgccctccacggccgagtcccccgccgctggacctggtcgggggttgtgaggcgctgcggaggccccttgtctgttcccacggacgggggctcgggcgcggactaagcaggggggatctcccgcgcaggggcggcggcggcggggaccggtcgcctggcgctgggctcagtctcctcagggtctgagaccccggcgctgccaccggaacccgccttcaggggcgcacgcgcgctgggaccatgcgtcggtcgtcgcccccgtcgttccctcccggctgccgccagggggcggtcggaccccgcctcccgagcccggggaggggcggggaggacaaggggcgggcccgcggcctcacccggagggacggcagccccggtcgcgcgctggccccgcaggaccttccttttccaggaagagccagcttttctcggagcgcagtcctgggactctccgcagccccgccccgcctggccactgcgtctggcattcctgggtcgttagaggacaggcctgactgcgaagctgtgccttgcccctctcccacccgcagtttctcaccccgttctgctcccacaaggcccccctacagtcactgccacactggtggggacctgggacccagacccggaaccagcccagatatcacccctgaggacccatgcgccacgtcctgggtggtggaatcagtggctggagggacgacccttgctctccaggctgttaaccttttccgttgctcccccgccacccacctcctcctccccaggccacccaacttgggcacctccctgggcccagaactgccttccattcaatggggaacccttctatccccaagaaccccttccctgcttgcaccctggagagaacagcttgactcccatcaactcaacgctggtggaaagacagggaccgaaccctggctcaggcctggtcattgcctcctcagcactccctcctgggaggccttagctctagagtgaggggtgggtggaacctgggggcacctcgttcaccctgtccccactccccacagttttaggatctaaatgattgcctctggaactattcttctagactatcccacatcagaatcactgggaaatttaagtttgcagatcccacactcaccctgaatcctcactcagggtggggtcaggaatctgcattttaactagtcgcggggattgtggggggcagtagctggctgtttcgtggcatttctgtggctctgcagtgttcctccaccccaggaccaatatgttcaggccacaccgatggcctgaaccccatgggtagagtcacttaggggccacttcctaagttgctgtccagcctcagtgaccccctagtgcttcctggagctgaggctgtgggcggctgtcccagcaaccaagcgaggggttgccccagttgctcatacaaacagatcagcatgaggacagaaggcaggagactttggtcagttacctgggaattctgggctgccaggaaacgatttgggcctctgtcagtttcttttccatgtatgaggagggggaaatttgtatattagaaacttattcatcccactcaggacaataaaaacgaatgtacaaaaaaaaaaa

SEQ ID NO: 277720 - DNA, 3434 bp, Homo sapiens
gggatctgggaagagaaacttgcggacgagggagttagagccgtggacccccggcccccgcccgggcgtcctgcgtcggaggagggtctctgggtcgggcaggggccacctcttggcccgccccttgtcgctggacgtccgaagattgggccatttcccttgccgcgcccttaccgcatatcggggtgcgcccggcccggcccggcccgccccacccagccctccgctcgcgcccggagaggaggggccgctggcgcagcgccccgggaccccgagaggccgccgcggcacatccagacctccgccgctcccgcgccctctcaaccatcctgggattcccgggcccacccgacccagcggcgcaaccctggccctccgggaccctccgctgactccaccgcgcacttcccgggacccccacacacatcccagccctccggccgatccctccctactcggtgccgggtgccccccgccctctccaggcccggatctcctcccccaggtccccggggcggccccagccaggcccccttcgaaccccgccggcggcccgggctggggcgcaccatgcggctgcggctccggcttctggcgctgctgcttctgctgctggcaccgcccgcgcgcgccccgaagccctcggcgcaggacgtgagcctgggcgtggactggctgactcgctatggttacctgccgccaccccaccctgcccaggcccagctgcagagccctgagaagttgcgcgatgccatcaaagtcatgcagaggttcgcggggctgccggagaccggccgcatggacccagggacagtggccaccatgcgtaagccccgctgctccctgcctgacgtgctgggggtggcggggctggtcaggcggcgtcgccggtacgctctgagcggcagcgtgtggaagaagcgaaccctgacatggagggtacgttccttcccccagagctcccagctgagccaggagaccgtgcgggtcctcatgagctatgccctgatggcctggggcatggagtcaggcctcacatttcatgaggtggattccccccagggccaggagcccgacatcctcatcgactttgcccgcgccttccaccaggacagctaccccttcgacgggttggggggcaccctagcccatgccttcttccctggggagcaccccatctccggggacactcactttgacgatgaggagacctggacttttgggtcaaaagacggcgaggggaccgacctgtttgccgtggctgtccatgagtttggccacgccctgggcctgggccactcctcagcccccaactccattatgaggcccttctaccagggtccggtgggcgaccctgacaagtaccgcctgtctcaggatgaccgcgatggcctgcagcaactctatgggaaggcgccccaaaccccatatgacaagcccacaaggaaacccctggctcctccgccccagcccccggcctcgcccacacacagcccatccttccccatccctgatcgatgtgagggcaattttgacgccatcgccaacatccgaggggaaactttcttcttcaaaggcccctggttctggcgcctccagccctccggacagctggtgtccccgcgacccgcacggctgcaccgcttctgggaggggctgcccgcccaggtgagggtggtgcaggccgcctatgctcggcaccgagacggccgaatcctcctctttagcgggccccagttctgggtgttccaggaccggcagctggagggcggggcgcggccgctcacggagctggggctgcccccgggagaggaggtggacgccgtgttctcgtggccacagaacgggaagacctacctggtccgcggccggcagtactggcgctacgacgaggcggcggcgcgcccggaccccggctaccctcgcgacctgagcctctgggaaggcgcgcccccctcccctgacgatgtcaccgtcagcaacgcaggtgacacctacttcttcaagggcgcccactactggcgcttccccaagaacagcatcaagaccgagccggacgccccccagcccatggggcccaactggctggactgccccgccccgagctctggtccccgcgcccccaggccccccaaagcgacccccgtgtccgaaacctgcgattgtcagtgcgagctcaaccaggccgcaggacgttggcctgctcccatcccgctgctcctcttgcccctgctggtggggggtgtagcctcccgctgatggggggagccatccagaccgaacagcgcccccgcctggccactgcgtctggcattcctgggtcgttagaggacaggcctgactgcgaagctgtgccttgcccctctcccacccgcagtttctcaccccgttctgctcccacaaggcccccctacagtcactgccacactggtggggacctgggacccagacccggaaccagcccagatatcacccctgaggacccatgcgccacgtcctgggtggtggaatcagtggctggagggacgacccttgctctccaggctgttaaccttttccgttgctcccccgccacccacctcctcctccccaggccacccaacttgggcacctccctgggcccagaactgccttccattcaatggggaacccttctatccccaagaaccccttccctgcttgcaccctggagagaacagcttgactcccatcaactcaacgctggtggaaagacagggaccgaaccctggctcaggcctggtcattgcctcctcagcactccctcctgggaggccttagctctagagtgaggggtgggtggaacctgggggcacctcgttcaccctgtccccactccccacagttttaggatctaaatgattgcctctggaactattcttctagactatcccacatcagaatcactgggaaatttaagtttgcagatcccacactcaccctgaatcctcactcagggtggggtcaggaatctgcattttaactagtcgcggggattgtggggggcagtagctggctgtttcgtggcatttctgtggctctgcagtgttcctccaccccaggaccaatatgttcaggccacaccgatggcctgaaccccatgggtagagtcacttaggggccacttcctaagttgctgtccagcctcagtgaccccctagtgcttcctggagctgaggctgtgggcggctgtcccagcaaccaagcgaggggttgccccagttgctcatacaaacagatcagcatgaggacagaaggcaggagactttggtcagttacctgggaattctgggctgccaggaaacgatttgggcctctgtcagtttcttttccatgtatgaggagggggaaatttgtatattagaaacttattcatcccactcaggacaataaaaacgaatgtacaaaaaaaaaaa

SEQ ID NO: 277721 - DNA, 5354 bp, Homo sapiens
gggatctgggaagagaaacttgcggacgagggagttagagccgtggacccccggcccccgcccgggcgtcctgcgtcggaggagggtctctgggtcgggcaggggccacctcttggcccgccccttgtcgctggacgtccgaagattgggccatttcccttgccgcgcccttaccgcatatcggggtgcgcccggcccggcccggcccgccccacccagccctccgctcgcgcccggagaggaggggccgctggcgcagcgccccgggaccccgagaggccgccgcggcacatccagacctccgccgctcccgcgccctctcaaccatcctgggattcccgggcccacccgacccagcggcgcaaccctggccctccgggaccctccgctgactccaccgcgcacttcccgggacccccacacacatcccagccctccggccgatccctccctactcggtgccgggtgccccccgccctctccaggcccggatctcctcccccaggtccccggggcggccccagccaggcccccttcgaaccccgccggcggcccgggctggggcgcaccatgcggctgcggctccggcttctggcgctgctgcttctgctgctggcaccgcccgcgcgcgccccgaagccctcggcgcaggacgtgagcctgggcgtggactggctgactcgctatggttacctgccgccaccccaccctgcccaggcccagctgcagagccctgagaagttgcgcgatgccatcaaagtcatgcagaggttcgcggggctgccggagaccggccgcatggacccagggacagtggccaccatgcgtaagccccgctgctccctgcctgacgtgctgggggtggcggggctggtcaggcggcgtcgccggtacgctctgagcggcagcgtgtggaagaagcgaaccctgacatggagggtacgttccttcccccagagctcccagctgagccaggagaccgtgcgggtcctcatgagctatgccctgatggcctggggcatggagtcaggcctcacatttcatgaggtggattccccccagggccaggagcccgacatcctcatcgactttgcccgcgccttccaccaggacagctaccccttcgacgggttggggggcaccctagcccatgccttcttccctggggagcaccccatctccggggacactcactttgacgatgaggagacctggacttttgggtcaaaaggcctctcagcagctggagcaggagctggcaggcggctcaccggttgatgaggagctgggcttcagccggggctggcgtgtgaatcctctgggtcctggcagtcctgagcgcctgagctgaatacagagggaagaggctgggagcaaggccgggtgctggggccggcaggctgtgttctgagagtgcctgctagaggagctctgtgttcccaaggagatggaggaagacctggggtgggggtggtacagggtagggagaggaggggcagaggctgtgaacagggagatgggggaggggggatggaggactcaagggatgtaagggatatggcttgaggagggatgggggcaggaatgagggaaggtcttgggtcaaggacatggacctacatccccagcagatgggggtggcaagggggagacgggtgggggtcgctgactatagactgtagctgggaggaggggatgctcccagggctggggctgcctgaagagaatggcacgcaccttgtaggctcctgccctcaccccaccgccctcttaagtttcttttattttctttttctttttttttctttttactttttttgagacggggccttattctgtcctccaggctggagtgcaatgacatggtcatgcgtcactgcagcctccacctcccgggctccagcgattctcctgcctccctgcctcagcctgggacctgagtagctgggaccacaggcatgcgccaccactcctggccaatttttaaaatttttttgtaagagatggggatctccttatgttgtccaggccagtcttgaactcttgggctcaagcgatcctcccacctgggactccaaaagtgctgggtttacaggcatgagccaccacacccagctcctccccctcaaacttctgtgcacaaagtgctcccttcccagaggaggggccccatcggtgtgtaaggtggcctattcctctgtgtgttctctggatcttttcagccctgtggtccagtgtccatcacagccatgctgactgagtgactggagacagggatgatggagagttcaggaagggctgggcagaggaggctggggccacctctggagggtgtcctgctgttcctgttggccccagctgcactcgcagggccttcctgtggcccctttccccaagcaggggcggccgcagctctcacccactttctcctgcagacggcgaggggaccgacctgtttgccgtggctgtccatgagtttggccacgccctgggcctgggccactcctcagcccccaactccattatgaggcccttctaccagggtccggtgggcgaccctgacaagtaccgcctgtctcaggatgaccgcgatggcctgcagcaactctatggtagggggagagggacctgccgcgaaaccatcattgccccatccagtgtcctctgcagcaaggccaggggacgcacacctgcctgactctttcctcacagggaaggcgccccaaaccccatatgacaagcccacaaggaaacccctggctcctccgccccagcccccggcctcgcccacacacagcccatccttccccatccctgatcgatgtgagggcaattttgacgccatcgccaacatccgaggggaaactttcttcttcaaaggcccctggttctggcgcctccagccctccggacagctggtgtccccgcgacccgcacggctgcaccgcttctgggaggggctgcccgcccaggtgagggtggtgcaggccgcctatgctcggcaccgagacggccgaatcctcctctttagcgggccccagttctgggtgttccaggaccggcagctggagggcggggcgcggccgctcacggagctggggctgcccccgggagaggaggtggacgccgtgttctcgtggccacagaacgggaagacctacctggtccgcggccggcagtactggcgctacgacgaggcggcggcgcgcccggaccccggctaccctcgcgacctgagcctctgggaaggcgcgcccccctcccctgacgatgtcaccgtcagcaacgcaggtggggagcgcggtgacctgcgggttactgggcctgggggtggggagagggatgtggggaatggggacatggaggccaccctgcggggatgggggtccttgggcatcagggagcggcggggcggggagggaccgggactcaagctctgctcctccaggtgacacctacttcttcaagggcgcccactactggcgcttccccaagaacagcatcaagaccgagccggacgccccccagcccatggggcccaactggctggactgccccgccccgagctctggtccccgcgcccccaggccccccaaagcgacccccgtgtccgaaacctgcgattgtcagtgcgagctcaaccaggccgcaggacgttggcctgctcccatcccgctgctcctcttgcccctgctggtggggggtgtagcctcccgctgatggggggagccatccagaccgaacagcgccctccacggccgagtcccccgccgctggacctggtcgggggttgtgaggcgctgcggaggccccttgtctgttcccacggacgggggctcgggcgcggactaagcaggggggatctcccgcgcaggggcggcggcggcggggaccggtcgcctggcgctgggctcagtctcctcagggtctgagaccccggcgctgccaccggaacccgccttcaggggcgcacgcgcgctgggaccatgcgtcggtcgtcgcccccgtcgttccctcccggctgccgccagggggcggtcggaccccgcctcccgagcccggggaggggcggggaggacaaggggcgggcccgcggcctcacccggagggacggcagccccggtcgcgcgctggccccgcaggaccttccttttccaggaagagccagcttttctcggagcgcagtcctgggactctccgcagccccgccccgcctggccactgcgtctggcattcctgggtcgttagaggacaggcctgactgcgaagctgtgccttgcccctctcccacccgcagtttctcaccccgttctgctcccacaaggcccccctacagtcactgccacactggtggggacctgggacccagacccggaaccagcccagatatcacccctgaggacccatgcgccacgtcctgggtggtggaatcagtggctggagggacgacccttgctctccaggctgttaaccttttccgttgctcccccgccacccacctcctcctccccaggccacccaacttgggcacctccctgggcccagaactgccttccattcaatggggaacccttctatccccaagaaccccttccctgcttgcaccctggagagaacagcttgactcccatcaactcaacgctggtggaaagacagggaccgaaccctggctcaggcctggtcattgcctcctcagcactccctcctgggaggccttagctctagagtgaggggtgggtggaacctgggggcacctcgttcaccctgtccccactccccacagttttaggatctaaatgattgcctctggaactattcttctagactatcccacatcagaatcactgggaaatttaagtttgcagatcccacactcaccctgaatcctcactcagggtggggtcaggaatctgcattttaactagtcgcggggattgtggggggcagtagctggctgtttcgtggcatttctgtggctctgcagtgttcctccaccccaggaccaatatgttcaggccacaccgatggcctgaaccccatgggtagagtcacttaggggccacttcctaagttgctgtccagcctcagtgaccccctagtgcttcctggagctgaggctgtgggcggctgtcccagcaaccaagcgaggggttgccccagttgctcatacaaacagatcagcatgaggacagaaggcaggagactttggtcagttacctgggaattctgggctgccaggaaacgatttgggcctctgtcagtttcttttccatgtatgaggagggggaaatttgtatattagaaacttattcatcccactcaggacaataaaaacgaatgtacaaaaaaaaaaa

SEQ ID NO: 277722 - DNA, 479 bp, Homo sapiens
gctctcacccactttctcctgcagacggcgaggggaccgacctgtttgccgtggctgtccatgagtttggccacgccctgggcctgggccactcctcagcccccaactccattatgaggcccttctaccagggtccggtgggcgaccctgacaagtaccgcctgtctcaggatgaccgcgatggcctgcagcaactctatggtagggggagagggacctgccgcgaaaccatcattgccccatccagtgtcctctgcagcaaggccaggggacgcacacctgcctgactctttcctcacagggaaggcgccccaaaccccatatgacaagcccacaaggaaacccctggctcctccgccccagcccccggcctcgcccacacacaggtgagtcccccaccaactcggagaccttgggtgaccagctgcccagcctcagtgtcctctgagatggggatggtgggggtccctgccttggag

SEQ ID NO: 277723 - DNA, 1296 bp, Homo sapiens
  misc_feature (181)..(181): n is a, c, g, or t
  misc_feature (188)..(188): n is a, c, g, or t
  misc_feature (191)..(191): n is a, c, g, or t
gcagtacgtagcgatttcgtttcccctcagtcctttagccgtgcacccggccgatggtgtgtgctcttgattctgagcgaatagagtgcccagtaaagtgcgatggtgggctcgtcaacgaattcagaagcaccgggagatacgttgagcttcatgaaatgactccgtgctgagtagaaangtgtgcngancaagtctttatctgcaaactctagtcatgatgtttgagtttgtctccctgtggagcaggggtccccagcccccgacccccgcatcggtccatggcctgtcaggaactgggccacacagcaggagttgaactgcagaaaattaatgcaaaacttcatgatggagtatgtcagcgctgtaaagaagttcttgagtggcgtgtaaaatacagcaaatacaaaccattatcaaaacctaaaaagtgtgttaaatgtttacaaaagacagtgaaggattcttatcacataatgtgcaggccatgtgcctgtgaacttgaagtttgcgcaaaatgtggaaagaaagaagacattgttattccgttgaataaagaaacagaaaaaatagaacatactgaaaataatctaagttccaaccatagaagaagctgcagaagaaatgaagaaagtgatgatgatttagattttgatattgatttagaagacacaggaggattgcttgaaccctggaggcggagattgaagtgagctgagttcgtgccattacactccagcctgggtgacagagtgagactctgtctcaaaaaaaataaaataaaaagtcaatttagaatgtgaaattctgaccaccttttggctttgagtattttccaaaagatatttgaaatcctaatgaggaaatcagaaaaagctatggaaaaatagacaaatttcatacatgaacaatataaattgtgtatattacttaacatcaaactaaacaagattcagaattgatggttgtataagaactagctcatgtaaaaataaaataacattattacattgcctcaaaaattggtcctcggtaagtgccttttgataaatgatctcaaataaatgactcatagcaaaagccctgtcgcttatgtttaatttttacaaagtaaaagcaattttttccaaataataatgtttaacaagcgtatagcaattctgctttgtatttttatatatttcatcacattttaacttttttctcgtgaaatgtacatacagaaaaagtgcatataatttatacactttataagtgtatgcattttttataataattataaaggaaagttcatgc

SEQ ID NO: 277724 - DNA, 1537 bp, Homo sapiens
  misc_feature (3)..(4): n is a, c, g, or t
ggnncgaggctgcgccgcgtggagtggcttggcttaacagcagggagggcagagcgatgctctttgacctcccagaagagtcacgtgggctgacccagagccggggcggaaaggctgcgttagtttcttccgggtcattgacagaagcgtcaattcctgggagtagttcgttggttttctttcccctcatccttttgcctgctcccggcgaggggtggctttgatttcggcgatgagctcccagaaaggcaacgtggctcgttccagacctcagaagcaccagaatacgtttagcttcaaaaatgacaagttcgataaaagtgtgcagaccaagaaaattaatgcaaaacttcatgatggagtatgtcagcgctgtaaagaagttcttgagtggcgtgtaaaatacagcaaatacaaaccattatcaaaacctaaaaagtgtgttaaatgtttacaaaagacagtgaaggattcttatcacataatgtgcaggccatgtgcctgtgaacttgaagtttgcgcaaaatgtggaaagaaagaagacattgttattccgttgaataaagaaacagaaaaaatagaacatactgaaaataatctaagttccaaccatagaagaagctgcagaagaaatgaagaaagtgatgatgatttagattttgatattgatttagaagacacaggaggagaccatcaaatgaattaatatcactgtattaaaagtctgccgggcacagtggctcacgcctgtaatcccaacactttgggaggccaaggagggtggatcacctgaggtcaggagttcgagaccagcctggccaacatggcggaaccccatctccactaaaagtacaaaaaattagctgggcgtggtggctcatgcctgtaatcccagctactcaggaggctgaggcaggaggattgcttgaaccctggaggcggagattgaagtgagctgagttcgtgccattacactccagcctgggtgacagagtgagactctgtctcaaaaaaaataaaataaaaagtcaatttagaatgtgaaattctgaccaccttttggctttgagtattttccaaaagatatttgaaatcctaatgaggaaatcagaaaaagctatggaaaaatagacaaatttcatacatgaacaatataaattgtgtatattacttaacatcaaactaaacaagattcagaattgatggttgtataagaactagctcatgtaaaaataaaataacattattacattgcctcaaaaattggtcctcggtaagtgccttttgataaatgatctcaaataaatgactcatagcaaaagccctgtcgcttatgtttaatttttacaaagtaaaagcaattttttccaaataataatgtttaacaagcgtatagcaattctgctttgtatttttatatatttcatcacattttaacttttttctcgtgaaatgtacatacagaaaaagtgcatataatttatacactttataagtgtatgcattttttataataattataaaggaaagttcatgc

SEQ ID NO: 277725 - DNA, 1057 bp, Homo sapiens
ccattgagttatgagtcttttatatatattctagatacaagtcctttatcagatataatttggaaatattttctcgctgtctgtaatgtgttatacatcaattttaagatatccttcacattaagaaactaacggtgtggataataatcctggtattgacagaggtttggactcctgaagcctgaaagtctatctgctgccacgcctgggcacatactgcatcatttacaaaactgtagagcacctgttgtgtgtgcagttgtgatttcttatagatttttagaattggaaggcatgtaaagaacacgtaatctggtacattgcttcagtaggtaagtcagtatgaacttctaagaatttttgttttcttctgtattgggtctattgtgggtatgtccaacgtgacaggggaggtaagggaagtggcatcccctgagatagtgactgaaatggctttcatcatctttaagtcaaagtgagatgccagtaataggatatatgtatgtatgtacttgtgtctctgtatgtatgtaaataaacaaacatgctggaaggaggaggtgattcaatcagggactttgtgaaagaaaaaaagaataactggaccttcctttaatgatgaaaactgtttatacagcaaaccatcaaagccaaaatgtgaattttggtattagcccgatttttcctaagaaactgttgatgtaaccactgtagttgcagagatcgttttggtatattctagaccctctttgttttgttctgtttggggtttcttccccctcaagttgctcttgtccaccactagactggctgccttttattccatagcagacagtccttaagtctttgcatatgtccttattcaaaaattaatcttcatcagtttttttctgcagaaaacagttttttaaatatcttacatgagaatgctctgcacctgcaatctctggttgatgcagtttcctttctctcttctctgttcccattggtagaataaatctgctccttcttaaatcctgagctgaaaatgtccacacttcccagaagtgtactttag

SEQ ID NO: 277726 - DNA, 1180 bp, Homo sapiens
  misc_feature (3)..(4): n is a, c, g, or t
ggnncgaggctgcgccgcgtggagtggcttggcttaacagcagggagggcagagcgatgctctttgacctcccagaagagtcacgtgggctgacccagagccggggcggaaaggctgcgttagtttcttccgggtcattgacagaagcgtcaattcctgggagtagttcgttggttttctttcccctcatccttttgcctgctcccggcgaggggtggctttgatttcggcgatgagctcccagaaaggcaacgtggctcgttccagacctcagaagcaccagaatacgtttagcttcaaaaatgacaagttcgataaaagtgtgcagaccaagacatactgcatcatttacaaaactgtagagcacctgttgtgtgtgcagttgtgatttcttatagatttttagaattggaaggcatgtaaagaacacgtaatctggtacattgcttcagtaggtaagtcagtatgaacttctaagaatttttgttttcttctgtattgggtctattgtgggtatgtccaacgtgacaggggaggtaagggaagtggcatcccctgagatagtgactgaaatggctttcatcatctttaagtcaaagtgagatgccagtaataggatatatgtatgtatgtacttgtgtctctgtatgtatgtaaataaacaaacatgctggaaggaggaggtgattcaatcagggactttgtgaaagaaaaaaagaataactggaccttcctttaatgatgaaaactgtttatacagcaaaccatcaaagccaaaatgtgaattttggtattagcccgatttttcctaagaaactgttgatgtaaccactgtagttgcagagatcgttttggtatattctagaccctctttgttttgttctgtttggggtttcttccccctcaagttgctcttgtccaccactagactggctgccttttattccatagcagacagtccttaagtctttgcatatgtccttattcaaaaattaatcttcatcagtttttttctgcagaaaacagttttttaaatatcttacatgagaatgctctgcacctgcaatctctggttgatgcagtttcctttctctcttctctgttcccattggtagaataaatctgctccttcttaaatcctgagctgaaaatgtccacacttcccagaagtgtactttag

SEQ ID NO: 277727 - DNA, 768 bp, Homo sapiens
  misc_feature (3)..(4): n is a, c, g, or t
ggnncgaggctgcgccgcgtggagtggcttggcttaacagcagggagggcagagcgatgctctttgacctcccagaagagtcacgtgggctgacccagagccggggcggaaaggctgcgttagtttcttccgggtcattgacagaagcgtcaattcctgggagtagttcgttggttttctttcccctcatccttttgcctgctcccggcgaggggtggctttgatttcggcgatgagctcccagaaaggcaacgtggctcgttccagacctcagaagcaccagaatacgtttagcttcaaaaatgacaagttcgataaaagtgtgcagaccaagaaaattaatgcaaaacttcatgatggagtatgtcagcgctgtaaagaagttcttgagtggcgtgtaaaatacagcaaatacaaaccattatcaaaacctaaaaagtgatggagtctccctctgttgcccaggctggagtgcagtggcaggatcttgggctcaccacaacctccgcctcccttgttcaagtgattctcctgcctcagcctctcgagtatagctgggattacaggcacacaccaccatgcccagctaatttttgtatttttagtagaaacaggttttcacaatgttggccaggatggtctccatctactgaccttgtgatccgcccccctaggcctcccaaagtgctgggcttacaggcatgagccactgcacccagccgactgaacatcttttcatgtgtttattagccaatcctatatcttcac

SEQ ID NO: 277728 - DNA, 802 bp, Homo sapiens
  misc_feature (3)..(4): n is a, c, g, or t
ggnncgaggctgcgccgcgtggagtggcttggcttaacagcagggagggcagagcgatgctctttgacctcccagaagagtcacgtgggctgacccagagccggggcggaaaggctgcgttagtttcttccgggtcattgacagaagcgtcaattcctgggagtagttcgttggttttctttcccctcatccttttgcctgctcccggcgaggggtggctttgatttcggcgatgagctcccagaaaggcaacgtggctcgttccagacctcagaagcaccagaatacgtttagcttcaaaaatgacaagttcgataaaagtgtgcagaccaaggtaggaacctgcctgttgcaccgtctttgactccaggaaggaatggctcactggagaggggagagaggaaatgagaggagtcggctggggcgagtgtggaccgcagcccagagttagtcttggctgcagtgcaactctttcttatttgatggtcagcacacttaactaattgcagagtgaacaggaccctaatgaaatctaaggtgcagatggggcagttacgtcgttcagcgttcccatctggatcacattagcagagggaaacgaggattgtggcatgagtggctctttcaaattttacaccaagtttatgcagctacgatttttttttccaaaaaccccaagcccatagaggaaatgtgaatgattaagctgtcttaggctgtcctcactagtattgtgtgaaatttctgttttgtaacaattgttttgaagataaaaatatttggttaatgtaaaaatacttgt

SEQ ID NO: 277729 - DNA, 1430 bp, Homo sapiens
  misc_feature (3)..(4): n is a, c, g, or t
ggnncgaggctgcgccgcgtggagtggcttggcttaacagcagggagggcagagcgatgctctttgacctcccagaagagtcacgtgggctgacccagagccggggcggaaaggctgcgttagtttcttccgggtcattgacagaagcgtcaattcctgggagtagttcgttggttttctttcccctcatccttttgcctgctcccggcgaggggtggctttgatttcggcgatgagctcccagaaaggcaacgtggctcgttccagacctcagaagcaccagaatacgtttagcttcaaaaatgacaagttcgataaaagtgtgcagaccaagtgttaaatgtttacaaaagacagtgaaggattcttatcacataatgtgcaggccatgtgcctgtgaacttgaagtttgcgcaaaatgtggaaagaaagaagacattgttattccgttgaataaagaaacagaaaaaatagaacatactgaaaataatctaagttccaaccatagaagaagctgcagaagaaatgaagaaagtgatgatgatttagattttgatattgatttagaagacacaggaggagaccatcaaatgaattaatatcactgtattaaaagtctgccgggcacagtggctcacgcctgtaatcccaacactttgggaggccaaggagggtggatcacctgaggtcaggagttcgagaccagcctggccaacatggcggaaccccatctccactaaaagtacaaaaaattagctgggcgtggtggctcatgcctgtaatcccagctactcaggaggctgaggcaggaggattgcttgaaccctggaggcggagattgaagtgagctgagttcgtgccattacactccagcctgggtgacagagtgagactctgtctcaaaaaaaataaaataaaaagtcaatttagaatgtgaaattctgaccaccttttggctttgagtattttccaaaagatatttgaaatcctaatgaggaaatcagaaaaagctatggaaaaatagacaaatttcatacatgaacaatataaattgtgtatattacttaacatcaaactaaacaagattcagaattgatggttgtataagaactagctcatgtaaaaataaaataacattattacattgcctcaaaaattggtcctcggtaagtgccttttgataaatgatctcaaataaatgactcatagcaaaagccctgtcgcttatgtttaatttttacaaagtaaaagcaattttttccaaataataatgtttaacaagcgtatagcaattctgctttgtatttttatatatttcatcacattttaacttttttctcgtgaaatgtacatacagaaaaagtgcatataatttatacactttataagtgtatgcattttttataataattataaaggaaagttcatgc

SEQ ID NO: 277730 - DNA, 856 bp, Homo sapiens
  misc_feature (3)..(4): n is a, c, g, or t
ggnncgaggctgcgccgcgtggagtggcttggcttaacagcagggagggcagagcgatgctctttgacctcccagaagagtcacgtgggctgacccagagccggggcggaaaggctgcgttagtttcttccgggtcattgacagaagcgtcaattcctgggagtagttcgttggttttctttcccctcatccttttgcctgctcccggcgaggggtggctttgatttcggcgatgagctcccagaaaggcaacgtggctcgttccagacctcagaagcaccagaatacgtttagcttcaaaaatgacaagttcgataaaagtgtgcagaccaaggtaggaacctgcctgttgcaccgtctttgactccaggaaggaatggctcactggagaggggagagaggaaatgagaggagtcggctggggcgagtgtggaccgcagcccagagttagtcttggctgcagtgcaactctttctaaaatgttattctcacgccctttctttgacctggacatgttgtctcctggtaaatatttgatggtcagcacacttaactaattgcagagtgaacaggaccctaatgaaatctaaggtgcagatggggcagttacgtcgttcagcgttcccatctggatcacattagcagagggaaacgaggattgtggcatgagtggctctttcaaattttacaccaagtttatgcagctacgatttttttttccaaaaaccccaagcccatagaggaaatgtgaatgattaagctgtcttaggctgtcctcactagtattgtgtgaaatttctgttttgtaacaattgttttgaagataaaaatatttggttaatgtaaaaatacttgt

SEQ ID NO: 277731 - DNA, 769 bp, Homo sapiens
  misc_feature (3)..(4): n is a, c, g, or t
ggnncgaggctgcgccgcgtggagtggcttggcttaacagcagggagggcagagcgatgctctttgacctcccagaagagtcacgtgggctgacccagagccggggcggaaaggctgcgttagtttcttccgggtcattgacagaagcgtcaattcctgggagtagttcgttggttttctttcccctcatccttttgcctgctcccggcgaggggtggctttgatttcggcgatgagctcccagaaaggcaacgtggctcgttccagacctcagaagcaccagaatacgtttagcttcaaaaatgacaagttcgataaaagtgtgcagaccaagaaaattaatgcaaaacttcatgatggagtatgtcagcgctgtaaagaagttcttgagtggcgtgtaaaatacagcaaatacaaaccattatcaaaacctaaaaagtgatggagtctccctctgttgcccaggctggagtgcagtggcaggatcttgggctcaccacaacctccgcctcccttgttcaagtgattctcctgcctcagcctctcgagtagctgggactacaggcgcacaccaccatgcccagctaatctttgtatttttagtagagatggggtttcactatgttggccaggccggtctcgaactcctgacctcatgatctgcctgcctcaacctcccaaagtgctggaattacaggtgtgagccatcatgcctggcctaatttgtatatttctaatgactcatgatgttgactgagcatcttttctt

SEQ ID NO: 277732 - DNA, 812 bp, Homo sapiens
  misc_feature (3)..(4): n is a, c, g, or t
  misc_feature (692)..(692): n is a, c, g, or t
ggnncgaggctgcgccgcgtggagtggcttggcttaacagcagggagggcagagcgatgctctttgacctcccagaagagtcacgtgggctgacccagagccggggcggaaaggctgcgttagtttcttccgggtcattgacagaagcgtcaattcctgggagtagttcgttggttttctttcccctcatccttttgcctgctcccggcgaggggtggctttgatttcggcgatgagctcccagaaaggcaacgtggctcgttccagacctcagaagcaccagaatacgtttagcttcaaaaatgacaagttcgataaaagtgtgcagaccaagaaaattaatgcaaaacttcatgatggagtatgtcagcgctgtaaagaagttcttgagtggcgtgtaaaatacagcaaatacaaaccattatcaaaacctaaaaagtgatggagcctgggcaacaagagtgaaactccatctcaaataaataaataaataataaattaaaaaactaaaatcatctggccaactcattgaagcattggaagtgggagtaaaataacatggacaaaacccatcttgtctgtagaaggatcttgtaacacttactatctctgaggttccctctggtggcgatggcagcttaacggaggaggaacaagctaaatgaggaagacagaagtctgtcggtggacanttggagatcgatgctgctggccctccctgtctctgttccttctctttctagttcattttccatactgctgctgtgtttgttttcctaaaataccattttctgaatgaattcctgcctcca

SEQ ID NO: 277733 - DNA, 337 bp, Homo sapiens
aaaggaaccagtgggtctctagctgatgtatttgccaatactcgaatagagaatttctctgctcctcctgatgtcactacaactacctcttcctcctcatcatcttcctcaattcgcccagcaaacattgacctgcccccctcggggatagttaaaggcatgcacaaaggatccaacaggtccagccttatggatacagctgatggtgttcctgtcagtagcagagtatctacaaaaatccagcagcttctgaacactctgaaacgacccaaaaggcctcccttaaaggaattttttgtggatgactctgaagaaattgtggaaggtagtagtaaaa

SEQ ID NO: 277734 - DNA, 446 bp, Homo sapiens
tttactctatttcagcacccaaggacctaagacaggcagctgcatttcctaatcctgattccttaaagtaaactgttacagccagttagtgtgatcctggagtgtgtccagctgcagaggcaagagctagtacctgtgtggcagaccggaaatagatttcaaaatgcacagctgcagaattcaggagtagaatgaaggcctagggtcaagccctgtttttcatcgtgggctcctccattcacgctcgttgacacctttcctggccatgctgtttaacttccatgtcaagaaaaaaccctgacaaagcctggtaatactgacacaagtggagtgtacttaagcagagagggagtgatgttcactaggctgttgttcttccccaccctttggcatttgtgtcgtgtcctgacgccttgtttgtgtcttccgccttcagtgctgttccc

SEQ ID NO: 277735 - DNA, 510 bp, Homo sapiens
cgatggatctttgtctgaaggacttctcctggagaacactgtagtagatggaaccacaggagcatcaagggaagaattctttgatggttgctacaataattccagctgtgtatacctcctgggatcataatagaaatgaacctctgaagcatcttactgaagaaggcccctacgttgactgtccagctgactgtctctacccgactgctgtcccacacaatatgggccaggcgatggtattgcctttgcaaactaaatgaagttcctcaaagtgaagctggtggcgacttcagagttaacttttcaaatggccgggcttatatagaataacctttgtaaaagtaaactatgatcatataataagatacatgtgcatttggaacgccactgcttttggaacctgtctcagtttttatcatcatacaaggttaattgtctaatgtcaattagattttatcacagtgcatttgggtcctaatctggaacaataaaagtctattaaacagcaaa

SEQ ID NO: 277736 - DNA, 6653 bp, Homo sapiens
gcgtgagcctgtgcgtgtgctcacacgcgcattttggcagggctgaatcacaagaggactcgcagttgatacccagactcaccaaaaaattgagctgtgaatttggggaggcaggtacgtgctgggaaggaagctaaaggagaacaacagctttgtgtgctgatgaagtaaacagacagttgcagatctgatctcttctgaacacctcatcgtgtctccatccctgggaatctgaccctagcaactggaccactttgttcttggaattttgggtgtcctcttttctcacctttcccttttcccttttccccttccccctcctgagaactccggaagactgtagagattgtcatggagtccagggaaaccttaagcagctcccggcaaagagggggcgagtcagacttcctgccggtctcctcagccaagcccccagctgctcctggctgtgcaggagaacctttgctctccactccaggacctgggaaggggatcccggtgggcggagagcgcatggagccagaggaggaggatgaactaggctcagggcgggatgtggattccaactccaacgcggacagtgagaaatgggtggcaggagatggtttggaagagcaggaattttctatcaaggaggcaaacttcacagagggaagtctgaagctaaagattcagaccacaaagcgggctaagaaacccccaaagaatttggagaactatatatgtccacctgagatcaagatcaccatcaagcagtctggggaccagaaggtgtcccgtgctggaaaaaatagcaaagccacgaaggaggaagaaagaagccactccaaaaagaagctcctcacagccagtgaccttgcagccagtgacctcaaaggatttcagccacaggcttacgaaaggccccagaaacattcaactctccattatgacacgggcctcccacaggacttcaccggtgacaccttaaaaccaaagcaccagcaaaaaagcagcagccagaaccacatggactggtccaccaactctgacagcggacccgtcactcagaattgcttcatcagtccagagtctggcagagaaactgcaagcaccagcaagatccccgctcttgagcccgtggcttcctttgcaaaggcccagggtaagaaaggcagtgcagggaacacgtggagtcagttgtctaacaataacaaagatctgctcttgggaggtgtggctccatccccaagcagccacagctcaccagccccacccagcagctctgctgagtgcaacgggcttcagcccttggtggatcaagatggaggaggtacaaaggagcccccagaaccacctacggtgggcagcaagaaaaagtccagtaaaaaagatgtgataagtcagaccataccaaacccagacctggattgggtcaagaatgcccagaaagcatttgacaatacagaagggaaaagggaaggttattccgcagatagtgcccaagaggcatcaccagccaggcagaacgtgagttctgccagtaatcctgaaaatgactcaagtcatgtccggattactatccccatcaaggcaccctctctggatccaaccaaccataagaggaaaaaaagacagtccattaaagcggtggtggaaaagatcatgccagagaaagccttggcttctggaatcaccatgagcagtgaagtagttaacaggatactttccaactctgaggggaataagaaggatccccgtgtccctaagttgagtaaaatgatagagaatgagtccccctcagttggccttgaaactggtggaaatgctgagaaagttatcccaggaggtgtgtctaagccgcggaagccacccatggtcatgacacctccaacgtgcacagatcactctccatccagaaagctgccagaaatccagcatccaaaatttgctgcaaaacgaaggtggacttgcagcaaaccaaaacctagcaccatgcttcgagaggcagttatggccacctctgataaactgatgctggagcccccgtctgcatatcccatcaccccatccagccctctctacaccaacacagacagtcttactgtgatcactccagtcaaaaagaagcggggacgaccaaagaagcagcctttgctcacagtcgagacgattcatgagggaacttccaccagccccgtcagtcccatcagccgagagtttcctggcactaagaaaagaaagcgacgacgcaatttagcgaagttggcccagctagtgccgggagaggacaaacccatgagcgagatgaaatttcacaagaaagttggaaagctcggcgtgttggataagaagaccatcaaaactatcaataagatgaagacactcaagaggaaaaacatcttgaatcagatcttgtcctgttccagcagcgttgctctgaaggcaaaagctcccccagagaccagccctggggcagcagccattgaaagcaaactgggcaagcagattaatgtcagcaagaggggaaccatctacattggcaagaagcggggcaggaagccaagagcagagctgccacccccatccgaagaacccaaaacagccatcaagcaccccaggcctgtttctagccagccggatgttccagccgtgccttccaactttcagtcacttgtggcgtcttcaccagcagctatgcacccactttcaacacagttaggtgggtccaatggcaacctgagccctgccagcactgaaaccaatttttcagagttgaaaactatgccaaatctccagcccatcagtgctcttccaaccaaaacccaaaagggaatacacagtggaacctggaagctgtctccacccagactgatggccaactccccttcacacctgtgcgagattggctccctaaaggaaatcacgctgtcccctgtgagcgagtcccacagtgaggagacgatccccagcgacagcggcattgggacagacaacaacagcacttctgaccaagcggagaagagctcagaatcccgaaggaggtactcttttgatttctgctccctggacaacccggaggccattccgtccgacaccagcacaaagaaccggcatggccaccggcaaaagcatctcattgtggacaactttctggcccacgaaagcctcaagaagccaaagcacaagaggaaacggaaaagcctgcaaaaccgcgatgacctccagtttctggcagacctggaggagctaatcaccaagttccaagtgttcagaatctcccaccggagttacaccttctaccacgagaatccatatcccagcatttttcggattaattttgatcactattacccggtgccatatatccagtatgacccgttgctctatcttcgtaggacttcagacttgaagtcaaagaagaagcgtggtaggcctgcaaaaaccaatgacaccatgacaaaggtgccttttttacaagggttcagctaccctattcccagtggaagttactatgcaccctatggaatgccttacacatcaatgcctatgatgaaccttggttattacggtcagtacccagctcctttgtacctatcgcacacgcttggagcagcttccccattcatgaggccaacagtgccaccacctcagttccacacaaactcccacataaagatgtccggtgcagctaagcataaagccaagcatggagtacacctgcagggacctgttagcatgggccttggtgacatgcagccttctctgaaccctcccaaggtaggcagtgccagtctgtccagtggtcggctccataagaggaaacacaaacacaagcataagcacaaggaagaccggatcctagggacccatgacaacctgagtggtctttttgcaggcaaagccacaggcttctccagccacatcctgagcgagcggctgagtagcgcagacaaagagctcccgctggtgagtgagaagaacaagcataaggagaaacagaagcaccagcacagcgaagccggccacaaagcttctaagaacaactttgaggtggacaccctgtctacactgtcactttccgacgcccagcattggacacaggccaaggaaaaaggagacttgagcagtgagcctgtggactcatgcacgaaaagatactctggcagtggcggggatggtggcagcacgagatcggagaacctggacgtgttcagtgaaatgaacccttcgaatgacaagtgggacagtgacgtgagtgggagtaaaaggaggagctatgaaggctttggaacgtacagggaaaaggacatccaagccttcaagatgaaccgcaaggagagaagttcttatgactcctccatgtctccagggatgccaagtccccacttaaaagtggaccagacagcagtgcatagtaagaacgaaggctcagtgcccaccatgatgaccaggaagaagccagccgcagttgacagtgttacaattccaccagccccagtgttatctctccttgctgcatctgcagcaacgtcggatgcagtcggctcctccctgaagaagaggttcaagcggcgggagatcgaagccatccagtgcgaagtgcggaagatgtgcaactacaccaagatcctgtccaccaagaagaacctggaccacgtgaacaagatcctgaaggccaagcggctgcagagacaatcaaaaacaggcaacaacttcgtgaagaagaggcgcgggcgtcccaggaagcagcccacccagttcgatgaggactccagagaccaaatgccggtgctggaaaaatgcatcgacctgcccagcaaaagaggccagaagcccagcctgagcccgctggtgctggagcccgccgccagccaagacaccatcatggccaccatcgaggcggtcatccacatggcccgggaggcgccgcccctgcccccgccaccgccgccgcccctgccgccaccgccgccaccacccctgcccccgccaccccctctacccaagaccccccgaggcggaaagaggaaacacaaaccgcaggcccccgctcagcccccacagcagtcgcccccgcagcagccccttccccaggaagaggaggtgaaagccaaaaggcagaggaagtcccgagggagtgagagcgaggtccttccctagggcgggtctgggcgtctgcacctggggcctagggaactgacacgtgggaagcgcagtgagccggggcgggggcggaatcccccgctgcagggacacccacgcccttctctccagaagccgggcaggcagaatccggccagacgacggggctgagccatcaggagctcttgggaaagcaaagcagggagacaccttcagaagaagcttgtctgagcttcaccgcagctcccaccacgcggcgcttcagtacggctggatcctccgcaggcgagcggaaggcccccaggaggagcaggctggtggcactctcctgacctcacgctgccaaggtgcgccctcgactcccgatttcatttgctggccaggaaaatcgaaagggaaacaccctcaattaggaaacattccaaggggagaaaagctgcaaattgctcaactggcattgctgtaacccgttccatttaattggtttttatttcttttgattttcaagctctgctaagctttggggtaccaacgtcatcttcaggtgacctgaatctttcccttaaccgtacagtttctcgatggaattgtgtgatcagaaggtggaattctagtgataggcgacctcagacccgcattcatgttctgtgtgcctcttctattgcacatacactgatttttagcattgtctattcctatttttcctttgcccattgtacttccatatatcttttcattaacttacttgctgccttttttttttcttggtacacatttaaataaagtaatccttaacctgtgctgtaaagttcacccttggcatgctgttccaagaacctgggtttgaatcccaatcgttgtgaaacatactcagtattgataaaacctttttaataagtgatgcagagcagccaaggatatgttgacccagatgtcaaccaggctatttttatacttaaaacatgtcagcagagcataggcagaataaaatggtttaaataccccacagcaaatagagtaactgacaaaccaccaaaaactgaaaccccagacccaccagaaagacaagtgtctagcaatgccttggtacctgatctttttcattcaaataattgtcataggttgttcaaaaaaaaaaaaaaaaaggaaacaaaaacacaatagaagtccattatcccttgataattatttcttaaaagcaaatgggagtaagtgttcttatctggaaaaataaataaataaaatgctcaaagggtatcaccacttcaattttatcaagccaccttggacaaagtatccaaattgtggttgccttaataaactaaaacattattgtacataatgtaattataaatctatcagtctgcatggatgcaaactgtgtgtgacaaatcgtcttttaaatggtcaatttcagctgtacatttctcatccaagttgtactctagccattggtttagcgtggacagatactccatctctattatccatttccacagcccaaataaaatatgttaagcaggctcaaa

SEQ ID NO: 277737 - DNA, 6290 bp, Homo sapiens
tgtaacttgcaggttaagtggagctagagagctacattgtaacctagttggatttttttggggggggaatgtatcagaatctaacgtgtcgttaatagaaagaagaacaggcaagaagtggtccagccggcgaagttgcagatctgatctcttctgaacacctcatcgtgtctccatccctgggaatctgaccctagcaactggaccactttgttcttggaattttgggtggcaggagatggtttggaagagcaggaattttctatcaaggaggcaaacttcacagagggaagtctgaagctaaagattcagaccacaaagcgggctaagaaacccccaaagaatttggagaactatatatgtccacctgagatcaagatcaccatcaagcagtctggggaccagaaggtgtcccgtgctggaaaaaatagcaaagccacgaaggaggaagaaagaagccactccaaaaagaagctcctcacagccagtgaccttgcagccagtgacctcaaaggatttcagccacaggcttacgaaaggccccagaaacattcaactctccattatgacacgggcctcccacaggacttcaccggtgacaccttaaaaccaaagcaccagcaaaaaagcagcagccagaaccacatggactggtccaccaactctgacagcggacccgtcactcagaattgcttcatcagtccagagtctggcagagaaactgcaagcaccagcaagatccccgctcttgagcccgtggcttcctttgcaaaggcccagggtaagaaaggcagtgcagggaacacgtggagtcagttgtctaacaataacaaagatctgctcttgggaggtgtggctccatccccaagcagccacagctcaccagccccacccagcagctctgctgagtgcaacgggcttcagcccttggtggatcaagatggaggaggtacaaaggagcccccagaaccacctacggtgggcagcaagaaaaagtccagtaaaaaagatgtgataagtcagaccataccaaacccagacctggattgggtcaagaatgcccagaaagcatttgacaatacagaagggaaaagggaaggttattccgcagatagtgcccaagaggcatcaccagccaggcagaacgtgagttctgccagtaatcctgaaaatgactcaagtcatgtccggattactatccccatcaaggcaccctctctggatccaaccaaccataagaggaaaaaaagacagtccattaaagcggtggtggaaaagatcatgccagagaaagccttggcttctggaatcaccatgagcagtgaagtagttaacaggatactttccaactctgaggggaataagaaggatccccgtgtccctaagttgagtaaaatgatagagaatgagtccccctcagttggccttgaaactggtggaaatgctgagaaagttatcccaggaggtgtgtctaagccgcggaagccacccatggtcatgacacctccaacgtgcacagatcactctccatccagaaagctgccagaaatccagcatccaaaatttgctgcaaaacgaaggtggacttgcagcaaaccaaaacctagcaccatgcttcgagaggcagttatggccacctctgataaactgatgctggagcccccgtctgcatatcccatcaccccatccagccctctctacaccaacacagacagtcttactgtgatcactccagtcaaaaagaagcggggacgaccaaagaagcagcctttgctcacagtcgagacgattcatgagggaacttccaccagccccgtcagtcccatcagccgagagtttcctggcactaagaaaagaaagcgacgacgcaatttagcgaagttggcccagctagtgccgggagaggacaaacccatgagcgagatgaaatttcacaagaaagttggaaagctcggcgtgttggataagaagaccatcaaaactatcaataagatgaagacactcaagaggaaaaacatcttgaatcagatcttgtcctgttccagcagcgttgctctgaaggcaaaagctcccccagagaccagccctggggcagcagccattgaaagcaaactgggcaagcagattaatgtcagcaagaggggaaccatctacattggcaagaagcggggcaggaagccaagagcagagctgccacccccatccgaagaacccaaaacagccatcaagcaccccaggcctgtttctagccagccggatgttccagccgtgccttccaactttcagtcacttgtggcgtcttcaccagcagctatgcacccactttcaacacagttaggtgggtccaatggcaacctgagccctgccagcactgaaaccaatttttcagagttgaaaactatgccaaatctccagcccatcagtgctcttccaaccaaaacccaaaagggaatacacagtggaacctggaagctgtctccacccagactgatggccaactccccttcacacctgtgcgagattggctccctaaaggaaatcacgctgtcccctgtgagcgagtcccacagtgaggagacgatccccagcgacagcggcattgggacagacaacaacagcacttctgaccaagcggagaagagctcagaatcccgaaggaggtactcttttgatttctgctccctggacaacccggaggccattccgtccgacaccagcacaaagaaccggcatggccaccggcaaaagcatctcattgtggacaactttctggcccacgaaagcctcaagaagccaaagcacaagaggaaacggaaaagcctgcaaaaccgcgatgacctccagtttctggcagacctggaggagctaatcaccaagttccaagtgttcagaatctcccaccggagttacaccttctaccacgagaatccatatcccagcatttttcggattaattttgatcactattacccggtgccatatatccagtatgacccgttgctctatcttcgtaggacttcagacttgaagtcaaagaagaagcgtggtaggcctgcaaaaaccaatgacaccatgacaaaggtgccttttttacaagggttcagctaccctattcccagtggaagttactatgcaccctatggaatgccttacacatcaatgcctatgatgaaccttggttattacggtcagtacccagctcctttgtacctatcgcacacgcttggagcagcttccccattcatgaggccaacagtgccaccacctcagttccacacaaactcccacataaagatgtccggtgcagctaagcataaagccaagcatggagtacacctgcagggacctgttagcatgggccttggtgacatgcagccttctctgaaccctcccaaggtaggcagtgccagtctgtccagtggtcggctccataagaggaaacacaaacacaagcataagcacaaggaagaccggatcctagggacccatgacaacctgagtggtctttttgcaggcaaagccacaggcttctccagccacatcctgagcgagcggctgagtagcgcagacaaagagctcccgctggtgagtgagaagaacaagcataaggagaaacagaagcaccagcacagcgaagccggccacaaagcttctaagaacaactttgaggtggacaccctgtctacactgtcactttccgacgcccagcattggacacaggccaaggaaaaaggagacttgagcagtgagcctgtggactcatgcacgaaaagatactctggcagtggcggggatggtggcagcacgagatcggagaacctggacgtgttcagtgaaatgaacccttcgaatgacaagtgggacagtgacgtgagtgggagtaaaaggaggagctatgaaggctttggaacgtacagggaaaaggacatccaagccttcaagatgaaccgcaaggagagaagttcttatgactcctccatgtctccagggatgccaagtccccacttaaaagtggaccagacagcagtgcatagtaagaacgaaggctcagtgcccaccatgatgaccaggaagaagccagccgcagttgacagtgttacaattccaccagccccagtgttatctctccttgctgcatctgcagcaacgtcggatgcagtcggctcctccctgaagaagaggttcaagcggcgggagatcgaagccatccagtgcgaagtgcggaagatgtgcaactacaccaagatcctgtccaccaagaagaacctggaccacgtgaacaagatcctgaaggccaagcggctgcagagacaatcaaaaacaggcaacaacttcgtgaagaagaggcgcgggcgtcccaggaagcagcccacccagttcgatgaggactccagagaccaaatgccggtgctggaaaaatgcatcgacctgcccagcaaaagaggccagaagcccagcctgagcccgctggtgctggagcccgccgccagccaagacaccatcatggccaccatcgaggcggtcatccacatggcccgggaggcgccgcccctgcccccgccaccgccgccgcccctgccgccaccgccgccaccacccctgcccccgccaccccctctacccaagaccccccgaggcggaaagaggaaacacaaaccgcaggcccccgctcagcccccacagcagtcgcccccgcagcagccccttccccaggaagaggaggtgaaagccaaaaggcagaggaagtcccgagggagtgagagcgaggtccttccctagggcgggtctgggcgtctgcacctggggcctagggaactgacacgtgggaagcgcagtgagccggggcgggggcggaatcccccgctgcagggacacccacgcccttctctccagaagccgggcaggcagaatccggccagacgacggggctgagccatcaggagctcttgggaaagcaaagcagggagacaccttcagaagaagcttgtctgagcttcaccgcagctcccaccacgcggcgcttcagtacggctggatcctccgcaggcgagcggaaggcccccaggaggagcaggctggtggcactctcctgacctcacgctgccaaggtgcgccctcgactcccgatttcatttgctggccaggaaaatcgaaagggaaacaccctcaattaggaaacattccaaggggagaaaagctgcaaattgctcaactggcattgctgtaacccgttccatttaattggtttttatttcttttgattttcaagctctgctaagctttggggtaccaacgtcatcttcaggtgacctgaatctttcccttaaccgtacagtttctcgatggaattgtgtgatcagaaggtggaattctagtgataggcgacctcagacccgcattcatgttctgtgtgcctcttctattgcacatacactgatttttagcattgtctattcctatttttcctttgcccattgtacttccatatatcttttcattaacttacttgctgccttttttttttcttggtacacatttaaataaagtaatccttaacctgtgctgtaaagttcacccttggcatgctgttccaagaacctgggtttgaatcccaatcgttgtgaaacatactcagtattgataaaacctttttaataagtgatgcagagcagccaaggatatgttgacccagatgtcaaccaggctatttttatacttaaaacatgtcagcagagcataggcagaataaaatggtttaaataccccacagcaaatagagtaactgacaaaccaccaaaaactgaaaccccagacccaccagaaagacaagtgtctagcaatgccttggtacctgatctttttcattcaaataattgtcataggttgttcaaaaaaaaaaaaaaaaaggaaacaaaaacacaatagaagtccattatcccttgataattatttcttaaaagcaaatgggagtaagtgttcttatctggaaaaataaataaataaaatgctcaaagggtatcaccacttcaattttatcaagccaccttggacaaagtatccaaattgtggttgccttaataaactaaaacattattgtacataatgtaattataaatctatcagtctgcatggatgcaaactgtgtgtgacaaatcgtcttttaaatggtcaatttcagctgtacatttctcatccaagttgtactctagccattggtttagcgtggacagatactccatctctattatccatttccacagcccaaataaaatatgttaagcaggctcaaa

SEQ ID NO: 277738 - DNA, 5134 bp, Homo sapiens
ctggcttcctgctctgccatcctggtctgcttcctgcttctatccccatcaaggcaccctctctggatccaaccaaccataagaggaaaaaaagacagtccattaaagcggtggtggaaaagatcatgccagagaaagccttggcttctggaatcaccatgagcagtgaagtagttaacaggatactttccaactctgaggggaataagaaggatccccgtgtccctaagttgagtaaaatgatagagaatgagtccccctcagttggccttgaaactggtggaaatgctgagaaagttatcccaggaggtgtgtctaagccgcggaagccacccatggtcatgacacctccaacgtgcacagatcactctccatccagaaagctgccagaaatccagcatccaaaatttgctgcaaaacgaaggtggacttgcagcaaaccaaaacctagcaccatgcttcgagaggcagttatggccacctctgataaactgatgctggagcccccgtctgcatatcccatcaccccatccagccctctctacaccaacacagacagtcttactgtgatcactccagtcaaaaagaagcggggacgaccaaagaagcagcctttgctcacagtcgagacgattcatgagggaacttccaccagccccgtcagtcccatcagccgagagtttcctggcactaagaaaagaaagcgacgacgcaatttagcgaagttggcccagctagtgccgggagaggacaaacccatgagcgagatgaaatttcacaagaaagttggaaagctcggcgtgttggataagaagaccatcaaaactatcaataagatgaagacactcaagaggaaaaacatcttgaatcagatcttgtcctgttccagcagcgttgctctgaaggcaaaagctcccccagagaccagccctggggcagcagccattgaaagcaaactgggcaagcagattaatgtcagcaagaggggaaccatctacattggcaagaagcggggcaggaagccaagagcagagctgccacccccatccgaagaacccaaaacagccatcaagcaccccaggcctgtttctagccagccggatgttccagccgtgccttccaactttcagtcacttgtggcgtcttcaccagcagctatgcacccactttcaacacagttaggtgggtccaatggcaacctgagccctgccagcactgaaaccaatttttcagagttgaaaactatgccaaatctccagcccatcagtgctcttccaaccaaaacccaaaagggaatacacagtggaacctggaagctgtctccacccagactgatggccaactccccttcacacctgtgcgagattggctccctaaaggaaatcacgctgtcccctgtgagcgagtcccacagtgaggagacgatccccagcgacagcggcattgggacagacaacaacagcacttctgaccaagcggagaagagctcagaatcccgaaggaggtactcttttgatttctgctccctggacaacccggaggccattccgtccgacaccagcacaaagaaccggcatggccaccggcaaaagcatctcattgtggacaactttctggcccacgaaagcctcaagaagccaaagcacaagaggaaacggaaaagcctgcaaaaccgcgatgacctccagtttctggcagacctggaggagctaatcaccaagttccaagtgttcagaatctcccaccggagttacaccttctaccacgagaatccatatcccagcatttttcggattaattttgatcactattacccggtgccatatatccagtatgacccgttgctctatcttcgtaggacttcagacttgaagtcaaagaagaagcgtggtaggcctgcaaaaaccaatgacaccatgacaaaggtgccttttttacaagggttcagctaccctattcccagtggaagttactatgcaccctatggaatgccttacacatcaatgcctatgatgaaccttggttattacggtcagtacccagctcctttgtacctatcgcacacgcttggagcagcttccccattcatgaggccaacagtgccaccacctcagttccacacaaactcccacataaagatgtccggtgcagctaagcataaagccaagcatggagtacacctgcagggacctgttagcatgggccttggtgacatgcagccttctctgaaccctcccaaggtaggcagtgccagtctgtccagtggtcggctccataagaggaaacacaaacacaagcataagcacaaggaagaccggatcctagggacccatgacaacctgagtggtctttttgcaggcaaagccacaggcttctccagccacatcctgagcgagcggctgagtagcgcagacaaagagctcccgctggtgagtgagaagaacaagcataaggagaaacagaagcaccagcacagcgaagccggccacaaagcttctaagaacaactttgaggtggacaccctgtctacactgtcactttccgacgcccagcattggacacaggccaaggaaaaaggagacttgagcagtgagcctgtggactcatgcacgaaaagatactctggcagtggcggggatggtggcagcacgagatcggagaacctggacgtgttcagtgaaatgaacccttcgaatgacaagtgggacagtgacgtgagtgggagtaaaaggaggagctatgaaggctttggaacgtacagggaaaaggacatccaagccttcaagatgaaccgcaaggagagaagttcttatgactcctccatgtctccagggatgccaagtccccacttaaaagtggaccagacagcagtgcatagtaagaacgaaggctcagtgcccaccatgatgaccaggaagaagccagccgcagttgacagtgttacaattccaccagccccagtgttatctctccttgctgcatctgcagcaacgtcggatgcagtcggctcctccctgaagaagaggttcaagcggcgggagatcgaagccatccagtgcgaagtgcggaagatgtgcaactacaccaagatcctgtccaccaagaagaacctggaccacgtgaacaagatcctgaaggccaagcggctgcagagacaatcaaaaacaggcaacaacttcgtgaagaagaggcgcgggcgtcccaggaagcagcccacccagttcgatgaggactccagagaccaaatgccggtgctggaaaaatgcatcgacctgcccagcaaaagaggccagaagcccagcctgagcccgctggtgctggagcccgccgccagccaagacaccatcatggccaccatcgaggcggtcatccacatggcccgggaggcgccgcccctgcccccgccaccgccgccgcccctgccgccaccgccgccaccacccctgcccccgccaccccctctacccaagaccccccgaggcggaaagaggaaacacaaaccgcaggcccccgctcagcccccacagcagtcgcccccgcagcagccccttccccaggaagaggaggtgaaagccaaaaggcagaggaagtcccgagggagtgagagcgaggtccttccctagggcgggtctgggcgtctgcacctggggcctagggaactgacacgtgggaagcgcagtgagccggggcgggggcggaatcccccgctgcagggacacccacgcccttctctccagaagccgggcaggcagaatccggccagacgacggggctgagccatcaggagctcttgggaaagcaaagcagggagacaccttcagaagaagcttgtctgagcttcaccgcagctcccaccacgcggcgcttcagtacggctggatcctccgcaggcgagcggaaggcccccaggaggagcaggctggtggcactctcctgacctcacgctgccaaggtgcgccctcgactcccgatttcatttgctggccaggaaaatcgaaagggaaacaccctcaattaggaaacattccaaggggagaaaagctgcaaattgctcaactggcattgctgtaacccgttccatttaattggtttttatttcttttgattttcaagctctgctaagctttggggtaccaacgtcatcttcaggtgacctgaatctttcccttaaccgtacagtttctcgatggaattgtgtgatcagaaggtggaattctagtgataggcgacctcagacccgcattcatgttctgtgtgcctcttctattgcacatacactgatttttagcattgtctattcctatttttcctttgcccattgtacttccatatatcttttcattaacttacttgctgccttttttttttcttggtacacatttaaataaagtaatccttaacctgtgctgtaaagttcacccttggcatgctgttccaagaacctgggtttgaatcccaatcgttgtgaaacatactcagtattgataaaacctttttaataagtgatgcagagcagccaaggatatgttgacccagatgtcaaccaggctatttttatacttaaaacatgtcagcagagcataggcagaataaaatggtttaaataccccacagcaaatagagtaactgacaaaccaccaaaaactgaaaccccagacccaccagaaagacaagtgtctagcaatgccttggtacctgatctttttcattcaaataattgtcataggttgttcaaaaaaaaaaaaaaaaaggaaacaaaaacacaatagaagtccattatcccttgataattatttcttaaaagcaaatgggagtaagtgttcttatctggaaaaataaataaataaaatgctcaaagggtatcaccacttcaattttatcaagccaccttggacaaagtatccaaattgtggttgccttaataaactaaaacattattgtacataatgtaattataaatctatcagtctgcatggatgcaaactgtgtgtgacaaatcgtcttttaaatggtcaatttcagctgtacatttctcatccaagttgtactctagccattggtttagcgtggacagatactccatctctattatccatttccacagcccaaataaaatatgttaagcaggctcaaa

SEQ ID NO: 277739 - DNA, 6554 bp, Homo sapiens
agctaggactgggagagataggagaagtaggactgctgtgattaggacggatcagacgaagaggggcgtttggtattgggttgcagatctgatctcttctgaacacctcatcgtgtctccatccctgggaatctgaccctagcaactggaccactttgttcttggaattttgggtgtcctcttttctcacctttcccttttcccttttccccttccccctcctgagaactccggaagactgtagagattgtcatggagtccagggaaaccttaagcagctcccggcaaagagggggcgagtcagacttcctgccggtctcctcagccaagcccccagctgctcctggctgtgcaggagaacctttgctctccactccaggacctgggaaggggatcccggtgggcggagagcgcatggagccagaggaggaggatgaactaggctcagggcgggatgtggattccaactccaacgcggacagtgagaaatgggtggcaggagatggtttggaagagcaggaattttctatcaaggaggcaaacttcacagagggaagtctgaagctaaagattcagaccacaaagcgggctaagaaacccccaaagaatttggagaactatatatgtccacctgagatcaagatcaccatcaagcagtctggggaccagaaggtgtcccgtgctggaaaaaatagcaaagccacgaaggaggaagaaagaagccactccaaaaagaagctcctcacagccagtgaccttgcagccagtgacctcaaaggatttcagccacaggcttacgaaaggccccagaaacattcaactctccattatgacacgggcctcccacaggacttcaccggtgacaccttaaaaccaaagcaccagcaaaaaagcagcagccagaaccacatggactggtccaccaactctgacagcggacccgtcactcagaattgcttcatcagtccagagtctggcagagaaactgcaagcaccagcaagatccccgctcttgagcccgtggcttcctttgcaaaggcccagggtaagaaaggcagtgcagggaacacgtggagtcagttgtctaacaataacaaagatctgctcttgggaggtgtggctccatccccaagcagccacagctcaccagccccacccagcagctctgctgagtgcaacgggcttcagcccttggtggatcaagatggaggaggtacaaaggagcccccagaaccacctacggtgggcagcaagaaaaagtccagtaaaaaagatgtgataagtcagaccataccaaacccagacctggattgggtcaagaatgcccagaaagcatttgacaatacagaagggaaaagggaaggttattccgcagatagtgcccaagaggcatcaccagccaggcagaacgtgagttctgccagtaatcctgaaaatgactcaagtcatgtccggattactatccccatcaaggcaccctctctggatccaaccaaccataagaggaaaaaaagacagtccattaaagcggtggtggaaaagatcatgccagagaaagccttggcttctggaatcaccatgagcagtgaagtagttaacaggatactttccaactctgaggggaataagaaggatccccgtgtccctaagttgagtaaaatgatagagaatgagtccccctcagttggccttgaaactggtggaaatgctgagaaagttatcccaggaggtgtgtctaagccgcggaagccacccatggtcatgacacctccaacgtgcacagatcactctccatccagaaagctgccagaaatccagcatccaaaatttgctgcaaaacgaaggtggacttgcagcaaaccaaaacctagcaccatgcttcgagaggcagttatggccacctctgataaactgatgctggagcccccgtctgcatatcccatcaccccatccagccctctctacaccaacacagacagtcttactgtgatcactccagtcaaaaagaagcggggacgaccaaagaagcagcctttgctcacagtcgagacgattcatgagggaacttccaccagccccgtcagtcccatcagccgagagtttcctggcactaagaaaagaaagcgacgacgcaatttagcgaagttggcccagctagtgccgggagaggacaaacccatgagcgagatgaaatttcacaagaaagttggaaagctcggcgtgttggataagaagaccatcaaaactatcaataagatgaagacactcaagaggaaaaacatcttgaatcagatcttgtcctgttccagcagcgttgctctgaaggcaaaagctcccccagagaccagccctggggcagcagccattgaaagcaaactgggcaagcagattaatgtcagcaagaggggaaccatctacattggcaagaagcggggcaggaagccaagagcagagctgccacccccatccgaagaacccaaaacagccatcaagcaccccaggcctgtttctagccagccggatgttccagccgtgccttccaactttcagtcacttgtggcgtcttcaccagcagctatgcacccactttcaacacagttaggtgggtccaatggcaacctgagccctgccagcactgaaaccaatttttcagagttgaaaactatgccaaatctccagcccatcagtgctcttccaaccaaaacccaaaagggaatacacagtggaacctggaagctgtctccacccagactgatggccaactccccttcacacctgtgcgagattggctccctaaaggaaatcacgctgtcccctgtgagcgagtcccacagtgaggagacgatccccagcgacagcggcattgggacagacaacaacagcacttctgaccaagcggagaagagctcagaatcccgaaggaggtactcttttgatttctgctccctggacaacccggaggccattccgtccgacaccagcacaaagaaccggcatggccaccggcaaaagcatctcattgtggacaactttctggcccacgaaagcctcaagaagccaaagcacaagaggaaacggaaaagcctgcaaaaccgcgatgacctccagtttctggcagacctggaggagctaatcaccaagttccaagtgttcagaatctcccaccggagttacaccttctaccacgagaatccatatcccagcatttttcggattaattttgatcactattacccggtgccatatatccagtatgacccgttgctctatcttcgtaggacttcagacttgaagtcaaagaagaagcgtggtaggcctgcaaaaaccaatgacaccatgacaaaggtgccttttttacaagggttcagctaccctattcccagtggaagttactatgcaccctatggaatgccttacacatcaatgcctatgatgaaccttggttattacggtcagtacccagctcctttgtacctatcgcacacgcttggagcagcttccccattcatgaggccaacagtgccaccacctcagttccacacaaactcccacataaagatgtccggtgcagctaagcataaagccaagcatggagtacacctgcagggacctgttagcatgggccttggtgacatgcagccttctctgaaccctcccaaggtaggcagtgccagtctgtccagtggtcggctccataagaggaaacacaaacacaagcataagcacaaggaagaccggatcctagggacccatgacaacctgagtggtctttttgcaggcaaagccacaggcttctccagccacatcctgagcgagcggctgagtagcgcagacaaagagctcccgctggtgagtgagaagaacaagcataaggagaaacagaagcaccagcacagcgaagccggccacaaagcttctaagaacaactttgaggtggacaccctgtctacactgtcactttccgacgcccagcattggacacaggccaaggaaaaaggagacttgagcagtgagcctgtggactcatgcacgaaaagatactctggcagtggcggggatggtggcagcacgagatcggagaacctggacgtgttcagtgaaatgaacccttcgaatgacaagtgggacagtgacgtgagtgggagtaaaaggaggagctatgaaggctttggaacgtacagggaaaaggacatccaagccttcaagatgaaccgcaaggagagaagttcttatgactcctccatgtctccagggatgccaagtccccacttaaaagtggaccagacagcagtgcatagtaagaacgaaggctcagtgcccaccatgatgaccaggaagaagccagccgcagttgacagtgttacaattccaccagccccagtgttatctctccttgctgcatctgcagcaacgtcggatgcagtcggctcctccctgaagaagaggttcaagcggcgggagatcgaagccatccagtgcgaagtgcggaagatgtgcaactacaccaagatcctgtccaccaagaagaacctggaccacgtgaacaagatcctgaaggccaagcggctgcagagacaatcaaaaacaggcaacaacttcgtgaagaagaggcgcgggcgtcccaggaagcagcccacccagttcgatgaggactccagagaccaaatgccggtgctggaaaaatgcatcgacctgcccagcaaaagaggccagaagcccagcctgagcccgctggtgctggagcccgccgccagccaagacaccatcatggccaccatcgaggcggtcatccacatggcccgggaggcgccgcccctgcccccgccaccgccgccgcccctgccgccaccgccgccaccacccctgcccccgccaccccctctacccaagaccccccgaggcggaaagaggaaacacaaaccgcaggcccccgctcagcccccacagcagtcgcccccgcagcagccccttccccaggaagaggaggtgaaagccaaaaggcagaggaagtcccgagggagtgagagcgaggtccttccctagggcgggtctgggcgtctgcacctggggcctagggaactgacacgtgggaagcgcagtgagccggggcgggggcggaatcccccgctgcagggacacccacgcccttctctccagaagccgggcaggcagaatccggccagacgacggggctgagccatcaggagctcttgggaaagcaaagcagggagacaccttcagaagaagcttgtctgagcttcaccgcagctcccaccacgcggcgcttcagtacggctggatcctccgcaggcgagcggaaggcccccaggaggagcaggctggtggcactctcctgacctcacgctgccaaggtgcgccctcgactcccgatttcatttgctggccaggaaaatcgaaagggaaacaccctcaattaggaaacattccaaggggagaaaagctgcaaattgctcaactggcattgctgtaacccgttccatttaattggtttttatttcttttgattttcaagctctgctaagctttggggtaccaacgtcatcttcaggtgacctgaatctttcccttaaccgtacagtttctcgatggaattgtgtgatcagaaggtggaattctagtgataggcgacctcagacccgcattcatgttctgtgtgcctcttctattgcacatacactgatttttagcattgtctattcctatttttcctttgcccattgtacttccatatatcttttcattaacttacttgctgccttttttttttcttggtacacatttaaataaagtaatccttaacctgtgctgtaaagttcacccttggcatgctgttccaagaacctgggtttgaatcccaatcgttgtgaaacatactcagtattgataaaacctttttaataagtgatgcagagcagccaaggatatgttgacccagatgtcaaccaggctatttttatacttaaaacatgtcagcagagcataggcagaataaaatggtttaaataccccacagcaaatagagtaactgacaaaccaccaaaaactgaaaccccagacccaccagaaagacaagtgtctagcaatgccttggtacctgatctttttcattcaaataattgtcataggttgttcaaaaaaaaaaaaaaaaaggaaacaaaaacacaatagaagtccattatcccttgataattatttcttaaaagcaaatgggagtaagtgttcttatctggaaaaataaataaataaaatgctcaaagggtatcaccacttcaattttatcaagccaccttggacaaagtatccaaattgtggttgccttaataaactaaaacattattgtacataatgtaattataaatctatcagtctgcatggatgcaaactgtgtgtgacaaatcgtcttttaaatggtcaatttcagctgtacatttctcatccaagttgtactctagccattggtttagcgtggacagatactccatctctattatccatttccacagcccaaataaaatatgttaagcaggctcaaa

SEQ ID NO: 277740 - DNA, 5352 bp, Homo sapiens
gcgtgagcctgtgcgtgtgctcacacgcgcattttggcagggctgaatcacaagaggactcgcagttgatacccagactcaccaaaaaattgagctgtgaatttggggaggcaggtacgtgctgggaaggaagctaaaggagaacaacagctttgtgtgctgatgaagtaaacagacagttgcagatctgatctcttctgaacacctcatcgtgtctccatccctgggaatctgaccctagcaactggaccactttgttcttggaattttgggtgtcctcttttctcacctttcccttttcccttttccccttccccctcctgagaactccggaagactgtagagattgtcatggagtccagggaaaccttaagcagctcccggcaaagagggggcgagtcagacttcctgccggtctcctcagccaagcccccagctgctcctggctgtgcaggagaacctttgctctccactccaggacctgggaaggggatcccggtgggcggagagcgcatggagccagaggaggaggatgaactaggctcagggcgggatgtggattccaactccaacgcggacagtgagaaatgggtggcaggagatggtttggaagagcaggaattttctatcaaggaggcaaacttcacagagggaagtctgaagctaaagattcagaccacaaagcgggctaagaaacccccaaagaatttggagaactatatatgtccacctgagatcaagatcaccatcaagcagtctggggaccagaaggtgtcccgtgctggaaaaaatagcaaagccacgaaggaggaagaaagaagccactccaaaaagaagctcctcacagccagtgaccttgcagccagtgacctcaaaggatttcagccacaggcttacgaaaggccccagaaacattcaactctccattatgacacgggcctcccacaggacttcaccggtgacaccttaaaaccaaagcaccagcaaaaaagcagcagccagaaccacatggactggtccaccaactctgacagcggacccgtcactcagaattgcttcatcagtccagagtctggcagagaaactgcaagcaccagcaagatccccgctcttgagcccgtggcttcctttgcaaaggcccagggtaagaaaggcagtgcagggaacacgtggagtcagttgtctaacaataacaaagatctgctcttgggaggtgtggctccatccccaagcagccacagctcaccagccccacccagcagctctgctgagtgcaacgggcttcagcccttggtggatcaagatggaggaggtacaaaggagcccccagaaccacctacggtgggcagcaagaaaaagtccagtaaaaaagatgtgataagtcagaccataccaaacccagacctggattgggtcaagaatgcccagaaagcatttgacaatacagaagggaaaagggaaggttattccgcagatagtgcccaagaggcatcaccagccaggcagaacgtgagttctgccagtaatcctgaaaatgactcaagtcatgtccggattactatccccatcaaggcaccctctctggatccaaccaaccataagaggaaaaaaagacagtccattaaagcggtggtggaaaagatcatgccagagaaagccttggcttctggaatcaccatgagcagtgaagtagttaacaggatactttccaactctgaggggaataagaaggatccccgtgtccctaagttgagtaaaatgatagagaatgagtccccctcagttggccttgaaactggtggaaatgctgagaaagttatcccaggaggtgtgtctaagccgcggaagccacccatggtcatgacacctccaacgtgcacagatcactctccatccagaaagctgccagaaatccagcatccaaaatttgctgcaaaacgaaggtggacttgcagcaaaccaaaacctagcaccatgcttcgagaggcagttatggccacctctgataaactgatgctggagcccccgtctgcatatcccatcaccccatccagccctctctacaccaacacagacagtcttactgtgatcactccagtcaaaaagaagcggggacgaccaaagaagcagcctttgctcacagtcgagacgattcatgagggaacttccaccagccccgtcagtcccatcagccgagagtttcctggcactaagaaaagaaagcgacgacgcaatttagcgaagttggcccagctagtgccgggagaggacaaacccatgagcgagatgaaatttcacaagaaagttggaaagctcggcgtgttggataagaagaccatcaaaactatcaataagatgaagacactcaagaggaaaaacatcttgaatcagatcttgtcctgttccagcagcgttgctctgaaggcaaaagctcccccagagaccagccctggggcagcagccattgaaagcaaactgggcaagcagattaatgtcagcaagaggggaaccatctacattggcaagaagcggggcaggaagccaagagcagagctgccacccccatccgaagaacccaaaacagccatcaagcaccccaggcctgtttctagccagccggatgttccagccgtgccttccaactttcagtcacttgtggcgtcttcaccagcagctatgcacccactttcaacacagttaggtgggtccaatggcaacctgagccctgccagcactgaaaccaatttttcagagttgaaaactatgccaaatctccagcccatcagtgctcttccaaccaaaacccaaaagggaatacacagtggaacctggaagctgtctccacccagactgatggccaactccccttcacacctgtgcgagattggctccctaaaggaaatcacgctgtcccctgtgagcgagtcccacagtgaggagacgatccccagcgacagcggcattgggacagacaacaacagcacttctgaccaagcggagaagagctcagaatcccgaaggaggtactcttttgatttctgctccctggacaacccggaggccattccgtccgacaccagcacaaagaaccggcatggccaccggcaaaagcatctcattgtggacaactttctggcccacgaaagcctcaagaagccaaagcacaagaggaaacggaaaagcctgcaaaaccgcgatgacctccagtttctggcagacctggaggagctaatcaccaagttccaagtgttcagaatctcccaccggagttacaccttctaccacgagaatccatatcccagcatttttcggattaattttgatcactattacccggtgccatatatccagtatgacccgttgctctatcttcgtaggacttcagacttgaagtcaaagaagaagcgtggtaggcctgcaaaaaccaatgacaccatgacaaaggtgccttttttacaagggttcagctaccctattcccagtggaagttactatgcaccctatggaatgccttacacatcaatgcctatgatgaaccttggttattacggtcagtacccagctcctttgtacctatcgcacacgcttggagcagcttccccattcatgaggccaacagtgccaccacctcagttccacacaaactcccacataaagatgtccggtgcagctaagcataaagccaagcatggagtacacctgcagggacctgttagcatgggccttggtgacatgcagccttctctgaaccctcccaaggtaggcagtgccagtctgtccagtggtcggctccataagaggaaacacaaacacaagcataagcacaaggaagaccggatcctagggacccatgacaacctgagtggtctttttgcaggcaaagccacaggcttctccagccacatcctgagcgagcggctgagtagcgcagacaaagagctcccgctggtgagtgagaagaacaagcataaggagaaacagaagcaccagcacagcgaagccggccacaaagcttctaagaacaactttgaggtggacaccctgtctacactgtcactttccgacgcccagcattggacacaggccaaggaaaaaggagacttgagcagtgagcctgtggactcatgcacgaaaagatactctggcagtggcggggatggtggcagcacgagatcggagaacctggacgtgttcagtgaaatgaacccttcgaatgacaagtgggacagtgacgtgagtgggagtaaaaggaggagctatgaaggctttggaacgtacagggaaaaggacatccaagccttcaagatgaaccgcaaggagagaagttcttatgactcctccatgtctccaggtaaggctgtttttcttcagaaatggattatcaagttatttcattgctgggctttgcacctcagacacatctgtggcacattgtgttcactagtttgcaaagaggtgggaatcaaattaaaatgggtctccttgcacatttgagtttgctgcacattttgtacattgtttacttggtatttactatcttccttctctcctggagccattgtttgagaaactgtgaagccataaccctaatagctgcctaggctgcagtcgtgcccactatggttatgctttttattaaagatgctgttcttaggtcctcatctgatctaatggtacagtttgctgtttggatacagcctctaaaactcattaggaatactaataagatccaagaatgccaagcctgggaggaaatgactagctaatttatctggcatgccagctccacaagtcacacatctaatgtgagaagtctactgcagagccattagaagctgatgaccagtgaatcctgaagtctaactcatcaggtagccacagccttgggccatattgtttccattttttttccatgggcatttgataagctgtcctgggcaggtccctaaaatgaaaacttgactacattcagatacttgtcattttcgtgcactaagtggaaggaggcaggctggaaggtgatatgtgcctcctgcttccagcagaccttataactgtgtctctttgcatgcccactagaaagggattttgctcactaatttaaactgaaatgctggttgctactagaaggatcctattccttgtcagttgctggcagaattcccttgccaacctccccaaccacacaaaatccttccctgctgttagggcctcacatttctgcaaaagtatccctttgaccctggccttacatcatatatgataagacccctataaagaccagagaagttagttattaggaaaatagtagaaacttcttacctaggagttgcagaagctaaaaaaaaaaaa

SEQ ID NO: 277741 - DNA, 3608 bp, Homo sapiens
gcgtgagcctgtgcgtgtgctcacacgcgcattttggcagggctgaatcacaagaggactcgcagttgatacccagactcaccaaaaaattgagctgtgaatttggggaggcaggtacgtgctgggaaggaagctaaaggagaacaacagctttgtgtgctgatgaagtaaacagacagttgcagatctgatctcttctgaacacctcatcgtgtctccatccctgggaatctgaccctagcaactggaccactttgttcttggaattttgggtgtcctcttttctcacctttcccttttcccttttccccttccccctcctgagaactccggaagactgtagagattgtcatggagtccagggaaaccttaagcagctcccggcaaagagggggcgagtcagacttcctgccggtctcctcagccaagcccccagctgctcctggctgtgcaggagaacctttgctctccactccaggacctgggaaggggatcccggtgggcggagagcgcatggagccagaggaggaggatgaactaggctcagggcgggatgtggattccaactccaacgcggacagtgagaaatgggtggcaggagatggtttggaagagcaggaattttctatcaaggaggcaaacttcacagagggaagtctgaagctaaagattcagaccacaaagcgggctaagaaacccccaaagaatttggagaactatatatgtccacctgagatcaagatcaccatcaagcagtctggggaccagaaggtgtcccgtgctggaaaaaatagcaaagccacgaaggaggaagaaagaagccactccaaaaagaagctcctcacagccagtgaccttgcagccagtgacctcaaaggatttcagccacaggcttacgaaaggccccagaaacattcaactctccattatgacacgggcctcccacaggacttcaccggtgacaccttaaaaccaaagcaccagcaaaaaagcagcagccagaaccacatggactggtccaccaactctgacagcggacccgtcactcagaattgcttcatcagtccagagtctggcagagaaactgcaagcaccagcaagatccccgctcttgagcccgtggcttcctttgcaaaggcccagggtaagaaaggcagtgcagggaacacgtggagtcagttgtctaacaataacaaagatctgctcttgggaggtgtggctccatccccaagcagccacagctcaccagccccacccagcagctctgctgagtgcaacgggcttcagcccttggtggatcaagatggaggaggtacaaaggagcccccagaaccacctacggtgggcagcaagaaaaagtccagtaaaaaagatgtgataagtcagaccataccaaacccagacctggattgggtcaagaatgcccagaaagcatttgacaatacagaagggaaaagggaaggttattccgcagatagtgcccaagaggcatcaccagccaggcagaacgtgagttctgccagtaatcctgaaaatgactcaagtcatgtccggattactatccccatcaaggcaccctctctggatccaaccaaccataagaggaaaaaaagacagtccattaaagcggtggtggaaaagatcatgccagagaaagccttggcttctggaatcaccatgagcagtgaagtagttaacaggatactttccaactctgaggggaataagaaggatccccgtgtccctaagttgagtaaaatgatagagaatgagtccccctcagttggccttgaaactggtggaaatgctgagaaagttatcccaggaggtgtgtctaagccgcggaagccacccatggtcatgacacctccaacgtgcacagatcactctccatccagaaagctgccagaaatccagcatccaaaatttgctgcaaaacgaaggtggacttgcagcaaaccaaaacctagcaccatgcttcgagaggcagttatggccacctctgataaactgatgctggagcccccgtctgcatatcccatcaccccatccagccctctctacaccaacacagacagtcttactgtgatcactccagtcaaaaagaagcggggacgaccaaagaagcagcctttgctcacagtcgagacgattcatgagggaacttccaccagccccgtcagtcccatcagccgagagtttcctggcactaagaaaagaaagcgacgacgcaatttagcgaagttggcccagctagtgccgggagaggacaaacccatgagcgagatgaaatttcacaagaaagttggaaagctcggcgtgttggataagaagaccatcaaaactatcaataagatgaagacactcaagaggaaaaacatcttgaatcagatcttgtcctgttccagcagcgttgctctgaaggcaaaagctcccccagagaccagccctggggcagcagccattgaaagcaaactgggcaagcagattaatgtcagcaagaggggaaccatctacattggcaagaagcggggcaggaagccaagagcagagctgccacccccatccgaagaacccaaaacagccatcaagcaccccaggcctgtttctagccagccggatgttccagccgtgccttccaactttcagtcacttgtggcgtcttcaccagcagctatgcacccactttcaacacagttaggtgggtccaatggcaacctgagccctgccagcactgaaaccaatttttcagagttgaaaactatgccaaatctccagcccatcagtgctcttccaaccaaaacccaaaagggaatacacagtggaacctggaagctgtctccacccagactgatggccaactccccttcacacctgtgcgagattggctccctaaaggaaatcacgctgtcccctgtgagcgagtcccacagtgaggagacgatccccagcgacagcggcattgggacagacaacaacagcacttctgaccaagcggagaagagctcagaatcccgaaggaggtactcttttgatttctgctccctggacaacccggaggccattccgtccgacaccagcacaaagaaccggcatggccaccggcaaaagcatctcattgtggacaactttctggcccacgaaagcctcaagaagccaaagcacaagaggaaacggaaaagcctgcaaaaccgcgatgacctccagtttctggcagacctggaggagctaatcaccaagttccaagtgttcagaatctcccaccggagttacaccttctaccacgagaatccatatcccagcatttttcggattaattttgatcactattacccggtgccatatatccagtatgacccgttgctctatcttcgtaggacttcagacttgaagtcaaagaagaagcgtggtaggcctgcaaaaaccaatgacaccatgacaaaggtgccttttttacaagggttcagctaccctattcccagtggaagttactatgcaccctatggaatgccttacacatcaatgcctatgatgaaccttggttattacggtcagtacccagctcctttgtacctatcgcggcttgtggcgtaacctcggggtcagcc

SEQ ID NO: 277742 - DNA, 1708 bp, Homo sapiens
gaggccaaacatggggcggggcggcgcggccggggaagcgtgatgaaggcctacgagtgcggcgcggcctgaaggggcacgcgggggacctgcaaagctagtgaggggcggggcaggcggcgcggtgggggcgggccgagcccggaggccagatgagcggacacagccccacgcgcggggccatgcaggtggccatgaacggtaaggcccgcaaagaggcggtgcagactgcggctaaggaactcctcaagttcgtgaaccggagtccctctcctttccatgctgtggctgaatgccgcaaccgccttctccaggctggcttcagtgaactcaaggagactgagaaatggaatattaagcccgagagcaagtacttcatgaccaggaactcctccaccatcatagcttttgctgtagggggccagtacgttcctggcaatggcttcagcctcatcggggcccacacggacagcccctgcctccgggtgaaacgtcggtctcgccgcagccaggtgggcttccagcaagtcggtgtggagacctatggtggtgggatctggagcacctggtttgaccgtgacctgactctggctggacgcgtcattgtcaagtgccctacctcaggtcggctggagcagcagctggtgcacgtggagcggcccattcttcgcatcccacacctggccatccatctgcagcgaaatatcaacgagaactttgggcccaacacagagatgcatctagtccccattcttgccacagccatccaggaggagctggagaaggggactcctgagccagggcctctcaatgctgtggatgagcggcaccattcggtcctcatgtccctgctctgtgcccatctggggctgagccccaaggacatagtggagatggagctctgccttgcagacacccagcctgcggtcttgggtggtgcctatgatgagttcatctttgctcctcggctggacaatctgcacagctgcttctgtgccctgcaggccttgatagattcctgtgcaggccctggctccctggccacagagcctcacgtgcgcatggtcacactctatgacaacgaagaggtggggtctgagagtgcacagggagcacagtcactgctgacagagctggtgctgcggcggatctcagcctcgtgccagcacccgacagccttcgaggaagccatacccaagtccttcatgatcagcgcagacatggcccatgctgtgcatcccaactacctggacaagcatgaggagaaccaccggcctttattccacaagggccccgtgatcaaggtgaacagcaagcaacgctatgcttcaaacgcggtgtcagaggccctgatccgagaggtggccaacaaagtcaaggtccccctgcaggatctcatggtccggaatgacaccccctgtggaaccaccattggacctatcttggcttctcggctggggctgcgggtgctggatttaggcagcccccaactggccatgcactctatccgggagatggcctgcaccacaggagtcctccagaccctcaccctcttcaagggcttctttgagctgttcccttctctaagccataatctcttagtggattgagccctcttggaaagacttctctgccatccctttgcacctgagaggggaagttctcagctgagctgaagctggattattaaagtggattgtcactcaga

SEQ ID NO: 277743 - DNA, 2566 bp, Homo sapiens
gaggccaaacatggggcggggcggcgcggccggggaagcgtgatgaaggcctacgagtgcggcgcggcctgaaggggcacgcgggggacctgcaaagctagtgaggggcggggcaggcggcgcggtgggggcgggccgagcccggaggccagatgagcggacacagccccacgcgcggggccatgcaggtggccatgaacggtaaggcccgcaaagaggcggtgcagactgcggctaaggaactcctcaagttcgtgaaccggagtccctctcctttccatgctgtggctgaatgccgcaaccgccttctccaggctggcttcagtgaactcaaggagactgagaaatggaatattaagcccgagagcaagtacttcatgaccaggaactcctccaccatcatagcttttgctgtagggggccagtacgttcctggcaatggcttcagcctcatcggggcccacacggacagcccctgcctccgggtgaaacgtcggtctcgccgcagccaggtgggcttccagcaagtcggtgtggagacctatggtggtgggatctggagcacctggtttgaccgtgacctgactctggctggacgcgtcattgtcaagtgccctacctcaggtcggctggagcagcagctggtgcacgtggagcggcccattcttcgcatcccacacctggccatccatctgcagcgaaatatcaacgagaactttgggcccaacacagagatgcatctagtccccattcttgccacagccatccaggaggagctggagaaggggactcctgagccagggcctctcaatgctgtggatgagcggcaccattcggtcctcatgtccctgctctgtgcccatctggggctgagccccaaggacatagtggagatggagctctgccttgcagacacccagcctgcggtcttgggtggtgcctatgatgagttcatctttgctcctcggctggacaatctgcacagctgcttctgtgccctgcaggccttgatagattcctgtgcaggccctggctccctggccacagagcctcacgtgcgcatggtcacactctatgacaacgaagaggtggggtctgagagtgcacagggagcacagtcactgctgacagagctggtgctgcggcggatctcagcctcgtgccagcacccgacagccttcgaggaagccatacccaagtccttcatgatcagcgcagacatggcccatgctgtgcatcccaactacctggacaagcatgaggagaaccaccggcctttattccacaagggccccgtgatcaaggtgaacagcaagcaacgctatgcttcaaacgcggtgtcagaggccctgatccgagaggtggccaacaaagtcaaggtccccctgcaggatctcatggtccggaatgacaccccctgtggaaccaccattggacctatcttggcttctcggctggggctgcgggtgctggatttaggcagcccccaactggccatgcactctatccgggagatggcctgcaccacaggagtcctccagaccctcaccctcttcaagggcttctttgagctgttcccttctctaagccataatctcttagtggattgagccctcttggaaagacttctctgccatccctttgcacctgagaggggaagttctcagctgagctgaagctggattattaaagtggattgtcactcagactctccgtgctacgcttatttggagactagaggagtgggagttgagcctggcttgaacctttggaaccagaaaagttggggagcaggtggaggaggccacactcctgggagctgatggttttaaatctggttttaaatctcttctctgtctcaagtccatgtctgaagtgggtgaagggtggactggatcctcaagcagaaggtcacttctcccacccctagtcctccacctgggaaatggcctcaacggtcttccctctttccatccccagaatgggtgtcccgctctgccttcagagatcctgttctgcactgggccaccttcagagctgctctgggcagacaaagctgtttctcaccctcccaaaatcccttcccatcccctctcaggagctgcaaagagaagggcacagtctatatcttatcacccttcatcatccacttctcagcagtccctggtattacttgattgtgaacatattatcaggaaaaaagattatcattgaaaaaattggaaaagtcaaagtctggccgggtgcagcggctcacatctgtattcccagcattttgggaggccaaggcaggtggatcacttgaggtcagagttcaagaccagccttgccaacatggtgaaacccatctctacttaaaaaaaaatacaaaaaaattagccaggcatggtggcacacacctgtaatctcagctattcaggagactgaggcaggagaatagcttgaaccaaggaggcgtaggttgcagtgagctgagatggagccaccacactccagcctgggcaacagagcaaggctctgtctcagagaaaaaaggccaggcgtgatgggtcatgcctgtagtccc

SEQ ID NO: 277744 - DNA, 1585 bp, Homo sapiens
gggacagtaagagtacatagttgatggggcagttgtgaagattaaacgaggtggctgtggcgagagacagcactttgtaccgtacccgtcggacccggtggccatgaacggtaaggcccgcaaagaggcggtgcagactgcggctaaggaactcctcaagttcgtgaaccggagtccctctcctttccatggctggcttcagtgaactcaaggagactgagaaatggaatattaagcccgagagcaagtacttcatgaccaggaactcctccaccatcatagcttttgctgtagggggccagtacgttcctggcaatggcttcagcctcatcggggcccacacggacagcccctgcctccgggtgaaacgtcggtctcgccgcagccaggtgggcttccagcaagtcggtgtggagacctatggtggtgggatctggagcacctggtttgaccgtgacctgactctggctggacgcgtcattgtcaagtgccctacctcaggtcggctggagcagcagctggtgcacgtggagcggcccattcttcgcatcccacacctggccatccatctgcagcgaaatatcaacgagaactttgggcccaacacagagatgcatctagtccccattcttgccacagccatccaggaggagctggagaaggggactcctgagccagggcctctcaatgctgtggatgagcggcaccattcggtcctcatgtccctgctctgtgcccatctggggctgagccccaaggacatagtggagatggagctctgccttgcagacacccagcctgcggtcttgggtggtgcctatgatgagttcatctttgctcctcggctggacaatctgcacagctgcttctgtgccctgcaggccttgatagattcctgtgcaggccctggctccctggccacagagcctcacgtgcgcatggtcacactctatgacaacgaagaggtggggtctgagagtgcacagggagcacagtcactgctgacagagctggtgctgcggcggatctcagcctcgtgccagcacccgacagccttcgaggaagccatacccaagtccttcatgatcagcgcagacatggcccatgctgtgcatcccaactacctggacaagcatgaggagaaccaccggcctttattccacaagggccccgtgatcaaggtgaacagcaagcaacgctatgcttcaaacgcggtgtcagaggccctgatccgagaggtggccaacaaagtcaaggtccccctgcaggatctcatggtccggaatgacaccccctgtggaaccaccattggacctatcttggcttctcggctggggctgcgggtgctggatttaggcagcccccaactggccatgcactctatccgggagatggcctgcaccacaggagtcctccagaccctcaccctcttcaagggcttctttgagctgttcccttctctaagccataatctcttagtggattgagccctcttggaaagacttctctgccatccctttgcacctgagaggggaagttctcagctgagctgaagctggattattaaagtggattgtcactcaga

SEQ ID NO: 277745 - DNA, 1244 bp, Homo sapiens
ggcacgaggctctctctctctctctctctctctctctctctctctctctctctctctctctctctctctctctctctctctctctctctctctcggagcacctggtttgaccgtgacctgactctggctggacgcgtcattgtcaagtgccctacctcaggtcggctggagcagcagctggtgcacgtggagcggcccattcttcgcatcccacacctggccatccatctgcagcgaaatatcaacgagaactttgggcccaacacagagatgcatctagtccccattcttgccacagccatccaggaggagctggagaaggggactcctgagccagggcctctcaatgctgtggatgagcggcaccattcggtcctcatgtccctgctctgtgcccatctggggctgagccccaaggacatagtggagatggagctctgccttgcagacacccagcctgcggtcttgggtggtgcctatgatgagttcatctttgctcctcggctggacaatctgcacagctgcttctgtgccctgcaggccttgatagattcctgtgcaggccctggctccctggccacagagcctcacgtgcgcatggtcacactctatgacaacgaagaggtggggtctgagagtgcacagggagcacagtcactgctgacagagctggtgctgcggcggatctcagcctcgtgccagcacccgacagccttcgaggaagccatacccaagtccttcatgatcagcgcagacatggcccatgctgtgcatcccaactacctggacaagcatgaggagaaccaccggcctttattccacaagggccccgtgatcaaggtgaacagcaagcaacgctatgcttcaaacgcggtgtcagaggccctgatccgagaggtggccaacaaagtcaaggtccccctgcaggatctcatggtccggaatgacaccccctgtggaaccaccattggacctatcttggcttctcggctggggctgcgggtgctggatttaggcagcccccaactggccatgcactctatccgggagatggcctgcaccacaggagtcctccagaccctcaccctcttcaagggcttctttgagctgttcccttctctaagccataatctcttagtggattgagccctcttggaaagacttctctgccatccctttgcacctgagaggggaagttctcagctgagctgaagctggattattaaagtggattgtcactcaga

SEQ ID NO: 277746 - DNA, 1765 bp, Homo sapiens
  misc_feature (1164)..(1164): n is a, c, g, or t
gaggccaaacatggggcggggcggcgcggccggggaagcgtgatgaaggcctacgagtgcggcgcggcctgaaggggcacgcgggggacctgcaaagctagtgaggggcggggcaggcggcgcggtgggggcgggccgagcccggaggccagatgagcggacacagccccacgcgcggggccatgcaggtggccatgaacggtaaggcccgcaaagaggcggtgcagactgcggctaaggaactcctcaagttcgtgaaccggagtccctctcctttccatgctgtggctgaatgccgcaaccgccttctccaggctggcttcagtgaactcaaggagactgagaaatggaatattaagcccgagagcaagtacttcatgaccaggaactcctccaccatcatagcttttgctgtagggggccagtacgttcctggcaatggcttcagcctcatcggggcccacacggacagcccctgcctccgggtgaaacgtcggtctcgccgcagccaggtgggcttccagcaagtcggtgtggagacctatggtggtgggatctggagcacctggtttgaccgtgacctgactctggctggacgcgtcattgtcaagtgccctacctcaggtcggctggagcagcagctggtgcacgtggagcggcccattcttcgcatcccacacctggccatccatctgcagcgaaatatcaacgagaactttgggcccaacacagagatgcatctagtccccattcttgccacagccatccaggaggagctggagaaggggactcctgagccagggcctctcaatgctgtggatgagcggcaccattcggtcctcatgtccctgctctgtgcccatctggggctgagccccaaggacatagtggagatggagctctgccttgcagacacccagcctgcggtgaggactggctgtaggaacctgtgggtgaagggcctccaggatcctggccacccctagcccgtcctgctgaagcacccatcacctccaccaagccctcagtaactctcatccccgtttttcccagtagacacatcccccactgcttctagggcggtggttctcaaaaagacaagttccctaccccagacctgcccactaggactatctgggaattggccctttttacagattcccnaagagtttcttctacaggtgggccctgtctgctttgacccacactgacactgaactgcttagggaaagaggcctggatgtggccatctgttctctgtctcccggttgctgatggtcagagattgctaaatctttggatgctgtgtcctgcttgaacacgtactaagtttctgttttttggctggtttcctctgtttacttctttggcctttttgatgacaattcagcccttccttttcttgacccacaggaagaggtcaagagctattggcctccacccttttgttcctcagcaccaacccagcccccttctccaatctctgcttggtcctgcctagcaaggaatcccagcactttgggaggctgaggcggggggaatcacatgaggtcaggagttcgagactagcctgaccaccatggtgaaaccctgtctctaataaaaatacaaaaattagctgggcctggtggtgcatgcctgtaatcccagctactcaggaggctgaggcacgagaatcctttgaacccgggaggcggaagttgcagtgagccgagatcgagccattgcacttcagactgggcaacaagagcgaaccttcatctca

SEQ ID NO: 277747 - DNA, 1251 bp, Homo sapiens
ggacgctgtgggtcgacccacgcgtcgcggacgcgtgggcgaagaggtggccaacaaagtcaaggtccccctgcaggatctcatggtccggaatgacaccccctgtggaaccaccattggacctatcttggcttctcggctggggctgcgggtgctggatttaggcagcccccaactggccatgcactctatccgggagatggcctgcaccacaggagtcctccagaccctcaccctcttcaagggcttctttgagctgttcccttctctaagccataatctcttagtggattgagccctcttggaaagacttctctgccatccctttgcacctgagaggggaagttctcagctgagctgaagctggattattaaagtggattgtcactcagactctccgtgctacgcttatttggagactagaggagtgggagttgagcctggcttgaacctttggaaccagaaaagttggggagcaggtggaggaggccacactcctgggagctgatggttttaaatctggttttaaatctcttctctgtctcaagtccatgtctgaagtgggtgaagggtggactggatcctcaagcagaaggtcacttctcccacccctagtcctccacctgggaaatggcctcaacggtcttccctctttccatccccagaatgggtgtcccgctctgccttcagagatcctgttctgcactgggccaccttcagagctgctctgggcagacaaagctgtttctcaccctcccaaaatcccttcccatcccctctcaggagctgcaaagagaagggcacagtctatatcttatcacccttcatcatccacttctcagcagtccctggtattacttgattgtgaacatattatcaggaaaaaagattatcattgaaaaaattggaaaagtcaaagtctggccgggtgcagcggctcacatctgtattcccagcattttgggaggccaaggcaggtggatcacttgaggtcagagttcaagaccagccttgccaacatggtgaaacccatctctacttaaaaaaaaatacaaaaaaattagccaggcatggtggcacacacctgtaatctcagctattcaggagactgaggcaggagaatagcttgaaccaaggaggcgtaggttgcagtgagctgagatggagccaccacactccagcctgggcaacagagcaaggctctgtctcagagaaaaaaggccaggcgtgatgggtcatgcctgtagtccc

SEQ ID NO: 277748 - DNA, 995 bp, Homo sapiens
cgggctgaagctttcaacggagtttcagccctgggtttgggtctctcggtggggacgggcggaagcagaggtggccatgaacggtaaggcccgcaaagaggcggtgcagactgcggctaaggaactcctcaagttcgtgaaccggagtccctctcctttccatgctgtggctgaatgccgcaaccgccttctccaggctggcttcagtgaactcaaggagactgagaaatggaatattaagcccgagagcaagtacttcatgaccaggaactcctccaccatcatagcttttgctgtagggggccagtacgttcctggcaatggcttcagcctcatcggggcccacacggacagcccctgcctccgggtgaaacgtcggtctcgccgcagccaggtgggcttccagcaagtcggtgtggagacctatggtggtgggatctggagcacctggtttgaccgtgacctgactctggctggacgcgtcattgtcaagtgccctacctcaggtcggctggagcagcagctggtgcacgtggagcggcccattcttcgcatcccacacctggccatccatctgcagcgaaatatcaacgagaactttgggcccaacacagagatgcatctagtccccattcttgccacagccatccaggaggagctggagaaggggactcctgagccagggcctctcaatgctgtggatgagcggcaccattcggtcctcatgtccctgctctgtgcccatctggggctgagccccaaggacatagtggagatggagctctgccttgcagacacccagcctgcggtcttgggtggtgcctatgatgagttcatctttgctcctcggctggacaatctgcacagctgcttctgtgccctgcaggcttgatgattccgtgcggccgggtcctggccagaggcccgtggcttggcaccttgacaccaagtggggtcgagcccggcccccctgtcaccgtctggggtccctcccg

SEQ ID NO: 277749 - DNA, 1676 bp, Homo sapiens
gaggccaaacatggggcggggcggcgcggccggggaagcgtgatgaaggcctacgagtgcggcgcggcctgaaggggcacgcgggggacctgcaaagctagtgaggggcggggcaggcggcgcggtgggggcgggccgagcccggaggccagatgagcggacacagccccacgcgcggggccatgcaggtggccatgaacggtaaggcccgcaaagaggcggtgcagactgcggctaaggaactcctcaagttcgtgaaccggagtccctctcctttccatggctggcttcagtgaactcaaggagactgagaaatggaatattaagcccgagagcaagtacttcatgaccaggaactcctccaccatcatagcttttgctgtagggggccagtacgttcctggcaatggcttcagcctcatcggggcccacacggacagcccctgcctccgggtgaaacgtcggtctcgccgcagccaggtgggcttccagcaagtcggtgtggagacctatggtggtgggatctggagcacctggtttgaccgtgacctgactctggctggacgcgtcattgtcaagtgccctacctcaggtcggctggagcagcagctggtgcacgtggagcggcccattcttcgcatcccacacctggccatccatctgcagcgaaatatcaacgagaactttgggcccaacacagagatgcatctagtccccattcttgccacagccatccaggaggagctggagaaggggactcctgagccagggcctctcaatgctgtggatgagcggcaccattcggtcctcatgtccctgctctgtgcccatctggggctgagccccaaggacatagtggagatggagctctgccttgcagacacccagcctgcggtcttgggtggtgcctatgatgagttcatctttgctcctcggctggacaatctgcacagctgcttctgtgccctgcaggccttgatagattcctgtgcaggccctggctccctggccacagagcctcacgtgcgcatggtcacactctatgacaacgaagaggtggggtctgagagtgcacagggagcacagtcactgctgacagagctggtgctgcggcggatctcagcctcgtgccagcacccgacagccttcgaggaagccatacccaagtccttcatgatcagcgcagacatggcccatgctgtgcatcccaactacctggacaagcatgaggagaaccaccggcctttattccacaagggccccgtgatcaaggtgaacagcaagcaacgctatgcttcaaacgcggtgtcagaggccctgatccgagaggtggccaacaaagtcaaggtccccctgcaggatctcatggtccggaatgacaccccctgtggaaccaccattggacctatcttggcttctcggctggggctgcgggtgctggatttaggcagcccccaactggccatgcactctatccgggagatggcctgcaccacaggagtcctccagaccctcaccctcttcaagggcttctttgagctgttcccttctctaagccataatctcttagtggattgagccctcttggaaagacttctctgccatccctttgcacctgagaggggaagttctcagctgagctgaagctggattattaaagtggattgtcactcaga

SEQ ID NO: 277750 - DNA, 1891 bp, Homo sapiens
gaggccaaacatggggcggggcggcgcggccggggaagcgtgatgaaggcctacgagtgcggcgcggcctgaaggggcacgcgggggacctgcaaagctagtgaggggcggggcaggcggcgcggtgggggcgggccgagcccggaggccagatgagcggacacagccccacgcgcggggccatgcaggtaagtggctcccgacggccccacttgaatttcgatcccagaccgggtccggcgccctccggggcccaagcttagcgcggtgctgcagtggggccgcctgacccaaagcgaaaccgaaagccccgcggagggtgacctgacgactttcccgggactggaagggggagtcctgcgagagactaggtggccatgaacggtaaggcccgcaaagaggcggtgcagactgcggctaaggaactcctcaagttcgtgaaccggagtccctctcctttccatgctgtggctgaatgccgcaaccgccttctccaggctggcttcagtgaactcaaggagactgagaaatggaatattaagcccgagagcaagtacttcatgaccaggaactcctccaccatcatagcttttgctgtagggggccagtacgttcctggcaatggcttcagcctcatcggggcccacacggacagcccctgcctccgggtgaaacgtcggtctcgccgcagccaggtgggcttccagcaagtcggtgtggagacctatggtggtgggatctggagcacctggtttgaccgtgacctgactctggctggacgcgtcattgtcaagtgccctacctcaggtcggctggagcagcagctggtgcacgtggagcggcccattcttcgcatcccacacctggccatccatctgcagcgaaatatcaacgagaactttgggcccaacacagagatgcatctagtccccattcttgccacagccatccaggaggagctggagaaggggactcctgagccagggcctctcaatgctgtggatgagcggcaccattcggtcctcatgtccctgctctgtgcccatctggggctgagccccaaggacatagtggagatggagctctgccttgcagacacccagcctgcggtcttgggtggtgcctatgatgagttcatctttgctcctcggctggacaatctgcacagctgcttctgtgccctgcaggccttgatagattcctgtgcaggccctggctccctggccacagagcctcacgtgcgcatggtcacactctatgacaacgaagaggtggggtctgagagtgcacagggagcacagtcactgctgacagagctggtgctgcggcggatctcagcctcgtgccagcacccgacagccttcgaggaagccatacccaagtccttcatgatcagcgcagacatggcccatgctgtgcatcccaactacctggacaagcatgaggagaaccaccggcctttattccacaagggccccgtgatcaaggtgaacagcaagcaacgctatgcttcaaacgcggtgtcagaggccctgatccgagaggtggccaacaaagtcaaggtccccctgcaggatctcatggtccggaatgacaccccctgtggaaccaccattggacctatcttggcttctcggctggggctgcgggtgctggatttaggcagcccccaactggccatgcactctatccgggagatggcctgcaccacaggagtcctccagaccctcaccctcttcaagggcttctttgagctgttcccttctctaagccataatctcttagtggattgagccctcttggaaagacttctctgccatccctttgcacctgagaggggaagttctcagctgagctgaagctggattattaaagtggattgtcactcaga

SEQ ID NO: 277751 - DNA, 1677 bp, Homo sapiens
tgcaagttggggcccaaggcaggggaaggatccggcaaaaaaggcacacggttcaggcctgtccactccagccttgggaggaggtgagcaggtcaccatggctcggagcctctccatcatgttcgtccccaacagctggctcaatggctaccacaaggtggccatgaacggtaaggcccgcaaagaggcggtgcagactgcggctaaggaactcctcaagttcgtgaaccggagtccctctcctttccatgctgtggctgaatgccgcaaccgccttctccaggctggcttcagtgaactcaaggagactgagaaatggaatattaagcccgagagcaagtacttcatgaccaggaactcctccaccatcatagcttttgctgtagggggccagtacgttcctggcaatggcttcagcctcatcggggcccacacggacagcccctgcctccgggtgaaacgtcggtctcgccgcagccaggtgggcttccagcaagtcggtgtggagacctatggtggtgggatctggagcacctggtttgaccgtgacctgactctggctggacgcgtcattgtcaagtgccctacctcaggtcggctggagcagcagctggtgcacgtggagcggcccattcttcgcatcccacacctggccatccatctgcagcgaaatatcaacgagaactttgggcccaacacagagatgcatctagtccccattcttgccacagccatccaggaggagctggagaaggggactcctgagccagggcctctcaatgctgtggatgagcggcaccattcggtcctcatgtccctgctctgtgcccatctggggctgagccccaaggacatagtggagatggagctctgccttgcagacacccagcctgcggtcttgggtggtgcctatgatgagttcatctttgctcctcggctggacaatctgcacagctgcttctgtgccctgcaggccttgatagattcctgtgcaggccctggctccctggccacagagcctcacgtgcgcatggtcacactctatgacaacgaagaggtggggtctgagagtgcacagggagcacagtcactgctgacagagctggtgctgcggcggatctcagcctcgtgccagcacccgacagccttcgaggaagccatacccaagtccttcatgatcagcgcagacatggcccatgctgtgcatcccaactacctggacaagcatgaggagaaccaccggcctttattccacaagggccccgtgatcaaggtgaacagcaagcaacgctatgcttcaaacgcggtgtcagaggccctgatccgagaggtggccaacaaagtcaaggtccccctgcaggatctcatggtccggaatgacaccccctgtggaaccaccattggacctatcttggcttctcggctggggctgcgggtgctggatttaggcagcccccaactggccatgcactctatccgggagatggcctgcaccacaggagtcctccagaccctcaccctcttcaagggcttctttgagctgttcccttctctaagccataatctcttagtggattgagccctcttggaaagacttctctgccatccctttgcacctgagaggggaagttctcagctgagctgaagctggattattaaagtggattgtcactcaga

SEQ ID NO: 277752 - DNA, 1571 bp, Homo sapiens
tgcaagttggggcccaaggcaggggaaggatccggcaaaaaaggcacacggttcaggcctgtccactccagccttgggaggaggtggccatgaacggtaaggcccgcaaagaggcggtgcagactgcggctaaggaactcctcaagttcgtgaaccggagtccctctcctttccatggctggcttcagtgaactcaaggagactgagaaatggaatattaagcccgagagcaagtacttcatgaccaggaactcctccaccatcatagcttttgctgtagggggccagtacgttcctggcaatggcttcagcctcatcggggcccacacggacagcccctgcctccgggtgaaacgtcggtctcgccgcagccaggtgggcttccagcaagtcggtgtggagacctatggtggtgggatctggagcacctggtttgaccgtgacctgactctggctggacgcgtcattgtcaagtgccctacctcaggtcggctggagcagcagctggtgcacgtggagcggcccattcttcgcatcccacacctggccatccatctgcagcgaaatatcaacgagaactttgggcccaacacagagatgcatctagtccccattcttgccacagccatccaggaggagctggagaaggggactcctgagccagggcctctcaatgctgtggatgagcggcaccattcggtcctcatgtccctgctctgtgcccatctggggctgagccccaaggacatagtggagatggagctctgccttgcagacacccagcctgcggtcttgggtggtgcctatgatgagttcatctttgctcctcggctggacaatctgcacagctgcttctgtgccctgcaggccttgatagattcctgtgcaggccctggctccctggccacagagcctcacgtgcgcatggtcacactctatgacaacgaagaggtggggtctgagagtgcacagggagcacagtcactgctgacagagctggtgctgcggcggatctcagcctcgtgccagcacccgacagccttcgaggaagccatacccaagtccttcatgatcagcgcagacatggcccatgctgtgcatcccaactacctggacaagcatgaggagaaccaccggcctttattccacaagggccccgtgatcaaggtgaacagcaagcaacgctatgcttcaaacgcggtgtcagaggccctgatccgagaggtggccaacaaagtcaaggtccccctgcaggatctcatggtccggaatgacaccccctgtggaaccaccattggacctatcttggcttctcggctggggctgcgggtgctggatttaggcagcccccaactggccatgcactctatccgggagatggcctgcaccacaggagtcctccagaccctcaccctcttcaagggcttctttgagctgttcccttctctaagccataatctcttagtggattgagccctcttggaaagacttctctgccatccctttgcacctgagaggggaagttctcagctgagctgaagctggattattaaagtggattgtcactcaga

SEQ ID NO: 277753 - DNA, 1368 bp, Homo sapiens
  misc_feature (30)..(30): n is a, c, g, or t
tctgtgcccatctggggctgtgccccaagnacatagtggagatggagctctgccttgcagacacccagcctgcggtcttgggtggtgcctatgatgagttcatctttgctcattgtttcccacacggacagcccctgtctgcgttgtgaaacgtcggtctcgccgcagccaggtgggcttccagcaagtcggtgtggagacctatggtggtgggatctggagcacctggtttgaccgtgacctgactctggctggacgcgtcattgtcaagtgccctacctcaggtcggctggagcagcagctggtgcacgtggagcggcccattcttcgcatcccacacctggccatccatctgcagcgaaatatcaacgagaactttgggcccaacacagagatgcatctagtccccattcttgccacagccatccaggaggagctggagaaggggactcctgagccagggcctctcaatgctgtggatgagcggcaccattcggtcctcatgtccctgctctgtgcccatctggggctgagccccaaggacatagtggagatggagctctgccttgcagacacccagcctgcggtcttgggtggtgcctatgatgagttcatctttgctcctcggctggacaatctgcacagctgcttctgtgccctgcaggccttgatagattcctgtgcaggccctggctccctggccacagagcctcacgtgcgcatggtcacactctatgacaacgaagaggtggggtctgagagtgcacagggagcacagtcactgctgacagagctggtgctgcggcggatctcagcctcgtgccagcacccgacagccttcgaggaagccatacccaagtccttcatgatcagcgcagacatggcccatgctgtgcatcccaactacctggacaagcatgaggagaaccaccggcctttattccacaagggccccgtgatcaaggtgaacagcaagcaacgctatgcttcaaacgcggtgtcagaggccctgatccgagaggtggccaacaaagtcaaggtccccctgcaggatctcatggtccggaatgacaccccctgtggaaccaccattggacctatcttggcttctcggctggggctgcgggtgctggatttaggcagcccccaactggccatgcactctatccgggagatggcctgcaccacaggagtcctccagaccctcaccctcttcaagggcttctttgagctgttcccttctctaagccataatctcttagtggattgagccctcttggaaagacttctctgccatccctttgcacctgagaggggaagttctcagctgagctgaagctggattattaaagtggattgtcactcaga

SEQ ID NO: 277754 - DNA, 1600 bp, Homo sapiens
gaggccaaacatggggcggggcggcgcggccggggaagcgtgatgaaggcctacgagtgcggcgcggcctgaaggggcacgcgggggacctgcaaagctagtgaggggcggggcaggcggcgcggtgggggcgggccgagcccggaggccagatgagcggacacagccccacgcgcggggccatgcaggtggccatgaacggtaaggcccgcaaagaggcggtgcagactgcggctaaggaactcctcaagttcgtgaaccggagtccctctcctttccatgctgtggctgaatgccgcaaccgccttctccaggctggcttcagtgaactcaaggagactgagaaatggaatattaagcccgagagcaagtacttcatgaccaggaactcctccaccatcatagcttttgctgtagggggccagtacgttcctggcaatggcttcagcctcatcggggcccacacggacagcccctgcctccgggtgaaacgtcggtctcgccgcagccaggtgggcttccagcaagtcggtgtggagacctatggtggtgggatctggagcacctggtttgaccgtgacctgactctggctggacgcgtcattgtcaagtgccctacctcaggtcggctggagcagcagctggtgcacgtggagcggcccattcttcgcatcccacacctggccatccatctgcagcgaaatatcaacgagaactttgggcccaacacagagatgcatctagtccccattcttgccacagccatccaggaggagctggagaaggggactcctgagccagggcctctcaatgctgtggtcttgggtggtgcctatgatgagttcatctttgctcctcggctggacaatctgcacagctgcttctgtgccctgcaggccttgatagattcctgtgcaggccctggctccctggccacagagcctcacgtgcgcatggtcacactctatgacaacgaagaggtggggtctgagagtgcacagggagcacagtcactgctgacagagctggtgctgcggcggatctcagcctcgtgccagcacccgacagccttcgaggaagccatacccaagtccttcatgatcagcgcagacatggcccatgctgtgcatcccaactacctggacaagcatgaggagaaccaccggcctttattccacaagggccccgtgatcaaggtgaacagcaagcaacgctatgcttcaaacgcggtgtcagaggccctgatccgagaggtggccaacaaagtcaaggtccccctgcaggatctcatggtccggaatgacaccccctgtggaaccaccattggacctatcttggcttctcggctggggctgcgggtgctggatttaggcagcccccaactggccatgcactctatccgggagatggcctgcaccacaggagtcctccagaccctcaccctcttcaagggcttctttgagctgttcccttctctaagccataatctcttagtggattgagccctcttggaaagacttctctgccatccctttgcacctgagaggggaagttctcagctgagctgaagctggattattaaagtggattgtcactcaga

SEQ ID NO: 277755 - DNA, 2095 bp, Homo sapiens
gaggccaaacatggggcggggcggcgcggccggggaagcgtgatgaaggcctacgagtgcggcgcggcctgaaggggcacgcgggggacctgcaaagctagtgaggggcggggcaggcggcgcggtgggggcgggccgagcccggaggccagatgagcggacacagccccacgcgcggggccatgcaggtggccatgaacggtaaggcccgcaaagaggcggtgcagactgcggctaaggaactcctcaagttcgtgaaccggagtccctctcctttccatgctgtggctgaatgccgcaaccgccttctccaggctggcttcagtgaactcaaggagactgagaaatggaatattaagcccgagagcaagtacttcatgaccaggaactcctccaccatcatagcttttgctgtagggggccagtacgttcctggcaatggcttcagcctcatcggggcccacacggacagcccctgcctccgggtgaaacgtcggtctcgccgcagccaggtgggcttccagcaagtcggtgtggagacctatggtggtgggatctggagcacctggtttgaccgtgacctgactctggctggacgcgtcattgtcaagtgccctacctcaggtcggctggagcagcagctggtgcacgtggagcggcccattcttcgcatcccacacctggccatccatctgcagcgaaatatcaacgagaactttgggcccaacacagagatgcatctagtccccattcttgccacagccatccaggaggagctggagaaggggactcctgagccagggcctctcaatgctgtggatgagcggcaccattcggtcctcatgtccctgctctgtgcccatctggggctgagccccaaggacatagtggagatggagctctgccttgcagacacccagcctgcggtcttgggtggtgcctatgatgagttcatctttgctcctcggctggacaatctgcacagctgcttctgtgccctgcaggccttgatagattcctgtgcaggccctggctccctggccacagagcctcacgtgcgcatggtcacactctatgacaacgaagagggcttctttgagctgttcccttctctaagccataatctcttagtggattgagccctcttggaaagacttctctgccatccctttgcacctgagaggggaagttctcagctgagctgaagctggattattaaagtggattgtcactcagactctccgtgctacgcttatttggagactagaggagtgggagttgagcctggcttgaacctttggaaccagaaaagttggggagcaggtggaggaggccacactcctgggagctgatggttttaaatctggttttaaatctcttctctgtctcaagtccatgtctgaagtgggtgaagggtggactggatcctcaagcagaaggtcacttctcccacccctagtcctccacctgggaaatggcctcaacggtcttccctctttccatccccagaatgggtgtcccgctctgccttcagagatcctgttctgcactgggccaccttcagagctgctctgggcagacaaagctgtttctcaccctcccaaaatcccttcccatcccctctcaggagctgcaaagagaagggcacagtctatatcttatcacccttcatcatccacttctcagcagtccctggtattacttgattgtgaacatattatcaggaaaaaagattatcattgaaaaaattggaaaagtcaaagtctggccgggtgcagcggctcacatctgtattcccagcattttgggaggccaaggcaggtggatcacttgaggtcagagttcaagaccagccttgccaacatggtgaaacccatctctacttaaaaaaaaatacaaaaaaattagccaggcatggtggcacacacctgtaatctcagctattcaggagactgaggcaggagaatagcttgaaccaaggaggcgtaggttgcagtgagctgagatggagccaccacactccagcctgggcaacagagcaaggctctgtctcagagaaaaaaggccaggcgtgatgggtcatgcctgtagtccc

SEQ ID NO: 277756 - DNA, 1237 bp, Homo sapiens
gaggccaaacatggggcggggcggcgcggccggggaagcgtgatgaaggcctacgagtgcggcgcggcctgaaggggcacgcgggggacctgcaaagctagtgaggggcggggcaggcggcgcggtgggggcgggccgagcccggaggccagatgagcggacacagccccacgcgcggggccatgcaggtggccatgaacggtaaggcccgcaaagaggcggtgcagactgcggctaaggaactcctcaagttcgtgaaccggagtccctctcctttccatgctgtggctgaatgccgcaaccgccttctccaggctggcttcagtgaactcaaggagactgagaaatggaatattaagcccgagagcaagtacttcatgaccaggaactcctccaccatcatagcttttgctgtagggggccagtacgttcctggcaatggcttcagcctcatcggggcccacacggacagcccctgcctccgggtgaaacgtcggtctcgccgcagccaggtgggcttccagcaagtcggtgtggagacctatggtggtgggatctggagcacctggtttgaccgtgacctgactctggctggacgcgtcattgtcaagtgccctacctcaggtcggctggagcagcagctggtgcacgtggagcggcccattcttcgcatcccacacctggccatccatctgcagcgaaatatcaacgagaactttgggcccaacacagagatgcatctagtccccattcttgccacagccatccaggaggagctggagaaggggactcctgagccagggcctctcaatgctgtggatgagcggcaccattcggtcctcatgtccctgctctgtgcccatctggggctgagccccaaggacatagtggagatggagctctgccttgcagacacccagcctgcggtcttgggtggtgcctatgatgagttcatctttgctcctcggctggacaatctgcacagctgcttctgtgccctgcaggccttgatagattcctgtgcaggccctggctccctggccacagagcctcacgtgcgcatggtcacactctatgacaacgaagagggcttctttgagctgttcccttctctaagccataatctcttagtggattgagccctcttggaaagacttctctgccatccctttgcacctgagaggggaagttctcagctgagctgaagctggattattaaagtggattgtcactcaga

SEQ ID NO: 277757 - DNA, 831 bp, Homo sapiens
ggaaacccaccagtactgttaagaatgtgagttagtttggtctcagcccactgtctggtgttcagtgacgaccccaggttaggggtgttgctaagaacacccagtgactcagtggggttttgggccagttgggcaatgggcccctctcactggcttccaagatcaggcccctaagcccagattcccagagtcaggactctactgtcgccaggtggggtctgagagtgcacagggagcacagtcactgctgacagagctggtgctgcggcggatctcagcctcgtgccagcacccgacagccttcgaggaagccatacccaagtccttcatgatcagcgcagacatggcccatgctgtgcatcccaactacctggacaagcatgaggagaaccaccggcctttattccacaagggccccgtgatcaaggtgaacagcaagcaacgctatgcttcaaacgcggtgtcagaggccctgatccgagaggtggccaacaaagtcaaggtccccctgcaggatctcatggtccggaatgacaccccctgtggaaccaccattggacctatcttggcttctcggctggggctgcgggtgctggatttaggcagcccccaactggccatgcactctatccgggagatggcctgcaccacaggagtcctccagaccctcaccctcttcaagggcttctttgagctgttcccttctctaagccataatctcttagtggattgagccctcttggaaagacttctctgccatccctttgcacctgagaggggaagttctcagctgagctgaagctggattattaaagtggattgtcactcaga

SEQ ID NO: 277758 - DNA, 1440 bp, Homo sapiens
tgtggaatacacctttgtctacaaacttgtttccatctattgctagaggctgcccggaaccctgtgtgtggaatgactctgaagtcccactgggctgggcgggaaagagtggtgatctattagtgatgtctgccatgggagggtggtgagtgtcgacaggcctgctcctgtttgctatgtctggcccttatctgtctcttacagggacaagcatgaggagaaccaccggcctttattccacaagggccccgtgatcaaggtgaacagcaagcaacgctatgcttcaaacgcggtgtcagaggccctgatccgagaggtggccaacaaagtcaaggtccccctgcaggatttaggcagcccccaactggccatgcactctatccgggagatggcctgcaccacaggagtcctccagaccctcaccctcttcaagggcttctttgagctgttcccttctctaagccataatctcttagtggattgagccctcttggaaagacttctctgccatccctttgcacctgagaggggaagttctcagctgagctgaagctggattattaaagtggattgtcactcagactctccgtgctacgcttatttggagactagaggagtgggagttgagcctggcttgaacctttggaaccagaaaagttggggagcaggtggaggaggccacactcctgggagctgatggttttaaatctggttttaaatctcttctctgtctcaagtccatgtctgaagtgggtgaagggtggactggatcctcaagcagaaggtcacttctcccacccctagtcctccacctgggaaatggcctcaacggtcttccctctttccatccccagaatgggtgtcccgctctgccttcagagatcctgttctgcactgggccaccttcagagctgctctgggcagacaaagctgtttctcaccctcccaaaatcccttcccatcccctctcaggagctgcaaagagaagggcacagtctatatcttatcacccttcatcatccacttctcagcagtccctggtattacttgattgtgaacatattatcaggaaaaaagattatcattgaaaaaattggaaaagtcaaagtctggccgggtgcagcggctcacatctgtattcccagcattttgggaggccaaggcaggtggatcacttgaggtcagagttcaagaccagccttgccaacatggtgaaacccatctctacttaaaaaaaaatacaaaaaaattagccaggcatggtggcacacacctgtaatctcagctattcaggagactgaggcaggagaatagcttgaaccaaggaggcgtaggttgcagtgagctgagatggagccaccacactccagcctgggcaacagagcaaggctctgtctcagagaaaaaaggccaggcgtgatgggtcatgcctgtagtccc

SEQ ID NO: 277759 - DNA, 138 bp, Homo sapiens
gtggcaggacatctccatctggtcactcactaattccaaactccatgttgcctcccattatggcttctttgagctgttcccttctctaagccataatctcttagtggattgagccctcttggaaagacttctctgcca

SEQ ID NO: 277760 - DNA, 2485 bp, Homo sapiens
gaggccaaacatggggcggggcggcgcggccggggaagcgtgatgaaggcctacgagtgcggcgcggcctgaaggggcacgcgggggacctgcaaagctagtgaggggcggggcaggcggcgcggtgggggcgggccgagcccggaggccagatgagcggacacagccccacgcgcggggccatgcaggtggccatgaacggtaaggcccgcaaagaggcggtgcagactgcggctaaggaactcctcaagttcgtgaaccggagtccctctcctttccatgctgtggctgaatgccgcaaccgccttctccaggctggcttcagtgaactcaaggagactgagaaatggaatattaagcccgagagcaagtacttcatgaccaggaactcctccaccatcatagcttttgctgtagggggccagtacgttcctggcaatggcttcagcctcatcggggcccacacggacagcccctgcctccgggtgaaacgtcggtctcgccgcagccaggtgggcttccagcaagtcggtgtggagacctatggtggtgggatctggagcacctggtttgaccgtgacctgactctggctggacgcgtcattgtcaagtgccctacctcaggtcggctggagcagcagctggtgcacgtggagcggcccattcttcgcatcccacacctggccatccatctgcagcgaaatatcaacgagaactttgggcccaacacagagatgcatctagtccccattcttgccacagccatccaggaggagctggagaaggggactcctgagccagggcctctcaatgctgtggatgagcggcaccattcggtcctcatgtccctgctctgtgcccatctggggctgagccccaaggacatagtggagatggagctctgccttgcagacacccagcctgcggtcttgggtggtgcctatgatgagttcatctttgctcctcggctggacaatctgcacagctgcttctgtgccctgcaggccttgatagattcctgtgcaggccctggctccctggccacagagcctcacgtgcgcatggtcacactctatgacaacgaagaggtggggtctgagagtgcacagggagcacagtcactgctgacagagctggtgctgcggcggatctcagcctcgtgccagcacccgacagccttcgaggaagccatacccaagtccttcatgatcagcgcagacatggcccatgctgtgcatcccaactacctggacaagcatgaggagaaccaccggcctttattccacaagggccccgtgatcaaggtgaacagcaagcaacgctatgcttcaaacgcggtgtcagaggccctgatccgagaggtggccaacaaagtcaaggtccccctgcaggatttaggcagcccccaactggccatgcactctatccgggagatggcctgcaccacaggagtcctccagaccctcaccctcttcaagggcttctttgagctgttcccttctctaagccataatctcttagtggattgagccctcttggaaagacttctctgccatccctttgcacctgagaggggaagttctcagctgagctgaagctggattattaaagtggattgtcactcagactctccgtgctacgcttatttggagactagaggagtgggagttgagcctggcttgaacctttggaaccagaaaagttggggagcaggtggaggaggccacactcctgggagctgatggttttaaatctggttttaaatctcttctctgtctcaagtccatgtctgaagtgggtgaagggtggactggatcctcaagcagaaggtcacttctcccacccctagtcctccacctgggaaatggcctcaacggtcttccctctttccatccccagaatgggtgtcccgctctgccttcagagatcctgttctgcactgggccaccttcagagctgctctgggcagacaaagctgtttctcaccctcccaaaatcccttcccatcccctctcaggagctgcaaagagaagggcacagtctatatcttatcacccttcatcatccacttctcagcagtccctggtattacttgattgtgaacatattatcaggaaaaaagattatcattgaaaaaattggaaaagtcaaagtctggccgggtgcagcggctcacatctgtattcccagcattttgggaggccaaggcaggtggatcacttgaggtcagagttcaagaccagccttgccaacatggtgaaacccatctctacttaaaaaaaaatacaaaaaaattagccaggcatggtggcacacacctgtaatctcagctattcaggagactgaggcaggagaatagcttgaaccaaggaggcgtaggttgcagtgagctgagatggagccaccacactccagcctgggcaacagagcaaggctctgtctcagagaaaaaaggccaggcgtgatgggtcatgcctgtagtccc

SEQ ID NO: 277761 - DNA, 1483 bp, Homo sapiens
ttatttcattgccgggcggccttagtgtagttactggcccgtcgtttgtacattatgctgtggctgaatgccgcaaccgccttctccaggctggcttcagtgaactcaaggagactgagaaatggaatattaagcccgagagcaagtacttcatgaccaggaactcctccaccatcatagcttttgctgtagggggccagtacgttcctggcaatggcttcagcctcatcggggcccacacggacagcccctgcctccgggtgaaacgtcggtctcgccgcagccaggtgggcttccagcaagtcggtgtggagacctatggtggtgggatctggagcacctggtttgaccgtgacctgactctggctggacgcgtcattgtcaagtgccctacctcaggtcggctggagcagcagctggtgcacgtggagcggcccattcttcgcatcccacacctggccatccatctgcagcgaaatatcaacgagaactttgggcccaacacagagatgcatctagtccccattcttgccacagccatccaggaggagctggagaaggggactcctgagccagggcctctcaatgctgtggatgagcggcaccattcggtcctcatgtccctgctctgtgcccatctggggctgagccccaaggacatagtggagatggagctctgccttgcagacacccagcctgcggtcttgggtggtgcctatgatgagttcatctttgctcctcggctggacaatctgcacagctgcttctgtgccctgcaggccttgatagattcctgtgcaggccctggctccctggccacagagcctcacgtgcgcatggtcacactctatgacaacgaagaggtggggtctgagagtgcacagggagcacagtcactgctgacagagctggtgctgcggcggatctcagcctcgtgccagcacccgacagccttcgaggaagccatacccaagtccttcatgatcagcgcagacatggcccatgctgtgcatcccaactacctggacaagcatgaggagaaccaccggcctttattccacaagggccccgtgatcaaggtgaacagcaagcaacgctatgcttcaaacgcggtgtcagaggccctgatccgagaggtggccaacaaagtcaaggtccccctgcaggatctcatggtccggaatgacaccccctgtggaaccaccattggacctatcttggcttctcggctggggctgcgggtgctggatttaggcagcccccaactggccatgcactctatccgggagatggcctgcaccacaggagtcctccagaccctcaccctcttcaagggcttctttgagctgttcccttctctaagccataatctcttagtggattgagccctcttggaaagacttctctgccatccctttgcacctgagaggggaagttctcagctgagctgaagctggattattaaagtggattgtcactcaga

SEQ ID NO: 277762 - DNA, 1649 bp, Homo sapiens
gaggccaaacatggggcggggcggcgcggccggggaagcgtgatgaaggcctacgagtgcggcgcggcctgaaggggcacgcgggggacctgcaaagctagtgaggggcggggcaggcggcgcggtgggggcgggccgagcccggaggccagatgagcggacacagccccacgcgcggggccatgcaggtggccatgaacggtaaggcccgcaaagaggcggtgcagactgcggctaaggaactcctcaagttcgtgaaccggagtccctctcctttccatgctgtggctgaatgccgcaaccgccttctccaggctggcttcagtgaactcaaggagactgagaaatggaatattaagcccgagagcaagtacttcatgaccaggaactcctccaccatcatagcttttgctgtagggggccagtacgttcctggcaatggcttcagcctcatcggggcccacacggacagcccctgcctccgggtgaaacgtcggtctcgccgcagccaggtgggcttccagcaagtcggtgtggagacctatggtggtgggatctggagcacctggtttgaccgtgacctgactctggctggacgcgtcattgtcaagtgccctacctcaggtcggctggagcagcagctggtgcacgtggagcggcccattcttcgcatcccacacctggccatccatctgcagcgaaatatcaacgagaactttgggcccaacacagagatgcatctagtccccattcttgccacagccatccaggaggagctggagaaggggactcctgagccagggcctctcaatgctgtggatgagcggcaccattcggtcctcatgtccctgctctgtgcccatctggggctgagccccaaggacatagtggagatggagctctgccttgcagacacccagcctgcggtcttgggtggtgcctatgatgagttcatctttgctcctcggctggacaatctgcacagctgcttctgtgccctgcaggccttgatagattcctgtgcaggccctggctccctggccacagagcctcacgtgcgcatggtcacactctatgacaacgaagaggtggggtctgagagtgcacagggagcacagtcactgctgacagagctggtgctgcggcggatctcagcctcgtgccagcacccgacagccttcgaggaagccatacccaagtccttcatgatcagcgcagacatggcccatgctgtgcatcccaactacctggacaagcatgaggagaaccaccggcctttattccacaagggcccgtgatcaaggtggcaaaggccccaacgttgtaggccctacgggctactacaacccttcggtgacgccataaaaactcttcaccaaagagcccttaaacccgcaaatctaccatcaacctttaaatcaacggccgacttagctttcaacatcgtcttattattgaaacccccctccatagcgaaccccgggtcaactacactaaggtctatttattgaggcccttacgagcgggcacccacccctgccaggggggaaccgctgccgtggccggcgacgccccacactcttcgcccattttgagtgccacacgcgccgcgcaaaagcacaaacaacaaggggcacggcgccgcatga

SEQ ID NO: 277763 - DNA, 1121 bp, Homo sapiens
gaggccaaacatggggcggggcggcgcggccggggaagcgtgatgaaggcctacgagtgcggcgcggcctgaaggggcacgcgggggacctgcaaagctagtgaggggcggggcaggcggcgcggtgggggcgggccgagcccggaggccagatgagcggacacagccccacgcgcggggccatgcaggtggccatgaacggtaaggcccgcaaagaggcggtgcagactgcggctaaggaactcctcaagttcgtgaaccggagtccctctcctttccatgctgtggctgaatgccgcaaccgccttctccaggctggcttcagtgaactcaaggagactgagaaatggaatattaagcccgagagcaagtacttcatgaccaggaactcctccaccatcatagcttttgctgtagggggccagtacgttcctggcaatggcttcagcctcatcggggcccacacggacagcccctgcctccgggtgaaacgtcggtctcgccgcagccaggtgggcttccagcaagtcggtgtggagacctatggtggtgggatctggagcacctggtttgaccgtgacctgactctggctggacgcgtcattgtcaagtgccctacctcaggtcggctggagcagcagctggtgcacgtggagcggcccattcttcgcatcccacacctggccatccatctgcagcgaaatatcaacgagaactttgggcccaacacagagatgcatctagtccccattcttgccacagccatccaggaggagctggagaaggggactcctgagccagggcctctcaatgctgtggatgagcggcaccattcggtcctcatgtccctgctctgtgcccatctggggctgagccccaaggacatagtggagatggagctctgccttgcagacacccagcctgcggtcttgggtggtgcctatgatgagttcatctttgctcctcggctggacaatctgcacagctgcttctgtgccctgcaggccttgataagattcctgtgcaaggcctgggtcctggcaagaacctcaagtgggctgtttccactctatgaaacaaaagtggggctaaatgcccaggccagcctgctgaaaactgtg

SEQ ID NO: 277764 - DNA, 469 bp, Homo sapiens
cattccctttgggcctgtcattacctctgcctcaccttgactctccccagggccccgtgatcaaggtgaacagcaagcaacgctatgcttcaaacgcggtgtcagaggccctgatccgagaggtggccaacaaagtcaaggtccccctgcaggatctcatggtccggaatgacaccccctgtggaaccaccattggacctatcttggcttctcggctggggctgcgggtgctggatttaggcagcccccaactggccatgcactctatccgggagatggcctgcaccacaggagtcctccagaccctcaccctcttcaagggcttctttgagctgttcccttctctaagccataatctcttagtggattgagccctcttggaaagacttctctgccatccctttgcacctgagaggggaagttctcagctgagctgaagctggattattaaagtggattgtcactcaga

SEQ ID NO: 277765 - DNA, 418 bp, Homo sapiens
ttgcctaggctggtcttgaacttctggcctcaagaaatcctcctcctgatcctcctacctcagccttccaaagtgttgggattacagcactggctagaacttccatccctgtggtgaataagagtgatgaaagtggacaccatcgtattattgaattgaagggacacctctgaaaacgtgtttagagagagagtgaagaatgagggtgtacctggcggagccaccatcctctgccacttctgaaacaagcaggtcttcaggcagtctcggggactgaggttgtaagttttatgtctcgacatcagttcctgcattggctccaatattacacacaactgcaagaagttcaaagacattggcatttcactacttcataacactaattacaataaataatgctaacagctggaatcaagta

SEQ ID NO: 277766 - DNA, 367 bp, Homo sapiens
ttactggcttttctttcttccctgtctcagatttctcacttcctcacaggacgtgtgggatcatctcccagatgaactaccagttcctaagtatttgtctgaagcactggctagaacttccatccctgtggtgaataagagtgatgaaagtggacaccatcgtattattgaattgaagggattcaaacctcttctgtgataatcatagaactgtagcatcagaaggcaattccctaagtgtggtctgcccacatccctggtggtaagccaaatgatcgtaagtggtagagcggcaattacttttaaaaaatttgacagtcatatatctatttcaatgtatagcaaatatagaattggaacatcaaac

SEQ ID NO: 277767 - DNA, 875 bp, Homo sapiens
gcgtcaagatcacggaattccaggctgggcgcagtggctcacgcctgtaatcccagcactttgggaggctgagaatatggggaagaaaaatgtcagctccagccaaagcccagcaccatcgcccttacccagaacactgtatgctacaagaatccatccacctacaccccttctccacctgggtgtctctcagacccagaaaatggtgccattggcccactgacaactaaatgtggggacaggtctcttacaagccactgggtagtaaaagcatcctgaggtggcataccatatcgcataattgcattaagaaaggcttttcgctgacgagcattaaaaccaagtacctaggggaagaagaaacccaggtgagaggcagcaggtcgcattccaccaaagatgcaatatctgacactcacccctccttagaatcgtatggcacttacttcaatattcccaccaacacgggccaacagaggaggcaatggcttatctttatcattccgcaggcccttacgactgggcctacggggagctgcaagaagaaaaagatgaatgagtgacacaggtaggatattaaacaaagcaacatttagaaaagcaacaaaaaaagcacagccctcaccttctgaacgttcatcaaagtcttcatcaccttcctctgaagccactgagtaatcggactggttgtcggactggtcgtcctgccaatctggagggagagagggcagatgagcggggcccactgctctagtggaacggcccatgggtggggggcggggccggccacacacacctcggtcctcctgggagccatcattgtagttgacctgtttacggattctttttcctttgcccagatttcgggctagatc

SEQ ID NO: 277768 - DNA, 751 bp, Homo sapiens
tttttttttgaagaatatgaacaacaaacaaatgttcaggaaatatgtgaaaaagaacagaatataaaactttatataatattccaattgtgtatgtacatagaaaagaagccaaaatataaaacaaattaacaattggtgcttctaattgaattatatattatttcatcgcctacaacataaatcactcccctttatttgtccttaaaagcatctctcttcatactttagaaggaacttcctagttctagcacttcaaaaagaacattataaattattttccatcaaaactttgatatagttaaacctataagataaccatcaattataatttctatttatttcccgttcagataagcacttcataaatgtttgctgacagattacaaaaattgtgcgcaaggactcactcacctcgacttgatccctttaaaaatctctaatacataagctgaaggctataaaggaaggattaataccattagtgatactcttggttggtttctactaaagttctctaatttctatctcctataaaacaggaacccctccttcttacttcagaaaaagtattctaaaatggcaagatctgcatgagtttagagtcagtcagatctgggttgacaactgaactctgccccttaccaactatgctacaagtcaagccagattccttatctataaggtgaagataccctgactcacaaaattactgtgatgagacatgcaataaaatactaattagagatta

SEQ ID NO: 277769 - DNA, 669 bp, Homo sapiens
gtagacctacatgtttgtaggctgaagagagtggagcagaagatatatattaaaaatatgaatgagtagaagtgattgaaactgcaatatccaaaacagggcaaaagaataataaaaaacagagctgaagggttagtcttggcaagggagaagctgaagatagctgatgattcagatattccgaggtgaaggagaaagttaaaggaacttgtgtcagatagcactgatgtcaataaatgaagtttagttcatttgttcatttatgctttcaaagatgccgaaacgcctgcctttatgtagcttacattccagtgggaggacagacaatacataaactgttttaacaagcagcaattatgataaacgaccaaaagactttccccagggaaaagaaaatccaatggtccagagaacttctacaatttattcctccacacttggagtcttcatgtctcgtaaagtttctccacattagtttcttctcggtacaactcaatagcctccataatcctctcagcctacagaggatgagaaaggaaagaagtcatcacaacatactccatcatcccaggacactgaaactggaagaactgaccagaaatttgccaaatgaaatagcttcaatctgtttaataaagacgtgcgaatagagtgccaaaaagcaaaaaa

SEQ ID NO: 277770 - DNA, 1923 bp, Homo sapiens
ttccatgaagcatcaccatgcaagtaaaaaggaagatacaattgtccctctaatctccggtcaaggtcatggaaacacttccctcagttgagaaaaaaactccaggacctccgtttggtactcagatttggaaaggcctttgcattgagtccaagcagctagtgagtgccccgggtgccatactcaagagccccagtgtgctacagatgcgccaattcattcagcatgaggtcataaagaatgaggtgaaactgaggctgcaggtttcccttaaggattacataaactatattctaaagaaagaagatgagctgcaggaaatgatggttaaagattccagaactgaggaggagagaggcaatgctgctgatctcctcaagctggttatgtctttccctaaaatggaggaaactacaaaaagtcatgttactgaagttgcagctcacctaactgatttattcaagcagtctttggctacgcctccaaaatgcccaccagacacatttggtaaagatttctttgaaaagacatggagacacacagcatcctcaaaacgctggaaagaaaagatagacaaaacgaggaaggaaattgagacaacacagaattacctaatggatattaagaaccgcataataccacccttttttaaatctgaattgaaccagttatatcagtctcagtataatcacctggacagtctttccaaaaaactgccttcttttacaaagaaaaatgaagatgcaaacgaaacagctgttcaagatacatctgatcttaatctagatttcaagccacataaggtttcagaacagaaatcctcaagtgtgcctagtcttccaaaaccagagatttctgcagataagaaggatttcactgctcagaaccaaactgaaaatttaacaaaatctcctgaagaagcagaatcttatgagcccgtgaaaattccaacccagtccttgctgcaggatgttgcgggacaaacaagaaaagaaaaagtgaagttgcctcattatttgctgagttccaagcctaagtctcaacctcttgcaaaggtgcaagattctgttggaggaaaagtgaacacatcctctgttgcatctgctgccattaataatgcaaagtcatccctttttgggttccatcttctcccatcatcagtcaagtttggagtgcttaaggaaggacatacctatgccacagttgtaaagctcaagaatgttggagtggacttctgcaggtttaaagtaaagcagcccccacccagcacaggactgaaagtgacttacaaacctggacctgtggcagctggtatgcagacagaactgaatatagagttatttgccacagctgttggagaggatggggccaagggatcagcacacatctctcacaatatcgagattatgacagagcatgaggttctgttcctacctgtggaagcaactgttttaacaagcagcaattatgataaacgaccaaaagactttccccagggaaaagaaaatccaatggtccagagaacttctacaatttattcctccacacttggagtcttcatgtctcgtaaagtttctccacattaggaacccctccttcttacttcagaaaaagtattctaaaatggcaagatctgcatgagtttagagtcagtcagatctgggttgacaactgaactctgccccttaccaactatgctacaagtcaagccagattccttatctataagtttcttctcggtacaactcaatagcctccataatcctctcagcctacagaggatgagaaaggaaagaagtcatcacaacatactccatcatcccaggacactgaaactggaagaactgaccagaaatttgccaaatgaaatagcttcaatctgtttaataaagacgtgcgaatagagtgccaaaaagcaaaaaa

SEQ ID NO: 277771 - DNA, 1804 bp, Homo sapiens
ttccatgaagcatcaccatgcaagtaaaaaggaagatacaattgtccctctaatctccggtcaaggtcatggaaacacttccctcagttgagaaaaaaactccaggacctccgtttggtactcagatttggaaaggcctttgcattgagtccaagcagctagtgagtgccccgggtgccatactcaagagccccagtgtgctacagatgcgccaattcattcagcatgaggtcataaagaatgaggtgaaactgaggctgcaggtttcccttaaggattacataaactatattctaaagaaagaagatgagctgcaggaaatgatggttaaagattccagaactgaggaggagagaggcaatgctgctgatctcctcaagctggttatgtctttccctaaaatggaggaaactacaaaaagtcatgttactgaagttgcagctcacctaactgatttattcaagcagtctttggctacgcctccaaaatgcccaccagacacatttggtaaagatttctttgaaaagacatggagacacacagcatcctcaaaacgctggaaagaaaagatagacaaaacgaggaaggaaattgagacaacacagaattacctaatggatattaagaaccgcataataccacccttttttaaatctgaattgaaccagttatatcagtctcagtataatcacctggacagtctttccaaaaaactgccttcttttacaaagaaaaatgaagatgcaaacgaaacagctgttcaagatacatctgatcttaatctagatttcaagccacataaggtttcagaacagaaatcctcaagtgtgcctagtcttccaaaaccagagatttctgcagataagaaggatttcactgctcagaaccaaactgaaaatttaacaaaatctcctgaagaagcagaatcttatgagcccgtgaaaattccaacccagtccttgctgcaggatgttgcgggacaaacaagaaaagaaaaagtgaagttgcctcattatttgctgagttccaagcctaagtctcaacctcttgcaaaggtgcaagattctgttggaggaaaagtgaacacatcctctgttgcatctgctgccattaataatgcaaagtcatccctttttgggttccatcttctcccatcatcagtcaagtttggagtgcttaaggaaggacatacctatgccacagttgtaaagctcaagaatgttggagtggacttctgcaggtttaaagtaaagcagcccccacccagcacaggactgaaagtgacttacaaacctggacctgtggcagctggtatgcagacagaactgaatatagagttatttgccacagctgttggagaggatggggccaagggatcagcacacatctctcacaatatcgagattatgacagagcatgaggttctgttcctacctgtggaagcaactgttttaacaagcagcaattatgataaacgaccaaaagactttccccagggaaaagaaaatccaatggtccagagaacttctacaatttattcctccacacttggagtcttcatgtctcgtaaagtttctccacattagctttgtgttccttcatttttgcagtttcttctcggtacaactcaatagcctccataatcctctcagcctacagaggatgagaaaggaaagaagtcatcacaacatactccatcatcccaggacactgaaactggaagaactgaccagaaatttgccaaatgaaatagcttcaatctgtttaataaagacgtgcgaatagagtgccaaaaagcaaaaaa

SEQ ID NO: 277772 - DNA, 812 bp, Homo sapiens
gtagacctacatgtttgtaggctgaagagagtggagcagaagatatatattaaaaatatgaatgagtagaagtgattgaaactgcaatatccaaaacagggcaaaagaataataaaaaacagagctgaagggttagtcttggcaagggagaagctgaagatagctgatgattcagatattccgaggtgaaggagaaagttaaaggaacttgtgtcagatagcactgatgtcaataaatgaagtttagttcatttgttcatttatgctttcaaagatgccgaaacgcctgcctttatgtagcttacattccagtgggaggacagacaatacataaactgttttaacaagcagcaattatgataaacgaccaaaagactttccccagggaaaagaaaatccaatggtccagagaacttctacaatttattcctccacacttggagtcttcatgtctcgtaaagtttctccacattaggaacccctccttcttacttcagaaaaagtattctaaaatggcaagatctgcatgagtttagagtcagtcagatctgggttgacaactgaactctgccccttaccaactatgctacaagtcaagccagattccttatctataagtttcttctcggtacaactcaatagcctccataatcctctcagcctacagaggatgagaaaggaaagaagtcatcacaacatactccatcatcccaggacactgaaactggaagaactgaccagaaatttgccaaatgaaatagcttcaatctgtttaataaagacgtgcgaatagagtgccaaaaagcaaaaaa

SEQ ID NO: 277773 - DNA, 1780 bp, Homo sapiens
ttccatgaagcatcaccatgcaagtaaaaaggaagatacaattgtccctctaatctccggtcaaggtcatggaaacacttccctcagttgagaaaaaaactccaggacctccgtttggtactcagatttggaaaggcctttgcattgagtccaagcagctagtgagtgccccgggtgccatactcaagagccccagtgtgctacagatgcgccaattcattcagcatgaggtcataaagaatgaggtgaaactgaggctgcaggtttcccttaaggattacataaactatattctaaagaaagaagatgagctgcaggaaatgatggttaaagattccagaactgaggaggagagaggcaatgctgctgatctcctcaagctggttatgtctttccctaaaatggaggaaactacaaaaagtcatgttactgaagttgcagctcacctaactgatttattcaagcagtctttggctacgcctccaaaatgcccaccagacacatttggtaaagatttctttgaaaagacatggagacacacagcatcctcaaaacgctggaaagaaaagatagacaaaacgaggaaggaaattgagacaacacagaattacctaatggatattaagaaccgcataataccacccttttttaaatctgaattgaaccagttatatcagtctcagtataatcacctggacagtctttccaaaaaactgccttcttttacaaagaaaaatgaagatgcaaacgaaacagctgttcaagatacatctgatcttaatctagatttcaagccacataaggtttcagaacagaaatcctcaagtgtgcctagtcttccaaaaccagagatttctgcagataagaaggatttcactgctcagaaccaaactgaaaatttaacaaaatctcctgaagaagcagaatcttatgagcccgtgaaaattccaacccagtccttgctgcaggatgttgcgggacaaacaagaaaagaaaaagtgaagttgcctcattatttgctgagttccaagcctaagtctcaacctcttgcaaaggtgcaagattctgttggaggaaaagtgaacacatcctctgttgcatctgctgccattaataatgcaaagtcatccctttttgggttccatcttctcccatcatcagtcaagtttggagtgcttaaggaaggacatacctatgccacagttgtaaagctcaagaatgttggagtggacttctgcaggtttaaagtaaagcagcccccacccagcacaggactgaaagtgacttacaaacctggacctgtggcagctggtatgcagacagaactgaatatagagttatttgccacagctgttggagaggatggggccaagggatcagcacacatctctcacaatatcgagattatgacagagcatgaggttctgttcctacctgtggaagcaactgttttaacaagcagcaattatgataaacgaccaaaagactttccccagggaaaagaaaatccaatggtccagagaacttctacaatttattcctccacacttggagtcttcatgtctcgtaaagtttctccacattagtttcttctcggtacaactcaatagcctccataatcctctcagcctacagaggatgagaaaggaaagaagtcatcacaacatactccatcatcccaggacactgaaactggaagaactgaccagaaatttgccaaatgaaatagcttcaatctgtttaataaagacgtgcgaatagagtgccaaaaagcaaaaaa

SEQ ID NO: 277774 - DNA, 1334 bp, Homo sapiens
ttccatgaagcatcaccatgcaagtaaaaaggaagatacaattgtccctctaatctccggtcaaggtcatggaaacacttccctcagttgagaaaaaaactccaggacctccgtttggtactcagatttggaaaggcctttgcattgagtccaagcagctagtgagtgccccgggtgccatactcaagagccccagtgtgctacagatgcgccaattcattcagcatgaggtcataaagaatgaggtgaaactgaggctgcaggtttcccttaaggattacataaactatattctaaagaaagaagatgagctgcaggaaatgatggttaaagattccagaactgaggaggagagaggcaatgctgctgatctcctcaagctggttatgtctttccctaaaatggaggaaactacaaaaagtcatgttactgaagttgcagctcacctaactgatttattcaagcagtctttggctacgcctccaaaatgcccaccagacacatttggtaaagatttctttgaaaagacatggagacacacagcatcctcaaaacgctggaaagaaaagatagacaaaacgaggaaggaaattgagacaacacagaattacctaatggatattaagaaccgcataataccacccttttttaaatctgaattgaaccagttatatcagtctcagtataatcacctggacagtctttccaaaaaactgccttcttttacaaagaaaaatgaagatgcaaacgaaacagctgttcaagatacatctgatcttaatctagatttcaagccacataaggtttcagaacagaaatcctcaagtgtgcctagtcttccaaaaccagagatttctgcagataagaaggatttcactgctcagaaccaaactgaaaatttaacaaaatctcctgaagaagcagaatcttatgagcccgtgaaaattccaacccagtccttgctgcaggatgttgcgggacaaacaagaaaagaaaaagtgaagttgcctcattatttgctgagttccaagcctaagtctcaacctcttgcaaaggtgcaagattctgttggaggaaaagtgaacacatcctctgttgcatctgctgccattaataatgcaaagtcatccctttttgggttccatcttctcccatcatcagtcaagtttggagtgcttaaggaaggacatacctatgccacagttgtaaagctcaagaatgttggagtggacttctgcaggtgaggccaagggaccaaaggtctgctcaggttacctttccctaccctgtgacttgtctttggtcacctccatcaataaatgtttattgaaccg

SEQ ID NO: 277775 - DNA, 1077 bp, Homo sapiens
tttttttttttaaaaccgctttattcaggttggctggtagtcacagactggatcatgtatacagggcaacccacccctaggcaaagccctcggcctctcccacctcccccacgtcatcactgagctgcggcagccagaggtgccagccaattccgaggagaattgggtccaatagaaatatttacaaataaccagggggcaggtgtgcccgtgatcgggaatcgtgagggaactgagtaccagggggcccttggctcccaacagccccaggccctggggcggacttggcacaggacccaagagggagctggggcattggggggccggcagagggggactcctgggagagccttgaaggccctcaaaggggtcctgctggtgcaaaactctgcctggggccatgggtccgagggaaaggcccctcccttctgactcgccgtgtgacagggcagagaatcctggatcccctgcatccctggagggtcgcacagggagctgaacaggaaggactcgccaggaggtggtggggcatctcgctgttcccctaggcctccatgagtgaccctgcagagccactgccccagaagggccctcctgggttccctgggtcttcaccaggggagaggccctagttctgctcagaagattcaagtccatattcagggaggggtcactgtccacacccccaggtccaagtgagggatggtaggaggagggaggcgaggctggggggccccggctcaggacaggatgggggacaagcaagcaaagcaaaacactggactccacagaagctggtgacaggaagggggtggccccgggccccagcatggtcctgccccagtgttcagggcggttggccccttggtgcccagggccaccttctccgagccaggtcaccgcaggggtctgaaagggcaggggtgggtggggcttacatgctgagcaaggggtggtggaaagagggccgacatggtggccacaggcggcctcggggatggggcgcggctggacgcaggcagtcggtccccggtggtccggcggctcctcatgcactctgtacagcgtgggggcgga

SEQ ID NO: 277776 - DNA, 988 bp, Homo sapiens
tttttttttttaaaaccgctttattcaggttggctggtagtcacagactggatcatgtatacagggcaacccacccctaggcaaagccctcggcctctcccacctcccccacgtcatcactgagctgcggcagccagagggaactgagtaccagggggcccttggctcccaacagccccaggccctggggcggacttggcacaggacccaagagggagctggggcattggggggccggcagagggggactcctgggagagccttgaaggccctcaaaggggtcctgctggtgcaaaactctgcctggggccatgggtccgagggaaaggcccctcccttctgactcgccgtgtgacagggcagagaatcctggatcccctgcatccctggagggtcgcacagggagctgaacaggaaggactcgccaggaggtggtggggcatctcgctgttcccctaggcctccatgagtgaccctgcagagccactgccccagaagggccctcctgggttccctgggtcttcaccaggggagaggccctagttctgctcagaagattcaagtccatattcagggaggggtcactgtccacacccccaggtccaagtgagggatggtaggaggagggaggcgaggctggggggccccggctcaggacaggatgggggacaagcaagcaaagcaaaacactggactccacagaagctggtgacaggaagggggtggccccgggccccagcatggtcctgccccagtgttcagggcggttggccccttggtgcccagggccaccttctccgagccaggtcaccgcaggggtctgaaagggcaggggtgggtggggcttacatgctgagcaaggggtggtggaaagagggccgacatggtggccacaggcggcctcggggatggggcgcggctggacgcaggcagtcggtccccggtggtccggcggctcctcatgcactctgtacagcgtgggggcgga

SEQ ID NO: 277777 - DNA, 935 bp, Homo sapiens
ctccgttgtcgagcgttttccgctgacggagccctcacctcagacaccggcggtagggctggatgcgggcccggcccaggaccggtcttctgtcctcacaccggggaggaccacgcaggaaggagctgagtcagagagaccgtgtgtaatttgctcagcgtcacacagatagtaaacggcagagccgctcttcctccctgtcccgccagctcctgccttctgctgtcttggatctcctatgcacgggaaacctgttgaagacgaggtctcactgtgttgctcaagctgtcctggaagtcctggactgaagtgatcctcccacctcggcctcccaaggtgctgggattacaggtgtgagccaccatgcccagccaaaaccttgatttttctgtcaccccctccactgcaccctgagaatcactgctgtaagtagactactgaagagagtatgttgaaaatgttctcatttggtaagaagtaattccaactacattcacgtgattatggtctctaaactaatatgacctaggagagagaccctagtgacattatgttaaccatttcttaaggaccttaaaccctagtgacattatgttaaccatttcttaaggaccttaaaccctagtgacattatgttaaccatttcttaaggaccttcgcccactgtgctgctgtggccacaaaagccatataatgttgggtgacctgaatatcaattaacacagtattataaaatcctctgcatctgcactttgaaaaagcatcacagggctgggagcagtggctcacgcctgtaatcccagcactttggaaggccaagacgagtgaattacctgaggtcaggagtttgagaccggcctggtcaacatggtgacaccccgtgtctactaaaaatacaaaaattagctgggcatggtggcaggcgcctgtaatcc

SEQ ID NO: 277778 - DNA, 403 bp, Homo sapiens
cataatatagtaaagtaccctcaatgccggcagcatgccttgatgactatccaacagctggtgctctccccaaatggggacgatgacatgggcactctcctggggctaatgcattcagccccaccgacggaattgcagttgaagactgatattttaagggccctcctgtcggtccttcgagaaagccatcgttcaagaacagtttttaggaaagttggaggatttgtgtacattacatccttgctcgttgctatggaaagatctttgagctgtccacccaagaatggctgggagaaagtgaaccagaatcaagtgtttgaacttcttcacactgtgttctgcacgttgactgcagcaatgcgctatgagccagccaactctcatttcttcaaaacagagattc

SEQ ID NO: 277779 - DNA, 252 bp, Homo sapiens
ctccacgtaggcctcgatgtgagacagcagcaccatccgcacatgctcttcatgaacttcaaacaactggagaagcacggggatcacccgtgactggaacagggctggtgagacgtgccttttgccttctgccatgattttaaggaactccccagccacgtggaacttttgtaaattgcccagtcttgggtatgtcttcatcagcagcgtgaaaacagagtaatacagtaaattggtaccagtagagtgggg

SEQ ID NO: 277780 - DNA, 489 bp, Homo sapiens
ttatctttttcattcattgttttatcttcagtgcctagaagagtgctggatacattgtaggtgctcaataactatttcttgaagattgaatgtttatttaaataaagggatgaagtcaatcaacttccaagaggaactaggaccccaaccaactactatgcgttgctctcagatggtgtgtaaggccacccttgctgatgaggctgcacgcgtaatgagctgagctgctgccttcagaagaagccagagaaaagaaccccaagacatgagactatccaggctacagcaactccagcagtctccttacctggcagaaaggagcacactctgctacaatgacatggaatttcctctttcgggcagcctctttgaggaaggcctctactgttcgggagaagccaatggtcatgatcacctcattggagtgaatgtgctccagagcctgggctgcaatgttctccattgtcccttctgtaagaacggttttgc

SEQ ID NO: 277781 - DNA, 821 bp, Homo sapiens
tcagtttgaagtagattggagacattttctcatgtttcagcctccttggaccaagcaaaataagctgacctttgaagagaacagatcttgagggggatctgtagatggacacagggagattccaggtgcctcagagggatcaacttgcagttccaagttgtcctcagggaaatcttgccattttttgggataatgaactgaattctcatcacagtggaatacgtatcatcggaagggatttttaaagggcagggtgagaagtggattgagaatttcgcatagcaccaaggttaaacagaagccaactacgaaacaaagccagaagggcactcaagcaaataatcaaaatcaaatccttaccacgctgccagggaccgatatatccagagcatgggaccaggagctggactcacggtgggatctctgatcagtcacagaaggagcttgacgagctcatggggtctctctccctaggtggagaagacagggctccaaatggacttccagtcccatccacgtcacagaggcaaattgtcagagacaaagacctaagccggtccttttccaggagtaaatgaccatcgtgcgcccatgggaagagtgctgcatccacggaggacatgggccaacagtgctctcaaatgggtttcatgaaagcatctgtgactcatccctgttcaagaatgttttcattacgattcagcagaagcgatgtgccaggtcagcaaatacaactgcaaaaccggggcctgccagcctggccaacacagcaagaccccgtctctactaaaaagtaaaattaaaattagctgagtatggtg

SEQ ID NO: 277782 - DNA, 616 bp, Homo sapiens
tcggaactgaggtagggacaatgttagatgagatccccctagtacataaggtgagttcgtcttgctctccaatgtgttcatccacaagtacagaagccaactacgaaacaaagccagaagggcactcaagcaaataatcaaaatcaaatccttaccacgctgccagggaccgatatatccagagcatgggaccaggagctggactcacggtgggatctctgatcagtcacagaaggagcttgacgagctcatggggtctctctccctaggtggagaagacagggctccaaatggacttccagtcccatccacgtcacagaggcaaattgtcagagacaaagacctaagccggtccttttccaggagtaaatgaccatcgtgcgcccatgggaagagtgctgcatccacggaggacatgggccaacagtgctctcaaatgggtttcatgaaagcatctgtgactcatccctgttcaagaatgttttcattacgattcagcagaagcgatgtgccaggtcagcaaatacaactgcaaaaccggggcctgccagcctggccaacacagcaagaccccgtctctactaaaaagtaaaattaaaattagctgagtatggtg

SEQ ID NO: 277783 - DNA, 2799 bp, Homo sapiens
acgcctcctaccaaaatcacagccccttgtggagcccgagctctcattcacagctttctagagaaatctgagcccgaacctgccagaataggggatctcacccacccagttcagcagcgaggacacctgcagaaatacattcccaaagcaaggctgggcggccgtgtgaagtaagcaatggcctcagttttgcttctgttttggatgaacaccaccacatagggcctgaatgtgaaagaagaccctctatttgtctgttccggggcagcctggtagtaaaacactgttgaatgggccacagtttcagcagaccatcaggtgaatgggaccagtctctcttcttccaaaatatcagaagttaaacacttggaacggagatttggccaagatgacccatttacaggctggactcagtccagagactatagagaaagctcgcctggaactgaatgaaaaccccgatgttttacatcaggatattcagcaagtcagggacatgatcatcaccaggcctgacattggatttttacgtacagatgatgccttcatcctgagatttctccgagccaggaagtttcaccaagcggatgcctttagactcctggctcagtatttccagtaccgccagctaaacctggacatgttcaaaaacttcaaggcagatgatcccggcattaagagggctctgatcgatgggttccccggggtgctggaaaaccgagaccattacggcaggaagattcttttgctgtttgcagccaattgggatcagagtaggaactccttcacagacatccttcgtgccatcctgctgtcattggaagtcctaatcgaagatccggagcttcagataaatggcttcattttaattatagactggagtaatttttccttcaaacaagcctccaaactgacaccttcaatccttaaactggccattgaagggttgcaggacagctttcctgcccgctttggaggagtccactttgtcaaccagccctggtacattcatgccctctacacactcatcaagccatttcttaaagacaagaccaggaaacggattttcctgcatggaaacaatttaaacagccttcaccagctaatacaccctgaatttttgccctctgaatttggaggaactcttcctccttatgacatgggaacttgggcccggacgttactcggtcccgactacagcgatgaaaatgactatactcacacatcctataatgcaatgcacgtgaagcatacgtcctcgaatctggagagagaatgctcacccaagctgatgaaaagatctcagtctgtggtagaagctgggaccctgaaacatgaggagaagggagagaatgagaacacccagccactcctggctctggactgaaccctgagtcaccccaatgctcctgcacactggccttcagtggtatcagccacccaggaagcacatgcacaactgacccatgcagacacgtgtgttctgcttgacacaaggtcctccactcctgaacccctgcagtgactgtcaccagccatcggtctgagcagccaaagttggacaaagacttgagagatgctttttttttcccccagtgaggggactggaggatgatgcaaggcatttatgtaaaaaagattctccctcctttcatatttattgtagtaaattgaaaaaataaagactaaatttgatggacacactgcattaggacaagaatttttctgaggtatcacacagggaccctctccagtttttgaaaattaagtgcatttccaagtaaatgtatcagagttaaactgtacagacaccactgtcaagtttcatgtagtacaaagccctgagacaatagtatctccagtaatttccattcttactgaattatttcctttgacctcatcaccagcatcgaattgttcagcctaagagcatgttctcataggtctgggtatttgcaaagtttgcttattttgatgatatcctgcaaaaaattattttgatgtcacatctcttgtcaggtcactagctgactgtcatgagctgacgttaaaggaagacacatggacgtgaaatacgattatttcatctgagcaatgtgagttaccacaggcagctcaaaagcccattagtgcagcatgtgtctgcagaggagatgtctcatgaaaatcacatgtcagtgattaatgaatccattccagttgcctcaactgggtcactacagcaaagaaaagtgctatcaaaccatttacccttgcccccacaaccctcctgcaaccattaaagatgtggagaaagaccatggttgttgctgagagggtaaatattcaatcatggagcatgacccatatggatggctaaatatgcaagtactgaagtaagagaagactagaaatgcaggatgaaatgtcaaaggtcattttatttacctagtctccttagaaatggagtccccaactactcattcaaaagaaatcagacataaaataaaccagacatcatatatgatatccttacttgtgccatgttttccaagaccagtgcatatttttagacatctcttattcgcccagccatctgcatgacatgggtatttattagtattaccagttggtgctcaaagtcaaacaaaaatattttagttaataatgggcagtaaaatatgattttacattattttaaatatttgggagagttaatttgttagctaaataattcaagggaaagagattattcaactggtcataatcacccctgataatattattactaatcttaattatttattacatcatctcttt

SEQ ID NO: 277784 - DNA, 2936 bp, Homo sapiens
acgcctcctaccaaaatcacagccccttgtggagcccgagctctcattcacagctttctagagaaatctgagcccgaacctgccagaataggggatctcacccacccagttcagcagcgaggacacctgcagaaatacattcccaaagcaaggctgggcggccgtgtgaaggcagttttcttagctgtgattcccactgctgccattgtctgtgcaatcacatccagaagaagggtcacggttacatggatctgctgggaaaacaattagtggaaaagggggcaaatagagttaatggccgtttttggtaagcaatggcctcagttttgcttctgttttggatgaacaccaccacatagggcctgaatgtgaaagaagaccctctatttgtctgttccggggcagcctggtagtaaaacactgttgaatgggccacagtttcagcagaccatcaggtgaatgggaccagtctctcttcttccaaaatatcagaagttaaacacttggaacggagatttggccaagatgacccatttacaggctggactcagtccagagactatagagaaagctcgcctggaactgaatgaaaaccccgatgttttacatcaggatattcagcaagtcagggacatgatcatcaccaggcctgacattggatttttacgtacagatgatgccttcatcctgagatttctccgagccaggaagtttcaccaagcggatgcctttagactcctggctcagtatttccagtaccgccagctaaacctggacatgttcaaaaacttcaaggcagatgatcccggcattaagagggctctgatcgatgggttccccggggtgctggaaaaccgagaccattacggcaggaagattcttttgctgtttgcagccaattgggatcagagtaggaactccttcacagacatccttcgtgccatcctgctgtcattggaagtcctaatcgaagatccggagcttcagataaatggcttcattttaattatagactggagtaatttttccttcaaacaagcctccaaactgacaccttcaatccttaaactggccattgaagggttgcaggacagctttcctgcccgctttggaggagtccactttgtcaaccagccctggtacattcatgccctctacacactcatcaagccatttcttaaagacaagaccaggaaacggattttcctgcatggaaacaatttaaacagccttcaccagctaatacaccctgaatttttgccctctgaatttggaggaactcttcctccttatgacatgggaacttgggcccggacgttactcggtcccgactacagcgatgaaaatgactatactcacacatcctataatgcaatgcacgtgaagcatacgtcctcgaatctggagagagaatgctcacccaagctgatgaaaagatctcagtctgtggtagaagctgggaccctgaaacatgaggagaagggagagaatgagaacacccagccactcctggctctggactgaaccctgagtcaccccaatgctcctgcacactggccttcagtggtatcagccacccaggaagcacatgcacaactgacccatgcagacacgtgtgttctgcttgacacaaggtcctccactcctgaacccctgcagtgactgtcaccagccatcggtctgagcagccaaagttggacaaagacttgagagatgctttttttttcccccagtgaggggactggaggatgatgcaaggcatttatgtaaaaaagattctccctcctttcatatttattgtagtaaattgaaaaaataaagactaaatttgatggacacactgcattaggacaagaatttttctgaggtatcacacagggaccctctccagtttttgaaaattaagtgcatttccaagtaaatgtatcagagttaaactgtacagacaccactgtcaagtttcatgtagtacaaagccctgagacaatagtatctccagtaatttccattcttactgaattatttcctttgacctcatcaccagcatcgaattgttcagcctaagagcatgttctcataggtctgggtatttgcaaagtttgcttattttgatgatatcctgcaaaaaattattttgatgtcacatctcttgtcaggtcactagctgactgtcatgagctgacgttaaaggaagacacatggacgtgaaatacgattatttcatctgagcaatgtgagttaccacaggcagctcaaaagcccattagtgcagcatgtgtctgcagaggagatgtctcatgaaaatcacatgtcagtgattaatgaatccattccagttgcctcaactgggtcactacagcaaagaaaagtgctatcaaaccatttacccttgcccccacaaccctcctgcaaccattaaagatgtggagaaagaccatggttgttgctgagagggtaaatattcaatcatggagcatgacccatatggatggctaaatatgcaagtactgaagtaagagaagactagaaatgcaggatgaaatgtcaaaggtcattttatttacctagtctccttagaaatggagtccccaactactcattcaaaagaaatcagacataaaataaaccagacatcatatatgatatccttacttgtgccatgttttccaagaccagtgcatatttttagacatctcttattcgcccagccatctgcatgacatgggtatttattagtattaccagttggtgctcaaagtcaaacaaaaatattttagttaataatgggcagtaaaatatgattttacattattttaaatatttgggagagttaatttgttagctaaataattcaagggaaagagattattcaactggtcataatcacccctgataatattattactaatcttaattatttattacatcatctcttt

SEQ ID NO: 277785 - DNA, 2348 bp, Homo sapiens
ttctcattcccctcctatccttccccccaagtctccaaagtccactgtatcattcttttttttttttgagacagactctcattctgtcacccaggctggagtgcagtggcacgatctcggctcactgcaagctccgcctcctgggttcatgccattctgctgccttagcctcctgagtagctggcattacaggtgcccgacgccacgtcaggctaattttttgtatttttagtagagatggggtttcaccgtgttagccaagatggtcttgatctcctgacctcgtgatccgcccgcctaggcctcccaaagtgctgggattccaggaactccttcacagacatccttcgtgccatcctgctgtcattggaagtcctaatcgaagatccggagcttcagataaatggcttcattttaattatagactggagtaatttttccttcaaacaagcctccaaactgacaccttcaatccttaaactggccattgaagggttgcaggacagctttcctgcccgctttggaggagtccactttgtcaaccagccctggtacattcatgccctctacacactcatcaagccatttcttaaagacaagaccaggaaacggattttcctgcatggaaacaatttaaacagccttcaccagctaatacaccctgaatttttgccctctgaatttggaggaactcttcctccttatgacatgggaacttgggcccggacgttactcggtcccgactacagcgatgaaaatgactatactcacacatcctataatgcaatgcacgtgaagcatacgtcctcgaatctggagagagaatgctcacccaagctgatgaaaagatctcagtctgtggtagaagctgggaccctgaaacatgaggagaagggagagaatgagaacacccagccactcctggctctggactgaaccctgagtcaccccaatgctcctgcacactggccttcagtggtatcagccacccaggaagcacatgcacaactgacccatgcagacacgtgtgttctgcttgacacaaggtcctccactcctgaacccctgcagtgactgtcaccagccatcggtctgagcagccaaagttggacaaagacttgagagatgctttttttttcccccagtgaggggactggaggatgatgcaaggcatttatgtaaaaaagattctccctcctttcatatttattgtagtaaattgaaaaaataaagactaaatttgatggacacactgcattaggacaagaatttttctgaggtatcacacagggaccctctccagtttttgaaaattaagtgcatttccaagtaaatgtatcagagttaaactgtacagacaccactgtcaagtttcatgtagtacaaagccctgagacaatagtatctccagtaatttccattcttactgaattatttcctttgacctcatcaccagcatcgaattgttcagcctaagagcatgttctcataggtctgggtatttgcaaagtttgcttattttgatgatatcctgcaaaaaattattttgatgtcacatctcttgtcaggtcactagctgactgtcatgagctgacgttaaaggaagacacatggacgtgaaatacgattatttcatctgagcaatgtgagttaccacaggcagctcaaaagcccattagtgcagcatgtgtctgcagaggagatgtctcatgaaaatcacatgtcagtgattaatgaatccattccagttgcctcaactgggtcactacagcaaagaaaagtgctatcaaaccatttacccttgcccccacaaccctcctgcaaccattaaagatgtggagaaagaccatggttgttgctgagagggtaaatattcaatcatggagcatgacccatatggatggctaaatatgcaagtactgaagtaagagaagactagaaatgcaggatgaaatgtcaaaggtcattttatttacctagtctccttagaaatggagtccccaactactcattcaaaagaaatcagacataaaataaaccagacatcatatatgatatccttacttgtgccatgttttccaagaccagtgcatatttttagacatctcttattcgcccagccatctgcatgacatgggtatttattagtattaccagttggtgctcaaagtcaaacaaaaatattttagttaataatgggcagtaaaatatgattttacattattttaaatatttgggagagttaatttgttagctaaataattcaagggaaagagattattcaactggtcataatcacccctgataatattattactaatcttaattatttattacatcatctcttt

SEQ ID NO: 277786 - DNA, 2940 bp, Homo sapiens
acgcctcctaccaaaatcacagccccttgtggagcccgagctctcattcacagctttctagagaaatctgagcccgaacctgccagaataggggatctcacccacccagttcagcagcgaggacacctgcagaaatacattcccaaagcaaggctgggcggccgtgtgaagtaagcaatggcctcagttttgcttctgttttggatgaacaccaccacatagggcctgaatgtgaaagaagaccctctatttgtctgttccggggcagcctggtagtaaaacactgttgaatgggccacagtttcagcagaccatcaggtgaatgggaccagtctctcttcttccaaaatatcagaagttaaacacttggaacggagatttggccaagatgacccatttacaggctggactcagtccagagactatagagaaagctcgcctggaactgaatgaaaaccccgatgttttacatcaggatattcagcaagtcagggacatgatcatcaccaggcctgacattggatttttacgtacagatgatgccttcatcctgagatttctccgagccaggaagtttcaccaagcggatgcctttagactcctggctcagtatttccagtaccgccagctaaacctggacatgttcaaaaacttcaaggcagatgatcccggcattaagagggctctgatcgatgggttccccggggtgctggaaaaccgagaccattacggcaggaagattcttttgctgtttgcagccaattgggatcagagtaggaactccttcacagacatccttcgtgccatcctgctgtcattggaagtcctaatcgaagatccggagcttcagataaatggcttcattttaattatagactggagtaatttttccttcaaacaagcctccaaactgacaccttcaatccttaaactggccattgaagggttgcagaagatggataaaatcaatgctgaggacctattcagaaggacagtgatgccagagctagttattcattgaactcattctgtgagaaatgtcagccaatctttggacagctttcctgcccgctttggaggagtccactttgtcaaccagccctggtacattcatgccctctacacactcatcaagccatttcttaaagacaagaccaggaaacggattttcctgcatggaaacaatttaaacagccttcaccagctaatacaccctgaatttttgccctctgaatttggaggaactcttcctccttatgacatgggaacttgggcccggacgttactcggtcccgactacagcgatgaaaatgactatactcacacatcctataatgcaatgcacgtgaagcatacgtcctcgaatctggagagagaatgctcacccaagctgatgaaaagttctgaaggttggaagggcaagatcaaggtgttggcaagatctcagtctgtggtagaagctgggaccctgaaacatgaggagaagggagagaatgagaacacccagccactcctggctctggactgaaccctgagtcaccccaatgctcctgcacactggccttcagtggtatcagccacccaggaagcacatgcacaactgacccatgcagacacgtgtgttctgcttgacacaaggtcctccactcctgaacccctgcagtgactgtcaccagccatcggtctgagcagccaaagttggacaaagacttgagagatgctttttttttcccccagtgaggggactggaggatgatgcaaggcatttatgtaaaaaagattctccctcctttcatatttattgtagtaaattgaaaaaataaagactaaatttgatggacacactgcattaggacaagaatttttctgaggtatcacacagggaccctctccagtttttgaaaattaagtgcatttccaagtaaatgtatcagagttaaactgtacagacaccactgtcaagtttcatgtagtacaaagccctgagacaatagtatctccagtaatttccattcttactgaattatttcctttgacctcatcaccagcatcgaattgttcagcctaagagcatgttctcataggtctgggtatttgcaaagtttgcttattttgatgatatcctgcaaaaaattattttgatgtcacatctcttgtcaggtcactagctgactgtcatgagctgacgttaaaggaagacacatggacgtgaaatacgattatttcatctgagcaatgtgagttaccacaggcagctcaaaagcccattagtgcagcatgtgtctgcagaggagatgtctcatgaaaatcacatgtcagtgattaatgaatccattccagttgcctcaactgggtcactacagcaaagaaaagtgctatcaaaccatttacccttgcccccacaaccctcctgcaaccattaaagatgtggagaaagaccatggttgttgctgagagggtaaatattcaatcatggagcatgacccatatggatggctaaatatgcaagtactgaagtaagagaagactagaaatgcaggatgaaatgtcaaaggtcattttatttacctagtctccttagaaatggagtccccaactactcattcaaaagaaatcagacataaaataaaccagacatcatatatgatatccttacttgtgccatgttttccaagaccagtgcatatttttagacatctcttattcgcccagccatctgcatgacatgggtatttattagtattaccagttggtgctcaaagtcaaacaaaaatattttagttaataatgggcagtaaaatatgattttacattattttaaatatttgggagagttaatttgttagctaaataattcaagggaaagagattattcaactggtcataatcacccctgataatattattactaatcttaattatttattacatcatctcttt

SEQ ID NO: 277787 - DNA, 1417 bp, Homo sapiens
acgcctcctaccaaaatcacagccccttgtggagcccgagctctcattcacagctttctagagaaatctgagcccgaacctgccagaataggggatctcacccacccagttcagcagcgaggacacctgcagaaatacattcccaaagcaaggctgggcggccgtgtgaagtaagcaatggcctcagttttgcttctgttttggatgaacaccaccacatagggcctgaatgtgaaagaagaccctctatttgtctgttccggggcagcctggtagtaaaacactgttgaatgggccacagtttcagcagaccatcaggtgaatgggaccagtctctcttcttccaaaatatcagaagttaaacacttggaacggagatttggccaagatgacccatttacaggctggactcagtccagagactatagagaaagctcgcctggaactgaatgaaaaccccgatgttttacatcaggatattcagcaagtcagggacatgatcatcaccaggcctgacattggatttttacgtacagatgatgccttcatcctgagatttctccgagccaggaagtttcaccaagcggatgcctttagactcctggctcagtatttccagtaccgccagctaaacctggacatgttcaaaaacttcaaggcagatgatcccggcattaagagggctctgatcgatgggttccccggggtgctggaaaaccgagaccattacggcaggaagattcttttgctgtttgcagccaattgggatcagagtaggaactccttcacagacatccttcgtgccatcctgctgtcattggaagtcctaatcgaagatccggagcttcagataaatggcttcattttaattatagactggagtaatttttccttcaaacaagcctccaaactgacaccttcaatccttaaactggccattgaagggttgcaggacagctttcctgcccgctttggaggagtccactttgtcaaccagccctggtacattcatgccctctacacactcatcaagccatttcttaaagacaagaccaggaaacggattttcctgcatggaaacaatttaaacagccttcaccagctaatacaccctgaatttttgccctctgaatttggaggaactcttcctccttatgacatgggaacttgggcccggacgttactcggtcccgactacagcgatgaaaatgactatactcacacatcctataatgcaatgcacgtgaagcatacgtcctcgaatctggagagagaatgctcacccaagctgatgaaaaggtaaggcctgggttatcagagcccccccccagtcagaggtcaatggaattttttatttggacctattgtgaattattaattaaagacctttatgggcagagaacttgaataaaataaa

SEQ ID NO: 277788 - DNA, 2193 bp, Homo sapiens
acgcctcctaccaaaatcacagccccttgtggagcccgagctctcattcacagctttctagagaaatctgagcccgaacctgccagaataggggatctcacccacccagttcagcagcgaggacacctgcagaaatacattcccaaagcaaggctgggcggccgtgtgaaggaactccttcacagacatccttcgtgccatcctgctgtcattggaagtcctaatcgaagatccggagcttcagataaatggcttcattttaattatagactggagtaatttttccttcaaacaagcctccaaactgacaccttcaatccttaaactggccattgaagggttgcaggacagctttcctgcccgctttggaggagtccactttgtcaaccagccctggtacattcatgccctctacacactcatcaagccatttcttaaagacaagaccaggaaacggattttcctgcatggaaacaatttaaacagccttcaccagctaatacaccctgaatttttgccctctgaatttggaggaactcttcctccttatgacatgggaacttgggcccggacgttactcggtcccgactacagcgatgaaaatgactatactcacacatcctataatgcaatgcacgtgaagcatacgtcctcgaatctggagagagaatgctcacccaagctgatgaaaagatctcagtctgtggtagaagctgggaccctgaaacatgaggagaagggagagaatgagaacacccagccactcctggctctggactgaaccctgagtcaccccaatgctcctgcacactggccttcagtggtatcagccacccaggaagcacatgcacaactgacccatgcagacacgtgtgttctgcttgacacaaggtcctccactcctgaacccctgcagtgactgtcaccagccatcggtctgagcagccaaagttggacaaagacttgagagatgctttttttttcccccagtgaggggactggaggatgatgcaaggcatttatgtaaaaaagattctccctcctttcatatttattgtagtaaattgaaaaaataaagactaaatttgatggacacactgcattaggacaagaatttttctgaggtatcacacagggaccctctccagtttttgaaaattaagtgcatttccaagtaaatgtatcagagttaaactgtacagacaccactgtcaagtttcatgtagtacaaagccctgagacaatagtatctccagtaatttccattcttactgaattatttcctttgacctcatcaccagcatcgaattgttcagcctaagagcatgttctcataggtctgggtatttgcaaagtttgcttattttgatgatatcctgcaaaaaattattttgatgtcacatctcttgtcaggtcactagctgactgtcatgagctgacgttaaaggaagacacatggacgtgaaatacgattatttcatctgagcaatgtgagttaccacaggcagctcaaaagcccattagtgcagcatgtgtctgcagaggagatgtctcatgaaaatcacatgtcagtgattaatgaatccattccagttgcctcaactgggtcactacagcaaagaaaagtgctatcaaaccatttacccttgcccccacaaccctcctgcaaccattaaagatgtggagaaagaccatggttgttgctgagagggtaaatattcaatcatggagcatgacccatatggatggctaaatatgcaagtactgaagtaagagaagactagaaatgcaggatgaaatgtcaaaggtcattttatttacctagtctccttagaaatggagtccccaactactcattcaaaagaaatcagacataaaataaaccagacatcatatatgatatccttacttgtgccatgttttccaagaccagtgcatatttttagacatctcttattcgcccagccatctgcatgacatgggtatttattagtattaccagttggtgctcaaagtcaaacaaaaatattttagttaataatgggcagtaaaatatgattttacattattttaaatatttgggagagttaatttgttagctaaataattcaagggaaagagattattcaactggtcataatcacccctgataatattattactaatcttaattatttattacatcatctcttt

SEQ ID NO: 277789 - DNA, 2838 bp, Homo sapiens
acgcctcctaccaaaatcacagccccttgtggagcccgagctctcattcacagctttctagagaaatctgagcccgaacctgccagaataggggatctcacccacccagttcagcagcgaggacacctgcagaaatacattcccaaagcaaggctgggcggccgtgtgaagtaagcaatggcctcagttttgcttctgttttggatgaacaccaccacatagggcctgaatgtgaaagaagaccctctatttgtctgttccggggcagcctggtagtaaaacactgttgaatgggccacagtttcagcagaccatcaggtgaatgggaccagtctctcttcttccaaaatatcagaagttaaacacttggaacggagatttggccaagatgacccatttacaggctggactcagtccagagactatagagaaagctcgcctggaactgaatgaaaaccccgatgttttacatcaggatattcagcaagtcagggacatgatcatcaccaggcctgacattggatttttacgtacagatgatgccttcatcctgagatttctccgagccaggaagtttcaccaagcggatgcctttagactcctggctcagtatttccagtaccgccagctaaacctggacatgttcaaaaacttcaaggcagatgatcccggcattaagagggctctgatcgatgggttccccggggtgctggaaaaccgagaccattacggcaggaagattcttttgctgtttgcagccaattgggatcagagtaggaactccttcacagacatccttcgtgccatcctgctgtcattggaagtcctaatcgaagatccggagcttcagataaatggcttcattttaattatagactggagtaatttttccttcaaacaagcctccaaactgacaccttcaatccttaaactggccattgaagggttgcaggacagctttcctgcccgctttggaggagtccactttgtcaaccagccctggtacattcatgccctctacacactcatcaagccatttcttaaagacaagaccaggaaacggattttcctgcatggaaacaatttaaacagccttcaccagctaatacaccctgaatttttgccctctgaatttggaggaactcttcctccttatgacatgggaacttgggcccggacgttactcggtcccgactacagcgatgaaaatgactatactcacacatcctataatgcaatgcacgtgaagcatacgtcctcgaatctggagagagaatgctcacccaagctgatgaaaagttctgaaggttggaagggcaagatcaaggtgttggcaagatctcagtctgtggtagaagctgggaccctgaaacatgaggagaagggagagaatgagaacacccagccactcctggctctggactgaaccctgagtcaccccaatgctcctgcacactggccttcagtggtatcagccacccaggaagcacatgcacaactgacccatgcagacacgtgtgttctgcttgacacaaggtcctccactcctgaacccctgcagtgactgtcaccagccatcggtctgagcagccaaagttggacaaagacttgagagatgctttttttttcccccagtgaggggactggaggatgatgcaaggcatttatgtaaaaaagattctccctcctttcatatttattgtagtaaattgaaaaaataaagactaaatttgatggacacactgcattaggacaagaatttttctgaggtatcacacagggaccctctccagtttttgaaaattaagtgcatttccaagtaaatgtatcagagttaaactgtacagacaccactgtcaagtttcatgtagtacaaagccctgagacaatagtatctccagtaatttccattcttactgaattatttcctttgacctcatcaccagcatcgaattgttcagcctaagagcatgttctcataggtctgggtatttgcaaagtttgcttattttgatgatatcctgcaaaaaattattttgatgtcacatctcttgtcaggtcactagctgactgtcatgagctgacgttaaaggaagacacatggacgtgaaatacgattatttcatctgagcaatgtgagttaccacaggcagctcaaaagcccattagtgcagcatgtgtctgcagaggagatgtctcatgaaaatcacatgtcagtgattaatgaatccattccagttgcctcaactgggtcactacagcaaagaaaagtgctatcaaaccatttacccttgcccccacaaccctcctgcaaccattaaagatgtggagaaagaccatggttgttgctgagagggtaaatattcaatcatggagcatgacccatatggatggctaaatatgcaagtactgaagtaagagaagactagaaatgcaggatgaaatgtcaaaggtcattttatttacctagtctccttagaaatggagtccccaactactcattcaaaagaaatcagacataaaataaaccagacatcatatatgatatccttacttgtgccatgttttccaagaccagtgcatatttttagacatctcttattcgcccagccatctgcatgacatgggtatttattagtattaccagttggtgctcaaagtcaaacaaaaatattttagttaataatgggcagtaaaatatgattttacattattttaaatatttgggagagttaatttgttagctaaataattcaagggaaagagattattcaactggtcataatcacccctgataatattattactaatcttaattatttattacatcatctcttt

SEQ ID NO: 277790 - DNA, 2737 bp, Homo sapiens
acgcctcctaccaaaatcacagccccttgtggagcccgagctctcattcacagctttctagagaaatctgagcccgaacctgccagaataggggatctcacccacccagttcagcagcgaggacacctgcagaaatacattcccaaagcaaggctgggcggccgtgtgaagtaagcaatggcctcagttttgcttctgttttggatgaacaccaccacatagggcctgaatgtgaaagaagaccctctatttgtctgttccggggcagcctggtagtaaaacactgttgaatgggccacagtttcagcagaccatcaggtgaatgggaccagtctctcttcttccaaaatatcagaagttaaacacttggaacggagatttggccaagatgacccatttacaggctggactcagtccagagactatagagaaagctcgcctggaactgaatgaaaaccccgatgttttacatcaggatattcagcaagtcagggacatgatcatcaccaggcctgacattggatttttacgtacagatgatgccttcatcctgagatttctccgagccaggaagtttcaccaagcggatgcctttagactcctggctcagtatttccagtaccgccagctaaacctggacatgttcaaaaacttcaaggcagatgatcccggcattaagagggctctgatcgatgggttccccggggtgctggaaaaccgagaccattacggcaggaagattcttttgctgtttgcagccaattgggatcagagtaggaactccttcacagacatccttcgtgccatcctgctgtcattggaagtcctaatcgaagatccggagcttcagataaatggcttcattttaatttttccttcaaacaagcctccaaactgacaccttcaatccttaaactggccattgaagggttgcagtccactttgtcaaccagccctggtacattcatgccctctacacactcatcaagccatttcttaaagacaagaccaggaaacggaatttaaacagccttcaccagctaatacaccctgaatttttgccctctgaatttggaggaactcttcctccttatgacatgggaacttgggcccggacgttactcggtcccgactacagcgatgaaaatgactatactcacacatcctataatgcaatgcacgtgaagcatacgtcctcgaatctggagagagaatgctcacccaagctgatgaaaagatctcagtctgtggtagaagctgggaccctgaaacatgaggagaagggagagaatgagaacacccagccactcctggctctggactgaaccctgagtcaccccaatgctcctgcacactggccttcagtggtatcagccacccaggaagcacatgcacaactgacccatgcagacacgtgtgttctgcttgacacaaggtcctccactcctgaacccctgcagtgactgtcaccagccatcggtctgagcagccaaagttggacaaagacttgagagatgctttttttttcccccagtgaggggactggaggatgatgcaaggcatttatgtaaaaaagattctccctcctttcatatttattgtagtaaattgaaaaaataaagactaaatttgatggacacactgcattaggacaagaatttttctgaggtatcacacagggaccctctccagtttttgaaaattaagtgcatttccaagtaaatgtatcagagttaaactgtacagacaccactgtcaagtttcatgtagtacaaagccctgagacaatagtatctccagtaatttccattcttactgaattatttcctttgacctcatcaccagcatcgaattgttcagcctaagagcatgttctcataggtctgggtatttgcaaagtttgcttattttgatgatatcctgcaaaaaattattttgatgtcacatctcttgtcaggtcactagctgactgtcatgagctgacgttaaaggaagacacatggacgtgaaatacgattatttcatctgagcaatgtgagttaccacaggcagctcaaaagcccattagtgcagcatgtgtctgcagaggagatgtctcatgaaaatcacatgtcagtgattaatgaatccattccagttgcctcaactgggtcactacagcaaagaaaagtgctatcaaaccatttacccttgcccccacaaccctcctgcaaccattaaagatgtggagaaagaccatggttgttgctgagagggtaaatattcaatcatggagcatgacccatatggatggctaaatatgcaagtactgaagtaagagaagactagaaatgcaggatgaaatgtcaaaggtcattttatttacctagtctccttagaaatggagtccccaactactcattcaaaagaaatcagacataaaataaaccagacatcatatatgatatccttacttgtgccatgttttccaagaccagtgcatatttttagacatctcttattcgcccagccatctgcatgacatgggtatttattagtattaccagttggtgctcaaagtcaaacaaaaatattttagttaataatgggcagtaaaatatgattttacattattttaaatatttgggagagttaatttgttagctaaataattcaagggaaagagattattcaactggtcataatcacccctgataatattattactaatcttaattatttattacatcatctcttt

SEQ ID NO: 277791 - DNA, 1661 bp, Homo sapiens
gcaccacacctaggtcggagcactgtcgtccttcagggctccagcctcttgatatttttgtacttcagtatcagctcgatagagcaaaagagagagaggacgagagagggggtcagagaaggggaagcaacggctctcacgttgggacaatattatctggaagctgaagaagaaactgaatactccttccttcctccccacccattcctttaaatccggagggggaaaaaatcccaaggtctgcaaaggcgcggcgctcggactataaaacacaacaaatcataaacccggcggagcagcagcggccgcgcgcgcctcccctcccaatgagttcctatttcgtgaactccaccttccccgtcactctggccagcgggcaggagtccttcctgggccagctaccgctctattcgtcgggctatgcggacccgctgagacattaccccgcgccctacgggccagggccgggccaggacaagggctttgccacttcctcctattacccgccggcgggcggtggctacggccgagcggcgccctgcgactacgggccggcgccggccttctaccgcgagaaagagtcggcctgcgcactctccggcgccgacgagcagcccccgttccaccccgagccgcggaagtcggactgcgcgcaggacaagagcgtgttcggcgagacagaagagcagaagtgctccactccggtctacccgtggatgcagcggatgaattcgtgcaacagttcctcctttgggcccagcggccggcgaggccgccagacatacacacgttaccagacgctggagctggagaaggagtttcactacaatcgctacctgacgcggcggcggcgcatcgagatcgcgcacgccctgtgcctgacggagaggcagatcaagatatggttccagaaccgacgcatgaagtggaaaaaggagagcaaactgctcagcgcgtctcagctcagtgccgaggaggaggaagaaaaacaggccgagtgaaggtgctggaaagggagggaggacgcgaggggaaaggcctgtggggagccacgggcgtcagagagacccgggaaggaaggctctcgggtgggggagccaggagacctgctctccggcgcagacaggcggggcccagcgctctcctggacgcccccgcccgcacagctcccggcgggtgctctgaggcctcactactcgagcccacccagcatcccgcgcgcccttccttcccgaggaactcgcctcagcctgatcaggcttcctggtgagaactgaggagcggactcacttgatgtttcctggaagcagagcaaaatgctcttgtccctgtcgcgtctcattttgtccatgtcccccgtgcacggttcaatggtagattcgctgtcccctcagcgggggccttgaagactccctgatcccagacctgtcgtctctcccaccccctccccaaagccactggaaggagcacatactacctagaagtaagaagaggagcctcagaagaaaacaaagttctattttattaattttctatgtgttgtgtttgtagtcttgtcttagctctggacgtgaaatacttcgatgatgatgatgatgatgatgatgataataataataataataacaacaacaacaacaataataaagatgtgaaaactc

SEQ ID NO: 277792 - DNA, 411 bp, Homo sapiens
ccttcagaaatagaagttggagtagtgacacttgaaaatcctatattcaggattctttcaagaagcaggaactgtccagttcctgcttcttgaaaatcctatagcccaggctattcttaagtcttttgggattgtagagggtactggagtgagggttgcaggcaggatagggatcagacaaataaagccacctaggctgagggatacccctcactccttcactccatatcaccaagtgaggagagggctagtctctttccccagtgccccttcccctgccaagggtgagcagctgcatactagaaccaggcagaatgttttgggcagccaccctcgtcgccgcctttcaagaagcagaactggccagttcctgcttcttgaaataatcacctgctcagtcccatctgcagg

SEQ ID NO: 277793 - DNA, 3800 bp, Homo sapiens
  misc_feature (2452)..(2452): n is a, c, g, or t
ccttcagaaatagaagttggagtagtgacacttgaaaatcctatattcaggattctttcaagaagcaggaactgtccagttcctgcttcttgaaaatcctatagcccaggctattcttaagtcttttgggattgtagagggtactggagtgagggttgcaggcaggatagggatcagacaaataaagccacctaggctgagggatacccctcactccttcactccatatcaccaagtgaggagagggctagtctctttccccagtgccccttcccctgccaagggtgagcagctgcatactagaaccaggcagaatgttttgggcagccaccctcgtcgccgcctttcaagaagctcctagtctagccacagagtcagaaggggaagcttgggctcagtccctcctgccagctcctcctcttctgggtcttctaggcagtgggatctggcctgccccctcagaccagaagggttgtggagaagcaggaacaataagccgaggcttggaggagacagagcagatctgataaacaggaaaaacgatgttcaaaacctggggaggagggtgtttcttctttgcttatcttagcggagaactcttctcaccttctaccgacacaaaaccctagaaacaaaccttctttagttctctctcaaggcgattcggagacatttacccaaccctccctggagagaaggggtcgaagcaacgcaggggttaacttttctgaaaacacaattaactttttccaatcctgcgtggggtgggggagagacatatttatttaatcacccgggagtggggtggtctcaatctaaacgttccctcctccctcaaaggcactgagcctgtttcacagatcctacgtaggtggaacaggacgcgttgtgttgttggggagagagaggagaaaggcgaaggagaaggaggaaaaaaaaaaggttgataggtttgtgcgcgggtccctcgtgcgggctgcgctcctcctgggtgctatttgacaattcctgcctctgccattggtcagtgttggatcagatggttgtatttccttctggccctcactggcacctcgccatcccccctcagctaaaacccaatctcggatatactactaataggcgcggcgctcggactataaaacacaacaaatcataaacccggcggagcagcagcggccgcgcgcgcctcccctcccaatgagttcctatttcgtgaactccaccttccccgtcactctggccagcgggcaggagtccttcctgggccagctaccgctctattcgtcgggctatgcggacccgctgagacattaccccgcgccctacgggccagggccgggccaggacaagggctttgccacttcctcctattacccgccggcgggcggtggctacggccgagcggcgccctgcgactacgggccggcgccggccttctaccgcgagaaagagtcggcctgcgcactctccggcgccgacgagcagcccccgttccaccccgagccgcggaagtcggactgcgcgcaggacaagagcgtgttcggcgagacagaagagcagaagtgctccactccggtctacccgtggatgcagcggatgaattcgtgcaacagtgagtgagacttcccgtcgccgtcgccccggctcccctgggcgcccaccccgggacacagaactagtgagcgccccctgccccaatctcccacagggtgctgggtgggcatctcagttaggagatagaagaagattgggcgccggccgggggtctctcgctgtgtcccctattaggcaggagttacaaagtttgcaaagtcccagccgcactgggagccatggggagcaagtgtgctctcctggggcgcctggccagagccggggttccaggacagggaagggagcaggagcctgcagtcactggcttggctttactttgagcccccaacccccctctcccagccctggtagggttccccaaccaaagacggctccattaaaaacggagtgcgtcatgcaagggggtagggggtgacgctgaagaggaagagttgagtctgtctgggactgtgtttccctgtggtggggagctggggcaagatgaggcaccaggaaaggggtggtagtcagaggagggaggaggaataaggggaaggaagagagagggagcaggcggagcgagagagggagaaacaggcgcggggtctcaggttggattatttgttggccttaagtcccaactgatgtccattagccggactcgaaagtgaggagccgttaatgtggactatggatcgatctacgtcattacggattaacggcctggatttatcattgggttggggggatgacggggggtgggaacaagatggatggaaagggagggaaagacaagatgcaactaggaagagacacacctgaccagcccctccccccaggctcaggtgggagttcnaactgctcctcccctcccccatctagagtctgacagacggcacaggcctaggagactaggagggaatctggagggggcgctggaggagtgcgaaacgggggaagggagccggcagaatagagggcatcccggtactggctggagtctgtgttcgagggtcgactaggggagggggtcctgggcccggtgaccgcaggcctcagcatctccactctgcgtaacaggttcctcctttgggcccagcggccggcgaggccgccagacatacacacgttaccagacgctggagctggagaaggagtttcactacaatcgctacctgacgcggcggcggcgcatcgagatcgcgcacgccctgtgcctgacggagaggcagatcaagatatggttccagaaccgacgcatgaagtggaaaaaggagagcaaactgctcagcgcgtctcagctcagtgccgaggaggaggaagaaaaacaggccgagtgaaggtgctggaaagggagggaggacgcgaggggaaaggcctgtggggagccacgggcgtcagagagacccgggaaggaaggctctcgggtgggggagccaggagacctgctctccggcgcagacaggcggggcccagcgctctcctggacgcccccgcccgcacagctcccggcgggtgctctgaggcctcactactcgagcccacccagcatcccgcgcgcccttccttcccgaggaactcgcctcagcctgatcaggcttcctggtgagaactgaggagcggactcacttgatgtttcctggaagcagagcaaaatgctcttgtccctgtcgcgtctcattttgtccatgtcccccgtgcacggttcaatggtagattcgctgtcccctcagcgggggccttgaagactccctgatcccagacctgtcgtctctcccaccccctccccaaagccactggaaggagcacatactacctagaagtaagaagaggagcctcagaagaaaacaaagttctattttattaattttctatgtgttgtgtttgtagtcttgtcttagctctggacgtgaaatacttcgatgatgatgatgatgatgatgatgataataataataataataacaacaacaacaacaataataaagatgtgaaaactcgacgctcggtcacctccaatcctcccctgccattttttcctctctcctcaacccccagcctctccatctttcctgagccagaattcttcagcaaaggcgagagccctggcccgccgaagcgagccctgttcgactgggaagttacagctgagataaaggctggagcgatcagtcctgcccaggccccagcgctgcgtttccctg

SEQ ID NO: 277794 - DNA, 3204 bp, Homo sapiens
  misc_feature (1856)..(1856): n is a, c, g, or t
gcaccacacctaggtcggagcactgtcgtccttcagggctccagcctcttgatatttttgtacttcagtatcagctcgatagagcaaaagagagagaggacgagagaggggggtgaggagaaaagagagagagcgcgagagggagagggagagaaggaggggtgggaattacacaaagagagaaccaaaaataattttgattcctaagttaatttgctcactgatctgggattttagtcaccatggagggtaaatggacaatctgcccaggactgcagcccgatactatttttcaaagccagaacttactccattttctatgcaaatgtcagaaaaatgaaacaccctctctcccaagtcagagaaggggaagcaacggctctcacgttgggacaatattatctggaagctgaagaagaaactgaatactccttccttcctccccacccattcctttaaatccggagggggaaaaaatcccaaggtctgcaaagctaaaacccaatctcggatatactactaataggcgcggcgctcggactataaaacacaacaaatcataaacccggcggagcagcagcggccgcgcgcgcctcccctcccaatgagttcctatttcgtgaactccaccttccccgtcactctggccagcgggcaggagtccttcctgggccagctaccgctctattcgtcgggctatgcggacccgctgagacattaccccgcgccctacgggccagggccgggccaggacaagggctttgccacttcctcctattacccgccggcgggcggtggctacggccgagcggcgccctgcgactacgggccggcgccggccttctaccgcgagaaagagtcggcctgcgcactctccggcgccgacgagcagcccccgttccaccccgagccgcggaagtcggactgcgcgcaggacaagagcgtgttcggcgagacagaagagcagaagtgctccactccggtctacccgtggatgcagcggatgaattcgtgcaacagtgagtgagacttcccgtcgccgtcgccccggctcccctgggcgcccaccccgggacacagaactagtgagcgccccctgccccaatctcccacagggtgctgggtgggcatctcagttaggagatagaagaagattgggcgccggccgggggtctctcgctgtgtcccctattaggcaggagttacaaagtttgcaaagtcccagccgcactgggagccatggggagcaagtgtgctctcctggggcgcctggccagagccggggttccaggacagggaagggagcaggagcctgcagtcactggcttggctttactttgagcccccaacccccctctcccagccctggtagggttccccaaccaaagacggctccattaaaaacggagtgcgtcatgcaagggggtagggggtgacgctgaagaggaagagttgagtctgtctgggactgtgtttccctgtggtggggagctggggcaagatgaggcaccaggaaaggggtggtagtcagaggagggaggaggaataaggggaaggaagagagagggagcaggcggagcgagagagggagaaacaggcgcggggtctcaggttggattatttgttggccttaagtcccaactgatgtccattagccggactcgaaagtgaggagccgttaatgtggactatggatcgatctacgtcattacggattaacggcctggatttatcattgggttggggggatgacggggggtgggaacaagatggatggaaagggagggaaagacaagatgcaactaggaagagacacacctgaccagcccctccccccaggctcaggtgggagttcnaactgctcctcccctcccccatctagagtctgacagacggcacaggcctaggagactaggagggaatctggagggggcgctggaggagtgcgaaacgggggaagggagccggcagaatagagggcatcccggtactggctggagtctgtgttcgagggtcgactaggggagggggtcctgggcccggtgaccgcaggcctcagcatctccactctgcgtaacaggttcctcctttgggcccagcggccggcgaggccgccagacatacacacgttaccagacgctggagctggagaaggagtttcactacaatcgctacctgacgcggcggcggcgcatcgagatcgcgcacgccctgtgcctgacggagaggcagatcaagatatggttccagaaccgacgcatgaagtggaaaaaggagagcaaactgctcagcgcgtctcagctcagtgccgaggaggaggaagaaaaacaggccgagtgaaggtgctggaaagggagggaggacgcgaggggaaaggcctgtggggagccacgggcgtcagagagacccgggaaggaaggctctcgggtgggggagccaggagacctgctctccggcgcagacaggcggggcccagcgctctcctggacgcccccgcccgcacagctcccggcgggtgctctgaggcctcactactcgagcccacccagcatcccgcgcgcccttccttcccgaggaactcgcctcagcctgatcaggcttcctggtgagaactgaggagcggactcacttgatgtttcctggaagcagagcaaaatgctcttgtccctgtcgcgtctcattttgtccatgtcccccgtgcacggttcaatggtagattcgctgtcccctcagcgggggccttgaagactccctgatcccagacctgtcgtctctcccaccccctccccaaagccactggaaggagcacatactacctagaagtaagaagaggagcctcagaagaaaacaaagttctattttattaattttctatgtgttgtgtttgtagtcttgtcttagctctggacgtgaaatacttcgatgatgatgatgatgatgatgatgataataataataataataacaacaacaacaacaataataaagatgtgaaaactcgacgctcggtcacctccaatcctcccctgccattttttcctctctcctcaacccccagcctctccatctttcctgagccagaattcttcagcaaaggcgagagccctggcccgccgaagcgagccctgttcgactgggaagttacagctgagataaaggctggagcgatcagtcctgcccaggccccagcgctgcgtttccctg

SEQ ID NO: 277795 - DNA, 2551 bp, Homo sapiens
aactatcaggagggttcaaagcccacaactggaagaagaatgatttcttccttgtgcccagatttactgggacagttcctgcttcttgaaaatcctatagcccaggctattcttaagtcttttgggattgtagagggtactggagtgagggttgcaggcaggatagggatcagacaaataaagccacctaggctgagggatacccctcactccttcactccatatcaccaagtgaggagagggctagtctctttccccagtgccccttcccctgccaagggtgagcagctgcatactagaaccaggcagaatgttttgggcagccaccctcgtcgccgcctttcaagaagctcctagtctagccacagagtcagaaggggaagcttgggctcagtccctcctgccagctcctcctcttctgggtcttctaggcagtgggatctggcctgccccctcagaccagaagggttgtggagaagcaggaacaataagccgaggcttggaggagacagagcagatctgataaacaggaaaaacgatgttcaaaacctggggaggagggtgtttcttctttgcttatcttagcggagaactcttctcaccttctaccgacacaaaaccctagaaacaaaccttctttagttctctctcaaggcgattcggagacatttacccaaccctccctggagagaaggggtcgaagcaacgcaggggttaacttttctgaaaacacaattaactttttccaatcctgcgtggggtgggggagagacatatttatttaatcacccgggagtggggtggtctcaatctaaacgttccctcctccctcaaaggcactgagcctgtttcacagatcctacgtaggtggaacaggacgcgttgtgttgttggggagagagaggagaaaggcgaaggagaaggaggaaaaaaaaaaggttgataggtttgtgcgcgggtccctcgtgcgggctgcgctcctcctgggtgctatttgacaattcctgcctctgccattggtcagtgttggatcagatggttgtatttccttctggccctcactggcacctcgccatcccccctcagctaaaacccaatctcggatatactactaataggcgcggcgctcggactataaaacacaacaaatcataaacccggcggagcagcagcggccgcgcgcgcctcccctcccaatgagttcctatttcgtgaactccaccttccccgtcactctggccagcgggcaggagtccttcctgggccagctaccgctctattcgtcgggctatgcggacccgctgagacattaccccgcgccctacgggccagggccgggccaggacaaggcgtgttcggcgagacagaagagcagaagtgctccactccggtctacccgtggatgcagcggatgaattcgtgcaacagttcctcctttgggcccagcggccggcgaggccgccagacatacacacgttaccagacgctggagctggagaaggagtttcactacaatcgctacctgacgcggcggcggcgcatcgagatcgcgcacgccctgtgcctgacggagaggcagatcaagatatggttccagaaccgacgcatgaagtggaaaaaggagagcaaactgctcagcgcgtctcagctcagtgccgaggaggaggaagaaaaacaggccgagtgaaggtgctggaaagggagggaggacgcgaggggaaaggcctgtggggagccacgggcgtcagagagacccgggaaggaaggctctcgggtgggggagccaggagacctgctctccggcgcagacaggcggggcccagcgctctcctggacgcccccgcccgcacagctcccggcgggtgctctgaggcctcactactcgagcccacccagcatcccgcgcgcccttccttcccgaggaactcgcctcagcctgatcaggcttcctggtgagaactgaggagcggactcacttgatgtttcctggaagcagagcaaaatgctcttgtccctgtcgcgtctcattttgtccatgtcccccgtgcacggttcaatggtagattcgctgtcccctcagcgggggccttgaagactccctgatcccagacctgtcgtctctcccaccccctccccaaagccactggaaggagcacatactacctagaagtaagaagaggagcctcagaagaaaacaaagttctattttattaattttctatgtgttgtgtttgtagtcttgtcttagctctggacgtgaaatacttcgatgatgatgatgatgatgatgatgataataataataataataacaacaacaacaacaataataaagatgtgaaaactcgacgctcggtcacctccaatcctcccctgccattttttcctctctcctcaacccccagcctctccatctttcctgagccagaattcttcagcaaaggcgagagccctggcccgccgaagcgagccctgttcgactgggaagttacagctgagataaaggctggagcgatcagtcctgcccaggccccagcgctgcgtttccctg

SEQ ID NO: 277796 - DNA, 3413 bp, Homo sapiens
aactatcaggagggttcaaagcccacaactggaagaagaatgatttcttccttgtgcccagatttactgggacagttcctgcttcttgaaaatcctatagcccaggctattcttaagtcttttgggattgtagagggtactggagtgagggttgcaggcaggatagggatcagacaaataaagccacctaggctgagggatacccctcactccttcactccatatcaccaagtgaggagagggctagtctctttccccagtgccccttcccctgccaagggtgagcagctgcatactagaaccaggcagaatgttttgggcagccaccctcgtcgccgcctttcaagaagctcctagtctagccacagagtcagaaggggaagcttgggctcagtccctcctgccagctcctcctcttctgggtcttctaggcagtgggatctggcctgccccctcagaccagaagggttgtggagaagcaggaacaataagccgaggcttggaggagacagagcagatctgataaacaggaaaaacgatgttcaaaacctggggaggagggtgtttcttctttgcttatcttagcggagaactcttctcaccttctaccgacacaaaaccctagaaacaaaccttctttagttctctctcaaggcgattcggagacatttacccaaccctccctggagagaaggggtcgaagcaacgcaggggttaacttttctgaaaacacaattaactttttccaatcctgcgtggggtgggggagagacatatttatttaatcacccgggagtggggtggtctcaatctaaacgttccctcctccctcaaaggcactgagcctgtttcacagatcctacgtaggtggaacaggacgcgttgtgttgttggggagagagaggagaaaggcgaaggagaaggaggaaaaaaaaaaggttgataggtttgtgcgcgggtccctcgtgcgggctgcgctcctcctgggtgctatttgacaattcctgcctctgccattggtcagtgttggatcagatggttgtatttccttctggccctcactggcacctcgccatcccccctcagctaaaacccaatctcggatatactactaataggcgcggcgctcggactataaaacacaacaaatcataaacccggcggagcagcagcggccgcgcgcgcctcccctcccaatgagttcctatttcgtgaactccaccttccccgtcactctggccagcgggcaggagtccttcctgggccagctaccgctctattcgtcgggctatgcggacccgctgagacattaccccgcgccctacgggccagggccgggccaggacaagggctttgccacttcctcctattacccgccggcgggcggtggctacggccgagcggcgccctgcgactacgggccggcgccggccttctaccgcgagaaagagtcggcctgcgcactctccggcgccgacgagcagcccccgttccaccccgagccgcggaagtcggactgcgcgcaggacaagagcgtgttcggcgagacagaagagcagaagtgctccactccggtctacccgtggatgcagcggatgaattcgtgcaacagtgagtgagacttcccgtcgccgtcgccccggctcccctgggcgcccaccccgggacacagaactagtgagcgccccctgccccaatctcccacagggtgctgggtgggcatctcagttaggagatagaagaagattgggcgccggccgggggtctctcgctgtgtcccctattaggcaggagttacaaagtttgcaaagtcccagccgcactgggagccatggggagcaagtgtgctctcctggggcgcctggccagagccggggttccaggacagggaagggagcaggagcctgcagtcactggcttggctttactttgagcccccaacccccctctcccagccctggtagggttccccaaccaaagacggctccattaaaaacggagtgcgtcatgcaagggggtagggggtgacgctgaagaggaagagttgagtctgtctgggactgtgtttccctgtggtggggagctggggcaagatgaggcaccaggaaaggggtggtagtcagaggagggaggaggaataaggggaaggaagagagagggagcaggcggagcgagagagggagaaacaggcgcggggtctcaggttggattatttgttggccttaagtcccaactgatgtccattagccggactcgaaagtgaggagccgttaatgtggactatggatcgatctacgtcattacggattaacggcctggatttatcattgggttggggggatgacggggggtgggaacaagatggatggaaagggagggaaagacaagatgcaactaggaagagacacacctgaccagcccctccccccaggctcaggttcctcctttgggcccagcggccggcgaggccgccagacatacacacgttaccagacgctggagctggagaaggagtttcactacaatcgctacctgacgcggcggcggcgcatcgagatcgcgcacgccctgtgcctgacggagaggcctgtggggagccacgggcgtcagagagacccgggaaggaaggctctcgggtgggggagccaggagacctgctctccggcgcagacaggcggggcccagcgctctcctggacgcccccgcccgcacagctcccggcgggtgctctgaggcctcactactcgagcccacccagcatcccgcgcgcccttccttcccgaggaactcgcctcagcctgatcaggcttcctggtgagaactgaggagcggactcacttgatgtttcctggaagcagagcaaaatgctcttgtccctgtcgcgtctcattttgtccatgtcccccgtgcacggttcaatggtagattcgctgtcccctcagcgggggccttgaagactccctgatcccagacctgtcgtctctcccaccccctccccaaagccactggaaggagcacatactacctagaagtaagaagaggagcctcagaagaaaacaaagttctattttattaattttctatgtgttgtgtttgtagtcttgtcttagctctggacgtgaaatacttcgatgatgatgatgatgatgatgatgataataataataataataacaacaacaacaacaataataaagatgtgaaaactcgacgctcggtcacctccaatcctcccctgccattttttcctctctcctcaacccccagcctctccatctttcctgagccagaattcttcagcaaaggcgagagccctggcccgccgaagcgagccctgttcgactgggaagttacagctgagataaaggctggagcgatcagtcctgcccaggccccagcgctgcgtttccctg

SEQ ID NO: 277797 - DNA, 695 bp, Homo sapiens
aactatcaggagggttcaaagcccacaactggaagaagaatgatttcttccttgtgcccagatttactgggacagttcctgcttcttgaaaatcctatagcccaggctattcttaagtcttttgggattgtagagggtactggagtgagggttgcaggcaggatagggatcagacaaataaagccacctaggctgagggatacccctcactccttcactccatatcaccaagtgaggagagggctagtctctttccccagtgccccttcccctgccaagggtgagcagctgcatactagaaccaggcagaatgttttgggcagccaccctcgtcgccgcctttcaagaagctcctagtctagccacagagtcagaaggggaagcttgggctcagtccctcctgccagctcctcctcttctgggtcttctaggcagtgggatctggcctgccccctcagaccagaagggttgtggagaagcaggaacaataagccgaggcttggaggagacagagcagatctgataaacaggaaaaacgatgttcaaaacctggggaggagggaacgtctagattgagaccaccccactcccgggtgattaaataaatatgtctctcccccaacccacgcaggattggaaaaagttaattctgttttcagacaagttcacccctgcgtagcttcgaccccttctct

SEQ ID NO: 277798 - DNA, 598 bp, Homo sapiens
gcaccacacctaggtcggagcactgtcgtccttcagggctccagcctcttgatatttttgtacttcagtatcagctcgatagagcaaaagagagagaggacgagagaggggggtgaggagaaaagagagagagcgcgagagggagagggagagaaggaggggtgggaattacacaaagagagaaccaaaaataattttgattcctaagttaatttgctcactgatctgggattttagtcaccatggagggtaaatggacaatctgcccaggactgcagcccgatactatttttcaaagccagaacttactccattttctatgcaaatgtcagaaaaatgaaacaccctctctcccaagtcagagaaggggaagcaacggctctcacgttgggacaatattatctggaagctgaagaagaaactgaatactccttccttcctccccacccattcgtttttctccctcctcccccgttccaagacggggctgaaccccacctctgggcgctgcagggagaagcttcccaggaaattcagtggtggagatatgggtggctgcttcctggagggggagccaaggcagggaaagcgggaagag

SEQ ID NO: 277799 - DNA, 226 bp, Homo sapiens
ccttcagaaatagaagttggagtagtgacacttgaaaatcctatattcaggattctttcaagaagcaggaactgtccagttcctgcttcttgaaaatcctatagcccaggctattcttaagtcttttgggattgtagagggtactggagtgagggttgcaggcaggatagggatattcttcactcatatcatctccgtgagcagctgcatactagaccaggcagta

SEQ ID NO: 277800 - DNA, 625 bp, Homo sapiens
taaatccggagggggaaaaaatcccaaggtctgcaaaggtaagggagattctacaattttcttcttgttcttttgcatcgcttttgtagggtgggggtggggcttgggtttttctccctcctcccccgttccaagacggggctgaaccccacctctgggcgctgcagggagaagcttcccaggaaattcagtggtggagatatgggtggctgcttcctggagggggagccaaggcagggaaagcgggaagaggaatcaaaagagggccaggagaccagctctaagtcgcctttttaagcttggaggagagactcaagcaaggggggtgcgaaagagaggatggggggtatctgggcttcagtggcacccaaagaagccagtggttctggcctccgcgggcttgcccctccccctcctgccatccctcccttgtctcggcctctggctattgccccagcgcagttctcttgcctggtgcggatatcgctgggttcccggcagcactggcatgtgaggcggtggcgctaagggacgtcctggtttctatagggcctggaatctccgccgaggccggcgagggagaggaaacggctagagaaacacagaaaagacaatttacagagaa

SEQ ID NO: 277801 - DNA, 674 bp, Homo sapiens
atctgggcttcagtggcacccaaagaagccagtggttctggcctccgcgggcttgcccctccccctcctgccatccctcccttgtctcggcctctggctattgccccagcgcagttctcttgcctggtgcggatatcgctgggttcccggcagcactggcatgtgaggcggtggcgctaagggacgtcctggtttctatagggcctggaatctccgccgaggccggcgagggagaggaaacggctagagaaacacagaaaagacaatttacagagaaatgtttactatctcccttcggagacatttttgaaattaaagggctgtgggtggaaacaccaaaaatgagggagactcccccctcaccaggaagcctgcccgagaatgcccaagtatctcgccactcccgcaggagggagcctcgctctacagggagacagttttgtggttttaatgcggtaggttacagctgttggtttctgcgtgatactgattctattacttgcgttgtattggtatgggatgtgtggatttcggtggaggaaaaaattgccatgtgtgtgtctgatatgataacatttcaaactttcctgggtccagacatggtgattgtgaagaagctgttaagtgcctttttgttttaggcttgtaaataaaaataaaagagaaagaaatga

SEQ ID NO: 277802 - DNA, 3796 bp, Homo sapiens
  misc_feature (2448)..(2448): n is a, c, g, or t
aactatcaggagggttcaaagcccacaactggaagaagaatgatttcttccttgtgcccagatttactgggacagttcctgcttcttgaaaatcctatagcccaggctattcttaagtcttttgggattgtagagggtactggagtgagggttgcaggcaggatagggatcagacaaataaagccacctaggctgagggatacccctcactccttcactccatatcaccaagtgaggagagggctagtctctttccccagtgccccttcccctgccaagggtgagcagctgcatactagaaccaggcagaatgttttgggcagccaccctcgtcgccgcctttcaagaagctcctagtctagccacagagtcagaaggggaagcttgggctcagtccctcctgccagctcctcctcttctgggtcttctaggcagtgggatctggcctgccccctcagaccagaagggttgtggagaagcaggaacaataagccgaggcttggaggagacagagcagatctgataaacaggaaaaacgatgttcaaaacctggggaggagggtgtttcttctttgcttatcttagcggagaactcttctcaccttctaccgacacaaaaccctagaaacaaaccttctttagttctctctcaaggcgattcggagacatttacccaaccctccctggagagaaggggtcgaagcaacgcaggggttaacttttctgaaaacacaattaactttttccaatcctgcgtggggtgggggagagacatatttatttaatcacccgggagtggggtggtctcaatctaaacgttccctcctccctcaaaggcactgagcctgtttcacagatcctacgtaggtggaacaggacgcgttgtgttgttggggagagagaggagaaaggcgaaggagaaggaggaaaaaaaaaaggttgataggtttgtgcgcgggtccctcgtgcgggctgcgctcctcctgggtgctatttgacaattcctgcctctgccattggtcagtgttggatcagatggttgtatttccttctggccctcactggcacctcgccatcccccctcagctaaaacccaatctcggatatactactaataggcgcggcgctcggactataaaacacaacaaatcataaacccggcggagcagcagcggccgcgcgcgcctcccctcccaatgagttcctatttcgtgaactccaccttccccgtcactctggccagcgggcaggagtccttcctgggccagctaccgctctattcgtcgggctatgcggacccgctgagacattaccccgcgccctacgggccagggccgggccaggacaagggctttgccacttcctcctattacccgccggcgggcggtggctacggccgagcggcgccctgcgactacgggccggcgccggccttctaccgcgagaaagagtcggcctgcgcactctccggcgccgacgagcagcccccgttccaccccgagccgcggaagtcggactgcgcgcaggacaagagcgtgttcggcgagacagaagagcagaagtgctccactccggtctacccgtggatgcagcggatgaattcgtgcaacagtgagtgagacttcccgtcgccgtcgccccggctcccctgggcgcccaccccgggacacagaactagtgagcgccccctgccccaatctcccacagggtgctgggtgggcatctcagttaggagatagaagaagattgggcgccggccgggggtctctcgctgtgtcccctattaggcaggagttacaaagtttgcaaagtcccagccgcactgggagccatggggagcaagtgtgctctcctggggcgcctggccagagccggggttccaggacagggaagggagcaggagcctgcagtcactggcttggctttactttgagcccccaacccccctctcccagccctggtagggttccccaaccaaagacggctccattaaaaacggagtgcgtcatgcaagggggtagggggtgacgctgaagaggaagagttgagtctgtctgggactgtgtttccctgtggtggggagctggggcaagatgaggcaccaggaaaggggtggtagtcagaggagggaggaggaataaggggaaggaagagagagggagcaggcggagcgagagagggagaaacaggcgcggggtctcaggttggattatttgttggccttaagtcccaactgatgtccattagccggactcgaaagtgaggagccgttaatgtggactatggatcgatctacgtcattacggattaacggcctggatttatcattgggttggggggatgacggggggtgggaacaagatggatggaaagggagggaaagacaagatgcaactaggaagagacacacctgaccagcccctccccccaggctcaggtgggagttcnaactgctcctcccctcccccatctagagtctgacagacggcacaggcctaggagactaggagggaatctggagggggcgctggaggagtgcgaaacgggggaagggagccggcagaatagagggcatcccggtactggctggagtctgtgttcgagggtcgactaggggagggggtcctgggcccggtgaccgcaggcctcagcatctccactctgcgtaacaggttcctcctttgggcccagcggccggcgaggccgccagacatacacacgttaccagacgctggagctggagaaggagtttcactacaatcgctacctgacgcggcggcggcgcatcgagatcgcgcacgccctgtgcctgacggagaggcagatcaagatatggttccagaaccgacgcatgaagtggaaaaaggagagcaaactgctcagcgcgtctcagctcagtgccgaggaggaggaagaaaaacaggccgagtgaaggtgctggaaagggagggaggacgcgaggggaaaggcctgtggggagccacgggcgtcagagagacccgggaaggaaggctctcgggtgggggagccaggagacctgctctccggcgcagacaggcggggcccagcgctctcctggacgcccccgcccgcacagctcccggcgggtgctctgaggcctcactactcgagcccacccagcatcccgcgcgcccttccttcccgaggaactcgcctcagcctgatcaggcttcctggtgagaactgaggagcggactcacttgatgtttcctggaagcagagcaaaatgctcttgtccctgtcgcgtctcattttgtccatgtcccccgtgcacggttcaatggtagattcgctgtcccctcagcgggggccttgaagactccctgatcccagacctgtcgtctctcccaccccctccccaaagccactggaaggagcacatactacctagaagtaagaagaggagcctcagaagaaaacaaagttctattttattaattttctatgtgttgtgtttgtagtcttgtcttagctctggacgtgaaatacttcgatgatgatgatgatgatgatgatgataataataataataataacaacaacaacaacaataataaagatgtgaaaactcgacgctcggtcacctccaatcctcccctgccattttttcctctctcctcaacccccagcctctccatctttcctgagccagaattcttcagcaaaggcgagagccctggcccgccgaagcgagccctgttcgactgggaagttacagctgagataaaggctggagcgatcagtcctgcccaggccccagcgctgcgtttccctg

SEQ ID NO: 277803 - DNA, 2735 bp, Homo sapiens
aactatcaggagggttcaaagcccacaactggaagaagaatgatttcttccttgtgcccagatttactgggacagttcctgcttcttgaaaatcctatagcccaggctattcttaagtcttttgggattgtagagggtactggagtgagggttgcaggcaggatagggatcagacaaataaagccacctaggctgagggatacccctcactccttcactccatatcaccaagtgaggagagggctagtctctttccccagtgccccttcccctgccaagggtgagcagctgcatactagaaccaggcagaatgttttgggcagccaccctcgtcgccgcctttcaagaagctcctagtctagccacagagtcagaaggggaagcttgggctcagtccctcctgccagctcctcctcttctgggtcttctaggcagtgggatctggcctgccccctcagaccagaagggttgtggagaagcaggaacaataagccgaggcttggaggagacagagcagatctgataaacaggaaaaacgatgttcaaaacctggggaggagggtgtttcttctttgcttatcttagcggagaactcttctcaccttctaccgacacaaaaccctagaaacaaaccttctttagttctctctcaaggcgattcggagacatttacccaaccctccctggagagaaggggtcgaagcaacgcaggggttaacttttctgaaaacacaattaactttttccaatcctgcgtggggtgggggagagacatatttatttaatcacccgggagtggggtggtctcaatctaaacgttccctcctccctcaaaggcactgagcctgtttcacagatcctacgtaggtggaacaggacgcgttgtgttgttggggagagagaggagaaaggcgaaggagaaggaggaaaaaaaaaaggttgataggtttgtgcgcgggtccctcgtgcgggctgcgctcctcctgggtgctatttgacaattcctgcctctgccattggtcagtgttggatcagatggttgtatttccttctggccctcactggcacctcgccatcccccctcagctaaaacccaatctcggatatactactaataggcgcggcgctcggactataaaacacaacaaatcataaacccggcggagcagcagcggccgcgcgcgcctcccctcccaatgagttcctatttcgtgaactccaccttccccgtcactctggccagcgggcaggagtccttcctgggccagctaccgctctattcgtcgggctatgcggacccgctgagacattaccccgcgccctacgggccagggccgggccaggacaagggctttgccacttcctcctattacccgccggcgggcggtggctacggccgagcggcgccctgcgactacgggccggcgccggccttctaccgcgagaaagagtcggcctgcgcactctccggcgccgacgagcagcccccgttccaccccgagccgcggaagtcggactgcgcgcaggacaagagcgtgttcggcgagacagaagagcagaagtgctccactccggtctacccgtggatgcagcggatgaattcgtgcaacagttcctcctttgggcccagcggccggcgaggccgccagacatacacacgttaccagacgctggagctggagaaggagtttcactacaatcgctacctgacgcggcggcggcgcatcgagatcgcgcacgccctgtgcctgacggagaggcagatcaagatatggttccagaaccgacgcatgaagtggaaaaaggagagcaaactgctcagcgcgtctcagctcagtgccgaggaggaggaagaaaaacaggccgagtgaaggtgctggaaagggagggaggacgcgaggggaaaggcctgtggggagccacgggcgtcagagagacccgggaaggaaggctctcgggtgggggagccaggagacctgctctccggcgcagacaggcggggcccagcgctctcctggacgcccccgcccgcacagctcccggcgggtgctctgaggcctcactactcgagcccacccagcatcccgcgcgcccttccttcccgaggaactcgcctcagcctgatcaggcttcctggtgagaactgaggagcggactcacttgatgtttcctggaagcagagcaaaatgctcttgtccctgtcgcgtctcattttgtccatgtcccccgtgcacggttcaatggtagattcgctgtcccctcagcgggggccttgaagactccctgatcccagacctgtcgtctctcccaccccctccccaaagccactggaaggagcacatactacctagaagtaagaagaggagcctcagaagaaaacaaagttctattttattaattttctatgtgttgtgtttgtagtcttgtcttagctctggacgtgaaatacttcgatgatgatgatgatgatgatgatgataataataataataataacaacaacaacaacaataataaagatgtgaaaactcgacgctcggtcacctccaatcctcccctgccattttttcctctctcctcaacccccagcctctccatctttcctgagccagaattcttcagcaaaggcgagagccctggcccgccgaagcgagccctgttcgactgggaagttacagctgagataaaggctggagcgatcagtcctgcccaggccccagcgctgcgtttccctg

SEQ ID NO: 277804 - DNA, 2531 bp, Homo sapiens
aactatcaggagggttcaaagcccacaactggaagaagaatgatttcttccttgtgcccagatttactgggacagttcctgcttcttgaaaatcctatagcccaggctattcttaagtcttttgggattgtagagggtactggagtgagggttgcaggcaggatagggatcagacaaataaagccacctaggctgagggatacccctcactccttcactccatatcaccaagtgaggagagggctagtctctttccccagtgccccttcccctgccaagggtgagcagctgcatactagaaccaggcagaatgttttgggcagccaccctcgtcgccgcctttcaagaagctcctagtctagccacagagtcagaaggggaagcttgggctcagtccctcctgccagctcctcctcttctgggtcttctaggcagtgggatctggcctgccccctcagaccagaagggttgtggagaagcaggaacaataagccgaggcttggaggagacagagcagatctgataaacaggaaaaacgatgttcaaaacctggggaggagggtgtttcttctttgcttatcttagcggagaactcttctcaccttctaccgacacaaaaccctagaaacaaaccttctttagttctctctcaaggcgattcggagacatttacccaaccctccctggagagaaggggtcgaagcaacgcaggggttaacttttctgaaaacacaattaactttttccaatcctgcgtggggtgggggagagacatatttatttaatcacccgggagtggggtggtctcaatctaaacgttccctcctccctcaaaggcactgagcctgtttcacagatcctacgtaggtggaacaggacgcgttgtgttgttggggagagagaggagaaaggcgaaggagaaggaggaaaaaaaaaaggttgataggtttgtgcgcgggtccctcgtgcgggctgcgctcctcctgggtgctatttgacaattcctgcctctgccattggtcagtgttggatcagatggttgtatttccttctggccctcactggcacctcgccatcccccctcagctaaaacccaatctcggatatactactaataggcgcggcgctcggactataaaacacaacaaatcataaacccggcggagcagcagcggccgcgcgcgcctcccctcccaatgagttcctatttcgtgaactccaccttccccgtcactctggccagcgggcaggagtccttcctgggccagctaccgctctattcgtcgggctatgcggacccgctgagacattaccccgcgccctacgggccagggccgggccaggacaagggctttgccacttcctcctattacccgccggcgggcggtggctacggccgagcggcgccctgcgactacgggccggcgccggccttctaccgcgagaaagagtcggcctgcgcactctccggcgccgacgagcagcccccgttccaccccgagccgcggaagtcggactgcgcgcaggacaagagcgtgttcggcgagacagaagagcagaagtgctccactccggtctacccgtggatgcagcggatgaattcgtgcaacagttcctcctttgggcccagcggccggcgaggccgccagacatacacacgttaccagacgctggagctggagaaggagtttcactacaatcgctacctgacgcggcggcggcgcatcgagatcgcgcacgccctgtgcctgacggagaggcagatcaagatatggttccagaaccgacgcatgaagtggaaaaaggagagcaaactgctcagcgcgtctcagctcagtgccgaggaggaggaagaaaaacaggccgagtgaaggtgctggaaagggagggaggacgcgaggggaaaggcctgtggggagccacgggcgtcagagagacccgggaaggaaggctctcgggtgggggagccaggagacctgctctccggcgcagacaggcggggcccagcgctctcctggacgcccccgcccgcacagctcccggcgggtgctctgaggcctcactactcgagcccacccagcatcccgcgcgcccttccttcccgaggaactcgcctcagcctgatcaggcttcctggtgagaactgaggagcggactcacttgatgtttcctggaagcagagcaaaatgctcttgtccctgtcgcgtctcattttgtccatgtcccccgtgcacggttcaatggtagattcgctgtcccctcagcgggggccttgaagactccctgatcccagacctgtcgtctctcccaccccctccccaaagccactggaaggagcacatactacctagaagtaagaagaggagcctcagaagaaaacaaagttctattttattaattttctatgtgttgtgtttgtagtcttgtcttagctctggacgtgaaatacttcgatgatgatgatgatgatgatgatgataataataataataataacaacaacaacaacaataataaagatgtgaaaactc

SEQ ID NO: 277805 - DNA, 3165 bp, Homo sapiens
  misc_feature (1817)..(1817): n is a, c, g, or t
atctgggcttcagtggcacccaaagaagccagtggttctggcctccgcgggcttgcccctccccctcctgccatccctcccttgtctcggcctctggctattgccccagcgcagttctcttgcctggtgcggatatcgctgggttcccggcagcactggcatgtgaggcggtggcgctaagggacgtcctggtttctatagggcctggaatctccgccgaggccggcgagggagaggaaacggctagagaaacacagaaaagacaatttacagagaaatgtttactatctcccttcggagacatttttgaaattaaagggctgtgggtggaaacaccaaaaatgagggagactcccccctcaccaggaagcctgcccgagaatgcccaagtatctcgccactcccgcaggagggagcctcgctctacagggagacagttttgtggttttaatgcgctaaaacccaatctcggatatactactaataggcgcggcgctcggactataaaacacaacaaatcataaacccggcggagcagcagcggccgcgcgcgcctcccctcccaatgagttcctatttcgtgaactccaccttccccgtcactctggccagcgggcaggagtccttcctgggccagctaccgctctattcgtcgggctatgcggacccgctgagacattaccccgcgccctacgggccagggccgggccaggacaagggctttgccacttcctcctattacccgccggcgggcggtggctacggccgagcggcgccctgcgactacgggccggcgccggccttctaccgcgagaaagagtcggcctgcgcactctccggcgccgacgagcagcccccgttccaccccgagccgcggaagtcggactgcgcgcaggacaagagcgtgttcggcgagacagaagagcagaagtgctccactccggtctacccgtggatgcagcggatgaattcgtgcaacagtgagtgagacttcccgtcgccgtcgccccggctcccctgggcgcccaccccgggacacagaactagtgagcgccccctgccccaatctcccacagggtgctgggtgggcatctcagttaggagatagaagaagattgggcgccggccgggggtctctcgctgtgtcccctattaggcaggagttacaaagtttgcaaagtcccagccgcactgggagccatggggagcaagtgtgctctcctggggcgcctggccagagccggggttccaggacagggaagggagcaggagcctgcagtcactggcttggctttactttgagcccccaacccccctctcccagccctggtagggttccccaaccaaagacggctccattaaaaacggagtgcgtcatgcaagggggtagggggtgacgctgaagaggaagagttgagtctgtctgggactgtgtttccctgtggtggggagctggggcaagatgaggcaccaggaaaggggtggtagtcagaggagggaggaggaataaggggaaggaagagagagggagcaggcggagcgagagagggagaaacaggcgcggggtctcaggttggattatttgttggccttaagtcccaactgatgtccattagccggactcgaaagtgaggagccgttaatgtggactatggatcgatctacgtcattacggattaacggcctggatttatcattgggttggggggatgacggggggtgggaacaagatggatggaaagggagggaaagacaagatgcaactaggaagagacacacctgaccagcccctccccccaggctcaggtgggagttcnaactgctcctcccctcccccatctagagtctgacagacggcacaggcctaggagactaggagggaatctggagggggcgctggaggagtgcgaaacgggggaagggagccggcagaatagagggcatcccggtactggctggagtctgtgttcgagggtcgactaggggagggggtcctgggcccggtgaccgcaggcctcagcatctccactctgcgtaacaggttcctcctttgggcccagcggccggcgaggccgccagacatacacacgttaccagacgctggagctggagaaggagtttcactacaatcgctacctgacgcggcggcggcgcatcgagatcgcgcacgccctgtgcctgacggagaggcagatcaagatatggttccagaaccgacgcatgaagtggaaaaaggagagcaaactgctcagcgcgtctcagctcagtgccgaggaggaggaagaaaaacaggccgagtgaaggtgctggaaagggagggaggacgcgaggggaaaggcctgtggggagccacgggcgtcagagagacccgggaaggaaggctctcgggtgggggagccaggagacctgctctccggcgcagacaggcggggcccagcgctctcctggacgcccccgcccgcacagctcccggcgggtgctctgaggcctcactactcgagcccacccagcatcccgcgcgcccttccttcccgaggaactcgcctcagcctgatcaggcttcctggtgagaactgaggagcggactcacttgatgtttcctggaagcagagcaaaatgctcttgtccctgtcgcgtctcattttgtccatgtcccccgtgcacggttcaatggtagattcgctgtcccctcagcgggggccttgaagactccctgatcccagacctgtcgtctctcccaccccctccccaaagccactggaaggagcacatactacctagaagtaagaagaggagcctcagaagaaaacaaagttctattttattaattttctatgtgttgtgtttgtagtcttgtcttagctctggacgtgaaatacttcgatgatgatgatgatgatgatgatgataataataataataataacaacaacaacaacaataataaagatgtgaaaactcgacgctcggtcacctccaatcctcccctgccattttttcctctctcctcaacccccagcctctccatctttcctgagccagaattcttcagcaaaggcgagagccctggcccgccgaagcgagccctgttcgactgggaagttacagctgagataaaggctggagcgatcagtcctgcccaggccccagcgctgcgtttccctg

SEQ ID NO: 277806 - DNA, 745 bp, Homo sapiens
ctcccagagtgctctgggccggagaaacctcccgcaggctcccgggccaggcgtgcaaggccccctctcctgccagggcccaggacgctgcgggccccagcggaggggaaggggactaagtaggggaagaagctgtaaacagccccagcgtccgggcctcgcctcgaagagccgcgcttcccaggcccagccgcgggccgcccaggcccccagcctgccccggggccgccgcgcccggggtccgggacaccggaggggagtcgggtcccctccccggagagctccgggagctcgcggagcggccccaggagcagagaagggggaagtcaggacttacctgtcattactttctacgccatcttggatccacttgtcaacgtccccacaaagcattatggacgccccgcgtctgcattgaatcaacccgaggtttccttgccgcccgcggcgcggcgcggagctgctcgcggatttatttgtgcgcgtggatgtgagcgtttctgctcctgcggccgcgcttccaggaagcccgcgagcggccggggtcgccttcagaggccgcgcagaccagctccgcacccgccgcccggagaggtgcctctgccctgggaaaccgccccggggccgttgggctccgggaactgggaggacgccgtgtccccgagtccaccagcgtcgaagcacgatttacacaccacacaattgaggccaatgccaaaagacacaaaaaaactctcaggagcga

SEQ ID NO: 277807 - DNA, 816 bp, Homo sapiens
ctcccagagtgctctgggccggagaaacctcccgcaggctcccgggccaggcgtgcaaggccccctctcctgccagggcccaggacgctgcgggccccagcggaggggaaggggactaagtaggggaagaagctgtaaacagccccagcgtccgggcctcgcctcgaagagccgcgcttcccaggcccagccgcgggccgcccaggcccccagcctgccccggggccgccgcgcccggggtccgggacaccggaggggagtcgggtcccctccccggagagctccgggagctcgcggagcggccccaggagcagagaagggggaagtcaggacttacctgtcattactttctacgccatcttggatccacttgtcaacgtccccacaaagcattatgggtcctactgcaactcgaatggcacttaggctccacaagaccaacttcctatttctacatcagtgaaggttcggagtggagcttttcattcagcaaagacagcaggaagcacagggttcggtgatgaattctcacgtgcaggtacctcttcagtagaaaaattcaataaggtttctgacactttctacctatgggccagttacatacagaagagaaaactgaaactgaaaactggtttgtcatttttacagaaagtcactgcaaagaaggagaattccaagtgcaaatgacttgagcttgacggaaaggtaaaaatatccctatgattctcttcacaagaaggtagccaagtatttattggatgcaagacagtttgtttaaggagcctaaaaaagcaaagatgcagcggtgagaaagaa

SEQ ID NO: 277808 - DNA, 268 bp, Homo sapiens
cgggtggactgccgaccccggcgcccgcagctggccccttcccctcccccgggctgacggcattgaaaattcacccgcatttttaaaacgtggctttggggttttctccctttctcctgccccggcctccctgcccccacgcccggtcctctcgcctcgccgcgttcctgcccgggcagacgccccgcgtctgcattgaatcaacccgaggtttccttgccgcccgcggcgcggcgcggagctgctcgcggatttatttgtgcgcgtg

SEQ ID NO: 277809 - DNA, 381 bp, Homo sapiens
gaattcactaagcctcttgaggaccagacggtcgaagagggagccactgcagtgctggagtgtgaagtctccagagaaaatgctaaggtgaaatggttcaaaaatgggacagaaatcctcaaaagcaagaagtatgaaattgttgctgatggcagggtcagaaaacttgttatacatgactgtaccccagaggatattaaaacatacacttgtgatgctaaggattttaagacttcctgtaacctgaatgtcgtgcctcctcatgtggaattcttaagaccactcaccgaccttcaagttagagaaaaagaaatggctcgatttgagtgtgaactttcccgagaaaatgctaaggtctgtgactgtatacctgtcatcttg

SEQ ID NO: 277810 - DNA, 528 bp, Homo sapiens
actttatttctgctacaaattatataataccttttaagacagagtccaattatccatttttatatatgataaactattttatacagtaccttggaggtaataggttcttgatatctatctaatatctgtttggctgaagacactgataaggaggaatgcatgcataattcagtgaatacccaacctttataataataaggtatttcctatccttccataaaattataatttttttgtgatagatacttgctgttttattattctgtctgatattccgtagatagccaataacatttacatttattcaatctgaagttactgcacatatactatgtgtcaggtatttttttagatttggctaggtgctttcaaagatgaatgaagatgctctttgtcttaataaatttaactctgattttgaagatagaattaataaagtagagatgcattttgacttccatgttttcctcactcgtgtaatttctgcactatatatgattactcaagttgaactttaaaggatatttg

SEQ ID NO: 277811 - DNA, 1223 bp, Homo sapiens
cttgtcatttttgaagctaaacgtattctggtgcttctgaggtctggaacgagccacgttgcctttctgggagctcatcgccgaaatcaaagccacccctcgccgggagcaggcaaaaggatgaggggaaagaaaaccaacgaactactcccaggaattgacgcttctgtcaatgacccggaagaaacaaacgcagcctttccgccccggctctgggtcagcccacgtgactcttctgggaggtcaaagagcatcgctctgccctccctgctgttaagccaagccactccacgcggcgcagcctcgacccctccggctccgcgcagcctctttctcaaacccggagaacaagtcccactttcttcgaaatgagaattcccccattggcccgaatgtgtagtccatcaaatcaaaggggcggggaacctttgttcctattggttcttcttttccgcaatccccgcctcctgctgagcgagctcagcctctccttgagctcagagcgcctcccaccctgccgggcggcctctgattggtggaagtgaggcaaggctgggctccgtctctccccccgcccgctagtaggctggagccggggtcagctttggcaccttcctccagtcagtggccaactcctggctcagtggggattgtgctcgtcccctccgttcccctccagtcttcctcccgctaccggaacgagcctcgcgcttggcaggctgaggaggagcaaagaaagcaggattaaagagaaggaagacctggctaggtctgggtggcgtctgcagtgccagaaagggaggcggtggcggcggcggctgcgaccacggccgcgcgggacgtgaggcccgagagcaaccgacgggcagcggcggccgctccagcgccccgcaccggggccgttagtcagcagaacgcgagctcttgtggaggagcagggccggcgcgaggcgagactcgggagcgtgagcggggcccctggggcgccgccgtccttcttcgccccggcgccgggggctgtagccctggtccccgctcctctgtcgggccagtctgcaggcggagagagtcggacggcgcccggagcgcggatctcgccttgtggaggacagcgcgtcggctgcggttctctctcgaccccttctgcccggcgcttcggcccgggccgctcaggtgcaggtgcgtgcggcctcggggtttggggacgccgcagcccggctcgg

SEQ ID NO: 277812 - DNA, 3686 bp, Homo sapiens
cttgtcatttttgaagctaaacgtattctggtgcttctgaggtctggaacgagccacgttgcctttctgggagctcatcgccgaaatcaaagccacccctcgccgggagcaggcaaaaggatgaggggaaagaaaaccaacgaactactcccaggaattgacgcttctgtcaatgacccggaagaaacaaacgcagcctttccgccccggctctgggtcagcccacgtgactcttctgggaggtcaaagagcatcgctctgccctccctgctgttaagccaagccactccacgcggcgcagcctcgacccctccggctccgcgcagcctctttctcaaacccggagaacaagtcccactttcttcgaaatgagaattcccccattggcccgaatgtgtagtccatcaaatcaaaggggcggggaacctttgttcctattggttcttcttttccgcaatccccgcctcctgctgagcgagctcagcctctccttgagctcagagcgcctcccaccctgccgggcggcctctgattggtggaagtgaggcaaggctgggctccgtctctccccccgcccgctagtaggctggagccggggtcagctttggcaccttcctccagtcagtggccaactcctggctcagtggggattgtgctcgtcccctccgttcccctccagtcttcctcccgctaccggaacgagcctcgcgcttggcaggctgaggaggagcaaagaaagcaggattaaagagaaggaagacctggctaggtctgggtggcgtctgcagtgccagaaagggaggcggtggcggcggcggctgcgaccacggccgcgcgggacgtgaggcccgagagcaaccgacgggcagcggcggccgctccagcgccccgcaccggggccgttagtcagcagaacgcgagctcttgtggaggagcagggccggcgcgaggcgagactcgggagcgtgagcggggcccctggggcgccgccgtccttcttcgccccggcgccgggggctgtagccctggtccccgctcctctgtcgggccagtctgcaggcggagagagtcggacggcgcccggagcgcggatctcgccttgtggaggacagcgcgtcggctgcggttctctctcgaccccttctgcccggcgcttcggcccgggccgctcaggtgcagagcatgaataatctttcatttagtgagctatgttgcctcttctgctgtccaccttgtccagggaagattgcttcaaaattagcgtttttgccacctgatccaacttacacactgatgtgtgatgaaagcggaagccgttggactttacatctgtctgaacgagcagactggcagtattcttctagagaaaaagatgctattgagtgtttcatgactagaaccagtaaaggcaacagaattgcttgtatgtttgtacgttgttcacccaatgcgaaatacactttactcttctcacatggaaatgctgttgatcttggtcaaatgagcagcttttacataggactaggatcacggattaattgtaatatattctcatatgattattctggatatggtgccagttccgggaaacccacagagaagaacctctatgcagacattgaagctgcttggcttgctcttaggacaagatatggcattcgccctgaaaatgtgattatatatggccaaagtatagggacagtaccgtctgtggatcttgctgctcgatatgagagtgctgctgttattcttcattctcctctgacttcgggaatgcgagttgcctttcctgataccaagaagacctactgttttgatgcattcccaaacattgacaaaatctctaagataacctctccagtattaataattcatgggactgaagatgaagtcattgacttttcacatggcctcgcattgtttgaacgttgccaaagacctgtggagcctctctgggttgaaggagcaggtcacaatgatgtggaactttatggacagtatcttgaaaggttgaaacagtttgtgtcacaggaactggtaaatttgtaaaatattctgtaaatttgctactgggttttcctttcttgctgaactgcactctttggtaaataacataaaacctgaaggttttgtttgcaaatcatgtcagttgccttcataaatgtacaggtaatgatttgttaacagacttaatgaaggttttaattaccagaactaaaaactggaaataacagtaccgtgcagtcaggctgtgtaatttatattttttctgtgaatttttttttaacatcaagatgagtactgtatgagattttaattctataaaatcaaatgctgtaaaagtattgccaaatgcttttgcatactagaaacaaatttataaatatttttaaaacatctcaatatattaaatcttatcctggaatacaactgtaatattttgaaaaaagctatgtatctaaagcaatttaagtactcataatggaatgaactgtaaaagagatttaaaaccatgcaagttcactaggaattaacctaaaccctgttgtacagggatagaggtttaaagttattttattgtaaaatacattgaattttctgtatactctgattacatacatttatcctttaaaaaagatgtaaatcttaatttttatgccatctattaatttaccaatgagttaccttgtaaatgagaagtcatgatagcactgaattttaactagttttgacttctaagtttggtactgtgaggcaagtacttaaaattttcatgctggttacttaaaaggcatttagagatttcaagaatgattttgtatacgatgttttaaattttgactgatctcatagtcttcatagaattgcagtagtcttcattgtatgaaatcccgaaagtccatgagttgatcttaaagaccactaacagactggctatcagatcccttttcactttggctatttttttcattttttgagatggagtcttgctgtgtcactgaggctggagtgcagtggcgcgatcttgactcactgcaacctctgcctcccaggatcaagtgattctcctgcctcagcctcctgagtagctggtattacagatgcttgccaccacgcctggctaatttttgtatttttagtagagacagggttttgccatgttgatcaggctggtcttgaactcctgacctcatgatctgcccttggcctcccaaagtgtcggaattacaggcatgagccactgcgcctggcccactttagctatttttaaaaataggacctattgttttggattactatctgagaatttcatggattcactcctgggtataggagataagaatacgtttaattcataacttttatattaaccaatatagtaaaaaaataaagctcacacatacaaaaactaagttgcctttccttgaatgaaccctgtctgaataaaacaatgaaaaataaaaataaaattaatggtatgtagtctaatttgtaaatgaatgaatatggaaataatacacactgtggatatattttaaggccttatgtagttttaattgttctgctcgttccgtggttatgtttaagactatagtatatgactctcttcaaagtatatcaagtattgtgaatgctttggttcagatgtgtcaaattaacagtaaaacaacaaatatacccactga

SEQ ID NO: 277813 - DNA, 4034 bp, Homo sapiens
cttgtcatttttgaagctaaacgtattctggtgcttctgaggtctggaacgagccacgttgcctttctgggagctcatcgccgaaatcaaagccacccctcgccgggagcaggcaaaaggatgaggggaaagaaaaccaacgaactactcccaggaattgacgcttctgtcaatgacccggaagaaacaaacgcagcctttccgccccggctctgggtcagcccacgtgactcttctgggaggtcaaagagcatcgctctgccctccctgctgttaagccaagccactccacgcggcgcagcctcgacccctccggctccgcgcagcctctttctcaaacccggagaacaagtcccactttcttcgaaatgagaattcccccattggcccgaatgtgtagtccatcaaatcaaaggggcggggaacctttgttcctattggttcttcttttccgcaatccccgcctcctgctgagcgagctcagcctctccttgagctcagagcgcctcccaccctgccgggcggcctctgattggtggaagtgaggcaaggctgggctccgtctctccccccgcccgctagtaggctggagccggggtcagctttggcaccttcctccagtcagtggccaactcctggctcagtggggattgtgctcgtcccctccgttcccctccagtcttcctcccgctaccggaacgagcctcgcgcttggcaggctgaggaggagcaaagaaagcaggattaaagagaaggaagacctggctaggtctgggtggcgtctgcagtgccagaaagggaggcggtggcggcggcggctgcgaccacggccgcgcgggacgtgaggcccgagagcaaccgacgggcagcggcggccgctccagcgccccgcaccggggccgttagtcagcagaacgcgagctcttgtggaggagcagggccggcgcgaggcgagactcgggagcgtgagcggggcccctggggcgccgccgtccttcttcgccccggcgccgggggctgtagccctggtccccgctcctctgtcgggccagtctgcaggcggagagagtcggacggcgcccggagcgcggatctcgccttgtggaggacagcgcgtcggctgcggttctctctcgaccccttctgcccggcgcttcggcccgggccgctcaggtgcagagcatgaataatctttcatttagtgagctatgttgcctcttctgctgtccaccttgtccagggaagattgcttcaaaattagcgtttttgccacctgatccaacttacacactgatgtgtgatgaaagcggaagccgttggactttacatctgtctgaacgagcagactggcagtattcttctagagaaaaagatgctattgagtgtttcatgactagaaccagtaaaggcaacagaattgcttgtatgtttgtacgttgttcacccaatgcgaaatacactttactcttctcacatggaaatgctgttgatcttggtcaaatgagcagcttttacataggactaggatcacggattaattgtaatatattctcatatgattattctggatatggtgccagttccgggaaacccacagagaagaacctctatgcagacattgaagctgcttggcttgctcttaggacaagatatggcattcgccctgaaaatgtgattatatatggccaaagtatagggacagtaccgtctgtggatcttgctgctcgatatgagagtgctgctgttattcttcattctcctctgacttcgggaatgcgagttgcctttcctgataccaagaagacctactgttttgatgcattcccaaacattgacaaaatctctaagataacctctccagtattaataattcatgggactgaagatgaagtcattgacttttcacatggcctcgcattgtttgaacgttgccaaagacctgtggagcctctctgggttgaaggagcaggtcacaatgatgtggaactttatggacagtatcttgaaaggttgaaacagtttgtgtcacaggaactggtaaatttgtaaaatattctgtaaatttgctactgggttttcctttcttgctgaactgcactctttggtaaataacataaaacctgaaggttttgtttgcaaatcatgtcagttgccttcataaatgtacaggtaatgatttgttaacagacttaatgaaggttttaattaccagaactaaaaactggaaataacagtaccgtgcagtcaggctgtgtaatttatattttttctgtgaatttttttttaacatcaagatgagtactgtatgagattttaattctataaaatcaaatgctgtaaaagtattgccaaatgcttttgcatactagaaacaaatttataaatatttttaaaacatctcaatatattaaatcttatcctggaatacaactgtaatattttgaaaaaagctatgtatctaaagcaatttaagtactcataatggaatgaactgtaaaagagatttaaaaccatgcaagttcactaggaattaacctaaaccctgttgtacagggatagaggtttaaagttattttattgtaaaatacattgaattttctgtatactctgattacatacatttatcctttaaaaaagatgtaaatcttaatttttatgccatctattaatttaccaatgagttaccttgtaaatgagaagtcatgatagcactgaattttaactagttttgacttctaagtttggtactgtgaggcaagtacttaaaattttcatgctggttacttaaaaggcatttagagatttcaagaatgattttgtatacgatgttttaaattttgactgatctcatagtcttcatagaattgcagtagtcttcattgtatgaaatcccgaaagtccatgagttgatcttaaagaccactaacagactggctatcagatcccttttcactttggctatttttttcattttttgagatggagtcttgctgtgtcactgaggctggagtgcagtggcgcgatcttgactcactgcaacctctgcctcccaggatcaagtgattctcctgcctcagcctcctgagtagctggtattacagatgcttgccaccacgcctggctaatttttgtatttttagtagagacagggttttgccatgttgatcaggctggtcttgaactcctgacctcatgatctgcccttggcctcccaaagtgtcggaattacaggcatgagccactgcgcctggcccactttagctatttttaaaaataggacctattgttttggattactatctgagaatttcatggattcactcctgggtataggagataagaatacgtttaattcataacttttatattaaccaatatagtaaaaaaataaagctcacacatacaaaaactaagttgcctttccttgaatgaaccctgtctgaataaaacaatgaaaaataaaaataaaattaatggtatgtagtctaatttgtaaatgaatgaatatggaaataatacacactgtggatatattttaaggccttatgtagttttaattgttctgctcgttccgtggttatgtttaagactatagtatatgactctcttcaaagtatatcaagtattgtgaatgctttggttcagatgtgtcaaattaacagtaaaacaacaaatatacccactgacctgtgcttatttgcctttttccatgctccccacccccacactagaaagagtgaaaaaaaattacccttcgtttttataggacatagtttgaaaatttttaaaattatatcatcacttttttggagaggtctttctttctcaagattgtcttgtaacctatacagtttcttctttgtacagcatacaacccagggcttagctaaatgttttctttgattacctggggaaatctaaatattgatcctattcattcagtgttcgttcattcaacagacagttactgaatgtataaatcatgcaaaaacctgtgctaggtaaagacagactgtgtcctcatagatttcatg

SEQ ID NO: 277814 - DNA, 2677 bp, Homo sapiens
aactccgtctcaaaaaaaaaaaagaagccaaaaatctgtttggaatcatacctaaaatagtaatagtcattaaccaccaataaaatttacccatgtctgtgttttaactttttattgtatgagtctacattcagttattaaaatatttgctatctccttttctttttcagagcatgaataatctttcatttagtgagctatgttgcctcttctgctgtccaccttgtccagggaagattgcttcaaaattagcgtttttgccacctgatccaacttacacactgatgtgtgatgaaagcggaagccgttggactttacatctgtctgaacgagcagactggcagtattcttctagagaaaaagatgctattgagtgtttcatgactagaaccagtaaaggcaacagaattgcttgtatgtttgtacgttgttcacccaatgcgaaatacactttactcttctcacatggaaatgctgttgatcttggtcaaatgagcagcttttacataggactaggatcacggattaattgtaatatattctcatatgattattctggatatggtgccagttccgggaaacccacagagaagaacctctatgcagacattgaagctgcttggcttgctcttaggacaagatatggcattcgccctgaaaatgtgattatatatggccaaagtatagggacagtaccgtctgtggatcttgctgctcgatatgagagtgctgctgttattcttcattctcctctgacttcgggaatgcgagttgcctttcctgataccaagaagacctactgttttgatgcattcccaaacattgacaaaatctctaagataacctctccagtattaataattcatgggactgaagatgaagtcattgacttttcacatggcctcgcattgtttgaacgttgccaaagacctgtggagcctctctgggttgaaggagcaggtcacaatgatgtggaactttatggacagtatcttgaaaggttgaaacagtttgtgtcacaggaactggtaaatttgtaaaatattctgtaaatttgctactgggttttcctttcttgctgaactgcactctttggtaaataacataaaacctgaaggttttgtttgcaaatcatgtcagttgccttcataaatgtacaggtaatgatttgttaacagacttaatgaaggttttaattaccagaactaaaaactggaaataacagtaccgtgcagtcaggctgtgtaatttatattttttctgtgaatttttttttaacatcaagatgagtactgtatgagattttaattctataaaatcaaatgctgtaaaagtattgccaaatgcttttgcatactagaaacaaatttataaatatttttaaaacatctcaatatattaaatcttatcctggaatacaactgtaatattttgaaaaaagctatgtatctaaagcaatttaagtactcataatggaatgaactgtaaaagagatttaaaaccatgcaagttcactaggaattaacctaaaccctgttgtacagggatagaggtttaaagttattttattgtaaaatacattgaattttctgtatactctgattacatacatttatcctttaaaaaagatgtaaatcttaatttttatgccatctattaatttaccaatgagttaccttgtaaatgagaagtcatgatagcactgaattttaactagttttgacttctaagtttggtactgtgaggcaagtacttaaaattttcatgctggttacttaaaaggcatttagagatttcaagaatgattttgtatacgatgttttaaattttgactgatctcatagtcttcatagaattgcagtagtcttcattgtatgaaatcccgaaagtccatgagttgatcttaaagaccactaacagactggctatcagatcccttttcactttggctatttttttcattttttgagatggagtcttgctgtgtcactgaggctggagtgcagtggcgcgatcttgactcactgcaacctctgcctcccaggatcaagtgattctcctgcctcagcctcctgagtagctggtattacagatgcttgccaccacgcctggctaatttttgtatttttagtagagacagggttttgccatgttgatcaggctggtcttgaactcctgacctcatgatctgcccttggcctcccaaagtgtcggaattacaggcatgagccactgcgcctggcccactttagctatttttaaaaataggacctattgttttggattactatctgagaatttcatggattcactcctgggtataggagataagaatacgtttaattcataacttttatattaaccaatatagtaaaaaaataaagctcacacatacaaaaactaagttgcctttccttgaatgaaccctgtctgaataaaacaatgaaaaataaaaataaaattaatggtatgtagtctaatttgtaaatgaatgaatatggaaataatacacactgtggatatattttaaggccttatgtagttttaattgttctgctcgttccgtggttatgtttaagactatagtatatgactctcttcaaagtatatcaagtattgtgaatgctttggttcagatgtgtcaaattaacagtaaaacaacaaatatacccactga

SEQ ID NO: 277815 - DNA, 2728 bp, Homo sapiens
cttgtcatttttgaagctaaacgtattctggtgcttctgaggtctggaacgagccacgttgcctttctgggagctcatcgccgaaatcaaagccacccctcgccgggagcaggcaaaaggatgaggggaaagaaaaccaacgaactactcccaggaattgacgcttctgtcaatgacccggaagaaacaaacgcagcctttccgccccggctctgggtcagcccacgtgactcttctgggaggtcaaagagcatcgctctgccctccctgctgttaagccaagccactccacgcggcgcagcctcgacccctccggctccgcgcagcctctttctcaaacccggagaacaagtcccactttcttcgaaatgagaattcccccattggcccgaatgtgtagtccatcaaatcaaaggggcggggaacctttgttcctattggttcttcttttccgcaatccccgcctcctgctgagcgagctcagcctctccttgagctcagagcgcctcccaccctgccgggcggcctctgattggtggaagtgaggcaaggctgggctccgtctctccccccgcccgctagtaggctggagccggggtcagctttggcaccttcctccagtcagtggccaactcctggctcagtggggattgtgctcgtcccctccgttcccctccagtcttcctcccgctaccggaacgagcctcgcgcttggcaggctgaggaggagcaaagaaagcaggattaaagagaaggaagacctggctaggtctgggtggcgtctgcagtgccagaaagggaggcggtggcggcggcggctgcgaccacggccgcgcgggacgtgaggcccgagagcaaccgacgggcagcggcggccgctccagcgccccgcaccggggccgttagtcagcagaacgcgagctcttgtggaggagcagggccggcgcgaggcgagactcgggagcgtgagcggggcccctggggcgccgccgtccttcttcgccccggcgccgggggctgtagccctggtccccgctcctctgtcgggccagtctgcaggcggagagagtcggacggcgcccggagcgcggatctcgccttgtggaggacagcgcgtcggctgcggttctctctcgaccccttctgcccggcgcttcggcccgggccgctcaggtgcagagcatgaataatctttcatttagtgagctatgttgcctcttctgctgtccaccttgtccagggaagattgcttcaaaattagcgtttttgccacctgatccaacttacacactgatgtgtgatgaaagcggaagccgttggactttacatctgtctgaacgagcagactggcagtattcttctagagaaaaagatgctattgagtgtttcatgactagaaccagtaaaggcaacagaattgcttgtatgtttgtacgttgttcacccaatgcgaaatacactttactcttctcacatggaaatgctgttgatcttggtcaaatgagcagcttttacataggactaggatcacggattaattgtaatatattctcatatgattattctggatatggtgccagttccgggaaacccacagagaagaacctctatgcagacattgaagctgcttggcttgctcttaggacaagatatggcattcgccctgaaaatgtgattatatatggccaaagtatagggacagtaccgtctgtggatcttgctgctcgatatgagagtgctgctgttattcttcattctcctctgacttcgggaatgcgagttgcctttcctgataccaagaagacctactgttttgatgcattcccaaacattgacaaaatctctaagataacctctccagtattaataattcatgggactgaagatgaagtcattgacttttcacatggcctcgcattgtttgaacgttgccaaagacctgtggagcctctctgggttgaaggagcaggtcacaatgatgtggaactttatggacagtatcttgaaaggttgaaacagtttgtgtcacaggaactggtgcagaaacataaagaagggaagtgattttctcaaggtctacagttttcaatgacggtactatgtattccattatcttctctttaccaaacttaactggattaatataccaatgatcctttcaaattatatgacataaacttatttgctctccaatgttagtcacaattgtatttttttaatgggtaggttcctccttgtcagttattcattgaatagtaaattggtagattgtgccaattaattctcaagttcatgattatttaaagaatttaatactaattcattttactaggcacagttacagttagttatgttgaaacctagtgaggatggtagccacagacacatgaataaacaagtgtttacttcagaagctgatttactataaattgtaacacacagaataagcaattacattgaaaaaagtatcaatatagttactacgaattagcttttagcttgttgctttgttttaaaataggcaatttattcaaacatgataacatgttgtattctgataatgtgcaccccaaatgtccagtaaccaaaaaagtaacaatttatgcttacgatacttggaattaggctttgagtttgagcttgcagaatggagaagacatttgtctatcgtatctctaaatggattatgcctctgactgaatagttgaatgagtaatgctaaggaagg

SEQ ID NO: 277816 - DNA, 3455 bp, Homo sapiens
cttgtcatttttgaagctaaacgtattctggtgcttctgaggtctggaacgagccacgttgcctttctgggagctcatcgccgaaatcaaagccacccctcgccgggagcaggcaaaaggatgaggggaaagaaaaccaacgaactactcccaggaattgacgcttctgtcaatgacccggaagaaacaaacgcagcctttccgccccggctctgggtcagcccacgtgactcttctgggaggtcaaagagcatcgctctgccctccctgctgttaagccaagccactccacgcggcgcagcctcgacccctccggctccgcgcagcctctttctcaaacccggagaacaagtcccactttcttcgaaatgagaattcccccattggcccgaatgtgtagtccatcaaatcaaaggggcggggaacctttgttcctattggttcttcttttccgcaatccccgcctcctgctgagcgagctcagcctctccttgagctcagagcgcctcccaccctgccgggcggcctctgattggtggaagtgaggcaaggctgggctccgtctctccccccgcccgctagtaggctggagccggggtcagctttggcaccttcctccagtcagtggccaactcctggctcagtggggattgtgctcgtcccctccgttcccctccagtcttcctcccgctaccggaacgagcctcgcgcttggcaggctgaggaggagcaaagaaagcaggattaaagagaaggaagacctggctaggtctgggtggcgtctgcagtgccagaaagggaggcggtggcggcggcggctgcgaccacggccgcgcgggacgtgaggcccgagagcaaccgacgggcagcggcggccgctccagcgccccgcaccggggccgttagtcagcagaacgcgagctcttgtggaggagcagggccggcgcgaggcgagactcgggagcgtgagcggggcccctggggcgccgccgtccttcttcgccccggcgccgggggctgtagccctggtccccgctcctctgtcgggccagtctgcaggcggagagagtcggacggcgcccggagcgcggatctcgccttgtggaggacagcgcgtcggctgcggttctctctcgaccccttctgcccggcgcttcggcccgggccgctcaggtgcagagcatgaataatctttcatttagtgagctatgttgcctcttctgctgtccaccttgtccagggaagattgcttcaaaattagcgtttttgccacctgatccaacttacacactgatgtgtgatgaaagcggaagccgttggactttacatctgtctgaacgagcagactggcagtattcttctagagaaaaagatgctattgagtgtttcatgactagaaccagtaaaggcaacagaattgcttgtatgtttgtacgttgttcacccaatgcgaaatacactttactcttctcacatggaaatgctgttgatcttggtcaaatgagcagcttttacataggactaggatcacggattaattgtaatatattctcatatgattattctggatatggtgccagttccgggaaacccacagagaagaacctctatgcagacattgaagctgcttggcttgctcttaggacaagatatggcattcgccctgaaaatgtgattatatatggccaaagtatagggacagtaccgtctgtggatcttgctgctcgatatgagagtgctgctgttattcttcattctcctctgacttcgggaatgcgagttgcctttcctgataccaagaagacctactgttttgatgcattcccaaacattgacaaaatctctaagataacctctccagtattaataattcatgggactgaagatgaagtcattgacttttcacatggcctcgcattgtttgaacgttgccaaagacctgtggagcctctctgggttgaaggagcaggtcacaatgatgtggaactttatggacagtatcttgaaaggttgaaacagtttgtgtcacaggaactggtaaatttgtaaaatattctgtaaatttgctactgggttttcctttcttgctgaactgcactctttggtaaataacataaaacctgaaggttttgtttgcaaatcatgtcagttgccttcataaatgtacaggtaatgatttgttaacagacttaatgaaggttttaattaccagaactaaaaactggaaataacagtaccgtgcagtcaggctgtgtaatttatattttttctgtgaatttttttttaacatcaagatgagtactgtatgagattttaattctataaaatcaaatgctgtaaaagtattgccaaatgcttttgcatactagaaacaaatttataaatatttttaaaacatctcaatatattaaatcttatcctggaatacaactgtaatattttgaaaaaagctatgtatctaaagcaatttaagtactcataatggaatgaactgtaaaagagatttaaaaccatgcaagttcactaggaattaacctaaaccctgttgtacagggatagaggtttaaagttattttattgtaaaatacattgaattttctgtatactctgattacatacatttatcctttaaaaaagatgtaaatcttaatttttatgccatctattaatttaccaatgagttaccttgtaaatgagaagtcatgatagcactgaattttaactagttttgacttctaagtttggtactgtgaggcaagtacttaaaattttcatgctggttacttaaaaggcatttagagatttcaagaatgattttgtatacgatgttttaaattttgactgatctcatagtcttcatagaattgcagtagtcttcattgtatgaaatcccgaaagtccatgagttgatcttaaagaccactaacagactggctatcagatcccttttcactttggctatttttttcattttttgagatggagtcttgctgtgtcactgaggctggagtgcagtggcgcgatcttgactcactgcaacctctgcctcccaggatcaagtgattctcctgcctcagcctcctgagtagctggtattacagatgcttgccaccacgcctggctaatttttgtatttttagtagagacagggttttgccatgttgatcaggctggtcttgaactcctgacctcatgatctgcccttggcctcccaaagtgtcggaattacaggcatgagccactgcgcctggcccactttagctatttttaaaaataggacctattgttttggattactatctgagaatttcatggattcactcctgggtataggagataagaatacgtttaattcataacttttatattaaccaatatagtaaaaaaataaagctcacacatacaaaaactaagttgcctttccttgaatgaaccctgtctgaataaaacaatga

SEQ ID NO: 277817 - DNA, 1901 bp, Homo sapiens
  misc_feature (740)..(740): n is a, c, g, or t
cctaagtgggcaactctctggcatccttaatattcttctatagaaattgtgatgaaagaacagataagcctaagtaaatctagcgtgtggagctcctttaaaatgtgaagaccttgccaactggttaaaaataaaacttggttttgtcctaaatatccttgctgggcctattatacataaaaaaaggggccacagcccatttgcaaggcttctgaatgaactccattcattctgtacttggaaatgtctcttcagccacaaaaagaaacaatagttataacctaatttctttggtgccaatatcagcagaagaagagccaagagaccattatgaaaactctagtaagttctcttggtgattatataatgctgtattcattgatcatatttctgtatttaaataagtacattttttaaaacatcataaagtggatcagtaatgctgtaatatcacatttcatgtattatacaacatttttgaaatggagtactccaaagtaatttgcttcttatggttaccaaagtttaaagaataccctaacatgcactccaagattttaagaggaaaggctttgtgtttttcattactgtattatgaaatctgagagtgcaaaactagttttcttaggtaaaccccgtaatcagtttccacatttacctgtaaaagtcagtggagggcatacatctggaagtagtagtggcggtacacaatgtgtgttaatatgatttccaaggggtanctagagtaaactttcttaatcacagatctgatctgagcatgccactcctttcttaaaatcttttgttgattttccatttccctaaaaggaaggcccactggagcatgggccttgcaaagtcctctttctggcttctgcctgcctgccttttcagcttcatctctgccatcttccctgaatgaacttttgtcagtggcctcgctctttctacctatgagatgttgtttctgcatgttcttgcatggaattctcttcctcccaaccctgtttcattcctttaatctgtacaactctttcttatcctgaagtctttatgttaaggttgccttttcaggaagacttttaattgtattagctaattaattaattaatagtctgaggtatttggagctgagattctatggggattagttgctggagggtagtttagagccagattgcgaaggactttctaaactgtgctttcaaggttttgaacaggaaaatgatgtagactttctgttttttgtaagtttggaggatggcttgtgtcttaaaagaatatgtaacataaccatctaatttgtgagtagtggactaaggaaacaccactctaacctttttctctctgcgataatcccatcttcagcctctcaagcactgtgaaaaatcactttctcttgttgtattcttggagcccctgctaattcattattgaaaaatacctgctgcctgcatttggccttatgttgtcatttacttggtacttcctaagcgtggctactccaatgaagctttagtatatgtactgaaagaagatcctctcatactgccacagccaagagataaggttgtaaatctttattgggagaagccgtcaaggacagttctgtgaaatgaaaggatctctggatcaccacaaagtctggctcagtgactatggctttgcaaacactaaacattcctgtctcaagtcctgtagatggcttgaaatagtatacataagcatgccttataaacatcttcagtctttatcaactctttggagattcagccattcttttttgtactttagggaattaaatcattttataatgtataaatctgagcatggccgatggcagaagaaattttgtcatacgtttttaaagaaataaaaatgtattatgttttaaaaatcat

SEQ ID NO: 277818 - DNA, 557 bp, Homo sapiens
ttgtgtttaaaaaaaattagttacatgaagtagtcatccacatgacataagagacctaattttaataggaaataatattaaaaatgtaactcctagaaaatgttagtgatcatcatcttcctttattttttttcctaggtacttcctaagcgtggctactccaatgaagctttagtatatgtactgaaagaagatcctctcatactgccacagccaagagataaggttgtaaatctttattgggagaagccgtcaaggacagttctgtgaaatgaaaggatctctggatcaccacaaagtctggctcagtgactatggctttgcaaacactaaacattcctgtctcaagtcctgtagatggcttgaaatagtatacataagcatgccttataaacatcttcagtctttatcaactctttggagattcagccattcttttttgtactttagggaattaaatcattttataatgtataaatctgagcatggccgatggcagaagaaattttgtcatacgtttttaaagaaataaaaatgtattatgttttaaaaatcat

SEQ ID NO: 277819 - DNA, 609 bp, Homo sapiens
gggctactgggctgcggagaccagagcccggctccactgaagaaacccgccggctgctggggcagggcggcgaaaggtcagtcggccgagaggagtccgtggagccaccgtttcatagcctcagggaaaggatcgggcgtgctcacgagccctctaacccatggcttaaacacccgcttcctaagcctgggtacttcctaagcgtggctactccaatgaagctttagtatatgtactgaaagaagatcctctcatactgccacagccaagagataaggttgtaaatctttattgggagaagccgtcaaggacagttctgtgaaatgaaaggatctctggatcaccacaaagtctggctcagtgactatggctttgcaaacactaaacattcctgtctcaagtcctgtagatggcttgaaatagtatacataagcatgccttataaacatcttcagtctttatcaactctttggagattcagccattcttttttgtactttagggaattaaatcattttataatgtataaatctgagcatggccgatggcagaagaaattttgtcatacgtttttaaagaaataaaaatgtattatgttttaaaaatcat

SEQ ID NO: 277820 - DNA, 1005 bp, Homo sapiens
gatgaaaaaataaacattcagaggtgaagtcacccaagaaccctcacctattcctgaatatatcacatgtggtgataaacatgaagatgtatgaaaaattgtgttcgttgagagaaaatggaaggcttttcattctacttccacattttcattccagcagcttttctgttttggaagatgagtactgaatcttgcaatgaaatttttttaacttaaacaagacaaggaaaatgaagcgcagagacgttaaataactctctcaaggtcatgcagctgagaagagatgagacttgaactccagtgccagccctgttaatcactattctatggaatgatagggtatgcataaatgttcatgtgggctctggagtataccaggaactgaagtaaggtacatggacgtcttgaatattgtaactgagatgggcaagcctacacctttgcaaataaaggaggattgggaaagattaagcctctcaagcactgtgaaaaatcactttctcttgttgtattcttggagcccctgctaattcattattgaaaaatacctgctgcctgcatttggccttatgttgtcatttacttggtacttcctaagcgtggctactccaatgaagctttagtatatgtactgaaagaagatcctctcatactgccacagccaagagataaggttgtaaatctttattgggagaagccgtcaaggacagttctgtgaaatgaaaggatctctggatcaccacaaagtctggctcagtgactatggctttgcaaacactaaacattcctgtctcaagtcctgtagatggcttgaaatagtatacataagcatgccttataaacatcttcagtctttatcaactctttggagattcagccattcttttttgtactttagggaattaaatcattttataatgtataaatctgagcatggccgatggcagaagaaattttgtcatacgtttttaaagaaataaaaatgtattatgttttaaaaatcat

SEQ ID NO: 277821 - DNA, 1847 bp, Homo sapiens
  misc_feature (686)..(686): n is a, c, g, or t
cctaagtgggcaactctctggcatccttaatattcttctatagaaattgtgatgaaagaacagataagcctaagtaaatctagcgtgtggagctcctttaaaatgtgaagaccttgccaactggttaaaaataaaacttggttttgtcctaaatatccttgctgggcctattatacataaaaaaaggggccacagcccatttgcaaggcttctgaatgaactccattcattctgtacttggaaatgtctcttcagccacaaaaagaaacaatagttataacctaatttctttggtgccaatatcagcagaagaagagccaagagaccattatgaaaactctagtaagttctcttggtgattatataatgctgtattcattgatcatatttctgtatttaaataagtacattttttaaacatttttgaaatggagtactccaaagtaatttgcttcttatggttaccaaagtttaaagaataccctaacatgcactccaagattttaagaggaaaggctttgtgtttttcattactgtattatgaaatctgagagtgcaaaactagttttcttaggtaaaccccgtaatcagtttccacatttacctgtaaaagtcagtggagggcatacatctggaagtagtagtggcggtacacaatgtgtgttaatatgatttccaaggggtanctagagtaaactttcttaatcacagatctgatctgagcatgccactcctttcttaaaatcttttgttgattttccatttccctaaaaggaaggcccactggagcatgggccttgcaaagtcctctttctggcttctgcctgcctgccttttcagcttcatctctgccatcttccctgaatgaacttttgtcagtggcctcgctctttctacctatgagatgttgtttctgcatgttcttgcatggaattctcttcctcccaaccctgtttcattcctttaatctgtacaactctttcttatcctgaagtctttatgttaaggttgccttttcaggaagacttttaattgtattagctaattaattaattaatagtctgaggtatttggagctgagattctatggggattagttgctggagggtagtttagagccagattgcgaaggactttctaaactgtgctttcaaggttttgaacaggaaaatgatgtagactttctgttttttgtaagtttggaggatggcttgtgtcttaaaagaatatgtaacataaccatctaatttgtgagtagtggactaaggaaacaccactctaacctttttctctctgcgataatcccatcttcagcctctcaagcactgtgaaaaatcactttctcttgttgtattcttggagcccctgctaattcattattgaaaaatacctgctgcctgcatttggccttatgttgtcatttacttggtacttcctaagcgtggctactccaatgaagctttagtatatgtactgaaagaagatcctctcatactgccacagccaagagataaggttgtaaatctttattgggagaagccgtcaaggacagttctgtgaaatgaaaggatctctggatcaccacaaagtctggctcagtgactatggctttgcaaacactaaacattcctgtctcaagtcctgtagatggcttgaaatagtatacataagcatgccttataaacatcttcagtctttatcaactctttggagattcagccattcttttttgtactttagggaattaaatcattttataatgtataaatctgagcatggccgatggcagaagaaattttgtcatacgtttttaaagaaataaaaatgtattatgttttaaaaatcat

SEQ ID NO: 277822 - DNA, 1362 bp, Homo sapiens
gggctactgggctgcggagaccagagcccggctccactgaagaaacccgccggctgctggggcagggcggcgaaaggtcagtcggccgagaggagtccgtggagccaccgtttcatagcctcagggaaaggatcgggcgtgctcacgagccctctaacccatggcttaaacacccgcttcctaagcctggttcctgaatatatcacatgtggtgataaacatgaagatgtatgaaaaattgtgttcgttgagagaaaatggaaggcttttcattctacttccacattttcattccagcagcttttctgttttggaagatgagtactgaatcttgcaatgaaatttttttaacttaaacaaggttcttatgcctttgtttgaaaaacatggttccctgtgaaattttacatgtagaagaaagcttcacactacgagagctctcaggatataattatttcagacagatactgggaacataagatggcttatcaatctaagatggccttcctgtccttcggattgaactgaaaccatccctgattccagggataggtagatgatccaggtttggacaatcaaaatattgaaccaccctggacctacaagtgtttctgggatgggaacatgcaaacgttggtccaaattgttgttctaggcagcccagtacatttctccaatgcctgatggaatgatagggtatgcataaatgttcatgtgggctctggagtataccaggaactgaagtaaggtacatggacgtcttgaatattgtaactgagatgggcaagcctacacctttgcaaataaaggaggattgggaaagattaagcctctcaagcactgtgaaaaatcactttctcttgttgtattcttggagcccctgctaattcattattgaaaaatacctgctgcctgcatttggccttatgttgtcatttacttggtacttcctaagcgtggctactccaatgaagctttagtatatgtactgaaagaagatcctctcatactgccacagccaagagataaggttgtaaatctttattgggagaagccgtcaaggacagttctgtgaaatgaaaggatctctggatcaccacaaagtctggctcagtgactatggctttgcaaacactaaacattcctgtctcaagtcctgtagatggcttgaaatagtatacataagcatgccttataaacatcttcagtctttatcaactctttggagattcagccattcttttttgtactttagggaattaaatcattttataatgtataaatctgagcatggccgatggcagaagaaattttgtcatacgtttttaaagaaataaaaatgtattatgttttaaaaatcat

SEQ ID NO: 277823 - DNA, 1211 bp, Homo sapiens
  misc_feature (24)..(24): n is a, c, g, or t
gcctagcggcactgactctcttanctaccagcgctaacgttcctgaatatatcacatgtggtgataaacatgaagatgtatgaaaaattgtgttcgttgagagaaaatggaaggcttttcattctacttccacattttcattccagcagcttttctgttttggaagatgagtactgaatcttgcaatgaaatttttttaacttaaacaaggttcttatgcctttgtttgaaaaacatggttccctgtgaaattttacatgtagaagaaagcttcacactacgagagctctcaggatataattatttcagacagatactgggaacataagatggcttatcaatctaagatggccttcctgtccttcggattgaactgaaaccatccctgattccagggataggtagatgatccaggtttggacaatcaaaatattgaaccaccctggacctacaagtgtttctgggatgggaacatgcaaacgttggtccaaattgttgttctaggcagcccagtacatttctccaatgcctgatggaatgatagggtatgcataaatgttcatgtgggctctggagtataccaggaactgaagtaaggtacatggacgtcttgaatattgtaactgagatgggcaagcctacacctttgcaaataaaggaggattgggaaagattaagcctctcaagcactgtgaaaaatcactttctcttgttgtattcttggagcccctgctaattcattattgaaaaatacctgctgcctgcatttggccttatgttgtcatttacttggtacttcctaagcgtggctactccaatgaagctttagtatatgtactgaaagaagatcctctcatactgccacagccaagagataaggttgtaaatctttattgggagaagccgtcaaggacagttctgtgaaatgaaaggatctctggatcaccacaaagtctggctcagtgactatggctttgcaaacactaaacattcctgtctcaagtcctgtagatggcttgaaatagtatacataagcatgccttataaacatcttcagtctttatcaactctttggagattcagccattcttttttgtactttagggaattaaatcattttataatgtataaatctgagcatggccgatggcagaagaaattttgtcatacgtttttaaagaaataaaaatgtattatgttttaaaaatcat

SEQ ID NO: 277824 - DNA, 1191 bp, Homo sapiens
gggctactgggctgcggagaccagagcccggctccactgaagaaacccgccggctgctggggcagggcggcgaaaggtcagtcggccgagaggagtccgtggagccaccgtttcatagcctcagggaaaggatcgggcgtgctcacgagccctctaacccatggcttaaacacccgcttcctaagcctgggttcttatgcctttgtttgaaaaacatggttccctgtgaaattttacatgtagaagaaagcttcacactacgagagctctcaggatataattatttcagacagatactgggaacataagatggcttatcaatctaagatggccttcctgtccttcggattgaactgaaaccatccctgattccagggataggtagatgatccaggtttggacaatcaaaatattgaaccaccctggacctacaagtgtttctgggatgggaacatgcaaacgttggtccaaattgttgttctaggcagcccagtacatttctccaatgcctgatggaatgatagggtatgcataaatgttcatgtgggctctggagtataccaggaactgaagtaaggtacatggacgtcttgaatattgtaactgagatgggcaagcctacacctttgcaaataaaggaggattgggaaagattaagcctctcaagcactgtgaaaaatcactttctcttgttgtattcttggagcccctgctaattcattattgaaaaatacctgctgcctgcatttggccttatgttgtcatttacttggtacttcctaagcgtggctactccaatgaagctttagtatatgtactgaaagaagatcctctcatactgccacagccaagagataaggttgtaaatctttattgggagaagccgtcaaggacagttctgtgaaatgaaaggatctctggatcaccacaaagtctggctcagtgactatggctttgcaaacactaaacattcctgtctcaagtcctgtagatggcttgaaatagtatacataagcatgccttataaacatcttcagtctttatcaactctttggagattcagccattcttttttgtactttagggaattaaatcattttataatgtataaatctgagcatggccgatggcagaagaaattttgtcatacgtttttaaagaaataaaaatgtattatgttttaaaaatcat

SEQ ID NO: 277825 - DNA, 1316 bp, Homo sapiens
  misc_feature (24)..(24): n is a, c, g, or t
gcctagcggcactgactctcttanctaccagcgctaacgttcctgaatatatcacatgtggtgataaacatgaagatgtatgaaaaattgtgttcgttgagagaaaatggaaggcttttcattctacttccacattttcattccagcagcttttctgttttggaagatgagtactgaatcttgcaatgaaatttttttaacttaaacaagacaaggaaaatgaagcgcagagacgttaaataactctctcaaggtcatgcagctgagaagagatgagacttgaactccagtgccagccctgttaatcactattctgttcttatgcctttgtttgaaaaacatggttccctgtgaaattttacatgtagaagaaagcttcacactacgagagctctcaggatataattatttcagacagatactgggaacataagatggcttatcaatctaagatggccttcctgtccttcggattgaactgaaaccatccctgattccagggataggtagatgatccaggtttggacaatcaaaatattgaaccaccctggacctacaagtgtttctgggatgggaacatgcaaacgttggtccaaattgttgttctaggcagcccagtacatttctccaatgcctgatggaatgatagggtatgcataaatgttcatgtgggctctggagtataccaggaactgaagtaaggtacatggacgtcttgaatattgtaactgagatgggcaagcctacacctttgcaaataaaggaggattgggaaagattaagcctctcaagcactgtgaaaaatcactttctcttgttgtattcttggagcccctgctaattcattattgaaaaatacctgctgcctgcatttggccttatgttgtcatttacttggtacttcctaagcgtggctactccaatgaagctttagtatatgtactgaaagaagatcctctcatactgccacagccaagagataaggttgtaaatctttattgggagaagccgtcaaggacagttctgtgaaatgaaaggatctctggatcaccacaaagtctggctcagtgactatggctttgcaaacactaaacattcctgtctcaagtcctgtagatggcttgaaatagtatacataagcatgccttataaacatcttcagtctttatcaactctttggagattcagccattcttttttgtactttagggaattaaatcattttataatgtataaatctgagcatggccgatggcagaagaaattttgtcatacgtttttaaagaaataaaaatgtattatgttttaaaaatcat

SEQ ID NO: 277826 - DNA, 1215 bp, Homo sapiens
agcagaaacacctaataagagtaaaggcaaagagttcctgaatatatcacatgtggtgataaacatgaagatgtatgaaaaattgtgttcgttgagagaaaatggaaggcttttcattctacttccacattttcattccagcagcttttctgttttggaagatgagtactgaatcttgcaatgaaatttttttaacttaaacaagacaaggaaaatgaagcgcagagacgttaaataactctctcaaggtcatgcagctgagaagagatgagacttgaactccagtgccagccctgttaatcactattctatggaatgatagggtatgcataaatgttcatgtgggctctggagtataccaggaactgaagtaaggtacatggacgtcttgaatattgtaactgagatgggcaagcctacacctttgcaaataaaggaggattgggaaagattaagatcctgttaaacgtcagtgttactatttagcctttgatatctccagtaaaggcaacttctttctggacccagaaataaagctttacattagcagcttccataacaccaataacatgaatgaccatctactgagcaattgcagtgcaccaggattatggcttatgagcactttatgtttattatctcacaactcactgagttagatactctccacaaacccagtgagcctctcaagcactgtgaaaaatcactttctcttgttgtattcttggagcccctgctaattcattattgaaaaatacctgctgcctgcatttggccttatgttgtcatttacttggtacttcctaagcgtggctactccaatgaagctttagtatatgtactgaaagaagatcctctcatactgccacagccaagagataaggttgtaaatctttattgggagaagccgtcaaggacagttctgtgaaatgaaaggatctctggatcaccacaaagtctggctcagtgactatggctttgcaaacactaaacattcctgtctcaagtcctgtagatggcttgaaatagtatacataagcatgccttataaacatcttcagtctttatcaactctttggagattcagccattcttttttgtactttagggaattaaatcattttataatgtataaatctgagcatggccgatggcagaagaaattttgtcatacgtttttaaagaaataaaaatgtattatgttttaaaaatcat

SEQ ID NO: 277827 - DNA, 1266 bp, Homo sapiens
gggctactgggctgcggagaccagagcccggctccactgaagaaacccgccggctgctggggcagggcggcgaaaggtcagtcggccgagaggagtccgtggagccaccgtttcatagcctcagggaaaggatcgggcgtgctcacgagccctctaacccatggcttaaacacccgcttcctaagcctggttcctgaatatatcacatgtggtgataaacatgaagatgtatgaaaaattgtgttcgttgagagaaaatggaaggcttttcattctacttccacattttcattccagcagcttttctgttttggaagatgagtactgaatcttgcaatgaaatttttttaacttaaacaagatggaatgatagggtatgcataaatgttcatgtgggctctggagtataccaggaactgaagtaaggtacatggacgtcttgaatattgtaactgagatgggcaagcctacacctttgcaaataaaggaggattgggaaagattaagatcctgttaaacgtcagtgttactatttagcctttgatatctccagtaaaggcaacttctttctggacccagaaataaagctttacattagcagcttccataacaccaataacatgaatgaccatctactgagcaattgcagtgcaccaggattatggcttatgagcactttatgtttattatctcacaactcactgagttagatactctccacaaacccagtgagcctctcaagcactgtgaaaaatcactttctcttgttgtattcttggagcccctgctaattcattattgaaaaatacctgctgcctgcatttggccttatgttgtcatttacttggtacttcctaagcgtggctactccaatgaagctttagtatatgtactgaaagaagatcctctcatactgccacagccaagagataaggttgtaaatctttattgggagaagccgtcaaggacagttctgtgaaatgaaaggatctctggatcaccacaaagtctggctcagtgactatggctttgcaaacactaaacattcctgtctcaagtcctgtagatggcttgaaatagtatacataagcatgccttataaacatcttcagtctttatcaactctttggagattcagccattcttttttgtactttagggaattaaatcattttataatgtataaatctgagcatggccgatggcagaagaaattttgtcatacgtttttaaagaaataaaaatgtattatgttttaaaaatcat

SEQ ID NO: 277828 - DNA, 985 bp, Homo sapiens
gatgaaaaaataaacattcagaggtgaagtcacccaagaaccctcacctattcctgaatatatcacatgtggtgataaacatgaagatgtatgaaaaattgtgttcgttgagagaaaatggaaggcttttcattctacttccacattttcattccagcagcttttctgttttggaagatgagtactgaatcttgcaatgaaatttttttaacttaaacaagacaaggaaaatgaagcgcagagacgttaaataactctctcaaggtcatgcagctgagaagagatgagacttgaactccagtgccagccctgttaatcactattctatggaatgatagggtatgcataaatgttcatgtgggctctggagtataccaggaactgaagtaaggtacatggacgtcttgaatattgtaactgagatgggcaagcctacacctttgcaaataaaggaggattgggaaagattaagcctctcaagcactgtgaaaaatcactttctcttgttgtattcttggagcccctgctaattcattattgaaaaatacctgctgcctgcatttggccttatgttgtcatttacttggtacttcctaagcgtggctactccaatgaagctttagtatatgtactgaaagaagatcctctcatactgccacagccaagagataaggttgtaaatctttattgggagaagccgtcaaggacagttctgtgaaatgaaaggatctctggatcaccacaaagtctggctcagtgactatggctttgcaaacactaaacattcctgtctcaagtcctgtagatggcttgaaatagtatacataagcatgccttataaacatcttcagtctttatcaactctttggagattcagccattcttttttgtactttagggaattaaatcattttataatgtaaaacatgatccgcccgcaaatcgtacacgccttgaccgatccggcccgcttggccaaccaaca

SEQ ID NO: 277829 - DNA, 977 bp, Homo sapiens
gatgaaaaaataaacattcagaggtgaagtcacccaagaaccctcacctattcctgaatatatcacatgtggtgataaacatgaagatgtatgaaaaattgtgttcgttgagagaaaatggaaggcttttcattctacttccacattttcattccagcagcttttctgttttggaagatgagtactgaatcttgcaatgaaatttttttaacttaaacaagacaaggaaaatgaagcgcagagacgttaaataactctctcaaggtcatgcagctgagaagagatgagacttgaactccagtgccagccctgttaatcactattctatggaatgatagggtatgcataaatgttcatgtgggctctggagtataccaggaactgaagtaaggtacatggacgtcttgaatattgtaactgagatgggcaagcctacacctttgcaaataaaggaggattgggaaagattaagcctctcaagcactgtgaaaaatcactttctcttgttgtattcttggagcccctgctaattcattattgaaaaatacctgctgcctgcatttggccttatgttgtcatttacttggtacttcctaagcgtggctactccaatgaagctttagtatatgtactgaaagaagatcctctcatactgccacagccaagagataaggttgtaaatctttattgggagaagccgtcaaggacagttctgtgaaatgaaaggatctctggatcaccacaaagtctggctcagtgactatggctttgcaaacactaaacattcctgtctcaagtcctgtagatggcttgaaatagtatacataagcatgccttataaacatcttcagtctttatcaactctttggagattcagccattcttttttgtactttagggaattaaatcattttataatgtaccgtgatgcggccggcgccttttccgaaatagacagactttatttggaaatctta

SEQ ID NO: 277830 - DNA, 1371 bp, Homo sapiens
gggctactgggctgcggagaccagagcccggctccactgaagaaacccgccggctgctggggcagggcggcgaaaggtcagtcggccgagaggagtccgtggagccaccgtttcatagcctcagggaaaggatcgggcgtgctcacgagccctctaacccatggcttaaacacccgcttcctaagcctggttcctgaatatatcacatgtggtgataaacatgaagatgtatgaaaaattgtgttcgttgagagaaaatggaaggcttttcattctacttccacattttcattccagcagcttttctgttttggaagatgagtactgaatcttgcaatgaaatttttttaacttaaacaagacaaggaaaatgaagcgcagagacgttaaataactctctcaaggtcatgcagctgagaagagatgagacttgaactccagtgccagccctgttaatcactattctatggaatgatagggtatgcataaatgttcatgtgggctctggagtataccaggaactgaagtaaggtacatggacgtcttgaatattgtaactgagatgggcaagcctacacctttgcaaataaaggaggattgggaaagattaagatcctgttaaacgtcagtgttactatttagcctttgatatctccagtaaaggcaacttctttctggacccagaaataaagctttacattagcagcttccataacaccaataacatgaatgaccatctactgagcaattgcagtgcaccaggattatggcttatgagcactttatgtttattatctcacaactcactgagttagatactctccacaaacccagtgagcctctcaagcactgtgaaaaatcactttctcttgttgtattcttggagcccctgctaattcattattgaaaaatacctgctgcctgcatttggccttatgttgtcatttacttggtacttcctaagcgtggctactccaatgaagctttagtatatgtactgaaagaagatcctctcatactgccacagccaagagataaggttgtaaatctttattgggagaagccgtcaaggacagttctgtgaaatgaaaggatctctggatcaccacaaagtctggctcagtgactatggctttgcaaacactaaacattcctgtctcaagtcctgtagatggcttgaaatagtatacataagcatgccttataaacatcttcagtctttatcaactctttggagattcagccattcttttttgtactttagggaattaaatcattttataatgtataaatctgagcatggccgatggcagaagaaattttgtcatacgtttttaaagaaataaaaatgtattatgttttaaaaatcat

SEQ ID NO: 277831 - DNA, 1468 bp, Homo sapiens
gggctactgggctgcggagaccagagcccggctccactgaagaaacccgccggctgctggggcagggcggcgaaaggtcagtcggccgagaggagtccgtggagccaccgtttcatagcctcagggaaaggatcgggcgtgctcacgagccctctaacccatggcttaaacacccgcttcctaagcctggttcctgaatatatcacatgtggtgataaacatgaagatgtatgaaaaattgtgttcgttgagagaaaatggaaggcttttcattctacttccacattttcattccagcagcttttctgttttggaagatgagtactgaatcttgcaatgaaatttttttaacttaaacaaggttcttatgcctttgtttgaaaaacatggttccctgtgaaattttacatgtagaagaaagcttcacactacgagagctctcaggatataattatttcagacagatactgggaacataagatggcttatcaatctaagatggccttcctgtccttcggattgaactgaaaccatccctgattccagggataggtagatgatccaggtttggacaatcaaaatattgaaccaccctggacctacaagtgtttctgggatgggaacatgcaaacgttggtccaaattgttgttctaggcagcccagtacatttctccaatgcctgatggaatgatagggtatgcataaatgttcatgtgggctctggagtataccaggaactgaagtaaggtacatggacgtcttgaatattgtaactgagatgggcaagcctacacctttgcaaataaaggaggattgggaaagattaagcctctcaagcactgtgaaaaatcactttctcttgttgtattcttggagcccctgctaattcattattgaaaaatacctgctgcctgcatttggccttatgttgtcatttacttgggtctgtgcatggcgtttagaaggctacaccttaggctgggggtcaagaatgtcttccctgatgtgaggtttacacagagatctgaagaatgaagagtccagctaagtacttcctaagcgtggctactccaatgaagctttagtatatgtactgaaagaagatcctctcatactgccacagccaagagataaggttgtaaatctttattgggagaagccgtcaaggacagttctgtgaaatgaaaggatctctggatcaccacaaagtctggctcagtgactatggctttgcaaacactaaacattcctgtctcaagtcctgtagatggcttgaaatagtatacataagcatgccttataaacatcttcagtctttatcaactctttggagattcagccattcttttttgtactttagggaattaaatcattttataatgtataaatctgagcatggccgatggcagaagaaattttgtcatacgtttttaaagaaataaaaatgtattatgttttaaaaatcat

SEQ ID NO: 277832 - DNA, 1251 bp, Homo sapiens
gggctactgggctgcggagaccagagcccggctccactgaagaaacccgccggctgctggggcagggcggcgaaaggtcagtcggccgagaggagtccgtggagccaccgtttcatagcctcagggaaaggatcgggcgtgctcacgagccctctaacccatggcttaaacacccgcttcctaagcctggttcctgaatatatcacatgtggtgataaacatgaagatgtatgaaaaattgtgttcgttgagagaaaatggaaggcttttcattctacttccacattttcattccagcagcttttctgttttggaagatgagtactgaatcttgcaatgaaatttttttaacttaaacaagacaaggaaaatgaagcgcagagacgttaaataactctctcaaggtcatgcagctgagaagagatgagacttgaactccagtgccagccctgttaatcactattctatggaatgatagggtatgcataaatgttcatgtgggctctggagtataccaggaactgaagtaaggtacatggacgtcttgaatattgtaactgagatgggcaagcctacacctttgcaaataaaggaggattgggaaagattaagcctctcaagcactgtgaaaaatcactttctcttgttgtattcttggagcccctgctaattcattattgaaaaatacctgctgcctgcatttggccttatgttgtcatttacttgggtctgtgcatggcgtttagaaggctacaccttaggctgggggtcaagaatgtcttccctgatgtgaggtttacacagagatctgaagaatgaagagtccagctaagtacttcctaagcgtggctactccaatgaagctttagtatatgtactgaaagaagatcctctcatactgccacagccaagagataaggttgtaaatctttattgggagaagccgtcaaggacagttctgtgaaatgaaaggatctctggatcaccacaaagtctggctcagtgactatggctttgcaaacactaaacattcctgtctcaagtcctgtagatggcttgaaatagtatacataagcatgccttataaacatcttcagtctttatcaactctttggagattcagccattcttttttgtactttagggaattaaatcattttataatgtataaatctgagcatggccgatggcagaagaaattttgtcatacgtttttaaagaaataaaaatgtattatgttttaaaaatcat

SEQ ID NO: 277833 - DNA, 1028 bp, Homo sapiens
gtgtagaagtccgaccgcggaaccaggactgctgtccagtcggcgagcgcgtaccattcagcatcggctccgccgagtcccaccttcctcaggctctgattggctgacacatggcaagcgcgaaaagcctggaccgctggaaacccggctgcttgagggcggaagtactgcgttgacgtacgccttagtaagggcggaagtgagttttccagcgaagtggctcctgtaaggcagcaaggtagcgtggccggcgcccgagctggggttgtgtccctgctgggctgccgttccagctggactgccgccatggaactcagcgccgaatacctccgcgagaagctgcagcgggacctggaggcggagcatgtcttggatcctagcatgactatacattgtgacatggtcattacatatggattagaccaactggagaattgccagacttgtggtaccaattatatcatctcagtcttgaatttactcacgctgattgttgaacagataaatacgaaactgccatcatcatttgtagaaaaactgtttataccatcatctaaactactattcttgcgttatcataaagaaaaagaggttgttgctgtagcccatgctgtttatcaagcaatgctcagcttgaagaatattcctgttttggagactgcctataagttaatattgggagaaatgacttgtgccctaaacaacctcctgcacagtctgcaacttcctgaggcctgttctgaaataaaacatgaggcttttaagaatcatgtgttcaatgtagacaatgcaaaatttgtagttaaatttgacctcagtgccctgactacaattggaaatgccaaaaactcgagtctttaattgtaatgactttgttttatccacagttaagccttttctcattacatatttatgtatttcactgtcatgtcaacatgtctgcagaatcactgtatgtaacaaacagccatatttaagacatgcctggataaataaaattggtaggaatgttttcttgccattatatt

SEQ ID NO: 277834 - DNA, 1271 bp, Homo sapiens
atgggtagactaaataaaatcctgtatgtattggttgttaaatattatagaaatatttttaaacatttgctctgttttctcccccattttattagaaatttagtacacaattattggccattatagttaagtgggggattttgtttgtgtgtgtattggaaataatatgatttttgaagatattatgtggtaagcatgagagtgcttatctttcaaaagagaccatcagtagatagaaactttaataagcttaaagtgacttgtatgttcagttttgaaagattgattcccaaaagcccaagagctagcttgtagtatgtgtgggcaggctattccccatgctgtcaataccattactgtcgtggtgtatttcatgataaagattctgagcttcagccatttagtgacattgggagaaacgaagttgggtatatgggaaatagaggatggcaggttccatttcctgtcatagtagcactttaggattttttagccaagatcatgtttacatattgtagtaaagggatcattattattcagctactgagaactagaatattaagagactgctggcaaggcaagcagttaattttcagttgaaattgcattaaataaaaagtattttcttgctttgtggaagcacgtgaatttttgtaaaaagctgcttgttttccccatttacaaggttctgtacagagtaatgagatgtgtgacggctgcaaaccaggtgtttttttctgaggctgtgttgacagctgctaatgagtgtgttggtgttttgctcggcagcttggatcctagcatgactatacattgtgacatggtcattacatatggattagaccaactggagaattgccagacttgtggtaccaattatatcatctcagtcttgaatttactcacgctggtatgtgaattattcttttcctttttaatgtgttggtttattcaggcccttaaatcgatatgtaagaaattaaggactttgtctgggtatggtggctcatgcttgtaatcccagcactttgggaggccaaagcagaaggattgcttgcatccaggaattctggcacagcttgggcaatgtagtgagaccccatctgtacaaaaagtcaaaaattagcttggtgtagtggtgtgcacctgcagtcctagctactcgggaggctgagggaggaagatcgattaagcccaggaacttgaggttgaagtgagctctgattgtgccactgcactcagccaaggtgacaaaaaaggccctgtctcca

SEQ ID NO: 277835 - DNA, 1157 bp, Homo sapiens
aaaaaatgcccatgataactgtaaaatacgtgtgtcctatttaggtgtctaaacactttaatgtcacagtattaaggccttaaaatatagcttagatatatttttctaaattaaaagactttattttttagatatacagaaaattgagcagaaaacaatgagttcccatataccttcttcatcccaacagtttccccctcattaacatattgtgttagtgtggtacatttattacaaaggagtgaatattgatatattattattaactaattttatagtttactttgtgttatgtattctatggactttaacatgtgtaatgacatgtatcccctattaccagtatcatacaggatagtttcacttccctaaaaatctttgatgttctacccactccttcctcgttccctctcctcactcctccctccctccatcttaagcccatggcaacccctgatctttttactgtctccatcgttttgccttttccagaatgccatgtagttggagtcatatagtatgtagccttttcaattggcttctttcacttaccagtgtgcatttaaggtttctccatgtctttttgtaatttgagaagctcattttttaaaaattttattcttttagattgttgaacagataaatacgaaactgccatcatcatttgtagaaaaactgtttataccatcatctaaactactattcttgcgttatcataaagaaaaagaggtaagtaatatactgataatgaattttgacaacttgagtcactgaagagttggacctaatgttgcttaccaggctatataagtgaaattgagtgaaatgtgaaatgtttgatttagaatatagtgattgtatttgttcttttaaatttatatttcttgataatcatactgaatactttcatgaatgatgtgccagatactcttttcagattatgcatctcttgctgttattaaatttattaaattttcataagggtaaaacaagttgacacatttataaagttataaattaagtactgtatattttataaacaaaaatgactggcttttcaaccaccccctagtcaaatccaccacagactttcctggtagatttaagaaacccagtcttaaactgctgtttgcatatgtcttttgatgttgattatt

SEQ ID NO: 277836 - DNA, 355 bp, Homo sapiens
tggtggtgcacacctgtaatcctagctactttggaggctgaggtaggagaattgcttgaacccaggaagtggaggttgcagtgagctgagatcacaccaccgcactccagcctgggctacagaaccagactctgtctcaaaagaaaaaaaaaaaaaagaaagaaacaaagaaagaaagtaatggatgtaattagggaataaagtttttaggaggaaaaaggtaaaatttgatgtttgcgcttcagtgtgctccatgttgtttgattggattgccttgtataattccatagctgcttcgcttattaccagttacagcttatgtttgaagtcacaataaactcttcttcaaacatga

SEQ ID NO: 277837 - DNA, 694 bp, Homo sapiens
aaaaaatgcccatgataactgtaaaatacgtgtgtcctatttaggtgtctaaacactttaatgtcacagtattaaggccttaaaatatagcttagatatatttttctaaattaaaagactttattttttagatatacagaaaattgagcagaaaacaatgagttcccatataccttcttcatcccaacagtttccccctcattaacatattgtgttagtgtggtacatttattacaaaggagtgaatattgatatattattattaactaattttatagtttactttgtgttatgtattctatggactttaacatgtgtaatgacatgtatcccctattaccagtatcatacaggatagtttcacttccctaaaaatctttgatgttctacccactccttcctcgttccctctcctcactcctccctccctccatcttaagcccatggcaacccctgatctttttactgtctccatcgttttgccttttccagaatgccatgtagttggagtcatatagtatgtagccttttcaattggcttctttcacttaccagtgtgcatttaaggtttctccatgtctttttgtaatttgagaagctcattttttacagtgttatcgtttacaactgctgtcctatacacatggaaaccgccatcaccatgtgtagggatacatggccaccgttatcacat

SEQ ID NO: 277838 - DNA, 615 bp, Homo sapiens
gtaagatcctgagctatcaggaaattgactgaatgaaacgaacaatcatatttaaataacgtacacattgctgtttgtaggtggctacagtgtcaatggaggatctggggaaaatacttatggtcggaagtcgttggggcaagagctgagggttaacaatgtgaccagccctgagttcaccagtgttcagcatggcagtcgtgctttagccaccaaagacatgaggaaatcacaggagagatcgatgtcttattgtgatgagtctcgactgtcaaatcttcttcggaggatcacccgggaagacgacagagactgaagattggtcactgtaaagcagttgaaagaatttattcagcaaccagaaaataagctggtaagtatagtatgtttggaaatatgaggatttttgtgtttccataataaactaggtaatgctaccttgagtagtttaagaatggggaaagtctgtattatgatgatcaagaacttaatgctctctaatatgtaatttctttttcttcttaaagacaagatcttgctctcacccaggctggagtgcagtggcacaatcatagctcactgcagtctcaaactcctggattcaagctatcctcc

SEQ ID NO: 277839 - DNA, 2126 bp, Homo sapiens
gtgtcggcagcggccggttcgggcggcgactcgcgcttctctgggcggcggcgcttggccatgtcgtgtcggggaaggtaatgagccgcagagccccggggtctcggctgagcagcggcggcaccaactattcgcggagctggaatgactggcaacccagaactgatagtgcatcagctgacccaggtaatttaaaatattcttcatccagagatagaggtggttcttcctcttacggactgcaaccttcaaattcagctgtggtgtctcggcaaaggcacgatgataccagagtccacgctgacatacagaatgacgaaaagggtggctacagtgtcaatggaggatctggggaaaatacttatggtcggaagtcgttggggcaagagctgagggttaacaatgtgaccagccctgagttcaccagtgttcagcatggcagtcgtgctttagccaccaaagacatgaggaaatcacaggagagatcgatgtcttattgtgatgagtctcgactgtcaaatcttcttcggaggatcacccgggaagacgacagagactgaagattggtcactgtaaagcagttgaaagaatttattcagcaaccagaaaataagctggtactagttaaacaattggataatatcttggctgctgtacatgatgtgcttaatgaaagtagcaaattgcttcaggagttgagacaggagggagcttgctgtcttggccttctttgtgcttctctgagctatgaggctgagaagatcttcaagtggagttttagcaaatttagctcatctgcaaaagatgaagttaaactcctctacttatgtgccacctacaaagcactagagactgtaggagaaaagaaagccttttcatctgtaatgcagcttgtaatgaccagcctgcagtcaattcttgaaaatgtggatacaccagaattgctttgcaaatgtgttaagtgcattcttttggtggctcgatgttaccctcatattttcagcgctaattttagggatacagttgatatattagttggatggcatagagatcatactcagaaaccttcgctcacgcagcaggtatctgggtggttgcagagtttggagccattttgggtagctgatcttgcatttcctacgactcttcttggtcagtttctagaagacatggaagcatatgctgaggacctcagccatgtggcctctggggaatcagtggatgaagacgtccctcctccatcagtgtcatcaccaaagctggctgcgcttctccgggtatttagtactgtgctgaggagcattggggaacgcttcagcccaattcgggtcctccaattactgaggcatacgtaacagttaggttctgtacagagtaatgagatgtgtgacggctgcaaaccaggtgtttttttctgaggctgtgttgacagctgctaatgagtgtgttggtgttttgctcggcagcttggatcctagcatgactatacattgtgacatggtcattacatatggattagaccaactggagaattgccagacttgtggtaccaattatatcatctcagtcttgaatttactcacgctgattgttgaacagataaatacgaaactgccatcatcatttgtagaaaaactgtttataccatcatctaaactactattcttgcgttatcataaagaaaaagaggttgttgctgtagcccatgctgtttatcaagcaatgctcagcttgaagaatattcctgttttggagactgcctataagttaatattgggagaaatgacttgtgccctaaacaacctcctgcacagtctgcaacttcctgaggcctgttctgaaataaaacatgaggcttttaagaatcatgtgttcaatgtagacaatgcaaaatttgtagttaaatttgacctcagtgccctgactacaattggaaatgccaaaaactcgagtctttaattgtaatgactttgttttatccacagttaagccttttctcattacatatttatgtatttcactgtcatgtcaacatgtctgcagaatcactgtatgtaacaaacagccatatttaagacatgcctggataaataaaattggtaggaatgttttcttgccattatatt

SEQ ID NO: 277840 - DNA, 1878 bp, Homo sapiens
  misc_feature (1324)..(1324): n is a, c, g, or t
gtgtagaagtccgaccgcggaaccaggactgctgtccagtcggcgagcgcgtaccattcagcatcggctccgccgagtcccaccttcctcaggctctgattggctgacacatggcaagcgcgaaaagcctggaccgctggaaacccggctgcttgagggcggaagtactgcgttgacgtacgccttagtaagggcggaagtgagttttccagcgaagtggctcctgtaaggcagcaaggtagcgtggccggcgcccgagctggggttgtgtccctgctgggctgccgttccagctggactgccgccatggaactcagcgccgaatacctccgcgagaagctgcagcgggacctggaggcggagcatgtggaggtggaggacacgaccctcaaccgttgctcctgtagcttccgagtcctggtggtgtcggccaagttcgaggggaaaccgctgcttcagagacacaggttctgtacagagtaatgagatgtgtgacggctgcaaaccaggtgtttttttctgaggctgtgttgacagctgctaatgagtgtgttggtgttttgctcggcagcttggatcctagcatgactatacattgtgacatggtcattacatatggattagaccaactggagaattgccagacttgtggtaccaattatatcatctcagtcttgaatttactcacgctgattgttgaacagataaatacgaaactgccatcatcatttgtagaaaaactgtttataccatcatctaaactactattcttgcgttatcataaagaaaaagaggttgttgctgtagcccatgctgtttatcaagcaatgctcagcttgaagaatattcctgttttggagactgcctataagttaatattgggagaaatgacttgtgccctaaacaacctcctgcacagtctgcaacttcctgaggcctgttctgaaataaaacatgaggcttttaagaatcatgtgttcaatgtagacaatgcaaaatttgtagttaaatttgacctcagtgccctgactacaattggaaatgccaaaaactcgagtctttaattgtaatgactttgttttatccacagttaagccttttctcattacatatttatgtatttcactgtcatgtcaacatgtctgcagaatcactgtatgtaacaaacagccatatttaagacatgcctggataaataaaattggtaggaatgttttcttgccattatatttaacgtttcttctttttccttgacaaatcttgataagtttttttatattagttttattttctagaaaacgtcttatgaatttctcccatttgntctagcatgcttatagaaaatgtcagtgtttcttacagctcaaatttgtatagttgttttaaaatgcggtctcttcttcttcccctggtacttttttctttctgtctactgaagttagttcttatacatggtcttatattttggctgtctttttttccctaggaacattcatacaggttgaatattccttatctgaaatacttgggactggaagtgtttttgattttggagtttggaatacttttttttttttggagatagtgttttactcttgttgcagtgagctgagatcacaccaccgcactccagcctgggctacagaaccagactctgtctcaaaagaaaaaaaaaaaaaagaaagaaacaaagaaagaaagtaatggatgtaattagggaataaagtttttaggaggaaaaaggtaaaatttgatgtttgcgcttcagtgtgctccatgttgtttgattggattgccttgtataattccatagctgcttcgcttattaccagttacagcttatgtttgaagtcacaataaactcttcttcaaacatga

SEQ ID NO: 277841 - DNA, 2069 bp, Homo sapiens
  misc_feature (1324)..(1324): n is a, c, g, or t
gtgtagaagtccgaccgcggaaccaggactgctgtccagtcggcgagcgcgtaccattcagcatcggctccgccgagtcccaccttcctcaggctctgattggctgacacatggcaagcgcgaaaagcctggaccgctggaaacccggctgcttgagggcggaagtactgcgttgacgtacgccttagtaagggcggaagtgagttttccagcgaagtggctcctgtaaggcagcaaggtagcgtggccggcgcccgagctggggttgtgtccctgctgggctgccgttccagctggactgccgccatggaactcagcgccgaatacctccgcgagaagctgcagcgggacctggaggcggagcatgtggaggtggaggacacgaccctcaaccgttgctcctgtagcttccgagtcctggtggtgtcggccaagttcgaggggaaaccgctgcttcagagacacaggttctgtacagagtaatgagatgtgtgacggctgcaaaccaggtgtttttttctgaggctgtgttgacagctgctaatgagtgtgttggtgttttgctcggcagcttggatcctagcatgactatacattgtgacatggtcattacatatggattagaccaactggagaattgccagacttgtggtaccaattatatcatctcagtcttgaatttactcacgctgattgttgaacagataaatacgaaactgccatcatcatttgtagaaaaactgtttataccatcatctaaactactattcttgcgttatcataaagaaaaagaggttgttgctgtagcccatgctgtttatcaagcaatgctcagcttgaagaatattcctgttttggagactgcctataagttaatattgggagaaatgacttgtgccctaaacaacctcctgcacagtctgcaacttcctgaggcctgttctgaaataaaacatgaggcttttaagaatcatgtgttcaatgtagacaatgcaaaatttgtagttaaatttgacctcagtgccctgactacaattggaaatgccaaaaactcgagtctttaattgtaatgactttgttttatccacagttaagccttttctcattacatatttatgtatttcactgtcatgtcaacatgtctgcagaatcactgtatgtaacaaacagccatatttaagacatgcctggataaataaaattggtaggaatgttttcttgccattatatttaacgtttcttctttttccttgacaaatcttgataagtttttttatattagttttattttctagaaaacgtcttatgaatttctcccatttgntctagcatgcttatagaaaatgtcagtgtttcttacagctcaaatttgtatagttgttttaaaatgcggtctcttcttcttcccctggtacttttttctttctgtctactgaagttagttcttatacatggtcttatattttggctgtctttttttccctaggaacattcatacaggttgaatattccttatctgaaatacttgggactggaagtgtttttgattttggagtttggaatacttttttttttttggagatagtgttttactcttgttgcccaggctggagtgcaatggcgcaatcttggctcgctgcaacctccgcctcccgggtacaagcgattctcctgtttcagcctcccaagtagctcggattacaggcatgcgccaccacgcctggctaatttttttgtatttagtagagatgggttttcaccatgttagccaggctggttgtgaactcctgacctcaggtgatccacctgccttggcctcccaaaatgccgggattacaggtgggcaccaccatgcccagccggattttggaatattttcataacacttactggtgagcacccctaatctgaaaatcctaaatctaaaatgctccaaaatttgaaactttttgagcaccagtatgatgccccaagtggaaaatcccacacccgacctcatgtgatgagtccaaactgttgtatgcacaaaattatttaaaatattgcataaaatgaccttcaggctatga

SEQ ID NO: 277842 - DNA, 1583 bp, Homo sapiens
  misc_feature (1324)..(1324): n is a, c, g, or t
  misc_feature (1542)..(1542): n is a, c, g, or t
gtgtagaagtccgaccgcggaaccaggactgctgtccagtcggcgagcgcgtaccattcagcatcggctccgccgagtcccaccttcctcaggctctgattggctgacacatggcaagcgcgaaaagcctggaccgctggaaacccggctgcttgagggcggaagtactgcgttgacgtacgccttagtaagggcggaagtgagttttccagcgaagtggctcctgtaaggcagcaaggtagcgtggccggcgcccgagctggggttgtgtccctgctgggctgccgttccagctggactgccgccatggaactcagcgccgaatacctccgcgagaagctgcagcgggacctggaggcggagcatgtggaggtggaggacacgaccctcaaccgttgctcctgtagcttccgagtcctggtggtgtcggccaagttcgaggggaaaccgctgcttcagagacacaggttctgtacagagtaatgagatgtgtgacggctgcaaaccaggtgtttttttctgaggctgtgttgacagctgctaatgagtgtgttggtgttttgctcggcagcttggatcctagcatgactatacattgtgacatggtcattacatatggattagaccaactggagaattgccagacttgtggtaccaattatatcatctcagtcttgaatttactcacgctgattgttgaacagataaatacgaaactgccatcatcatttgtagaaaaactgtttataccatcatctaaactactattcttgcgttatcataaagaaaaagaggttgttgctgtagcccatgctgtttatcaagcaatgctcagcttgaagaatattcctgttttggagactgcctataagttaatattgggagaaatgacttgtgccctaaacaacctcctgcacagtctgcaacttcctgaggcctgttctgaaataaaacatgaggcttttaagaatcatgtgttcaatgtagacaatgcaaaatttgtagttaaatttgacctcagtgccctgactacaattggaaatgccaaaaactcgagtctttaattgtaatgactttgttttatccacagttaagccttttctcattacatatttatgtatttcactgtcatgtcaacatgtctgcagaatcactgtatgtaacaaacagccatatttaagacatgcctggataaataaaattggtaggaatgttttcttgccattatatttaacgtttcttctttttccttgacaaatcttgataagtttttttatattagttttattttctagaaaacgtcttatgaatttctcccatttgntctagcatgcttatagaaaatgtcagtgtttcttacagctcaaatttgtatagttgttttaaaatgcggtctcttcttcttcccctggtacttttttctttctgtctactgaagttagtttataaagggcatatttggggggtttttcccaggaaaattcataagggggaaagtcctgtgtggaaggtgggaaggaaggtgtgagcggggggaaaatncggggaaagggacctgtggggggggaggaaacgctggtgaa

SEQ ID NO: 277843 - DNA, 2051 bp, Homo sapiens
  misc_feature (1324)..(1324): n is a, c, g, or t
gtgtagaagtccgaccgcggaaccaggactgctgtccagtcggcgagcgcgtaccattcagcatcggctccgccgagtcccaccttcctcaggctctgattggctgacacatggcaagcgcgaaaagcctggaccgctggaaacccggctgcttgagggcggaagtactgcgttgacgtacgccttagtaagggcggaagtgagttttccagcgaagtggctcctgtaaggcagcaaggtagcgtggccggcgcccgagctggggttgtgtccctgctgggctgccgttccagctggactgccgccatggaactcagcgccgaatacctccgcgagaagctgcagcgggacctggaggcggagcatgtggaggtggaggacacgaccctcaaccgttgctcctgtagcttccgagtcctggtggtgtcggccaagttcgaggggaaaccgctgcttcagagacacaggttctgtacagagtaatgagatgtgtgacggctgcaaaccaggtgtttttttctgaggctgtgttgacagctgctaatgagtgtgttggtgttttgctcggcagcttggatcctagcatgactatacattgtgacatggtcattacatatggattagaccaactggagaattgccagacttgtggtaccaattatatcatctcagtcttgaatttactcacgctgattgttgaacagataaatacgaaactgccatcatcatttgtagaaaaactgtttataccatcatctaaactactattcttgcgttatcataaagaaaaagaggttgttgctgtagcccatgctgtttatcaagcaatgctcagcttgaagaatattcctgttttggagactgcctataagttaatattgggagaaatgacttgtgccctaaacaacctcctgcacagtctgcaacttcctgaggcctgttctgaaataaaacatgaggcttttaagaatcatgtgttcaatgtagacaatgcaaaatttgtagttaaatttgacctcagtgccctgactacaattggaaatgccaaaaactcgagtctttaattgtaatgactttgttttatccacagttaagccttttctcattacatatttatgtatttcactgtcatgtcaacatgtctgcagaatcactgtatgtaacaaacagccatatttaagacatgcctggataaataaaattggtaggaatgttttcttgccattatatttaacgtttcttctttttccttgacaaatcttgataagtttttttatattagttttattttctagaaaacgtcttatgaatttctcccatttgntctagcatgcttatagaaaatgtcagtgtttcttacagctcaaatttgtatagttgttttaaaatgcggtctcttcttcttcccctggtacttttttctttctgtctactgaagttagttcttatacatggtcttatattttggctgtctttttttccctaggaacattcatacaggttgaatattccttatctgaaatacttgggactggaagtgtttttgattttggagtttggaatacttttttttttttggagatagtgttttactcttgttgcccaggctggagtgcaatggcgcaatcttggctcgctgcaacctccgcctcccgggtacaagcgattctcctgtttcagcctcccaagtagctcggattacaggcatgcgccaccacgcctggctaatttttttgtatttagtagagatgggttttcaccatgttagccaggctggttgtgaactcctgacctcaggtgatccacctgccttggcctcccaaaatgccgggattacaggtgggcaccaccatgcccagccggattttggaatattttcataacacttactggtgagcacccctaatctgaaaatcgtaaaatttgatgtttgcgcttcagtgtgctccatgttgtttgattggattgccttgtataattccatagctgcttcgcttattaccagttacagcttatgtttgaagtcacaataaactcttcttcaaacatga

SEQ ID NO: 277844 - DNA, 1125 bp, Homo sapiens
gtgtagaagtccgaccgcggaaccaggactgctgtccagtcggcgagcgcgtaccattcagcatcggctccgccgagtcccaccttcctcaggctctgattggctgacacatggcaagcgcgaaaagcctggaccgctggaaacccggctgcttgagggcggaagtactgcgttgacgtacgccttagtaagggcggaagtgagttttccagcgaagtggctcctgtaaggcagcaaggtagcgtggccggcgcccgagctggggttgtgtccctgctgggctgccgttccagctggactgccgccatggaactcagcgccgaatacctccgcgagaagctgcagcgggacctggaggcggagcatgtggaggtggaggacacgaccctcaaccgttgctcctgtagcttccgagtcctggtggtgtcggccaagttcgaggggaaaccgctgcttcagagacaccttggatcctagcatgactatacattgtgacatggtcattacatatggattagaccaactggagaattgccagacttgtggtaccaattatatcatctcagtcttgaatttactcacgctgattgttgaacagataaatacgaaactgccatcatcatttgtagaaaaactgtttataccatcatctaaactactattcttgcgttatcataaagaaaaagaggttgttgctgtagcccatgctgtttatcaagcaatgctcagcttgaagaatattcctgttttggagactgcctataagttaatattgggagaaatgacttgtgccctaaacaacctcctgcacagtctgcaacttcctgaggcctgttctgaaataaaacatgaggcttttaagaatcatgtgttcaatgtagacaatgcaaaatttgtagttaaatttgacctcagtgccctgactacaattggaaatgccaaaaactcgagtctttaattgtaatgactttgttttatccacagttaagccttttctcattacatatttatgtatttcactgtcatgtcaacatgtctgcagaatcactgtatgtaacaaacagccatatttaagacatgcctggataaataaaattggtaggaatgttttcttgccattatatt

SEQ ID NO: 277845 - DNA, 1318 bp, Homo sapiens
gtgtagaagtccgaccgcggaaccaggactgctgtccagtcggcgagcgcgtaccattcagcatcggctccgccgagtcccaccttcctcaggctctgattggctgacacatggcaagcgcgaaaagcctggaccgctggaaacccggctgcttgagggcggaagtactgcgttgacgtacgccttagtaagggcggaagtgagttttccagcgaagtggctcctgtaaggcagcaaggtagcgtggccggcgcccgagctggggttgtgtccctgctgggctgccgttccagctggactgccgccatggaactcagcgccgaatacctccgcgagaagctgcagcgggacctggaggcggagcatgtgggagcatgtggtgagttgagccgccggacaaggggaaaagagctcggggggcgggttcggcaccattcatattcttccgctcggtaggaggtggaggacacgaccctcaaccgttgctcctgtagcttccgagtcctggtggtgtcggccaagttcgaggggaaaccgctgcttcagagacacaggttctgtacagagtaatgagatgtgtgacggctgcaaaccaggtgtttttttctgaggctgtgttgacagctgctaatgagtgtgttggtgttttgctcggcagcttggatcctagcatgactatacattgtgacatggtcattacatatggattagaccaactggagaattgccagacttgtggtaccaattatatcatctcagtcttgaatttactcacgctgattgttgaacagataaatacgaaactgccatcatcatttgtagaaaaactgtttataccatcatctaaactactattcttgcgttatcataaagaaaaagaggttgttgctgtagcccatgctgtttatcaagcaatgctcagcttgaagaatattcctgttttggagactgcctataagttaatattgggagaaatgacttgtgccctaaacaacctcctgcacagtctgcaacttcctgaggcctgttctgaaataaaacatgaggcttttaagaatcatgtgttcaatgtagacaatgcaaaatttgtagttaaatttgacctcagtgccctgactacaattggaaatgccaaaaactcgagtctttaattgtaatgactttgttttatccacagttaagccttttctcattacatatttatgtatttcactgtcatgtcaacatgtctgcagaatcactgtatgtaacaaacagccatatttaagacatgcctggataaataaaattggtaggaatgttttcttgccattatatt

SEQ ID NO: 277846 - DNA, 1212 bp, Homo sapiens
gtgtagaagtccgaccgcggaaccaggactgctgtccagtcggcgagcgcgtaccattcagcatcggctccgccgagtcccaccttcctcaggctctgattggctgacacatggcaagcgcgaaaagcctggaccgctggaaacccggctgcttgagggcggaagtactgcgttgacgtacgccttagtaagggcggaagtgagttttccagcgaagtggctcctgtaaggcagcaaggtagcgtggccggcgcccgagctggggttgtgtccctgctgggctgccgttccagctggactgccgccatggaactcagcgccgaatacctccgcgagaagctgcagcgggacctggaggcggagcatgtgggagcatgtggtgagttgagccgccggacaaggggaaaagagctcggggggcgggttcggcaccattcatattcttccgctcggtaggaggtggaggacacgaccctcaaccgttgctcctgtagcttccgagtcctggtggtgtcggccaagttcgaggggaaaccgctgcttcagagacaccttggatcctagcatgactatacattgtgacatggtcattacatatggattagaccaactggagaattgccagacttgtggtaccaattatatcatctcagtcttgaatttactcacgctgattgttgaacagataaatacgaaactgccatcatcatttgtagaaaaactgtttataccatcatctaaactactattcttgcgttatcataaagaaaaagaggttgttgctgtagcccatgctgtttatcaagcaatgctcagcttgaagaatattcctgttttggagactgcctataagttaatattgggagaaatgacttgtgccctaaacaacctcctgcacagtctgcaacttcctgaggcctgttctgaaataaaacatgaggcttttaagaatcatgtgttcaatgtagacaatgcaaaatttgtagttaaatttgacctcagtgccctgactacaattggaaatgccaaaaactcgagtctttaattgtaatgactttgttttatccacagttaagccttttctcattacatatttatgtatttcactgtcatgtcaacatgtctgcagaatcactgtatgtaacaaacagccatatttaagacatgcctggataaataaaattggtaggaatgttttcttgccattatatt

SEQ ID NO: 277847 - DNA, 1416 bp, Homo sapiens
gtgtagaagtccgaccgcggaaccaggactgctgtccagtcggcgagcgcgtaccattcagcatcggctccgccgagtcccaccttcctcaggctctgattggctgacacatggcaagcgcgaaaagcctggaccgctggaaacccggctgcttgagggcggaagtactgcgttgacgtacgccttagtaagggcggaagtgagttttccagcgaagtggctcctgtaaggcagcaaggtagcgtggccggcgcccgagctggggttgtgtccctgctgggctgccgttccagctggactgccgccatggaactcagcgccgaatacctccgcgagaagctgcagcgggacctggaggcggagcatgtgggagcatgtggtgagttgagccgccggacaaggggaaaagagctcggggggcgggttcggcaccattcatattcttccgctcggtaggaggtggaggacacgaccctcaaccgttgctcctgtagcttccgagtcctggtggtgtcggccaagttcgaggggaaaccgctgcttcagagacacgctggagtgcaatggcacgatctcggctcaccacaacctccgcctcctgggttcaagcgattctcttgtctcagcctcccaagtagctgggattacagaggttctgtacagagtaatgagatgtgtgacggctgcaaaccaggtgtttttttctgaggctgtgttgacagctgctaatgagtgtgttggtgttttgctcggcagcttggatcctagcatgactatacattgtgacatggtcattacatatggattagaccaactggagaattgccagacttgtggtaccaattatatcatctcagtcttgaatttactcacgctgattgttgaacagataaatacgaaactgccatcatcatttgtagaaaaactgtttataccatcatctaaactactattcttgcgttatcataaagaaaaagaggttgttgctgtagcccatgctgtttatcaagcaatgctcagcttgaagaatattcctgttttggagactgcctataagttaatattgggagaaatgacttgtgccctaaacaacctcctgcacagtctgcaacttcctgaggcctgttctgaaataaaacatgaggcttttaagaatcatgtgttcaatgtagacaatgcaaaatttgtagttaaatttgacctcagtgccctgactacaattggaaatgccaaaaactcgagtctttaattgtaatgactttgttttatccacagttaagccttttctcattacatatttatgtatttcactgtcatgtcaacatgtctgcagaatcactgtatgtaacaaacagccatatttaagacatgcctggataaataaaattggtaggaatgttttcttgccattatatt

SEQ ID NO: 277848 - DNA, 1134 bp, Homo sapiens
gtgtagaagtccgaccgcggaaccaggactgctgtccagtcggcgagcgcgtaccattcagcatcggctccgccgagtcccaccttcctcaggctctgattggctgacacatggcaagcgcgaaaagcctggaccgctggaaacccggctgcttgagggcggaagtactgcgttgacgtacgccttagtaagggcggaagtgagttttccagcgaagtggctcctgtaaggcagcaaggtagcgtggccggcgcccgagctggggttgtgtccctgctgggctgccgttccagctggactgccgccatggaactcagcgccgaatacctccgcgagaagctgcagcgggacctggaggcggagcatgtaggttctgtacagagtaatgagatgtgtgacggctgcaaaccaggtgtttttttctgaggctgtgttgacagctgctaatgagtgtgttggtgttttgctcggcagcttggatcctagcatgactatacattgtgacatggtcattacatatggattagaccaactggagaattgccagacttgtggtaccaattatatcatctcagtcttgaatttactcacgctgattgttgaacagataaatacgaaactgccatcatcatttgtagaaaaactgtttataccatcatctaaactactattcttgcgttatcataaagaaaaagaggttgttgctgtagcccatgctgtttatcaagcaatgctcagcttgaagaatattcctgttttggagactgcctataagttaatattgggagaaatgacttgtgccctaaacaacctcctgcacagtctgcaacttcctgaggcctgttctgaaataaaacatgaggcttttaagaatcatgtgttcaatgtagacaatgcaaaatttgtagttaaatttgacctcagtgccctgactacaattggaaatgccaaaaactcgagtctttaattgtaatgactttgttttatccacagttaagccttttctcattacatatttatgtatttcactgtcatgtcaacatgtctgcagaatcactgtatgtaacaaacagccatatttaagacatgcctggataaataaaattggtaggaatgttttcttgccattatatt

SEQ ID NO: 277849 - DNA, 1449 bp, Homo sapiens
atgggtagactaaataaaatcctgtatgtattggttgttaaatattatagaaatatttttaaacatttgctctgttttctcccccattttattagaaatttagtacacaattattggccattatagttaagtgggggattttgtttgtgtgtgtattggaaataatatgatttttgaagatattatgtggtaagcatgagagtgcttatctttcaaaagagaccatcagtagatagaaactttaataagcttaaagtgacttgtatgttcagttttgaaagattgattcccaaaagcccaagagctagcttgtagtatgtgtgggcaggctattccccatgctgtcaataccattactgtcgtggtgtatttcatgataaagattctgagcttcagccatttagtgacattgggagaaacgaagttgggtatatgggaaatagaggatggcaggttccatttcctgtcatagtagcactttaggattttttagccaagatcatgtttacatattgtagtaaagggatcattattattcagctactgagaactagaatattaagagactgctggcaaggcaagcagttaattttcagttgaaattgcattaaataaaaagtattttcttgctttgtggaagcacgtgaatttttgtaaaaagctgcttgttttccccatttacaaggttctgtacagagtaatgagatgtgtgacggctgcaaaccaggtgtttttttctgaggctgtgttgacagctgctaatgagtgtgttggtgttttgctcggcagcttggatcctagcatgactatacattgtgacatggtcattacatatggattagaccaactggagaattgccagacttgtggtaccaattatatcatctcagtcttgaatttactcacgctgattgttgaacagataaatacgaaactgccatcatcatttgtagaaaaactgtttataccatcatctaaactactattcttgcgttatcataaagaaaaagaggttgttgctgtagcccatgctgtttatcaagcaatgctcagcttgaagaatattcctgttttggagactgcctataagttaatattgggagaaatgacttgtgccctaaacaacctcctgcacagtctgcaacttcctgaggcctgttctgaaataaaacatgaggcttttaagaatcatgtgttcaatgtagacaatgcaaaatttgtagttaaatttgacctcagtgccctgactacaattggaaatgccaaaaactcgagtctttaattgtaatgactttgttttatccacagttaagccttttctcattacatatttatgtatttcactgtcatgtcaacatgtctgcagaatcactgtatgtaacaaacagccatatttaagacatgcctggataaataaaattggtaggaatgttttcttgccattatatt

SEQ ID NO: 277850 - DNA, 1166 bp, Homo sapiens
aaaaaatgcccatgataactgtaaaatacgtgtgtcctatttaggtgtctaaacactttaatgtcacagtattaaggccttaaaatatagcttagatatatttttctaaattaaaagactttattttttagatatacagaaaattgagcagaaaacaatgagttcccatataccttcttcatcccaacagtttccccctcattaacatattgtgttagtgtggtacatttattacaaaggagtgaatattgatatattattattaactaattttatagtttactttgtgttatgtattctatggactttaacatgtgtaatgacatgtatcccctattaccagtatcatacaggatagtttcacttccctaaaaatctttgatgttctacccactccttcctcgttccctctcctcactcctccctccctccatcttaagcccatggcaacccctgatctttttactgtctccatcgttttgccttttccagaatgccatgtagttggagtcatatagtatgtagccttttcaattggcttctttcacttaccagtgtgcatttaaggtttctccatgtctttttgtaatttgagaagctcattttttaaaaattttattcttttagattgttgaacagataaatacgaaactgccatcatcatttgtagaaaaactgtttataccatcatctaaactactattcttgcgttatcataaagaaaaagaggttgttgctgtagcccatgctgtttatcaagcaatgctcagcttgaagaatattcctgttttggagactgcctataagttaatattgggagaaatgacttgtgccctaaacaacctcctgcacagtctgcaacttcctgaggcctgttctgaaataaaacatgaggcttttaagaatcatgtgttcaatgtagacaatgcaaaatttgtagttaaatttgacctcagtgccctgactacaattggaaatgccaaaaactcgagtctttaattgtaatgactttgttttatccacagttaagccttttctcattacatatttatgtatttcactgtcatgtcaacatgtctgcagaatcactgtatgtaacaaacagccatatttaagacatgcctggataaataaaattggtaggaatgttttcttgccattatatt

SEQ ID NO: 277851 - DNA, 1948 bp, Homo sapiens
gtgtcggcagcggccggttcgggcggcgactcgcgcttctctgggcggcggcgcttggccatgtcgtgtcggggaaggtaatgagccgcagagccccggggtctcggctgagcagcggcggcaccaactattcgcggagctggaatgactggcaacccagaactgatagtgcatcagctgacccaggtaatttaaaatattcttcatccagagatagaggtggttcttcctcttacggactgcaaccttcaaattcagctgtggtgtctcggcaaaggcacgatgataccagagtccacgctgacatacagaatgacgaaaagggtggctacagtgtcaatggaggatctggggaaaatacttatggtcggaagtcgttggggcaagagctgagggttaacaatgtgaccagccctgagttcaccagtgttcagcatggcagtcgtgctttagccaccaaagacatgaggaaatcacaggagagatcgatgtcttattgtgatgagtctcgactgtcaaatcttcttcggaggatcacccgggaagacgacagagactgaagattggtcactgtaaagcagttgaaagaatttattcagcaaccagaaaataagctggtactagttaaacaattggataatatcttggctgctgtacatgatgtgcttaatgaaagtagcaaattgcttcaggagttgagacaggagggagcttgctgtcttggccttctttgtgcttctctgagctatgaggctgagaagatcttcaagtggagttttagcaaatttagctcatctgcaaaagatgaagttaaactcctctacttatgtgccacctacaaagcactagagactgtaggagaaaagaaagccttttcatctgtaatgcagcttgtaatgaccagcctgcagtcaattcttgaaaatgtggatacaccagaattgctttgcaaatgtgttaagtgcattcttttggtggctcgatgttaccctcatattttcagcgctaattttagggatacagttgatatattagttggatggcatagagatcatactcagaaaccttcgctcacgcagcaggtatctgggtggttgcagagtttggagccattttgggtagctgatcttgcatttcctacgactcttcttggtcagtttctagaagacatggaagcatatgctgaggacctcagccatgtggcctctggggaatcagtggatgaagacgtccctcctccatcagtgtcatcaccaaagctggctgcgcttctccgggtatttagtactgtgctgaggagcattggggaacgcttcagcccaattcgggtcctccaattactgaggcatacgtaacagttaggttctgtacagagtaatgagatgtgtgacggctgcaaaccaggtgtttttttctgaggctgtgttgacagctgctaatgagtgtgttggtgttttgctcggcagcttggatcctagcatgactatacattgtgacatggtcattacatatggattagaccaactggagaattgccagacttgtggtaccaattatatcatctcagtcttgaatttactcacgctggtatgtgaattattcttttcctttttaatgtgttggtttattcaggcccttaaatcgatatgtaagaaattaaggactttgtctgggtatggtggctcatgcttgtaatcccagcactttgggaggccaaagcagaaggattgcttgcatccaggaattctggcacagcttgggcaatgtagtgagaccccatctgtacaaaaagtcaaaaattagcttggtgtagtggtgtgcacctgcagtcctagctactcgggaggctgagggaggaagatcgattaagcccaggaacttgaggttgaagtgagctctgattgtgccactgcactcagccaaggtgacaaaaaaggccctgtctcca

SEQ ID NO: 277852 - DNA, 1337 bp, Homo sapiens
  misc_feature (1293)..(1293): n is a, c, g, or t
gtgtcggcagcggccggttcgggcggcgactcgcgcttctctgggcggcggcgcttggccatgtcgtgtcggggaaggtaatgagccgcagagccccggggtctcggctgagcagcggcggcaccaactattcgcggagctggaatgactggcaacccagaactgatagtgcatcagctgacccaggtaatttaaaatattcttcatccagagatagaggtggttcttcctcttacggactgcaaccttcaaattcagctgtggtgtctcggcaaaggcacgatgataccagagtccacgctgacatacagaatgacgaaaagggtggctacagtgtcaatggaggatctggggaaaatacttatggtcggaagtcgttggggcaagagctgagggttaacaatgtgaccagccctgagttcaccagtgttcagcatggcagtcgtgctttagccaccaaagacatgaggaaatcacaggagagatcgatgtcttattgtgatgagtctcgactgtcaaatcttcttcggaggatcacccgggaagacgacagagactgaagattggtcactgtaaagcagttgaaagaatttattcagcaaccagaaaataagctggtactagttaaacaattggataatatcttggctgctgtacatgatgtgcttaatgaaagtagcaaattgcttcaggagttgagacaggagggagcttgctgtcttggccttctttgtgcttctctgagctatgaggctgagaagatcttcaagtggagttttagcaaatttagctcatctgcaaaagatgaagttaaactcctctacttatgtgccacctacaaagcactagagactgtaggagaaaagaaagccttttcatctgtaatgcagcttgtaatgaccagcctgcagtcaattcttgaaaatgtggatacaccagaattgctttgcaaatgtgttaagtgcattcttttggtggctcgatgttaccctcatattttcagcgctaattttagggatacagttgatatattagttggatggcatagagatcatactcagaaaccttcgctcacgcagcaggtatctgggtggttgcagagtttggagccattttgggtagctgatcttgcatttcctacgactcttcttggtcagtttctagaagacatggaagcatatgctgaggacctcagccatgtggcctctggggaatggattcaaatccctccggctaaaaggccaacatttaattattttgcaaagcaacctaagagctaaagatgtaattttncttgcaattgtaaatcttttgtgtctcctgaaggcttcccttaa

SEQ ID NO: 277853 - DNA, 1042 bp, Homo sapiens
gtgtcggcagcggccggttcgggcggcgactcgcgcttctctgggcggcggcgcttggccatgtcgtgtcggggaaggtaatgagccgcagagccccggggtctcggctgagcagcggcggcaccaactattcgcggagctggaatgactggcaacccagaactgatagtgcatcagctgacccaggtaatttaaaatattcttcatccagagatagaggtggttcttcctcttacggactgcaaccttcaaattcagctgtggtgtctcggcaaaggcacgatgataccagagtccacgctgacatacagaatgacgaaaagggtggctacagtgtcaatggaggatctggggaaaatacttatggtcggaagtcgttggggcaagagctgagggttaacaatgtgaccagccctgagttcaccagtgttcagcatggcagtcgtgctttagccaccaaagacatgaggaaatcacaggagagatcgatgtcttattgtgatgagtctcgactgtcaaatcttcttcggaggatcacccgggaagacgacagagactgaagattggtcactgtaaagcagttgaaagaatttattcagcaaccagaaaataagctggtactagttaaacaattggataatatcttggctgctgtacatgatgtgcttaatgaaagtagcaaattgcttcaggagttgagacaggagggagcttgctgtcttggccttctttgtgcttctctgagctatgaggctgagaagatcttcaagtggagttttagcaaatttagctcatctgcaaaagatgaagttaaactcctctacttatgtgccacctacaaagcactagagactgtaggagaaaagaaagccttttcatctgtaatgcagcttgtaatgaccagcctgcagtcaattcttgaaaatgtggatacaccagaattgctttgcaaatgtgttaagtgcattcttttggtggctcgatgttaccctcatattttcagcgctaattttagggggatctctagatgcctcagcacccc

SEQ ID NO: 277854 - DNA, 371 bp, Homo sapiens
agccctgagttcaccagtgttcagcatggcagtcgtgctttagccaccaaagacatgaggaaatcacagggtaagtctgggaaaatggggaccaatcacatacaccttccaaagacttgtatctcctcttattctggatgcctcttactaacgccttgcacaggcataagttgattagtctactgtgcaggtaaaaattgtttacattcttttcctgtgaattgttaatttcccactagaaaggttatagtacattttaaaagagaattctcttaaaacaagattagaagactggataagatcttacagaaaaggtttacccaattatcgtggatattgaatgtatagtgcatagtaggctcttactacag

SEQ ID NO: 277855 - DNA, 580 bp, Homo sapiens
tagcaaattgcttcaggagttgagacaggagggagcttgctgtcttggccttctttgtgcttctctgagctatgaggctgagaagatcttcaagtggagttttagcaaatttagctcatctgcaaaagatgaagttaaactcctctacttatgtgccacctacaaagcactagagactgtaggagaaaagaaagccttttcatctgtaatgcaggtaagaatgaagggggaaaaatgcatgatgtacttgggaagaaaattgtcccttaacacatgtccttggaggggagcttgaagaagggaaacatagaataggggttatctactgataggaaatatgttttaaaaattcctctttctcagtttgagtaaaggatacactgttcaaggattagtgctacatacatatatgcatatatgtggagaaagagggagagatttcttctaagaaattggcttacacgccgggtgcggtggctcacgtctgttatcccagcactttgggaggccgaggcaggcggatcatgaggtcaggagatcgagaccatcctggctaacatagtgaaaccccatatctact

SEQ ID NO: 277856 - DNA, 639 bp, Homo sapiens
ggctcaaagaatacctagaatgagatttttagccaaaaactaattcaggagtggcaaaagcttccgtcttcatttatacctacatataactagagcatatgtgctagaatttatttttccccaacagctttctgagttgatttaagagattatttccttaatttgttgtctattgggtttaatgttggctttttgaaataattaggtaaaacccatttttatattcagagtcatgaatattctcatgggccacagttctctttctaaaagcctaaaaatctattctaaaatgaattgattgaaatattttagagttttttgtttttttttaaacaatgtactacttattaagaatgctgtgaattcacatctaggacctcagccatgtggcctctggggaatcagtggatgaagacgtccctcctccatcagtgtcatcaccaaagctggctgcgcttctccgggtatttagtactgtgctgaggagcattggggaacgcttcagcccaattcgggtcctccaattactgaggcatacgtaacagttgtaagtgcttttgggcatttgaagtgtcattcaaaaataaaattgttttacattgtaaatgattctctttaccaggtgaactgttattaatc

SEQ ID NO: 277857 - DNA, 1454 bp, Homo sapiens
  misc_feature (1324)..(1324): n is a, c, g, or t
gtgtagaagtccgaccgcggaaccaggactgctgtccagtcggcgagcgcgtaccattcagcatcggctccgccgagtcccaccttcctcaggctctgattggctgacacatggcaagcgcgaaaagcctggaccgctggaaacccggctgcttgagggcggaagtactgcgttgacgtacgccttagtaagggcggaagtgagttttccagcgaagtggctcctgtaaggcagcaaggtagcgtggccggcgcccgagctggggttgtgtccctgctgggctgccgttccagctggactgccgccatggaactcagcgccgaatacctccgcgagaagctgcagcgggacctggaggcggagcatgtggaggtggaggacacgaccctcaaccgttgctcctgtagcttccgagtcctggtggtgtcggccaagttcgaggggaaaccgctgcttcagagacacaggttctgtacagagtaatgagatgtgtgacggctgcaaaccaggtgtttttttctgaggctgtgttgacagctgctaatgagtgtgttggtgttttgctcggcagcttggatcctagcatgactatacattgtgacatggtcattacatatggattagaccaactggagaattgccagacttgtggtaccaattatatcatctcagtcttgaatttactcacgctgattgttgaacagataaatacgaaactgccatcatcatttgtagaaaaactgtttataccatcatctaaactactattcttgcgttatcataaagaaaaagaggttgttgctgtagcccatgctgtttatcaagcaatgctcagcttgaagaatattcctgttttggagactgcctataagttaatattgggagaaatgacttgtgccctaaacaacctcctgcacagtctgcaacttcctgaggcctgttctgaaataaaacatgaggcttttaagaatcatgtgttcaatgtagacaatgcaaaatttgtagttaaatttgacctcagtgccctgactacaattggaaatgccaaaaactcgagtctttaattgtaatgactttgttttatccacagttaagccttttctcattacatatttatgtatttcactgtcatgtcaacatgtctgcagaatcactgtatgtaacaaacagccatatttaagacatgcctggataaataaaattggtaggaatgttttcttgccattatatttaacgtttcttctttttccttgacaaatcttgataagtttttttatattagttttattttctagaaaacgtcttatgaatttctcccatttgntctagcatgcttatagaaaatgtcagtgtttcttacagctcaaatttgtatagttgttttaaaatgcggtctcttcttcttcccctggtacttttttctttcgctaggggaggtccgaagggcctaattt

SEQ ID NO: 277858 - DNA, 1231 bp, Homo sapiens
gtgtagaagtccgaccgcggaaccaggactgctgtccagtcggcgagcgcgtaccattcagcatcggctccgccgagtcccaccttcctcaggctctgattggctgacacatggcaagcgcgaaaagcctggaccgctggaaacccggctgcttgagggcggaagtactgcgttgacgtacgccttagtaagggcggaagtgagttttccagcgaagtggctcctgtaaggcagcaaggtagcgtggccggcgcccgagctggggttgtgtccctgctgggctgccgttccagctggactgccgccatggaactcagcgccgaatacctccgcgagaagctgcagcgggacctggaggcggagcatgtggaggtggaggacacgaccctcaaccgttgctcctgtagcttccgagtcctggtggtgtcggccaagttcgaggggaaaccgctgcttcagagacacaggttctgtacagagtaatgagatgtgtgacggctgcaaaccaggtgtttttttctgaggctgtgttgacagctgctaatgagtgtgttggtgttttgctcggcagcttggatcctagcatgactatacattgtgacatggtcattacatatggattagaccaactggagaattgccagacttgtggtaccaattatatcatctcagtcttgaatttactcacgctgattgttgaacagataaatacgaaactgccatcatcatttgtagaaaaactgtttataccatcatctaaactactattcttgcgttatcataaagaaaaagaggttgttgctgtagcccatgctgtttatcaagcaatgctcagcttgaagaatattcctgttttggagactgcctataagttaatattgggagaaatgacttgtgccctaaacaacctcctgcacagtctgcaacttcctgaggcctgttctgaaataaaacatgaggcttttaagaatcatgtgttcaatgtagacaatgcaaaatttgtagttaaatttgacctcagtgccctgactacaattggaaatgccaaaaactcgagtctttaattgtaatgactttgttttatccacagttaagccttttctcattacatatttatgtatttcactgtcatgtcaacatgtctgcagaatcactgtatgtaacaaacagccatatttaagacatgcctggataaataaaattggtaggaatgttttcttgccattatatt

SEQ ID NO: 277859 - DNA, 2504 bp, Homo sapiens
gtgtcggcagcggccggttcgggcggcgactcgcgcttctctgggcggcggcgcttggccatgtcgtgtcggggaaggtaatgagccgcagagccccggggtctcggctgagcagcggcggcaccaactattcgcggagctggaatgactggcaacccagaactgatagtgcatcagctgacccaggtaatttaaaatattcttcatccagagatagaggtggttcttcctcttacggactgcaaccttcaaattcagctgtggtgtctcggcaaaggcacgatgataccagagtccacgctgacatacagaatgacgaaaagggtggctacagtgtcaatggaggatctggggaaaatacttatggtcggaagtcgttggggcaagagctgagggttaacaatgtgaccagccctgagttcaccagtgttcagcatggcagtcgtgctttagccaccaaagacatgaggaaatcacaggagagatcgatgtcttattgtgatgagtctcgactgtcaaatcttcttcggaggatcacccgggaagacgacagagactgaagattggtcactgtaaagcagttgaaagaatttattcagcaaccagaaaataagctggtactagttaaacaattggataatatcttggctgctgtacatgatgtgcttaatgaaagtagcaaattgcttcaggagttgagacaggagggagcttgctgtcttggccttctttgtgcttctctgagctatgaggctgagaagatcttcaagtggagttttagcaaatttagctcatctgcaaaagatgaagttaaactcctctacttatgtgccacctacaaagcactagagactgtaggagaaaagaaagccttttcatctgtaatgcagcttgtaatgaccagcctgcagtcaattcttgaaaatgtggatacaccagaattgctttgcaaatgtgttaagtgcattcttttggtggctcgatgttaccctcatattttcagcgctaattttagggtgagttcctcattccgttgttcagatcatggggtgagggggatggttgtgtgtgtgaggaactgaggaatcagatggaaaacaatgcctctgctcctttgaatataatcagtgatatttgaggttccagggttaaatgccgcatttttctttctgacgttcgtaccttaaaatatttgaagaaaataaactatttcattgttgtcagaaatgtagttcttttattttcctgcccctctcccctttctaagtttctagaatgtcaagtaggtagaacatagatgctccttttaggatcttttgctgtgaaatggtccacaggtgaatggcagtaatatcttaaaatgattggccccctctctctttgtttccatcaaggatacagttgatatattagttggatggcatagagatcatactcagaaaccttcgctcacgcagcaggtatctgggtggttgcagagtttggagccattttgggtagctgatcttgcatttcctacgactcttcttggtcagtttctagaagacatggaagcatatgctgaggacctcagccatgtggcctctggggaatcagtggatgaagacgtccctcctccatcagtgtcatcaccaaagctggctgcgcttctccgggtatttagtactgtgctgaggagcattggggaacgcttcagcccaattcgggtcctccaattactgaggcatacgtaacagttaggttctgtacagagtaatgagatgtgtgacggctgcaaaccaggtgtttttttctgaggctgtgttgacagctgctaatgagtgtgttggtgttttgctcggcagcttggatcctagcatgactatacattgtgacatggtcattacatatggattagaccaactggagaattgccagacttgtggtaccaattatatcatctcagtcttgaatttactcacgctgattgttgaacagataaatacgaaactgccatcatcatttgtagaaaaactgtttataccatcatctaaactactattcttgcgttatcataaagaaaaagaggttgttgctgtagcccatgctgtttatcaagcaatgctcagcttgaagaatattcctgttttggagactgcctataagttaatattgggagaaatgacttgtgccctaaacaacctcctgcacagtctgcaacttcctgaggcctgttctgaaataaaacatgaggcttttaagaatcatgtgttcaatgtagacaatgcaaaatttgtagttaaatttgacctcagtgccctgactacaattggaaatgccaaaaactcgagtctttaattgtaatgactttgttttatccacagttaagccttttctcattacatatttatgtatttcactgtcatgtcaacatgtctgcagaatcactgtatgtaacaaacagccatatttaagacatgcctggataaataaaattggtaggaatgttttcttgccattatatt

SEQ ID NO: 277860 - DNA, 1990 bp, Homo sapiens
  misc_feature (1324)..(1324): n is a, c, g, or t
gtgtagaagtccgaccgcggaaccaggactgctgtccagtcggcgagcgcgtaccattcagcatcggctccgccgagtcccaccttcctcaggctctgattggctgacacatggcaagcgcgaaaagcctggaccgctggaaacccggctgcttgagggcggaagtactgcgttgacgtacgccttagtaagggcggaagtgagttttccagcgaagtggctcctgtaaggcagcaaggtagcgtggccggcgcccgagctggggttgtgtccctgctgggctgccgttccagctggactgccgccatggaactcagcgccgaatacctccgcgagaagctgcagcgggacctggaggcggagcatgtggaggtggaggacacgaccctcaaccgttgctcctgtagcttccgagtcctggtggtgtcggccaagttcgaggggaaaccgctgcttcagagacacaggttctgtacagagtaatgagatgtgtgacggctgcaaaccaggtgtttttttctgaggctgtgttgacagctgctaatgagtgtgttggtgttttgctcggcagcttggatcctagcatgactatacattgtgacatggtcattacatatggattagaccaactggagaattgccagacttgtggtaccaattatatcatctcagtcttgaatttactcacgctgattgttgaacagataaatacgaaactgccatcatcatttgtagaaaaactgtttataccatcatctaaactactattcttgcgttatcataaagaaaaagaggttgttgctgtagcccatgctgtttatcaagcaatgctcagcttgaagaatattcctgttttggagactgcctataagttaatattgggagaaatgacttgtgccctaaacaacctcctgcacagtctgcaacttcctgaggcctgttctgaaataaaacatgaggcttttaagaatcatgtgttcaatgtagacaatgcaaaatttgtagttaaatttgacctcagtgccctgactacaattggaaatgccaaaaactcgagtctttaattgtaatgactttgttttatccacagttaagccttttctcattacatatttatgtatttcactgtcatgtcaacatgtctgcagaatcactgtatgtaacaaacagccatatttaagacatgcctggataaataaaattggtaggaatgttttcttgccattatatttaacgtttcttctttttccttgacaaatcttgataagtttttttatattagttttattttctagaaaacgtcttatgaatttctcccatttgntctagcatgcttatagaaaatgtcagtgtttcttacagctcaaatttgtatagttgttttaaaatgcggtctcttcttcttcccctggtacttttttctttctgtctactgaagttagttcttatacatggtcttatattttggctgtctttttttccctaggaacattcatacaggttgaatattccttatctgaaatacttgggactggaagtgtttttgattttggagtttggaatacttttttttttttggagatagtgttttactcttgttgcagtgagctgagatcacaccaccgcactccagcctgggctacagaaccagactctgtctcaaaagaaaaaaaaaaaaaagaaagaaacaaagaaagaaagtaatggatgtaattagggaataaagtttttaggaggaaaaaggtaaaatttgatgtttgcgcttcagtgtgctccatgttgtttgattggattgccttgtataattccatagctgcttcgcttattaccagttacagcttatgtttgaagtcacaataaactcttcttcaaacatgaaagcttgatttttgaggaaaattattcacattatttgcagattcaaagatgtttatgtcctgtactctagaaataaggagaaagtgggtggggctggggcagtcaggtggaa

SEQ ID NO: 277861 - DNA, 1210 bp, Homo sapiens
gtgtagaagtccgaccgcggaaccaggactgctgtccagtcggcgagcgcgtaccattcagcatcggctccgccgagtcccaccttcctcaggctctgattggctgacacatggcaagcgcgaaaagcctggaccgctggaaacccggctgcttgagggcggaagtactgcgttgacgtacgccttagtaagggcggaagtgagttttccagcgaagtggctcctgtaaggcagcaaggtagcgtggccggcgcccgagctggggttgtgtccctgctgggctgccgttccagctggactgccgccatggaactcagcgccgaatacctccgcgagaagctgcagcgggacctggaggcggagcatgtggaggtggaggacacgaccctcaaccgttgctcctgtagcttccgagtcctggtggtgtcggccaagttcgaggggaaaccgctgcttcagagacacaggctggtgaacgcgtgcctagcagaagagctcccgcacatccatgcctttgaacagaaaaccctgaccccagaccagtgggcaccttggatcctagcatgactatacattgtgacatggtcattacatatggattagaccaactggagaattgccagacttgtggtaccaattatatcatctcagtcttgaatttactcacgctgattgttgaacagataaatacgaaactgccatcatcatttgtagaaaaactgtttataccatcatctaaactactattcttgcgttatcataaagaaaaagaggttgttgctgtagcccatgctgtttatcaagcaatgctcagcttgaagaatattcctgttttggagactgcctataagttaatattgggagaaatgacttgtgccctaaacaacctcctgcacagtctgcaacttcctgaggcctgttctgaaataaaacatgaggcttttaagaatcatgtgttcaatgtagacaatgcaaaatttgtagttaaatttgacctcagtgccctgactacaattggaaatgccaaaaactcgagtctttaattgtaatgactttgttttatccacagttaagccttttctcattacatatttatgtatttcactgtcatgtcaacatgtctgcagaatcactgtatgtaacaaacagccatatttaagacatgcctggataaataaaattggtaggaatgttttcttgccattatatt

SEQ ID NO: 277862 - DNA, 1809 bp, Homo sapiens
gtgtcggcagcggccggttcgggcggcgactcgcgcttctctgggcggcggcgcttggccatgtcgtgtcggggaaggtaatgagccgcagagccccggggtctcggctgagcagcggcggcaccaactattcgcggagctggaatgactggcaacccagaactgatagtgcatcagctgacccaggtaatttaaaatattcttcatccagagatagaggtggttcttcctcttacggactgcaaccttcaaattcagctgtggtgtctcggcaaaggcacgatgataccagagtccacgctgacatacagaatgacgaaaagggtggctacagtgtcaatggaggatctggggaaaatacttatggtcggaagtcgttggggcaagagctgagggttaacaatgtgaccagccctgagttcaccagtgttcagcatggcagtcgtgctttagccaccaaagacatgaggaaatcacaggagagatcgatgtcttattgtgatgagtctcgactgtcaaatcttcttcggaggatcacccgggaagacgacagagactgaagattggtcactgtaaagcagttgaaagaatttattcagcaaccagaaaataagctggtactagttaaacaattggataatatcttggctgctgtacatgatgtgcttaatgaaagtagcaaattgcttcaggagttgagacaggagggagcttgctgtcttggccttctttgtgcttctctgagctatgaggctgagaagatcttcaagtggagttttagcaaatttagctcatctgcaaaagatgaagttaaactcctctacttatgtgccacctacaaagcactagagactgtaggagaaaagaaagccttttcatctgtaatgcagcttgtaatgaccagcctgcagtcaattcttgaaaatgtggatacaccagaattgctttgcaaatgtgttaagtgcattcttttggtggctcgatgttaccctcatattttcagcgctaattttagggtgagttcctcattccgttgttcagatcatggggtgagggggatggttgtgtgtgtgaggaactgaggaatcagatggaaaacaatgcctctgctcctttgaatataatcagtgatatttgaggttccagggttaaatgccgcatttttctttctgacgttcgtaccttaaaatatttgaagaaaataaactatttcattgttgtcagaaatgtagttcttttattttcctgcccctctcccctttctaagtttctagaatgtcaagtaggtagaacatagatgctccttttaggatcttttgctgtgaaatggtccacaggtgaatggcagtaatatcttaaaatgattggccccctctctctttgtttccatcaaggatacagttgatatattagttggatggcatagagatcatactcagaaaccttcgctcacgcagcaggtatctggtaagtcttgcagcctataccagttatttaaatactgtcggggaggagcagtggtcccccagtgaccatctatcaataccatttctttaataatgcaagaaaactaattcagagaaatgttttattgtaaatgaacatgacttgttagctaaatatatattttcagaggaaattactagtaggtgggtagagtaagtacagacaggacttacccaagttatttgtagtttgtactggtaggaaagtatatggtaagaatatattgcagtggcaataccctgaagtggacaatggaagatccaagttatttgtcacattttattgtttttctggttatttttt

SEQ ID NO: 277863 - DNA, 909 bp, Homo sapiens
gtgtagaagtccgaccgcggaaccaggactgctgtccagtcggcgagcgcgtaccattcagcatcggctccgccgagtcccaccttcctcaggctctgattggctgacacatggcaagcgcgaaaagcctggaccgctggaaacccggctgcttgagggcggaagtactgcgttgacgtacgccttagtaagggcggaagtgagttttccagcgaagtggctcctgtaaggcagcaaggtagcgtggccggcgcccgagctggggttgtgtccctgctgggctgccgttccagctggactgccgccatggaactcagcgccgaatacctccgcgagaagctgcagcgggacctggaggcggagcatgtgggagcatgtggtgagttgagccgccggacaaggggaaaagagctcggggggcgggttcggcaccattcatattcttccgctcggtaggaggtggaggacacgaccctcaaccgttgctcctgtagcttccgagtcctggtggtgtcggccaagttcgaggggaaaccgctgcttcagagacaccttggatcctagcatgactatacattgtgacatggtcattacatatggattagaccaactggagaattgccagacttgtggtaccaattatatcatctcagtcttgaatttactcacgctgattgttgaacagataaatacgaaactgccatcatcatttgtagaaaaactgtttataccatcatctaaactactattcttgcgttatcataaagaaaaagagcatgcccagctaatttttgtatttttaatggagacagggtttcaccatgttggccaggctggtctcgaactccagacctcaagtgatccacccacctcggcctcccaaagtgctgggattacaggcctgagtct

SEQ ID NO: 277864 - DNA, 740 bp, Homo sapiens
tctccctctgtggcccaggctggagtgcagtggctctatctaggctcactgcaagctccgcctctcgggttcacaccattctcctgcctcagcctcccaagtagctgggaccacaggtacccgccaccacgcccgactaattttttgtatttttttagtagagacagggtttcaccatgttagccaagatggtctcgatctcctgaccttgtgatctgcctgcctcggcctcccaaagtgctaggatcacaggcatgaaccaccacgcccagccacttatttcattttttttaattgcaagaaacatatgaaaccatcagaggatttcaagcaggaaaaagaggtaaggccccattgttggtttttgagaagattgttccctgtgatgtgaagaagatgggtcagaaggagccaaaaggggacacagggagatgagctcaaggcccccagtgatagtcccaggggacagttgatgggggcttacattagcatgcccagctgtgagaaggaatggaaatgggtgggcataagagagttaagtatggagaataaaggcgactcataaatgcccttgatatcctcctagtgcaatgacatgaaggtgtatatctgtttccagaatggaagctgacttttctacgttgcctctccactcatgccagaagccatcctacccaattcctcctttacatactcagggttcttctgtccttcactttgttcagaggttccccaggaac

SEQ ID NO: 277865 - DNA, 475 bp, Homo sapiens
tctccctctgtggcccaggctggagtgcagtggctctatctaggctcactgcaagctccgcctctcgggttcacaccattctcctgcctcagcctcccaagtagctgggaccacaggtacccgccaccacgcccgactaattttttgtatttttttagtagagacagggtttcaccatgttagccaagatggtctcgatctcctgaccttgtgatctgcctgcctcggcctcccaaagtgctaggatcacaggcatgaaccaccacgcccagccacttatttcattttttttaattgcaagaaacatatgaaaccatcagaggatttcaagcaggaaaaagagaagaaaagactgaggcttagaaggccaaagtaatttgcacaaagaatgtatggtggagccagcagtcttactctgcaactgactgacttatttgataagctggatctggccatctgaatttaactggaccat

SEQ ID NO: 277866 - DNA, 621 bp, Homo sapiens
ttctgtccttcactttgttcagaggttccccaggaactttgatccttgacttggagagccttatatatttgttcatagattaacatgattaataagtcagtacattctccagtgaccacaaacaccgggtctataatgtgctctggtcacgataaaattctgggctaaaaagtcatcaaagaagtaccttgtctactgtaactcatgccaacaggacaactaagagattagataataatcattatgattaacacctactgagtacttatgaatataccaggttttctagtttgatgatgaatgtaaacctcacagaactcttatgtcctataatttatctcaattttacagaagaaaagactgaggcttagaaggccaaagtaatttgcacaaagaatgtatggtggagccagcagtcttactctgcaactgactgacttatttgataaggtaatacacatctcacaagcagaagctttatcttctatgaaggaatctttggctccaagccccatgcaccagttaaaggcattgctgagatatcccacagtctcagtgatagccatatttgtcaaactgattattgagattctgattcccttagtgaggggagcatttaat

SEQ ID NO: 277867 - DNA, 1590 bp, Homo sapiens
cggagtgggctgggtggggtggggtgtctctggtctggcaggggtcttaccaggggtcctcttgccaggacgcccagcccaactcgggtctgctgcaggcctcggtcatcaccctctacaccatgtttgtcacctggtcagccctatccagtatccctggtaagtatgggcccaggctcaaggaggcctggcctcgttcctgggtcagtatcagtctactgtggggctggggaccctcacaggtgacagggacatccctgctccagcccattctgagactcagtcctcccatgagatgggagggccccgtctgttcctgagttgtctctctgcccttgtgactgctgagcgctctgttgctgggacttgagtggttggctgtgtatctgtctgtctattaggggtggctctctagccatcctcagggccacttggctacctaggcctggcctgcatgggctgagggtgattgtgctcccatctccagaacagaaatgcaacccccatttgccaacccagctgggcaacgagacagttgtggcaggccccgagggctatgagacccagtggtgggatgccccgagcattgtgggcctcatcatcttcctcctgtgcaccctcttcatcaggtatggccaggtctggattctggggaaggatcgtgattgagggccctgagccagagtgaggggagggtgtgggagccaggataccaaactggaacgtgctcttcacattcaatatatccaggtcttgcattgtgcgggaggggaaactgagtccctcagagggcatggcatgagtgggcaacagaggcaggcgtgaccttgcctcctggctcacagccctttcctgcatactgggccagttcagttgggtgcagacggctgtggggtcagggaaggagcatggactggggtcagtgggtccagggtctgtttctcccctgctgtgcggcttggggtaagtggcttaacctttctgagctcctgtttcctcctcagtaagaggatgacaacctccactgtagtggatgtggctgtgaccccacactctcccccgagagaaggcagctcatgctgaagttcacatagaggttcttttcaaaggggcatcttagtaggtgcttatccatgtggactcaaatgcctgcatttgagcctggcattgccacttactagctatgtgatcctgggcaagtcacttagcctctttgggcctccatttccttgtctgtaaaatagagataaaaatagtaccttcctcattggattgttgaagggctatagatgaatcagtatgtgtaaaacacttagaaaggggccaggcatggtggctcacacctgtagcccccagcactttgggaggccgaggtgggaggatctcttgggcccaggagattgagaccagcctgggcaacatagtaagacgctgtctctttttaaaaattaacaaaacaaaacaaaaacacttagaaaggaacttggcaagtagtaagttatttgtaatccaaacactttgccagactgaagcaggaggattgcttgggcccaggagttcagggccagcctgggcaacatggtgtcccca

SEQ ID NO: 277868 - DNA, 465 bp, Homo sapiens
ataaatataaaagtaaagatagatataataaacaagaagagacaaaaataaaaataaaagcaccataaaacaaccaaaaaccaggctgagcccccacccctgccccagctccaggacctgcccctgagccgggccttctagtcgtagtgccttcagggtccgaggagcatcaggctcctgcagagccccatccccccgccacacccacacggtggagctgcctcttccttcccctcctccctgttgcccatactcagcatctcggatgaaagggctcccttgtcctcaggctccacgggagcggggctgctggagagagcggggaactcccaccacagtggggcatccggcactgaagccctggtgttcctggtcacgtcccccaggggaccctgcccccttcctggacttcgtgccttactgagtctctaagactttttctaataaacaagccagtgcgtgtac

SEQ ID NO: 277869 - DNA, 623 bp, Homo sapiens
taaggtcaggagctccagggtcccaagttcagaggctaggattgaggtcccagaattaggatcacaaggttggagaccaggagtcaggtcatgatctcatggactaacactgggctcaagatgggaatcgaggtcaggagctatgtccacggtcacaaggccgggtgttaaaaatgtcagagatggactggagttacagggtaagagccagagttgaagtcaggggtcataactgggacataaggccaggggccaagatggaagtcaccagactgggcaccaggctcatggggaagatggtgtgttccaggcccggtgagacccggaagatgatcagcacgtggaccgccgtgtgggtgaagatctgtgccagctgggcagggctgctcctctacctgtggaccctggtagccccactcctcctgcgcaaccgcgacttcagctgaggcagcctcacagcctgccatctggtgagagcggggaactcccaccacagtggggcatccggcactgaagccctggtgttcctggtcacgtcccccaggggaccctgcccccttcctggacttcgtgccttactgagtctctaagactttttctaataaacaagccagtgcgtgtac

SEQ ID NO: 277870 - DNA, 1910 bp, Homo sapiens
cggatcccgaggtccgcgccccgccgcgccggcgccgggcgccgaagccgggagccgccgccatgggggcctgcctgggagcctgctccctgctcagctgcgcgtcctgcctctgcggctctgccccctgcatcctgtgcagctgctgccccgccagccgcaactccaccgtgagccgcctcatcttcacgttcttcctcttcctgggggtgctggtgtccatcattatgctgagcccgggcgtggagagtcagctctacaagctgccctgggtgtgtgaggagggggccgggatccccaccgtcctgcagggccacatcgactgtggctccctgcttggctaccgcgctgtctaccgcatgtgcttcgccacggcggccttcttcttctttttcaccctgctcatgctctgcgtgagcagcagccgggacccccgggctgccatccagaatgggttttggttctttaagttcctgatcctggtgggcctcaccgtgggtgccttctacatccctgacggctccttcaccaacatctggttctacttcggcgtcgtgggctccttcctcttcatcctcatccagctggtgctgctcatcgactttgcgcactcctggaaccagcggtggctgggcaaggccgaggagtgcgattcccgtgcctggtacgcaggcctcttcttcttcactctcctcttctacttgctgtcgatcgcggccgtggcgctgatgttcatgtactacactgagcccagcggctgccacgagggcaaggtcttcatcagcctcaacctcaccttctgtgtctgcgtgtccatcgctgctgtcctgcccaaggtccaggacgcccagcccaactcgggtctgctgcaggcctcggtcatcaccctctacaccatgtttgtcacctggtcagccctatccagtatccctgaacagaaatgcaacccccatttgccaacccagctgggcaacgagacagttgtggcaggccccgagggctatgagacccagtggtgggatgccccgagcattgtgggcctcatcatcttcctcctgtgcaccctcttcatcagtctgcgctcctcagaccaccggcaggtgaacagcctgatgcagaccgaggagtgcccacctatgctagacgccacacagcagcagcagcagcaggtggcagcctgtgagggccgggcctttgacaacgagcaggacggcgtcacctacagctactccttcttccacttctgcctggtgctggcctcactgcacgtcatgatgacgctcaccaactggtacaagcccggtgagacccggaagatgatcagcacgtggaccgccgtgtgggtgaagatctgtgccagctgggcagggctgctcctctacctgtggaccctggtagccccactcctcctgcgcaaccgcgacttcagctgaggcagcctcacagcctgccatctggtgcctcctgccacctggtgcctctcggctcggtgacagccaacctgccccctccccacaccaatcagccaggctgagcccccacccctgccccagctccaggacctgcccctgagccgggccttctagtcgtagtgccttcagggtccgaggagcatcaggctcctgcagagccccatccccccgccacacccacacggtggagctgcctcttccttcccctcctccctgttgcccatactcagcatctcggatgaaagggctcccttgtcctcaggctccacgggagcggggctgctggagagagcggggaactcccaccacagtggggcatccggcactgaagccctggtgttcctggtcacgtcccccaggggaccctgcccccttcctggacttcgtgccttactgagtctctaagactttttctaataaacaagccagtgcgtgtac

SEQ ID NO: 277871 - DNA, 2103 bp, Homo sapiens
aggctaaggtacgaggctggtgttaatttggccgaggccgcgccggcgccgggcgccgaagccgggagccgccgccatgggggcctgcctgggagcctgctccctgctcagctgcgcgtcctgcctctgcggctctgccccctgcatcctgtgcagctgctgccccgccagccgcaactccaccgtgagccgcctcatcttcacgttcttcctcttcctgggggtgctggtgtccatcattatgctgagcccgggcgtggagagtcagctctacaagctgccctgggtgtgtgaggagggggccgggatccccaccgtcctgcagggccacatcgactgtggctccctgcttggctaccgcgctgtctaccgcatgtgcttcgccacggcggccttcttcttctttttcaccctgctcatgctctgcgtgagcagcagccgggacccccgggctgccatccagaatgggttttggttctttaagttcctgatcctggtgggcctcaccgtgggtgccttctacatccctgacggctccttcaccaacatctggttctacttcggcgtcgtgggctccttcctcttcatcctcatccagctggtgctgctcatcgactttgcgcactcctggaaccagcggtggctgggcaaggccgaggagtgcgattcccgtgcctggtacgcaggcctcttcttcttcactctcctcttctacttgctgtcgatcgcggccgtggcgctgatgttcatgtactacactgagcccagcggctgccacgagggcaaggtcttcatcagcctcaacctcaccttctgtgtctgcgtgtccatcgctgctgtcctgcccaaggtccaggacgcccagcccaactcgggtctgctgcaggcctcggtcatcaccctctacaccatgtttgtcacctggtcagccctatccagtatccctgaacagaaatgcaacccccatttgccaacccagctgggcaacgagacagttgtggcaggccccgagggctatgagacccagtggtgggatgccccgagcattgtgggcctcatcatcttcctcctgtgcaccctcttcatcagtctgcgctcctcagaccaccggcaggtgaacagcctgatgcagaccgaggagtgcccacctatgctagacgccacacagcagcagcagcagcaggtggcagcctgtgagggccgggcctttgacaacgagcaggacggcgtcacctacagctactccttcttccacttctgcctggtgctggcctcactgcacgtcatgatgacgctcaccaactggtacaagcccggtgagacccggaagatgatcagcacgtggaccgccgtgtgggtgaagatctgtgccagctgggcagggctgctcctctacctgtggaccctggtagccccactcctcctgcgcaaccgcgacttcagctgaggcagcctcacagcctgccatctggtgcctcctgccacctggtgcctctcggctcggtgacagccaacctgccccctccccacaccaatcagccaggctgagcccccacccctgccccagctccaggacctgcccctgagccgggccttctagtcgtagtgccttcagggtccgaggagcatcaggctcctgcagagccccatccccccgccacacccacacggtggagctgcctcttccttcccctcctccctgttgcccatactcagcatctcggatgaaagggctcccttgtcctcaggctccacgggagcggggctgctggagagagcggggaactcccaccacagtggggcatccggcactgaagccctggtgttcctggtcacgtcccccaggggaccctgcccccttcctggacttcgtgccttactgagtctctaagactttttctaataaacaagccagtgcgtgtacaaaaaaaaaaaaaaaaaacttgcggggcctatatttggcggggggggagaagacggggtttgaagttgcgcaattggcacattagcttgttctcttgaacccggttttttgtccaacggtgggaaattctggcgggcccccataagggagcggattaatttcggaaagcggttactgtt

SEQ ID NO: 277872 - DNA, 2040 bp, Homo sapiens
ccacagtggacctgatttccatcggttgcacctggtgaggcacaggccctgctgggctggcctgggggtggagatgttgaggggcagcctgccagccctgtgtgccttggtcaccccatctggcagttgacagtaacagggcctttctcacaatgctgttgggagatgaggcacagttcctggcatatcgtgagtgctccttgtgggaattattgctaacatcaaggaaaggcgtcctgcctctgcggctctgccccctgcatcctgtgcagctgctgccccgccagccgcaactccaccgtgagccgcctcatcttcacgttcttcctcttcctgggggtgctggtgtccatcattatgctgagcccgggcgtggagagtcagctctacaagctgccctgggtgtgtgaggagggggccgggatccccaccgtcctgcagggccacatcgactgtggctccctgcttggctaccgcgctgtctaccgcatgtgcttcgccacggcggccttcttcttctttttcaccctgctcatgctctgcgtgagcagcagccgggacccccgggctgccatccagaatgggttttggttctttaagttcctgatcctggtgggcctcaccgtgggtgccttctacatccctgacggctccttcaccaacatctggttctacttcggcgtcgtgggctccttcctcttcatcctcatccagctggtgctgctcatcgactttgcgcactcctggaaccagcggtggctgggcaaggccgaggagtgcgattcccgtgcctggtacgcaggcctcttcttcttcactctcctcttctacttgctgtcgatcgcggccgtggcgctgatgttcatgtactacactgagcccagcggctgccacgagggcaaggtcttcatcagcctcaacctcaccttctgtgtctgcgtgtccatcgctgctgtcctgcccaaggtccaggacgcccagcccaactcgggtctgctgcaggcctcggtcatcaccctctacaccatgtttgtcacctggtcagccctatccagtatccctgaacagaaatgcaacccccatttgccaacccagctgggcaacgagacagttgtggcaggccccgagggctatgagacccagtggtgggatgccccgagcattgtgggcctcatcatcttcctcctgtgcaccctcttcatcagtctgcgctcctcagaccaccggcaggtgaacagcctgatgcagaccgaggagtgcccacctatgctagacgccacacagcagcagcagcagcaggtggcagcctgtgagggccgggcctttgacaacgagcaggacggcgtcacctacagctactccttcttccacttctgcctggtgctggcctcactgcacgtcatgatgacgctcaccaactggtacaagcccggtgagacccggaagatgatcagcacgtggaccgccgtgtgggtgaagatctgtgccagctgggcagggctgctcctctacctgtggaccctggtagccccactcctcctgcgcaaccgcgacttcagctgaggcagcctcacagcctgccatctggtgcctcctgccacctggtgcctctcggctcggtgacagccaacctgccccctccccacaccaatcagccaggctgagcccccacccctgccccagctccaggacctgcccctgagccgggccttctagtcgtagtgccttcagggtccgaggagcatcaggctcctgcagagccccatccccccgccacacccacacggtggagctgcctcttccttcccctcctccctgttgcccatactcagcatctcggatgaaagggctcccttgtcctcaggctccacgggagcggggctgctggagagagcggggaactcccaccacagtggggcatccggcactgaagccctggtgttcctggtcacgtcccccaggggaccctgcccccttcctggacttcgtgccttactgagtctctaagactttttctaataaacaagccagtgcgtgtac

SEQ ID NO: 277873 - DNA, 1963 bp, Homo sapiens
  misc_feature (244)..(245): n is a, c, g, or t
aggctaaggtacgaggctggtgttaatttggccgaggccgcgccggcgccgggcgccgaagccgggagccgccgccatgggggcctgcctgggagcctgctccctgctcagctgcgcgtcctgcctctgcggctctgccccctgcatcctgtgcagctgctgccccgccagccgcaactccaccgtgagccgcctcatcttcacgttcttcctcttcctgggggtgcctaggtgttcccatccnnattattgcctgatgcccgctgtggcgtttgggaaggaggtcgaaggccttctttaacctagatggctttggctgccctgggtgtgtgaggagggggccgggatccccaccgtcctgcagggccacatcgactgtggctccctgcttggctaccgcgctgtctaccgcatgtgcttcgccacggcggccttcttcttctttttcaccctgctcatgctctgcgtgagcagcagccgggacccccgggctgccatccagaatgggttttggttctttaagttcctgatcctggtgggcctcaccgtgggtgccttctacatccctgacggctccttcaccaacatctggttctacttcggcgtcgtgggctccttcctcttcatcctcatccagctggtgctgctcatcgactttgcgcactcctggaaccagcggtggctgggcaaggccgaggagtgcgattcccgtgcctggtacgcaggcctcttcttcttcactctcctcttctacttgctgtcgatcgcggccgtggcgctgatgttcatgtactacactgagcccagcggctgccacgagggcaaggtcttcatcagcctcaacctcaccttctgtgtctgcgtgtccatcgctgctgtcctgcccaaggtccaggacgcccagcccaactcgggtctgctgcaggcctcggtcatcaccctctacaccatgtttgtcacctggtcagccctatccagtatccctgaacagaaatgcaacccccatttgccaacccagctgggcaacgagacagttgtggcaggccccgagggctatgagacccagtggtgggatgccccgagcattgtgggcctcatcatcttcctcctgtgcaccctcttcatcagtctgcgctcctcagaccaccggcaggtgaacagcctgatgcagaccgaggagtgcccacctatgctagacgccacacagcagcagcagcagcaggtggcagcctgtgagggccgggcctttgacaacgagcaggacggcgtcacctacagctactccttcttccacttctgcctggtgctggcctcactgcacgtcatgatgacgctcaccaactggtacaagcccggtgagacccggaagatgatcagcacgtggaccgccgtgtgggtgaagatctgtgccagctgggcagggctgctcctctacctgtggaccctggtagccccactcctcctgcgcaaccgcgacttcagctgaggcagcctcacagcctgccatctggtgcctcctgccacctggtgcctctcggctcggtgacagccaacctgccccctccccacaccaatcagccaggctgagcccccacccctgccccagctccaggacctgcccctgagccgggccttctagtcgtagtgccttcagggtccgaggagcatcaggctcctgcagagccccatccccccgccacacccacacggtggagctgcctcttccttcccctcctccctgttgcccatactcagcatctcggatgaaagggctcccttgtcctcaggctccacgggagcggggctgctggagagagcggggaactcccaccacagtggggcatccggcactgaagccctggtgttcctggtcacgtcccccaggggaccctgcccccttcctggacttcgtgccttactgagtctctaagactttttctaataaacaagccagtgcgtgtac

SEQ ID NO: 277874 - DNA, 1381 bp, Homo sapiens
cctggtggtgctgctgtcctggtggtgctgctgtcctggtggtgctgctgtcctgctggtgctgctcatcgactttgcgcactcctggaaccagcggtggctgggcaaggccgaggagtgcgattcccgtgcctggtacgcaggcctcttcttcttcactctcctcttctacttgctgtcgatcgcggccgtggcgctgatgttcatgtactacactgagcccagcggctgccacgagggcaaggtcttcatcagcctcaacctcaccttctgtgtctgcgtgtccatcgctgctgtcctgcccaaggtccaggacgcccagcccaactcgggtctgctgcaggcctcggtcatcaccctctacaccatgtttgtcacctggtcagccctatccagtatccctgaacagaaatgcaacccccatttgccaacccagctgggcaacgagacagttgtggcaggccccgagggctatgagacccagtggtgggatgccccgagcattgtgggcctcatcatcttcctcctgtgcaccctcttcatcagtctgcgctcctcagaccaccggcaggtgaacagcctgatgcagaccgaggagtgcccacctatgctagacgccacacagcagcagcagcagcaggtggcagcctgtgagggccgggcctttgacaacgagcaggacggcgtcacctacagctactccttcttccacttctgcctggtgctggcctcactgcacgtcatgatgacgctcaccaactggtacaagcccggtgagacccggaagatgatcagcacgtggaccgccgtgtgggtgaagatctgtgccagctgggcagggctgctcctctacctgtggaccctggtagccccactcctcctgcgcaaccgcgacttcagctgaggcagcctcacagcctgccatctggtgcctcctgccacctggtgcctctcggctcggtgacagccaacctgccccctccccacaccaatcagccaggctgagcccccacccctgccccagctccaggacctgcccctgagccgggccttctagtcgtagtgccttcagggtccgaggagcatcaggctcctgcagagccccatccccccgccacacccacacggtggagctgcctcttccttcccctcctccctgttgcccatactcagcatctcggatgaaagggctcccttgtcctcaggctccacgggagcggggctgctggagagagcggggaactcccaccacagtggggcatccggcactgaagccctggtgttcctggtcacgtcccccaggggaccctgcccccttcctggacttcgtgccttactgagtctctaagactttttctaataaacaagccagtgcgtgtac

SEQ ID NO: 277875 - DNA, 1913 bp, Homo sapiens
cggatcccgaggtccgcgccccgccgcgccggcgccgggcgccgaagccgggagccgccgccatgggggcctgcctgggagcctgctccctgctcagctgcgcgtcctgcctctgcggctctgccccctgcatcctgtgcagctgctgccccgccagccgcaactccaccgtgagccgcctcatcttcacgttcttcctcttcctgggggtgctggtgtccatcattatgctgagcccgggcgtggagagtcagctctacaagctgccctgggtgtgtgaggagggggccgggatccccaccgtcctgcagggccacatcgactgtggctccctgcttggctaccgcgctgtctaccgcatgtgcttcgccacggcggccttcttcttctttttcaccctgctcatgctctgcgtgagcagcagccgggacccccgggctgccatccagaatgggttttggttctttaagttcctgatcctggtgggcctcaccgtgggtgccttctacatccctgacggctccttcaccaacatctggttctacttcggcgtcgtgggctccttcctcttcatcctcatccagctggtgctgctcatcgactttgcgcactcctggaaccagcggtggctgggcaaggccgaggagtgcgattcccgtgcctggtacgcaggcctcttcttcttcactctcctcttctacttgctgtcgatcgcggccgtggcgctgatgttcatgtactacactgagcccagcggctgccacgagggcaaggtcttcatcagcctcaacctcaccttctgtgtctgcgtgtccatcgctgctgtcctgcccaaggtccaggacgcccagcccaactcgggtctgctgcaggcctcggtcatcaccctctacaccatgtttgtcacctggtcagccctatccagtatccctgaacagaaatgcaacccccatttgccaacccagctgggcaacgagacagttgtggcaggccccgagggctatgagacccagtggtgggatgccccgagcattgtgggcctcatcatcttcctcctgtgcaccctcttcatcagtctgcgctcctcagaccaccggcaggtgaacagcctgatgcagaccgaggagtgcccacctatgctagacgccacacagcagcagcagcagcaggtggcagcctgtgagggccgggcctttgacaacgagcaggacggcgtcacctacagctactccttcttccacttctgcctggtgctggcctcactgcacgtcatgatgacgctcaccaactggtacaagcccggtgagacccggaagatgatcagcacgtggaccgccgtgtgggtgaagatctgtgccagctgggcagggctgctcctctacctgtggaccctggtagccccactcctcctgcgcaaccgcgacttcagctgaggcagcctcacagcctgccatctggtgccccccgccacacccacacggtggagctgcctcttccttcccctcctccctgttgcccatactcagcatctcggatgaaagggctcccttgtcctcaggctccacgggagcggggctgctggagagagcggggaactcccaccacagtggggcatccggcactgaagccctggtgttcctggtcacgtcccccaggggaccctgcccccttcctggacttcgtgccttactgagtctctaagactttttctaataaacaagccagtgcgtgtacaaaaaaaaaaaaaaaaaacttgcggggcctatatttggcggggggggagaagacggggtttgaagttgcgcaattggcacattagcttgttctcttgaacccggttttttgtccaacggtgggaaattctggcgggcccccataagggagcggattaatttcggaaagcggttactgtt

SEQ ID NO: 277876 - DNA, 2238 bp, Homo sapiens
cggatcccgaggtccgcgccccgccgcgccggcgccgggcgccgaagccgggagccgccgccatgggggcctgcctgggagcctgctccctgctcagctgcgcgtcctgcctctgcggctctgccccctgcatcctgtgcagctgctgccccgccagccgcaactccaccgtgagccgcctcatcttcacgttcttcctcttcctgggggtgctggtgtccatcattatgctgagcccgggcgtggagagtcagctctacaagctgccctgggtgtgtgaggagggggccgggatccccaccgtcctgcagggccacatcgactgtggctccctgcttggctaccgcgctgtctaccgcatgtgcttcgccacggcggccttcttcttctttttcaccctgctcatgctctgcgtgagcagcagccgggacccccgggctgccatccagaatgggttttggttctttaagttcctgatcctggtgggcctcaccgtgggtgccttctacatccctgacggctccttcaccaacatctggttctacttcggcgtcgtgggctccttcctcttcatcctcatccagctggtgctgctcatcgactttgcgcactcctggaaccagcggtggctgggcaaggccgaggagtgcgattcccgtgcctggtacgcaggcctcttcttcttcactctcctcttctacttgctgtcgatcgcggccgtggcgctgatgttcatgtactacactgagcccagcggctgccacgagggcaaggtcttcatcagcctcaacctcaccttctgtgtctgcgtgtccatcgctgctgtcctgcccaaggtccaggacgcccagcccaactcgggtctgctgcaggcctcggtcatcaccctctacaccatgtttgtcacctggtcagccctatccagtatccctggtaagtatgggcccaggctcaaggaggcctggcctcgttcctgggtcagtatcagtctactgtggggctggggaccctcacaggtgacagggacatccctgctccagcccattctgagactcagtcctcccatgagatgggagggccccgtctgttcctgagttgtctctctgcccttgtgactgctgagcgctctgttgctgggacttgagtggttggctgtgtatctgtctgtctattaggggtggctctctagccatcctcagggccacttggctacctaggcctggcctgcatgggctgagggtgattgtgctcccatctccagaacagaaatgcaacccccatttgccaacccagctgggcaacgagacagttgtggcaggccccgagggctatgagacccagtggtgggatgccccgagcattgtgggcctcatcatcttcctcctgtgcaccctcttcatcagtctgcgctcctcagaccaccggcaggtgaacagcctgatgcagaccgaggagtgcccacctatgctagacgccacacagcagcagcagcagcaggtggcagcctgtgagggccgggcctttgacaacgagcaggacggcgtcacctacagctactccttcttccacttctgcctggtgctggcctcactgcacgtcatgatgacgctcaccaactggtacaagcccggtgagacccggaagatgatcagcacgtggaccgccgtgtgggtgaagatctgtgccagctgggcagggctgctcctctacctgtggaccctggtagccccactcctcctgcgcaaccgcgacttcagctgaggcagcctcacagcctgccatctggtgcctcctgccacctggtgcctctcggctcggtgacagccaacctgccccctccccacaccaatcagccaggctgagcccccacccctgccccagctccaggacctgcccctgagccgggccttctagtcgtagtgccttcagggtccgaggagcatcaggctcctgcagagccccatccccccgccacacccacacggtggagctgcctcttccttcccctcctccctgttgcccatactcagcatctcggatgaaagggctcccttgtcctcaggctccacgggagcggggctgctggagagagcggggaactcccaccacagtggggcatccggcactgaagccctggtgttcctggtcacgtcccccaggggaccctgcccccttcctggacttcgtgccttactgagtctctaagactttttctaataaacaagccagtgcgtgtac

SEQ ID NO: 277877 - DNA, 1205 bp, Homo sapiens
cggatcccgaggtccgcgccccgccgcgccggcgccgggcgccgaagccgggagccgccgccatgggggcctgcctgggagcctgctccctgctcagctgcgcgtcctgcctctgcggctctgccccctgcatcctgtgcagctgctgccccgccagccgcaactccaccgtgagccgcctcatcttcacgttcttcctcttcctgggggtgctggtgtccatcattatgctgagcccgggcgtggagagtcagctctacaagctgccctgggtgtgtgaggagggggccgggatccccaccgtcctgcagggccacatcgactgtggctccctgcttggctaccgcgctgtctaccgcatgtgcttcgccacggcggccttcttcttctttttcaccctgctcatgctctgcgtgagcagcagccgggacccccgggctgccatccagaatgggttttggttctttaagttcctgatcctggtgggcctcaccgtgggtgccttctacatccctgacggctccttcaccaacatctggttctacttcggcgtcgtgggctccttcctcttcatcctcatccagctggtgctgctcatcgactttgcgcactcctggaaccagcggtggctgggcaaggccgaggagtgcgattcccgtgcctggtacgcaggcctcttcttcttcactctcctcttctacttgctgtcgatcgcggccgtggcgctgatgttcatgtactacactgagcccagcggctgccacgagggcaaggtcttcatcagcctcaacctcaccttctgtgtctgcgtgtccatcgctgctgtcctgcccaaggtccaggacgcccagcccaactcgggtctgctgcaggcctcggtcatcaccctctacaccatgtttgtcacctggtcagccctatccagtatccctgaacagaaatgcaacccccatttgccaacccagctgggcaacgagacagttgtggcaggccccgagggctatgagacccagtggtgggatgccccgagcattgtgggcctcatcatcttcctcctgtgcaccctcttcatcagtctgcgctcctcagaccaccggcaggtgaacagcctgatgcagaccgaggagtgcccacctatgctagacgccacacagcagcagcagcaccaccaggacagcagcaccaccaggacacacacatcaagt

SEQ ID NO: 277878 - DNA, 2036 bp, Homo sapiens
cggatcccgaggtccgcgccccgccgcgccggcgccgggcgccgaagccgggagccgccgccatgggggcctgcctgggagcctgctccctgctcagctgcgcgtcctgcctctgcggctctgccccctgcatcctgtgcagctgctgccccgccagccgcaactccaccgtgagccgcctcatcttcacgttcttcctcttcctgggggtgctggtgtccatcattatgctgagcccgggcgtggagagtcagctctacaagctgccctgggtgtgtgaggagggggccgggatccccaccgtcctgcagggccacatcgactgtggctccctgcttggctaccgcgctgtctaccgcatgtgcttcgccacggcggccttcttcttctttttcaccctgctcatgctctgcgtgagcagcagccgggacccccgggctgccatccagaatgggttttggttctttaagttcctgatcctggtgggcctcaccgtgggtgccttctacatccctgacggctccttcaccaacatctggttctacttcggcgtcgtgggctccttcctcttcatcctcatccagctggtgctgctcatcgactttgcgcactcctggaaccagcggtggctgggcaaggccgaggagtgcgattcccgtgcctggtacgcaggcctcttcttcttcactctcctcttctacttgctgtcgatcgcggccgtggcgctgatgttcatgtactacactgagcccagcggctgccacgagggcaaggtcttcatcagcctcaacctcaccttctgtgtctgcgtgtccatcgctgctgtcctgcccaaggtccaggacgcccagcccaactcgggtctgctgcaggcctcggtcatcaccctctacaccatgtttgtcacctggtcagccctatccagtatccctgaacagaaatgcaacccccatttgccaacccagctgggcaacgagacagttgtggcaggccccgagggctatgagacccagtggtgggatgccccgagcattgtgggcctcatcatcttcctcctgtgcaccctcttcatcaggtatggccaggtctggattctggggaaggatcgtgattgagggccctgagccagagtgaggggagggtgtgggagccaggataccaaactggaacgtgctcttcacattcaatatatccaggtcttgcattgtgcgggaggggaaactgagtccctcagagggcatggcatgagtgggcaacagaggcaggcgtgaccttgcctcctggctcacagccctttcctgcatactgggccagttcagttgggtgcagacggctgtggggtcagggaaggagcatggactggggtcagtgggtccagggtctgtttctcccctgctgtgcggcttggggtaagtggcttaacctttctgagctcctgtttcctcctcagtaagaggatgacaacctccactgtagtggatgtggctgtgaccccacactctcccccgagagaaggcagctcatgctgaagttcacatagaggttcttttcaaaggggcatcttagtaggtgcttatccatgtggactcaaatgcctgcatttgagcctggcattgccacttactagctatgtgatcctgggcaagtcacttagcctctttgggcctccatttccttgtctgtaaaatagagataaaaatagtaccttcctcattggattgttgaagggctatagatgaatcagtatgtgtaaaacacttagaaaggggccaggcatggtggctcacacctgtagcccccagcactttgggaggccgaggtgggaggatctcttgggcccaggagattgagaccagcctgggcaacatagtaagacgctgtctctttttaaaaattaacaaaacaaaacaaaaacacttagaaaggaacttggcaagtagtaagttatttgtaatccaaacactttgccagactgaagcaggaggattgcttgggcccaggagttcagggccagcctgggcaacatggtgtcccca

SEQ ID NO: 277879 - DNA, 1464 bp, Homo sapiens
cggagtgggctgggtggggtggggtgtctctggtctggcaggggtcttaccaggggtcctcttgccaggacgcccagcccaactcgggtctgctgcaggcctcggtcatcaccctctacaccatgtttgtcacctggtcagccctatccagtatccctggtaagtatgggcccaggctcaaggaggcctggcctcgttcctgggtcagtatcagtctactgtggggctggggaccctcacaggtgacagggacatccctgctccagcccattctgagactcagtcctcccatgagatgggagggccccgtctgttcctgagttgtctctctgcccttgtgactgctgagcgctctgttgctgggacttgagtggttggctgtgtatctgtctgtctattaggggtggctctctagccatcctcagggccacttggctacctaggcctggcctgcatgggctgagggtgattgtgctcccatctccagaacagaaatgcaacccccatttgccaacccagctgggcaacgagacagttgtggcaggccccgagggctatgagacccagtggtgggatgccccgagcattgtgggcctcatcatcttcctcctgtgcaccctcttcatcagtctgcgctcctcagaccaccggcaggtgaacagcctgatgcagaccgaggagtgcccacctatgctagacgccacacagcagcagcagcagcaggtggcagcctgtgagggccgggcctttgacaacgagcaggacggcgtcacctacagctactccttcttccacttctgcctggtgctggcctcactgcacgtcatgatgacgctcaccaactggtacaagcccggtgagacccggaagatgatcagcacgtggaccgccgtgtgggtgaagatctgtgccagctgggcagggctgctcctctacctgtggaccctggtagccccactcctcctgcgcaaccgcgacttcagctgaggcagcctcacagcctgccatctggtgcctcctgccacctggtgcctctcggctcggtgacagccaacctgccccctccccacaccaatcagccaggctgagcccccacccctgccccagctccaggacctgcccctgagccgggccttctagtcgtagtgccttcagggtccgaggagcatcaggctcctgcagagccccatccccccgccacacccacacggtggagctgcctcttccttcccctcctccctgttgcccatactcagcatctcggatgaaagggctcccttgtcctcaggctccacgggagcggggctgctggagagagcggggaactcccaccacagtggggcatccggcactgaagccctggtgttcctggtcacgtcccccaggggaccctgcccccttcctggacttcgtgccttactgagtctctaagactttttctaataaacaagccagtgcgtgtac

SEQ ID NO: 277880 - DNA, 1053 bp, Homo sapiens
gcaggaggcaccagatggcaggctgtgaggctgcctcagctgaagtcgcggttgcgcaggaggagtggggctaccagggtccacaggtagaggagcagccctacccagctgggcaacgagacagttgtggcaggccccgagggctatgagacccagtggtgggatgccccgagcattgtgggcctcatcatcttcctcctgtgcaccctcttcatcagtctgcgctcctcagaccaccggcaggtgaacagcctgatgcagaccgaggagtgcccacctatgctagacgccacacagcagcagcagcagcaggtggcagcctgtgagggccgggcctttgacaacgagcaggacggcgtcacctacagctactccttcttccacttctgcctggtgctggcctcactgcacgtcatgatgacgctcaccaactggtacaagcccggtgagacccggaagatgatcagcacgtggaccgccgtgtgggtgaagatctgtgccagctgggcagggctgctcctctacctgtggaccctggtagccccactcctcctgcgcaaccgcgacttcagctgaggcagcctcacagcctgccatctggtgcctcctgccacctggtgcctctcggctcggtgacagccaacctgccccctccccacaccaatcagccaggctgagcccccacccctgccccagctccaggacctgcccctgagccgggccttctagtcgtagtgccttcagggtccgaggagcatcaggctcctgcagagccccatccccccgccacacccacacggtggagctgcctcttccttcccctcctccctgttgcccatactcagcatctcggatgaaagggctcccttgtcctcaggctccacgggagcggggctgctggagagagcggggaactcccaccacagtggggcatccggcactgaagccctggtgttcctggtcacgtcccccaggggaccctgcccccttcctggacttcgtgccttactgagtctctaagactttttctaataaacaagccagtgcgtgtac

SEQ ID NO: 277881 - DNA, 1164 bp, Homo sapiens
cggatcccgaggtccgcgccccgccgcgccggcgccgggcgccgaagccgggagccgccgccatgggggcctgcctgggagcctgctccctgctcagctgcgcgtcctgcctctgcggctctgccccctgcatcctgtgcagctgctgccccgccagccgcaactccaccgtgagccgcctcatcttcacgttcttcctcttcctgggggtgctggtgtccatcattatgctgagcccgggcgtggagagtcagctctacaagctgccctgggtgtgtgaggagggggccgggatccccaccgtcctgcagggccacatcgactgtggctccctgcttggctaccgcgctgtctaccgcatgtgcttcgccacggcggccttcttcttctttttcaccctgctcatgctctgcgtgagcagcagccgggacccccgggctgccatccagaatgggttttggttctttaagttcctgatcctggtgggcctcaccgtgggtgccttctacatccctgacggctccttcaccaacatctggttctacttcggcgtcgtgggctccttcctcttcatcctcatccagctggtgctgctcatcgactttgcgcactcctggaaccagcggtggctgggcaaggccgaggagtgcgattcccgtgcctggtacgcaggcctcttcttcttcactctcctcttctacttgctgtcgatcgcggccgtggcgctgatgttcatgtactacactgagcccagcggctgccacgagggcaaggtcttcatcagcctcaacctcaccttctgtgtctgcgtgtccatcgctgctgtcctgcccaaggtccaggacgcccagcccaactcgggtctgctgcaggcctcggtcatcaccctctacaccatgtttgtcacctggtcagccctatccagtatccctgaacagaaatgcaacccccatactcagcatctcggatgaaagggctcccttgtcctcaggctccacgggagcggggctgctggagagagcggggaactcccaccacagtggggcatccggcactgaagccctggtgttcctgataactacacccaggaaaacagaccaaatcatagacttcgtgaccatacgaatctctcagaatttataaaataaaaaaacaagtgcgtgt

SEQ ID NO: 277882 - DNA, 910 bp, Homo sapiens
aaaaataatggctaggtagagcctgggtgttgaatcggccgaggtcatcttcctcctgttgcacctcttcatcagtctgcgctcctcagaccaccggcaggtgaacagcctgatgcagaccgaggagtgcccacctatgctagacgccacacagcagcagcagcagcaggtggcagcctgtgagggccgggcctttgacaacgagcaggacggcgtcacctacagctactccttcttccacttctgcctggtgctggcctcactgcacgtcatgatgacgctcaccaactggtacaagcccggtgagacccggaagatgatcagcacgtggaccgccgtgtgggtgaagatctgtgccagctgggcagggctgctcctctacctgtggaccctggtagccccactcctcctgcgcaaccgcgacttcagctgaggcagcctcacagcctgccatctggtgcctcctgccacctggtgcctctcggctcggtgacagccaacctgccccctccccacaccaatcagccaggctgagcccccacccctgccccagctccaggacctgcccctgagccgggccttctagtcgtagtgccttcagggtccgaggagcatcaggctcctgcagagccccatccccccgccacacccacacggtggagctgcctcttccttcccctcctccctgttgcccatactcagcatctcggatgaaagggctcccttgtcctcaggctccacgggagcggggctgctggagagagcggggaactcccaccacagtggggcatccggcactgaagccctggtgttcctggtcacgtcccccaggggaccctgcccccttcctggacttcgtgccttactgagtctctaagactttttctaataaacaagccagtgcgtgtac

SEQ ID NO: 277883 - DNA, 228 bp, Homo sapiens
gggggagctgtcttgccccgacccatatcctgccctctgtgcgtagctaggggctccctgagggcagggactctgttcttctcagtgtccccggtgcagggtgtagcagaaaacgcttgttgaacgagtagatgtgagagagggaccctcctcgcctcactcccctctccccacccagtctggttctacttcggcgtcgtgggctccttcctcttcatcctcatccag

SEQ ID NO: 277884 - DNA, 1924 bp, Homo sapiens
aggctaaggtacgaggctggtgttaatttggccgaggccgcgccggcgccgggcgccgaagccgggagccgccgccatgggggcctgcctgggagcctgctccctgctcagctgcgcgtcctgcctctgcggctctgccccctgcatcctgtgcagctgctgccccgccagccgcaactccaccgtgagccgcctcatcttcacgttcttcctcttcctgggggtgctggtgtccatcattatgctgagcccgggcgtggagagtcagctctacaagctgccctgggtgtgtgaggagggggccgggatccccaccgtcctgcagggccacatcgactgtggctccctgcttggctaccgcgctgtctaccgcatgtgcttcgccacggcggccttcttcttctttttcaccctgctcatgctctgcgtgagcagcagccgggacccccgggctgccatccagaatgggttttggttctttaagttcctgatcctggtgggcctcaccgtgggtgccttctacatccctgacggctccttcaccaacatctggttctacttcggcgtcgtgggctccttcctcttcatcctcatccagctggtgctgctcatcgactttgcgcactcctggaaccagcggtggctgggcaaggccgaggagtgcgattcccgtgcctggtacgcaggcctcttcttcttcactctcctcttctacttgctgtcgatcgcggccgtggcgctgatgttcatgtactacactgagcccagcggctgccacgagggcaaggtcttcatcagcctcaacctcaccttctgtgtctgcgtgtccatcgctgctgtcctgcccaaggtccaggacgcccagcccaactcgggtctgctgcaggcctcggtcatcaccctctacaccatgtttgtcacctggtcagccctatccagtatccctgaacagaaatgcaacccccatttgccaacccagctgggcaacgagacagttgtggcaggccccgagggctatgagacccagtggtgggatgccccgagcattgtgggcctcatcatcttcctcctgtgcaccctcttcatcagtctgcgctcctcagaccaccggcaggtgaacagcctgatgcagaccgaggagtgcccacctatgctagacgccacacagcagcagcagcagcaggtggcagcctgtgagggccgggcctttgacaacgagcaggacggcgtcacctacagctactccttcttccacttctgcctggtgctggcctcactgcacgtcatgatgacgctcaccaactggtacaagcccggtgagacccggaagatgatcagcacgtggaccgccgtgtgggtgaagatctgtgccagctgggcagggctgctcctctacctgtggaccctggtagccccactcctcctgcgcaaccgcgacttcagctgaggcagcctcacagcctgccatctggtgcctcctgccacctggtgcctctcggctcggtgacagccaacctgccccctccccacaccaatcagccaggctgagcccccacccctgccccagctccaggacctgcccctgagccgggccttctagtcgtagtgccttcagggtccgaggagcatcaggctcctgcagagccccatccccccgccacacccacacggtggagctgcctcttccttcccctcctccctgttgcccatactcagcatctcggatgaaagggctcccttgtcctcaggctccacgggagcggggctgctggagagagcggggaactcccaccacagtggggcatccggcactgaagccctggtgttcctggtcacgtcccccaggggaccctgcccccttcctggacttcgtgccttactgagtctctaagactttttctaataaacaagccagtgcgtgtac

SEQ ID NO: 277885 - DNA, 1928 bp, Homo sapiens
  misc_feature (32)..(32): n is a, c, g, or t
  misc_feature (40)..(40): n is a, c, g, or t
gataggctaggtggagccggtggtatatcggncgaggcgngccgcgccggcgccgggcgccgaagccgggagccgccgccatgggggcctgcctgggagcctgctccctgctcagctgcgcgtcctgcctctgcggctctgccccctgcatcctgtgcagctgctgccccgccagccgcaactccaccgtgagccgcctcatcttcacgttcttcctcttcctgggggtgctggtgtccatcattatgctgagcccgggcgtggagagtcagctctacaagctgccctgggtgtgtgaggagggggccgggatccccaccgtcctgcagggccacatcgactgtggctccctgcttggctaccgcgctgtctaccgcatgtgcttcgccacggcggccttcttcttctttttcaccctgctcatgctctgcgtgagcagcagccgggacccccgggctgccatccagaatgggttttggttctttaagttcctgatcctggtgggcctcaccgtgggtgccttctacatccctgacggctccttcaccaacatctggttctacttcggcgtcgtgggctccttcctcttcatcctcatccagctggtgctgctcatcgactttgcgcactcctggaaccagcggtggctgggcaaggccgaggagtgcgattcccgtgcctggtacgcaggcctcttcttcttcactctcctcttctacttgctgtcgatcgcggccgtggcgctgatgttcatgtactacactgagcccagcggctgccacgagggcaaggtcttcatcagcctcaacctcaccttctgtgtctgcgtgtccatcgctgctgtcctgcccaaggtccaggacgcccagcccaactcgggtctgctgcaggcctcggtcatcaccctctacaccatgtttgtcacctggtcagccctatccagtatccctgaacagaaatgcaacccccatttgccaacccagctgggcaacgagacagttgtggcaggccccgagggctatgagacccagtggtgggatgccccgagcattgtgggcctcatcatcttcctcctgtgcaccctcttcatcagtctgcgctcctcagaccaccggcaggtgaacagcctgatgcagaccgaggagtgcccacctatgctagacgccacacagcagcagcagcagcaggtggcagcctgtgagggccgggcctttgacaacgagcaggacggcgtcacctacagctactccttcttccacttctgcctggtgctggcctcactgcacgtcatgatgacgctcaccaactggtacaagcccggtgagacccggaagatgatcagcacgtggaccgccgtgtgggtgaagatctgtgccagctgggcagggctgctcctctacctgtggaccctggtagccccactcctcctgcgcaaccgcgacttcagctgaggcagcctcacagcctgccatctggtgcctcctgccacctggtgcctctcggctcggtgacagccaacctgccccctccccacaccaatcagccaggctgagcccccacccctgccccagctccaggacctgcccctgagccgggccttctagtcgtagtgccttcagggtccgaggagcatcaggctcctgcagagccccatccccccgccacacccacacggtggagctgcctcttccttcccctcctccctgttgcccatactcagcatctcggatgaaagggctcccttgtcctcaggctccacgggagcggggctgctggagagagcggggaactcccaccacagtggggcatccggcactgaagccctggtgttcctggtcacgtcccccaggggaccctgcccccttcctggacttcgtgccttactgagtctctaagactttttctaataaacaagccagtgcgtgtac

SEQ ID NO: 277886 - DNA, 1853 bp, Homo sapiens
aggctaaggtacgaggctggtgttaatttggccgaggccgcgccggcgccgggcgccgaagccgggagccgccgccatgggggcctgcctgggagcctgctccctgctcagctgcgcgtcctgcctctgcggctctgccccctgcatcctgtgcagctgctgccccgccagccgcaactccaccgtgagccgcctcatcttcacgttcttcctcttcctgggggtgctggtgtccatcattatgctgagcccgggcgtggagagtcagctctacaagctgccctgggtgtgtgaggagggggccgggatccccaccgtcctgcagggccacatcgactgtggctccctgcttggctaccgcgctgtctaccgcatgtgcttcgccacggcggccttcttcttctttttcaccctgctcatgctctgcgtgagcagcagccgggacccccgggctgccatccagaatgggttttggttctttaagttcctgatcctggtgggcctcaccgtgggtgccttctacatccctgacggctccttcaccaacatctggttctacttcggcgtcgtgggctccttcctcttcatcctcatccagctggtgctgctcatcgactttgcgcactcctggaaccagcggtggctgggcaaggccgaggagtgcgattcccgtgcctggtacgcaggcctcttcttcttcactctcctcttctacttgctgtcgatcgcggccgtggcgctgatgttcatgtactacactgagcccagcggctgccacgagggcaaggtcttcatcagcctcaacctcaccttctgtgtctgcgtgtccatcgctgctgtcctgcccaaggtccaggacgcccagcccaactcgggtctgctgcaggcctcggtcatcaccctctacaccatgtttgtcacctggtcagccctatccagtatccctgaacagaaatgcaacccccatttgccaacccagctgggcaacgagacagttgtggcaggccccgagggctatgagacccagtggtgggatgccccgagcattgtgggcctcatcatcttcctcctgtgcaccctcttcatcagtctgcgctcctcagaccaccggcaggtgaacagcctgatgcagaccgaggagtgcccacctatgctagacgccacacagcagcagcagcagcaggtggcagcctgtgagggccgggcctttgacaacgagcaggacggcgtcacctacagctactccttcttccacttctgcctggtgctggcctcactgcacgtcatgatgacgctcaccaactggtacaagcccggtgagacccggaagatgatcagcacgtggaccgccgtgtgggtgaagatctgtgccagctgggcagggctgctcctctacctgtggaccctggtagccccactcctcctgcgcaaccgcgacttcagctgaggcagcctcacagcctgccatctggtgcctcctgccacctggtgcctctcggctcggtgacagccaacctgccccctccccacaccaatcagccaggctgagcccccacccctgccccagctccaggacctgcccctgagccgggccttctagtcgtagtgccttcagggtccgaggagcatcaggctcctgcagagccccatccccccgccacacccacacggtggagctgcctcttccttcccctcctccctgttgcccatactcagcatctcggatgaaagggctcccttgtcctcaggctccacgggagcggggctgctggagagagcggggaactcccaccacagtggggcatccggcactgaagccctggtgttcctgaccaggaacaccagggtcgagc

SEQ ID NO: 277887 - DNA, 1626 bp, Homo sapiens
gcagccgcctactactactaaattcgcggccacatcgactgtggctccctgcttggctaccgcgctgtctaccgcatgtgcttcgccacggcggccttcttcttctttttcaccctgctcatgctctgcgtgagcagcagccgggacccccgggctgccatccagaatgggttttggttctttaagttcctgatcctggtgggcctcaccgtgggtgccttctacatccctgacggctccttcaccaacatctggttctacttcggcgtcgtgggctccttcctcttcatcctcatccagctggtgctgctcatcgactttgcgcactcctggaaccagcggtggctgggcaaggccgaggagtgcgattcccgtgcctggtacgcaggcctcttcttcttcactctcctcttctacttgctgtcgatcgcggccgtggcgctgatgttcatgtactacactgagcccagcggctgccacgagggcaaggtcttcatcagcctcaacctcaccttctgtgtctgcgtgtccatcgctgctgtcctgcccaaggtccaggacgcccagcccaactcgggtctgctgcaggcctcggtcatcaccctctacaccatgtttgtcacctggtcagccctatccagtatccctgaacagaaatgcaacccccatttgccaacccagctgggcaacgagacagttgtggcaggccccgagggctatgagacccagtggtgggatgccccgagcattgtgggcctcatcatcttcctcctgtgcaccctcttcatcagtctgcgctcctcagaccaccggcaggtgaacagcctgatgcagaccgaggagtgcccacctatgctagacgccacacagcagcagcagcagcaggtggcagcctgtgagggccgggcctttgacaacgagcaggacggcgtcacctacagctactccttcttccacttctgcctggtgctggcctcactgcacgtcatgatgacgctcaccaactggtacaagcccggtgagacccggaagatgatcagcacgtggaccgccgtgtgggtgaagatctgtgccagctgggcagggctgctcctctacctgtggaccctggtagccccactcctcctgcgcaaccgcgacttcagctgaggcagcctcacagcctgccatctggtgcctcctgccacctggtgcctctcggctcggtgacagccaacctgccccctccccacaccaatcagccaggctgagcccccacccctgccccagctccaggacctgcccctgagccgggccttctagtcgtagtgccttcagggtccgaggagcatcaggctcctgcagagccccatccccccgccacacccacacggtggagctgcctcttccttcccctcctccctgttgcccatactcagcatctcggatgaaagggctcccttgtcctcaggctccacgggagcggggctgctggagagagcggggaactcccaccacagtggggcatccggcactgaagccctggtgttcctggtcacgtcccccaggggaccctgcccccttcctggacttcgtgccttactgagtctctaagactttttctaataaacaagccagtgcgtgtac

SEQ ID NO: 277888 - DNA, 533 bp, Homo sapiens
aatctgcaacggtgggctgcagtggagagaggggcgtggactgccactgctgcccctcgccctaggtcacccccagctttatcaaatgtcagagcaccaggaatcctccatcatcaatgaggacacagagctgggtgatgcctacgtgttgagatcctggtccctccacacacgctctaccagctgctgcgtgatgcccgtgtccaagatcaggttgtgcagaaggaagttgttgcctggaacaggaggggaggggtgggggtgggggcatcttcttgcagctccttgcccaccctcacccccacccttaaggctccaccaggagcctcctccatgacctggccctggcccaggcccagcccttagcttgtgcctgcttatttccacacctgcccggcctctgggttcctctgggctggccccatgctgcctgggcactgcccagagccagctgccctgccaggcactcacactgcttggagtctggagtcactttctccatgagctcaataaagtttttcaggaactcggtg

SEQ ID NO: 277889 - DNA, 593 bp, Homo sapiens
cgcggggtccggcctcgaggagggggagaggcgcaaaaggctggtcttgtgggccattggtcaactatttggctggcaccgttttttaatctgactgccaacaggtggtgcaaacattcttaattggccacagttcttaccactctcccatcctttcgatgtcatttgttatatgcctggcccctgcagacatgagagttctcaatccctagataagatgtggtttgcaactcttggtgagcctagacctgccttcagaaaaaagatactggtgatcaggactcaaccagactcaccaatcacgatctctctggcacggttctggaaataacctatatgtttacaaaattttgcgggtgattctgatgtgcaataaaaattaaaactggtctaggataaggaccggtggggggcacaaacaagggaaggagcgaagggaaccctcccttttgtacatgcatgccatgtttctactcatgtgtgcacacatagggggaagcattttattccttcccagtctactgtcttcatagccacacagctagcagcatgaactctaaatgcaaagctggcctgccttgctttctgttgct

SEQ ID NO: 277890 - DNA, 568 bp, Homo sapiens
cctgttttctcatcttctttataggactatgaggcttaaatgagacagtacacaactgcctggcacaatgtctggcaaatattaagtgctagataaatggcagctcttgccccttcacactctgccaacccaagattaagggtcccagggtccagctcctggtttcctgcataggaagtccagcagtttggaatttccctggtcgccagcatcattaatataacgaatacttcctttgctctttcagacaaagatgataagtcagttgtagcatccatcaccgagagtctgcagaagaaatcaaagcacctcatgtgagctccagccaagcccaggcatcaggaggctgttatgatgtggagtttcttggcctgtcctctgcatggcccagtgtaggaagcccagtttgctctctggtgtttgttaatgtaaacattcagtgaagggatggggcaataaacgtaactcatcctttcccgttcctgagggtgatatacagcagggaccaaggggatggatgtgattgcatgatagggaatcccagacctggacccctgaaagcctagtc

SEQ ID NO: 277891 - DNA, 482 bp, Homo sapiens
cctgttttctcatcttctttataggactatgaggcttaaatgagacagtacacaactgcctggcacaatgtctggcaaatattaagtgctagataaatggcagctcttgccccttcacactctgccaacccaagattaagggtcccagggtccagctcctggtttcctgcataggaagtccagcagtttggaatttccctggtcgccagcatcattaatataacgaatacttcctttgctctttcagacaaagatgataagtcagttgtagcatccatcaccgagagtctgcagaagaaatcaaagcacctcatgtgagctccagccaagcccaggcatcaggaggctgttatgatgtggagtttcttggcctgtcctctgcatggcccagtgtaggaagcccagtttgctctctggtgtttgttaatgtaaacattcagtgaagggatggggcaataaacgtaactcatcctttcccgttc

SEQ ID NO: 277892 - DNA, 803 bp, Homo sapiens
ctcggaatgaaatcggtgacagtgagccacttgactccagggacacctggctcatcaataaggaccagatccaggacctgagcgccaagctcaagccctacgagaagaaggactggcgccacgcgccgcgcttcgtgacgcccctcaagccacacacggtgctccgcggccaggactgcaccatgacctgcgccttccttgggaacccgcggcccacagtgaccctctacaagggcgacgtcaacatcacggccaactccaagttctggtacaactccaccagcggcgtgtgcaccctcgtcatccccacctgcacgctcaaggacagcggcgattacagcgtgctggtggagaacgagctgggcaaggaccgcagcagctgcacgctcaccgtctatgacatgagagttctcaatccctagataagatgtggtttgcaactcttggtgagcctagacctgccttcagaaaaaagatactggtgatcaggactcaaccagactcaccaatcacgatctctctggcacggttctggaaataacctatatgtttacaaaattttgcgggtgattctgatgtgcaataaaaattaaaactggtctaggataaggaccggtggggggcacaaacaagggaaggagcgaagggaaccctcccttttgtacatgcatgccatgtttctactcatgtgtgcacacatagggggaagcattttattccttcccagtctactgtcttcatagccacacagctagcagcatgaactctaaatgcaaagctggcctgccttgctttctgttgct

SEQ ID NO: 277893 - DNA, 339 bp, Homo sapiens
cctgttttctcatcttctttataggactatgaggcttaaatgagacagtacacaactgcctggcacaatgtctggcaaatattaagtgctagataaatggcagctcttgccccttcacactctgccaacccaagattaagggtcccagggtccagctcctggtttcctgcataggaagtccagcagtttggaatttccctggtcgccagcatcattaatataacgaatacttcctttgctctttcagacaaagatgataagtcagttgtagcatccatcaccgagagtctgcagaagaaatcaaagcacctcatgtccccgtacatcgttagaagcttg

SEQ ID NO: 277894 - DNA, 634 bp, Homo sapiens
ctcggaatgaaatcggtgacagtgagccacttgactccagggacacctggctcatcaataaggaccagatccaggacctgagcgccaagctcaagccctacgagaagaaggactggcgccacgcgccgcgcttcgtgacgcccctcaagccacacacggtgctccgcggccaggactgcaccatgacctgcgccttccttgggaacccgcggcccacagtgaccctctacaagggcgacgtcaacatcacggccaactccaagttctggtacaactccaccagcggcgtgtgcaccctcgtcatccccacctgcacgctcaaggacagcggcgattacagcgtgctggtggagaacgagctgggcaaggaccgcagcagctgcacgctcaccgtctatgacaaagatgataagtcagttgtagcatccatcaccgagagtctgcagaagaaatcaaagcacctcatgtgagctccagccaagcccaggcatcaggaggctgttatgatgtggagtttcttggcctgtcctctgcatggcccagtgtaggaagcccagtttgctctctggtgtttgttaatgtaaacattcagtgaagggatggggcaataaacgtaactcatcctttcccgttc

SEQ ID NO: 277895 - DNA, 3015 bp, Homo sapiens
gggtaagagaagactggaagcatgtcggagtttggttaatttctgcccctggcgataaggaaaatttgcaagctctggagaggatgaatactgtaacctccaagtccaacctgtcttataataccaaattcgctattcctgacttcaaggtggggaccttggattccctggttggcctctctgatgagttggggaaactcgacacctttgctgaaagcctcataaggagaatggctcagagcgtggtggaagtcatggaggactcaaaggggaaggtccaggagcacctcctggcaaacggagttgacttaacatcctttgtgacccactttgaatgggacatggccaaatatcctgtcaagcagccgctcgtgagtgtggtggacacaatagccaagcaactggcgcagatcgagatggacctgaagtcccgaacggccgcctacaacactctgaagacaaacctggagaacctggaaaagaaatccatggggaacctcttcacccggacactgagtgatattgtgagcaaagaggacttcgtgctggattctgaatatctcgtcacacttctggtcatcgtccccaaaccaaactactcacaatggcaaaaaacctacgaatctctctcagacatggtggtccctcgatcaaccaaactcattactgaggacaaggaagggggccttttcactgtgactctgtttcgaaaagtgattgaagatttcaaaaccaaggccaaagaaaacaagttcacctgttcgtgaattttactatgatgagaaggaaattgaaagggaaagggaggagatggccagattgctgtctgataagaagcaacagtatggccccctgctgcgctggctcaaggtgaacttcagtgaagccttcattgcctggatccacatcaaggccctgagagtgtttgtggagtccgtgctcaggtatggactaccagtgaacttccaggcagtgctcctgcagccgcataagaagtcatccaccaagcgtttaagagaggttctaaactctgtcttccgacatctggatgaagtagccgctacaagtatactggatgcatctgtggagatcccgggactgcaactcaataaccaagactattttccttatgtctacttccatattgaccttagtcttcttgactagaaaggccagctggcacctctgtctcatgttcgtgcagattattacagacacctctttcctttagccagagaatggttcaaatgtcttacagaactaagatctttttcagagaaattgctcacaaaagttagtgacagttgtatttatttttttaagttacaataaaatgctctcaagtcctttgaatgttccaacaaattcaaaacttcattttctgaatgttttacataaatgcgaactacctgttcgcattggtaacctgctgctgtatttcatgtcttaacggctattttgaggttcattaacaacatagaaagccttgaactgtataaccagctagattccttaataattagtcactagagacagcccaaagacaaatattgggcaggaaatcagttctcactgagcccggtttccatgtaaaatctctgttgtggtgggcataggtggcaccatctaaagaaaagaggtcttgttttttgtttaaaaaagtttgtggggaggaaagacatctgtgtatcacttcaaaatattgatttactgctaaacatcactctgaatttatgatgtggatactaacttcatacatttatcggcattgtccaaaatattttattctttaatggaaaaagccattaatattcaaatgaagggatcacattaaaaaaaacccatacataagaaacagcctccaagaacattcaagcagcagtcagagagaaaaatgtttcgacagccaagttttcttcaaaatattatgtgacagaatacgactcaattcaccggctacaacaattcatagaatttttcaatgttttcttgagatgcaaaagttcactgttgcagtgttttcaaatgaccaatcaagtactacttcttggttaaaaggccactggtagagtcatctgagtgtagagaatgtcccttcactgctggaaaaatccactggctcccaagaaaagaaaatggtctgaagcctctgttgtggctctcacaactcatctttccctaagtcatcaagctccacatcactgaggtcaatgtcatcctccacgggaagctgggagacgacagaaagccactgttagatctgcagaaggggacaccctggaaggtcaacatctcattttatggaagagcgactctctggagctactcctgctacaatccaggttctcctcagtctgactcctaccctgaccttcgtacctatgattatacggatggaaaagctcagaactcaggtgaaacatttcaacatcacatcactcaccattttaacactggaagccacttgaacgtgtccttttgaggagggtgggacacaacagtacagaaataagtgctaatttcaaagctatcattttctatttttctaagataaagtaaatgaattccaggttaaatgttcactttaaggtaataatcaggaaagcaaccttactactgaaatgtatcttggctgtcaagagtatcaaatgccatgcagcacttaaacttgtgataaggaagatgaagggtcttcagagaagaacctcttaaaaggcccacgggtgcaccagggctgaggtctgatgggaaggacttgactccaggtgcagagatgcacaggctcaagagagtaaaccaggactgctgcccgcacagcttccctcccgggcactcacctcgccatccctgccgtcccaaggctctctctcaacgatggtagggaaagccccgcctcctacaggtgccgtggagccacgcccaaaagagagctcccttagggaaaaatgaccaaaacacacacacacatttacaatggactgctggtgcagaagaataaacaactttaaaaataaa

SEQ ID NO: 277896 - DNA, 769 bp, Homo sapiens
ttcaggcgatgagaatgatttatttgtttgtgatgcatgtttgctgaaagattaataaatcatttctgtgcctttagcaaacttcctgtgttgctcttaaaaagggatcatccaccttccctgaccttcgtacctatgattatacggatggaaaagctcagaactcaggtgaaacatttcaacatcacatcactcaccattttaacactggaagccacttgaacgtgtccttttgaggagggtgggacacaacagtacagaaataagtgctaatttcaaagctatcattttctatttttctaagataaagtaaatgaattccaggttaaatgttcactttaaggtaataatcaggaaagcaaccttactactgaaatgtatcttggctgtcaagagtatcaaatgccatgcagcacttaaacttgtgataaggaagatgaagggtcttcagagaagaacctcttaaaaggcccacgggtgcaccagggctgaggtctgatgggaaggacttgactccaggtgcagagatgcacaggctcaagagagtaaaccaggactgctgcccgcacagcttccctcccgggcactcacctcgccatccctgccgtcccaaggctctctctcaacgatggtagggaaagccccgcctcctacaggtgccgtggagccacgcccaaaagagagctcccttagggaaaaatgaccaaaacacacacacacatttacaatggactgctggtgcagaagaataaacaactttaaaaataaa

SEQ ID NO: 277897 - DNA, 326 bp, Homo sapiens
gccctgccagcctccctgtccctggaggggaggaggcagcagctgtggccccagcacagagcctggccctggggttgtggggagcaatcattgctgagaattgctgtgttctcctaggctccagcatccctggcacccacccttccttgagaactgcccccagtgcccgggtgtgggtgtgtgtggggtcactgtgtccctttctgctcacatctttcacaccctttgttccacctgccttttagggggaacctcttcacccggacactgagtgatattgtgagcaaagaggacttcgtgctggattctgaatatctcgtcacact

SEQ ID NO: 277898 - DNA, 3153 bp, Homo sapiens
gggtaagagaagactggaagcatgtcggagtttggttaatttctgcccctggcgataaggaaaatttgcaagctctggagaggatgaatactgtaacctccaagtccaacctgtcttataataccaaattcgctattcctgacttcaaggtggggaccttggattccctggttggcctctctgatgagttggggaaactcgacacctttgctgaaagcctcataaggagaatggctcagagcgtggtggaagtcatggaggactcaaaggggaaggtccaggagcacctcctggcaaacggagttgacttaacatcctttgtgacccactttgaatgggacatggccaaatatcctgtcaagcagccgctcgtgagtgtggtggacacaatagccaagcaactggcgcagatcgagatggacctgaagtcccgaacggccgcctacaacactctgaagacaaacctggagaacctggaaaagaaatccatggggaacctcttcacccggacactgagtgatattgtgagcaaagaggacttcgtgctggattctgaatatctcgtcacacttctggtcatcgtccccaaaccaaactactcacaatggcaaaaaacctacgaatctctctcagacatggtggtccctcgatcaaccaaactcattactgaggacaaggaagggggccttttcactgtgactctgtttcgaaaagtgattgaagatttcaaaaccaaggccaaagaaaacaagttcacctgttcgtgaattttactatgatgagaaggaaattgaaagggaaagggaggagatggccagattgctgtctgataagaagcaacagtatcaaacttcctgtgttgctcttaaaaagggatcatccaccttcccggaccacaaggttaaggtaaccccgctaggtaaccctgataggcctgctgcggggcagaccgacagagagagagagagtgagggcgagggtgagggccccctgctgcgctggctcaaggtgaacttcagtgaagccttcattgcctggatccacatcaaggccctgagagtgtttgtggagtccgtgctcaggtatggactaccagtgaacttccaggcagtgctcctgcagccgcataagaagtcatccaccaagcgtttaagagaggttctaaactctgtcttccgacatctggatgaagtagccgctacaagtatactggatgcatctgtggagatcccgggactgcaactcaataaccaagactattttccttatgtctacttccatattgaccttagtcttcttgactagaaaggccagctggcacctctgtctcatgttcgtgcagattattacagacacctctttcctttagccagagaatggttcaaatgtcttacagaactaagatctttttcagagaaattgctcacaaaagttagtgacagttgtatttatttttttaagttacaataaaatgctctcaagtcctttgaatgttccaacaaattcaaaacttcattttctgaatgttttacataaatgcgaactacctgttcgcattggtaacctgctgctgtatttcatgtcttaacggctattttgaggttcattaacaacatagaaagccttgaactgtataaccagctagattccttaataattagtcactagagacagcccaaagacaaatattgggcaggaaatcagttctcactgagcccggtttccatgtaaaatctctgttgtggtgggcataggtggcaccatctaaagaaaagaggtcttgttttttgtttaaaaaagtttgtggggaggaaagacatctgtgtatcacttcaaaatattgatttactgctaaacatcactctgaatttatgatgtggatactaacttcatacatttatcggcattgtccaaaatattttattctttaatggaaaaagccattaatattcaaatgaagggatcacattaaaaaaaacccatacataagaaacagcctccaagaacattcaagcagcagtcagagagaaaaatgtttcgacagccaagttttcttcaaaatattatgtgacagaatacgactcaattcaccggctacaacaattcatagaatttttcaatgttttcttgagatgcaaaagttcactgttgcagtgttttcaaatgaccaatcaagtactacttcttggttaaaaggccactggtagagtcatctgagtgtagagaatgtcccttcactgctggaaaaatccactggctcccaagaaaagaaaatggtctgaagcctctgttgtggctctcacaactcatctttccctaagtcatcaagctccacatcactgaggtcaatgtcatcctccacgggaagctgggagacgacagaaagccactgttagatctgcagaaggggacaccctggaaggtcaacatctcattttatggaagagcgactctctggagctactcctgctacaatccaggttctcctcagtctgactcctaccctgaccttcgtacctatgattatacggatggaaaagctcagaactcaggtgaaacatttcaacatcacatcactcaccattttaacactggaagccacttgaacgtgtccttttgaggagggtgggacacaacagtacagaaataagtgctaatttcaaagctatcattttctatttttctaagataaagtaaatgaattccaggttaaatgttcactttaaggtaataatcaggaaagcaaccttactactgaaatgtatcttggctgtcaagagtatcaaatgccatgcagcacttaaacttgtgataaggaagatgaagggtcttcagagaagaacctcttaaaaggcccacgggtgcaccagggctgaggtctgatgggaaggacttgactccaggtgcagagatgcacaggctcaagagagtaaaccaggactgctgcccgcacagcttccctcccgggcactcacctcgccatccctgccgtcccaaggctctctctcaacgatggtagggaaagccccgcctcctacaggtgccgtggagccacgcccaaaagagagctcccttagggaaaaatgaccaaaacacacacacacatttacaatggactgctggtgcagaagaataaacaactttaaaaataaa

SEQ ID NO: 277899 - DNA, 903 bp, Homo sapiens
cttcaggaaaatttttttttaaagcaacgaaaaaactgactccatagaaactgagataaaacttgaaactagggatagggtggagagagaaacagaacacttcaatttagtatctccataaatactggagagaataaataaaaacaaaaagttgaatagaaactaaaattgagaaaactgcctagagtacaaaaaaatgacaaagacaaaaaatacaacagagcaagaccctgtctcttaaaagaatttaaaaaaaaaaaaaaggatacataaataccactgtttcaactgcctatagtaacacgctatacagctttacaccctagaagcaacaggctatactatataggctaggcatgcagtacactatgccatctaggtttgtataagtactacgctaaatgtttcaagacacagattatcattaaactacagactacattagaatgctgtgttttccaacagctttatcaccaccaagtgatgttttgacaaagagggggctagccaacttctcatgtattttccatccagtctaatgcatccatgcatcttttttttggcaatatgaacataatactctttccaactacaaggatacttcaaaattcaccgtgctatttccgattttaaccctataaatgtctccagtcaaagtcaatgggagaaatcttgccacaactaatatataatagatttcacactgaagttatttttcctcttcccatcaggacagaattatcttaattaccttagttttcagtaagtttgagtattattaactaggagtaaatctgctacataaaaatataaagcagacatattttaaaaccacagttttatactagcaattcataattcacttttccaataatcaagatccaaagaattattccccgtttt

SEQ ID NO: 277900 - DNA, 1170 bp, Homo sapiens
acccaagcattttcaccagggcaggaatgcctccagacttaaagatggccagtaagccctcacgatgatgggaaaggttatgcaaggtcccagcggtacaacgagctgtttctacatcatttgtattctgcatggacttgggaggtatccacatcctcttcctcaggattgcctttaccactcagagaaggagctgtggtagtggcaccagaatggattccagagtccaggtaaacaagccaggcgaagtggcttgtaattctaacactttgggaggcgggtggattgctgcagcacaagagttccaagaccagcctggacaacacagcgaaattccatctctacaaaaaaatgttaaaaattagccaggtgtggtagtatgtgcctgtagtcctagccactggggaggctgaggcaaagaggatcacttaggagttcaaggttatagtgagctatgatcacaccaatgcatccagcctgggcaacagagcaagaccctgtctcttaaaagaatttaaaaaaaaaaaaaaggatacataaataccactgtttcaactgcctatagtaacacgctatacagctttacaccctagaagcaacaggctatactatataggctaggcatgcagtacactatgccatctaggtttgtataagtactacgctaaatgtttcaagacacagattatcattaaactacagactacattagaatgctgtgttttccaacagctttatcaccaccaagtgatgttttgacaaagagggggctagccaacttctcatgtattttccatccagtctaatgcatccatgcatcttttttttggcaatatgaacataatactctttccaactacaaggatacttcaaaattcaccgtgctatttccgattttaaccctataaatgtctccagtcaaagtcaatgggagaaatcttgccacaactaatatataatagatttcacactgaagttatttttcctcttcccatcaggacagaattatcttaattaccttagttttcagtaagtttgagtattattaactaggagtaaatctgctacataaaaatataaagcagacatattttaaaaccacagttttatactagcaattcataattcacttttccaataatcaagatccaaagaattattccccgtttt

SEQ ID NO: 277901 - DNA, 1202 bp, Homo sapiens
acccaagcattttcaccagggcaggaatgcctccagacttaaagatggccagtaagccctcacgatgatgggaaaggttatgcaaggtcccagcggtacaacgagctgtttctacatcatttgtattctgcatggacttgggaggtatccacatcctcttcctcaggattgcctttaccactcagagaaggagctgtggtagtggcaccagaatggattccagagtccagaaaaattcacagatcccctttggataacagaggtaaacaagccaggcgaagtggcttgtaattctaacactttgggaggcgggtggattgctgcagcacaagagttccaagaccagcctggacaacacagcgaaattccatctctacaaaaaaatgttaaaaattagccaggtgtggtagtatgtgcctgtagtcctagccactggggaggctgaggcaaagaggatcacttaggagttcaaggttatagtgagctatgatcacaccaatgcatccagcctgggcaacagagcaagaccctgtctcttaaaagaatttaaaaaaaaaaaaaaggatacataaataccactgtttcaactgcctatagtaacacgctatacagctttacaccctagaagcaacaggctatactatataggctaggcatgcagtacactatgccatctaggtttgtataagtactacgctaaatgtttcaagacacagattatcattaaactacagactacattagaatgctgtgttttccaacagctttatcaccaccaagtgatgttttgacaaagagggggctagccaacttctcatgtattttccatccagtctaatgcatccatgcatcttttttttggcaatatgaacataatactctttccaactacaaggatacttcaaaattcaccgtgctatttccgattttaaccctataaatgtctccagtcaaagtcaatgggagaaatcttgccacaactaatatataatagatttcacactgaagttatttttcctcttcccatcaggacagaattatcttaattaccttagttttcagtaagtttgagtattattaactaggagtaaatctgctacataaaaatataaagcagacatattttaaaaccacagttttatactagcaattcataattcacttttccaataatcaagatccaaagaattattccccgtttt

SEQ ID NO: 277902 - DNA, 474 bp, Homo sapiens
aaacgaaggccatattgtccataaatgtcatttttttcatcaaagacaccagggcagatttttaagtaaagaaagacaattggacccttaagaatttatgcatttgtaaagttgctgttgatccaaatattttcaagccatgtaatccattggttttgtgggcagtttaataaacctgaacctttgtgtgttttctaattgtacctgagttgaccatcctttctttttatagtatatttcttgtatgatattttgtaaagctctcacctggttcttttatggggacttttcgtttttgggcaactccagtgtatttatgtgaaactttataagagaattaatttttccatttgcatattaatatgttcctccacacatgtaaaggcacagtggctccgtgtgttaaaaaacagctgtattttatgtatgctttactgataagtgtgccaataataaactgtgttaatgaccaaa

SEQ ID NO: 277903 - DNA, 773 bp, Homo sapiens
ccttcttcataggaattattggaagcctgtattttcttgcttcttgtttatttcttaagtatttgcttgtccttgatagaatataagccccatgagggcagggacctgattgtcttacacatcattgcatccccagtgccctatatagcacatggctgatgtgcaaaatattacctattgaataaagaaaattaagttgttccagcactggccatcctgacgctaaaattttccccaagtcttaccaacaattgcctacagttccagtaggagaagaatctgtgagcctaatagcccagtgagcattcactgctagaacgcacgtccagcccaaaggaaaaagaagccctgagagaacaaaatttcttctatgaagggagtgttgacctgactattttgccctctggatagtgcaaatctgttgggaatctcctgacttctgattaaaaatatttatacttatcctagtgtttcttttctcatttgatatttctgctacttctgtctctctatatctacctgggagcccacagccgtgaattacggtatgaatcatgataatatgttacatttcctggagcactttgcattttaggtaagtgctttcggggccattaatcagcttatttgaagtgatttgcacaacagaaaatatgggaagttctatcagtatatgatgctgtggtctgtaataactttgtgtttgctaactggtgtatgtatgtgtgtgtgtgtgtgtgtgtcatgtgtgtgagagagagagagagagagac

SEQ ID NO: 277904 - DNA, 2867 bp, Homo sapiens
  misc_feature (1)..(1): n is a, c, g, or t
ncccgtgctccctccctccctccctctttccctccctcctctcctctccctctcctctcctgctatagagggctccgacagcagttcccagccagcgtgttcagcctgcctgcctgcctgcctctgtgtgtgtgtgagcgtgtgtgcgtgcgtctactttgtactgggaagaacacagcccatgtgctctgcatggacgttactgatactctgtttagcttgattttcgaaaagcaggcaagatgtccagcacaccacatgaccccttctattcttctcctttcggcccattttataggaggcatacaccatacatggtacagccagagtaccgaatctatgagatgaacaagagactgcagtctcgcacagaggatagtgacaacctctggtgggacgcctttgccactgaattttttgaagatgacgccacattaaccctttcattttgtttggaagatggaccaaagcgatacactatcggcaggaccctcatcccccgttactttagcactgtgtttgaaggaggggtgaccgacctgtattacattctcaaacactcgaaagagtcataccacaactcatccatcacggtggactgcgaccagtgtaccatggtcacccagcacgggaagcccatgtttaccaaggtatgtacagaaggcagactgatcttggagttcacctttgatgatctcatgagaatcaaaacatggcactttaccattagacaataccgagagttagtcccgagaagcatcctagccatgcatgcacaagatcctcaggtcctggatcagctgtccaaaaacatcaccaggatggggctaacaaacttcaccctcaactacctcaggttgtgtgtaatattggagccaatgcaggaactgatgtcgagacataaaacttacaacctcagtccccgagactgcctgaagacctgcttgtttcagaagtggcagaggatggtggctccgccagcagaacccacaaggcaaccaacaaccaaacggagaaaaaggaaaaattccaccagcagcacttccaacagcagcgctgggaacaatgcaaacagcactggcagcaagaagaagaccacagctgcaaacctgagtctgtccagtcaggtacctgggctaggagcgatcccgaactgcagcctcaaccctgggagggatggagacctgtgtcattcaacagcagtgaccccttctggccaatttaaggagaagcattgaggggccctgaaaggagtcacttccagtcctcctcagagattgctagcattgctcgttctccagtgtcaggctgcgcactaaggacataaactcgcgtggttgttacacatcaggaggcgatgtttatttcctgtagaaatcaaatatgcgtctcggcccccgacattgagacttgaccccgttgtacagtacacgagtgtgtctgtcctagattccccgactcctcccactgttattttaagctgagcttctctctcccaaggtttccctgtaataatgtcagctgctgttcacaggatgtgatggtggtaggagagccaactctgatgggaggtgagtttggggacgaggacgaaaggctaatcactagattagaaaacacgcaatatgatgcggccaacggcatggacgacgaggaggacttcaacaattcacccgcgctggggaacaacagcccgtggaacagtaaacctcccgccactcaagagaccaaatcagaaaaccccccaccccaggcttcccaataagatgatcggcaccagaatccactgtcaataggcccgtgggtgatcattacaattgcaaatctttacttacaggagaggaaacagaagagataaaaacttttccatgcaaatatctatttctaaaccacaatgatctgattttctttcttctttctttttttctaattgagaggattattcccaataagcttccatgaccctttcttggaggccttcacaggtaatacagatactggcactgattgtaattaaaatgagagaaaactctagcgcatcttctggcacggttttaacaacgtgtttgtgttgaatttcctttttatgcatcaaacgaaggccatattgtccataaatgctcagtgctcaggatctcattaatatgccgaacctaactacagatgactttttaatattgtaaaatattttctgctttttgacttgcatctgagagtttcttgtttcagtaaaaaaagaaaagacaaaaaaatcagctttggaaagtaatttaaatgtaccttattttttttttctttatgttttctttcattgggcaacagctaagagggcccagcaaggtaatttatggttgagctgatgtcaattggttcttgtcttgagtcgactcaatttagcccaagtgctgaaacaagaaatgtcatttttttcatcaaagacaccagggcagatttttaagtaaagaaagacaattggacccttaagaatttatgcatttgtaaagttgctgttgatccaaatattttcaagccatgtaatccattggttttgtgggcagtttaataaacctgaacctttgtgtgttttctaattgtacctgagttgaccatcctttctttttatagtatatttcttgtatgatattttgtaaagctctcacctggttcttttatggggacttttcgtttttgggcaactccagtgtatttatgtgaaactttataagagaattaatttttccatttgcatattaatatgttcctccacacatgtaaaggcacagtggctccgtgtgttaaaaaacagctgtattttatgtatgctttactgataagtgtgccaataataaactgtgttaatgaccaaa

SEQ ID NO: 277905 - DNA, 2915 bp, Homo sapiens
ccttcttcataggaattattggaagcctgtattttcttgcttcttgtttatttcttaagtatttgcttgtccttgatagaatataagccccatgagggcagggacctgattgtcttacacatcattgcatccccagtgccctatatagcacatggctgatgtgcaaaatattacctattgaataaagaaaattaagttgttccagcactggccatcctgacgctaaaattttccccaagtcttaccaacaattgcctacagttccagtaggagaagaatctgtgagcctaatagcccagtgagcattcactgctagaacgcacgtccagcccaaaggaaaaagaagccctgagagaacaaaatttcttctatgaagggagtgttgacctgactattttgccctctggatagtgcaaatctgttgggaatctcctgacttctgattaaaaatatttatacttatcctagtgtttcttttctcatttgatatttctgctacttctgtctctctatatctacctgggagcccacagccgtgaattacggtatgaatcatgataatatgttacatttcctggagcactttgcattttaggtgccacatcattgggaactatgatgatgatgacgacgatgacgacgatacacttattctggattctatcagcaaattaaataatgatagtgacaacctctggtgggacgcctttgccactgaattttttgaagatgacgccacattaaccctttcattttgtttggaagatggaccaaagcgatacactatcggcaggaccctcatcccccgttactttagcactgtgtttgaaggaggggtgaccgacctgtattacattctcaaacactcgaaagagtcataccacaactcatccatcacggtggactgcgaccagtgtaccatggtcacccagcacgggaagcccatgtttaccaaggtatgtacagaaggcagactgatcttggagttcacctttgatgatctcatgagaatcaaaacatggcactttaccattagacaataccgagagttagtcccgagaagcatcctagccatgcatgcacaagatcctcaggtcctggatcagctgtccaaaaacatcaccaggatggggctaacaaacttcaccctcaactacctcaggttgtgtgtaatattggagccaatgcaggaactgatgtcgagacataaaacttacaacctcagtccccgagactgcctgaagacctgcttgtttcagaagtggcagaggatggtggctccgccagcagaacccacaaggcaaccaacaaccaaacggagaaaaaggaaaaattccaccagcagcacttccaacagcagcgctgggaacaatgcaaacagcactggcagcaagaagaagaccacagctgcaaacctgagtctgtccagtcaggtacctgggctaggagcgatcccgaactgcagcctcaaccctgggagggatggagacctgtgtcattcaacagcagtgaccccttctggccaatttaaggagaagcattgaggggccctgaaaggagtcacttccagtcctcctcagaggatgtgatggtggtaggagagccaactctgatgggaggtgagtttggggacgaggacgaaaggctaatcactagattagaaaacacgcaatatgatgcggccaacggcatggacgacgaggaggacttcaacaattcacccgcgctggggaacaacagcccgtggaacagtaaacctcccgccactcaagagaccaaatcagaaaaccccccaccccaggcttcccaataagatgatcggcaccagaatccactgtcaataggcccgtgggtgatcattacaattgcaaatctttacttacaggagaggaaacagaagagataaaaacttttccatgcaaatatctatttctaaaccacaatgatctgattttctttcttctttctttttttctaattgagaggattattcccaataagcttccatgaccctttcttggaggccttcacaggtaatacagatactggcactgattgtaattaaaatgagagaaaactctagcgcatcttctggcacggttttaacaacgtgtttgtgttgaatttcctttttatgcatcaaacgaaggccatattgtccataaatgctcagtgctcaggatctcattaatatgccgaacctaactacagatgactttttaatattgtaaaatattttctgctttttgacttgcatctgagagtttcttgtttcagtaaaaaaagaaaagacaaaaaaatcagctttggaaagtaatttaaatgtaccttattttttttttctttatgttttctttcattgggcaacagctaagagggcccagcaaggtaatttatggttgagctgatgtcaattggttcttgtcttgagtcgactcaatttagcccaagtgctgaaacaagaaatgtcatttttttcatcaaagacaccagggcagatttttaagtaaagaaagacaattggacccttaagaatttatgcatttgtaaagttgctgttgatccaaatattttcaagccatgtaatccattggttttgtgggcagtttaataaacctgaacctttgtgtgttttctaattgtacctgagttgaccatcctttctttttatagtatatttcttgtatgatattttgtaaagctctcacctggttcttttatggggacttttcgtttttgggcaactccagtgtatttatgtgaaactttataagagaattaatttttccatttgcatattaatatgttcctccacacatgtaaaggcacagtggctccgtgtgttaaaaaacagctgtattttatgtatgctttactgataagtgtgccaataataaactgtgttaatgaccaaa

SEQ ID NO: 277906 - DNA, 2218 bp, Homo sapiens
caaccagctcggggattcggaaccagatgcctgtgatggattattacaatttcctatcatgtaattgcttttctgtttgaccaaagctatcggcaggaccctcatcccccgttactttagcactgtgtttgaaggaggggtgaccgacctgtattacattctcaaacactcgaaagagtcataccacaactcatccatcacggtggactgcgaccagtgtaccatggtcacccagcacgggaagcccatgtttaccaaggtatgtacagaaggcagactgatcttggagttcacctttgatgatctcatgagaatcaaaacatggcactttaccattagacaataccgagagttagtcccgagaagcatcctagccatgcatgcacaagatcctcaggtcctggatcagctgtccaaaaacatcaccaggatggggctaacaaacttcaccctcaactacctcaggttgtgtgtaatattggagccaatgcaggaactgatgtcgagacataaaacttacaacctcagtccccgagactgcctgaagacctgcttgtttcagaagtggcagaggatggtggctccgccagcagaacccacaaggcaaccaacaaccaaacggagaaaaaggaaaaattccaccagcagcacttccaacagcagcgctgggaacaatgcaaacagcactggcagcaagaagaagaccacagctgcaaacctgagtctgtccagtcaggtacctgggctaggagcgatcccgaactgcagcctcaaccctgggagggatggagacctgtgtcattcaacagcagtgaccccttctggccaatttaaggagaagcattgaggggccctgaaaggagtcacttccagtcctcctcagaggatgtgatggtggtaggagagccaactctgatgggaggtgagtttggggacgaggacgaaaggctaatcactagattagaaaacacgcaatatgatgcggccaacggcatggacgacgaggaggacttcaacaattcacccgcgctggggaacaacagcccgtggaacagtaaacctcccgccactcaagagaccaaatcagaaaaccccccaccccaggcttcccaataagatgatcggcaccagaatccactgtcaataggcccgtgggtgatcattacaattgcaaatctttacttacaggagaggaaacagaagagataaaaacttttccatgcaaatatctatttctaaaccacaatgatctgattttctttcttctttctttttttctaattgagaggattattcccaataagcttccatgaccctttcttggaggccttcacaggtaatacagatactggcactgattgtaattaaaatgagagaaaactctagcgcatcttctggcacggttttaacaacgtgtttgtgttgaatttcctttttatgcatcaaacgaaggccatattgtccataaatgctcagtgctcaggatctcattaatatgccgaacctaactacagatgactttttaatattgtaaaatattttctgctttttgacttgcatctgagagtttcttgtttcagtaaaaaaagaaaagacaaaaaaatcagctttggaaagtaatttaaatgtaccttattttttttttctttatgttttctttcattgggcaacagctaagagggcccagcaaggtaatttatggttgagctgatgtcaattggttcttgtcttgagtcgactcaatttagcccaagtgctgaaacaagaaatgtcatttttttcatcaaagacaccagggcagatttttaagtaaagaaagacaattggacccttaagaatttatgcatttgtaaagttgctgttgatccaaatattttcaagccatgtaatccattggttttgtgggcagtttaataaacctgaacctttgtgtgttttctaattgtacctgagttgaccatcctttctttttatagtatatttcttgtatgatattttgtaaagctctcacctggttcttttatggggacttttcgtttttgggcaactccagtgtatttatgtgaaactttataagagaattaatttttccatttgcatattaatatgttcctccacacatgtaaaggcacagtggctccgtgtgttaaaaaacagctgtattttatgtatgctttactgataagtgtgccaataataaactgtgttaatgaccaaa

SEQ ID NO: 277907 - DNA, 2202 bp, Homo sapiens
  misc_feature (63)..(63): n is a, c, g, or t
cccacccatccccccatgctgtcctaagtacacatacaaaacacagacatagtgctgctggtncggccagctatcggcaggaccctcatcccccgttactttagcactgtgtttgaaggaggggtgaccgacctgtattacattctcaaacactcgaaagagtcataccacaactcatccatcacggtggactgcgaccagtgtaccatggtcacccagcacgggaagcccatgtttaccaaggtatgtacagaaggcagactgatcttggagttcacctttgatgatctcatgagaatcaaaacatggcactttaccattagacaataccgagagttagtcccgagaagcatcctagccatgcatgcacaagatcctcaggtcctggatcagctgtccaaaaacatcaccaggatggggctaacaaacttcaccctcaactacctcaggttgtgtgtaatattggagccaatgcaggaactgatgtcgagacataaaacttacaacctcagtccccgagactgcctgaagacctgcttgtttcagaagtggcagaggatggtggctccgccagcagaacccacaaggcaaccaacaaccaaacggagaaaaaggaaaaattccaccagcagcacttccaacagcagcgctgggaacaatgcaaacagcactggcagcaagaagaagaccacagctgcaaacctgagtctgtccagtcaggtacctgggctaggagcgatcccgaactgcagcctcaaccctgggagggatggagacctgtgtcattcaacagcagtgaccccttctggccaatttaaggagaagcattgaggggccctgaaaggagtcacttccagtcctcctcagaggatgtgatggtggtaggagagccaactctgatgggaggtgagtttggggacgaggacgaaaggctaatcactagattagaaaacacgcaatatgatgcggccaacggcatggacgacgaggaggacttcaacaattcacccgcgctggggaacaacagcccgtggaacagtaaacctcccgccactcaagagaccaaatcagaaaaccccccaccccaggcttcccaataagatgatcggcaccagaatccactgtcaataggcccgtgggtgatcattacaattgcaaatctttacttacaggagaggaaacagaagagataaaaacttttccatgcaaatatctatttctaaaccacaatgatctgattttctttcttctttctttttttctaattgagaggattattcccaataagcttccatgaccctttcttggaggccttcacaggtaatacagatactggcactgattgtaattaaaatgagagaaaactctagcgcatcttctggcacggttttaacaacgtgtttgtgttgaatttcctttttatgcatcaaacgaaggccatattgtccataaatgctcagtgctcaggatctcattaatatgccgaacctaactacagatgactttttaatattgtaaaatattttctgctttttgacttgcatctgagagtttcttgtttcagtaaaaaaagaaaagacaaaaaaatcagctttggaaagtaatttaaatgtaccttattttttttttctttatgttttctttcattgggcaacagctaagagggcccagcaaggtaatttatggttgagctgatgtcaattggttcttgtcttgagtcgactcaatttagcccaagtgctgaaacaagaaatgtcatttttttcatcaaagacaccagggcagatttttaagtaaagaaagacaattggacccttaagaatttatgcatttgtaaagttgctgttgatccaaatattttcaagccatgtaatccattggttttgtgggcagtttaataaacctgaacctttgtgtgttttctaattgtacctgagttgaccatcctttctttttatagtatatttcttgtatgatattttgtaaagctctcacctggttcttttatggggacttttcgtttttgggcaactccagtgtatttatgtgaaactttataagagaattaatttttccatttgcatattaatatgttcctccacacatgtaaaggcacagtggctccgtgtgttaaaaaacagctgtattttatgtatgctttactgataagtgtgccaataataaactgtgttaatgaccaaa

SEQ ID NO: 277908 - DNA, 2466 bp, Homo sapiens
  misc_feature (1)..(1): n is a, c, g, or t
ncccgtgctccctccctccctccctctttccctccctcctctcctctccctctcctctcctgctatagagggctccgacagcagttcccagccagcgtgttcagcctgcctgcctgcctgcctctgtgtgtgtgtgagcgtgtgtgcgtgcgtctactttgtactgggaagaacacagcccatgtgctctgcatggacgttactgatactctgtttagcttgattttcgaaaagcaggcaagatgtccagcacaccacatgaccccttctattcttctcctttcggcccattttataggaggcatacaccatacatggtacagccagagtaccgaatctatgagatgaacaagagactgcagtctcgcacagaggatagtgacaacctctggtgggacgcctttgccactgaattttttgaagatgacgccacattaaccctttcattttgtttggaagatggaccaaagcgatacactatcggcaggaccctcatcccccgttactttagcactgtgtttgaaggaggggtgaccgacctgtattacattctcaaacactcgaaagagtcataccacaactcatccatcacggtggactgcgaccagtgtaccatggtcacccagcacgggaagcccatgtttaccaaggtatgtacagaaggcagactgatcttggagttcacctttgatgatctcatgagaatcaaaacatggcactttaccattagacaataccgagagttagtcccgagaagcatcctagccatgcatgcacaagatcctcaggtcctggatcagctgtccaaaaacatcaccaggatggggctaacaaacttcaccctcaactacctcaggttgtgtgtaatattggagccaatgcaggaactgatgtcgagacataaaacttacaacctcagtccccgagactgcctgaagacctgcttgtttcagaagtggcagaggatggtggctccgccagcagaacccacaaggcaaccaacaaccaaacggagaaaaaggaaaaattccaccagcagcacttccaacagcagcgctgggaacaatgcaaacagcactggcagcaagaagaagaccacagctgcaaacctgagtctgtccagtcaggtacctgatgtgatggtggtaggagagccaactctgatgggaggtgagtttggggacgaggacgaaaggctaatcactagattagaaaacacgcaatatgatgcggccaacggcatggacgacgaggaggacttcaacaattcacccgcgctggggaacaacagcccgtggaacagtaaacctcccgccactcaagagaccaaatcagaaaaccccccaccccaggcttcccaataagatgatcggcaccagaatccactgtcaataggcccgtgggtgatcattacaattgcaaatctttacttacaggagaggaaacagaagagataaaaacttttccatgcaaatatctatttctaaaccacaatgatctgattttctttcttctttctttttttctaattgagaggattattcccaataagcttccatgaccctttcttggaggccttcacaggtaatacagatactggcactgattgtaattaaaatgagagaaaactctagcgcatcttctggcacggttttaacaacgtgtttgtgttgaatttcctttttatgcatcaaacgaaggccatattgtccataaatgctcagtgctcaggatctcattaatatgccgaacctaactacagatgactttttaatattgtaaaatattttctgctttttgacttgcatctgagagtttcttgtttcagtaaaaaaagaaaagacaaaaaaatcagctttggaaagtaatttaaatgtaccttattttttttttctttatgttttctttcattgggcaacagctaagagggcccagcaaggtaatttatggttgagctgatgtcaattggttcttgtcttgagtcgactcaatttagcccaagtgctgaaacaagaaatgtcatttttttcatcaaagacaccagggcagatttttaagtaaagaaagacaattggacccttaagaatttatgcatttgtaaagttgctgttgatccaaatattttcaagccatgtaatccattggttttgtgggcagtttaataaacctgaacctttgtgtgttttctaattgtacctgagttgaccatcctttctttttatagtatatttcttgtatgatattttgtaaagctctcacctggttcttttatggggacttttcgtttttgggcaactccagtgtatttatgtgaaactttataagagaattaatttttccatttgcatattaatatgttcctccacacatgtaaaggcacagtggctccgtgtgttaaaaaacagctgtattttatgtatgctttactgataagtgtgccaataataaactgtgttaatgaccaaa

SEQ ID NO: 277909 - DNA, 2609 bp, Homo sapiens
  misc_feature (1)..(1): n is a, c, g, or t
ncccgtgctccctccctccctccctctttccctccctcctctcctctccctctcctctcctgctatagagggctccgacagcagttcccagccagcgtgttcagcctgcctgcctgcctgcctctgtgtgtgtgtgagcgtgtgtgcgtgcgtctactttgtactgggaagaacacagcccatgtgctctgcatggacgttactgatactctgtttagcttgattttcgaaaagcaggcaagatgtccagcacaccacatgaccccttctattcttctcctttcggcccattttataggaggcatacaccatacatggtacagccagagtaccgaatctatgagatgaacaagagactgcagtctcgcacagaggatagtgacaacctctggtgggacgcctttgccactgaattttttgaagatgacgccacattaaccctttcattttgtttggaagatggaccaaagcgatacactatcggcaggaccctcatcccccgttactttagcactgtgtttgaaggaggggtgaccgacctgtattacattctcaaacactcgaaagagtcataccacaactcatccatcacggtggactgcgaccagtgtaccatggtcacccagcacgggaagcccatgtttaccaaggtatgtacagaaggcagactgatcttggagttcacctttgatgatctcatgagaatcaaaacatggcactttaccattagacaataccgagagttagtcccgagaagcatcctagccatgcatgcacaagatcctcaggtcctggatcagctgtccaaaaacatcaccaggatggggctaacaaacttcaccctcaactacctcaggttgtgtgtaatattggagccaatgcaggaactgatgtcgagacataaaacttacaacctcagtccccgagactgcctgaagacctgcttgtttcagaagtggcagaggatggtggctccgccagcagaacccacaaggcaaccaacaaccaaacggagaaaaaggaaaaattccaccagcagcacttccaacagcagcgctgggaacaatgcaaacagcactggcagcaagaagaagaccacagctgcaaacctgagtctgtccagtcaggtacctgggctaggagcgatcccgaactgcagcctcaaccctgggagggatggagacctgtgtcattcaacagcagtgaccccttctggccaatttaaggagaagcattgaggggccctgaaaggagtcacttccagtcctcctcagaggatgtgatggtggtaggagagccaactctgatgggaggtgagtttggggacgaggacgaaaggctaatcactagattagaaaacacgcaatatgatgcggccaacggcatggacgacgaggaggacttcaacaattcacccgcgctggggaacaacagcccgtggaacagtaaacctcccgccactcaagagaccaaatcagaaaaccccccaccccaggcttcccaataagatgatcggcaccagaatccactgtcaataggcccgtgggtgatcattacaattgcaaatctttacttacaggagaggaaacagaagagataaaaacttttccatgcaaatatctatttctaaaccacaatgatctgattttctttcttctttctttttttctaattgagaggattattcccaataagcttccatgaccctttcttggaggccttcacaggtaatacagatactggcactgattgtaattaaaatgagagaaaactctagcgcatcttctggcacggttttaacaacgtgtttgtgttgaatttcctttttatgcatcaaacgaaggccatattgtccataaatgctcagtgctcaggatctcattaatatgccgaacctaactacagatgactttttaatattgtaaaatattttctgctttttgacttgcatctgagagtttcttgtttcagtaaaaaaagaaaagacaaaaaaatcagctttggaaagtaatttaaatgtaccttattttttttttctttatgttttctttcattgggcaacagctaagagggcccagcaaggtaatttatggttgagctgatgtcaattggttcttgtcttgagtcgactcaatttagcccaagtgctgaaacaagaaatgtcatttttttcatcaaagacaccagggcagatttttaagtaaagaaagacaattggacccttaagaatttatgcatttgtaaagttgctgttgatccaaatattttcaagccatgtaatccattggttttgtgggcagtttaataaacctgaacctttgtgtgttttctaattgtacctgagttgaccatcctttctttttatagtatatttcttgtatgatattttgtaaagctctcacctggttcttttatggggacttttcgtttttgggcaactccagtgtatttatgtgaaactttataagagaattaatttttccatttgcatattaatatgttcctccacacatgtaaaggcacagtggctccgtgtgttaaaaaacagctgtattttatgtatgctttactgataagtgtgccaataataaactgtgttaatgaccaaa

SEQ ID NO: 277910 - DNA, 2405 bp, Homo sapiens
  misc_feature (1)..(1): n is a, c, g, or t
ncccgtgctccctccctccctccctctttccctccctcctctcctctccctctcctctcctgctatagagggctccgacagcagttcccagccagcgtgttcagcctgcctgcctgcctgcctctgtgtgtgtgtgagcgtgtgtgcgtgcgtctactttgtactgggaagaacacagcccatgtgctctgcatggacgttactgatactctgtttagcttgattttcgaaaagcaggaggcatacaccatacatggtacagccagagtaccgaatctatgagatgaacaagagactgcagtctcgcacagaggatagtgacaacctctggtgggacgcctttgccactgaattttttgaagatgacgccacattaaccctttcattttgtttggaagatggaccaaagcgatacactatcggcaggaccctcatcccccgttactttagcactgtgtttgaaggaggggtgaccgacctgtattacattctcaaacactcgaaagagtcataccacaactcatccatcacggtggactgcgaccagtgtaccatggtcacccagcacgggaagcccatgtttaccaaggtatgtacagaaggcagactgatcttggagttcacctttgatgatctcatgagaatcaaaacatggcactttaccattagacaataccgagagttagtcccgagaagcatcctagccatgcatgcacaagatcctcaggtcctggatcagctgtccaaaaacatcaccaggatggggctaacaaacttcaccctcaactacctcaggttgtgtgtaatattggagccaatgcaggaactgatgtcgagacataaaacttacaacctcagtccccgagactgcctgaagacctgcttgtttcagaagtggcagaggatggtggctccgccagcagaacccacaaggcaaccaacaaccaaacggagaaaaaggaaaaattccaccagcagcacttccaacagcagcgctgggaacaatgcaaacagcactggcagcaagaagaagaccacagctgcaaacctgagtctgtccagtcaggtacctgatgtgatggtggtaggagagccaactctgatgggaggtgagtttggggacgaggacgaaaggctaatcactagattagaaaacacgcaatatgatgcggccaacggcatggacgacgaggaggacttcaacaattcacccgcgctggggaacaacagcccgtggaacagtaaacctcccgccactcaagagaccaaatcagaaaaccccccaccccaggcttcccaataagatgatcggcaccagaatccactgtcaataggcccgtgggtgatcattacaattgcaaatctttacttacaggagaggaaacagaagagataaaaacttttccatgcaaatatctatttctaaaccacaatgatctgattttctttcttctttctttttttctaattgagaggattattcccaataagcttccatgaccctttcttggaggccttcacaggtaatacagatactggcactgattgtaattaaaatgagagaaaactctagcgcatcttctggcacggttttaacaacgtgtttgtgttgaatttcctttttatgcatcaaacgaaggccatattgtccataaatgctcagtgctcaggatctcattaatatgccgaacctaactacagatgactttttaatattgtaaaatattttctgctttttgacttgcatctgagagtttcttgtttcagtaaaaaaagaaaagacaaaaaaatcagctttggaaagtaatttaaatgtaccttattttttttttctttatgttttctttcattgggcaacagctaagagggcccagcaaggtaatttatggttgagctgatgtcaattggttcttgtcttgagtcgactcaatttagcccaagtgctgaaacaagaaatgtcatttttttcatcaaagacaccagggcagatttttaagtaaagaaagacaattggacccttaagaatttatgcatttgtaaagttgctgttgatccaaatattttcaagccatgtaatccattggttttgtgggcagtttaataaacctgaacctttgtgtgttttctaattgtacctgagttgaccatcctttctttttatagtatatttcttgtatgatattttgtaaagctctcacctggttcttttatggggacttttcgtttttgggcaactccagtgtatttatgtgaaactttataagagaattaatttttccatttgcatattaatatgttcctccacacatgtaaaggcacagtggctccgtgtgttaaaaaacagctgtattttatgtatgctttactgataagtgtgccaataataaactgtgttaatgaccaaa

SEQ ID NO: 277911 - DNA, 510 bp, Homo sapiens
gcacgaggcaagagactgcagtctcgcacagaggatctctacatggcctcagaaaaccaatttgtttcttttctcatttgatatttctgctacttctgtctctctatatctacctgggagcccacagccgtgaattacggtatgaatcatgataatatgttacatttcctggagcactttgcattttaggtgccacatcattgggaactatgatgatgatgacgacgatgacgacgatacacttattctggattctatcagcaaattaaataatgatagtgacaacctctggtgggacgcctttgccactgaattttttgaagatgacgccacattaaccctttcattttgtttggaagatggaccaaagcgatacagaaccaagaatttaagaccaattggggaaaaaatgaatattaatggaaaatggtgttgctgccagaatttattgtttggggactggagaagagaactgttctacacaataaaaaattattgagaaacacatta

SEQ ID NO: 277912 - DNA, 2838 bp, Homo sapiens
  misc_feature (1)..(1): n is a, c, g, or t
ncccgtgctccctccctccctccctctttccctccctcctctcctctccctctcctctcctgctatagagggctccgacagcagttcccagccagcgtgttcagcctgcctgcctgcctgcctctgtgtgtgtgtgagcgtgtgtgcgtgcgtctactttgtactgggaagaacacagcccatgtgctctgcatggacgttactgatactctgtttagcttgattttcgaaaagcaggcaagatgtccagcacaccacatgaccccttctattcttctcctttcggcccattttataggaggcatacaccatacatggtacagccagagtaccgaatctatgagatgaacaagagactgcagtctcgcacagaggatagtgacaacctctggtgggacgcctttgccactgaattttttgaagatgacgccacattaaccctttcattttgtttggaagatggaccaaagcgatacactatcggcaggaccctcatcccccgttactttagcactgtgtttgaaggaggggtgaccgacctgtattacattctcaaacactcgaaagagtcataccacaactcatccatcacggtggactgcgaccagtgtaccatggtcacccagcacgggaagcccatgtttaccaaggtatgtacagaaggcagactgatcttggagttcacctttgatgatctcatgagaatcaaaacatggcactttaccattagacaataccgagagttagtcccgagaagcatcctagccatgcatgcacaagatcctcaggtcctggatcagctgtccaaaaacatcaccaggatggggctaacaaacttcaccctcaactacctcaggttgtgtgtaatattggagccaatgcaggaactgatgtcgagacataaaacttacaacctcagtccccgagactgcctgaagacctgcttgtttcagaagtggcagaggatggtggctccgccagcagaacccacaaggcaaccaacaaccaaacggagaaaaaggaaaaattccaccagcagcacttccaacagcagcgctgggaacaatgcaaacagcactggcagcaagaagaagaccacagctgcaaacctgagtctgtccagtcaggtacctgggctaggagcgatcccgaactgcagcctcaaccctgggagggatggagacctgtgtcattcaacagcagtgaccccttctggccaatttaaggagaagcattgaggggccctgaaaggagtcacttccagtcctcctcagaggatgtgatggtggtaggagagccaactctgatgggaggtgagtttggggacgaggacgaaaggctaatcactagattagaaaacacgcaatatgatgcggccaacggcatggacgacgaggaggacttcaacaattcacccgcgctggggaacaacagcccgtggaacagtaaacctcccgccactcaagagaccaaatcagaaaaccccccaccccaggcttcccaataagatgatcggcaccagaatccactgtcaataggcccgtgggtgatcattacaattgcaaatctttacttacaggagaggaaacagaagagataaaaacttttccatgcaaatatctatttctaaaccacaatgatctgattttctttcttctttctttttttctaattgagaggattattcccaataagcttccatgaccctttcttggaggccttcacaggtaatacagatactggcactgattgtaattaaaatgagagaaaactctagcgcatcttctggcacggttttaacaacgtgtttgtgttgaatttcctttttatgcatcaaacgaaggccatattgtccataaatgctcagtgctcaggatctcattaatatgccgaacctaactacagatgactttttaatattgtaaaatattttctgctttttgacttgcatctgagagtttcttgtttcagtaaaaaaagaaaagacaaaaaaatcagctttggaaagtaatttaaatgtaccttattttttttttctttatgttttctttcattgggcaacagctaagagggcccagcaaggtaatttatggttgagctgatgtcaattggttcttgtcttgagtcgactcaatttagcccaagtgctgaaacaagaaatgtcatttttttcatcaaagacaccagggcagatttttaagtaaagaaagacaattggacccttaagaatttatgcatttgtaaagttgctgttgatccaaatattttcaagccatgtaatccattggttttgtgggcagtttaataaacctgaacctttgtgtgttttctaattgtacctgagttgaccatcctttctttttatagtatatttcttgtatgatattttgtaaagctctcacctggttcttttatggggacttttcgtttttgggcaactccagtgtatttatgtgaaactttataagagaattaatttttccatttgcatattaatatgttcctccacacatgtaaaggcacagtggctccgtgtgttaaaaaacagctgtattttatgtatgctttactgataagtgtgccaataataaactgtgttaatgaccaaaaaaaaaaaaaaaaaaaaacacaacagaaaaaaaacttttttgcggcccgcttggcgcccggaaaaaattttttataaaccaatgtcggttggggggcgggcccccacatgggtaagtaaacatgggcacaacgggctcccagagagaaccccggcgccgcacagtgcgggggtctccaccaataaaaaacgcgggcacccgcgttctgacacccgaatgggttcgggct

SEQ ID NO: 277913 - DNA, 2784 bp, Homo sapiens
  misc_feature (1)..(1): n is a, c, g, or t
ncccgtgctccctccctccctccctctttccctccctcctctcctctccctctcctctcctgctatagagggctccgacagcagttcccagccagcgtgttcagcctgcctgcctgcctgcctctgtgtgtgtgtgagcgtgtgtgcgtgcgtctactttgtactgggaagaacacagcccatgtgctctgcatggacgttactgatactctgtttagcttgattttcgaaaagcaggcaagatgtccagcacaccacatgaccccttctattcttctcctttcggcccattttataggaggcatacaccatacatggtacagccagagtaccgaatctatgagatgaacaagagactgcagtctcgcacagaggatagtgacaacctctggtgggacgcctttgccactgaattttttgaagatgacgccacattaaccctttcattttgtttggaagatggaccaaagcgatacactatcggcaggaccctcatcccccgttactttagcactgtgtttgaaggaggggtgaccgacctgtattacattctcaaacactcgaaagagtcataccacaactcatccatcacggtggactgcgaccagtgtaccatggtcacccagcacgggaagcccatgtttaccaaggtatgtacagaaggcagactgatcttggagttcacctttgatgatctcatgagaatcaaaacatggcactttaccattagacaataccgagagttagtcccgagaagcatcctagccatgcatgttgtgtgtaatattggagccaatgcaggaactgatgtcgagacataaaacttacaacctcagtccccgagactgcctgaagacctgcttgtttcagaagtggcagaggatggtggctccgccagcagaacccacaaggcaaccaacaaccaaacggagaaaaaggaaaaattccaccagcagcacttccaacagcagcgctgggaacaatgcaaacagcactggcagcaagaagaagaccacagctgcaaacctgagtctgtccagtcaggtacctgggctaggagcgatcccgaactgcagcctcaaccctgggagggatggagacctgtgtcattcaacagcagtgaccccttctggccaatttaaggagaagcattgaggggccctgaaaggagtcacttccagtcctcctcagagattgctagcattgctcgttctccagtgtcaggctgcgcactaaggacataaactcgcgtggttgttacacatcaggaggcgatgtttatttcctgtagaaatcaaatatgcgtctcggcccccgacattgagacttgaccccgttgtacagtacacgagtgtgtctgtcctagattccccgactcctcccactgttattttaagctgagcttctctctcccaaggtttccctgtaataatgtcagctgctgttcacaggatgtgatggtggtaggagagccaactctgatgggaggtgagtttggggacgaggacgaaaggctaatcactagattagaaaacacgcaatatgatgcggccaacggcatggacgacgaggaggacttcaacaattcacccgcgctggggaacaacagcccgtggaacagtaaacctcccgccactcaagagaccaaatcagaaaaccccccaccccaggcttcccaataagatgatcggcaccagaatccactgtcaataggcccgtgggtgatcattacaattgcaaatctttacttacaggagaggaaacagaagagataaaaacttttccatgcaaatatctatttctaaaccacaatgatctgattttctttcttctttctttttttctaattgagaggattattcccaataagcttccatgaccctttcttggaggccttcacaggtaatacagatactggcactgattgtaattaaaatgagagaaaactctagcgcatcttctggcacggttttaacaacgtgtttgtgttgaatttcctttttatgcatcaaacgaaggccatattgtccataaatgctcagtgctcaggatctcattaatatgccgaacctaactacagatgactttttaatattgtaaaatattttctgctttttgacttgcatctgagagtttcttgtttcagtaaaaaaagaaaagacaaaaaaatcagctttggaaagtaatttaaatgtaccttattttttttttctttatgttttctttcattgggcaacagctaagagggcccagcaaggtaatttatggttgagctgatgtcaattggttcttgtcttgagtcgactcaatttagcccaagtgctgaaacaagaaatgtcatttttttcatcaaagacaccagggcagatttttaagtaaagaaagacaattggacccttaagaatttatgcatttgtaaagttgctgttgatccaaatattttcaagccatgtaatccattggttttgtgggcagtttaataaacctgaacctttgtgtgttttctaattgtacctgagttgaccatcctttctttttatagtatatttcttgtatgatattttgtaaagctctcacctggttcttttatggggacttttcgtttttgggcaactccagtgtatttatgtgaaactttataagagaattaatttttccatttgcatattaatatgttcctccacacatgtaaaggcacagtggctccgtgtgttaaaaaacagctgtattttatgtatgctttactgataagtgtgccaataataaactgtgttaatgaccaaa

SEQ ID NO: 277914 - DNA, 2694 bp, Homo sapiens
  misc_feature (1)..(1): n is a, c, g, or t
ncccgtgctccctccctccctccctctttccctccctcctctcctctccctctcctctcctgctatagagggctccgacagcagttcccagccagcgtgttcagcctgcctgcctgcctgcctctgtgtgtgtgtgagcgtgtgtgcgtgcgtctactttgtactgggaagaacacagcccatgtgctctgcatggacgttactgatactctgtttagcttgattttcgaaaagcaggcaagatgtccagcacaccacatgaccccttctattcttctcctttcggcccattttataggaggcatacaccatacatggtacagccagagtaccgaatctatgagatgaacaagagactgcagtctcgcacagaggtgccacatcattgggaactatgatgatgatgacgacgatgacgacgatacacttattctggattctatcagcaaattaaataatgatagtgacaacctctggtgggacgcctttgccactgaattttttgaagatgacgccacattaaccctttcattttgtttggaagatggaccaaagcgatacactatcggcaggaccctcatcccccgttactttagcactgtgtttgaaggaggggtgaccgacctgtattacattctcaaacactcgaaagagtcataccacaactcatccatcacggtggactgcgaccagtgtaccatggtcacccagcacgggaagcccatgtttaccaaggtatgtacagaaggcagactgatcttggagttcacctttgatgatctcatgagaatcaaaacatggcactttaccattagacaataccgagagttagtcccgagaagcatcctagccatgcatgcacaagatcctcaggtcctggatcagctgtccaaaaacatcaccaggatggggctaacaaacttcaccctcaactacctcaggttgtgtgtaatattggagccaatgcaggaactgatgtcgagacataaaacttacaacctcagtccccgagactgcctgaagacctgcttgtttcagaagtggcagaggatggtggctccgccagcagaacccacaaggcaaccaacaaccaaacggagaaaaaggaaaaattccaccagcagcacttccaacagcagcgctgggaacaatgcaaacagcactggcagcaagaagaagaccacagctgcaaacctgagtctgtccagtcaggtacctgggctaggagcgatcccgaactgcagcctcaaccctgggagggatggagacctgtgtcattcaacagcagtgaccccttctggccaatttaaggagaagcattgaggggccctgaaaggagtcacttccagtcctcctcagaggatgtgatggtggtaggagagccaactctgatgggaggtgagtttggggacgaggacgaaaggctaatcactagattagaaaacacgcaatatgatgcggccaacggcatggacgacgaggaggacttcaacaattcacccgcgctggggaacaacagcccgtggaacagtaaacctcccgccactcaagagaccaaatcagaaaaccccccaccccaggcttcccaataagatgatcggcaccagaatccactgtcaataggcccgtgggtgatcattacaattgcaaatctttacttacaggagaggaaacagaagagataaaaacttttccatgcaaatatctatttctaaaccacaatgatctgattttctttcttctttctttttttctaattgagaggattattcccaataagcttccatgaccctttcttggaggccttcacaggtaatacagatactggcactgattgtaattaaaatgagagaaaactctagcgcatcttctggcacggttttaacaacgtgtttgtgttgaatttcctttttatgcatcaaacgaaggccatattgtccataaatgctcagtgctcaggatctcattaatatgccgaacctaactacagatgactttttaatattgtaaaatattttctgctttttgacttgcatctgagagtttcttgtttcagtaaaaaaagaaaagacaaaaaaatcagctttggaaagtaatttaaatgtaccttattttttttttctttatgttttctttcattgggcaacagctaagagggcccagcaaggtaatttatggttgagctgatgtcaattggttcttgtcttgagtcgactcaatttagcccaagtgctgaaacaagaaatgtcatttttttcatcaaagacaccagggcagatttttaagtaaagaaagacaattggacccttaagaatttatgcatttgtaaagttgctgttgatccaaatattttcaagccatgtaatccattggttttgtgggcagtttaataaacctgaacctttgtgtgttttctaattgtacctgagttgaccatcctttctttttatagtatatttcttgtatgatattttgtaaagctctcacctggttcttttatggggacttttcgtttttgggcaactccagtgtatttatgtgaaactttataagagaattaatttttccatttgcatattaatatgttcctccacacatgtaaaggcacagtggctccgtgtgttaaaaaacagctgtattttatgtatgctttactgataagtgtgccaataataaactgtgttaatgaccaaa

SEQ ID NO: 277915 - DNA, 2417 bp, Homo sapiens
  misc_feature (25)..(25): n is a, c, g, or t
attttacaaggaaagtaatatgttntgttttttgtttcagttctgtctattctactctatcggcaggaccctcatcccccgttactttagcactgtgtttgaaggaggggtgaccgacctgtattacattctcaaacactcgaaagagtcataccacaactcatccatcacggtggactgcgaccagtgtaccatggtcacccagcacgggaagcccatgtttaccaaggtatgtacagaaggcagactgatcttggagttcacctttgatgatctcatgagaatcaaaacatggcactttaccattagacaataccgagagttagtcccgagaagcatcctagccatgcatgcacaagatcctcaggtcctggatcagctgtccaaaaacatcaccaggatggggctaacaaacttcaccctcaactacctcaggttgtgtgtaatattggagccaatgcaggaactgatgtcgagactgcctgaagacctgcttgtttcagaagtggcagaggatggtggctccgccagcagaacccacaaggcaaccaacaaccaaacggagaaaaaggaaaaattccaccagcagcacttccaacagcagcgctgggaacaatgcaaacagcactggcagcaagaagaagaccacagctgcaaacctgagtctgtccagtcaggtacctgggctaggagcgatcccgaactgcagcctcaaccctgggagggatggagacctgtgtcattcaacagcagtgaccccttctggccaatttaaggagaagcattgaggggccctgaaaggagtcacttccagtcctcctcagagattgctagcattgctcgttctccagtgtcaggctgcgcactaaggacataaactcgcgtggttgttacacatcaggaggcgatgtttatttcctgtagaaatcaaatatgcgtctcggcccccgacattgagacttgaccccgttgtacagtacacgagtgtgtctgtcctagattccccgactcctcccactgttattttaagctgagcttctctctcccaaggtttccctgtaataatgtcagctgctgttcacaggatgtgatggtggtaggagagccaactctgatgggaggtgagtttggggacgaggacgaaaggctaatcactagattagaaaacacgcaatatgatgcggccaacggcatggacgacgaggaggacttcaacaattcacccgcgctggggaacaacagcccgtggaacagtaaacctcccgccactcaagagaccaaatcagaaaaccccccaccccaggcttcccaataagatgatcggcaccagaatccactgtcaataggcccgtgggtgatcattacaattgcaaatctttacttacaggagaggaaacagaagagataaaaacttttccatgcaaatatctatttctaaaccacaatgatctgattttctttcttctttctttttttctaattgagaggattattcccaataagcttccatgaccctttcttggaggccttcacaggtaatacagatactggcactgattgtaattaaaatgagagaaaactctagcgcatcttctggcacggttttaacaacgtgtttgtgttgaatttcctttttatgcatcaaacgaaggccatattgtccataaatgctcagtgctcaggatctcattaatatgccgaacctaactacagatgactttttaatattgtaaaatattttctgctttttgacttgcatctgagagtttcttgtttcagtaaaaaaagaaaagacaaaaaaatcagctttggaaagtaatttaaatgtaccttattttttttttctttatgttttctttcattgggcaacagctaagagggcccagcaaggtaatttatggttgagctgatgtcaattggttcttgtcttgagtcgactcaatttagcccaagtgctgaaacaagaaatgtcatttttttcatcaaagacaccagggcagatttttaagtaaagaaagacaattggacccttaagaatttatgcatttgtaaagttgctgttgatccaaatattttcaagccatgtaatccattggttttgtgggcagtttaataaacctgaacctttgtgtgttttctaattgtacctgagttgaccatcctttctttttatagtatatttcttgtatgatattttgtaaagctctcacctggttcttttatggggacttttcgtttttgggcaactccagtgtatttatgtgaaactttataagagaattaatttttccatttgcatattaatatgttcctccacacatgtaaaggcacagtggctccgtgtgttaaaaaacagctgtattttatgtatgctttactgataagtgtgccaataataaactgtgttaatgaccaaa

SEQ ID NO: 277916 - DNA, 462 bp, Homo sapiens
tgaagtggttgcactatttaacaaagtttctctgtcactcagttccacaggtcgagacatgtcagtcaagatttcaatgcccttttccagggccttctggaatgactcagaaatgatggttggatgaatccctttctgaagaagcttggtacaagaatctaagagggagccagcaatgatgactactgatgtggtgccatctcctgcttctatatcttgagccttagacagctccaccagcattctggctgctggatgtaatacttgcatttgtttcagaatggtagcaccatcatttgtaatggttacatcaccttttccatcttgaatcattttatccattccttttggtccaaggcttgttctaatagcatcagcaaccgctttggcggcggaaatgttgctgaagcggatctgggctggcttgtcgcggtcctgataggcgcctttcccgcggccgct

SEQ ID NO: 277917 - DNA, 461 bp, Homo sapiens
tgggtggcggtctcagaagagtgacaagttccacaggtcgagacatgtcagtcaagatttcaatgcccttttccagggccttctggaatgactcagaaatgatggttggatgaatccctgtaatttgtgaaagtctagttatttaattgtaacagtaataaagtacatcctacccacctttctgaagaagcttggtacaagaatctaagagggagccagcaatgatgactactgatgtggtgccatctcctgcttctatatcttgagccttagacagctccaccagctaagtgaacagaaaatgccaagttgctcaatgagaaatgacagaacccagtaacacctaattcaaataatcgcaccagtgtcacaaacagaatttgaagatacaacatgattcctgatttcttctgatttgttgtctaccttgggtttcatttaaaattaaagactagtagatg

SEQ ID NO: 277918 - DNA, 329 bp, Homo sapiens
acgcttcttttattagtttttattagtttttcaaaagtatcagaaataacagaatgttgggagaagataaatctgccttttgaaaccaaatatttaatattttcattaaattgtttcaatacaacttcaggcaaatgccaactggaagaccaagcccagaaattcgtaatggttacatcaccttttccatcttgaatcattttatccattccttttggtccaaggcttgttctaatagcatcagcaaccgctttggcggcggaaatgttgctgaagcggatctgggctggcttgtcgcggtcctgataggcgcctttcccgcggccgct

SEQ ID NO: 277919 - DNA, 205 bp, Homo sapiens
acgcttcttttattagtttttattagtttttcaaaagtatcagaaataacagaatgttgggagaagataaatctgccttttgaaaccaaatatttaatattttcattaaattgtttcaatacaacttcaggcaaatgccaactggaagaccaagcccagaaattcagaggaaataatcttccaaacaaggaacaccaaggtgatc

SEQ ID NO: 277920 - DNA, 2438 bp, Homo sapiens
cgggttcctgagaattgtcaatcaggcgcgaggcagagaggagggtgtgacgttccaggagctagtggcctcttcaccctggtgacctctgttccgtattctgtcactgagagacgccctgggacatctgtggtggcttttgtcgcgctgggacctaccctgactacgggagttgggaggacccgggacaccgcacagccgggaaatggactcagtggcctttgaggatgtggctgtgaacttcacccatgaggagtgggctttgctgggtccatcacagaagaatctctacagagatgtgatgcgagaaaccattaggaacctgaactgtataggaatgaaatgggaaaaccagaacattgatgatcagcaccaaaatctcaggagaaatccaaggtgtgatgtggtagagagatttggtaaaagtaaagatggtagtcagtgtggagaaaccttaagccagattcgaaatagtattgtaaacaagaacactcccgccagagtagatgcatgtggaagcagtgtgaatggagaagtcataatgggtcattcatccctgaattgctacatcagagttgatactggacacaaacaccgggagtgtcatgaatatgcagagaagtcatatacacataagcagtgtgggaaaggcttaagttatcgccactcctttcaaacatgtgaaaggcctcacactggaaagaaaccctatgattgtaaggaatgtggaaaaaccttcagttctcctggaaaccttcgaagacatatggtagtaaaaggtggagatggaccttataaatgtgaattgtgtgggaaagcctttttttggcccagtttattacgtatgcatgaaagaactcacactggagagaaaccatatgaatgtaagcagtgttctaaagccttccctgtttacagttcctatctaagacatgaaaaaatacacactggggagaaaccgtatgaatgtaagcagtgttctaaagccttccctgattacagttcatatctaagacatgaaagaactcacactggagagaaaccctacaaatgtaaacaatgtgggaaagccttcagtgtttccggttcccttcgagtacatgaaagaattcacactggagagaaaccctatacatgtaaacagtgtgggaaagcgttttgtcatcttggaagctttcaaagacacatgataatgcacagtggagatggacctcataaatgtaagagatgtgggaaaggctttgattttcctggttcagcacgaattcatgaaggaactcacactctagagaaaccctatgaatgtaagcaatgtgggaaattgttatctcatcgctcaagctttcgaagacacatgatggcacacactggagatggccctcataaatgcacagtatgtgggaaagcctttgattctcctagtgtatttcaaagacatgaaaggactcacactggagagaaaccctatgaatgcaagcaatgtgggaaagccttccgtacttccagttcccttcgaaaacatgaaacaacacacactggagagcaaccctataaatgtaaatgtggaaaagcttttagtgatttattttcctttcaaagtcatgaaacaacacacagtgaagaggagccttatgaatgtaaggagtgtgggaaagcatttagttcttttaaatacttttgtcgccatgaaaggactcacagtgaagaaaaatcttatgagtgtcaaatttgtggcaaagccttcagtcgtttcagttacttaaaaactcatgaaaggactcacacggcagagaagccatatgaatgtaagcaatgcaggaaagcattcttttggccctctttccttctaagacatgaaaggactcacactggagaaagaccctatgaatgtaaacactgtggtaaagccttcagtcgttccagtttctgtcgagaacatgaaagaactcacactggagagaagccctatgaatgactcagtgacctttgaagatgtggctgtgaacttcacccaggaggaatggactttgctggatccttcacagaaaaaactctacagagacgtgatgtgggaaaccttcaggaacctggccactataggaacaaaacaaaaagaatggaacattgaagagcagtacaaaaaccaggggagaaatctcagaaatcatatggtagagagactctgtgaaagtaaagaaggtagtcatggcggagaaggtttcagccagattgcaaatctcagtctgaacaagaaaactccttctggaggaaagctttgggaaagcagtgtatgtggaaaagtcttgagccatcattcatcccttaacaggcacattagatcttacaccagacacaaactgtataagtgtcaggaatatggagagaagccatataaatgtaagaaatgtgggaaacccttcagttatctgcagtcttta

SEQ ID NO: 277921 - DNA, 1117 bp, Homo sapiens
cgggttcctgagaattgtcaatcaggcgcgaggcagagaggagggtgtgacgttccaggagctagtggcctcttcaccctggtgacctctgttccgtattctgtcactgagagacgccctgggacatctgtggtggcttttgtcgcgctgggacctaccctgactacgggagttgggaggacccgggacaccgcacagccgggaaatggccctgtgttatggaactttctggggctaccctaagatgctggaagctgccaatctcatggagggcctagtggatatcggcccttgggtcactcttcccagaggacagcctgaggtgttggagtggggcctcccaaaggatcaggctggagaacttgggacagtggataagtctggtctgttcctgttatctggacttggcagattaatgcaacattctgtgggactttgcaatagctaaagaacttaaatatcctttgtttactaaaggcttcattattatggaagtagtaactgatgtttattatctgagatggatagatacttgtgcttttcttgttgagctataaaatagaagtgacttacaatttccttccctcctgtaaacactgaatttgagtgattttgatagattcatcacacatggagttttgtttgtttgttttatgttttaaatccacgtaaggcatgaaagggtaagcaaatggccttgactggggtggagaggcttgaggccagtgactccaagtggaggccaattttgagcctgcaaagggaggtcattgtgggcccagtttagttggttcttcctggggagcctcccctgcaggtgtcccagcctaatcactccagcaatgggaggaaatcccttgaacccaggaggcggaggctgcagtgggtgacagagcgagattccgtctcaaggaaaaaaaaagaagaatgtgtatatatgtggacagtgaagactcatggggatgagggaggttatttggtggataatgggggttgctccagggatggatgcactgaaaggcctgactttacaaggcaatatatcaatgtagtaaaattgcactggtactccatgaatatatatatataatttatacatatatgtgtatatatatat

SEQ ID NO: 277922 - DNA, 950 bp, Homo sapiens
ggggtagcagagactgaagaacatttatatataaatggacttgtgcagttcaaacctgtgttgttcaggagtcaactatagttcaatgaatgaatcatacatgattgtagtgtacataaaatcttaacaatttttgtatcattttgtaataatttatagtgaattttctggatctctcttttaggaatgaaatgggaaaaccagaacattgatgatcagcaccaaaatctcaggagaaatccaaggtaatttgtacttataagagacaggtgatgtccttgcagtgtttctgagaatgacaagaacttttaaaaagaagcaaagattatgaacaagcccagcttaaatttatttattcttagaaaaatttctctataaaaatatattattaaatgtgacataaatatattattaaatgtgacatagctattcagtgtttgcaaagtagttcccatggaaacaatattaagatttcccatatgaggctgggtgtggtagctcatgcccgcaatcccagcactttgggaggctgagacaggaggatcacttgagcctgggagtttgaggctgcagtgatctgtgatggcactggtgcactctaacctaagtgacagagcaagaccctgtcttaaaaaaaaaaaaaaggccaggcgcagtggcttatgcctgtaatcccagcactttgggaggccgaggtgggtggatccacgaggtcaggagatcgagaccaacctggccaacatggtgaaaccccatctctactaaaaatacacaaaaattagctgggtgtggtggtgcatgcctgtagtcccagctacttgggaggctgaggcaggagaatcacttgaacctgggaggcggaggttgcagcaagccgagacagcaccagctgcactccagcctgatgacagagggagactccatctcaaaaaaaaaaaaaaaaaaaaaaa

SEQ ID NO: 277923 - DNA, 897 bp, Homo sapiens
cgggttcctgagaattgtcaatcaggcgcgaggcagagaggagggtgtgacgttccaggagctagtggcctcttcaccctggtgacctctgttccgtattctgtcactgagagacgccctgggacatctgtggtggcttttgtcgcgctgggacctaccctgactacgggagttgggaggacccgggacaccgcacagccgggaaatggccctgtgttatggaactttctggggctaccctaagatgctggaagctgccaatctcatggagggcctagtggatatcggcccttgggtcactcttcccagaggacagcctgaggtgttggagtggggcctcccaaaggatcaggactcagtggcctttgaggatgtggctgtgaacttcacccatgaggagtgggctttgctgggtccatcacagaagaatctctacagagatgtgatgcgagaaaccattaggaacctgaactgtataggaatgaaatgggaaaaccagaacattgatgatcagcaccaaaatctcaggagaaatccaaggttatcggagacatggttacagaatttcattttgatccattatggtcacctggtagctttgtctgatggaggtttgttacagttttcaacaggacagggtctccctgtcacccaggctggagttcagtagtgttctcttggctcactgaaactgctgcctcccaagcaaatgatcctcccacctcagcctcctgaatagctgggactacaggtgcacactaccatgcccagactgagataaggtatgaggaagccttggccatgccaccagccgcttatcccaaattcctgatccctggaagacatctgggctctccctcctgttccagcccagtagcttccagcaaaggtactggc

SEQ ID NO: 277924 - DNA, 2259 bp, Homo sapiens
aacttttgcaggtatttcttagaaatattttattaactcttttaaaacaacttgtatactaacaactattgtattaatattttccattacctgagaatatatattaaaatatcccattgcaattatgcattttcaggtcaactttgtaattttgtcaggttattcattatacattctaaataatgagtcagtattaccatttgcatataagtccaagtactttttttctttaaaaaatgttaaagaaaatgtaaaggaaaaaattttttaaaattcttacatggtcacaatttttctcatgaatctaatttctcatttagaataccacaggaacaaagcatgcttttgtctgtgccatcttgccagagaccactagaatcacacctatagtcaaagagtggcatgtaaagagttgtaataaggatgaacacaaagcatcaatgacggagggttatccataagagggtgctcaagaggacttcttataggatttgtgtttcttttaggtgatttcattgccattcaacaaagtgaggtgtttgtattggatgctgttaggtgaactcaattccatccttggaaaattctaatagttcttatctaggaggcagaaagaatagagtggcactaacactaattcataagaagcacaagtcatattaggagatttctggtcatttttaaagtttggagtctgttttcttttaggttatcggagacatggttacagaatttcattttgatccattatggtcacctggtagctttgtctgatggaggtttgttacagttttcaacagggtaagacttcgccttgtggtgagttggggagcagctgtcattgggaacagcttttgcttttctcattatttaaacactgaagtatttcctgtggtataatggacactgttatctataaagtacctcagttaaattgttgaccaaaattaagtctgttgaggcagaataatttgataaaggctaatcaaagccaaatgtgaggattggcctgggacgcaccaacaagttgtatatgtttcaaagtctattacaagttggaacactcataagtttaggaggccaggtgccgtggcttatgcctataattccacgtacttgggaggagtgcctgaggctaggaatctgggaccaacctgggcgacatagggagacttcatgtctaaaataaataaataaataaattattagctgggcatagtggtgcccaattgtagtcccagtactcagaagtgtgagtcaggaagatcgtttgaatccaggagttcgacaccaacctgggtaacataatgagacccctctcatctcaaaaaactaacaaattaagaaaaatagactggtttctgcaaggggtaaaaacaataagaaaaaataaatttaaaaaccctgagtggacatttttttcaaagaagacatacaaatggccggaaagcaaatgaaaagggacttaatatcactaatcattagagaaattcaaatcaaaaccacaattacatgttacctcatacatgcaaggatgggtactatcaagagagattagtgttagagtacagagaaaaaggaagctttgtatactgttggtgggaatgtacattggtacagccattgtgaaaaacaatatggaggttctgcaaaaaaaaacaaaaactaccatgtgatccaacagtctcactcctgggtatatgcatatatgaccaaaggcagtgatcagtatttcaaagagatatctgccactcgcatatgttcattacagcattattcacaatagtcaacatatggaaacaaacttagcatccattaatggatgaataaagaaagtgtgatgtatatttaaacagaatattactcagccgtaaaaaggaaatcctgacatttgtcacatgaataaacctggtggacactataaaataaggcagacataggcaaatacttcatgatcccacttaattgtggaatattaaaaacttaaactccgaggcagagggaggaacggtggttactagagtccagaaggtagggaaaatggagaaatgttggtcaaaggttaaaaaccaagttgtaaggtgaacacgttctggagatttaatgtacagcatgggtggtcatcaatgtgttaatttgactgtggtaaccattacagaatgtatatatatacatcaaaacataactgtacatcatgaacatatacaatctttgtgaagtattttaaaataaaaaaggaatgtttactgaaaaaaaaac

SEQ ID NO: 277925 - DNA, 2671 bp, Homo sapiens
ggtcactttctacacctagatgtggtggcacacgtctgtaattccagcatcagaattccagcatcagacagtgagtgcagacacagaataagagtggatttaccacgtcattgaataaatgcttggaaaccacagcatcatgggaagtttatgaaggtgagtataggttctcagtactgtgagtttcaaccttccttttctggacatatgggatgtttcaggactcagtggcctttgaggatgtggctgtgaacttcacccatgaggagtgggctttgctgggtccatcacagaagaatctctacagagatgtgatgcgagaaaccattaggaacctgaactgtataggaatgaaatgggaaaaccagaacattgatgatcagcaccaaaatctcaggagaaatccaaggtgtgatgtggtagagagatttggtaaaagtaaagatggtagtcagtgtggagaaaccttaagccagattcgaaatagtattgtaaacaagaacactcccgccagagtagatgcatgtggaagcagtgtgaatggagaagtcataatgggtcattcatccctgaattgctacatcagagttgatactggacacaaacaccgggagtgtcatgaatatgcagagaagtcatatacacataagcagtgtgggaaaggcttaagttatcgccactcctttcaaacatgtgaaaggcctcacactggaaagaaaccctatgattgtaaggaatgtggaaaaaccttcagttctcctggaaaccttcgaagacatatggtagtaaaaggtggagatggaccttataaatgtgaattgtgtgggaaagcctttttttggcccagtttattacgtatgcatgaaagaactcacactggagagaaaccatatgaatgtaagcagtgttctaaagccttccctgtttacagttcctatctaagacatgaaaaaatacacactggggagaaaccgtatgaatgtaagcagtgttctaaagccttccctgattacagttcatatctaagacatgaaagaactcacactggagagaaaccctacaaatgtaaacaatgtgggaaagccttcagtgtttccggttcccttcgagtacatgaaagaattcacactggagagaaaccctatacatgtaaacagtgtgggaaagcgttttgtcatcttggaagctttcaaagacacatgataatgcacagtggagatggacctcataaatgtaagagatgtgggaaaggctttgattttcctggttcagcacgaattcatgaaggaactcacactctagagaaaccctatgaatgtaagcaatgtgggaaattgttatctcatcgctcaagctttcgaagacacatgatggcacacactggagatggccctcataaatgcacagtatgtgggaaagcctttgattctcctagtgtatttcaaagacatgaaaggactcacactggagagaaaccctatgaatgcaagcaatgtgggaaagccttccgtacttccagttcccttcgaaaacatgaaacaacacacactggagagcaaccctataaatgtaaatgtggaaaagcttttagtgatttattttcctttcaaagtcatgaaacaacacacagtgaagaggagccttatgaatgtaaggagtgtgggaaagcatttagttcttttaaatacttttgtcgccatgaaaggactcacagtgaagaaaaatcttatgagtgtcaaatttgtggcaaagccttcagtcgtttcagttacttaaaaactcatgaaaggactcacacggcagagaagccatatgaatgtaagcaatgcaggaaagcattcttttggccctctttccttctaagacatgaaaggactcacactggagaaagaccctatgaatgtaaacactgtggtaaagccttcagtcgttccagtttctgtcgagaacatgaaagaactcacactggagagaagccctatgaatgtaaggaatgtgggaaagccttcagttctctcagttcctttaatagacataaaaggacacactggaaggatattctataagtgtatggaatgtgggaaagcattcattggttttatcacattcagatacttgaaagaaataaatcctgtgaatgtaaacgtggtaaagccttaagaagtttccaggctgggcgcagcggctcacacctgtaatcccagcactttgagaggccgaggagggcagatcacgaggccaggagatcgagaccagcctggctaacatgggaaaccctgtctctactaaaaatacggaaaaaaaaaaaaatagccaggcatagttgctcacacctgtagtcctagctactcaggaggctgaggcaggagaatcccttgaacccgggaggtggaggttgcagtgagccgagattgcactactgcactccagcttgggtgctagagcgagactccatctcaaaaaaaaaaaaaaagtttccatttctttcaaatagagttgctgcctgctatatgcaagaagattggttccagtacaccctgagtatacctaaatccacagatgccagctcttttataaaatggaatattcgcatgtacctacccacattctcctgtatactctataaatgtctagattaattaaaatatctcatgcattgtaaaaaagctgt

SEQ ID NO: 277926 - DNA, 1728 bp, Homo sapiens
aacttttgcaggtatttcttagaaatattttattaactcttttaaaacaacttgtatactaacaactattgtattaatattttccattacctgagaatatatattaaaatatcccattgcaattatgcattttcaggtcaactttgtaattttgtcaggttattcattatacattctaaataatgagtcagtattaccatttgcatataagtccaagtactttttttctttaaaaaatgttaaagaaaatgtaaaggaaaaaattttttaaaattcttacatggtcacaatttttctcatgaatctaatttctcatttagaataccacaggaacaaagcatgcttttgtctgtgccatcttgccagagaccactagaatcacacctatagtcaaagagtggcatgtaaagagttgtaataaggatgaacacaaagcatcaatgacggagggttatccataagagggtgctcaagaggacttcttataggatttgtgtttcttttaggtgatttcattgccattcaacaaagtgaggtgtttgtattggatgctgttaggtgaactcaattccatccttggaaaattctaatagttcttatctaggaggcagaaagaatagagtggcactaacactaattcataagaagcacaagtcatattaggagatttctggtcatttttaaagtttggagtctgttttcttttaggttatcggagacatggttacagaatttcattttgatccattatggtcacctggtagctttgtctgatggaggtttgttacagttttcaacagggtaagacttcgccttgtggtgagttggggagcagctgtcattgggaacagcttttgcttttctcattatttaaacactgaagtatttcctgtggtataatggacactgttatctataaagtacctcagttaaattgttgaccaaaattaagtctgttgaggcagaataatttgataaaggctaatcaaagccaaatgtgaggattggcctgggacgcaccaacaagttgtatatgtttcaaagtctattacaagttggaacactcataagtttaggaggccaggtgccgtggcttatgcctataattccacgtacttgggaggagtgcctgaggctaggaatctgggaccaacctgggcgacatagggagacttcatgtctaaaataaataaataaataaattattagctgggcatagtggtgcccaattgtagtcccagtactcagaagtgtgagtcaggaagatcgtttgaatccaggagttcgacaccaacctgggtaacataatgagacccctctcatctcaaaaaactaacaaattaagaaaaatagactggtttctgcaaggggtaaaaacaataagaaaaaataaatttaaaaaccctgagtggacatttttttcaaagaagacatacaaatggccggaaagcaaatgaaaagggacttaatatcactaatcattagagaaattcaaatcaaaaccacaattacatgttacctcatacatgcaaggatgggtactatcaagagagattagtgttagagtacagagaaaaaggaagctttgtatactgttggtgggaatgtacattggtacagccattgtgaaaaacaatatggagtgcttgctatatatgacccatggcactgatccggacttcaaagacatatttgtcaatcgcattagttcattcccgcattactcac

SEQ ID NO: 277927 - DNA, 1703 bp, Homo sapiens
aacttttgcaggtatttcttagaaatattttattaactcttttaaaacaacttgtatactaacaactattgtattaatattttccattacctgagaatatatattaaaatatcccattgcaattatgcattttcaggtcaactttgtaattttgtcaggttattcattatacattctaaataatgagtcagtattaccatttgcatataagtccaagtactttttttctttaaaaaatgttaaagaaaatgtaaaggaaaaaattttttaaaattcttacatggtcacaatttttctcatgaatctaatttctcatttagaataccacaggaacaaagcatgcttttgtctgtgccatcttgccagagaccactagaatcacacctatagtcaaagagtggcatgtaaagagttgtaataaggatgaacacaaagcatcaatgacggagggttatccataagagggtgctcaagaggacttcttataggatttgtgtttcttttaggtgatttcattgccattcaacaaagtgaggtgtttgtattggatgctgttaggtgaactcaattccatccttggaaaattctaatagttcttatctaggaggcagaaagaatagagtggcactaacactaattcataagaagcacaagtcatattaggagatttctggtcatttttaaagtttggagtctgttttcttttaggttatcggagacatggttacagaatttcattttgatccattatggtcacctggtagctttgtctgatggaggtttgttacagttttcaacagggtaagacttcgccttgtggtgagttggggagcagctgtcattgggaacagcttttgcttttctcattatttaaacactgaagtatttcctgtggtataatggacactgttatctataaagtacctcagttaaattgttgaccaaaattaagtctgttgaggcagaataatttgataaaggctaatcaaagccaaatgtgaggattggcctgggacgcaccaacaagttgtatatgtttcaaagtctattacaagttggaacactcataagtttaggaggccaggtgccgtggcttatgcctataattccacgtacttgggaggagtgcctgaggctaggaatctgggaccaacctgggcgacatagggagacttcatgtctaaaataaataaataaataaattattagctgggcatagtggtgcccaattgtagtcccagtactcagaagtgtgagtcaggaagatcgtttgaatccaggagttcgacaccaacctgggtaacataatgagacccctctcatctcaaaaaactaacaaattaagaaaaatagactggtttctgcaaggggtaaaaacaataagaaaaaataaatttaaaaaccctgagtggacatttttttcaaagaagacatacaaatggccggaaagcaaatgaaaagggacttaatatcactaatcattagagaaattcaaatcaaaaccacaattacatgttacctcatacatgcaaggatgggtactatcaagagagattagtgttagagtacagagaaaaaggaagctttgtatactgttggtgggaatgtacattggtacagccattgtgaaaaacaatatggaggttctgcaaaaaaaaacacaggcagcgatcagatttcaaagagatatcttgccctccacg

SEQ ID NO: 277928 - DNA, 1055 bp, Homo sapiens
aacttttgcaggtatttcttagaaatattttattaactcttttaaaacaacttgtatactaacaactattgtattaatattttccattacctgagaatatatattaaaatatcccattgcaattatgcattttcaggtcaactttgtaattttgtcaggttattcattatacattctaaataatgagtcagtattaccatttgcatataagtccaagtactttttttctttaaaaaatgttaaagaaaatgtaaaggaaaaaattttttaaaattcttacatggtcacaatttttctcatgaatctaatttctcatttagaataccacaggaacaaagcatgcttttgtctgtgccatcttgccagagaccactagaatcacacctatagtcaaagagtggcatgtaaagagttgtaataaggatgaacacaaagcatcaatgacggagggttatccataagagggtgctcaagaggacttcttataggatttgtgtttcttttaggtgatttcattgccattcaacaaagtgaggtgtttgtattggatgctgttaggtgaactcaattccatccttggaaaattctaatagttcttatctaggaggcagaaagaatagagtggcactaacactaattcataagaagcacaagtcatattaggagatttctggtcatttttaaagtttggagtctgttttcttttaggttatcggagacatggttacagaatttcattttgatccattatggtcacctggtagctttgtctgatggaggtttgttacagttttcaacagggtaagacttcgccttgtggtgagttggggagcagctgtcattgggaacagcttttgcttttctcattatttaaacactgaagtatttcctgtggtataatggacactgttatctataaagtacctcagttaaattgttgaccaaaattaagtctgttgaggcagaataatttgataaaggctaatcaaagccaaatgtgaggattggcctgggacgcaccaacaacacaccagaagtccggaccggctcaatac

SEQ ID NO: 277929 - DNA, 1100 bp, Homo sapiens
cgacaagagggaaactctgtctcccaaaaaaaaaaccaccaaaaaaaaaaaacctaacctctgggacattgacatttttttccccaagcctagtttccattccttggtgacgcatggcttatcagaaaattggatggtgttattcaggggacaagacaaatgatttctgccttctggactctctccgactgtgaagctagaaaactgtttctaaaaactgaaaaacccacccaatgaggttttgcatgagcctgaaaaagacataaggcagtgtctcctaggaatgtggttgctgagcacttcaatgagcaccgtggggctggcggatgtgccaggctggagaacttgggacagtggataagtctggtctgttcctgttatctggacttggcagattaatgcaacattctgtgggactttgcaatagctaaagaacttaaatatcctttgtttactaaaggcttcattattatggaagtagtaactgatgtttattatctgagatggatagatacttgtgcttttcttgttgagctataaaatagaagtgacttacaatttccttccctcctgtaaacactgaatttgagtgattttgatagattcatcacacatggagttttgtttgtttgttttatgttttaaatccacgtaaggcatgaaagggtaagcaaatggccttgactggggtggagaggcttgaggccagtgactccaagtggaggccaattttgagcctgcaaagggaggtcattgtgggcccagtttagttggttcttcctggggagcctcccctgcaggtgtcccagcctaatcactccagcaatgggaggaaatcccttgaacccaggaggcggaggctgcagtgggtgacagagcgagattccgtctcaaggaaaaaaaaagaagaatgtgtatatatgtggacagtgaagactcatggggatgagggaggttatttggtggataatgggggttgctccagggatggatgcactgaaaggcctgactttacaaggcaatatatcaatgtagtaaaattgcactggtactccatgaatatatatatataatttatacatatatgtgtatatatatat

SEQ ID NO: 277930 - DNA, 717 bp, Homo sapiens
cgggttcctgagaattgtcaatcaggcgcgaggcagagaggagggtgtgacgttccaggagctagtggcctcttcaccctggtgacctctgttccgtattctgtcactgagagacgccctgggacatctgtggtggcttttgtcgcgctgggacctaccctgactacgggagttgggaggacccgggacaccgcacagccgggaaatggccctgtgttatggaactttctggggctaccctaagatgctggaagctgccaatctcatggagggcctagtggatatcggcccttgggtcactcttcccagaggacagcctgaggtgttggagtggggcctcccaaaggatcaggactcagtggcctttgaggatgtggctgtgaacttcacccatgaggagtgggctttgctgggtccatcacagaagaatctctacagagatgtgatgcgagaaaccattaggaacctgaactgtataggaatgaaatgggaaaaccagaacattgatgatcagcaccaaaatctcaggagaaatccaagagttgctgcctgctatatgcaagaagattggttccagtacaccctgagtatacctaaatccacagatgccagctcttttataaaatggaatattcgcatgtacctacccacattctcctgtatactctataaatgtctagattaattaaaatatctcatgcattgtaaaaaagctgt

SEQ ID NO: 277931 - DNA, 578 bp, Homo sapiens
ggtcactttctacacctagatgtggtggcacacgtctgtaattccagcatcagaattccagcatcagacagtgagtgcagacacagaataagagtggatttaccacgtcattgaataaatgcttggaaaccacagcatcatgggaagtttatgaaggtgagtataggttctcagtactgtgagtttcaaccttccttttctggacatatgggatgtttcaggactcagtggcctttgaggatgtggctgtgaacttcacccatgaggagtgggctttgctgggtccatcacagaagaatctctacagagatgtgatgcgagaaaccattaggaacctgaactgtataggaatgaaatgggaaaaccagaacattgatgatcagcaccaaaatctcaggagaaatccaagagaggtcgcgtgccacattgcaataagattggtcccagtacaccgggtgtccccatctccccaactcactcttcccttttattctatcagagttgtgtaaatacagtgccacattttctgggttttttaaattaacatttgcaaaaaaaaaaagtatcacgcaaagaaa

SEQ ID NO: 277932 - DNA, 516 bp, Homo sapiens
tggggcggctccggggccggggatggcggcggccgcggttgcggcggctccgggacgagtgagtggatcctgggaagcgctgtgaaatgggctggctcccgagccagccgggaggacacttactacagctgctcagaagcaccactggaaactcaggtattaggttgcagcgtctagggcacaccacagactttagcaagaaaaaaaacgagtgaaatctcagcttgatgaaaagagagtgcgttcccacctccagctctggtgcagttcccacggagcaaagcaaactcgactgaatccaagtgatctgtatctgccaaaaaggagaggacaagaaagctggtcacttagccgcctggctgttcacctgacccctggggttgggtctggggcgtgtctaatcagccgagatggtccctctgcttcttcaagcatgagcccagaatgcctgagcctgccctggcatcgcttacctggagaagcagggaatgcagaggaaagaagatgagatctggt

SEQ ID NO: 277933 - DNA, 503 bp, Homo sapiens
tggggcggctccggggccggggatggcggcggccgcggttgcggcggctccgggacgagtgagtggatcctgggaagcgctgtgaaatgggctggctcccgagccagccgggaggacacttactacagctgctcagaagcaccactggaaactcaggtaataccggcactttgaattccttgtttcaggaaaatatctgggatgtcacagtggaaaaacagaacagaatgtaatatagaaagctcttttcagatccaaagaactggaacctggttggaagaaataggcagcaaagttcatgtgcactgaagtgttcagaccaaaaagttgctttataacaatggacaaaagcatttgtgaaaggtgacaataagagaaaagggaaagagaactttcttatgaatcatacagatacggggaaaaaaacaggcatgtttagaggaatggaaccagaatttcatggagtggtgcctggagcagacctacagtggagaaggagctat

SEQ ID NO: 277934 - DNA, 1243 bp, Homo sapiens
tggggcggctccggggccggggatggcggcggccgcggttgcggcggctccgggacgagtgagtggatcctgggaagcgctgtgaaatgggctggctcccgagccagccgggaggacacttactacagctgctcagaagcaccactggaaactcagatgtgggcgccccagccagaagcagagaggggtacagggaagctacagagaagccccttctgatgccccagggagcaagtcgactccttccaggctccaggaacaccacaaagcaatatgaaacctgttcatgaaaggagtcaggaatgccttccaccaaagaaacgagacctccccgtgaccagcgaggatatggggagaactaccagctgctccactaaccacacaccctccagtgatgcttctgaatggtcccgaggggttgtggtggctgggcagagccaggcaggagccagagtcagcctggggggtgatggagctgaggccatcaccggtctgacagtggaccagtatggcatgctgtataaggtggctgtgccgcctgccaccttttcaccaactggactcccatctgtggtgaatatgagtcccttgcccccaacgtttaatgtagcgtcttcactaattcaacatccaggcatccactatcctccactccactatgctcagctcccatccacctcgctgcagttcattgggtctccttatagccttccctatgctgtgccacctaatttcctaccgagtcccctcctatctccttctgccaaccttgccacctctcaccttccacactttgtgccatatgcctcacttctggctgaaggagccactcctcccccacaggctccctccccggcccactcatttaacaaagctccctctgccacctccccatctgggcaattgccacatcattcaagtactcagccgctggaccttgctccaggtcggatgcccatttattatcagatgtccaggctacctgctgggtatactttgcatgaaacccctccagcaggtgccagcccagttcttacccctcaggagagccagtctgctctggaagcagctgctgcaaatggaggacagagaccacgagagcgaaatttagtaagacgggaaagtgaagcccttgactcccccaacagcaagggtgaaggccagggactggtgccagtggtagaatgtgtggtggatggacagttgttttcaggttctcagactccacgggtagaggtagcag

SEQ ID NO: 277935 - DNA, 700 bp, Homo sapiens
tggggcggctccggggccggggatggcggcggccgcggttgcggcggctccgggacgagtgagtggatcctgggaagcgctgtgaaatgggctggctcccgagccagccgggaggacacttactacagctgctcagaagcaccactggaaactcagatgtgggcgccccagccagaagcagagaggggtacagggaagctacagagaagccccttctgatgccccagggagcaagtcgactccttccaggctccaggaacaccacaaagcaatatgaaacctgttcatgaaaggagtcaggaatgccttccaccaaagaaacgagacctccccgtgaccagcgaggatatggggagaactaccagctgctccactaaccacacaccctccagtgatgcttctgaatggtcccgaggggttgtggtggctgggcagagccaggcaggagccagagtcagcctggggggtgatggagctgaggccatcaccggtctgacagtggaccagtatggcatgctgtataaggtggctgtgccgcctgccaccttttcaccaactggactcccatctgtggtgaatatgagtcccttgcccccaacgtttaatgtagcgtcttcactaattcaacatccaggcatccactatcctccactccactatgctcagcgttcctggacagtgcacgaccctggataacaca

SEQ ID NO: 277936 - DNA, 474 bp, Homo sapiens
tgtttttctctctgttcaactgcctgggcactctgggtaaatgtactgtttacctgtggagaagaagatgaggcaaggacgtgtatactctaatgctttggaattacctttcatggtgaccctggggagaattagaggtcaggcagccgcttactccattcctgtttctatcttctaggctcccgagccagccgggaggacacttactacagctgctcagaagcaccactggaaactcaggtaataccggcactttgaattccttgtttcaggaaaatatctgggatgtcacagtggaaaaacagaacagaatgtaatatagaaagctcttttcagatccaaagaactggaacctggttggaagaaataggcagcaaagttcatgtgcactgaagtgttcagaccaaaaagttgctttataacaatggacaaaagcatttgtgaaaggtgacaataagagaaaagggaaagaga

SEQ ID NO: 277937 - DNA, 6551 bp, Homo sapiens
caaaacatagagtaccccggcagccggcaagaggaagagagagtggcttccacatccccaatatcctagaggcggctgagccggaggcggtcgcacaaagcgggccccgggggccgttccagccgcggccgaccatagagatgcggctcccgccggctctgggtctggagataggaaagctgaggcccagagaagcgaagcgactgtgtctgtccaagaccacgcgccctcctgcccggaagataagcgtatttcttctctggtgcccacctgtctcctacctcaccctgccctcccgcaggtgaaggttcttaatcttgacggctcagcgtcctccttggctccccccggaggccatgtatggtcaagcttgaagattccccagaacagcgctaatattcacatttaagaagccaaaacacacaagtcggtggtgatgacagacccccttttggactcacagccagccagtagcaccggggagatggatggactgtgccctgagctattgctgatccccccgcctctctctaaccgtggaatcctggggcctgtccagagcccctgtccttcccgggaccctgcacctatacctactgagccaggctgcctgctggtagaggccacagcaactgaagagggaccagggaacatggagatcattgtggagacagtagctggaaccctgaccccaggtgctcctggagagaccccagctcccaaactgcctccaggagagagagaaccttcacaggaagcaggtacacccttgcctgggcaggagacagctgaagaggagaatgtagagaaagaagagaagagtgacacccagaaggactcccaaaaggctgtggataaaggccaaggggctcagcggctggaaggggatgtggtctctggcaccgagtccctcttcaagacccatatgtgtccagagtgtaagcgctgctttaagaagcggactcatctggtggagcacctgcatctccacttcccagaccccagcctccagtgccctaactgccagaagttcttcaccagtaagagcaagctcaagacccatctgctgcgggagctgggtgaaaaggcccaccactgcccactgtgccactacagtgcggtggagaggaatgcactcaaccgccacatggccagcatgcatgaagatatttccaacttctactcagacacctatgcctgtcctgtctgccgtgaggaattccgcctcagccaggccctaaaggagcacctcaagagccacacggcagcagccgcagcagagccattaccccttcgctgctttcaggagggctgcagctatgcagcacccgaccgcaaggccttcattaagcacctgaaggagacccatggggtgcgggctgtggagtgccgccatcactcatgtcccatgctctttgccacagccgaagccatggaggcccaccacaagagtcactacgccttccactgcccccactgtgattttgcttgttccaataagcacctattccgtaaacacaagaagcagggccaccctggcagtgaagagctgcgctgcaccttctgcccctttgccaccttcaacccagtggcttaccaggatcatgtaggcaagatgcatgctcatgaaaagatccaccagtgtcctgagtgcaactttgccactgcccacaagagggtgctcatccgacacatgcttctacatacgggtgagaagccccacaagtgtgagctgtgtgacttcacatgccgagacgtgagctacctatccaagcacatgctgacccactccaacaccaaggattacatgtgcactgaatgtggctatgtcaccaagtggaagcactacctccgtgtgcacatgcgaaaacatgcaggggacctcaggtatcagtgcaaccagtgctcctatcgctgtcaccgggctgatcagctgagcagccacaagctgcggcatcagggcaagtctctgatgtgtgaggtgtgtgccttcgcctgcaagcggaagtatgagctgcagaagcacatggcttcccagcaccaccctggcacaccggccccactctacccttgccactactgcagttaccagagccgccacaagcaggctgtgctgagccatgagaactgcaagcatacccgcctccgtgagttccactgtgccctctgtgactaccgcaccttcagcaacaccacactcttgttccataaacgcaaggcccatggctatgtacctggagaccaggcctggcagctccgctatgcaagccaggagccagaaggggccatgcagggcccaacacccccaccagattcagagccctcaaaccagctgtcagcccgacctgaggggccaggtcacgaacctgggactgtggtggaccccagcttggaccaggccctgccagagatgagtgaggaggtcaacactggaagacaggagggcagtgaggctccccatgggggtgacctgggtggcagtcccagcccagcagaggtggaggagggcagctgcacactacacctagaggccctgggagtagagctggagtctgtgactgagccaccccttgaggaggtcactgaaacagcccctatggagttcaggcccctgggactggaagggccagatggactggaaggaccagagctatctagctttgaaggtattgggacttctgacttgggtgctgaagaaaatccccttctggaaaagccagtgtctgagccctccacaaatcctccatccttagaggaggctcctaacaactgggtaggaaccttcaagacaactccacctgctgagacagcacccttgcccccattacctgagtcagagtcattactcaaggccctaaggagacaggacaaagaacaagcagaggcattggtgctagaggggcgggtgcagatggtagtgatccagggagaggggcgagccttccgctgcccacactgcccttttatcactcgccgggagaaggccctgaatctgcactccaggactgggtgccaaggccgccgagagcccctgctgtgccccgagtgtggggctagcttcaagcaacaacgcggcctcagcacccacctgctgaagaagtgccctgttctactcagaaagaacaagggcttgcccagaccagattcacccatccctctgcaacctgtgctcccaggtacccaggcctcagaggacacagaaagtgggaagcccccacctgcatcacaagaagcagagctactgcttccaaaagatgctcctttggagcttcccagggagccagaagaaacagaagagcctcttgccacagtctctggttccccagtccctcctgcaggaaactccttgcccacagaggcccctaagaagcactgctttgacccagtccctcctgcaggaaactcctcacccacggaggcccctaagaagcaccaccttgacccagtccctcctgcaggaaactcctcacccacagaggccctgaagaagcaccgctttgagcagggcaagtttcactgcaactcctgcccattcctttgttcccggctctcctctattacctctcacgtggctgaaggctgcagggggggacgtggcgggggaggaaaacgagggaccccccagacccagcctgatgtgtccccgttgagcaatggggactctgctcccccgaagaatgggagtacagagtccagctctggtgatggggatacagttctggttcaaaagcagaagggggctcgcttctcctgccctacatgtccctttagctgccagcaggaacgggctctgaggactcaccagatccggggctgccccctcgaggagtctggagagctgcactgcagcctctgcccattcactgctcctgctgccactgccttaaggctccaccagaagcggaggcaccccactgcagccccagcccgtgggccccggccccatctacagtgtggggactgtggcttcacctgtaaacagagccgttgcatgcagcagcaccggcggctcaagcacgagggggtgaagccccatcagtgccccttctgtgacttttcgaccaccagacggtaccggttagaggctcaccagtcccgacacacaggcattggccgcatcccctgcagctcttgcccccagacgtttggtaccaactcgaaactgcgcttgcaccggttaagggtacatgacaaaacacctacccacttctgtccactttgtgactatagtggctaccttcgccatgacatcactcgtcatgtcaacagctgccaccaaggcaccccagcctttgcctgctcccagtgtgaagcccagttcagctcagagacagcacttaagcagcatgctctgcgccgacaccccgagcctgcacagcctgcccctggctctcctgcagagaccactgagggccccctgcactgttcccgctgtgggttgctgtgccccagccctgccagcttacgaggacacacccgtaaacagcacccacggcttgagtgtggggcctgccaggaggccttccctagccgactggctctggatgagcaccggaggcagcagcatttcagccaccgctgtcagctctgtgactttgctgcccgggagcgggtgggcctggtaaagcactacctggaacagcatgaggagacttcagcagccgtggcagcctcagatggggatggggatgctggccagcccccgctacactgccccttttgtgacttcacatgccgccatcagctggtactagatcaccatgtgaaagggcatgggggcactcgtctctacaagtgcaccgattgtgcttacagcaccaagaaccgacagaagatcacctggcacagccgcatccacactggggaaaagccttaccactgtcacctctgcccctatgcctgtgctgatccctctcgtctcaagtaccacatgcggatccacaaggaggaacggaagtacctgtgccctgagtgtggctacaagtgcaagtgggtcaaccagctgaaataccacatgaccaagcatacaggactgaagccataccagtgtcccgagtgtgagtactgcaccaaccgggctgatgcactgcgtgtgcaccaggagacccggcatcgagaagcacgggctttcatgtgtgagcagtgtggcaaggccttcaagacgcgcttcctgctgcgcacccaccttcgcaagcacagtgaggccaaaccctatgtgtgcaatgtgtgccaccgtgctttccgctgggctgctggcctgcgccatcatgccctcacccacaccgaccgccaccccttcttttgccgcctctgcaactacaaggccaagcaaaagttccaggtggtcaagcacgtacgcaggcaccaccctgaccaagccgacccaaaccagggtgtgggcaaagaccccaccacccccacagtgcacctgcatgatgtgcagctggaggatcccagccctcctgctcctgccgctccccacactggacctgagggctgaaagcctgccccacctcctgtataggaagagggtatggtctgagatgtgcagactgggaccagcgctagcctgaggagctcagagcctaaggaaagactggcttttggggtacaagggtgactagaaccttcctgggactctggctatagtactttgaaattatcacccatataaaagagggacatggactataacgttgatttcttattgctgtacattgcgtttttaacctgcaagttctcagtttcttcaccatcactccatcaaagtccctggctataagatctggattttacccactccatcttctctttccttcttactgtgtcaattcctattttctttcagaatcttctaaaaacagttgtatctaaccgcatgtgctgttgtgcctaatgctctataaagcatgttaaacagaaagtggttactacattatagattcatccaaatccctgtcttaacatttccaggctgtcatcttgatcaactctgtcccctctcagacctctgcctcccttttgtcccttccatcttcactcagtattgatactgaaacaggcctaggtctgccttctccctgtccttgagccatcttgacccttgacctgctccctacttccaagctcctttgtctacctgtatctatagagggaggattgctacccactaagcctcctcctagaagcaactttagctcatcatcaatcctcagactggctcagcagctacactaaggtgttaaagcacaaggatactatggaaaggcagatgactagagaggaaaatctccaattcagaattctataactgcttcacagtataattctgtagtgccttactatataattgatcatctaaactgagacacactgggaaaacttaaagagggtactattaataattatgctgggacaacagacataaaccaggatggttccagccagactcttcaggaaggctgggaccacataaccttttgtctgcttttgccctgattcttaaaagccatactctgtgtccttcctatgtagcacatgcaagaggtctc

SEQ ID NO: 277938 - DNA, 509 bp, Homo sapiens
aaaattatttatcctaaccaataaatttatgggggggggggggggggggggggggggggggggggggggggggggggacgggggggggcgggggggggggggaggggggggggggggggggggtggtgaggagagaagggccaagcaaaagttccaggtggtcaagcacgtacgcaggcaccaccctgaccaagccgacccaaaccagggtgtgggcaaagaccccaccacccccacagtgcacctgcatgatgtgcagctggaggatcccagccctcctgctcctgccgctccccacactggacctgagggctgaaagcctgccccacctcctgtataggaagagggtatggtctgagatgtgcagactgggaccagcgctagcctgaggagctcagagcctaaggaaagactggcttttggggtacaagggtgactagaaccttcctgggactctggctatagtactttgaaattatcacccatataaaagagggacatggactata

SEQ ID NO: 277939 - DNA, 6470 bp, Homo sapiens
caaaacatagagtaccccggcagccggcaagaggaagagagagtggcttccacatccccaatatcctagaggcggctgagccggaggcggtcgcacaaagcgggccccgggggccgttccagccgcggccgaccatagagatgcggctcccgccggctctgggtctggagccttccaggttacaaaccgcctttccagttcgctggctcttatgatccagctcctgcccgacgatgtggacactgtcatcacctccattttacagataggaaagctgaggcccagagaagcgaagcgactgtgtctgtccaagaccacgcgcatttaagaagccaaaacacacaagtcggtggtgatgacagacccccttttggactcacagccagccagtagcaccggggagatggatggactgtgccctgagctattgctgatccccccgcctctctctaaccgtggaatcctggggcctgtccagagcccctgtccttcccgggaccctgcacctatacctactgagccaggctgcctgctggtagaggccacagcaactgaagagggaccagggaacatggagatcattgtggagacagtagctggaaccctgaccccaggtgctcctggagagaccccagctcccaaactgcctccaggagagagagaaccttcacaggaagcaggtacacccttgcctgggcaggagacagctgaagaggagaatgtagagaaagaagagaagagtgacacccagaaggactcccaaaaggctgtggataaaggccaaggggctcagcggctggaaggggatgtggtctctggcaccgagtccctcttcaagacccatatgtgtccagagtgtaagcgctgctttaagaagcggactcatctggtggagcacctgcatctccacttcccagaccccagcctccagtgccctaactgccagaagttcttcaccagtaagagcaagctcaagacccatctgctgcgggagctgggtgaaaaggcccaccactgcccactgtgccactacagtgcggtggagaggaatgcactcaaccgccacatggccagcatgcatgaagatatttccaacttctactcagacacctatgcctgtcctgtctgccgtgaggaattccgcctcagccaggccctaaaggagcacctcaagagccacacggcagcagccgcagcagagccattaccccttcgctgctttcaggagggctgcagctatgcagcacccgaccgcaaggccttcattaagcacctgaaggagacccatggggtgcgggctgtggagtgccgccatcactcatgtcccatgctctttgccacagccgaagccatggaggcccaccacaagagtcactacgccttccactgcccccactgtgattttgcttgttccaataagcacctattccgtaaacacaagaagcagggccaccctggcagtgaagagctgcgctgcaccttctgcccctttgccaccttcaacccagtggcttaccaggatcatgtaggcaagatgcatgctcatgaaaagatccaccagtgtcctgagtgcaactttgccactgcccacaagagggtgctcatccgacacatgcttctacatacgggtgagaagccccacaagtgtgagctgtgtgacttcacatgccgagacgtgagctacctatccaagcacatgctgacccactccaacaccaaggattacatgtgcactgaatgtggctatgtcaccaagtggaagcactacctccgtgtgcacatgcgaaaacatgcaggggacctcaggtatcagtgcaaccagtgctcctatcgctgtcaccgggctgatcagctgagcagccacaagctgcggcatcagggcaagtctctgatgtgtgaggtgtgtgccttcgcctgcaagcggaagtatgagctgcagaagcacatggcttcccagcaccaccctggcacaccggccccactctacccttgccactactgcagttaccagagccgccacaagcaggctgtgctgagccatgagaactgcaagcatacccgcctccgtgagttccactgtgccctctgtgactaccgcaccttcagcaacaccacactcttgttccataaacgcaaggcccatggctatgtacctggagaccaggcctggcagctccgctatgcaagccaggagccagaaggggccatgcagggcccaacacccccaccagattcagagccctcaaaccagctgtcagcccgacctgaggggccaggtcacgaacctgggactgtggtggaccccagcttggaccaggccctgccagagatgagtgaggaggtcaacactggaagacaggagggcagtgaggctccccatgggggtgacctgggtggcagtcccagcccagcagaggtggaggagggcagctgcacactacacctagaggccctgggagtagagctggagtctgtgactgagccaccccttgaggaggtcactgaaacagcccctatggagttcaggcccctgggactggaagggccagatggactggaaggaccagagctatctagctttgaaggtattgggacttctgacttgggtgctgaagaaaatccccttctggaaaagccagtgtctgagccctccacaaatcctccatccttagaggaggctcctaacaactgggtaggaaccttcaagacaactccacctgctgagacagcacccttgcccccattacctgagtcagagtcattactcaaggccctaaggagacaggacaaagaacaagcagaggcattggtgctagaggggcgggtgcagatggtagtgatccagggagaggggcgagccttccgctgcccacactgcccttttatcactcgccgggagaaggccctgaatctgcactccaggactgggtgccaaggccgccgagagcccctgctgtgccccgagtgtggggctagcttcaagcaacaacgcggcctcagcacccacctgctgaagaagtgccctgttctactcagaaagaacaagggcttgcccagaccagattcacccatccctctgcaacctgtgctcccaggtacccaggcctcagaggacacagaaagtgggaagcccccacctgcatcacaagaagcagagctactgcttccaaaagatgctcctttggagcttcccagggagccagaagaaacagaagagcctcttgccacagtctctggttccccagtccctcctgcaggaaactccttgcccacagaggcccctaagaagcactgctttgacccagtccctcctgcaggaaactcctcacccacggaggcccctaagaagcaccaccttgacccagtccctcctgcaggaaactcctcacccacagaggccctgaagaagcaccgctttgagcagggcaagtttcactgcaactcctgcccattcctttgttcccggctctcctctattacctctcacgtggctgaaggctgcagggggggacgtggcgggggaggaaaacgagggaccccccagacccagcctgatgtgtccccgttgagcaatggggactctgctcccccgaagaatgggagtacagagtccagctctggtgatggggatacagttctggttcaaaagcagaagggggctcgcttctcctgccctacatgtccctttagctgccagcaggaacgggctctgaggactcaccagatccggggctgccccctcgaggagtctggagagctgcactgcagcctctgcccattcactgctcctgctgccactgccttaaggctccaccagaagcggaggcaccccactgcagccccagcccgtgggccccggccccatctacagtgtggggactgtggcttcacctgtaaacagagccgttgcatgcagcagcaccggcggctcaagcacgagggggtgaagccccatcagtgccccttctgtgacttttcgaccaccagacggtaccggttagaggctcaccagtcccgacacacaggcattggccgcatcccctgcagctcttgcccccagacgtttggtaccaactcgaaactgcgcttgcaccggttaagggtacatgacaaaacacctacccacttctgtccactttgtgactatagtggctaccttcgccatgacatcactcgtcatgtcaacagctgccaccaaggcaccccagcctttgcctgctcccagtgtgaagcccagttcagctcagagacagcacttaagcagcatgctctgcgccgacaccccgagcctgcacagcctgcccctggctctcctgcagagaccactgagggccccctgcactgttcccgctgtgggttgctgtgccccagccctgccagcttacgaggacacacccgtaaacagcacccacggcttgagtgtggggcctgccaggaggccttccctagccgactggctctggatgagcaccggaggcagcagcatttcagccaccgctgtcagctctgtgactttgctgcccgggagcgggtgggcctggtaaagcactacctggaacagcatgaggagacttcagcagccgtggcagcctcagatggggatggggatgctggccagcccccgctacactgccccttttgtgacttcacatgccgccatcagctggtactagatcaccatgtgaaagggcatgggggcactcgtctctacaagtgcaccgattgtgcttacagcaccaagaaccgacagaagatcacctggcacagccgcatccacactggggaaaagccttaccactgtcacctctgcccctatgcctgtgctgatccctctcgtctcaagtaccacatgcggatccacaaggaggaacggaagtacctgtgccctgagtgtggctacaagtgcaagtgggtcaaccagctgaaataccacatgaccaagcatacaggactgaagccataccagtgtcccgagtgtgagtactgcaccaaccgggctgatgcactgcgtgtgcaccaggagacccggcatcgagaagcacgggctttcatgtgtgagcagtgtggcaaggccttcaagacgcgcttcctgctgcgcacccaccttcgcaagcacagtgaggccaaaccctatgtgtgcaatgtgtgccaccgtgctttccgctgggctgctggcctgcgccatcatgccctcacccacaccgaccgccaccccttcttttgccgcctctgcaactacaaggccaagcaaaagttccaggtggtcaagcacgtacgcaggcaccaccctgaccaagccgacccaaaccagggtgtgggcaaagaccccaccacccccacagtgcacctgcatgatgtgcagctggaggatcccagccctcctgctcctgccgctccccacactggacctgagggctgaaagcctgccccacctcctgtataggaagagggtatggtctgagatgtgcagactgggaccagcgctagcctgaggagctcagagcctaaggaaagactggcttttggggtacaagggtgactagaaccttcctgggactctggctatagtactttgaaattatcacccatataaaagagggacatggactataacgttgatttcttattgctgtacattgcgtttttaacctgcaagttctcagtttcttcaccatcactccatcaaagtccctggctataagatctggattttacccactccatcttctctttccttcttactgtgtcaattcctattttctttcagaatcttctaaaaacagttgtatctaaccgcatgtgctgttgtgcctaatgctctataaagcatgttaaacagaaagtggttactacattatagattcatccaaatccctgtcttaacatttccaggctgtcatcttgatcaactctgtcccctctcagacctctgcctcccttttgtcccttccatcttcactcagtattgatactgaaacaggcctaggtctgccttctccctgtccttgagccatcttgacccttgacctgctccctacttccaagctcctttgtctacctgtatctatagagggaggattgctacccactaagcctcctcctagaagcaactttagctcatcatcaatcctcagactggctcagcagctacactaaggtgttaaagcacaaggatactatggaaaggcagatgactagagaggaaaatctccaattcagaattctataactgcttcacagtataattctgtagtgccttactatataattgatcatctaaactgagacacactgggaaaacttaaagagggtactattaataattatgctgggacaacagacataaaccaggatggttccagccagactcttcaggaaggctgggaccacataaccttttgtctgcttttgccctgattcttaaaagccatactctgtgtccttcctatgtagcacatgcaagaggtctc

SEQ ID NO: 277940 - DNA, 6521 bp, Homo sapiens
caaaacatagagtaccccggcagccggcaagaggaagagagagtggcttccacatccccaatatcctagaggcggctgagccggaggcggtcgcacaaagcgggccccgggggccgttccagccgcggccgaccatagagatgcggctcccgccggctctgggtctggagccttccaggttacaaaccgcctttccagttcgctggctcttatgatccagctcctgcccgacgatgtggacactgtcatcacctccattttacagataggaaagctgaggcccagagaagcgaagcgactgtgtctgtccaagaccacgcgccctcctgcccggaagataagcgtatttcttctctggtgcccacctgtctcctacctcaccctgccctcccgcaggtgaaggttcttaatcttgacggctcagcgtcctccttggctccccccggaggccatgtatggtcaagcttgaagattccccagaacagcgctaatattcacatttaagaagccaaaacacacaagtcggtggtgatgacagacccccttttggactcacagccagccagtagcaccggggagatggatggactgtgccctgagctattgctgatccccccgcctctctctaaccgtggaatcctggggcctgtccagagcccctgtccttcccgggaccctgcacctatacctactgagccaggctgcctgctggtagaggccacagcaactgaagagggaccagggaacatggagatcattgtggagacagtagctggaaccctgaccccaggtgctcctggagagaccccagctcccaaactgcctccaggagagagagaaccttcacaggaagcaggtacacccttgcctgggcaggagacagctgaagaggagaatgtagagaaagaagagaagagtgacacccagaaggactcccaaaaggctgtggataaaggccaaggggctcagcggctggaaggggatgtggtctctggcaccgagtccctcttcaagacccatatgtgtccagagtgtaagcgctgctttaagaagcggactcatctggtggagcacctgcatctccacttcccagaccccagcctccagtgccctaactgccagaagttcttcaccagtaagagcaagctcaagacccatctgctgcgggagctgggtgaaaaggcccaccactgcccactgtgccactacagtgcggtggagaggaatgcactcaaccgccacatggccagcatgcatgaagatatttccaacttctactcagacacctatgcctgtcctgtctgccgtgaggaattccgcctcagccaggccctaaaggagcacctcaagagccacacggcagcagccgcagcagagccattaccccttcgctgctttcaggagggctgcagctatgcagcacccgaccgcaaggccttcattaagcacctgaaggagacccatggggtgcgggctgtggagtgccgccatcactcatgtcccatgctctttgccacagccgaagccatggaggcccaccacaagagtcactacgccttccactgcccccactgtgattttgcttgttccaataagcacctattccgtaaacacaagaagcagggccaccctggcagtgaagagctgcgctgcaccttctgcccctttgccaccttcaacccagtggcttaccaggatcatgtaggcaagatgcatgctcatgaaaagatccaccagtgtcctgagtgcaactttgccactgcccacaagagggtgctcatccgacacatgcttctacatacgggtgagaagccccacaagtgtgagctgtgtgacttcacatgccgagacgtgagctacctatccaagcacatgctgacccactccaacaccaaggattacatgtgcactgaatgtggctatgtcaccaagtggaagcactacctccgtgtgcacatgcgaaaacatgcaggggacctcaggtatcagtgcaaccagtgctcctatcgctgtcaccgggctgatcagctgagcagccacaagctgcggcatcagggcaagtctctgatgtgtgaggtgtgtgccttcgcctgcaagcggaagtatgagctgcagaagcacatggcttcccagcaccaccctggcacaccggccccactctacccttgccactactgcagttaccagagccgccacaagcaggctgtgctgagccatgagaactgcaagcatacccgcctccgtgagttccactgtgccctctgtgactaccgcaccttcagcaacaccacactcttgttccataaacgcaaggcccatggctatgtacctggagaccaggcctggcagctccgctatgcaagccaggagccagaaggggccatgcagggcccaacacccccaccagattcagagccctcaaaccagctgtcagcccgacctgaggggccaggtcacgaacctgggactgtggtggaccccagcttggaccaggccctgccagagatgagtgaggaggtcaacactggaagacaggagggcagtgaggctccccatgggggtgacctgggtggcagtcccagcccagcagaggtggaggagggcagctgcacactacacctagaggccctgggagtagagctggagtctgtgactgagccaccccttgaggaggtcactgaaacagcccctatggagttcaggcccctgggactggaagggccagatggactggaaggaccagagctatctagctttgaaggtattgggacttctgacttgggtgctgaagaaaatccccttctggaaaagccagtgtctgagccctccacaaatcctccatccttagaggaggctcctaacaactgggtaggaaccttcaagacaactccacctgctgagacagcacccttgcccccattacctgagtcagagtcattactcaaggccctaaggagacaggacaaagaacaagcagaggcattggtgctagaggggcgggtgcagatggtagtgatccagggagaggggcgagccttccgctgcccacactgcccttttatcactcgccgggagaaggccctgaatctgcactccaggactgggtgccaaggccgccgagagcccctgctgtgccccgagtgtggggctagcttcaagcaacaacgcggcctcagcacccacctgctgaagaagtgccctgttctactcagaaagaacaagggcttgcccagaccagattcacccatccctctgcaacctgtgctcccaggtacccaggcctcagaggacacagaaagtgggaagcccccacctgcatcacaagaagcagagctactgcttccaaaagatgctcctttggagcttcccagggagccagaagaaacagaagagcctcttgccacagtctctggttccccagtccctcctgcaggaaactccttgcccacagaggcccctaagaagcactgctttgacccagtccctcctgcaggaaactcctcacccacggaggcccctaagaagcaccaccttgacccagtccctcctgcaggaaactcctcacccacagaggccctgaagaagcaccgctttgagcagggcaagtttcactgcaactcctgcccattcctttgttcccggctctcctctattacctctcacgtggctgaaggctgcagggggggacgtggcgggggaggaaaacgagggaccccccagacccagcctgatgtgtccccgttgagcaatggggactctgctcccccgaagaatgggagtacagagtccagctctggtgatggggatacagttctggttcaaaagcagaagggggctcgcttctcctgccctacatgtccctttagctgccagcaggaacgggctctgaggactcaccagatccggggctgcccatctacagtgtggggactgtggcttcacctgtaaacagagccgttgcatgcagcagcaccggcggctcaagcacgagggggtgaagccccatcagtgccccttctgtgacttttcgaccaccagacggtaccggttagaggctcaccagtcccgacacacaggcattggccgcatcccctgcagctcttgcccccagacgtttggtaccaactcgaaactgcgcttgcaccggttaagggtacatgacaaaacacctacccacttctgtccactttgtgactatagtggctaccttcgccatgacatcactcgtcatgtcaacagctgccaccaaggcaccccagcctttgcctgctcccagtgtgaagcccagttcagctcagagacagcacttaagcagcatgctctgcgccgacaccccgagcctgcacagcctgcccctggctctcctgcagagaccactgagggccccctgcactgttcccgctgtgggttgctgtgccccagccctgccagcttacgaggacacacccgtaaacagcacccacggcttgagtgtggggcctgccaggaggccttccctagccgactggctctggatgagcaccggaggcagcagcatttcagccaccgctgtcagctctgtgactttgctgcccgggagcgggtgggcctggtaaagcactacctggaacagcatgaggagacttcagcagccgtggcagcctcagatggggatggggatgctggccagcccccgctacactgccccttttgtgacttcacatgccgccatcagctggtactagatcaccatgtgaaagggcatgggggcactcgtctctacaagtgcaccgattgtgcttacagcaccaagaaccgacagaagatcacctggcacagccgcatccacactggggaaaagccttaccactgtcacctctgcccctatgcctgtgctgatccctctcgtctcaagtaccacatgcggatccacaaggaggaacggaagtacctgtgccctgagtgtggctacaagtgcaagtgggtcaaccagctgaaataccacatgaccaagcatacaggactgaagccataccagtgtcccgagtgtgagtactgcaccaaccgggctgatgcactgcgtgtgcaccaggagacccggcatcgagaagcacgggctttcatgtgtgagcagtgtggcaaggccttcaagacgcgcttcctgctgcgcacccaccttcgcaagcacagtgaggccaaaccctatgtgtgcaatgtgtgccaccgtgctttccgctgggctgctggcctgcgccatcatgccctcacccacaccgaccgccaccccttcttttgccgcctctgcaactacaaggccaagcaaaagttccaggtggtcaagcacgtacgcaggcaccaccctgaccaagccgacccaaaccagggtgtgggcaaagaccccaccacccccacagtgcacctgcatgatgtgcagctggaggatcccagccctcctgctcctgccgctccccacactggacctgagggctgaaagcctgccccacctcctgtataggaagagggtatggtctgagatgtgcagactgggaccagcgctagcctgaggagctcagagcctaaggaaagactggcttttggggtacaagggtgactagaaccttcctgggactctggctatagtactttgaaattatcacccatataaaagagggacatggactataacgttgatttcttattgctgtacattgcgtttttaacctgcaagttctcagtttcttcaccatcactccatcaaagtccctggctataagatctggattttacccactccatcttctctttccttcttactgtgtcaattcctattttctttcagaatcttctaaaaacagttgtatctaaccgcatgtgctgttgtgcctaatgctctataaagcatgttaaacagaaagtggttactacattatagattcatccaaatccctgtcttaacatttccaggctgtcatcttgatcaactctgtcccctctcagacctctgcctcccttttgtcccttccatcttcactcagtattgatactgaaacaggcctaggtctgccttctccctgtccttgagccatcttgacccttgacctgctccctacttccaagctcctttgtctacctgtatctatagagggaggattgctacccactaagcctcctcctagaagcaactttagctcatcatcaatcctcagactggctcagcagctacactaaggtgttaaagcacaaggatactatggaaaggcagatgactagagaggaaaatctccaattcagaattctataactgcttcacagtataattctgtagtgccttactatataattgatcatctaaactgagacacactgggaaaacttaaagagggtactattaataattatgctgggacaacagacataaaccaggatggttccagccagactcttcaggaaggctgggaccacataaccttttgtctgcttttgccctgattcttaaaagccatactctgtgtccttcctatgtagcacatgcaagaggtctc

SEQ ID NO: 277941 - DNA, 1865 bp, Homo sapiens
agctgtgatcacaccagttcactccagcctgggcaacagagtgagaccctgtctctttaaaaaaaaaaaaaaaaaaatccctagcaagtaaactgaagattaagaaaaacaaagttccataatgtctgcttgccatatgataaaggcatagaacagggcaagaataacctggataataacagctaacatttattgagcacttactatattttctgctttttgctcttgcctcttccagtaccacatgcggatccacaaggaggaacggaagtacctgtgccctgagtgtggctacaagtgcaagtgggtcaaccagctgaaataccacatgaccaagcatacaggactgaagccataccagtgtcccgagtgtgagtactgcaccaaccgggctgatgcactgcgtgtgcaccaggagacccggcatcgagaagcacgggctttcatgtgtgagcagtgtggcaaggccttcaagacgcgcttcctgctgcgcacccaccttcgcaagcacagtgaggccaaaccctatgtgtgcaatgtgtgccaccgtgctttccgctgggctgctggcctgcgccatcatgccctcacccacaccgaccgccaccccttcttttgccgcctctgcaactacaaggccaagcaaaagttccaggtggtcaagcacgtacgcaggcaccaccctgaccaagccgacccaaaccagggtgtgggcaaagaccccaccacccccacagtgcacctgcatgatgtgcagctggaggatcccagccctcctgctcctgccgctccccacactggacctgagggctgaaagcctgccccacctcctgtataggaagagggtatggtctgagatgtgcagactgggaccagcgctagcctgaggagctcagagcctaaggaaagactggcttttggggtacaagggtgactagaaccttcctgggactctggctatagtactttgaaattatcacccatataaaagagggacatggactataacgttgatttcttattgctgtacattgcgtttttaacctgcaagttctcagtttcttcaccatcactccatcaaagtccctggctataagatctggattttacccactccatcttctctttccttcttactgtgtcaattcctattttctttcagaatcttctaaaaacagttgtatctaaccgcatgtgctgttgtgcctaatgctctataaagcatgttaaacagaaagtggttactacattatagattcatccaaatccctgtcttaacatttccaggctgtcatcttgatcaactctgtcccctctcagacctctgcctcccttttgtcccttccatcttcactcagtattgatactgaaacaggcctaggtctgccttctccctgtccttgagccatcttgacccttgacctgctccctacttccaagctcctttgtctacctgtatctatagagggaggattgctacccactaagcctcctcctagaagcaactttagctcatcatcaatcctcagactggctcagcagctacactaaggtgttaaagcacaaggatactatggaaaggcagatgactagagaggaaaatctccaattcagaattctataactgcttcacagtataattctgtagtgccttactatataattgatcatctaaactgagacacactgggaaaacttaaagagggtactattaataattatgctgggacaacagacataaaccaggatggttccagccagactcttcaggaaggctgggaccacataaccttttgtctgcttttgccctgattcttaaaagccatactctgtgtccttcctatgtagcacatgcaagaggtctc

SEQ ID NO: 277942 - DNA, 3037 bp, Homo sapiens
caaaacatagagtaccccggcagccggcaagaggaagagagagtggcttccacatccccaatatcctagaggcggctgagccggaggcggtcgcacaaagcgggccccgggggccgttccagccgcggccgaccatagagatgcggctcccgccggctctgggtctggagccttccaggttacaaaccgcctttccagttcgctggctcttatgatccagctcctgcccgacgatgtggacactgtcatcacctccattttacagataggaaagctgaggcccagagaagcgaagcgactgtgtctgtccaagaccacgcgccctcctgcccggaagataagcgtatttcttctctggtgcccacctgtctcctacctcaccctgccctcccgcaggtgaaggttcttaatcttgacggctcagcgtcctccttggctccccccggaggccatgtatggtcaagcttgaagattccccagaacagcgctaatattcacatttaagaagccaaaacacacaagtcggtggtgatgacagacccccttttggactcacagccagccagtagcaccggggagatggatggactgtgccctgagctattgctgatccccccgcctctctctaaccgtggaatcctggggcctgtccagagcccctgtccttcccgggaccctgcacctatacctactgagccaggctgcctgctggtagaggccacagcaactgaagagggaccagggaacatggagatcattgtggagacagtagctggaaccctgaccccaggtgctcctggagagaccccagctcccaaactgcctccaggagagagagaaccttcacaggaagcaggtacacccttgcctgggcaggagacagctgaagaggagaatgtagagaaagaagagaagagtgacacccagaaggactcccaaaaggctgtggataaaggccaaggggctcagcggctggaaggggatgtggtctctggcaccgagtccctcttcaagacccatatgtgtccagagtgtaagcgctgctttaagaagcggactcatctggtggagcacctgcatctccacttcccagaccccagcctccagtgccctaactgccagaagttcttcaccagtaagagcaagctcaagacccatctgctgcgggagctgggtgaaaaggcccaccactgcccactgtgccactacagtgcggtggagaggaatgcactcaaccgccacatggccagcatgcatgaagatatttccaacttctactcagacacctatgcctgtcctgtctgccgtgaggaattccgcctcagccaggccctaaaggagcacctcaagagccacacggcagcagccgcagcagagccattaccccttcgctgctttcaggagggctgcagctatgcagcacccgaccgcaaggccttcattaagcacctgaaggagacccatggggtgcgggctgtggagtgccgccatcactcatgtcccatgctctttgccacagccgaagccatggaggcccaccacaagagtcactacgccttccactgcccccactgtgattttgcttgttccaataagcacctattccgtaaacacaagaagcagggccaccctggcagtgaagagctgcgctgcaccttctgcccctttgccaccttcaacccagtggcttaccaggatcatgtaggcaagatgcatgctcatgaaaagatccaccagtgtcctgagtgcaactttgccactgcccacaagagggtgctcatccgacacatgcttctacatacgggtgagaagccccacaagtgtgagctgtgtgacttcacatgccgagacgtgagctacctatccaagcacatgctgacccactccaacaccaaggattacatgtgcactgaatgtggctatgtcaccaagtggaagcactacctccgtgtgcacatgcgaaaacatgcaggggacctcaggtatcagtgcaaccagtgctcctatcgctgtcaccgggctgatcagctgagcagccacaagctgcggcatcagggcaagtctctgatgtgtgaggtgtgtgccttcgcctgcaagcggaagtatgagctgcagaagcacatggcttcccagcaccaccctggcacaccggccccactctacccttgccactactgcagttaccagagccgccacaagcaggctgtgctgagccatgagaactgcaagcatacccgcctccgtgagttccactgtgccctctgtgactaccgcaccttcagcaacaccacactcttgttccataaacgcaaggcccatggctatgtacctggagaccaggcctggcagctccgctatgcaagccaggagccagaaggggccatgcagggcccaacacccccaccagattcagagccctcaaaccagctgtcagcccgacctgaggggccaggtcacgaacctgggactgtggtggaccccagcttggaccaggccctgccagagatgagtgaggaggtcaacactggaagacaggagggcagtgaggctccccatgggggtgacctgggtggcagtcccagcccagcagaggtggaggagggcagctgcacactacacctagaggccctgggagtagagctggagtctgtgactgagccaccccttgaggaggtcactgaaacagcccctatggagttcaggcccctgggactggaagggccagatggactggaaggaccagagctatctagctttgaaggtattgggacttctgacttgggtgctgaagaaaatccccttctggaaaagccagtgtctgagccctccacaaatcctccatccttagaggaggctcctaacaactgggtaggaaccttcaagacaactccacctgctgagacagcacccttgcccccattacctgagtcagagtcattactcaaggccctaaggagacaggacaaagaaccttcctgggactctggctatagtactttgaaattatcacccatataaaagagggacatggactata

SEQ ID NO: 277943 - DNA, 495 bp, Homo sapiens
gacgatgtggacactgtcatcacctccattttacagataggaaagctgaggcccagagaagcgaagcgactgtgtctgtccaagaccacgcggtgagtcagagccagaggcaggtgggaacctgggtcgctaggccggggcccgttgtttctccaggccttctctctgccttagtctgtcctttctcttcctcagccctcctgcccggaagataagcgtatttcttctctggtgcccacctgtctcctacctcaccctgccctcccgcaggtgaaggttcttaatcttgacggctcagcgtcctccttggctccccccggaggccatgtatggtcaagcttgaagattccccagaacagcgctaatattcagtaagtggaggctgcagtttccagagaatccctctgaccacgggagtgcactttccagccaccttgtgaatccctgtgatctgttgttttgagtccatgggattctggaaatagggactatcag

SEQ ID NO: 277944 - DNA, 6646 bp, Homo sapiens
caaaacatagagtaccccggcagccggcaagaggaagagagagtggcttccacatccccaatatcctagaggcggctgagccggaggcggtcgcacaaagcgggccccgggggccgttccagccgcggccgaccatagagatgcggctcccgccggctctgggtctggagccttccaggttacaaaccgcctttccagttcgctggctcttatgatccagctcctgcccgacgatgtggacactgtcatcacctccattttacagataggaaagctgaggcccagagaagcgaagcgactgtgtctgtccaagaccacgcgccctcctgcccggaagataagcgtatttcttctctggtgcccacctgtctcctacctcaccctgccctcccgcaggtgaaggttcttaatcttgacggctcagcgtcctccttggctccccccggaggccatgtatggtcaagcttgaagattccccagaacagcgctaatattcacatttaagaagccaaaacacacaagtcggtggtgatgacagacccccttttggactcacagccagccagtagcaccggggagatggatggactgtgccctgagctattgctgatccccccgcctctctctaaccgtggaatcctggggcctgtccagagcccctgtccttcccgggaccctgcacctatacctactgagccaggctgcctgctggtagaggccacagcaactgaagagggaccagggaacatggagatcattgtggagacagtagctggaaccctgaccccaggtgctcctggagagaccccagctcccaaactgcctccaggagagagagaaccttcacaggaagcaggtacacccttgcctgggcaggagacagctgaagaggagaatgtagagaaagaagagaagagtgacacccagaaggactcccaaaaggctgtggataaaggccaaggggctcagcggctggaaggggatgtggtctctggcaccgagtccctcttcaagacccatatgtgtccagagtgtaagcgctgctttaagaagcggactcatctggtggagcacctgcatctccacttcccagaccccagcctccagtgccctaactgccagaagttcttcaccagtaagagcaagctcaagacccatctgctgcgggagctgggtgaaaaggcccaccactgcccactgtgccactacagtgcggtggagaggaatgcactcaaccgccacatggccagcatgcatgaagatatttccaacttctactcagacacctatgcctgtcctgtctgccgtgaggaattccgcctcagccaggccctaaaggagcacctcaagagccacacggcagcagccgcagcagagccattaccccttcgctgctttcaggagggctgcagctatgcagcacccgaccgcaaggccttcattaagcacctgaaggagacccatggggtgcgggctgtggagtgccgccatcactcatgtcccatgctctttgccacagccgaagccatggaggcccaccacaagagtcactacgccttccactgcccccactgtgattttgcttgttccaataagcacctattccgtaaacacaagaagcagggccaccctggcagtgaagagctgcgctgcaccttctgcccctttgccaccttcaacccagtggcttaccaggatcatgtaggcaagatgcatgctcatgaaaagatccaccagtgtcctgagtgcaactttgccactgcccacaagagggtgctcatccgacacatgcttctacatacgggtgagaagccccacaagtgtgagctgtgtgacttcacatgccgagacgtgagctacctatccaagcacatgctgacccactccaacaccaaggattacatgtgcactgaatgtggctatgtcaccaagtggaagcactacctccgtgtgcacatgcgaaaacatgcaggggacctcaggtatcagtgcaaccagtgctcctatcgctgtcaccgggctgatcagctgagcagccacaagctgcggcatcagggcaagtctctgatgtgtgaggtgtgtgccttcgcctgcaagcggaagtatgagctgcagaagcacatggcttcccagcaccaccctggcacaccggccccactctacccttgccactactgcagttaccagagccgccacaagcaggctgtgctgagccatgagaactgcaagcatacccgcctccgtgagttccactgtgccctctgtgactaccgcaccttcagcaacaccacactcttgttccataaacgcaaggcccatggctatgtacctggagaccaggcctggcagctccgctatgcaagccaggagccagaaggggccatgcagggcccaacacccccaccagattcagagccctcaaaccagctgtcagcccgacctgaggggccaggtcacgaacctgggactgtggtggaccccagcttggaccaggccctgccagagatgagtgaggaggtcaacactggaagacaggagggcagtgaggctccccatgggggtgacctgggtggcagtcccagcccagcagaggtggaggagggcagctgcacactacacctagaggccctgggagtagagctggagtctgtgactgagccaccccttgaggaggtcactgaaacagcccctatggagttcaggcccctgggactggaagggccagatggactggaaggaccagagctatctagctttgaaggtattgggacttctgacttgggtgctgaagaaaatccccttctggaaaagccagtgtctgagccctccacaaatcctccatccttagaggaggctcctaacaactgggtaggaaccttcaagacaactccacctgctgagacagcacccttgcccccattacctgagtcagagtcattactcaaggccctaaggagacaggacaaagaacaagcagaggcattggtgctagaggggcgggtgcagatggtagtgatccagggagaggggcgagccttccgctgcccacactgcccttttatcactcgccgggagaaggccctgaatctgcactccaggactgggtgccaaggccgccgagagcccctgctgtgccccgagtgtggggctagcttcaagcaacaacgcggcctcagcacccacctgctgaagaagtgccctgttctactcagaaagaacaagggcttgcccagaccagattcacccatccctctgcaacctgtgctcccaggtacccaggcctcagaggacacagaaagtgggaagcccccacctgcatcacaagaagcagagctactgcttccaaaagatgctcctttggagcttcccagggagccagaagaaacagaagagcctcttgccacagtctctggttccccagtccctcctgcaggaaactccttgcccacagaggcccctaagaagcactgctttgacccagtccctcctgcaggaaactcctcacccacggaggcccctaagaagcaccaccttgacccagtccctcctgcaggaaactcctcacccacagaggccctgaagaagcaccgctttgagcagggcaagtttcactgcaactcctgcccattcctttgttcccggctctcctctattacctctcacgtggctgaaggctgcagggggggacgtggcgggggaggaaaacgagggaccccccagacccagcctgatgtgtccccgttgagcaatggggactctgctcccccgaagaatgggagtacagagtccagctctggtgatggggatacagttctggttcaaaagcagaagggggctcgcttctcctgccctacatgtccctttagctgccagcaggaacgggctctgaggactcaccagatccggggctgccccctcgaggagtctggagagctgcactgcagcctctgcccattcactgctcctgctgccactgccttaaggctccaccagaagcggaggcaccccactgcagccccagcccgtgggccccggccccatctacagtgtggggactgtggcttcacctgtaaacagagccgttgcatgcagcagcaccggcggctcaagcacgagggggtgaagccccatcagtgccccttctgtgacttttcgaccaccagacggtaccggttagaggctcaccagtcccgacacacaggcattggccgcatcccctgcagctcttgcccccagacgtttggtaccaactcgaaactgcgcttgcaccggttaagggtacatgacaaaacacctacccacttctgtccactttgtgactatagtggctaccttcgccatgacatcactcgtcatgtcaacagctgccaccaaggcaccccagcctttgcctgctcccagtgtgaagcccagttcagctcagagacagcacttaagcagcatgctctgcgccgacaccccgagcctgcacagcctgcccctggctctcctgcagagaccactgagggccccctgcactgttcccgctgtgggttgctgtgccccagccctgccagcttacgaggacacacccgtaaacagcacccacggcttgagtgtggggcctgccaggaggccttccctagccgactggctctggatgagcaccggaggcagcagcatttcagccaccgctgtcagctctgtgactttgctgcccgggagcgggtgggcctggtaaagcactacctggaacagcatgaggagacttcagcagccgtggcagcctcagatggggatggggatgctggccagcccccgctacactgccccttttgtgacttcacatgccgccatcagctggtactagatcaccatgtgaaagggcatgggggcactcgtctctacaagtgcaccgattgtgcttacagcaccaagaaccgacagaagatcacctggcacagccgcatccacactggggaaaagccttaccactgtcacctctgcccctatgcctgtgctgatccctctcgtctcaagtaccacatgcggatccacaaggaggaacggaagtacctgtgccctgagtgtggctacaagtgcaagtgggtcaaccagctgaaataccacatgaccaagcatacaggactgaagccataccagtgtcccgagtgtgagtactgcaccaaccgggctgatgcactgcgtgtgcaccaggagacccggcatcgagaagcacgggctttcatgtgtgagcagtgtggcaaggccttcaagacgcgcttcctgctgcgcacccaccttcgcaagcacagtgaggccaaaccctatgtgtgcaatgtgtgccaccgtgctttccgctgggctgctggcctgcgccatcatgccctcacccacaccgaccgccaccccttcttttgccgcctctgcaactacaaggccaagcaaaagttccaggtggtcaagcacgtacgcaggcaccaccctgaccaagccgacccaaaccagggtgtgggcaaagaccccaccacccccacagtgcacctgcatgatgtgcagctggaggatcccagccctcctgctcctgccgctccccacactggacctgagggctgaaagcctgccccacctcctgtataggaagagggtatggtctgagatgtgcagactgggaccagcgctagcctgaggagctcagagcctaaggaaagactggcttttggggtacaagggtgactagaaccttcctgggactctggctatagtactttgaaattatcacccatataaaagagggacatggactataacgttgatttcttattgctgtacattgcgtttttaacctgcaagttctcagtttcttcaccatcactccatcaaagtccctggctataagatctggattttacccactccatcttctctttccttcttactgtgtcaattcctattttctttcagaatcttctaaaaacagttgtatctaaccgcatgtgctgttgtgcctaatgctctataaagcatgttaaacagaaagtggttactacattatagattcatccaaatccctgtcttaacatttccaggctgtcatcttgatcaactctgtcccctctcagacctctgcctcccttttgtcccttccatcttcactcagtattgatactgaaacaggcctaggtctgccttctccctgtccttgagccatcttgacccttgacctgctccctacttccaagctcctttgtctacctgtatctatagagggaggattgctacccactaagcctcctcctagaagcaactttagctcatcatcaatcctcagactggctcagcagctacactaaggtgttaaagcacaaggatactatggaaaggcagatgactagagaggaaaatctccaattcagaattctataactgcttcacagtataattctgtagtgccttactatataattgatcatctaaactgagacacactgggaaaacttaaagagggtactattaataattatgctgggacaacagacataaaccaggatggttccagccagactcttcaggaaggctgggaccacataaccttttgtctgcttttgccctgattcttaaaagccatactctgtgtccttcctatgtagcacatgcaagaggtctc

SEQ ID NO: 277945 - DNA, 6613 bp, Homo sapiens
gggaactctcggaaggaggtactgaagggagcacccagacgagctgggccccggcgctgcagtcgcgtcacggttctggaccccgcccgggtacctgctgctctcaggacaaaatcatgacgatgctccatcccaagccttccaggttacaaaccgcctttccagttcgctggctcttatgatccagctcctgcccgacgatgtggacactgtcatcacctccattttacagataggaaagctgaggcccagagaagcgaagcgactgtgtctgtccaagaccacgcgccctcctgcccggaagataagcgtatttcttctctggtgcccacctgtctcctacctcaccctgccctcccgcaggtgaaggttcttaatcttgacggctcagcgtcctccttggctccccccggaggccatgtatggtcaagcttgaagattccccagaacagcgctaatattcacatttaagaagccaaaacacacaagtcggtggtgatgacagacccccttttggactcacagccagccagtagcaccggggagatggatggactgtgccctgagctattgctgatccccccgcctctctctaaccgtggaatcctggggcctgtccagagcccctgtccttcccgggaccctgcacctatacctactgagccaggctgcctgctggtagaggccacagcaactgaagagggaccagggaacatggagatcattgtggagacagtagctggaaccctgaccccaggtgctcctggagagaccccagctcccaaactgcctccaggagagagagaaccttcacaggaagcaggtacacccttgcctgggcaggagacagctgaagaggagaatgtagagaaagaagagaagagtgacacccagaaggactcccaaaaggctgtggataaaggccaaggggctcagcggctggaaggggatgtggtctctggcaccgagtccctcttcaagacccatatgtgtccagagtgtaagcgctgctttaagaagcggactcatctggtggagcacctgcatctccacttcccagaccccagcctccagtgccctaactgccagaagttcttcaccagtaagagcaagctcaagacccatctgctgcgggagctgggtgaaaaggcccaccactgcccactgtgccactacagtgcggtggagaggaatgcactcaaccgccacatggccagcatgcatgaagatatttccaacttctactcagacacctatgcctgtcctgtctgccgtgaggaattccgcctcagccaggccctaaaggagcacctcaagagccacacggcagcagccgcagcagagccattaccccttcgctgctttcaggagggctgcagctatgcagcacccgaccgcaaggccttcattaagcacctgaaggagacccatggggtgcgggctgtggagtgccgccatcactcatgtcccatgctctttgccacagccgaagccatggaggcccaccacaagagtcactacgccttccactgcccccactgtgattttgcttgttccaataagcacctattccgtaaacacaagaagcagggccaccctggcagtgaagagctgcgctgcaccttctgcccctttgccaccttcaacccagtggcttaccaggatcatgtaggcaagatgcatgctcatgaaaagatccaccagtgtcctgagtgcaactttgccactgcccacaagagggtgctcatccgacacatgcttctacatacgggtgagaagccccacaagtgtgagctgtgtgacttcacatgccgagacgtgagctacctatccaagcacatgctgacccactccaacaccaaggattacatgtgcactgaatgtggctatgtcaccaagtggaagcactacctccgtgtgcacatgcgaaaacatgcaggggacctcaggtatcagtgcaaccagtgctcctatcgctgtcaccgggctgatcagctgagcagccacaagctgcggcatcagggcaagtctctgatgtgtgaggtgtgtgccttcgcctgcaagcggaagtatgagctgcagaagcacatggcttcccagcaccaccctggcacaccggccccactctacccttgccactactgcagttaccagagccgccacaagcaggctgtgctgagccatgagaactgcaagcatacccgcctccgtgagttccactgtgccctctgtgactaccgcaccttcagcaacaccacactcttgttccataaacgcaaggcccatggctatgtacctggagaccaggcctggcagctccgctatgcaagccaggagccagaaggggccatgcagggcccaacacccccaccagattcagagccctcaaaccagctgtcagcccgacctgaggggccaggtcacgaacctgggactgtggtggaccccagcttggaccaggccctgccagagatgagtgaggaggtcaacactggaagacaggagggcagtgaggctccccatgggggtgacctgggtggcagtcccagcccagcagaggtggaggagggcagctgcacactacacctagaggccctgggagtagagctggagtctgtgactgagccaccccttgaggaggtcactgaaacagcccctatggagttcaggcccctgggactggaagggccagatggactggaaggaccagagctatctagctttgaaggtattgggacttctgacttgggtgctgaagaaaatccccttctggaaaagccagtgtctgagccctccacaaatcctccatccttagaggaggctcctaacaactgggtaggaaccttcaagacaactccacctgctgagacagcacccttgcccccattacctgagtcagagtcattactcaaggccctaaggagacaggacaaagaacaagcagaggcattggtgctagaggggcgggtgcagatggtagtgatccagggagaggggcgagccttccgctgcccacactgcccttttatcactcgccgggagaaggccctgaatctgcactccaggactgggtgccaaggccgccgagagcccctgctgtgccccgagtgtggggctagcttcaagcaacaacgcggcctcagcacccacctgctgaagaagtgccctgttctactcagaaagaacaagggcttgcccagaccagattcacccatccctctgcaacctgtgctcccaggtacccaggcctcagaggacacagaaagtgggaagcccccacctgcatcacaagaagcagagctactgcttccaaaagatgctcctttggagcttcccagggagccagaagaaacagaagagcctcttgccacagtctctggttccccagtccctcctgcaggaaactccttgcccacagaggcccctaagaagcactgctttgacccagtccctcctgcaggaaactcctcacccacggaggcccctaagaagcaccaccttgacccagtccctcctgcaggaaactcctcacccacagaggccctgaagaagcaccgctttgagcagggcaagtttcactgcaactcctgcccattcctttgttcccggctctcctctattacctctcacgtggctgaaggctgcagggggggacgtggcgggggaggaaaacgagggaccccccagacccagcctgatgtgtccccgttgagcaatggggactctgctcccccgaagaatgggagtacagagtccagctctggtgatggggatacagttctggttcaaaagcagaagggggctcgcttctcctgccctacatgtccctttagctgccagcaggaacgggctctgaggactcaccagatccggggctgccccctcgaggagtctggagagctgcactgcagcctctgcccattcactgctcctgctgccactgccttaaggctccaccagaagcggaggcaccccactgcagccccagcccgtgggccccggccccatctacagtgtggggactgtggcttcacctgtaaacagagccgttgcatgcagcagcaccggcggctcaagcacgagggggtgaagccccatcagtgccccttctgtgacttttcgaccaccagacggtaccggttagaggctcaccagtcccgacacacaggcattggccgcatcccctgcagctcttgcccccagacgtttggtaccaactcgaaactgcgcttgcaccggttaagggtacatgacaaaacacctacccacttctgtccactttgtgactatagtggctaccttcgccatgacatcactcgtcatgtcaacagctgccaccaaggcaccccagcctttgcctgctcccagtgtgaagcccagttcagctcagagacagcacttaagcagcatgctctgcgccgacaccccgagcctgcacagcctgcccctggctctcctgcagagaccactgagggccccctgcactgttcccgctgtgggttgctgtgccccagccctgccagcttacgaggacacacccgtaaacagcacccacggcttgagtgtggggcctgccaggaggccttccctagccgactggctctggatgagcaccggaggcagcagcatttcagccaccgctgtcagctctgtgactttgctgcccgggagcgggtgggcctggtaaagcactacctggaacagcatgaggagacttcagcagccgtggcagcctcagatggggatggggatgctggccagcccccgctacactgccccttttgtgacttcacatgccgccatcagctggtactagatcaccatgtgaaagggcatgggggcactcgtctctacaagtgcaccgattgtgcttacagcaccaagaaccgacagaagatcacctggcacagccgcatccacactggggaaaagccttaccactgtcacctctgcccctatgcctgtgctgatccctctcgtctcaagtaccacatgcggatccacaaggaggaacggaagtacctgtgccctgagtgtggctacaagtgcaagtgggtcaaccagctgaaataccacatgaccaagcatacaggactgaagccataccagtgtcccgagtgtgagtactgcaccaaccgggctgatgcactgcgtgtgcaccaggagacccggcatcgagaagcacgggctttcatgtgtgagcagtgtggcaaggccttcaagacgcgcttcctgctgcgcacccaccttcgcaagcacagtgaggccaaaccctatgtgtgcaatgtgtgccaccgtgctttccgctgggctgctggcctgcgccatcatgccctcacccacaccgaccgccaccccttcttttgccgcctctgcaactacaaggccaagcaaaagttccaggtggtcaagcacgtacgcaggcaccaccctgaccaagccgacccaaaccagggtgtgggcaaagaccccaccacccccacagtgcacctgcatgatgtgcagctggaggatcccagccctcctgctcctgccgctccccacactggacctgagggctgaaagcctgccccacctcctgtataggaagagggtatggtctgagatgtgcagactgggaccagcgctagcctgaggagctcagagcctaaggaaagactggcttttggggtacaagggtgactagaaccttcctgggactctggctatagtactttgaaattatcacccatataaaagagggacatggactataacgttgatttcttattgctgtacattgcgtttttaacctgcaagttctcagtttcttcaccatcactccatcaaagtccctggctataagatctggattttacccactccatcttctctttccttcttactgtgtcaattcctattttctttcagaatcttctaaaaacagttgtatctaaccgcatgtgctgttgtgcctaatgctctataaagcatgttaaacagaaagtggttactacattatagattcatccaaatccctgtcttaacatttccaggctgtcatcttgatcaactctgtcccctctcagacctctgcctcccttttgtcccttccatcttcactcagtattgatactgaaacaggcctaggtctgccttctccctgtccttgagccatcttgacccttgacctgctccctacttccaagctcctttgtctacctgtatctatagagggaggattgctacccactaagcctcctcctagaagcaactttagctcatcatcaatcctcagactggctcagcagctacactaaggtgttaaagcacaaggatactatggaaaggcagatgactagagaggaaaatctccaattcagaattctataactgcttcacagtataattctgtagtgccttactatataattgatcatctaaactgagacacactgggaaaacttaaagagggtactattaataattatgctgggacaacagacataaaccaggatggttccagccagactcttcaggaaggctgggaccacataaccttttgtctgcttttgccctgattcttaaaagccatactctgtgtccttcctatgtagcacatgcaagaggtctc

SEQ ID NO: 277946 - DNA, 5788 bp, Homo sapiens
caaaacatagagtaccccggcagccggcaagaggaagagagagtggcttccacatccccaatatcctagaggcggctgagccggaggcggtcgcacaaagcgggccccgggggccgttccagccgcggccgaccatagagatgcggctcccgccggctctgggtctggagccttccaggttacaaaccgcctttccagttcgctggctcttatgatccagctcctgcccgacgatgtggacactgtcatcacctccattttacagataggaaagctgaggcccagagaagcgaagcgactgtgtctgtccaagaccacgcgccctcctgcccggaagataagcgtatttcttctctggtgcccacctgtctcctacctcaccctgccctcccgcaggtgaaggttcttaatcttgacggctcagcgtcctccttggctccccccggaggccatgtatggtcaagcttgaagattccccagaacagcgctaatattcacatttaagaagccaaaacacacaagtcggtggtgatgacagacccccttttggactcacagccagccagtagcaccggggagatggatggactgtgccctgagctattgctgatccccccgcctctctctaaccgtggaatcctggggcctgtccagagcccctgtccttcccgggaccctgcacctatacctactgagccaggctgcctgctggtagaggccacagcaactgaagagggaccagggaacatggagatcattgtggagacagtagctggaaccctgaccccaggtgctcctggagagaccccagctcccaaactgcctccaggagagagagaaccttcacaggaagcaggtacacccttgcctgggcaggagacagctgaagaggagaatgtagagaaagaagagaagagtgacacccagaaggactcccaaaaggctgtggataaaggccaaggggctcagcggctggaaggggatgtggtctctggcaccgagtccctcttcaagacccatatgtgtccagagtgtaagcgctgctttaagaagcggactcatctggtggagcacctgcatctccacttcccagaccccagcctccagtgccctaactgccagaagttcttcaccagtaagagcaagctcaagacccatctgctgcgggagctgggtgaaaaggcccaccactgcccactgtgccactacagtgcggtggagaggaatgcactcaaccgccacatggccagcatgcatgaagatatttccaacttctactcagacacctatgcctgtcctgtctgccgtgaggaattccgcctcagccaggccctaaaggagcacctcaagagccacacggcagcagccgcagcagagccattaccccttcgctgctttcaggagggctgcagctatgcagcacccgaccgcaaggccttcattaagcacctgaaggagacccatggggtgcgggctgtggagtgccgccatcactcatgtcccatgctctttgccacagccgaagccatggaggcccaccacaagagtcactacgccttccactgcccccactgtgattttgcttgttccaataagcacctattccgtaaacacaagaagcagggccaccctggcagtgaagagctgcgctgcaccttctgcccctttgccaccttcaacccagtggcttaccaggatcatgtaggcaagatgcatgctcatgaaaagatccaccagtgtcctgagtgcaactttgccactgcccacaagagggtgctcatccgacacatgcttctacatacgggtgagaagccccacaagtgtgagctgtgtgacttcacatgccgagacgtgagctacctatccaagcacatgctgacccactccaacaccaaggattacatgtgcactgaatgtggctatgtcaccaagtggaagcactacctccgtgtgcacatgcgaaaacatgcaggggacctcaggtatcagtgcaaccagtgctcctatcgctgtcaccgggctgatcagctgagcagccacaagctgcggcatcagggcaagtctctgatgtgtgaggtgtgtgccttcgcctgcaagcggaagtatgagctgcagaagcacatggcttcccagcaccaccctggcacaccggccccactctacccttgccactactgcagttaccagagccgccacaagcaggctgtgctgagccatgagaactgcaagcatacccgcctccgtgagttccactgtgccctctgtgactaccgcaccttcagcaacaccacactcttgttccataaacgcaaggcccatggctatgtacctggagaccaggcctggcagctccgctatgcaagccaggagccagaaggggccatgcagggcccaacacccccaccagattcagagccctcaaaccagctgtcagcccgacctgaggggccaggtcacgaacctgggactgtggtggaccccagcttggaccaggccctgccagagatgagtgaggaggtcaacactggaagacaggagggcagtgaggctccccatgggggtgacctgggtggcagtcccagcccagcagaggtggaggagggcagctgcacactacacctagaggccctgggagtagagctggagtctgtgactgagccaccccttgaggaggtcactgaaacagcccctatggagttcaggcccctgggactggaagggccagatggactggaaggaccagagctatctagctttgaaggtattgggacttctgacttgggtgctgaagaaaatccccttctggaaaagccagtgtctgagccctccacaaatcctccatccttagaggaggctcctaacaactgggtaggaaccttcaagacaactccacctgctgagacagcacccttgcccccattacctgagtcagagtcattactcaaggccctaaggagacaggacaaagaacaagcagaggcattggtgctagaggggcgggtgcagatggtagtgatccagggagaggggcgagccttccgctgcccacactgcccttttatcactcgccgggagaaggccctgaatctgcactccaggactgggtgccaaggccgccgagagcccctgctgtgccccgagtgtggggctagcttcaagcaacaacgcggcctcagcacccacctgctgaagaagtgccctgttctactcagaaagaacaagggcttgcccagaccagattcacccatccctctgcaacctgtgctcccaggtacccaggcctcagaggacacagaaagtgggaagcccccacctgcatcacaagaagcagagctactgcttccaaaagatgctcctttggagcttcccagggagccagaagaaacagaagagcctcttgccacagtctctggttccccagtccctcctgcaggaaactccttgcccacagaggcccctaagaagcactgctttgacccagtccctcctgcaggaaactcctcacccacggaggcccctaagaagcaccaccttgacccagtccctcctgcaggaaactcctcacccacagaggccctgaagaagcaccgctttgagcagggcaagtttcactgcaactcctgcccattcctttgttcccggctctcctctattacctctcacgtggctgaaggctgcagggggggacgtggcgggggaggaaaacgagggaccccccagacccagcctgatgtgtccccgttgagcaatggggactctgctcccccgaagaatgggagtacagagtccagctctggtgatggggatacagttctggttcaaaagcagaagggggctcgcttctcctgccctacatgtccctttagctgccagcaggaacgggctctgaggactcaccagatccggggctgccccctcgaggagtctggagagctgcactgcagcctctgcccattcactgctcctgctgccactgccttaaggctccaccagaagcggaggcaccccactgcagccccagcccgtgggccccggccccatctacagtgtggggactgtggcttcacctgtaaacagagccgttgcatgcagcagcaccggcggctcaagcacgagggggtgaagccccatcagtgccccttctgtgacttttcgaccaccagacggtaccggttagaggctcaccagtcccgacacacaggcattggccgcatcccctgcagctcttgcccccagacgtttggtaccaactcgaaactgcgcttgcaccggttaagggtacatgacaaaacacctacccacttctgtccactttgtgactatagtggctaccttcgccatgacatcactcgtcatgtcaacagctgccaccaaggcaccccagcctttgcctgctcccagtgtgaagcccagttcagctcagagacagcacttaagcagcatgctctgcgccgacaccccgagcctgcacagcctgcccctggctctcctgcagagaccactgagggccccctgcactgttcccgctgtgggttgctgtgccccagccctgccagcttacgaggacacacccgtaaacagcacccacggcttgagtgtggggcctgccaggaggccttccctagccgactggctctggatgagcaccggaggcagcagcatttcagccaccgctgtcagctctgtgactttgctgcccgggagcgggtgggcctggtaaagcactacctggaacagcatgaggagacttcagcagccgtggcagcctcagatggggatggggatgctggccagcccccgctacactgccccttttgtgacttcacatgccgccatcagctggtactagatcaccatgtgaaagggcatgggggcactcgtctctacaagtgcaccgattgtgcttacagcaccaagaaccgacagaagatcacctggcacagccgcatccacactggggaaaagccttaccactgtcacctctgcccctatgcctgtgctgatccctctcgtctcaagtaccacatgcggatccacaaggaggaacggaagtacctgtgccctgagtgtggctacaagtgcaagtgggtcaaccagctgaaataccacatgaccaagcatacaggactgaagccataccagtgtcccgagtgtgagtactgcaccaaccgggctgatgcactgcgtgtgcaccaggagacccggcatcgagaagcacgggctttcatgtgtgagcagtgtggcaaggccttcaagacgcgcttcctgctgcgcacccaccttcgcaagcacagtgaggccaaaccctatgtgtgcaatgtgtgccaccgtgctttccgctgggctgctggcctgcgccatcatgccctcacccacaccgaccgccaccccttcttttgccgcctctgcaactacaaggccaagcaaaagttccaggtggtcaagcacgtacgcaggcaccaccctgaccaagccgacccaaaccagggtgtgggcaaagaccccaccacccccacagtgcacctgcatgatgtgcagctggaggatcccagccctcctgctcctgccgctccccacactggacctgagggctgaaagcctgccccacctcctgtataggaagagggtatggtctgagatgtgcagactgggaccagcgctagcctgaggagctcagagcctaaggaaagactggcttttggggtacaagggtgactagaaccttcctgggactctggctatagtactttgaaattatcacccatataaaagagggacatggactata

SEQ ID NO: 277947 - DNA, 5040 bp, Homo sapiens
caaaacatagagtaccccggcagccggcaagaggaagagagagtggcttccacatccccaatatcctagaggcggctgagccggaggcggtcgcacaaagcgggccccgggggccgttccagccgcggccgaccatagagatgcggctcccgccggctctgggtctggagccttccaggttacaaaccgcctttccagttcgctggctcttatgatccagctcctgcccgacgatgtggacactgtcatcacctccattttacagataggaaagctgaggcccagagaagcgaagcgactgtgtctgtccaagaccacgcgccctcctgcccggaagataagcgtatttcttctctggtgcccacctgtctcctacctcaccctgccctcccgcaggtgaaggttcttaatcttgacggctcagcgtcctccttggctccccccggaggccatgtatggtcaagcttgaagattccccagaacagcgctaatattcacatttaagaagccaaaacacacaagtcggtggtgatgacagacccccttttggactcacagccagccagtagcaccggggagatggatggactgtgccctgagctattgctgatccccccgcctctctctaaccgtggaatcctggggcctgtccagagcccctgtccttcccgggaccctgcacctatacctactgagccaggctgcctgctggtagaggccacagcaactgaagagggaccagggaacatggagatcattgtggagacagtagctggaaccctgaccccaggtgctcctggagagaccccagctcccaaactgcctccaggagagagagaaccttcacaggaagcaggtacacccttgcctgggcaggagacagctgaagaggagaatgtagagaaagaagagaagagtgacacccagaaggactcccaaaaggctgtggataaaggccaaggggctcagcggctggaaggggatgtggtctctggcaccgagtccctcttcaagacccatatgtgtccagagtgtaagcgctgctttaagaagcggactcatctggtggagcacctgcatctccacttcccagaccccagcctccagtgccctaactgccagaagttcttcaccagtaagagcaagctcaagacccatctgctgcgggagctgggtgaaaaggcccaccactgcccactgtgccactacagtgcggtggagaggaatgcactcaaccgccacatggccagcatgcatgaagatatttccaacttctactcagacacctatgcctgtcctgtctgccgtgaggaattccgcctcagccaggccctaaaggagcacctcaagagccacacggcagcagccgcagcagagccattaccccttcgctgctttcaggagggctgcagctatgcagcacccgaccgcaaggccttcattaagcacctgaaggagacccatggggtgcgggctgtggagtgccgccatcactcatgtcccatgctctttgccacagccgaagccatggaggcccaccacaagagtcactacgccttccactgcccccactgtgattttgcttgttccaataagcacctattccgtaaacacaagaagcagggccaccctggcagtgaagagctgcgctgcaccttctgcccctttgccaccttcaacccagtggcttaccaggatcatgtaggcaagatgcatgctcatgaaaagatccaccagtgtcctgagtgcaactttgccactgcccacaagagggtgctcatccgacacatgcttctacatacgggtgagaagccccacaagtgtgagctgtgtgacttcacatgccgagacgtgagctacctatccaagcacatgctgacccactccaacaccaaggattacatgtgcactgaatgtggctatgtcaccaagtggaagcactacctccgtgtgcacatgcgaaaacatgcaggggacctcaggtatcagtgcaaccagtgctcctatcgctgtcaccgggctgatcagctgagcagccacaagctgcggcatcagggcaagtctctgatgtgtgaggtgtgtgccttcgcctgcaagcggaagtatgagctgcagaagcacatggcttcccagcaccaccctggcacaccggccccactctacccttgccactactgcagttaccagagccgccacaagcaggctgtgctgagccatgagaactgcaagcatacccgcctccgtgagttccactgtgccctctgtgactaccgcaccttcagcaacaccacactcttgttccataaacgcaaggcccatggctatgtacctggagaccaggcctggcagctccgctatgcaagccaggagccagaaggggccatgcagggcccaacacccccaccagattcagagccctcaaaccagctgtcagcccgacctgaggggccaggtcacgaacctgggactgtggtggaccccagcttggaccaggccctgccagagatgagtgaggaggtcaacactggaagacaggagggcagtgaggctccccatgggggtgacctgggtggcagtcccagcccagcagaggtggaggagggcagctgcacactacacctagaggccctgggagtagagctggagtctgtgactgagccaccccttgaggaggtcactgaaacagcccctatggagttcaggcccctgggactggaagggccagatggactggaaggaccagagctatctagctttgaaggtattgggacttctgacttgggtgctgaagaaaatccccttctggaaaagccagtgtctgagccctccacaaatcctccatccttagaggaggctcctaacaactgggtaggaaccttcaagacaactccacctgctgagacagcacccttgcccccattacctgagtcagagtcattactcaaggccctaaggagacaggacaaagaacaagcagaggcattggtgctagaggggcgggtgcagatggtagtgatccagggagaggggcgagccttccgctgcccacactgcccttttatcactcgccgggagaaggccctgaatctgcactccaggactgggtgccaaggccgccgagagcccctgctgtgccccgagtgtggggctagcttcaagcaacaacgcggcctcagcacccacctgctgaagaagtgccctgttctactcagaaagaacaagggcttgcccagaccagattcacccatccctctgcaacctgtgctcccaggtacccaggcctcagaggacacagaaagtgggaagcccccacctgcatcacaagaagcagagctactgcttccaaaagatgctcctttggagcttcccagggagccagaagaaacagaagagcctcttgccacagtctctggttccccagtccctcctgcaggaaactccttgcccacagaggcccctaagaagcactgctttgacccagtccctcctgcaggaaactcctcacccacggaggcccctaagaagcaccaccttgacccagtccctcctgcaggaaactcctcacccacagaggccctgaagaagcaccgctttgagcagggcaagtttcactgcaactcctgcccattcctttgttcccggctctcctctattacctctcacgtggctgaaggctgcagggggggacgtggcgggggaggaaaacgagggaccccccagacccagcctgatgtgtccccgttgagcaatggggactctgctcccccgaagaatgggagtacagagtccagctctggtgatggggatacagttctggttcaaaagcagaagggggctcgcttctcctgccctacatgtccctttagctgccagcaggaacgggctctgaggactcaccagatccggggctgccccctcgaggagtctggagagctgcactgcagcctctgcccattcactgctcctgctgccactgccttaaggctccaccagaagcggaggcaccccactgcagccccagcccgtgggccccggccccatctacagtgtggggactgtggcttcacctgtaaacagagccgttgcatgcagcagcaccggcggctcaagcacgagggggtgaagccccatcagtgccccttctgtgacttttcgaccaccagacggtaccggttagaggctcaccagtcccgacacacaggcattggccgcatcccctgcagctcttgcccccagacgtttggtaccaactcgaaactgcgcttgcaccggttaagggtacatgacaaaacacctacccacttctgtccactttgtgactatagtggctaccttcgccatgacatcactcgtcatgtcaacagctgccaccaaggcaccccagcctttgcctgctcccagtgtgaagcccagttcagctcagagacagcacttaagcagcatgctctgcgccgacaccccgagcctgcacagcctgcccctggctctcctgcagagaccactgagggccccctgcactgttcccgctgtgggttgctgtgccccagccctgccagcttacgaggacacacccgtaaacagcacccacggcttgagtgtggggcctgccaggaggccttccctagccgactggctctggatgagcaccggaggcagcagcatttcagccaccgctgtcagctctgtgactttgctgcccgggagcgggtgggcctggtaaagcactacctggaacagcatgaggagacttcagcagccgtggcagcctcagatggggatggggatgctggccagcccccgctacactgccccttttgtgacttcacatgccgccatcagctggtactagatcaccatgtgaaagggcatgggggcactcgtctctacaagtgcaccgattgtgcttacagcaccaagaaccgacagaagatcacctggcacagccgcatccacactggggaaaagccttaccactgtcacctctgcccctatgcctgtgctgatccctctcgtctcaaggtaatgtcagaggatatgggg

SEQ ID NO: 277948 - DNA, 550 bp, Homo sapiens
ctgaagagggaccagggaacatggagatcattgtggagacagtagctggaaccctgaccccaggtgctcctggagagaccccaggtacaaacacagttgcaagcaggccagtgggacaagcagctctgaggttttgtctgggttatttttgattctgtataaatatgatgagaacacaaggtagcatcctatttttatacttggagatgttgtcatttggtttgcagttggtgcatgttgattgaaggctggcgaagtggtgcacagccttctaccaagcttttggcagtctgtcctgcaagggcttcatgtgtgctaggcagtaatccagaaagtaagacctttctgacacctccgcccaatcctggcttgtccctactcttacagtccttggagattctttcctccatattgaccctcctacccaggaactgcagccagggattaagcaaaaaccctgtctctaccaccctgggcttggcagggctttccagaagtgatctggtatttccctgccctagttttttgtgtataacatactttactcatc

SEQ ID NO: 277949 - DNA, 870 bp, Homo sapiens
tgggcattctggagactctgattggctgggcagatgggctgactggctgggcagatgggtgggtgagttccctctccccagagccatcggccaggtaccaaagctcagctgtatggattcccaacaggaggacctgcgcttccctgggatgtgggtctcattgtactttggaatcctggggctgtgttctgtgataactggagggtgcattatctttctgcactggaggaagaacttgaggcgggaagagcatgcccagcagtgggtggaggtgatgagagctgccacattcacctacagcccattgttgtactggattaacaagcgacggcgctacggcatgaatgcagccatcaacacgggccctgcccctgctgtcaccaagactgagactgaggtccagaatccagatgttctgtgggatttggacatccccgaaggcaggagccatgctgaccaagacagcaaccccaaggcggaagcccctgctcccctgcaacctgcactgcagctggctccacagcagccccaggccagatccccattcccacttcccatctttcaggaggtgccctttgccccacccttgtgcaacctaccccccctgctgaaccactctgtctcctatcctttggccacctgtcctgaaaggaatgttctcttccattccctcctgaatctggcccaggaagaccatagcttcaatgccaagccttttccttcagaactgtagcctcctctcactgaaggtgggagctgcaggaatcaggtgcagagtaggaaatggaactaacctcaggaaggtggtattgacagaggtcaggacccacctggatgtcatgctatgaaacattaaaagaaaaaaaaaaa

SEQ ID NO: 277950 - DNA, 975 bp, Homo sapiens
cacatgcccccgctagacctagcttttgtgatctgtaaagagttaaaggtggtgcttaagctccctggaaatctagctttgactgaataagggaatgatgaggcaagtcaataagggagggaaggaacggtgagagtagttaagtggatggagtgattgatgcatgggttaagtgaaagaggaatgagaaacagctcaggccccaagctacagctatcagccagcatgcctctttttctttcttgctgccttagtgtgggtctcattgtactttggaatcctggggctgtgttctgtgataactggagggtgcattatctttctgcactggaggaagaacttgaggcgggaagagcatgcccagcagtgggtggaggtgatgagagctgccacattcacctacagcccattgttgtactggattaacaagcgacggcgctacggcatgaatgcagccatcaacacgggccctgcccctgctgtcaccaagactgagactgaggtccagaatccagatgttctgtgggatttggacatccccgaaggcaggagccatgctgaccaagacagcaaccccaaggcggaagcccctgctcccctgcaacctgcactgcagctggctccacagcagccccaggccagatccccattcccacttcccatctttcaggaggtgccctttgccccacccttgtgcaacctaccccccctgctgaaccactctgtctcctatcctttggccacctgtcctgaaaggaatgttctcttccattccctcctgaatctggcccaggaagaccatagcttcaatgccaagccttttccttcagaactgtagcctcctctcactgaaggtgggagctgcaggaatcaggtgcagagtaggaaatggaactaacctcaggaaggtggtattgacagaggtcaggacccacctggatgtcatgctatgaaacattaaaagaaaaaaaaaaa

SEQ ID NO: 277951 - DNA, 2143 bp, Homo sapiens
ctgcgcagcagctggatcttgtcgcggtagcggtcgtagaaagggttggcctggagctcggcctcggccccgaccccgctgctgtcggcgcccccctcgggccggcccgagccggggcgcactgggaagacgcgcagctgcgcgggtgacacgagccccaggcccagggcgcggctgcgcaccgcgcacaggccccggtagagaccggccacctgcaggaccgccggtcccgcgccacccgcagccgccaccaccacagcagccatggccgcccccgcctcctcctcctcctcaggcgcgtcggcctcggcccgcggcccgcgcgcccgctccatcccgctccgagtgcgccgcgcccgcgctccggcaccgaggttccgcgcgcccaaggttccgggcgcgggatagcggcgaggcggggcggggaggagggggcgcgccgctctggccccggcactgcgcgctctcgccgccctgtgtatgccacggcccgcctcctccagggaggctgcccaaattcaacgcccttcctccctctgggaccagcagcctctgcgcgccaagtccgttctctaaagccagcggatctccaggtcctcgcggtgcttgcccctggcactcgctgtagtgccaggcactcgatgtagtagtccgtccttcagcatcgaaggtcttttcatcaactataatcacagcagcaagcttctctttactgaggttgctatgtgcaggacactgagcggcttcatactctgtgtggcagtattatcctcatctaacaaataaggaaactgaggccgagagtaattatgtgacttgttcaagttctacccgacagctgagctcttttcaagatggcagctgcctcccaagcctccttttcctctgcttcctgacatcctccttgaactccagccacagtgacctattctctcccaaagaaacaccaggattactccttgaagagtccttattcaggccctttttgacccctggaatcctctctccttccattctctcaacccaaatgccacaatcttccttaccgtctgaaccaggtgtgagctcctagggtcagggacagtgacattaacatctctgtgtcccacctgctcacagaacagggccagtcctggagtgggctctctgggacagtactcatcatcaggtccttcttgtctgggttttgtctgattgaagcccctcctgggacaggggcagagccttcaactctgctcaatccaacctatgctcatggagatcagccctgagccctgccctgtgcgaggaacagtgtaatggaagatgaataagtccttcaagtatgccagcccatacctggctcacactcctaacacttgctgttttctctgtggatctgcatgtggctgcctcctcatcatctaagggctcagttcacattgtgggtctcattgtactttggaatcctggggctgtgttctgtgataactggagggtgcattatctttctgcactggaggaagaacttgaggcgggaagagcatgcccagcagtgggtggaggtgatgagagctgccacattcacctacagcccattgttgtactggattaacaagcgacggcgctacggcatgaatgcagccatcaacacgggccctgcccctgctgtcaccaagactgagactgaggtccagaatccagatgttctgtgggatttggacatccccgaaggcaggagccatgctgaccaagacagcaaccccaaggcggaagcccctgctcccctgcaacctgcactgcagctggctccacagcagccccaggccagatccccattcccacttcccatctttcaggaggtgccctttgccccacccttgtgcaacctaccccccctgctgaaccactctgtctcctatcctttggccacctgtcctgaaaggaatgttctcttccattccctcctgaatctggcccaggaagaccatagcttcaatgccaagccttttccttcagaactgtagcctcctctcactgaaggtgggagctgcaggaatcaggtgcagagtaggaaatggaactaacctcaggaaggtggtattgacagaggtcaggacccacctggatgtcatgctatgaaacattaaaagaaaaaaaaaaa

SEQ ID NO: 277952 - DNA, 719 bp, Homo sapiens
tgggcattctggagactctgattggctgggcagatgggctgactggctgggcagatgggtgggtgagttccctctccccagagccatcggccaggtaccaaagctcagctgtatggattcccaacaggaggacctgcgcttccctgggacccattgttgtactggattaacaagcgacggcgctacggcatgaatgcagccatcaacacgggccctgcccctgctgtcaccaagactgagactgaggtccagaatccagatgttctgtgggatttggacatccccgaaggcaggagccatgctgaccaagacagcaaccccaaggcggaagcccctgctcccctgcaacctgcactgcagctggctccacagcagccccaggccagatccccattcccacttcccatctttcaggaggtgccctttgccccacccttgtgcaacctaccccccctgctgaaccactctgtctcctatcctttggccacctgtcctgaaaggaatgttctcttccattccctcctgaatctggcccaggaagaccatagcttcaatgccaagccttttccttcagaactgtagcctcctctcactgaaggtgggagctgcaggaatcaggtgcagagtaggaaatggaactaacctcaggaaggtggtattgacagaggtcaggacccacctggatgtcatgctatgaaacattaaaagaaaaaaaaaaa

SEQ ID NO: 277953 - DNA, 794 bp, Homo sapiens
cgtcagtcccgctgtctgtgtcaaatcagaaaaagaacctgaccgtgaggactagagtaagaggctgtgaagactgccgcctcctcgcacgacccacaccgtcgagtgtccggagatggacgggaaaagctaccacagtggcatggccttatttcctgatcttaacagcatttgtttgccatgagaggctgcatgacttggagccagtcaatctacggtgacagcaaagcagttgtgactctaatgtactgccaccaaaaacactttcttttccgtctctcagccttagcaggatcatctgagccactgccagttcagagtgagctggggctgcttttccaggagggcagttggggacctgacttttgaggagattctgaggtttactgaaggagcaaaccctatggggttagacagagttttgtgaaatctgagctctgccttctctgtacttcagttactgcctctgtaaaatgggggtgtggacactgtagacattaaatggcagtgtataaaggaggcaccatctggagcatttgtccagcctgcaatgatgccgtttgtctgagaaggttgtagggatcatttctggtttgaatctcagccctcttcccagctcagccaccagccatctggaattgtgggagaggtcagacggctgcaaagcctctatgtggaattggaactaaatacacatatttatcagtatttaatggaagactgcaggatgcttgcagagtctacagaaggcactggtaaggtggctcttttagtctgggaacaagaactgggca

SEQ ID NO: 277954 - DNA, 428 bp, Homo sapiens
tgtctctagctttatagctttgtaagtgcatcatcatttgaagataacaaaatgctctccttggattttatcctgaatttatcctacatattctcaggtcctaaactctgagtccgcagactgagatgacgccccggattttgtgggcagcgctgcaacttaccctctccgaaagcccgggagtaggggagcggctcctccggcccccagccctcggcgctcccagtcacctctccgaaatgactggaggtccagttgagcggtgactgtcggtgcttctgagtggcaaccttggtgacttcctctctaccgccgttatgtttctctctttgatagcctttaaaaaatattgaaaatgtgagactgataatgattgagaaacaaatattttatgcaattaaaactgaaattatgaataaaatgtttct

SEQ ID NO: 277955 - DNA, 399 bp, Homo sapiens
actggaaattaacaaggaatgatgcagatgaacacctgcagcaagaaccactctacacctgtccacaggtcctaaactctgagtccgcagactgagatgacgccccggattttgtgggcagcgctgcaacttaccctctccgaaagcccgggagtaggggagcggctcctccggcccccagccctcggcgctcccagtcacctctccgaaatgactggaggtccagttgagcggtgactgtcggtgcttctgagtggcaaccttggtgacttcctctctaccgccgttatgtttctctctttgatagcctttaaaaaatattgaaaatgtgagactgataatgattgagaaacaaatattttatgcaattaaaactgaaattatgaataaaatgtttct

SEQ ID NO: 277956 - DNA, 618 bp, Homo sapiens
cccggtttctgcaaagtggagcgggggtggggcggggtagcggaactcatgcgctgggcgtcagaaacccggcaggggaatggggtcccagattccgggcacgtgcacatgggtgaagaagctgttgaaaatacagctacaatctttttctgctctcctcccaactcatcttgcccctccctacctctgaacagtcgccttccaacacaagcaacaataaagtttagtctacggtcctcagagctgccggaagagaagaatcaatggatgataaaataactagacaatgatgggtaggagtgatggaagttcactgtaagctcctataaccccccatcaccatcaccacatgcctaatacaacctgcagacacacttactcgcaacagacctgcaatctgggctctcttttccttcttgatggaggcctcaaaacctcagcagttgtacccattaaactaaaatgctttttccctcttagtatttcttggtttcccgtgtgtactttacttccaaagagttgcaaatgcatttgcatccccatagttctgcagtcggtgaaccctggaattttgatggactcccacgggggtgctggatgccacaggaactttttaca

SEQ ID NO: 277957 - DNA, 480 bp, Homo sapiens
cccggtttctgcaaagtggagcgggggtggggcggggtagcggaactcatgcgctgggcgtcagaaacccggcaggggaatggggtcccagattccgggcacgtgcacatgggtgaagaagctgttgaaaatacagctacaatctttttctgctctcctcccaactcatcttgcccctccctacctctgaacagtcgccttccaacacaagcaacaataaagtttagtctacggtcctcagagctgccggaagagaagaatcaatggatgataaaataactagacaatgatgggtaggagtgatggaagttcactgtaagctcctataaccccccatcaccatcaccacatgcctaatacaacctgcagacacacttactcgcaacagacctgcaatctgggctctcttttccttcttgatggaggcctcaaaacctcagcagttgtacccattaaactaaaatgctttttccctcttag

SEQ ID NO: 277958 - DNA, 1065 bp, Homo sapiens
caaccaccaggtctatgagggtccctgttgtccctcagccaaggctgctctctcccctagatccccacctcaccagggtcacaaggatacacacaactattgcaggaaacataggttcttcctgcaatacaattaaagctgctaacatttactgagtacctactggttgttgtgaggatattgaggttcagaagggctaagtgacttgcccaaggtcatccagttaattgttaaggcagtattcataactcgagcctgtcagactctagaatccactttatttttcctctgctacactgccctggctccctaccctacaagtgcttagagatctaaagcaaagtagaaaaggaaaagtgagcaagacggaggggcttttacattttcactgcctggctcccaacccagactctggcaaggctaattccatgatgtttcactcagcggcagtcccaccagcctggagccctggggagctgaccagagtcaaaaggctccctggcaggcttgttctggcagctgcccagccgacttgtgctaacacagcaacaggcacaggaaagagtctagaaagagtggaaaagcaccagacactgaaccgctgcagggagagaagtgattcctgccgtgctcggagaggaccctatactaaagccaccaccatcattgggctgggaagagacgggggtaagcggggagcaaaaagccccaagcacatccactcactcatgtgtttcagtgaactgtgactggaaggccagtcaaaaagagggtcacatgcctccaaggtgaatcagcaagcatggaagaaaaccggtctgcaccttggttcatcccagcaaccctgacctgtctatacccacgtccacataaaccttgctatctaatgtcacccgagcagaggcaagagcacatatactatcttacagccaccgcaacggctgatttcagccagcctgtgggaaagaaagatctagctgagaacactaatagacttgctagaggaagaattcagtgacaaagtgcccttggaaaggaaagaaaagaatttaaaagggggcacaa

SEQ ID NO: 277959 - DNA, 924 bp, Homo sapiens
aagcatgaaagaaaaactgtcactcaccaaagtgaagcttctggagcgagagctgctgcttcgactctccaggctgccgcctctgctgaaggctcggagcctgcagctgggggacgtgtctgagttcatgtcagatgcgtctgatttccggtgggttacaggcatctccacagagtcctcagggccggctcgatcacaggaagcagggcaggagccagcagcccattctgcggcaacagctcactcctagagacaccaaacacgaatgacaatggtcagtaagccgagactgtaaaacgcctcaatccctcaaaaacatggcttagattaatctccactctcagactcgaccattagggtaaaggcgattgggaaacgctaagtcaaccagtttgaggatgctgactgccatgtctcctttatattgttaaccattctgaacacataagaataatttttaaaagtttgttgttgtttttttttcagagatagagtcttgctatgttgtccaggctgacactgaactcttgggctccaacgatcctcctgccccggcctcctgagtacctgggattataggcacaagtcaccatgcccagccggaataatctgaaggaaagacgggtatattcaagatgactttgctgctggaaatatgacagaataatgtggtatcttcttctgcacttccaagctctttcacactcaggctcttcctggcttttctgcctcagccaccataaactgtggttgcttctccagctctgttacagttcagacttgaggggaggtgacaagagctaacatgttaccatggggagcctggctgacatctccgaaactgaagactctatggaagcctcatgctattgcaatgtgtacatcaaaagtaaagtaccccaggttaaaactatgaggaagttg

SEQ ID NO: 277960 - DNA, 676 bp, Homo sapiens
aatctgtgcagttttttctagaaaacaaggctgtgaacgagaccagagccataaccgcaatgagatacatgtacagttttgattataaaaccaaagaataatggcttcacaagatgacggctgggctcctgggctgccttcagtgtctttaaacaggtaatacagatcttgctttcttctctctctctctgagagatcttgactgagacagacacaccccaagtgtgcagcatttgaggcgctccgagaccctcatgagcttgggtcctccatggctgcctcgtcactatatggtgagttcctaaaagggggcaaactgagtcttatcccatcacctctcagttcttatatacagtaggcatgtatgaaatgttgagtgaattggccttttagaacagctactgagttatgttttaaagcagctgtttgaccaggaccatttggattccagctgggtgagaaggcagcatgaaagggcggggttatggctgatggggcggctcctccctcaaggcacctccggttcagtgtcccctcctgaagtcacagagcaaacagcacatcagatttctagcacactcctcagactttgctccggcccggccacgtgggaagccccccagtgcttgccatgccttcttagtccatgagccatgtgtggggccaaaggtgtcaa

SEQ ID NO: 277961 - DNA, 2185 bp, Homo sapiens
accttggtgtgtggtgttcccccccctggtgttcttctcccccccccccaggctgtgggtgtgctctctttccccaccagttgatccgccctcgcgccgcgctgctttctctcgcctcccctgtgctgtgggttgttttatagcgccgcggccgccgcccgctgtcgcctgtgatagttgaaggctcgcccccctccactttgtgggggcgccccttctgtttctcgcataagcatcgtgtggctggcgcgtgcacttggtgtgcccctccgcgcggcggggttttgggggggcccccccctctctttttttttttttttttttttttttttttttttttttttttttttttttttttttttttttttttttttttttttttttgaaacaagcatttttttttattattttcttagaaaaggcggcgagaatcctgagtggaagggatctgaactttcatgtcatgtacttcgagaagagggtagatgagactcaagaatgataatcagaccagtcctactcctcccaacccccaaaagatggcatttacacatcacggaaacctatgggtctaacaggttattctctctctctcagttcttgggaaaagggagacaagccctcggccagattcctttagggaagagttctctgtgccggtggctggagcttgcggtgcgtgctcagccaggaggccccagccaggcacctctagactccgatgtgccacagagggcaggggctcccgctgtcacttccattttagaccaaacagctcctgggtgcagcgactctttcaccctctcttcagggtggggagaaacagggtggactggagcccgcgcggccctcacgaactctccctgagcagccccagcttccgcagggcctccctgcgcgcctcctccgaggagccgcggcccacgaactgcacggtgatgccctggggccggggcagggagtctgcgcggcgccagtcctgggcgccgttgggctgccggggcccggggaagctctgacgggcccgcgtgctgggcagggccgggccagggcggaagcagagggacttcccagcgggcgcgaaggagctgggtgcgctcttcagggcctcgtgcgcacttgggaagccgttggccagcgccgggccccgcggagcctgaccccctgcccggagactctcagcggggcccggcaggccccggccacgcgccacccgctccggggaggagccgccccctggggccccctcgccggcgtcccccgcggcggggaaggcgccggcgtggccgtggatggtggccaacacctgcgccctgcgctcctgcacgctgacggccgccctggacagggtcctgcggggctcccgggccgcgccgttggtgcaggccctggaagacaagggaggagcctgtgagccaccggcccacgtgaaagtaaatgcatgaagttccctctcgctgaactgaaaagagcctcaacctggacctgacaccaacttcgccggtgctgcctggctggttgctctagcgccctgaaggagaggaatgcagtcatatttcactgtgattttcagtgtcatttccacgaagactaatgatgttgagcttgtttttctccataatacaggaaagagacccaaacccatgaagaatgagatacatgtacagttttgattataaaaccaaagaataatggcttcacaagatgacggctgggctcctgggctgccttcagtgtctttaaacagagatagagtcttgctatgttgtccaggctgacactgaactcttgggctccaacgatcctcctgccccggcctcctgagtacctgggattataggcacaagtcaccatgcccagccggaataatctgaaggaaagacgggtatattcaagatgactttgctgctggaaatatgacagaataatgtggtatcttcttctgcacttccaagctctttcacactcaggctcttcctggcttttctgcctcagccaccataaactgtggttgcttctccagctctgttacagttcagacttgaggggaggtgacaagagctaacatgttaccatggggagcctggctgacatctccgaaactgaagactctatggaagcctcatgctattgcaatgtgtacatcaaaagtaaagtaccccaggttaaaactatgaggaagttg

SEQ ID NO: 277962 - DNA, 1993 bp, Homo sapiens
cagtaaaaaacaaaactgggcaaactaaagtacgtcaagaaacaaaagcaaagtaccatgatgcctcacccttcaaaaacaaaagcaagtatattaagacattaaaaaatgaaacaagcatttttttttattattttcttagaaaaggcggcgagaatcctgagtggaagggatctgaactttcatgtcatgtacttcgagaagagggtagatgagactcaagaatgataatcagaccagtcctactcctcccaacccccaaaagatggcatttacacatcacggaaacctatgggtctaacaggttattctctctctctcagttcttgggaaaagggagacaagccctcggccagattcctttagggaagagttctctgtgccggtggctggagcttgcggtgcgtgctcagccaggaggccccagccaggcacctctagactccgatgtgccacagagggcaggggctcccgctgtcacttccattttagaccaaacagctcctgggtgcagcgactctttcaccctctcttcagggtggggagaaacagggtggactggagcccgcgcggccctcacgaactctccctgagcagccccagcttccgcagggcctccctgcgcgcctcctccgaggagccgcggcccacgaactgcacggtgatgccctggggccggggcagggagtctgcgcggcgccagtcctgggcgccgttgggctgccggggcccggggaagctctgacgggcccgcgtgctgggcagggccgggccagggcggaagcagagggacttcccagcgggcgcgaaggagctgggtgcgctcttcagggcctcgtgcgcacttgggaagccgttggccagcgccgggccccgcggagcctgaccccctgcccggagactctcagcggggcccggcaggccccggccacgcgccacccgctccggggaggagccgccccctggggccccctcgccggcgtcccccgcggcggggaaggcgccggcgtggccgtggatggtggccaacacctgcgccctgcgctcctgcacgctgacggccgccctggacagggtcctgcggggctcccgggccgcgccgttggtgcaggccctggaagacaagggaggagcctgtgagccaccggcccacgtgaaagtaaatgcatgaagttccctctcgctgaactgaaaagagcctcaacctggacctgacaccaacttcgccggtgctgcctggctggttgctctagcgccctgaaggagaggaatgcagtcatatttcactgtgattttcagtgtcatttccacgaagactaatgatgttgagcttgtttttctccataatacaggaaagagacccaaacccatgaagaatgagatacatgtacagttttgattataaaaccaaagaataatggcttcacaagatgacggctgggctcctgggctgccttcagtgtctttaaacaggtaatacagatcttgctttcttctctctctctctgagagatcttgactgagacagacacaccccaagtgtgcagcatttgaggcgctccgagaccctcatgagcttgggtcctccatggctgcctcgtcactatatggtgagttcctaaaagggggcaaactgagtcttatcccatcacctctcagttcttatatacagtaggcatgtatgaaatgttgagtgaattggccttttagaacagctactgagttatgttttaaagcagctgtttgaccaggaccatttggattccagctgggtgagaaggcagcatgaaagggcggggttatggctgatggggcggctcctccctcaaggcacctccggttcagtgtcccctcctgaagtcacagagcaaacagcacatcagatttctagcacactcctcagactttgctccggcccggccacgtgggaagccccccagtgcttgccatgccttcttagtccatgagccatgtgtggggccaaaggtgtcaa

SEQ ID NO: 277963 - DNA, 367 bp, Homo sapiens
ccactgcacccggccaataatggttacttctagctagatactactgtcatgtttcaagatggctcacttaaacctgtacttctggcaggaaagagacccaaacccatgaagaatgagatacatgtacagttttgattataaaaccaaagaataatggcttcacaagatgacggctgggctcctgggctgccttcagtgtctttaaacaggtaatacagatcttgctttcttctctctctctctgagagatcttgactgagacagacacaccccaagtgtgcagcatttgaggcgctccgagaccctcatgagcttgggtcctccatggctgcctcgtcactatatggtgagttcctaaaagggggca

SEQ ID NO: 277964 - DNA, 1911 bp, Homo sapiens
cagtaaaaaacaaaactgggcaaactaaagtacgtcaagaaacaaaagcaaagtaccatgatgcctcacccttcaaaaacaaaagcaagtatattaagacattaaaaaatgaaacaagcatttttttttattattttcttagaaaaggcggcgagaatcctgagtggaagggatctgaactttcatgtcatgtacttcgagaagagggtagatgagactcaagaatgataatcagaccagtcctactcctcccaacccccaaaagatggcatttacacatcacggaaacctatgggtctaacaggttattctctctctctcagttcttgggaaaagggagacaagccctcggccagattcctttagggaagagttctctgtgccggtggctggagcttgcggtgcgtgctcagccaggaggccccagccaggcacctctagactccgatgtgccacagagggcaggggctcccgctgtcacttccattttagaccaaacagctcctgggtgcagcgactctttcaccctctcttcagggtggggagaaacagggtggactggagcccgcgcggccctcacgaactctccctgagcagccccagcttccgcagggcctccctgcgcgcctcctccgaggagccgcggcccacgaactgcacggtgatgccctggggccggggcagggagtctgcgcggcgccagtcctgggcgccgttgggctgccggggcccggggaagctctgacgggcccgcgtgctgggcagggccgggccagggcggaagcagagggacttcccagcgggcgcgaaggagctgggtgcgctcttcagggcctcgtgcgcacttgggaagccgttggccagcgccgggccccgcggagcctgaccccctgcccggagactctcagcggggcccggcaggccccggccacgcgccacccgctccggggaggagccgccccctggggccccctcgccggcgtcccccgcggcggggaaggcgccggcgtggccgtggatggtggccaacacctgcgccctgcgctcctgcacgctgacggccgccctggacagggtcctgcggggctcccgggccgcgccgttggtgcaggccctggaagacaagggaggagcctgtgagccaccggcccacgtgaaagtaaatgcatgaagttccctctcgctgaactgaaaagagcctcaacctggacctgacaccaacttcgccggtgctgcctggctggttgctctagcgccctgaaggagaggaatgcagtcatatttcactgtgattttcagtgtcatttccacgaagactaatgatgttgagcttgtttttctccataatacaggaaagagacccaaacccatgaagaatgagatacatgtacagttttgattataaaaccaaagaataatggcttcacaagatgacggctgggctcctgggctgccttcagtgtctttaaacagagatagagtcttgctatgttgtccaggctgacactgaactcttgggctccaacgatcctcctgccccggcctcctgagtacctgggattataggcacaagtcaccatgcccagccggaataatctgaaggaaagacgggtatattcaagatgactttgctgctggaaatatgacagaataatgtggtatcttcttctgcacttccaagctctttcacactcaggctcttcctggcttttctgcctcagccaccataaactgtggttgcttctccagctctgttacagttcagacttgaggggaggtgacaagagctaacatgttaccatggggagcctggctgacatctccgaaactgaagactctatggaagcctcatgctattgcaatgtgtacatcaaaagtaaagtaccccaggttaaaactatgaggaagttg

SEQ ID NO: 277965 - DNA, 602 bp, Homo sapiens
atcaaattgcttatctttaaaaaccaatgataaagaggaaatgttacaagaaaccaggcttttcttttttctttttaaggatgtcttacactccaaaaacaaagattaagaatgaaagcaaaatcttccctgaaaacattcgatctagaaaacaggagagtactaaaagaaaaaactgtcaacttagaattccacaggcagctattataaaatatctttctaaaacaaatacaaaataaaggcttttttggatataaaagcagaaagaactaatcactagcagaccaacactacaataaatgctaaaagaactatttcagacaaataataaatgaaatgtgaatataccaaaaagaaggaagagcattagaaatgttcattgctaatagtaaatatagtacagagagatgatgatgatgtgaaatttctcatcacaccactcaaaacagtgtgcaaattataatgtatttatttctggaattttctattcaatatttttcagaccgcagttgactgaagataactgaaactgtgaaaagagataaggaaggagtaacagacaaatacagtaaaaatggtaaacaataaagacttgttccatt

SEQ ID NO: 277966 - DNA, 156 bp, Homo sapiens
agtttgagcccgcttatatcctgctgtaggaaggctggaattacccaaatctccagaccgcagttgactgaagataactgaaactgtgaaaagagataaggaaggagtaacagacaaatacagtaaaaatggtaaacaataaagacttgttccatt

SEQ ID NO: 277967 - DNA, 610 bp, Homo sapiens
agcaggtcacaatgaagggcaggtgacaatgaagaagggcagggaaggtgactgagatggaagatacagtcaaaatggtgttcgaaaatacagagggatccagcataattaagagcattaagcaatcatctcagcccaaggaggcagttgaagaaaagaacagagtttgggcaacacttggggaaataaattccacagcctttcaccaagttgaaatcttggctttggacacacataaaaatgagcctggcccaatcttagctctcagtggacatctgccatatcacaagatttgacccaattggcctgccttaccatagagaaggccactgctggagcagcagatggtactgctggtaagagccaacgtggacggacagggctgtggcagggaaatggcagagcacagctggccccagcctgggtaggaggctttgctttgaagagaatcatttttgtgatgcatttttttaaaataacatcgatctgatttccttctctcgtagacttcaatcacttttcatgtcctacagaacattgctaattattcttttttttctctcttgtcaccagtactgtcatacagtagtaaaacaagtgctaaactcta

SEQ ID NO: 277968 - DNA, 787 bp, Homo sapiens
gccgcggtggtcgcctctggcagtgccgctagctttcaggcagtcgcctctcctcccgacatcccgccttgaggaggctgaggcggaatcgcggctggcggcggggggacggaccggccctgcagtggccgcagtgacagcccggacccggccctccgcccgctctcgcctcggcgcccgcagccacgatgaaccggggcggcggcagcccgtcggccgccgccaactacctgctctgtaccaactgccggaaagtgctgcggaaggataaaagaatcagagtgtctcaacccttgacaagaggaccaagtgcctttattccagagaaggaagttgtccaagcaaacacagtggatgaacgtactaactttcttgtggaagaatactctacatccggtcgtctggacaacatcacacaggtcatgagtttacacactcagtacctggagtctttcttgcggagccagttttacatgttgcgcatggatggtccccttcctctaccatacaggcactatattgcaataatggctgcagctagacatcagtgttcttacttaataaacatgcatgtggatgaatttttaaagactggaggtattgctgagtggttgaatggtttggaatatgtgccacaaagactgaaaaatcttaatgaaattaataagctgctagcacatcgaccttggctgatcacaaaagagcacattcagaaacttgtcaaaactggagaaaataattggtctctgcctgaactggtacacgcatagtggtacctcctggcaca

SEQ ID NO: 277969 - DNA, 890 bp, Homo sapiens
aatgcacagtcctgtggccacggccatggccgggtggggagctgggctccagtgagcacagagctccttgccagtaggcgatgcaagttatctctggggcccggaggacacgagtgaggaccgggcaccaatcaggttctcgctctgcgccggcctttgttctcactcgggagcaggttgcgggcgtctagcatcgggaacccgcattcgactcggacgcgcattgctagccccttcgggagacctggctcccctacccgtctgtcccgccacactcggtcagcctgcgctttccccagtcaagtctgccttctctccgcagaacgtggacgctaaaaccctgacttaccattttaagctttagaagaggataaaagaatcagagtgtctcaacccttgacaagaggaccaagtgcctttattccagagaaggaagttgtccaagcaaacacagtggatgaacgtactaactttcttgtggaagaatactctacatccggtcgtctggacaacatcacacaggtcatgagtttacacactcagtacctggagtctttcttgcggagccagttttacatgttgcgcatggatggtccccttcctctaccatacaggcactatattgcaataatggctgcagctagacatcagtgttcttacttaataaacatgcatgtggatgaatttttaaagactggaggtattgctgagtggttgaatggtttggaatatgtgccacaaagactgaaaaatcttaatgaaattaataagctgctagcacatcgaccttggctgatcacaaaagagcacattcagaaacttgtcaaaactggagaaaataattggtctctgcctgaactggtacacgcatagtggtacctcctggcaca

SEQ ID NO: 277970 - DNA, 503 bp, Homo sapiens
cagttttcccaggtaaggaatggattttttagccttctagttataggtctgtgacctgaatttctcaaatgagttgagcccagggaggggtcctcatgccctctgcaagagcggaaaccaggtacagttctatgatcccacctgaaatgggtgtgtggttctgggaagctaaatacccatttcggagatcaagcatggggttggtgaatcactcatcctctgaatcatatgtgtgttcttcagtgtactaatctcatttttcctgctagagcctttcatccatgaaagcctccctgattcccatgcaggaactacctcaccttcttccaatctcttagtacattcccgtgaaaagaaggcagagatgttttgctgtgcccagtgtgaggaagcgaaggaaaagaaagatcttttgaaaatgtgtacatctacttgcagcttgaaaattccaagggccagacatttttcttggaggaaataaatgttttcaatttattcatttt

SEQ ID NO: 277971 - DNA, 402 bp, Homo sapiens
ataatctgccatctgcaacctggagactaaggagagccagtggaattgtgccagttgaagttcaaaagcatgagaaccagaagaactgatgatgtgaacagatgggtctcactcagtgacccaggctgaatgcagtggaacaatcatggcttactgtagccttgaccttgagggcttaagcaatcctgccacctcagcctgcctagtactgggactacagaaacatcaaatatattcagctcccgtctctcttcaaccatgtaaaattatttcaacaactatcagctattgaaggtgaaactggcatgtctgtttgttcttctcttcctggtgtcaaagactcttaaagcatgcatataaaatatgaaagtaaataaaacgtaatcaaaaatactaacattc

SEQ ID NO: 277972 - DNA, 403 bp, Homo sapiens
ccatggtccccatgacttgcctgtttgcctgctctggctaagggtcttgaccagtggggcactgaagaagcgagccacacctccatcgtacgccctgcgaggaggggtctcactcagtgacccaggctgaatgcagtggaacaatcatggcttactgtagccttgaccttgagggcttaagcaatcctgccacctcagcctgcctagtactgggactacagaaacatcaaatatattcagctcccgtctctcttcaaccatgtaaaattatttcaacaactatcagctattgaaggtgaaactggcatgtctgtttgttcttctcttcctggtgtcaaagactcttaaagcatgcatataaaatatgaaagtaaataaaacgtaatcaaaaatactaacattc

SEQ ID NO: 277973 - DNA, 556 bp, Homo sapiens
gcgctgatcaactgcagggcgtattcccgggggcagttggggagcgcagatcccgaagcagcgctgggagcgtaagtgcgggcagagcactgcgccgtttgggaacgcaactttgaggagacagtgcggtggacttcagtgaagttccttatgacttcccctgaaattgcttccttatcatgggggcaaatgaaagtaaaaggctctaatacaacctataaggactgcaaagtatggccagggggtagtcggacttgggattggagagaaacaggaactgagcattctcctggtgtgcagcctgcagatgtgaaggaagttgttgagaagggtgtacagactcttgtgattggccgagggatgagtgaggccttgaaggtgccttcatcaactgtggagtacctcaagaaacatggcattgatgtgcgggtcctccagacagagcaggcagtgaaggagtataatgccttggttgcccaaggggtcagggtgggaggtgtcttccattccacctgctgatggagccttaagaggagaataaatcactaagtgccta

SEQ ID NO: 277974 - DNA, 598 bp, Homo sapiens
gcgctgatcaactgcagggcgtattcccgggggcagttggggagcgcagatcccgaagcagcgctgggagcgtaagtgcgggcagagcactgcgccgtttgggaacgcaactttgaggagacagtgcggtggttctggaggctgggaagtccaagaccagttggctcgcatctgacttcagtgaagttccttatgacttcccctgaaattgcttccttatcatgggggcaaatgaaagtaaaaggctctaatacaacctataaggactgcaaagtatggccagggggtagtcggacttgggattggagagaaacaggaactgagcattctcctggtgtgcagcctgcagatgtgaaggaagttgttgagaagggtgtacagactcttgtgattggccgagggatgagtgaggccttgaaggtgccttcatcaactgtggagtacctcaagaaacatggcattgatgtgcgggtcctccagacagagcaggcagtgaaggagtataatgccttggttgcccaaggggtcagggtgggaggtgtcttccattccacctgctgatggagccttaagaggagaataaatcactaagtgccta

SEQ ID NO: 277975 - DNA, 723 bp, Homo sapiens
gcgctgatcaactgcagggcgtattcccgggggcagttggggagcgcagatcccgaagcagcgctgggagcgtaagtgcgggcagagcactgcgccgtttgggaacgcaactttgaggagacagtgcggtggttctggaggctgggaagtccaagaccagttggctcgcatctgacttcagtgaagttccttatgacttcccctgaaattgcttccttatcatgggggcaaatgaaagtaaaaggctctaatacaacctataaggactgcaaagtatggccagggggtagtcggacttgggattggagagaaacaggaactgagcattctcctggtgtgcagcctgcagatgtgaaggaagttgttgagaagggtgtacagactcttgtgattggccgagggatgagtgaggccttgaaggctccaacccagcagctgccatcaggtgttcatgtcagggctggggtacaattccacctggctacagcttcatggcacatcctttgagagatgcaaaacaggagctggactgacatcaaacatgctgtaacttgcaatgaagtcacctaagtacttttttggatcaaatctatgatgccatcattcttaagatcaccctttattttaatgaaattgtaggaaaccaaaaaccacttttgggacaccatcaaaatatctgatttcagagaagttacaataataaaaaatgtgtatcttggaatc

SEQ ID NO: 277976 - DNA, 1333 bp, Homo sapiens
gcgctgatcaactgcagggcgtattcccgggggcagttggggagcgcagatcccgaagcagcgctgggagcgtaagtgcgggcagagcactgcgccgtttgggaacgcaactttgaggagacagtgcggtggacttcagtgaagttccttatgacttcccctgaaattgcttccttatcatgggggcaaatgaaagtaaaaggctctaatacaacctataaggactgcaaagtatggccagggggtagtcggacttgggattggagagaaacaggaactgagcattctcctggtgtgcagcctgcagatgtgaaggaagttgttgagaagggtgtacagactcttgtgattggccgagggatgagtgaggccttgaaggtgccttcatcaactgtggagtacctcaagaaacatggcattgatgtgcgggtcctccagacagagcaggcagtgaaggagtataatgccttggttgcccaaggggtcagggtgggaggtgtcttccattccacctgctgatggagccttaagaggagaataaatcactaagtgcctaaaaaaaaaaaaaaaacaaaacacaaaaagacacaacaaaaacacaaaacaacaaacaacaacaaaaaaacaaacaaaaacaacacaagacaacagcaaaacacaaaaaaacacgaaaaacaagaaaaacaaacagagcgcaaaaaaaacaacgagacggagaaacaaaacaccacaacacaagaaaacacaaaagacaaaaaagaggcggcacaaacaacagcgagaaaccacgcaggacagaaacacacacgtgacacagtacaaccaagaaaaaggagacacaagtggcaccacccagagaaagaatacaaccgaacacacagagcccgcgcagagcatccacgacctagtcatcaacagcacaagggcagacgaagaaacagagaacggacgacgagccaacacgagagcaaaagagaagaaaaaacagaagaaccaagggaacgaaggagaaggagagaaagacaacagcaaaacgaaagagaagcagacagcaaggccagaacagagaggacaacgacagaagaagaaagacaggaagagacaaagcagaacgacaagaaaaaaacaggaagaaaagaaaaaaagaaaacgaaaagagaaagaagaacaaacgaaaagaggaacagaaaaacgagaaaaacagaaaaacaaagaaaaaagagagaccaagaaaaagaacaagcaagaacacagaagagagaaaaaaaagaaacgaagagaaacgaaaagaaagaaagaaacgaaaaaaaagagaaaaaaagaaagaacgaag

SEQ ID NO: 277977 - DNA, 653 bp, Homo sapiens
gctcgaccgaagcagcgctgggagcgtaagtgcgggcagagcactgcgccgtttgggaacgcaactttgaggagacagtgcggtggacttcagtgaagttccttatgacttcccctgaaattgcttccttatcatgggggcaaatgaaagtaaaaggctctaatacaacctataaggactgcaaagtatggccagggggtagtcggacttgggattggagagaaacaggaactgagcattctcctggtgtgcagcctgcagatgtgaaggaagttgttgagaagggtgtacagactcttgtgattggccgagggatgagtgaggccttgaaggtgccttcatcaactgtggagtacctcaagaaacatggcattgatgtgcgggtcctccagacagagcaggcagtgaaggagtataatgccttggttgcccaaggggtcagggtgggaggtgtcttccattccacctgctgatggagccttaagaggagaataaatcactaagtgcctaaaaaaaaaaaaaaaacaaaactcgggggggcccggtcccaatcgccctattggagtgattacaattaatggccgccgtttacaacgcgggctggaaaacctgcgttcccaactaatgcttggaaacatcccttttgccgctgg

SEQ ID NO: 277978 - DNA, 511 bp, Homo sapiens
ccttttataatgaacctactactcctgcaataacagcataatctattcatgagggtggaaccctcatggcctaatcagctcttaaagacttcagtgaagttccttatgacttcccctgaaattgcttccttatcatgggggcaaatgaaagtaaaaggctctaatacaacctataaggactgcaaagtatggccagggggtagtcggacttgggattggagagaaacaggaactgagcattctcctggtgtgcagcctgcagatgtgaaggaagttgttgagaagggtgtacagactcttgtgattggccgagggatgagtgaggccttgaaggtgccttcatcaactgtggagtacctcaagaaacatggcattgatgtgcgggtcctccagacagagcaggcagtgaaggagtataatgccttggttgcccaaggggtcagggtgggaggtgtcttccattccacctgctgatggagccttaagaggagaataaatcactaagtgccta

SEQ ID NO: 277979 - DNA, 660 bp, Homo sapiens
gcgctgatcaactgcagggcgtattcccgggggcagttggggagcgcagatcccgaagcagcgctgggagcgtaagtgcgggcagagcactgcgccgtttgggaacgcaactttgaggagacagtgcggtggacttcagtgaagttccttatgacttcccctgaaattgcttccttatcatgggggcaaatgaaagtaaaaggctctaatacaacctataaggactgcaaagtatggccagggggtagtcggacttgggattggagagaaacaggaactgagcattctcctggtgtgcagcctgcagatgtgaaggaagttgttgagaagggtgtacagactcttgtgattggccgagggatgagtgaggccttgaaggtgccttcatcaactgtggagtacctcaagaaacatggcattgatgtgcgggtcctccagacagagcaggcagtgaaggagtataatgccttggttgcccaaggggtcagggtgggaggtgtcttccattccacctgctgatggagccttaagaggagaataaatcactaagtgcctaaaaaaaaattattctctactctattcttcatagtttttctacttttatctcttcttattgctcttgtaatttaatcctttctttatattattcctttctcattc

SEQ ID NO: 277980 - DNA, 334 bp, Homo sapiens
gcttgttcaacctctgcccaaactcatctagcctggagaattctataccccctagtacagcccgttcaattcttacacagcttttaaaaatgtattctgataccaagccaaaacctgtcccttagtgcatgtctacctttgatggaagaagtactacattttgcatttttaagacaggatcaagtcctggctttgtcccttaggagacagacattatctcaaagcctctgtttccttacatggaaaatgagggctaacttggaggatttttgcttcgatcggccgctcgaagacgagaaattagccgtcgccccaggtctcgacatgggtgggc

SEQ ID NO: 277981 - DNA, 1375 bp, Homo sapiens
gcgctgatcaactgcagggcgtattcccgggggcagttggggagcgcagatcccgaagcagcgctgggagcgtaagtgcgggcagagcactgcgccgtttgggaacgcaactttgaggagacagtgcggtggttctggaggctgggaagtccaagaccagttggctcgcatctgacttcagtgaagttccttatgacttcccctgaaattgcttccttatcatgggggcaaatgaaagtaaaaggctctaatacaacctataaggactgcaaagtatggccagggggtagtcggacttgggattggagagaaacaggaactgagcattctcctggtgtgcagcctgcagatgtgaaggaagttgttgagaagggtgtacagactcttgtgattggccgagggatgagtgaggccttgaaggtgccttcatcaactgtggagtacctcaagaaacatggcattgatgtgcgggtcctccagacagagcaggcagtgaaggagtataatgccttggttgcccaaggggtcagggtgggaggtgtcttccattccacctgctgatggagccttaagaggagaataaatcactaagtgcctaaaaaaaaaaaaaaaacaaaacacaaaaagacacaacaaaaacacaaaacaacaaacaacaacaaaaaaacaaacaaaaacaacacaagacaacagcaaaacacaaaaaaacacgaaaaacaagaaaaacaaacagagcgcaaaaaaaacaacgagacggagaaacaaaacaccacaacacaagaaaacacaaaagacaaaaaagaggcggcacaaacaacagcgagaaaccacgcaggacagaaacacacacgtgacacagtacaaccaagaaaaaggagacacaagtggcaccacccagagaaagaatacaaccgaacacacagagcccgcgcagagcatccacgacctagtcatcaacagcacaagggcagacgaagaaacagagaacggacgacgagccaacacgagagcaaaagagaagaaaaaacagaagaaccaagggaacgaaggagaaggagagaaagacaacagcaaaacgaaagagaagcagacagcaaggccagaacagagaggacaacgacagaagaagaaagacaggaagagacaaagcagaacgacaagaaaaaaacaggaagaaaagaaaaaaagaaaacgaaaagagaaagaagaacaaacgaaaagaggaacagaaaaacgagaaaaacagaaaaacaaagaaaaaagagagaccaagaaaaagaacaagcaagaacacagaagagagaaaaaaaagaaacgaagagaaacgaaaagaaagaaagaaacgaaaaaaaagagaaaaaaagaaagaacgaag

SEQ ID NO: 277982 - DNA, 495 bp, Homo sapiens
gcgctgatcaactgcagggcgtattcccgggggcagttggggagcgcagatcccgaagcagcgctgggagcacttcagtgaagttccttatgacttcccctgaaattgcttccttatcatgggggcaaatgaaagtaaaaggctctaatacaacctataaggactgcaaagtatggccagggggtagtcggacttgggattggagagaaacaggaactgagcattctcctggtgtgcagcctgcagatgtgaaggaagttgttgagaagggtgtacagactcttgtgattggccgagggatgagtgaggccttgaaggtgccttcatcaactgtggagtacctcaagaaacatggcattgatgtgcgggtcctccagacagagcaggcagtgaaggagtataatgccttggttgcccaaggggtcagggtgggaggtgtcttccattccacctgctgatggagccttaagaggagaataaatcactaagtgccta

SEQ ID NO: 277983 - DNA, 860 bp, Homo sapiens
gcgctgatcaactgcagggcgtattcccgggggcagttggggagcgcagatcccgaagcagcgctgggagcgtaagtgcgggcagagcactgcgccgtttgggaacgcaactttgaggagacagtgcggtggttctggaggctgggaagtccaagaccagttggctcgcatctgacttcagtgaagttccttatgacttcccctgaaattgcttccttatcatgggggcaaatgaaagtaaaaggctctaatacaacctataaggactgcaaagtatggccagggggtagtcggacttgggattggagagaaacaggaactgagcattctcctggtgtgcagcctgcagatgtgaaggaagttgttgagaagggtgtacagactcttgtgattggccgagggatgagtgaggccttgaaggctccaacccagcagctgccatcaggtgttcatgtcagggctggggtacaattccacctggctacagcttcatggcacatcctttgagagatgcaaaacagggtcttactctgccacccaggctggagtgcagtggcacgatcataactcactgaagcctcaaactcctgggcgcaagtgatcttcctgcctcagcctcctgaggagtggggattacaggcacgtgccaccacgccaggagctggactgacatcaaacatgctgtaacttgcaatgaagtcacctaagtacttttttggatcaaatctatgatgccatcattcttaagatcaccctttattttaatgaaattgtaggaaaccaaaaaccacttttgggacaccatcaaaatatctgatttcagagaagttacaataataaaaaatgtgtatcttggaatc

SEQ ID NO: 277984 - DNA, 642 bp, Homo sapiens
gcgctgatcaactgcagggcgtattcccgggggcagttggggagcgcagatcccgaagcagcgctgggagcgtaagtgcgggcagagcactgcgccgtttgggaacgcaactttgaggagacagtgcggtggttctggaggctgggaagtccaagaccagttggctcgcatctgacttcagtgaagttccttatgacttcccctgaaattgcttccttatcatgggggcaaatgaaagtaaaaggctctaatacaacctataaggactgcaaagtatggccagggggtagtcggacttgggattggagagaaacaggaactgaggtgccttcatcaactgtggagtacctcaagaaacatggcattgatgtgcgggtcctccagacagagcaggcagtgaaggagtataatgccttggttgcccaaggggtcagggtgggaggtgtcttccattccacctgctgatggagccttaagaggagaataaatcactaagtgcctaaaaaaaaaaaaaaacccttataacccctcctgaaacaaactgttagcaccaaaccggatcacctctctagaaactacactgccggcgtttacaacgtaggcctgggaaaccctggggttcccaccttaacgctttgaact

SEQ ID NO: 277985 - DNA, 485 bp, Homo sapiens
gagaattctataccccctagtacagcccgttcaattcttacacagcttttaaaaatgtattctgataccaagccaaaacctgtcccttagtgcatgtctacctttgatggaagaagtactacattttgcatttttaagacaggatcaagtcctggctttgtcccttaggagacagacattatctcaaagcctctgtttccttacatggaaaatgagggctaacttggaggatttttataaaaggggtacttatctgaaaaatatcagcatattcttcccttagaaggttttctataattacagcacgatgggctcaggcagcagccatggttcttcatgtttttgtctaggctccaacccagcagctgccatcaggtgttcatgtcagggctggggtacaattccacctggctacagcttcatggcacatcctttgagagatgcaaaacaggtaagcacactagaaaagtcagctccctggagtt

SEQ ID NO: 277986 - DNA, 581 bp, Homo sapiens
gcgctgatcaactgcagggcgtattcccgggggcagttggggagcgcagatcccgaagcagcgctgggagcacttcagtgaagttccttatgacttcccctgaaattgcttccttatcatgggggcaaatgaaagtaaaaggctctaatacaacctataaggactgcaaagtatggccagggggtagtcggacttgggattggagagaaacaggaactgagcattctcctggtgtgcagcctgcagatgtgaaggaagttgttgagaagggtgtacagactcttgtgattggccgagggatgagtgaggccttgaaggatggaatacagggggcacagttagatctgaattgttaagcagaggctgcttgatgcagaagatgaagacagaagaaagaatgagcctaggccgggcacagtggctcacgcctgtaattccagcactttgggaggccgaggcgggaggatcacttgagctcaggagtttgagaccagcctggccaccatggtgaaacctcgactctacaaaaaaaaaaaagccaaaattagccaggtgtggtggcatatgcctgtggtcccagc

SEQ ID NO: 277987 - DNA, 674 bp, Homo sapiens
gcgctgatcaactgcagggcgtattcccgggggcagttggggagcgcagatcccgaagcagcgctgggagcgtaagtgcgggcagagcactgcgccgtttgggaacgcaactttgaggagacagtgcggtggagatgaggtttcaccatgttggccagtctggtcttgaactcctgacctcaagtgatccacccacttcggcctctcagaagtgctgggattacaggcatgagccaccacgcctggccagacttcagtgaagttccttatgacttcccctgaaattgcttccttatcatgggggcaaatgaaagtaaaaggctctaatacaacctataaggactgcaaagtatggccagggggtagtcggacttgggattggagagaaacaggaactgagcattctcctggtgtgcagcctgcagatgtgaaggaagttgttgagaagggtgtacagactcttgtgattggccgagggatgagtgaggccttgaaggtgccttcatcaactgtggagtacctcaagaaacatggcattgatgtgcgggtcctccagacagagcaggcagtgaaggagtataatgccttggttgcccaaggggtcagggtgggaggtgtcttccattccacctgctgatggagccttaagaggagaataaatcactaagtgccta

SEQ ID NO: 277988 - DNA, 629 bp, Homo sapiens
gctcgaccgaagcagcgctgggagcttctggaggctgggaagtccaagaccagttggctcgcatctgacttcagtgaagttccttatgacttcccctgaaattgcttccttatcatgggggcaaatgaaagtaaaaggctctaatacaacctataaggactgcaaagtatggccagggggtagtcggacttgggattggagagaaacaggaactgagagtctcactctgttgcccaggctggagtgcagtggcgcgatctcggctcactgcaacctccacctcccaggttcatgccattctcctgcctcagcctcccaagtagctgggactacaggtgcctgccaccacacccagcattctcctggtgtgcagcctgcagatgtgaaggaagttgttgagaagggtgtacagactcttgtgattggccgagggatgagtgaggccttgaaggtgccttcatcaactgtggagtacctcaagaaacatggcattgatgtgcgggtcctccagacagagcaggcagtgaaggagtataatgccttggttgcccaaggggtcagggtgggaggtgtcttccattccacctgctgatggagccttaagaggagaataaatcactaagtgccta

SEQ ID NO: 277989 - DNA, 408 bp, Homo sapiens
tctaaaataacaacaacaacaacaacaacaacaataataataataataataatatagagaatgaccaggtggatggcaagagttttacaactttagatagggtgatcacaagtcacttaagtggacagtacataactaaggagtcagccataagaaagtccaagtacagagggaatagtaaatagacttaagtatatatattttgtgagaaatttgttttcagtttttataccttataatttatatggaagagctaattcttggactcttgtctatgtggaaaaaaaaatatttcaagccaaagaaattactggaaattttggagacaaactcatctctctatatatgcattgtcactaacttgagtatttattttttatgtcctcaaggctgaactcatgtggatta

SEQ ID NO: 277990 - DNA, 306 bp, Homo sapiens
ccctatttttcaccatgttaggattaagaagtggatccctgacacagtcagaatcaaatagctgtcgtttttggccacagtcttgtgaattttggtactgagggtcctgggttgaaggcccagacaatggtgcatcgggatcaaggtaatagatctcatttgttcgaacatacggaataaaatgggatgattcagaaatcccagatgataattctgtttgattacttcctgagatcaaattctctctctcatagctactgttttttagtggtaaatgtaatgtattttgagtttgttgggttctgt

SEQ ID NO: 277991 - DNA, 8134 bp, Homo sapiens
cggctccgaggaccgggcagcgcatttggggtgcccgctacagggccccccaagaggctgccaggtcgggagcgcagcctgaggccacggggggaagggggtgggtgggctgagagcagctcggcggcgagactggcccgccgccccttccccccacacccgtcgaccttgtgggcagaagcttcccagagctccttaggccggcgcgatggcgactgctgtggagacggaggcctgtcagccgacggatgcgagttgggaaagtggcggcggcggagacgacgagatgaagcaggcgcttccggagcttgagtcctcccaacaaaatggcggcggcggcggcctcaacatcgctgagcccagcggcggcgctgggcgtgaggagaacgcgggggccgaggccgcccagagcctcagccacgagcagcctcaggactcctctgaggcgggcgcggccgccctgcccagaggccccgaagagcccgaaaggcctgttaggaggagttttcagatccccaggaagagcagagaaaagaaagcacttttccagccattaactccaggctctcgagaatttgaagatgttgtaaatattctccattcttcttaccttgaaccaacctcagtaacaaattttaactacagacgtgcttgcttggtacacaatgagcttttggaaaaggagtttacagaaaagcgaagagaactgaagtttgatggtcgtttagataaggaactttcagaatcctatgcatttctgatggttgatcgataccaggttcaaaccatatgtgaaaaaggattacatgtgggtcagtccaaaataacaattcttggcagtccttccatgggtgtctatctttctaggtatgctgatttattacaagcgaatcctttggacacgggggcaatgggtgatgttgttatttttaaaataatgaagggtaaaataaagagtatatatgaccccatgggtgtaaaaagtttggaatctatgttaaataagagtgctttggaccccacaccaaagcatgaatgtcacgtgtcaaagaatgccaatcgaattacatcacttttggcttacagagcctatgagcttactcagtattatttttatgagtatggctttgatgagctaaggcgaagaccaagacacgtttgtccatatgcagttgtgtcttttacttacaaagatgatatacaaactccgaagtttgtaccttcatcaagatctaacagctttaatacagatagaaacatagataaatataactataccttgtggaaaggacagcttttaaataaaggaaaacttttgtgttatatttctctgaggtcagccactcgtgcttttttgcctatcaaactacctgagaaattagatgttgaaacagttatgagtattgatcatctgaaacagaaaatccctccagcactgttttataaggaaacatacttaggtccaaatgaagttttgaagaatggaatgtattgcagcctttatgaagttgtggaaaagacaagaattggaagtaacatggagagtttactgcaaaaactagacagagaaaaacttgttcttgttaaacctttgggagaccgaggatacctttttcttctctccccttatcagatggttcctccatatgaatatcagactgccaagtctcgagtcctacatgctttgtttctatttcaagaacctagaagcatagttacttcacaaaaaggttcaaccaatgcagcaccacaggagaggcatgagagcatgccagatgtattaaaaatagctcagtttttacaattttctttgattcagtgtcgaaaggaattcaaaaatataagcgccataaattttcattctgttgttgaaaagtatgtaagtgaattttttaagcgaggttttggttcaggtaaacgagagtttattatgtttccatatgattcacgattagatgataaaaaattcttatactcagctcccagaaataaatcccatattgatacttgtttgcatgcctatatttttcggcctgaagtgtatcagttacctatttgtaaattaaaagaactatttgaagaaaatagaaaacttcagcagtttagtccactttcagattatgaaggtcaagaagaagaaatgaatggtacaaaaatgaaatttggaaaacgaaataactcaagaggtgaagccattatatctggaaagcaaagatcatctcattctttggattatgataaggatagagtcaaagaattgattaatttaattcagtgtaggaaaaagagtgtgggtggggactcagacacagaagatatgagaagcaaaactgtcttgaagaggaagcttgaggatctacctgaaaatatgagaaagctcgccaaaaccagtaatttatctgaaaattgccatctgtatgaagagtctccacagcctattggctcacttggacatgatgctgacttgaggcggcagcagcaggatacctgtaactccggcattgctgacatccataggctgtttaattggttatcagaaacactagcaaatgcgcgccattctgatgcatctctgacagacacagtcaacaaagccttaggattgagcactgatgatgcctatgaagagctgaggcaaaaacatgagtatgagttgaactctaccccagataagaaagactatgagcagcctacttgtgcaaaagttgaaaatgcacagtttaagggtactcagagcttattactagaagttgatgcaacatctaagtattctgttgctatttctaccagcgaagtgggcactgaccataagctacatttgaaagaagatccaaatttaattagcgtgaataattttgaagattgcagtttgtgtcccagtgttcccattgaacatggatttcgtagacaacagtctaagtcaaataatgttgaagagactgaaatacattggaaactgattccaattacaggagggaatgcaagaagcccagaagaccagctggggaaacatggtgagaaacaaacaccaggtatgaaatcaccagaagaacaactggtgtgtgtgccaccacaggaggcctttcctaacgacccccgggtaataaatagacagagaagttctgattaccagtttccatcctctccatttacagacacactaaagggcaccactgaggatgacgtgttgacaggtcaggtggaggagcagtgtgtgccagcagcagaggcagagccgcctgcagtgagcgaaaccacagagaggacagtgttaggagagtacaatctcttttctaggaagatagaagagattttgaagcaaaagaatgtttcatatgtcagtagagtttccacacctatcttttcaacacaagagaagatgaaacggctttccgagttcatatattctaagacttccaaagctggtgtgcaggagtttgtagatggtttgcatgagaagctaaatactattattattaaagcatcagccaagggtgggaatttgccaccagtcagtcctaacgattctggtgctaagatagcatcgaatcctctggaaaggcatgtcataccagtttcctcaagtgacttcaacaataaacatctccttgagccactgtgtagtgatcctttgaaagataccaactctgatgagcagcattccacttcggctttaactgaagtagaaatgaaccagcctcaacatgccacagagttaatggtgacttctgatcatattgtacctggtgatatggcccgggaaccagtagaagaaacaacaaaatcccccagtgatgtaaacatttctgctcaaccagctctttcaaattttataagccagttagaacctgaagtatttaatagtttggttaaaatcatgaaagacgtccagaaaaatactgtgaaattttatattcatgaagaagaagagagtgtgctctgtaaagaaataaaggaatatcttatcaaattaggcaatacagaatgtcatcctgaacagtttttggaaagaagatcaaaattagataaactattgattattattcaaaatgaagacattgcaggtttcattcacaagatacctggcttggtgactttaaagaagctcccctgtgttagttttgctggtgttgatagcctggatgatgttaaaaatcatacatacaatgaattatttgtatctggaggttttatcgtatctgatgaatcaattctaaacccagaggttgtcacagttgagaaccttaaaaattttttgacattccttgaggaacttagtactccagaaggaaaatggcaatggaaagtccactgtaaatttcagaagaaactaaaggaactaggcagattgaatgctaaagctctaagtctgttgacgcttctgaatgtctatcagaagaaacatctggttgaaattttgtcataccacaattgtgattcacaaactcgaaatgctccagaattggattgccttatcagacttcaggctcagaacatacagcaacgacacatagtctttttaacagagaagaacatcaagatgctttccagttatacagataatggaatagtggttgcaactgctgaagacttcatgcaaaactttaaaaatcttgtgggctatcacaattcaatcacagaagaaaaccttccacagcttggtgctaatgagaatcttgagtcgcagtcagctcttttagaaaacgatgaaaaggatgaagaggatatgtctctggattcaggggatgaaatctcacatatagaagtatgcagcaattttcattcagaaatatgggagaaagagaccaaaggatcacgtggaacagatcaaaaaaagaatactcaaattgagttgcaatcgtctcctgatgtgcaaaacagtttattagaagataagacttaccttgattctgaagagagaacttctattgatatagtatgctctgaaggagagaacagcaattcaacagaacaagattcatatagtaactttcaggtttatcatagtcaattaaatatgtcccatcagtttagtcattttaatgttctcactcatcagacatttttggggacaccatatgccctttcatcaagtcagtctcaagaaaatgagaattacttcttatctgcttatactgaaagcttggatagagataaatctccacctcccttaagttgggggaaaagtgattcttccaggccatattcacaagagaaataactgtagtaactttttttttaagagattgttgtggactttgtttattaacaatttatatttcattctctaaacaaaaggttcttgttctttctcaaatgttttttcttttatttaaatcatgatggcctgtaacagttgaagcatctaaaaattgaaataaatatatatttttaacatatattgtacttgaattatctcatgttggcacttctaagttttactttttgtatgttacctgtacttaggcttcaaattgaagcctgttttatgtgtaaaatcagatgcttgcaggaggacggtaaacagcaaaggctttacttctttttctctaatgtcacctgatataaagtacttttgttgaagtgaattattttgatgtaggcttttgtatactgtgtttacacaggtataagtcagtaatagcagtgttaatatttacaggattttggctcgatacctcaagatttatctaacagtgcagtttcatttagataataaactatgtacataggacacattttttatctctaggcttagtcatgtaaaaactgcctattgctaaaattctggtaactttttgagagtattggataattttcagtacctgcgcaatccttgatttaatgaaattaaattttttatttcaaaagataggcttctgtttatcaaaggcgttgaacaatttgatttttaaattagttttagcaaaatggaagtataatgggaatatatttttgaggtggtcttagtagtaattaccatttgttgaacacattaatgctatactagacagatacagtggagatagctttcaaacccgtatctattcctaactactgcctctaatactaattactaacttgttactaatgctaacttttaaaaatgtttttgaaaattgcaatttctacaaataaatgtcatagtgcaaataaatgtcaggatttagagaaggagcctaaactgaatttgtgttatttcagtaaaagttatggagttatgggtctagacgtgttaataagttagacagaactttggcactttagaacaaatgcatgagtggtatttcagttcctaagttacataaaaagtgtgaaagaacactgtgaggtcccagcaacgccagactatattaaggtaagtagaaagtgtttttatagggcttcaatacccaggtggtgacagagcagaagaaccggtttttttttttttttttttactactaagcttttacaaaagaagtatctgttttattgtatagaacaagtacagcattttactacatagtatacaagtttttaatgagcatttaaaaaaataagtaaatctaggctatttgaaaaatacagttgagccagtgagcacattttataatttggaagacacaaatcaaatgtgaaggatttgattttctacatttaaaatgaagaaccaaaactctcttcttgattttcagctaaaggcaggagactactttccaactccttttgcttctggagaaggccctgaaatcacattgatatatgtttgttagtaaaatgtgcacacctgacttgcaatgttgtgttaaactagaattatattcacttggaaaacatatcgcttaggataaaattttgtcattcaaaaattttttcagaaatgcttgtactagaccacctcatttggatatatagctatcacatttgtaagattctgtttttagcataaaaatcaatagggatgaaaattttcttagaactcaagactccataactatgggggtaaatgaagtcatcccttctcccccagtccacccccaagtgctcttagatactgaaggagtctcccttaacatacagtgttttttttttgttgttgtttttttgtttttttttggagatggagtctcgctctgtcgcccaagctggagtacagtggtgcaatctcactgcaagctctgcctcccaggttcacaccattctcctgcctcaacctcccgaatggctgggactacaggcacccaccaccacgcctggctaactaactaactaactttttgtatttttagtagagacagggtttcactgtgttagccaggatggtcttgatctcctgacctcatgatctgcctgcctcagcctcccaaagtgctgggattacaggcttgagccactgctcctggccaacatccagtattttatcttgactgtcctaaccttaccttagatgctaacagaagggtcctgctgaaataacactgggtgctatattgatgggtaaatgtgtacatcctattccttcctctttatctcacaatttttgtctccactaagcaagaagtaaactaacacttcgtcactctaaagaaataacttatgtaaaactcttagtaaccctgtttgtcttcaaatgagtaaatagaccaaagtggggggacaattttctagttctgtagagggaaaaacatctgagtcaacattttgaaatgcagagggtattggtacatgacgacatggaaaagggcacttttaaacacagcttactcttcctcaagtacagagagtatatagtgaatcaaaactaactacagccattctttttaaagcccaagggatggagcaaaggtgtaaggatgttacctgtttgttttaatcagagagcaaaaagaagtcacaatagtttgggagaaaaagtagtatggtgagtaaggttatgcgtataatttcatactgaatttattactatttgggatgtacgtcaatgttctaacaaacactgccaacacgtcaattttttaaaaagcgtgggccacattgctaagaatttgttaaagcataactgtattttttgttttagggccttattgatgttttgccgttccaatgtatgcatttttttactcaataaacttgtcttaattttaaaaaagtc

SEQ ID NO: 277992 - DNA, 8028 bp, Homo sapiens
cggctccgaggaccgggcagcgcatttggggtgcccgctacagggccccccaagaggctgccaggtcgggagcgcagcctgaggccacggggggaagggggtgggtgggctgagagcagctcggcggcgagactggcccgccgccccttccccccacacccgtcgaccttgtgggcagaagcttcccagagctccttaggccggcgcgatggcgactgctgtggagacggaggcctgtcagccgacggatgcgagttgggaaagtggcggcggcggagacgacgagatgaagcaggcgcttccggagcttgagtcctcccaacaaaatggcggcggcggcggcctcaacatcgctgagcccagcggcggcgctgggcgtgaggagaacgcgggggccgaggccgcccagagcctcagccacgagcagcctcaggactcctctgaggcgggcgcggccgccctgcccagaggccccgaagagcccgaaaggcctgttaggaggagttttcagatccccaggaagagcagagaaaagaaagcacttttccagccattaactccaggctctcgagaatttgaagatgttgtaaatattctccattcttcttaccttgaaccaacctcagtaacaaattttaactacagacgtgcttgcttggtacacaatgagcttttggaaaaggagtttacagaaaagcgaagagaactgaagtttgatggtcgtttagataaggaactttcagaatcctatgcatttctgatggttgatcgataccaggttcaaaccatatgtgaaaaaggattacatgtgggtcagtccaaaataacaattcttggcagtccttccatgggtgtctatctttctaggtatgctgatttattacaagcgaatcctttggacacgggggcaatgggtgatgttgttatttttaaaataatgaagggtaaaataaagagtatatatgaccccatgggtgtaaaaagtttggaatctatgttaaataagagtgctttggaccccacaccaaagcatgaatgtcacgtgtcaaagaatgccaatcgaattacatcacttttggcttacagagcctatgagcttactcagtattatttttatgagtatggctttgatgagctaaggcgaagaccaagacacgtttgtccatatgcagttgtgtcttttacttacaaagatgatatacaaactccgaagtttgtaccttcatcaagatctaacagctttaatacagatagaaacatagacctgagaaattagatgttgaaacagttatgagtattgatcatctgaaacagaaaatccctccagcactgttttataaggaaacatacttaggtccaaatgaagttttgaagaatggaatgtattgcagcctttatgaagttgtggaaaagacaagaattggaagtaacatggagagtttactgcaaaaactagacagagaaaaacttgttcttgttaaacctttgggagaccgaggatacctttttcttctctccccttatcagatggttcctccatatgaatatcagactgccaagtctcgagtcctacatgctttgtttctatttcaagaacctagaagcatagttacttcacaaaaaggttcaaccaatgcagcaccacaggagaggcatgagagcatgccagatgtattaaaaatagctcagtttttacaattttctttgattcagtgtcgaaaggaattcaaaaatataagcgccataaattttcattctgttgttgaaaagtatgtaagtgaattttttaagcgaggttttggttcaggtaaacgagagtttattatgtttccatatgattcacgattagatgataaaaaattcttatactcagctcccagaaataaatcccatattgatacttgtttgcatgcctatatttttcggcctgaagtgtatcagttacctatttgtaaattaaaagaactatttgaagaaaatagaaaacttcagcagtttagtccactttcagattatgaaggtcaagaagaagaaatgaatggtacaaaaatgaaatttggaaaacgaaataactcaagaggtgaagccattatatctggaaagcaaagatcatctcattctttggattatgataaggatagagtcaaagaattgattaatttaattcagtgtaggaaaaagagtgtgggtggggactcagacacagaagatatgagaagcaaaactgtcttgaagaggaagcttgaggatctacctgaaaatatgagaaagctcgccaaaaccagtaatttatctgaaaattgccatctgtatgaagagtctccacagcctattggctcacttggacatgatgctgacttgaggcggcagcagcaggatacctgtaactccggcattgctgacatccataggctgtttaattggttatcagaaacactagcaaatgcgcgccattctgatgcatctctgacagacacagtcaacaaagccttaggattgagcactgatgatgcctatgaagagctgaggcaaaaacatgagtatgagttgaactctaccccagataagaaagactatgagcagcctacttgtgcaaaagttgaaaatgcacagtttaagggtactcagagcttattactagaagttgatgcaacatctaagtattctgttgctatttctaccagcgaagtgggcactgaccataagctacatttgaaagaagatccaaatttaattagcgtgaataattttgaagattgcagtttgtgtcccagtgttcccattgaacatggatttcgtagacaacagtctaagtcaaataatgttgaagagactgaaatacattggaaactgattccaattacaggagggaatgcaagaagcccagaagaccagctggggaaacatggtgagaaacaaacaccaggtatgaaatcaccagaagaacaactggtgtgtgtgccaccacaggaggcctttcctaacgacccccgggtaataaatagacagagaagttctgattaccagtttccatcctctccatttacagacacactaaagggcaccactgaggatgacgtgttgacaggtcaggtggaggagcagtgtgtgccagcagcagaggcagagccgcctgcagtgagcgaaaccacagagaggacagtgttaggagagtacaatctcttttctaggaagatagaagagattttgaagcaaaagaatgtttcatatgtcagtagagtttccacacctatcttttcaacacaagagaagatgaaacggctttccgagttcatatattctaagacttccaaagctggtgtgcaggagtttgtagatggtttgcatgagaagctaaatactattattattaaagcatcagccaagggtgggaatttgccaccagtcagtcctaacgattctggtgctaagatagcatcgaatcctctggaaaggcatgtcataccagtttcctcaagtgacttcaacaataaacatctccttgagccactgtgtagtgatcctttgaaagataccaactctgatgagcagcattccacttcggctttaactgaagtagaaatgaaccagcctcaacatgccacagagttaatggtgacttctgatcatattgtacctggtgatatggcccgggaaccagtagaagaaacaacaaaatcccccagtgatgtaaacatttctgctcaaccagctctttcaaattttataagccagttagaacctgaagtatttaatagtttggttaaaatcatgaaagacgtccagaaaaatactgtgaaattttatattcatgaagaagaagagagtgtgctctgtaaagaaataaaggaatatcttatcaaattaggcaatacagaatgtcatcctgaacagtttttggaaagaagatcaaaattagataaactattgattattattcaaaatgaagacattgcaggtttcattcacaagatacctggcttggtgactttaaagaagctcccctgtgttagttttgctggtgttgatagcctggatgatgttaaaaatcatacatacaatgaattatttgtatctggaggttttatcgtatctgatgaatcaattctaaacccagaggttgtcacagttgagaaccttaaaaattttttgacattccttgaggaacttagtactccagaaggaaaatggcaatggaaagtccactgtaaatttcagaagaaactaaaggaactaggcagattgaatgctaaagctctaagtctgttgacgcttctgaatgtctatcagaagaaacatctggttgaaattttgtcataccacaattgtgattcacaaactcgaaatgctccagaattggattgccttatcagacttcaggctcagaacatacagcaacgacacatagtctttttaacagagaagaacatcaagatgctttccagttatacagataatggaatagtggttgcaactgctgaagacttcatgcaaaactttaaaaatcttgtgggctatcacaattcaatcacagaagaaaaccttccacagcttggtgctaatgagaatcttgagtcgcagtcagctcttttagaaaacgatgaaaaggatgaagaggatatgtctctggattcaggggatgaaatctcacatatagaagtatgcagcaattttcattcagaaatatgggagaaagagaccaaaggatcacgtggaacagatcaaaaaaagaatactcaaattgagttgcaatcgtctcctgatgtgcaaaacagtttattagaagataagacttaccttgattctgaagagagaacttctattgatatagtatgctctgaaggagagaacagcaattcaacagaacaagattcatatagtaactttcaggtttatcatagtcaattaaatatgtcccatcagtttagtcattttaatgttctcactcatcagacatttttggggacaccatatgccctttcatcaagtcagtctcaagaaaatgagaattacttcttatctgcttatactgaaagcttggatagagataaatctccacctcccttaagttgggggaaaagtgattcttccaggccatattcacaagagaaataactgtagtaactttttttttaagagattgttgtggactttgtttattaacaatttatatttcattctctaaacaaaaggttcttgttctttctcaaatgttttttcttttatttaaatcatgatggcctgtaacagttgaagcatctaaaaattgaaataaatatatatttttaacatatattgtacttgaattatctcatgttggcacttctaagttttactttttgtatgttacctgtacttaggcttcaaattgaagcctgttttatgtgtaaaatcagatgcttgcaggaggacggtaaacagcaaaggctttacttctttttctctaatgtcacctgatataaagtacttttgttgaagtgaattattttgatgtaggcttttgtatactgtgtttacacaggtataagtcagtaatagcagtgttaatatttacaggattttggctcgatacctcaagatttatctaacagtgcagtttcatttagataataaactatgtacataggacacattttttatctctaggcttagtcatgtaaaaactgcctattgctaaaattctggtaactttttgagagtattggataattttcagtacctgcgcaatccttgatttaatgaaattaaattttttatttcaaaagataggcttctgtttatcaaaggcgttgaacaatttgatttttaaattagttttagcaaaatggaagtataatgggaatatatttttgaggtggtcttagtagtaattaccatttgttgaacacattaatgctatactagacagatacagtggagatagctttcaaacccgtatctattcctaactactgcctctaatactaattactaacttgttactaatgctaacttttaaaaatgtttttgaaaattgcaatttctacaaataaatgtcatagtgcaaataaatgtcaggatttagagaaggagcctaaactgaatttgtgttatttcagtaaaagttatggagttatgggtctagacgtgttaataagttagacagaactttggcactttagaacaaatgcatgagtggtatttcagttcctaagttacataaaaagtgtgaaagaacactgtgaggtcccagcaacgccagactatattaaggtaagtagaaagtgtttttatagggcttcaatacccaggtggtgacagagcagaagaaccggtttttttttttttttttttactactaagcttttacaaaagaagtatctgttttattgtatagaacaagtacagcattttactacatagtatacaagtttttaatgagcatttaaaaaaataagtaaatctaggctatttgaaaaatacagttgagccagtgagcacattttataatttggaagacacaaatcaaatgtgaaggatttgattttctacatttaaaatgaagaaccaaaactctcttcttgattttcagctaaaggcaggagactactttccaactccttttgcttctggagaaggccctgaaatcacattgatatatgtttgttagtaaaatgtgcacacctgacttgcaatgttgtgttaaactagaattatattcacttggaaaacatatcgcttaggataaaattttgtcattcaaaaattttttcagaaatgcttgtactagaccacctcatttggatatatagctatcacatttgtaagattctgtttttagcataaaaatcaatagggatgaaaattttcttagaactcaagactccataactatgggggtaaatgaagtcatcccttctcccccagtccacccccaagtgctcttagatactgaaggagtctcccttaacatacagtgttttttttttgttgttgtttttttgtttttttttggagatggagtctcgctctgtcgcccaagctggagtacagtggtgcaatctcactgcaagctctgcctcccaggttcacaccattctcctgcctcaacctcccgaatggctgggactacaggcacccaccaccacgcctggctaactaactaactaactttttgtatttttagtagagacagggtttcactgtgttagccaggatggtcttgatctcctgacctcatgatctgcctgcctcagcctcccaaagtgctgggattacaggcttgagccactgctcctggccaacatccagtattttatcttgactgtcctaaccttaccttagatgctaacagaagggtcctgctgaaataacactgggtgctatattgatgggtaaatgtgtacatcctattccttcctctttatctcacaatttttgtctccactaagcaagaagtaaactaacacttcgtcactctaaagaaataacttatgtaaaactcttagtaaccctgtttgtcttcaaatgagtaaatagaccaaagtggggggacaattttctagttctgtagagggaaaaacatctgagtcaacattttgaaatgcagagggtattggtacatgacgacatggaaaagggcacttttaaacacagcttactcttcctcaagtacagagagtatatagtgaatcaaaactaactacagccattctttttaaagcccaagggatggagcaaaggtgtaaggatgttacctgtttgttttaatcagagagcaaaaagaagtcacaatagtttgggagaaaaagtagtatggtgagtaaggttatgcgtataatttcatactgaatttattactatttgggatgtacgtcaatgttctaacaaacactgccaacacgtcaattttttaaaaagcgtgggccacattgctaagaatttgttaaagcataactgtattttttgttttagggccttattgatgttttgccgttccaatgtatgcatttttttactcaataaacttgtcttaattttaaaaaagtc

SEQ ID NO: 277993 - DNA, 7108 bp, Homo sapiens
agatccccaggaagagcagagaaaagaaagcacttttccagccattaactccaggctctcgagaatttgaagatgttgtaaatattctccattcttcttaccttgaaccaacctcagtaacaaattttaactacagacgtgcttgcttggtacacaatgagcttttggaaaaggagtttacagaaaagcgaagagaactgaagtttgatggtcgtttagataaggaactttcagaatcctatgcatttctgatggttgatcgataccaggttcaaaccatatgtgaaaaaggattacatgtgggtcagtccaaaataacaattcttggcagtccttccatggacctgagaaattagatgttgaaacagttatgagtattgatcatctgaaacagaaaatccctccagcactgttttataaggaaacatacttaggtccaaatgaagttttgaagaatggaatgtattgcagcctttatgaagttgtggaaaagacaagaattggaagtaacatggagagtttactgcaaaaactagacagagaaaaacttgttcttgttaaacctttgggagaccgaggatacctttttcttctctccccttatcagatggttcctccatatgaatatcagactgccaagtctcgagtcctacatgctttgtttctatttcaagaacctagaagcatagttacttcacaaaaaggttcaaccaatgcagcaccacaggagaggcatgagagcatgccagatgtattaaaaatagctcagtttttacaattttctttgattcagtgtcgaaaggaattcaaaaatataagcgccataaattttcattctgttgttgaaaagtatgtaagtgaattttttaagcgaggttttggttcaggtaaacgagagtttattatgtttccatatgattcacgattagatgataaaaaattcttatactcagctcccagaaataaatcccatattgatacttgtttgcatgcctatatttttcggcctgaagtgtatcagttacctatttgtaaattaaaagaactatttgaagaaaatagaaaacttcagcagtttagtccactttcagattatgaaggtcaagaagaagaaatgaatggtacaaaaatgaaatttggaaaacgaaataactcaagaggtgaagccattatatctggaaagcaaagatcatctcattctttggattatgataaggatagagtcaaagaattgattaatttaattcagtgtaggaaaaagagtgtgggtggggactcagacacagaagatatgagaagcaaaactgtcttgaagaggaagcttgaggatctacctgaaaatatgagaaagctcgccaaaaccagtaatttatctgaaaattgccatctgtatgaagagtctccacagcctattggctcacttggacatgatgctgacttgaggcggcagcagcaggatacctgtaactccggcattgctgacatccataggctgtttaattggttatcagaaacactagcaaatgcgcgccattctgatgcatctctgacagacacagtcaacaaagccttaggattgagcactgatgatgcctatgaagagctgaggcaaaaacatgagtatgagttgaactctaccccagataagaaagactatgagcagcctacttgtgcaaaagttgaaaatgcacagtttaagggtactcagagcttattactagaagttgatgcaacatctaagtattctgttgctatttctaccagcgaagtgggcactgaccataagctacatttgaaagaagatccaaatttaattagcgtgaataattttgaagattgcagtttgtgtcccagtgttcccattgaacatggatttcgtagacaacagtctaagtcaaataatgttgaagagactgaaatacattggaaactgattccaattacaggagggaatgcaagaagcccagaagaccagctggggaaacatggtgagaaacaaacaccaggtatgaaatcaccagaagaacaactggtgtgtgtgccaccacaggaggcctttcctaacgacccccgggtaataaatagacagagaagttctgattaccagtttccatcctctccatttacagacacactaaagggcaccactgaggatgacgtgttgacaggtcaggtggaggagcagtgtgtgccagcagcagaggcagagccgcctgcagtgagcgaaaccacagagaggacagtgttaggagagtacaatctcttttctaggaagatagaagagattttgaagcaaaagaatgtttcatatgtcagtagagtttccacacctatcttttcaacacaagagaagatgaaacggctttccgagttcatatattctaagacttccaaagctggtgtgcaggagtttgtagatggtttgcatgagaagctaaatactattattattaaagcatcagccaagggtgggaatttgccaccagtcagtcctaacgattctggtgctaagatagcatcgaatcctctggaaaggcatgtcataccagtttcctcaagtgacttcaacaataaacatctccttgagccactgtgtagtgatcctttgaaagataccaactctgatgagcagcattccacttcggctttaactgaagtagaaatgaaccagcctcaacatgccacagagttaatggtgacttctgatcatattgtacctggtgatatggcccgggaaccagtagaagaaacaacaaaatcccccagtgatgtaaacatttctgctcaaccagctctttcaaattttataagccagttagaacctgaagtatttaatagtttggttaaaatcatgaaagacgtccagaaaaatactgtgaaattttatattcatgaagaagaagagagtgtgctctgtaaagaaataaaggaatatcttatcaaattaggcaatacagaatgtcatcctgaacagtttttggaaagaagatcaaaattagataaactattgattattattcaaaatgaagacattgcaggtttcattcacaagatacctggcttggtgactttaaagaagctcccctgtgttagttttgctggtgttgatagcctggatgatgttaaaaatcatacatacaatgaattatttgtatctggaggttttatcgtatctgatgaatcaattctaaacccagaggttgtcacagttgagaaccttaaaaattttttgacattccttgaggaacttagtactccagaaggaaaatggcaatggaaagtccactgtaaatttcagaagaaactaaaggaactaggcagattgaatgctaaagctctaagtctgttgacgcttctgaatgtctatcagaagaaacatctggttgaaattttgtcataccacaattgtgattcacaaactcgaaatgctccagaattggattgccttatcagacttcaggctcagaacatacagcaacgacacatagtctttttaacagagaagaacatcaagatgctttccagttatacagataatggaatagtggttgcaactgctgaagacttcatgcaaaactttaaaaatcttgtgggctatcacaattcaatcacagaagaaaaccttccacagcttggtgctaatgagaatcttgagtcgcagtcagctcttttagaaaacgatgaaaaggatgaagaggatatgtctctggattcaggggatgaaatctcacatatagaagtatgcagcaattttcattcagaaatatgggagaaagagaccaaaggatcacgtggaacagatcaaaaaaagaatactcaaattgagttgcaatcgtctcctgatgtgcaaaacagtttattagaagataagacttaccttgattctgaagagagaacttctattgatatagtatgctctgaaggagagaacagcaattcaacagaacaagattcatatagtaactttcaggtttatcatagtcaattaaatatgtcccatcagtttagtcattttaatgttctcactcatcagacatttttggggacaccatatgccctttcatcaagtcagtctcaagaaaatgagaattacttcttatctgcttatactgaaagcttggatagagataaatctccacctcccttaagttgggggaaaagtgattcttccaggccatattcacaagagaaataactgtagtaactttttttttaagagattgttgtggactttgtttattaacaatttatatttcattctctaaacaaaaggttcttgttctttctcaaatgttttttcttttatttaaatcatgatggcctgtaacagttgaagcatctaaaaattgaaataaatatatatttttaacatatattgtacttgaattatctcatgttggcacttctaagttttactttttgtatgttacctgtacttaggcttcaaattgaagcctgttttatgtgtaaaatcagatgcttgcaggaggacggtaaacagcaaaggctttacttctttttctctaatgtcacctgatataaagtacttttgttgaagtgaattattttgatgtaggcttttgtatactgtgtttacacaggtataagtcagtaatagcagtgttaatatttacaggattttggctcgatacctcaagatttatctaacagtgcagtttcatttagataataaactatgtacataggacacattttttatctctaggcttagtcatgtaaaaactgcctattgctaaaattctggtaactttttgagagtattggataattttcagtacctgcgcaatccttgatttaatgaaattaaattttttatttcaaaagataggcttctgtttatcaaaggcgttgaacaatttgatttttaaattagttttagcaaaatggaagtataatgggaatatatttttgaggtggtcttagtagtaattaccatttgttgaacacattaatgctatactagacagatacagtggagatagctttcaaacccgtatctattcctaactactgcctctaatactaattactaacttgttactaatgctaacttttaaaaatgtttttgaaaattgcaatttctacaaataaatgtcatagtgcaaataaatgtcaggatttagagaaggagcctaaactgaatttgtgttatttcagtaaaagttatggagttatgggtctagacgtgttaataagttagacagaactttggcactttagaacaaatgcatgagtggtatttcagttcctaagttacataaaaagtgtgaaagaacactgtgaggtcccagcaacgccagactatattaaggtaagtagaaagtgtttttatagggcttcaatacccaggtggtgacagagcagaagaaccggtttttttttttttttttttactactaagcttttacaaaagaagtatctgttttattgtatagaacaagtacagcattttactacatagtatacaagtttttaatgagcatttaaaaaaataagtaaatctaggctatttgaaaaatacagttgagccagtgagcacattttataatttggaagacacaaatcaaatgtgaaggatttgattttctacatttaaaatgaagaaccaaaactctcttcttgattttcagctaaaggcaggagactactttccaactccttttgcttctggagaaggccctgaaatcacattgatatatgtttgttagtaaaatgtgcacacctgacttgcaatgttgtgttaaactagaattatattcacttggaaaacatatcgcttaggataaaattttgtcattcaaaaattttttcagaaatgcttgtactagaccacctcatttggatatatagctatcacatttgtaagattctgtttttagcataaaaatcaatagggatgaaaattttcttagaactcaagactccataactatgggggtaaatgaagtcatcccttctcccccagtccacccccaagtgctcttagatactgaaggagtctcccttaacatacagtgttttttttttgttgttgtttttttgtttttttttggagatggagtctcgctctgtcgcccaagctggagtacagtggtgcaatctcactgcaagctctgcctcccaggttcacaccattctcctgcctcaacctcccgaatggctgggactacaggcacccaccaccacgcctggctaactaactaactaactttttgtatttttagtagagacagggtttcactgtgttagccaggatggtcttgatctcctgacctcatgatctgcctgcctcagcctcccaaagtgctgggattacaggcttgagccactgctcctggccaacatccagtattttatcttgactgtcctaaccttaccttagatgctaacagaagggtcctgctgaaataacactgggtgctatattgatgggtaaatgtgtacatcctattccttcctctttatctcacaatttttgtctccactaagcaagaagtaaactaacacttcgtcactctaaagaaataacttatgtaaaactcttagtaaccctgtttgtcttcaaatgagtaaatagaccaaagtggggggacaattttctagttctgtagagggaaaaacatctgagtcaacattttgaaatgcagagggtattggtacatgacgacatggaaaagggcacttttaaacacagcttactcttcctcaagtacagagagtatatagtgaatcaaaactaactacagccattctttttaaagcccaagggatggagcaaaggtgtaaggatgttacctgtttgttttaatcagagagcaaaaagaagtcacaatagtttgggagaaaaagtagtatggtgagtaaggttatgcgtataatttcatactgaatttattactatttgggatgtacgtcaatgttctaacaaacactgccaacacgtcaattttttaaaaagcgtgggccacattgctaagaatttgttaaagcataactgtattttttgttttagggccttattgatgttttgccgttccaatgtatgcatttttttactcaataaacttgtcttaattttaaaaaagtc

SEQ ID NO: 277994 - DNA, 5216 bp, Homo sapiens
cggctccgaggaccgggcagcgcatttggggtgcccgctacagggccccccaagaggctgccaggtcgggagcgcagcctgaggccacggggggaagggggtgggtgggctgagagcagctcggcggcgagactggcccgccgccccttccccccacacccgtcgaccttgtgggcagaagcttcccagagctccttaggccggcgcgatggcgactgctgtggagacggaggcctgtcagccgacggatgcgagttgggaaagtggcggcggcggagacgacgagatgaagcaggcgcttccggagcttgagtcctcccaacaaaatggcggcggcggcggcctcaacatcgctgagcccagcggcggcgctgggcgtgaggagaacgcgggggccgaggccgcccagagcctcagccacgagcagcctcaggactcctctgaggcgggcgcggccgccctgcccagaggccccgaagagcccgaaaggcctgttaggaggagttttcagatccccaggaagagcagagaaaagaaagcacttttccagccattaactccaggctctcgagaatttgaagatgttgtaaatattctccattcttcttaccttgaaccaacctcagtaacaaattttaactacagacgtgcttgcttggtacacaatgagcttttggaaaaggagtttacagaaaagcgaagagaactgaagtttgatggtcgtttagataaggaactttcagaatcctatgcatttctgatggttgatcgataccaggttcaaaccatatgtgaaaaaggattacatgtgggtcagtccaaaataacaattcttggcagtccttccatgggtgtctatctttctaggtatgctgatttattacaagcgaatcctttggacacgggggcaatgggtgatgttgttatttttaaaataatgaagggtaaaataaagagtatatatgaccccatgggtgtaaaaagtttggaatctatgttaaataagagtgctttggaccccacaccaaagcatgaatgtcacgtgtcaaagaatgccaatcgaattacatcacttttggcttacagagcctatgagcttactcagtattatttttatgagtatggctttgatgagctaaggcgaagaccaagacacgtttgtccatatgcagttgtgtcttttacttacaaagatgatatacaaactccgaagtttgtaccttcatcaagatctaacagctttaatacagatagaaacatagataaatataactataccttgtggaaaggacagcttttaaataaaggaaaacttttgtgttatatttctctgaggtcagccactcgtgcttttttgcctatcaaactacctgagaaattagatgttgaaacagttatgagtattgatcatctgaaacagaaaatccctccagcactgttttataaggaaacatacttaggtccaaatgaagttttgaagaatggaatgtattgcagcctttatgaagttgtggaaaagacaagaattggaagtaacatggagagtttactgcaaaaactagacagagaaaaacttgttcttgttaaacctttgggagaccgaggatacctttttcttctctccccttatcagatggttcctccatatgaatatcagactgccaagtctcgagtcctacatgctttgtttctatttcaagaacctagaagcatagttacttcacaaaaaggttcaaccaatgcagcaccacaggagaggcatgagagcatgccagatgtattaaaaatagctcagtttttacaattttctttgattcagtgtcgaaaggaattcaaaaatataagcgccataaattttcattctgttgttgaaaagtatgtaagtgaattttttaagcgaggttttggttcaggtaaacgagagtttattatgtttccatatgattcacgattagatgataaaaaattcttatactcagctcccagaaataaatcccatattgatacttgtttgcatgcctatatttttcggcctgaagtgtatcagttacctatttgtaaattaaaagaactatttgaagaaaatagaaaacttcagcagtttagtccactttcagattatgaaggtcaagaagaagaaatgaatggtacaaaaatgaaatttggaaaacgaaataactcaagaggtgaagccattatatctggaaagcaaagatcatctcattctttggattatgataaggatagagtcaaagaattgattaatttaattcagtgtaggaaaaagagtgtgggtggggactcagacacagaagatatgagaagcaaaactgtcttgaagaggaagcttgaggatctacctgaaaatatgagaaagctcgccaaaaccagtaatttatctgaaaattgccatctgtatgaagagtctccacagcctattggctcacttggacatgatgctgacttgaggcggcagcagcaggatacctgtaactccggcattgctgacatccataggctgtttaattggttatcagaaacactagcaaatgcgcgccattctgatgcatctctgacagacacagtcaacaaagccttaggattgagcactgatgatgcctatgaagagctgaggcaaaaacatgagtatgagttgaactctaccccagataagaaagactatgagcagcctacttgtgcaaaagttgaaaatgcacagtttaagggtactcagagcttattactagaagttgatgcaacatctaagtattctgttgctatttctaccagcgaagtgggcactgaccataagctacatttgaaagaagatccaaatttaattagcgtgaataattttgaagattgcagtttgtgtcccagtgttcccattgaacatggatttcgtagacaacagtctaagtcaaataatgttgaagagactgaaatacattggaaactgattccaattacagacacactaaagggcaccactgaggatgacgtgttgacaggtcaggtggaggagcagtgtgtgccagcagcagaggcagagccgcctgcagtgagcgaaaccacagagaggacagtgttaggagagtacaatctcttttctaggaagatagaagagattttgaagcaaaagaatgtttcatatgtcagtagagtttccacacctatcttttcaacacaagagaagatgaaacggctttccgagttcatatattctaagacttccaaagctggtgtgcaggagtttgtagatggtttgcatgagaagctaaatactattattattaaagcatcagccaagggtgggaatttgccaccagtcagtcctaacgattctggtgctaagatagcatcgaatcctctggaaaggcatgtcataccagtttcctcaagtgacttcaacaataaacatctccttgagccactgtgtagtgatcctttgaaagataccaactctgatgagcagcattccacttcggctttaactgaagtagaaatgaaccagcctcaacatgccacagagttaatggtgacttctgatcatattgtacctggtgatatggcccgggaaccagtagaagaaacaacaaaatcccccagtgatgtaaacatttctgctcaaccagctctttcaaattttataagccagttagaacctgaagtatttaatagtttggttaaaatcatgaaagacgtccagaaaaatactgtgaaattttatattcatgaagaagaagagagtgtgctctgtaaagaaataaaggaatatcttatcaaattaggcaatacagaatgtcatcctgaacagtttttggaaagaagatcaaaattagataaactattgattattattcaaaatgaagacattgcaggtttcattcacaagatacctggcttggtgactttaaagaagctcccctgtgttagttttgctggtgttgatagcctggatgatgttaaaaatcatacatacaatgaattatttgtatctggaggttttatcgtatctgatgaatcaattctaaacccagaggttgtcacagttgagaaccttaaaaattttttgacattccttgaggaacttagtactccagaaggaaaatggcaatggaaagtccactgtaaatttcagaagaaactaaaggaactaggcagattgaatgctaaagctctaagtctgttgacgcttctgaatgtctatcagaagaaacatctggttgaaattttgtcataccacaattgtgattcacaaactcgaaatgctccagaattggattgccttatcagacttcaggctcagaacatacagcaacgacacatagtctttttaacagagaagaacatcaagatgctttccagttatacagataatggaatagtggttgcaactgctgaagacttcatgcaaaactttaaaaatcttgtgggctatcacaattcaatcacagaagaaaaccttccacagcttggtgctaatgagaatcttgagtcgcagtcagctcttttagaaaacgatgaaaaggatgaagaggatatgtctctggattcaggggatgaaatctcacatatagaagtatgcagcaattttcattcagaaatatgggagaaagagaccaaaggatcacgtggaacagatcaaaaaaagaatactcaaattgagttgcaatcgtctcctgatgtgcaaaacagtttattagaagataagacttaccttgattctgaagagagaacttctattgatatagtatgctctgaaggagagaacagcaattcaacagaacaagattcatatagtaactttcaggtttatcatagtcaattaaatatgtcccatcagtttagtcattttaatgttctcactcatcagacatttttggggacaccatatgccctttcatcaagtcagtctcaagaaaatgagaattacttcttatctgcttatactgaaagcttggatagagataaatctccacctcccttaagttgggggaaaagtgattcttccaggccatattcacaagagaaataactgtagtaactttttttttaagagattgttgtggactttgtttattaacaatttatatttcattctctaaacaaaaggttcttgttctttctcaaatgttttttcttttatttaaatcatgatggcctgtaacagttgaagcatctaaaaattgaaataaatatatatttttaacata

SEQ ID NO: 277995 - DNA, 3567 bp, Homo sapiens
taaaggatcccccgtgtcacggatgtgaccctgacgcgttatattgtgtgagtagtgtataattttaaaacttaaacaaactgtgtatttcaatagaggaggactttttgttttttaaatgtagctcttttagaaaacgatgaaaaggatgaagaggatatgtctctggattcaggggatgaaatctcacatatagaagtatgcagcaattttcattcagaaatatgggagaaagagaccaaaggatcacgtggaacagatcaaaaaaagaatactcaaattgagttgcaatcgtctcctgatgtgcaaaacagtttattagaagataagacttaccttgattctgaagagagaacttctattgatatagtatgctctgaaggagagaacagcaattcaacagaacaagattcatatagtaactttcaggtttatcatagtcaattaaatatgtcccatcagtttagtcattttaatgttctcactcatcagacatttttggggacaccatatgccctttcatcaagtcagtctcaagaaaatgagaattacttcttatctgcttatactgaaagcttggatagagataaatctccacctcccttaagttgggggaaaagtgattcttccaggccatattcacaagagaaataactgtagtaactttttttttaagagattgttgtggactttgtttattaacaatttatatttcattctctaaacaaaaggttcttgttctttctcaaatgttttttcttttatttaaatcatgatggcctgtaacagttgaagcatctaaaaattgaaataaatatatatttttaacatatattgtacttgaattatctcatgttggcacttctaagttttactttttgtatgttacctgtacttaggcttcaaattgaagcctgttttatgtgtaaaatcagatgcttgcaggaggacggtaaacagcaaaggctttacttctttttctctaatgtcacctgatataaagtacttttgttgaagtgaattattttgatgtaggcttttgtatactgtgtttacacaggtataagtcagtaatagcagtgttaatatttacaggattttggctcgatacctcaagatttatctaacagtgcagtttcatttagataataaactatgtacataggacacattttttatctctaggcttagtcatgtaaaaactgcctattgctaaaattctggtaactttttgagagtattggataattttcagtacctgcgcaatccttgatttaatgaaattaaattttttatttcaaaagataggcttctgtttatcaaaggcgttgaacaatttgatttttaaattagttttagcaaaatggaagtataatgggaatatatttttgaggtggtcttagtagtaattaccatttgttgaacacattaatgctatactagacagatacagtggagatagctttcaaacccgtatctattcctaactactgcctctaatactaattactaacttgttactaatgctaacttttaaaaatgtttttgaaaattgcaatttctacaaataaatgtcatagtgcaaataaatgtcaggatttagagaaggagcctaaactgaatttgtgttatttcagtaaaagttatggagttatgggtctagacgtgttaataagttagacagaactttggcactttagaacaaatgcatgagtggtatttcagttcctaagttacataaaaagtgtgaaagaacactgtgaggtcccagcaacgccagactatattaaggtaagtagaaagtgtttttatagggcttcaatacccaggtggtgacagagcagaagaaccggtttttttttttttttttttactactaagcttttacaaaagaagtatctgttttattgtatagaacaagtacagcattttactacatagtatacaagtttttaatgagcatttaaaaaaataagtaaatctaggctatttgaaaaatacagttgagccagtgagcacattttataatttggaagacacaaatcaaatgtgaaggatttgattttctacatttaaaatgaagaaccaaaactctcttcttgattttcagctaaaggcaggagactactttccaactccttttgcttctggagaaggccctgaaatcacattgatatatgtttgttagtaaaatgtgcacacctgacttgcaatgttgtgttaaactagaattatattcacttggaaaacatatcgcttaggataaaattttgtcattcaaaaattttttcagaaatgcttgtactagaccacctcatttggatatatagctatcacatttgtaagattctgtttttagcataaaaatcaatagggatgaaaattttcttagaactcaagactccataactatgggggtaaatgaagtcatcccttctcccccagtccacccccaagtgctcttagatactgaaggagtctcccttaacatacagtgttttttttttgttgttgtttttttgtttttttttggagatggagtctcgctctgtcgcccaagctggagtacagtggtgcaatctcactgcaagctctgcctcccaggttcacaccattctcctgcctcaacctcccgaatggctgggactacaggcacccaccaccacgcctggctaactaactaactaactttttgtatttttagtagagacagggtttcactgtgttagccaggatggtcttgatctcctgacctcatgatctgcctgcctcagcctcccaaagtgctgggattacaggcttgagccactgctcctggccaacatccagtattttatcttgactgtcctaaccttaccttagatgctaacagaagggtcctgctgaaataacactgggtgctatattgatgggtaaatgtgtacatcctattccttcctctttatctcacaatttttgtctccactaagcaagaagtaaactaacacttcgtcactctaaagaaataacttatgtaaaactcttagtaaccctgtttgtcttcaaatgagtaaatagaccaaagtggggggacaattttctagttctgtagagggaaaaacatctgagtcaacattttgaaatgcagagggtattggtacatgacgacatggaaaagggcacttttaaacacagcttactcttcctcaagtacagagagtatatagtgaatcaaaactaactacagccattctttttaaagcccaagggatggagcaaaggtgtaaggatgttacctgtttgttttaatcagagagcaaaaagaagtcacaatagtttgggagaaaaagtagtatggtgagtaaggttatgcgtataatttcatactgaatttattactatttgggatgtacgtcaatgttctaacaaacactgccaacacgtcaattttttaaaaagcgtgggccacattgctaagaatttgttaaagcataactgtattttttgttttagggccttattgatgttttgccgttccaatgtatgcatttttttactcaataaacttgtcttaattttaaaaaagtc

SEQ ID NO: 277996 - DNA, 3160 bp, Homo sapiens
gtttgtgtttgtttggttgtgtgggtggtgattgtgtttgtggttcttctgtgttgtgtggttgtgttgttgtgcagtgggctagacatttttggggacaccatatgccctttcatcaagtcagtctcaagaaaatgagaattacttcttatctgcttatactgaaagcttggatagagataaatctccacctcccttaagttgggggaaaagtgattcttccaggccatattcacaagagaaataactgtagtaactttttttttaagagattgttgtggactttgtttattaacaatttatatttcattctctaaacaaaaggttcttgttctttctcaaatgttttttcttttatttaaatcatgatggcctgtaacagttgaagcatctaaaaattgaaataaatatatatttttaacatatattgtacttgaattatctcatgttggcacttctaagttttactttttgtatgttacctgtacttaggcttcaaattgaagcctgttttatgtgtaaaatcagatgcttgcaggaggacggtaaacagcaaaggctttacttctttttctctaatgtcacctgatataaagtacttttgttgaagtgaattattttgatgtaggcttttgtatactgtgtttacacaggtataagtcagtaatagcagtgttaatatttacaggattttggctcgatacctcaagatttatctaacagtgcagtttcatttagataataaactatgtacataggacacattttttatctctaggcttagtcatgtaaaaactgcctattgctaaaattctggtaactttttgagagtattggataattttcagtacctgcgcaatccttgatttaatgaaattaaattttttatttcaaaagataggcttctgtttatcaaaggcgttgaacaatttgatttttaaattagttttagcaaaatggaagtataatgggaatatatttttgaggtggtcttagtagtaattaccatttgttgaacacattaatgctatactagacagatacagtggagatagctttcaaacccgtatctattcctaactactgcctctaatactaattactaacttgttactaatgctaacttttaaaaatgtttttgaaaattgcaatttctacaaataaatgtcatagtgcaaataaatgtcaggatttagagaaggagcctaaactgaatttgtgttatttcagtaaaagttatggagttatgggtctagacgtgttaataagttagacagaactttggcactttagaacaaatgcatgagtggtatttcagttcctaagttacataaaaagtgtgaaagaacactgtgaggtcccagcaacgccagactatattaaggtaagtagaaagtgtttttatagggcttcaatacccaggtggtgacagagcagaagaaccggtttttttttttttttttttactactaagcttttacaaaagaagtatctgttttattgtatagaacaagtacagcattttactacatagtatacaagtttttaatgagcatttaaaaaaataagtaaatctaggctatttgaaaaatacagttgagccagtgagcacattttataatttggaagacacaaatcaaatgtgaaggatttgattttctacatttaaaatgaagaaccaaaactctcttcttgattttcagctaaaggcaggagactactttccaactccttttgcttctggagaaggccctgaaatcacattgatatatgtttgttagtaaaatgtgcacacctgacttgcaatgttgtgttaaactagaattatattcacttggaaaacatatcgcttaggataaaattttgtcattcaaaaattttttcagaaatgcttgtactagaccacctcatttggatatatagctatcacatttgtaagattctgtttttagcataaaaatcaatagggatgaaaattttcttagaactcaagactccataactatgggggtaaatgaagtcatcccttctcccccagtccacccccaagtgctcttagatactgaaggagtctcccttaacatacagtgttttttttttgttgttgtttttttgtttttttttggagatggagtctcgctctgtcgcccaagctggagtacagtggtgcaatctcactgcaagctctgcctcccaggttcacaccattctcctgcctcaacctcccgaatggctgggactacaggcacccaccaccacgcctggctaactaactaactaactttttgtatttttagtagagacagggtttcactgtgttagccaggatggtcttgatctcctgacctcatgatctgcctgcctcagcctcccaaagtgctgggattacaggcttgagccactgctcctggccaacatccagtattttatcttgactgtcctaaccttaccttagatgctaacagaagggtcctgctgaaataacactgggtgctatattgatgggtaaatgtgtacatcctattccttcctctttatctcacaatttttgtctccactaagcaagaagtaaactaacacttcgtcactctaaagaaataacttatgtaaaactcttagtaaccctgtttgtcttcaaatgagtaaatagaccaaagtggggggacaattttctagttctgtagagggaaaaacatctgagtcaacattttgaaatgcagagggtattggtacatgacgacatggaaaagggcacttttaaacacagcttactcttcctcaagtacagagagtatatagtgaatcaaaactaactacagccattctttttaaagcccaagggatggagcaaaggtgtaaggatgttacctgtttgttttaatcagagagcaaaaagaagtcacaatagtttgggagaaaaagtagtatggtgagtaaggttatgcgtataatttcatactgaatttattactatttgggatgtacgtcaatgttctaacaaacactgccaacacgtcaattttttaaaaagcgtgggccacattgctaagaatttgttaaagcataactgtattttttgttttagggccttattgatgttttgccgttccaatgtatgcatttttttactcaataaacttgtcttaattttaaaaaagtc

SEQ ID NO: 277997 - DNA, 1284 bp, Homo sapiens
cggctccgaggaccgggcagcgcatttggggtgcccgctacagggccccccaagaggctgccaggtcgggagcgcagcctgaggccacggggggaagggggtgggtgggctgagagcagctcggcggcgagactggcccgccgccccttccccccacacccgtcgaccttgtgggcagaagcttcccagagctccttaggccggcgcgatggcgactgctgtggagacggaggcctgtcagccgacggatgcgagttgggaaagtggcggcggcggagacgacgagatgaagcaggcgcttccggagcttgagtcctcccaacaaaatggcggcggcggcggcctcaacatcgctgagcccagcggcggcgctgggcgtgaggagaacgcgggggccgaggccgcccagagcctcagccacgagcagcctcaggactcctctgaggcgggcgcggccgccctgcccagaggccccgaagagcccgaaaggcctgttaggaggagttttcagatccccaggaagagcagagaaaagaaagcacttttccagccattaactccaggctctcgagaatttgaagatgttgtaaatattctccattcttcttaccttgaaccaacctcagtaacaaattttaactacagacgtgcttgcttggtacacaatgagcttttggaaaaggagtttacagaaaagcgaagagaactgaagtttgatggtcgtttagataaggaactttcagaatcctatgcatttctgatggttgatcgataccaggttcaaaccatatgtgaaaaaggattacatgtgggtcagtccaaaataacaattcttggcagtccttccatgggtgtctatctttctaggtatgctgatttattacaagcgaatcctttggacacgggggcaatgggtgatgttgttatttttaaaataatgaagggtaaaataaagagtatatatgaccccatgggtgtaaaaagtttggaatctatgttaaataagagtgctttggaccccacaccaaagcatgaatgtcacgtgtcaaagaatgccaatcgaattacatcacttttggcttacagagcctatgagcttactcagtattatttttatgagtatggctttgatgagctaaggcgaagaccaagacacgtttgtccatatgcagttgtgtcttttacttacaaagatgatatacaaactccgaagtttgtaccttcatcaagaattaacagctttttttccgatagaaacattctttaattttacttttccctggg

SEQ ID NO: 277998 - DNA, 1154 bp, Homo sapiens
atcgagatcaaggtacgcaccatagaatccagtccacccccaagtgctcttagatactgaaggagtctcccttaacatacagtgttttttttttgttgttgtttttttgtttttttttggagatggagtctcgctctgtcgcccaagctggagtacagtggtgcaatctcactgcaagctctgcctcccaggttcacaccattctcctgcctcaacctcccgaatggctgggactacaggcacccaccaccacgcctggctaactaactaactaactttttgtatttttagtagagacagggtttcactgtgttagccaggatggtcttgatctcctgacctcatgatctgcctgcctcagcctcccaaagtgctgggattacaggcttgagccactgctcctggccaacatccagtattttatcttgactgtcctaaccttaccttagatgctaacagaagggtcctgctgaaataacactgggtgctatattgatgggtaaatgtgtacatcctattccttcctctttatctcacaatttttgtctccactaagcaagaagtaaactaacacttcgtcactctaaagaaataacttatgtaaaactcttagtaaccctgtttgtcttcaaatgagtaaatagaccaaagtggggggacaattttctagttctgtagagggaaaaacatctgagtcaacattttgaaatgcagagggtattggtacatgacgacatggaaaagggcacttttaaacacagcttactcttcctcaagtacagagagtatatagtgaatcaaaactaactacagccattctttttaaagcccaagggatggagcaaaggtgtaaggatgttacctgtttgttttaatcagagagcaaaaagaagtcacaatagtttgggagaaaaagtagtatggtgagtaaggttatgcgtataatttcatactgaatttattactatttgggatgtacgtcaatgttctaacaaacactgccaacacgtcaattttttaaaaagcgtgggccacattgctaagaatttgttaaagcataactgtattttttgttttagggccttattgatgttttgccgttccaatgtatgcatttttttactcaataaacttgtcttaattttaaaaaagtc

SEQ ID NO: 277999 - DNA, 1026 bp, Homo sapiens
cggctccgaggaccgggcagcgcatttggggtgcccgctacagggccccccaagaggctgccaggtcgggagcgcagcctgaggccacggggggaagggggtgggtgggctgagagcagctcggcggcgagactggcccgccgccccttccccccacacccgtcgaccttgtgggcagaagcttcccagagctccttaggccggcgcgatggcgactgctgtggagacggaggcctgtcagccgacggatgcgagttgggaaagtggcggcggcggagacgacgagatgaagcaggcgcttccggagcttgagtcctcccaacaaaatggcggcggcggcggcctcaacatcgctgagcccagcggcggcgctgggcgtgaggagaacgcgggggccgaggccgcccagagcctcagccacgagcagcctcaggactcctctgaggcgggcgcggccgccctgcccagaggccccgaagagcccgaaaggcctgttaggaggagttttcagatccccaggaagagcagagaaaagaaagcacttttccagccattaactccaggctctcgagaatttgaagatgttgtaaatattctccattcttcttaccttgaaccaacctcagtaacaaattttaactacagacgtgcttgcttggtacacaatgagcttttggaaaaggagtttacagaaaagcgaagagaactgaagtttgatggtcgtttagataaggaactttcagaatcctatgcatttctgatggttgatcgataccaggtgagttaacgcattttataaaaaacaatttggggatgtttccattgtaagttactaattttgtgattattcaacagtattctttacaattacagacttttttgatatataagtggaatacatgatttaatggggcaaaatgtttattgtttgtaatttgtttttcaaatgtactcagttttttctctgaccagtcctattttcttcccctagaatgtgcttgataataatacttttctgtttattta

SEQ ID NO: 278000 - DNA, 7539 bp, Homo sapiens
aatgactgttaatttctttgcctcctctttgattccatctcttgacctctatatcatttcaaaggagcattgagtgaacatccatccttgtaccttgaatattccatgaatgctcctgcttcagggcctctgcatttgctgttctctcactttccccagtaagctgcataattcattctacatttcttcacgtatttccttatgattgaggtttctctgtttttttttttacctctatactcttatgtctctttttatagcactgaaaaccatcatgatctgttatatatcattgttttctgtcttcctcattagatttatgtaggttggaactttgttctgtttatctctataatcctattacctagaactgtgcctggtaaataagagcttagtatgtatttactgaatgatgaattaatatatttatatattgaggctgtgtcttctaatgtcagcaaaataattgacaagagactttggtggacactgttctctcttggttaatatttttggaaaaaacaactcccttaaatttgggtaaatgtggtaatttgagcgaagtaagtacttctgttttctctaagtagacttggatttactagactttgtaatgagtaatttctttgttcttcctacctggaggaaggacttaactgtagtatgccattaaaaattgcacttatatcatcttacatgttaatttttatgattatactaatgagtaatgtttttcttttcttttaaaaaatttgtagatctaacagctttaatacagatagaaacatagataaatataactataccttgtggaaaggacagcttttaaataaaggaaaacttttgtgttatatttctctgaggtcagccactcgtgcttttttgcctatcaaactacctgagaaattagatgttgaaacagttatgagtattgatcatctgaaacagaaaatccctccagcactgttttataaggaaacatacttaggtccaaatgaagttttgaagaatggaatgtattgcagcctttatgaagttgtggaaaagacaagaattggaagtaacatggagagtttactgcaaaaactagacagagaaaaacttgttcttgttaaacctttgggagaccgaggatacctttttcttctctccccttatcagatggttcctccatatgaatatcagactgccaagtctcgagtcctacatgctttgtttctatttcaagaacctagaagcatagttacttcacaaaaaggttcaaccaatgcagcaccacaggagaggcatgagagcatgccagatgtattaaaaatagctcagtttttacaattttctttgattcagtgtcgaaaggaattcaaaaatataagcgccataaattttcattctgttgttgaaaagtatgtaagtgaattttttaagcgaggttttggttcaggtaaacgagagtttattatgtttccatatgattcacgattagatgataaaaaattcttatactcagctcccagaaataaatcccatattgatacttgtttgcatgcctatatttttcggcctgaagtgtatcagttacctatttgtaaattaaaagaactatttgaagaaaatagaaaacttcagcagtttagtccactttcagattatgaaggtcaagaagaagaaatgaatggtacaaaaatgaaatttggaaaacgaaataactcaagaggtgaagccattatatctggaaagcaaagatcatctcattctttggattatgataaggatagagtcaaagaattgattaatttaattcagtgtaggaaaaagagtgtgggtggggactcagacacagaagatatgagaagcaaaactgtcttgaagaggaagcttgaggatctacctgaaaatatgagaaagctcgccaaaaccagtaatttatctgaaaattgccatctgtatgaagagtctccacagcctattggctcacttggacatgatgctgacttgaggcggcagcagcaggatacctgtaactccggcattgctgacatccataggctgtttaattggttatcagaaacactagcaaatgcgcgccattctgatgcatctctgacagacacagtcaacaaagccttaggattgagcactgatgatgcctatgaagagctgaggcaaaaacatgagtatgagttgaactctaccccagataagaaagactatgagcagcctacttgtgcaaaagttgaaaatgcacagtttaagggtactcagagcttattactagaagttgatgcaacatctaagtattctgttgctatttctaccagcgaagtgggcactgaccataagctacatttgaaagaagatccaaatttaattagcgtgaataattttgaagattgcagtttgtgtcccagtgttcccattgaacatggatttcgtagacaacagtctaagtcaaataatgttgaagagactgaaatacattggaaactgattccaattacaggagggaatgcaagaagcccagaagaccagctggggaaacatggtgagaaacaaacaccagacacactaaagggcaccactgaggatgacgtgttgacaggtcaggtggaggagcagtgtgtgccagcagcagaggcagagccgcctgcagtgagcgaaaccacagagaggacagtgttaggagagtacaatctcttttctaggaagatagaagagattttgaagcaaaagaatgtttcatatgtcagtagagtttccacacctatcttttcaacacaagagaagatgaaacggctttccgagttcatatattctaagacttccaaagctggtgtgcaggagtttgtagatggtttgcatgagaagctaaatactattattattaaagcatcagccaagggtgggaatttgccaccagtcagtcctaacgattctggtgctaagatagcatcgaatcctctggaaaggcatgtcataccagtttcctcaagtgacttcaacaataaacatctccttgagccactgtgtagtgatcctttgaaagataccaactctgatgagcagcattccacttcggctttaactgaagtagaaatgaaccagcctcaacatgccacagagttaatggtgacttctgatcatattgtacctggtgatatggcccgggaaccagtagaagaaacaacaaaatcccccagtgatgtaaacatttctgctcaaccagctctttcaaattttataagccagttagaacctgaagtatttaatagtttggttaaaatcatgaaagacgtccagaaaaatactgtgaaattttatattcatgaagaagaagagagtgtgctctgtaaagaaataaaggaatatcttatcaaattaggcaatacagaatgtcatcctgaacagtttttggaaagaagatcaaaattagataaactattgattattattcaaaatgaagacattgcaggtttcattcacaagatacctggcttggtgactttaaagaagctcccctgtgttagttttgctggtgttgatagcctggatgatgttaaaaatcatacatacaatgaattatttgtatctggaggttttatcgtatctgatgaatcaattctaaacccagaggttgtcacagttgagaaccttaaaaattttttgacattccttgaggaacttagtactccagaaggaaaatggcaatggaaagtccactgtaaatttcagaagaaactaaaggaactaggcagattgaatgctaaagctctaagtctgttgacgcttctgaatgtctatcagaagaaacatctggttgaaattttgtcataccacaattgtgattcacaaactcgaaatgctccagaattggattgccttatcagacttcaggctcagaacatacagcaacgacacatagtctttttaacagagaagaacatcaagatgctttccagttatacagataatggaatagtggttgcaactgctgaagacttcatgcaaaactttaaaaatcttgtgggctatcacaattcaatcacagaagaaaaccttccacagcttggtgctaatgagaatcttgagtcgcagtcagctcttttagaaaacgatgaaaaggatgaagaggatatgtctctggattcaggggatgaaatctcacatatagaagtatgcagcaattttcattcagaaatatgggagaaagagaccaaaggatcacgtggaacagatcaaaaaaagaatactcaaattgagttgcaatcgtctcctgatgtgcaaaacagtttattagaagataagacttaccttgattctgaagagagaacttctattgatatagtatgctctgaaggagagaacagcaattcaacagaacaagattcatatagtaactttcaggtttatcatagtcaattaaatatgtcccatcagtttagtcattttaatgttctcactcatcagacatttttggggacaccatatgccctttcatcaagtcagtctcaagaaaatgagaattacttcttatctgcttatactgaaagcttggatagagataaatctccacctcccttaagttgggggaaaagtgattcttccaggccatattcacaagagaaataactgtagtaactttttttttaagagattgttgtggactttgtttattaacaatttatatttcattctctaaacaaaaggttcttgttctttctcaaatgttttttcttttatttaaatcatgatggcctgtaacagttgaagcatctaaaaattgaaataaatatatatttttaacatatattgtacttgaattatctcatgttggcacttctaagttttactttttgtatgttacctgtacttaggcttcaaattgaagcctgttttatgtgtaaaatcagatgcttgcaggaggacggtaaacagcaaaggctttacttctttttctctaatgtcacctgatataaagtacttttgttgaagtgaattattttgatgtaggcttttgtatactgtgtttacacaggtataagtcagtaatagcagtgttaatatttacaggattttggctcgatacctcaagatttatctaacagtgcagtttcatttagataataaactatgtacataggacacattttttatctctaggcttagtcatgtaaaaactgcctattgctaaaattctggtaactttttgagagtattggataattttcagtacctgcgcaatccttgatttaatgaaattaaattttttatttcaaaagataggcttctgtttatcaaaggcgttgaacaatttgatttttaaattagttttagcaaaatggaagtataatgggaatatatttttgaggtggtcttagtagtaattaccatttgttgaacacattaatgctatactagacagatacagtggagatagctttcaaacccgtatctattcctaactactgcctctaatactaattactaacttgttactaatgctaacttttaaaaatgtttttgaaaattgcaatttctacaaataaatgtcatagtgcaaataaatgtcaggatttagagaaggagcctaaactgaatttgtgttatttcagtaaaagttatggagttatgggtctagacgtgttaataagttagacagaactttggcactttagaacaaatgcatgagtggtatttcagttcctaagttacataaaaagtgtgaaagaacactgtgaggtcccagcaacgccagactatattaaggtaagtagaaagtgtttttatagggcttcaatacccaggtggtgacagagcagaagaaccggtttttttttttttttttttactactaagcttttacaaaagaagtatctgttttattgtatagaacaagtacagcattttactacatagtatacaagtttttaatgagcatttaaaaaaataagtaaatctaggctatttgaaaaatacagttgagccagtgagcacattttataatttggaagacacaaatcaaatgtgaaggatttgattttctacatttaaaatgaagaaccaaaactctcttcttgattttcagctaaaggcaggagactactttccaactccttttgcttctggagaaggccctgaaatcacattgatatatgtttgttagtaaaatgtgcacacctgacttgcaatgttgtgttaaactagaattatattcacttggaaaacatatcgcttaggataaaattttgtcattcaaaaattttttcagaaatgcttgtactagaccacctcatttggatatatagctatcacatttgtaagattctgtttttagcataaaaatcaatagggatgaaaattttcttagaactcaagactccataactatgggggtaaatgaagtcatcccttctcccccagtccacccccaagtgctcttagatactgaaggagtctcccttaacatacagtgttttttttttgttgttgtttttttgtttttttttggagatggagtctcgctctgtcgcccaagctggagtacagtggtgcaatctcactgcaagctctgcctcccaggttcacaccattctcctgcctcaacctcccgaatggctgggactacaggcacccaccaccacgcctggctaactaactaactaactttttgtatttttagtagagacagggtttcactgtgttagccaggatggtcttgatctcctgacctcatgatctgcctgcctcagcctcccaaagtgctgggattacaggcttgagccactgctcctggccaacatccagtattttatcttgactgtcctaaccttaccttagatgctaacagaagggtcctgctgaaataacactgggtgctatattgatgggtaaatgtgtacatcctattccttcctctttatctcacaatttttgtctccactaagcaagaagtaaactaacacttcgtcactctaaagaaataacttatgtaaaactcttagtaaccctgtttgtcttcaaatgagtaaatagaccaaagtggggggacaattttctagttctgtagagggaaaaacatctgagtcaacattttgaaatgcagagggtattggtacatgacgacatggaaaagggcacttttaaacacagcttactcttcctcaagtacagagagtatatagtgaatcaaaactaactacagccattctttttaaagcccaagggatggagcaaaggtgtaaggatgttacctgtttgttttaatcagagagcaaaaagaagtcacaatagtttgggagaaaaagtagtatggtgagtaaggttatgcgtataatttcatactgaatttattactatttgggatgtacgtcaatgttctaacaaacactgccaacacgtcaattttttaaaaagcgtgggccacattgctaagaatttgttaaagcataactgtattttttgttttagggccttattgatgttttgccgttccaatgtatgcatttttttactcaataaacttgtcttaattttaaaaaagtc

SEQ ID NO: 278001 - DNA, 7304 bp, Homo sapiens
aatgactgttaatttctttgcctcctctttgattccatctcttgacctctatatcatttcaaaggagcattgagtgaacatccatccttgtaccttgaatattccatgaatgctcctgcttcagggcctctgcatttgctgttctctcactttccccagtaagctgcataattcattctacatttcttcacgtatttccttatgattgaggtttctctgtttttttttttacctctatactcttatgtctctttttatagcactgaaaaccatcatgatctgttatatatcattgttttctgtcttcctcattagatttatgtaggttggaactttgttctgtttatctctataatcctattacctagaactgtgcctggtaaataagagcttagtatgtatttactgaatgatgaattaatatatttatatattgaggctgtgtcttctaatgtcagcaaaataattgacaagagactttggtggacactgttctctcttggttaatatttttggaaaaaacaactcccttaaatttgggtaaatgtggtaatttgagcgaagtaagtacttctgttttctctaagtagacttggatttactagactttgtaatgagtaatttctttgttcttcctacctggaggaaggacttaactgtagtatgccattaaaaattgcacttatatcatcttacatgttaatttttatgattatactaatgagtaatgtttttcttttcttttaaaaaatttgtagatctaacagctttaatacagatagaaacatagataaatataactataccttgtggaaaggacagcttttaaataaaggaaaacttttgtgttatatttctctgaggtcagccactcgtgcttttttgcctatcaaactacctgagaaattagatgttgaaacagttatgagtattgatcatctgaaacagaaaatccctccagcactgttttataaggaaacatacttaggtccaaatgaagttttgaagaatggaatgtattgcagcctttatgaagttgtggaaaagacaagaattggaagtaacatggagagtttactgcaaaaactagacagagaaaaacttgttcttgttaaacctttgggagaccgaggatacctttttcttctctccccttatcagatggttcctccatatgaatatcagactgccaagtctcgagtcctacatgctttgtttctatttcaagaacctagaagcatagttacttcacaaaaaggttcaaccaatgcagcaccacaggagaggcatgagagcatgccagatgtattaaaaatagctcagtttttacaattttctttgattcagtgtcgaaaggaattcaaaaatataagcgccataaattttcattctgttgttgaaaagtatgtaagtgaattttttaagcgaggttttggttcaggtaaacgagagtttattatgtttccatatgattcacgattagatgataaaaaattcttatactcagctcccagaaataaatcccatattgatacttgtttgcatgcctatatttttcggcctgaagtgtatcagttacctatttgtaaattaaaagaactatttgaagaaaatagaaaacttcagcagtttagtccactttcagattatgaaggtcaagaagaagaaatgaatggtacaaaaatgaaatttggaaaacgaaataactcaagaggtgaagccattatatctggaaagcaaagatcatctcattctttggattatgataaggatagagtcaaagaattgattaatttaattcagtgtaggaaaaagagtgtgggtggggactcagacacagaagatatgagaagcaaaactgtcttgaagaggaagcttgaggatctacctgaaaatatgagaaagctcgccaaaaccagtaatttatctgaaaattgccatctgtatgaagagtctccacagcctattggctcacttggacatgatgctgacttgaggcggcagcagcaggatacctgtaactccggcattgctgacatccataggctgtttaattggttatcagaaacactagcaaatgcgcgccattctgatgcatctctgacagacacagtcaacaaagccttaggattgagcactgatgatgcctatgaagagctgaggcaaaaacatgagtatgagttgaactctaccccagataagaaagactatgagcagcctacttgtgcaaaagttgaaaatgcacagtttaagggtactcagagcttattactagaagttgatgcaacatctaagtattctgttgctatttctaccagcgaagtgggcactgaccataagctacatttgaaagaagatccaaatttaattagcgtgaataattttgaagattgcagtttgtgtcccagtgttcccattgaacatggatttcgtagacaacagtctaagtcaaataatgttgaagagactgaaatacattggaaactgattccaattacaggagggaatgcaagaagcccagaagaccagctggggaaacatggtgagaaacaaacaccagacacactaaagggcaccactgaggatgacgtgttgacaggtcaggtggaggagcagtgtgtgccagcagcagaggcagagccgcctgcagtgagcgaaaccacagagaggacagtgttaggagagtacaatctcttttctaggaagatagaagagattttgaagcaaaagaatgtttcatatgtcagtagagtttccacacctatcttttcaacacaagagaagatgaaacggctttccgagttcatatattctaagacttccaaagctggtgtgcaggagtttgtagatggtttgcatgagaagctaaatactattattattaaagcatcagccaagggtgggaatttgccaccagtcagtcctaacgattctggtgctaagatagcatcgaatcctctggaaaggcatgtcataccagtttcctcaagtgacttcaacaataaacatctccttgagccactgtgtagtgatcctttgaaagataccaactctgatgagcagcattccacttcggctttaactgaagtagaaatgaaccagcctcaacatgccacagagttaatggtgacttctgatcatattgtacctggtgatatggcccgggaaccagtagaagaaacaacaaaatcccccagtgatgtaaacatttctgctcaaccagctctttcaaattttataagccagttagaacctgaagtatttaatagtttggttaaaatcatgaaagacgtccagaaaaatactgtgaaattttatattcatgaagaagaagagagtgtgctctgtaaagaaataaaggaatatcttatcaaattaggcaatacagaatgtcatcctgaacagtttttggaaagaagatcaaaattagataaactattgattattattcaaaatgaagacattgcaggtttcattcacaagatacctggcttggtgactttaaagaagctcccctgtgttagttttgctggtgttgatagcctggatgatgttaaaaatcatacatacaatgaattatttgtatctggaggttttatcgtatctgatgaatcaattctaaacccagaggttgtcacagttgagaaccttaaaaattttttgacattccttgaggaacttagtactccagaaggaaaatggcaatggaaagtccactgtaaatttcagaagaaactaaaggaactaggcagattgaatgctaaagctctaagtctgttgacgcttctgaatgtctatcagaagaaacatctggttgaaattttgtcataccacaattgtgattcacaaactcgaaatgctccagaattggattgccttatcagacttcaggctcagaacatacagcaacgacacatagtctttttaacagagaagaacatcaagatgctttccagttatacagataatggaatagtggttgcaactgctgaagacttcatgcaaaactttaaaaatcttgtgggctatcacaattcaatcacagaagaaaaccttccacagcttggtgctaatgagaatcttgagtcgcagtcagctcttttagaaaacgatgaaaaggatgaagaggatatgtctctggattcaggggatgaaatctcacatatagaagtatgcagcaattttcattcagaaatatgggagaaagagaccaaaggatcacgtggaacagatcaaaaaaagaatactcaaattgagttgcaatcgtctcctgatgtgcaaaacagtttattagaagataagacttaccttgattctgaagagagaacttctattgatatagtatgctctgaaggagagaacagcaattcaacagaacaagattcatatagtaactttcaggtttatcatagtcaattaaatatgtcccatcagtttagtcattttaatgttctcactcatcagacatttttggggacaccatatgccctttcatcaagtcagtctcaagaaaatgagaattacttcttatctgcttatactgaaagcttggatagagataaatctccacctcccttaagttgggggaaaagtgattcttccaggccatattcacaagagaaataactgtagtaactttttttttaagagattgttgtggactttgtttattaacaatttatatttcattctctaaacaaaaggttcttgttctttctcaaatgttttttcttttatttaaatcatgatggcctgtaacagttgaagcatctaaaaattgaaataaatatatatttttaacatatattgtacttgaattatctcatgttggcacttctaagttttactttttgtatgttacctgtacttaggcttcaaattgaagcctgttttatgtgtaaaatcagatgcttgcaggaggacggtaaacagcaaaggctttacttctttttctctaatgtcacctgatataaagtacttttgttgaagtgaattattttgatgtaggcttttgtatactgtgtttacacaggtataagtcagtaatagcagtgttaatatttacaggattttggctcgatacctcaagatttatctaacagtgcagtttcatttagataataaactatgtacataggacacattttttatctctaggcttagtcatgtaaaaactgcctattgctaaaattctggtaactttttgagagtattggataattttcagtacctgcgcaatccttgatttaatgaaattaaattttttatttcaaaagataggcttctgtttatcaaaggcgttgaacaatttgatttttaaattagttttagcaaaatggaagtataatgggaatatatttttgaggtggtcttagtagtaattaccatttgttgaacacattaatgctatactagacagatacagtggagatagctttcaaacccgtatctattcctaactactgcctctaatactaattactaacttgttactaatgctaacttttaaaaatgtttttgaaaattgcaatttctacaaataaatgtcatagtgcaaataaatgtcaggatttagagaaggagcctaaactgaatttgtgttatttcagtaaaagttatggagttatgggtctagacgtgttaataagttagacagaactttggcactttagaacaaatgcatgagtggtatttcagttcctaagttacataaaaagtgtgaaagaacactgtgaggtcccagcaacgccagactatattaaggtaagtagaaagtgtttttatagggcttcaatacccaggtggtgacagagcagaagaaccggtttttttttttttttttttactactaagcttttacaaaagaagtatctgttttattgtatagaacaagtacagcattttactacatagtatacaagtttttaatgagcatttaaaaaaataagtaaatctaggctatttgaaaaatacagttgagccagtgagcacattttataatttggaagacacaaatcaaatgtgaaggatttgattttctacatttaaaatgaagaaccaaaactctcttcttgattttcagctaaaggcaggagactactttccaactccttttgcttctggagaaggccctgaaatcacattgatatatgtttgttagtaaaatgtgcacacctgacttgcaatgttgtgttaaactagaattatattcacttggaaaacatatcgcttaggataaaattttgtcattcaaaaattttttcagaaatgcttgtactagaccacctcatttggatatatagctatcacatttgtaagattctgtttttagcataaaaatcaatagggatgaaaattttcttagaactcaagactccataactatgggggtaaatgaagtcatcccttctcccccagtccacccccaagtgctcttagatactgaaggagtctcccttaacatacagtgttttttttttgttgttgtttttttgtttttttttggagatggagtctcgctctgtcgcccaagctggagtacagtggtgcaatctcactgcaagctctgcctcccaggttcacaccattctcctgcctcaacctcccgaatggctgggactacaggcacccaccaccacgcctggctaactaactaactaactttttgtatttttagtagagacagggtttcactgtgttagccaggatggtcttgatctcctgacctcatgatctgcctgcctcagcctcccaaagtgctgggattacaggcttgagccactgctcctggccaacatccagtattttatcttgactgtcctaaccttaccttagatgctaacagaagggtcctgctgaaataacactgggtgctatattgatgggtaaatgtgtacatcctattccttcctctttatctcacaatttttgtctccactaagcaagaagtaaactaacacttcgtcactctaaagaaataacttatgtaaaactcttagtaaccctgtttgtcttcaaatgagtaaatagaccaaagtggggggacaattttctagttctgtagagggaaaaacatctgagtcaacattttgaaatgcagagggtattggtacatgacgacatggaaaagggcacttttaaacacagcttactcttcctcaagtacagagagtatatagtgaatcaaaactaactacagccattctttttaaagcccaagggatggagcaaaggtgtaaggatgttacctgtttgttttaatcagagagcaaagacagcaaccaaaagagcaaagaccccaaaag

SEQ ID NO: 278002 - DNA, 8411 bp, Homo sapiens
cggctccgaggaccgggcagcgcatttggggtgcccgctacagggccccccaagaggctgccaggtcgggagcgcagcctgaggccacggggggaagggggtgggtgggctgagagcagctcggcggcgagactggcccgccgccccttccccccacacccgtcgaccttgtgggcagaagcttcccagagctccttaggccggcgcgatggcgactgctgtggagacggaggcctgtcagccgacggatgcgagttgggaaagtggcggcggcggagacgacgagatgaagcaggcgcttccggagcttgagtcctcccaacaaaatggcggcggcggcggcctcaacatcgctgagcccagcggcggcgctgggcgtgaggagaacgcgggggccgaggccgcccagagcctcagccacgagcagcctcaggactcctctgaggcgggcgcggccgccctgcccagaggccccgaagagcccgaaaggcctgttaggaggagttttcagatccccaggaagagcagagaaaagaaagcacttttccagccattaactccaggctctcgagaatttgaagatgttgtaaatattctccattcttcttaccttgaaccaacctcagtaacaaattttaactacagacgtgcttgcttggtacacaatgagcttttggaaaaggagtttacagaaaagcgaagagaactgaagtttgatggtcgtttagataaggaactttcagaatcctatgcatttctgatggttgatcgataccaggttcaaaccatatgtgaaaaaggattacatgtgggtcagtccaaaataacaattcttggcagtccttccatgggtgtctatctttctaggtatgctgatttattacaagcgaatcctttggacacgggggcaatgggtgatgttgttatttttaaaataatgaagggtaaaataaagagtatatatgaccccatgggtgtaaaaagtttggaatctatgttaaataagagtgctttggaccccacaccaaagcatgaatgtcacgtgtcaaagaatgccaatcgaattacatcacttttggcttacagagcctatgagcttactcagtattatttttatgagtatggctttgatgagctaaggcgaagaccaagacacgtttgtccatatgcagttgtgtcttttacttacaaagatgatatacaaactccgaagtttgtaccttcatcaagatctaacagctttaatacagatagaaacatagataaatataactataccttgtggaaaggacagcttttaaataaaggaaaacttttgtgttatatttctctgaggtcagccactcgtgcttttttgcctatcaaactacctgagaaattagatgttgaaacagttatgagtattgatcatctgaaacagaaaatccctccagcactgttttataaggaaacatacttaggtccaaatgaagttttgaagaatggaatgtattgcagcctttatgaagttgtggaaaagacaagaattggaagtaacatggagagtttactgcaaaaactagacagagaaaaacttgttcttgttaaacctttgggagaccgaggatacctttttcttctctccccttatcagatggttcctccatatgaatatcagactgccaagtctcgagtcctacatgctttgtttctatttcaagaacctagaagcatagttacttcacaaaaaggttcaaccaatgcagcaccacaggagaggcatgagagcatgccagatgtattaaaaatagctcagtttttacaattttctttgattcagtgtcgaaaggaattcaaaaatataagcgccataaattttcattctgttgttgaaaagtatgtaagtgaattttttaagcgaggttttggttcaggtaaacgagagtttattatgtttccatatgattcacgattagatgataaaaaattcttatactcagctcccagaaataaatcccatattgatacttgtttgcatgcctatatttttcggcctgaagtgtatcagttacctatttgtaaattaaaagaactatttgaagaaaatagaaaacttcagcagtttagtccactttcagattatgaaggtcaagaagaagaaatgaatggtacaaaaatgaaatttggaaaacgaaataactcaagaggtgaagccattatatctggaaagcaaagatcatctcattctttggattatgataaggatagagtcaaagaattgattaatttaattcagtgtaggaaaaagagtgtgggtggggactcagacacagaagatatgagaagcaaaactgtcttgaagaggaagcttgaggatctacctgaaaatatgagaaagctcgccaaaaccagtaatttatctgaaaattgccatctgtatgaagagtctccacagcctattggctcacttggacatgatgctgacttgaggcggcagcagcaggatacctgtaactccggcattgctgacatccataggctgtttaattggttatcagaaacactagcaaatgcgcgccattctgatgcatctctgacagacacagtcaacaaagccttaggattgagcactgatgatgcctatgaagagctgaggcaaaaacatgagtatgagttgaactctaccccagataagaaagactatgagcagcctacttgtgcaaaagttgaaaatgcacagtttaagggtactcagagcttattactagaagttgatgcaacatctaagtattctgttgctatttctaccagcgaagtgggcactgaccataagctacatttgaaagaagatccaaatttaattagcgtgaataattttgaagattgcagtttgtgtcccagtgttcccattgaacatggatttcgtagacaacagtctaagtcaaataatgttgaagagactgaaatacattggaaactgattccaattacaggagggaatgcaagaagcccagaagaccagctggggaaacatggtgagaaacaaacaccaggtatgaaatcaccagaagaacaactggtgtgtgtgccaccacaggaggcctttcctaacgacccccgggtaataaatagacagagaagttctgattaccagtttccatcctctccatttacagacacactaaagggcaccactgaggatgacgtgttgacaggtcaggtggaggagcagtgtgtgccagcagcagaggcagagccgcctgcagtgagcgaaaccacagagaggacagtgttaggagagtacaatctcttttctaggaagatagaagagattttgaagcaaaagaatgtttcatatgtcagtagagtttccacacctatcttttcaacacaagagaagatgaaacggctttccgagttcatatattctaagacttccaaagctggtgtgcaggagtttgtagatggtttgcatgagaagctaaatactattattattaaagcatcagccaagggtgggaatttgccaccagtcagtcctaacgattctggtgctaagatagcatcgaatcctctggaaaggcatgtcataccagtttcctcaagtgacttcaacaataaacatctccttgagccactgtgtagtgatcctttgaaagataccaactctgatgagcagcattccacttcggctttaactgaagtagaaatgaaccagcctcaacatgccacagagttaatggtgacttctgatcatattgtacctggtgatatggcccgggaaccagtagaagaaacaacaaaatcccccagtgatgtaaacatttctgctcaaccagctctttcaaattttataagccagttagaacctgaagtatttaatagtttggttaaaatcatgaaagacgtccagaaaaatactgtgaaattttatattcatgaagaagaagagagtgtgctctgtaaagaaataaaggaatatcttatcaaattaggcaatacagaatgtcatcctgaacagtttttggaaagaagatcaaaattagataaactattgattattattcaaaatgaagacattgcaggtttcattcacaagatacctggcttggtgactttaaagaagctcccctgtgttagttttgctggtgttgatagcctggatgatgttaaaaatcatacatacaatgaattatttgtatctggaggttttatcgtatctgatgaatcaattctaaacccagaggttgtcacagttgagaaccttaaaaattttttgacattccttgaggaacttagtactccagaaggaaaatggcaatggaaagtccactgtaaatttcagaagaaactaaaggaactaggcagattgaatgctaaagctctaagtctgttgacgcttctgaatgtctatcagaagaaacatctggttgaaattttgtcataccacaattgtgattcacaaactcgaaatgctccagaattggattgccttatcagacttcaggctcagaacatacagcaacgacacatagtctttttaacagagaagaacatcaagatgctttccagttatacagataatggaatagtggttgcaactgctgaagacttcatgcaaaactttaaaaatcttgtgggctatcacaattcaatcacagaagaaaaccttccacagcttggtgctaatgagaatcttgagtcgcagtcagatgctgttttgacattaacccctttggagctgggagttgggatttcccaacattaaacgtgaacacatttcgcagaagcttttagcatcggattatctggacattcacatctagtgtgagtgttgtgactaagtgaacttgtggcagaagaccaagctttaagggattgtggacttgcagaccctgacgcgttatattgtgtgagtagtgtataattttaaaacttaaacaaactgtgtatttcaatagaggaggactttttgttttttaaatgtagctcttttagaaaacgatgaaaaggatgaagaggatatgtctctggattcaggggatgaaatctcacatatagaagtatgcagcaattttcattcagaaatatgggagaaagagaccaaaggatcacgtggaacagatcaaaaaaagaatactcaaattgagttgcaatcgtctcctgatgtgcaaaacagtttattagaagataagacttaccttgattctgaagagagaacttctattgatatagtatgctctgaaggagagaacagcaattcaacagaacaagattcatatagtaactttcaggtttatcatagtcaattaaatatgtcccatcagtttagtcattttaatgttctcactcatcagacatttttggggacaccatatgccctttcatcaagtcagtctcaagaaaatgagaattacttcttatctgcttatactgaaagcttggatagagataaatctccacctcccttaagttgggggaaaagtgattcttccaggccatattcacaagagaaataactgtagtaactttttttttaagagattgttgtggactttgtttattaacaatttatatttcattctctaaacaaaaggttcttgttctttctcaaatgttttttcttttatttaaatcatgatggcctgtaacagttgaagcatctaaaaattgaaataaatatatatttttaacatatattgtacttgaattatctcatgttggcacttctaagttttactttttgtatgttacctgtacttaggcttcaaattgaagcctgttttatgtgtaaaatcagatgcttgcaggaggacggtaaacagcaaaggctttacttctttttctctaatgtcacctgatataaagtacttttgttgaagtgaattattttgatgtaggcttttgtatactgtgtttacacaggtataagtcagtaatagcagtgttaatatttacaggattttggctcgatacctcaagatttatctaacagtgcagtttcatttagataataaactatgtacataggacacattttttatctctaggcttagtcatgtaaaaactgcctattgctaaaattctggtaactttttgagagtattggataattttcagtacctgcgcaatccttgatttaatgaaattaaattttttatttcaaaagataggcttctgtttatcaaaggcgttgaacaatttgatttttaaattagttttagcaaaatggaagtataatgggaatatatttttgaggtggtcttagtagtaattaccatttgttgaacacattaatgctatactagacagatacagtggagatagctttcaaacccgtatctattcctaactactgcctctaatactaattactaacttgttactaatgctaacttttaaaaatgtttttgaaaattgcaatttctacaaataaatgtcatagtgcaaataaatgtcaggatttagagaaggagcctaaactgaatttgtgttatttcagtaaaagttatggagttatgggtctagacgtgttaataagttagacagaactttggcactttagaacaaatgcatgagtggtatttcagttcctaagttacataaaaagtgtgaaagaacactgtgaggtcccagcaacgccagactatattaaggtaagtagaaagtgtttttatagggcttcaatacccaggtggtgacagagcagaagaaccggtttttttttttttttttttactactaagcttttacaaaagaagtatctgttttattgtatagaacaagtacagcattttactacatagtatacaagtttttaatgagcatttaaaaaaataagtaaatctaggctatttgaaaaatacagttgagccagtgagcacattttataatttggaagacacaaatcaaatgtgaaggatttgattttctacatttaaaatgaagaaccaaaactctcttcttgattttcagctaaaggcaggagactactttccaactccttttgcttctggagaaggccctgaaatcacattgatatatgtttgttagtaaaatgtgcacacctgacttgcaatgttgtgttaaactagaattatattcacttggaaaacatatcgcttaggataaaattttgtcattcaaaaattttttcagaaatgcttgtactagaccacctcatttggatatatagctatcacatttgtaagattctgtttttagcataaaaatcaatagggatgaaaattttcttagaactcaagactccataactatgggggtaaatgaagtcatcccttctcccccagtccacccccaagtgctcttagatactgaaggagtctcccttaacatacagtgttttttttttgttgttgtttttttgtttttttttggagatggagtctcgctctgtcgcccaagctggagtacagtggtgcaatctcactgcaagctctgcctcccaggttcacaccattctcctgcctcaacctcccgaatggctgggactacaggcacccaccaccacgcctggctaactaactaactaactttttgtatttttagtagagacagggtttcactgtgttagccaggatggtcttgatctcctgacctcatgatctgcctgcctcagcctcccaaagtgctgggattacaggcttgagccactgctcctggccaacatccagtattttatcttgactgtcctaaccttaccttagatgctaacagaagggtcctgctgaaataacactgggtgctatattgatgggtaaatgtgtacatcctattccttcctctttatctcacaatttttgtctccactaagcaagaagtaaactaacacttcgtcactctaaagaaataacttatgtaaaactcttagtaaccctgtttgtcttcaaatgagtaaatagaccaaagtggggggacaattttctagttctgtagagggaaaaacatctgagtcaacattttgaaatgcagagggtattggtacatgacgacatggaaaagggcacttttaaacacagcttactcttcctcaagtacagagagtatatagtgaatcaaaactaactacagccattctttttaaagcccaagggatggagcaaaggtgtaaggatgttacctgtttgttttaatcagagagcaaaaagaagtcacaatagtttgggagaaaaagtagtatggtgagtaaggttatgcgtataatttcatactgaatttattactatttgggatgtacgtcaatgttctaacaaacactgccaacacgtcaattttttaaaaagcgtgggccacattgctaagaatttgttaaagcataactgtattttttgttttagggccttattgatgttttgccgttccaatgtatgcatttttttactcaataaacttgtcttaattttaaaaaagtc

SEQ ID NO: 278003 - DNA, 5083 bp, Homo sapiens
cggctccgaggaccgggcagcgcatttggggtgcccgctacagggccccccaagaggctgccaggtcgggagcgcagcctgaggccacggggggaagggggtgggtgggctgagagcagctcggcggcgagactggcccgccgccccttccccccacacccgtcgaccttgtgggcagaagcttcccagagctccttaggccggcgcgatggcgactgctgtggagacggaggcctgtcagccgacggatgcgagttgggaaagtggcggcggcggagacgacgagatgaagcaggcgcttccggagcttgagtcctcccaacaaaatggcggcggcggcggcctcaacatcgctgagcccagcggcggcgctgggcgtgaggagaacgcgggggccgaggccgcccagagcctcagccacgagcagcctcaggactcctctgaggcgggcgcggccgccctgcccagaggccccgaagagcccgaaaggcctgttaggaggagttttcagatccccaggaagagcagagaaaagaaagcacttttccagccattaactccaggctctcgagaatttgaagatgttgtaaatattctccattcttcttaccttgaaccaacctcagtaacaaattttaactacagacgtgcttgcttggtacacaatgagcttttggaaaaggagtttacagaaaagcgaagagaactgaagtttgatggtcgtttagataaggaactttcagaatcctatgcatttctgatggttgatcgataccaggttcaaaccatatgtgaaaaaggattacatgtgggtcagtccaaaataacaattcttggcagtccttccatgggtgtctatctttctaggtatgctgatttattacaagcgaatcctttggacacgggggcaatgggtgatgttgttatttttaaaataatgaagggtaaaataaagagtatatatgaccccatgggtgtaaaaagtttggaatctatgttaaataagagtgctttggaccccacaccaaagcatgaatgtcacgtgtcaaagaatgccaatcgaattacatcacttttggcttacagagcctatgagcttactcagtattatttttatgagtatggctttgatgagctaaggcgaagaccaagacacgtttgtccatatgcagttgtgtcttttacttacaaagatgatatacaaactccgaagtttgtaccttcatcaagatctaacagctttaatacagatagaaacatagataaatataactataccttgtggaaaggacagcttttaaataaaggaaaacttttgtgttatatttctctgaggtcagccactcgtgcttttttgcctatcaaactacctgagaaattagatgttgaaacagttatgagtattgatcatctgaaacagaaaatccctccagcactgttttataaggaaacatacttaggtccaaatgaagttttgaagaatggaatgtattgcagcctttatgaagttgtggaaaagacaagaattggaagtaacatggagagtttactgcaaaaactagacagagaaaaacttgttcttgttaaacctttgggagaccgaggatacctttttcttctctccccttatcagatggttcctccatatgaatatcagactgccaagtctcgagtcctacatgctttgtttctatttcaagaacctagaagcatagttacttcacaaaaaggttcaaccaatgcagcaccacaggagaggcatgagagcatgccagatgtattaaaaatagctcagtttttacaattttctttgattcagtgtcgaaaggaattcaaaaatataagcgccataaattttcattctgttgttgaaaagtatgtaagtgaattttttaagcgaggttttggttcaggtaaacgagagtttattatgtttccatatgattcacgattagatgataaaaaattcttatactcagctcccagaaataaatcccatattgatacttgtttgcatgcctatatttttcggcctgaagtgtatcagttacctatttgtaaattaaaagaactatttgaagaaaatagaaaacttcagcagtttagtccactttcagattatgaaggtcaagaagaagaaatgaatggtacaaaaatgaaatttggaaaacgaaataactcaagaggtgaagccattatatctggaaagcaaagatcatctcattctttggattatgataaggatagagtcaaagaattgattaatttaattcagtgtaggaaaaagagtgtgggtggggactcagacacagaagatatgagaagcaaaactgtcttgaagaggaagcttgaggatctacctgaaaatatgagaaagctcgccaaaaccagtaatttatctgaaaattgccatctgtatgaagagtctccacagcctattggctcacttggacatgatgctgacttgaggcggcagcagcaggatacctgtaactccggcattgctgacatccataggctgtttaattggttatcagaaacactagcaaatgcgcgccattctgatgcatctctgacagacacagtcaacaaagccttaggattgagcactgatgatgcctatgaagagctgaggcaaaaacatgagtatgagttgaactctaccccagataagaaagactatgagcagcctacttgtgcaaaagttgaaaatgcacagtttaagggtactcagagcttattactagaagttgatgcaacatctaagtattctgttgctatttctaccagcgaagtgggcactgaccataagctacatttgaaagaagatccaaatttaattagcgtgaataattttgaagattgcagtttgtgtcccagtgttcccattgaacatggatttcgtagacaacagtctaagtcaaataatgttgaagagactgaaatacattggaaactgattccaattacaggagggaatgcaagaagcccagaagaccagctggggaaacatggtgagaaacaaacaccaggtatgaaatcaccagaagaacaactggtgtgtgtgccaccacaggaggcctttcctaacgacccccgggtaataaatagacagagaagttctgattaccagtttccatcctctccatttacagacacactaaagggcaccactgaggatgacgtgttgacaggtcaggtggaggagcagtgtgtgccagcagcagaggcagagccgcctgcagtgagcgaaaccacagagaggacagtgttaggagagtacaatctcttttctaggaagatagaagagattttgaagcaaaagaatgtttcatatgtcagtagagtttccacacctatcttttcaacacaagagaagatgaaacggctttccgagttcatatattctaagacttccaaagctggtgtgcaggagtttgtagatggtttgcatgagaagctaaatactattattattaaagcatcagccaagggtgggaatttgccaccagtcagtcctaacgattctggtgctaagatagcatcgaatcctctggaaaggcatgtcataccagtttcctcaagtgacttcaacaataaacatctccttgagccactgtgtagtgatcctttgaaagataccaactctgatgagcagcattccacttcggctttaactgaagtagaaatgaaccagcctcaacatgccacagagttaatggtgacttctgatcatattgtacctggtgatatggcccgggaaccagtagaagaaacaacaaaatcccccagtgatgtaaacatttctgctcaaccagctctttcaaattttataagccagttagaacctgaagtatttaatagtttggttaaaatcatgaaagacgtccagaaaaatactgtgaaattttatattcatgaagaagaagagagtgtgctctgtaaagaaataaaggaatatcttatcaaattaggcaatacagaatgtcatcctgaacagtttttggaaagaagatcaaaattagataaactattgattattattcaaaatgaagacattgcaggtttcattcacaagatacctggcttggtgactttaaagaagctcccctgtgttagttttgctggtgttgatagcctggatgatgttaaaaatcatacatacaatgaattatttgtatctggaggttttatcgtatctgatgaatcaattctaaacccagaggttgtcacagttgagaaccttaaaaattttttgacattccttgaggaacttagtactccagaaggaaaatggcaatggaaagtccactgtaaatttcagaagaaactaaaggaactaggcagattgaatgctaaagctctaagtctgttgacgcttctgaatgtctatcagaagaaacatctggttgaaattttgtcataccacaattgtgattcacaaactcgaaatgctccagaattggattgccttatcagacttcaggctcagaacatacagcaacgacacatagtctttttaacagagaagaacatcaagatgctttccagttatacagataatggaatagtggttgcaactgctgaagacttcatgcaaaactttaaaaatcttgtgggctatcacaattcaatcacagaagaaaaccttccacagcttggtgctaatgagaatcttgagtcgcagtcagatgctgttttgacattaacccctttggagctgggagttgggatttcccaacattaaacgtgaacacatttcgcagaagcttttagcatcggattatctggacattcacatctagtgtgagtgttgtgactaagtgaacttgtggcagaagaccaagctttaagggattgtggacttgcagaccctgacgcgttatattgtgtgagtagtgtataattttaaaacttaaacaaactgtgtatttcaatagaggaggactttttgttttttaaatgtagctcttttagaaaacgatgaaaaggatgaagaggatatgtctctggattcaggggatgaaatctcacatatagaagtatgcagcattcctcatcttgggagggatcctctgacccg

SEQ ID NO: 278004 - DNA, 1871 bp, Homo sapiens
cggctccgaggaccgggcagcgcatttggggtgcccgctacagggccccccaagaggctgccaggtcgggagcgcagcctgaggccacggggggaagggggtgggtgggctgagagcagctcggcggcgagactggcccgccgccccttccccccacacccgtcgaccttgtgggcagaagcttcccagagctccttaggccggcgcgatggcgactgctgtggagacggaggcctgtcagccgacggatgcgagttgggaaagtggcggcggcggagacgacgagatgaagcaggcgcttccggagcttgagtcctcccaacaaaatggcggcggcggcggcctcaacatcgctgagcccagcggcggcgctgggcgtgaggagaacgcgggggccgaggccgcccagagcctcagccacgagcagcctcaggactcctctgaggcgggcgcggccgccctgcccagaggccccgaagagcccgaaaggcctgttaggaggagttttcagatccccaggaagagcagagaaaagaaagcacttttccagccattaactccaggctctcgagaatttgaagatgttgtaaatattctccattcttcttaccttgaaccaacctcagtaacaaattttaactacagacgtgcttgcttggtacacaatgagcttttggaaaaggagtttacagaaaagcgaagagaactgaagtttgatggtcgtttagataaggaactttcagaatcctatgcatttctgatggttgatcgataccaggttcaaaccatatgtgaaaaaggattacatgtgggtcagtccaaaataacaattcttggcagtccttccatgggtgtctatctttctaggtatgctgatttattacaagcgaatcctttggacacgggggcaatgggtgatgttgttatttttaaaataatgaagggtaaaataaagagtatatatgaccccatgggtgtaaaaagtttggaatctatgttaaataagagtgctttggaccccacaccaaagcatgaatgtcacgtgtcaaagaatgccaatcgaattacatcacttttggcttacagagcctatgagcttactcagtattatttttatgagtatggctttgatgagctaaggcgaagaccaagacacgtttgtccatatgcagttgtgtcttttacttacaaagatgatatacaaactccgaagtttgtaccttcatcaagatctaacagctttaatacagatagaaacatagataaatataactataccttgtggaaaggacagcttttaaataaaggaaaacttttgtgttatatttctctgaggtcagccactcgtgcttttttgcctatcaaactacctgagaaattagatgttgaaacagttatgagtattgatcatctgaaacagaaaatccctccagcactgttttataaggaaacatacttaggtccaaatgaagttttgaagaatggaatgtattgcagcctttatgaagttgtggaaaagacaagaattggaagtaacatggagagtttactgcaaaaactagacagagaaaaacttgttcttgttaaacctttgggagaccgaggatacctttttcttctctccccttatcagatggttcctccatatgaatatcagactgccaagtctcgagtcctacatgctttgtttctatttcaagaacctagaagcatagttacttcacaaaaaggttcaaccaatgcagcaccacaggagaggcatgagagcatgccagatgtattaaaaatagctcagtttttacaattttctttgattcagtgtcgaaaggaattcaaaaatataagcgccataaattttcattctgttgttg

SEQ ID NO: 278005 - DNA, 2009 bp, Homo sapiens
  misc_feature (1989)..(1989): n is a, c, g, or t
cggctccgaggaccgggcagcgcatttggggtgcccgctacagggccccccaagaggctgccaggtcgggagcgcagcctgaggccacggggggaagggggtgggtgggctgagagcagctcggcggcgagactggcccgccgccccttccccccacacccgtcgaccttgtgggcagaagcttcccagagctccttaggccggcgcgatggcgactgctgtggagacggaggcctgtcagccgacggatgcgagttgggaaagtggcggcggcggagacgacgagatgaagcaggcgcttccggagcttgagtcctcccaacaaaatggcggcggcggcggcctcaacatcgctgagcccagcggcggcgctgggcgtgaggagaacgcgggggccgaggccgcccagagcctcagccacgagcagcctcaggactcctctgaggcgggcgcggccgccctgcccagaggccccgaagagcccgaaaggcctgttaggaggagttttcagatccccaggaagagcagagaaaagaaagcacttttccagccattaactccaggctctcgagaatttgaagatgttgtaaatattctccattcttcttaccttgaaccaacctcagtaacaaattttaactacagacgtgcttgcttggtacacaatgagcttttggaaaaggagtttacagaaaagcgaagagaactgaagtttgatggtcgtttagataaggaactttcagaatcctatgcatttctgatggttgatcgataccaggttcaaaccatatgtgaaaaaggattacatgtgggtcagtccaaaataacaattcttggcagtccttccatgggtgtctatctttctaggtatgctgatttattacaagcgaatcctttggacacgggggcaatgggtgatgttgttatttttaaaataatgaagggtaaaataaagagtatatatgaccccatgggtgtaaaaagtttggaatctatgttaaataagagtgctttggaccccacaccaaagcatgaatgtcacgtgtcaaagaatgccaatcgaattacatcacttttggcttacagagcctatgagcttactcagtattatttttatgagtatggctttgatgagctaaggcgaagaccaagacacgtttgtccatatgcagttgtgtcttttacttacaaagatgatatacaaactccgaagtttgtaccttcatcaagatctaacagctttaatacagatagaaacatagataaatataactataccttgtggaaaggacagcttttaaataaaggaaaacttttgtgttatatttctctgaggtcagccactcgtgcttttttgcctatcaaactacctgagaaattagatgttgaaacagttatgagtattgatcatctgaaacagaaaatccctccagcactgttttataaggaaacatacttaggtccaaatgaagttttgaagaatggaatgtattgcagcctttatgaagttgtggaaaagacaagaattggaagtaacatggagagtttactgcaaaaactagacagagaaaaacttgttcttgttaaacctttgggagaccgaggatacctttttcttctctccccttatcagatggttcctccatatgaatatcagactgccaagtctcgagtcctacatgctttgtttctatttcaagaacctagaagcatagttacttcacaaaaaggttcaaccaatgcagcaccacaggagaggcatgagagcatgccagatgtattaaaaatagctcagtttttacaattttctttgattcagtgtcgaaaggaattcaaaaatataagcgccataaattttcattctgttgttgaaaagtatgtaagtgaattttttaagcgaggttttggttcaggtaaacgagagtttattatgtttccatatgattcacgattagatgataaaaaattcttatactcagctcccacttnatattggtaacacctcgtcc

SEQ ID NO: 278006 - DNA, 1382 bp, Homo sapiens
cggctccgaggaccgggcagcgcatttggggtgcccgctacagggccccccaagaggctgccaggtcgggagcgcagcctgaggccacggggggaagggggtgggtgggctgagagcagctcggcggcgagactggcccgccgccccttccccccacacccgtcgaccttgtgggcagaagcttcccagagctccttaggccggcgcgatggcgactgctgtggagacggaggcctgtcagccgacggatgcgagttgggaaagtggcggcggcggagacgacgagatgaagcaggcgcttccggagcttgagtcctcccaacaaaatggcggcggcggcggcctcaacatcgctgagcccagcggcggcgctgggcgtgaggagaacgcgggggccgaggccgcccagagcctcagccacgagcagcctcaggactcctctgaggcgggcgcggccgccctgcccagaggccccgaagagcccgaaaggcctgttaggaggagttttcagatccccaggaagagcagagaaaagaaaggtggtgcctccccttcttctcaaccccctctctctctcccctccatcttttcattagaatctttctatctcctcttcccacacccatccgagatacgtaaacacgcatgcagcgccggccgcctctcccctcaccgccacggccgcccagctgccgcgtttggtgcgagagaaagcggtggaaccacgctcccctgctgcccctccccgcggaagttggaagtagctcaggtttgaagcttgtccgtaaggctgcagctcccagagaggaaagatggtgctcggcgcccctccctcccagcccctgaaagcagagaagccgttgtgtcctcctaaggatgcttctgagaagtctcgctatggaaatagcccgtggccatggattctggggctttctccaaggccattgccaatgttctgaggaccatgagtgcttctccccgtggaaattcttcagttctgtgtgtctacttgaaatgtgcttgatgtcagcgtcctcccttatttagaaatctctattagtagatgtgatccatgcacactgctgttttccatcacacttcatttccatgtagatttttcccccttgtttttgaagcgttagattaaataggtttttctctctttaaattcgaacttagtattgtttttcttatatttgaaaagaatggaaaggtaggttcttggagcagtaatttcccaatggaaaaaaactaatgagaagttaccttattctcaagagtcaccaacttggtcttctagatggtagaacttcaggttggtgactaatgagaagttaccttattctcagagtcaccacttggtcttctaccatctagaagac

SEQ ID NO: 278007 - DNA, 1248 bp, Homo sapiens
tttgacagatgaacttttccatacataatcttacatggaaccataatatatcatacagcacataaaacaaaaaggctgtggcagagaggatcccagagctccattagaacccctaaatggttgtgcaaaacatgagctgcacaactctgggaggtaccatgacctccatcataattttactttattttttaaagcttttcagtgaagattggaaaacctgctagacaaattctaaaagagctgtaacactcatagatttgtacagttattaacagggcagttgtccaatagagggtggtagtatcttgaaggaaaagggatgccttttggaaatttgctttaagcctctgtatgttgactggctacagggctgagccccattcactcaacatccccctgtcctgaagtcattgcttcccaacctattccctgtcacggtacctagaaaatgatgccttttttttttctcttttctttttcagatagagtcttcctctgtcgcctaggctggagtgcagtggcgcgatctcggcgcaccgcaacctctgcctcccgggttcaagcgaattctcctgcctcagcctccggagtagctgggattacagatgtgctccaccatgcccggctaatttttgtatttttagtagagatgggggggtttcaccatgttggccaggctggtctcgaactcctgaccttgtgatccactagcttcggcctcccgaagttctgggattacaggcatgagccaccacacccggatgaattatgccatttttaaggcaaagcagcggtgatggtgggtgatggagtgacatcaggagcgccagaaggaggaagtcagaaagcccttggggacaggaatgtccttgtgttgcaaacatttctggtcagggaaagatgaagaaaacagaatgagtttctgataacagtgttcccaacacttaatggttaaaagaagctttgaggaacaccatatttcagccctatggaacagtgaacaaaaaggaaaaagccagtaagactgatggttctgtataagatgtccacttctgcatgatctgctccagacaacaaatgaaatgctcttattattcctgtcccactcttgtctccctacaggctaacctcatctttcacaatccactattttcacaatcgagctttgagaagctgaacagtcagcaggctatcttgggaaaccaactataggtgttctaaattctttgtcaaaattaaccttttaca

SEQ ID NO: 278008 - DNA, 655 bp, Homo sapiens
attttatcacgtggatctcttaaggaactaccaaatctactaagggacctccaagaattttgtgacccatgaaaatctcctctcctagtcacaaggcataaatacataaaaatacatgatggcaaatttctgaatctgacatgacttctcccaaatacagctgtcttcagttcctttattattgcctctttgcagcagcggtgatggtgggtgatggagtgacatcaggagcgccagaaggaggaagtcagaaagcccttggggacaggaatgtccttgtgttgcaaacatttctggtcagggaaagatgaagaaaacagaatgagtttctgataacagtgttcccaacacttaatggttaaaagaagctttgaggaacaccatatttcagccctatggaacagtgaacaaaaaggaaaaagccagtaagactgatggttctgtataagatgtccacttctgcatgatctgctccagacaacaaatgaaatgctcttattattcctgtcccactcttgtctccctacaggctaacctcatctttcacaatccactattttcacaatcgagctttgagaagctgaacagtcagcaggctatcttgggaaaccaactataggtgttctaaattctttgtcaaaattaaccttttaca

SEQ ID NO: 278009 - DNA, 863 bp, Homo sapiens
cccccacccttaaccctaaccctcaagggatccaaaaatcttccggggctcccaaaagccctcccctgttctcagccccgttagcccctcccctcagagcagaacgcgtttgcgctctatgtccctccgcagcccctccacggtcctctctgcccccaaaggtacctccccacctccactttagtctcacccctaagtaccccgaagaaagccaatatttccttctctccgcagcgtcccagatattaaccgttctatctcaatggttttcagattttatcttgcctcttgggtaccctttgggacccttatgtcatccccaccatcagggcacccagacttaaccctaactgcaagtcccagactcactctggtccttattgatgagccaggtgtccctggagtcaagtggctcactgtcaccgatttcattccgagccaccactctgaagtagtacttcctgcctgggagcagccccgtcactgtgtacttgttgctgaagacacgctcggctgccgtgtaccaggtggctgtgcttgcatcccgcttcatgatgacgtagtgagcctcaccgtcctcctgcacatctgggctgtggttccagccatctgccaagtccgatggaagataagatggggcaagtctcaggcagctggtgtcttggagtcggaaaactatttctgaagtctgctctgccatttactagcctcgtgacctgggatgaggaaactgaagctcagagggaaagcagcttgcccaagatggtgggagagctgataataaagtgatactaatctactgcagatgctgagttccaggcaccacgctccaccacctgggcaggtggatgattgacatgggt

SEQ ID NO: 278010 - DNA, 1562 bp, Homo sapiens
actgaggtgccagggtctggtcacccctctctcctcctggggctggggcccagatcctggggacctgcaggagctggatcaggatggctgcagtgccagcctggggcagcaggtactgcctgaggaatttgcaagttcgtgtggggaggctggaaaaggatctccctagcagaactcgtggttcaggacaatgctgagagctaaaagagccagcctaatatcagactggagccagaagtagacatctccccacctctaccctatcaggactttcaaaacccccctggaaggtgatggtgctcagcttcttgacacccccccacccacttcccctaccaggtggaagagtctgactccatgtgttatgcctaggaccaatggcagtgctgggttcacccactcctcccctttttcatctgcacaaagttgagggaaacgggagaatctgtgctgagaagactcagacccaggagcccctttcacaggcccctagttgggaagactggatgagagtggagcctccgtttcttttccctcttctatccttgttacttgaacaatctcagtctctaagtggtgggtggggacatgaagaggtgtgggtccaggttaggcaggagagagaacttctttggtctcggagtttggggtctcaagaattcaagtagccccatctctctctcgggcaagcccaaagctcaggtcccatacgctacccttagatcctatccccagggctagggtgaaccatgccaaaggaaggggccagcttctctgtgtgtgtgtgtagcctgtctcctagtctgcctatgtctttctctgctatatgtttctgtcctgctgtctgtcaaaagtctcacagagagagggcctcagggagctgctgaggggtgctgagcctggctcagggagctgggacccctcccctccaacacacatactcacagtgctttcctccttgtccctcctacactaggagcaagaggagggggctccaatgacactccggggttttaagacccaaggcacattcaatgcaaggggagcaaggatgggacaactccatcttctgctgcccatgtgaaaaataataaaaatcaagagccattggcaaaaaaaaaaaacaaaaaaaaaaaaaaacaagaaacaacaacagaaaacacagaaaaaaaaaagaaccaaacgaacaagaaaaagacacaagaagagacaggaacagagcaaaaataaagaaggagggggagacgccagatgacaacaccaacaagagggcgcacgagcactggcgcaacaaccaaagaaaagaaggagagcgcacaacgaaagagaagcacagaaaagaagaaaggaagaaagagcaaatacaaacagcgcggagagagaaaaaatcgaagagaggagtaaataggagggaagacagaacaattgggggagggagataataataggaaaaaaaacagcgaaaaaaataaatgctgtggggtatttatataaagtgaggtatatgagagaaaaaacagatatagtaggagaaaaaatagggaagggattaagaaaaaatg

SEQ ID NO: 278011 - DNA, 894 bp, Homo sapiens
actgaggtgccagggtctggtcacccctctctcctcctggggctggggcccagatcctggggacctgcaggagctggatcaggatggctgcagtgccagcctggggcagcaggtactgcctgaggaatttgcaagttcgtgtggggaggctggaaaaggatctccctagcagaactcgtggttcaggacaatgctgagagctaaaagagccagcctaatatcagactggagccagaagtagacatctccccacctctaccctatcaggactttcaaaacccccctggaaggtgtccctggagtcaagtggctcactgtcaccgatttcattccgagccaccactctgaagtagtacttcctgcctgggagcagccccgtcactgtgtacttgttgctgaagacacgctcggctgccgtgtaccaggtggctgtgcttgcatcccgcttcatgatgacgtagtgagcctcaccgtcctcctgcacatctgggctgtggttccagccatctgccaagtccgatggaagataagatggggcaagtctcaggcagctggtgtcttggagtcggaaaactatttctgaagtctgctctgccatttactagcctcgtgacctggggccatacagacatctagctgccctgcaaccctgtgaagcatttatttgttttctcatctgtctccttctactagtacgcaagaccctggaaggttgaggcaatgctgacgactgatggctccacctggacctgctctccctccaccccacaagtcctgaggccccagtcagaagcaggctccctggactttgaattttcggggaattgatttgggtaataactctgtctcccatacagcatggctggccttgtgtccattaaactctttgttgca

SEQ ID NO: 278012 - DNA, 789 bp, Homo sapiens
aggagatggcacaactggtcacacagatgatatttgggggcaggccttcctccattgtcgaggagtttcctgccaggctgtcgcactaggggtctggtgaggggcagagtcagagtcagagtcagagactgtgatggctacaatagccatcttggttatgtggacagtgtatggaggtcagggtcagggacaactcacagagaaggctgcatggatgcagagggctgtcccagcgcgaaccaccatgtgactcttcagccgggcactgaggtcaaacttgggtgcagctgagatggaggagacagaggtggaggcatggatctgtctttcaagaagactctgctttaagcctcctcatcaaagccttcccaacctctcctcctttatgcccccactacaggccatacagacatctagctgccctgcaaccctgtgaagcatttatttgttttctcatctgtctccttctactagtacgcaagaccctggaaggcaagtccttgtgtcttgtttctataaccctaacacctccttttgaaattgccattgcaacaattataacagcgagaaaattatgacagtgaacgagatctgatctaaccaacccccatcttgcctttaccctccaaactgcccttaatcattcctggtttcagaccaagctaatgttgggagagacatttagtttatagcttagatgataacagtcttcccccaaactaaatcacctttgcgaagctaatgaaaggccaccaggttaggaggatgtgaggagcctgaattctgcta

SEQ ID NO: 278013 - DNA, 575 bp, Homo sapiens
agtcaagtggctcactgtcaccgatttcattccgagccaccactctgaagtagtacttcctgcctgggagcagccccgtcactgtgtacttgttgctgaagacacgctcggctgccgtgtaccaggtggctgtgcttgcatcccgcttcatgatgacgtagtgagcctcaccgtcctcctgcacatctgggctgtggttccaggtcagagtcactgtgttggggacttcctcaaacaaccgtaggtttgtggggggccgagggaaatctggaagagttggaagatctgtcagcgaccttggggcacctgaagtattatgtccccaccccagccatctgccaagtccgatggaagataagatggggcaagtctcaggcagctggtgtcttggagtcggaaaactatttctgaagtctgctctgccatttactagcctcgtgacctggggtaagttacttatctgagacttctttcctcaattgcaaaatagagctgacaatgactatttcgtagaaatagtgggtaaagagactggcatgtagttactgttcagtaaaaatgaatccattccttcc

SEQ ID NO: 278014 - DNA, 1749 bp, Homo sapiens
ccacagtggcgccggcagagcaggagtggctggaggagctgtggttggagcaggaggtggcacggcagggctggagggctccctatgagtggcggagacggcccaggaggcgctggagcaacagctcccacaccgcaccaagcggtggctgcaggagctcgcccatcgcccctgcgctgctcggaccgcggccacagccggactggcgggtacggcggcgacagacggattggccgagagtcccagtccgcagagtagccccggcctcgaggcggtggcgtcccggtcctctccgtccaggagccaggacaggtgtcgcgcggcggggctccagggaccgcgcctgaggccggctgcccgcccgtcccgccccgccccgccgcccgccgcccgccgagcccagcctccttgccgtcggggcgtccccaggccctgggtcggccgcggagccgatgcgcgcccgctgagcgccccagctgagcgcccccggcctgccatgaccgcgctccccggcccgctctggctcctgggcctggcgctatgcgcgctgggcgggggcggccccggcctgcgacccccgcccggctgtccccagcgacgtctgggcgcgcgcgagcgccgggacgtgcagcgcgagatcctggcggtgctcgggctgcctgggcggccccggccccgcgcgccacccgccgcctcccggctgcccgcgtccgcgccgctcttcatgctggacctgtaccacgccatggccggcgacgacgacgaggacggcgcgcccgcggagcggcgcctgggccgcgccgacctggtcatgagcttcgttaacatggtggagcgagaccgtgccctgggccaccaggagccccattggaaggagttccgctttgacctgacccagatcccggctggggaggcggtcacagctgcggagttccggatttacaaggtgcccagcatccacctgctcaacaggaccctccacgtcagcatgttccaggtggtccaggagcagtccaacagggagtctgacttgttctttttggatcttcagacgctccgagctggagacgagggctggctggtgctggatgtcacagcagccagtgactgctggttgctgaagcgtcacaaggacctgggactccgcctctatgtggagactgaggacgggcacagcgtggatcctggcctggccggcctgctgggtcaacgggccccacgctcccaacagcctttcgtggtcactttcttcagggccagtccgagtcccatccgcacccctcgggcagtgaggccactgaggaggaggcagccgaagaaaagcaacgagctgccgcaggccaaccgactcccagggatctttgatgacgtccacggctcccacggccggcaggtctgccgtcggcacgagctctacgtcagcttccaggacctcggctggctggactgggtcatcgctccccaaggctactcggcctattactgtgagggggagtgctccttcccactggactcctgcatgaatgccaccaaccacgccatcctgcagtccctggaggttcaacggtgatgccttgatcaggtgcggtggctcaccctgtaatcgcagcacacgagcccagaagttcaagacaagcctgggcaacacagcaaaaccctgtctctaaaataaaaattaaaacacacacacacacacgtgcgcacactatgccttggtgtgagaggaaataaattaccaaaagctgctct

SEQ ID NO: 278015 - DNA, 1844 bp, Homo sapiens
ccacagtggcgccggcagagcaggagtggctggaggagctgtggttggagcaggaggtggcacggcagggctggagggctccctatgagtggcggagacggcccaggaggcgctggagcaacagctcccacaccgcaccaagcggtggctgcaggagctcgcccatcgcccctgcgctgctcggaccgcggccacagccggactggcgggtacggcggcgacagacggattggccgagagtcccagtccgcagagtagccccggcctcgaggcggtggcgtcccggtcctctccgtccaggagccaggacaggtgtcgcgcggcggggctccagggaccgcgcctgaggccggctgcccgcccgtcccgccccgccccgccgcccgccgcccgccgagcccagcctccttgccgtcggggcgtccccaggccctgggtcggccgcggagccgatgcgcgcccgctgagcgccccagctgagcgcccccggcctgccatgaccgcgctccccggcccgctctggctcctgggcctggcgctatgcgcgctgggcgggggcggccccggcctgcgacccccgcccggctgtccccagcgacgtctgggcgcgcgcgagcgccgggacgtgcagcgcgagatcctggcggtgctcgggctgcctgggcggccccggccccgcgcgccacccgccgcctcccggctgcccgcgtccgcgccgctcttcatgctggacctgtaccacgccatggccggcgacgacgacgaggacggcgcgcccgcggagcggcgcctgggccgcgccgacctggtcatgagcttcgttaacatggtggagcgagaccgtgccctgggccaccaggagccccattggaaggagttccgctttgacctgacccagatcccggctggggaggcggtcacagctgcggagttccggatttacaaggtgcccagcatccacctgctcaacaggaccctccacgtcagcatgttccaggtggtccaggagcagtccaacagggagtctgacttgttctttttggatcttcagacgctccgagctggagacgagggctggctggtgctggatgtcacagcagccagtgactgctggttgctgaagcgtcacaaggacctgggactccgcctctatgtggagactgaggacgggcacagcgtggatcctggcctggccggcctgctgggtcaacgggccccacgctcccaacagcctttcgtggtcactttcttcagggccagtccgagtcccatccgcacccctcgggcagtgaggccactgaggaggaggcagccgaagaaaagcaacgagctgccgcaggccaaccgactcccagggatctttgatgacgtccacggctcccacggccggcaggtctgccgtcggcacgagctctacgtcagcttccaggacctcggctggctggactgggtcatcgctccccaaggctactcggcctattactgtgagggggagtgctccttcccactggactcctgcatgaatgccaccaaccacgccatcctgcagtccctggtgcacctgatgaagccaaacgcagtccccaaggcgtgctgtgcacccaccaagctgagcgccacctctgtgctctactatgacagcagcaacaacgtcatcctgcgcaagcaccgcaacatggtggtcaaggcctgcggctgccactgagtccagcccgcccagccctagctgcagccacccttctcatctggatcgggccctgcagaggcagaaaacccttaaatgctgtcacagctcaagcaggagtgtcaggggccctcactctctgtgcctacttcctgtcagg

SEQ ID NO: 278016 - DNA, 1970 bp, Homo sapiens
ccacagtggcgccggcagagcaggagtggctggaggagctgtggttggagcaggaggtggcacggcagggctggagggctccctatgagtggcggagacggcccaggaggcgctggagcaacagctcccacaccgcaccaagcggtggctgcaggagctcgcccatcgcccctgcgctgctcggaccgcggccacagccggactggcgggtacggcggcgacagacggattggccgagagtcccagtccgcagagtagccccggcctcgaggcggtggcgtcccggtcctctccgtccaggagccaggacaggtgtcgcgcggcggggctccagggaccgcgcctgaggccggctgcccgcccgtcccgccccgccccgccgcccgccgcccgccgagcccagcctccttgccgtcggggcgtccccaggccctgggtcggccgcggagccgatgcgcgcccgctgagcgccccagctgagcgcccccggcctgccatgaccgcgctccccggcccgctctggctcctgggcctggcgctatgcgcgctgggcgggggcggccccggcctgcgacccccgcccggctgtccccagcgacgtctgggcgcgcgcgagcgccgggacgtgcagcgcgagatcctggcggtgctcgggctgcctgggcggccccggccccgcgcgccacccgccgcctcccggctgcccgcgtccgcgccgctcttcatgctggacctgtaccacgccatggccggcgacgacgacgaggacggcgcgcccgcggagcggcgcctgggccgcgccgacctggtcatgagcttcgttaacatggtggagcgagaccgtgccctgggccaccaggagccccattggaaggagttccgctttgacctgacccagatcccggctggggaggcggtcacagctgcggagttccggatttacaaggtgcccagcatccacctgctcaacaggaccctccacgtcagcatgttccaggtggtccaggagcagtccaacagggagtctgacttgttctttttggatcttcagacgctccgagctggagacgagggctggctggtgctggatgtcacagcagccagtgactgctggttgctgaagcgtcacaaggacctgggactccgcctctatgtggagactgaggacgggcacagcgtggatcctggcctggccggcctgctgggtcaacgggccccacgctcccaacagcctttcgtggtcactttcttcagggccagtccgagtcccatccgcacccctcgggcagtgaggccactgaggaggaggcagccgaagaaaagcaacgagctgccgcaggccaaccgactcccagggatctttgatgacgtccacggctcccacggccggcaggtctgccgtcggcacgagctctacgtcagcttccaggacctcggctggctggactgggtcatcgctccccaaggctactcggcctattactgtgagggggagtgctccttcccactggactcctgcatgaatgccaccaaccacgccatcctgcagtccctggtgcacctgatgaagccaaacgcagtccccaaggcgtgctgtgcacccaccaagctgagcgccacctctgtgctctactatgacagcagcaacaacgtcatcctgcgcaagcaccgcaacatggtggtcaaggcctgcggctgccactgagtccagcccgcccagccctagctgcagccacccttctcatctggatcgggccctgcagaggcagaaaacccttaaacccagccagaccccaggccggggcattgccagggaggaccctcacaaccacgtacatgaccctttctccttcatgccaggctcctatgctccccttgccctgccaggcatttgtgtgactgtcctgtttccagcccaggtggtctcaatcatcaggcagtgttctacccaaatgcaaacgcctctcccg

SEQ ID NO: 278017 - DNA, 1317 bp, Homo sapiens
gggcaggagaggaagggacgggccgagcgggtcggggcttgccgtttgactggaattgccagaatggcggaccgagccccacgacaacctacctccctgggctcctcgccgcagcgctgcggctcgcctccctctgctcctcctcctccgccggatcgcggcgagcggatcgaggactgcctagcgcccctctgcccaccggtggttggaggccgcggcggctgcgcgttgagtcgtttcctgccggttgacctgagcctacttcgcagtagcaggaccgctgctgtggagctggtcgcaggcggtgtgtgccggtcgcctagtcaggagaactagtcctcgactcacggtgagggaatggaccgacacgggtattgtaccgctgagggaaaggagcgggactccggacctccaggaggtagggagtgaggccagtaggaccggcgcgcctccggggggattcctcccgggcgttgagttgccaacctgggacccgaggaagatcggcgtggtggtgtgctttttgttgttgttaaccctcctcggatttctcgaatttcacaccactgtccatatgcgatgatgtttgtttgcccttgacgcacttactcatggatggtacttcttcagcctcgttagacagcctggtgatggaggatgaagaaaccatgtgcttttcattcagttctggacttagtctcccttttcttccttcagcaagttatttttgttagttccttatcaaaaagtgtacataaaaattaggcaactccaaacatgcctccagggttaatgtgtgaaataataagataatatatgtaaagtggaattagctcctaggcatagggaaagtgcagaatattgccgtgttgtcatttacagttctgttgatgtcgataacgtttgtgggtgtaattggtagtgttctgtccctccaaggagttaataaaacaaagcaaacataggcctgttaggtttctgtggctactgaatatttgtttctcaaaacacttgactgatatttgataattgaatgcagcagaaatacggacgattaaagtccacaaataattccaaagtttacttgatctagtagtttttacctttacctaaagggtaaagcagaataaattaccggaaggatctacttgggtttccctttccttcacatttgtggactcctggggatccaggaagtaattcagaaatgactgttcaaaagcccatgcaaggccgggcgcggtggctaacgcttgtaatcccagcgctttgggaggccaaggtgggcggatgacctgaggtcaggagttcgagacc

SEQ ID NO: 278018 - DNA, 203 bp, Homo sapiens
caccatgttagccaggatggtctcgttctcctgaccttgtgatccgcccacctcggcctcccaaagtgctgggattacaggcgtggtggtgtgctttttgttgttgttaaccctcctcggatttctcgaatttcacaccactgtccatatgcgatgatttgttttttttggtttttttgtttttttaggttttttttacgaaa

SEQ ID NO: 278019 - DNA, 1264 bp, Homo sapiens
gacagtggctcccagaaagcccaggattcaatcgctgagagagtgcttaggcccgaatgccggcccaaatcgttctactcaccgtgtcggaggccgaggccgaggccgagagcgatgagagtgcagggaagtggggaagagggggtggccgccaggctcctccgcttccctgggtccacggcggatccctcccgcttgtcaggaggcggccagcggtagcaggaccgctgctgtggagctggtcgcaggcggtgtgtgccggtcgcctagtcaggagaactagtcctcgactcacggtgagggaatggaccgacacgggtattgtaccgctgagggaaaggagcgggactccggacctccaggaggtagggagtgaggccagtaggaccggcgcgcctccggggggattcctcccgggcgttgagttgccaacctgggacccgaggaagatcggcgtggtggtgtgctttttgttgttgttaaccctcctcggatttctcgaatttcacaccactgtccatatgcgatgatgtttgtttgcccttgacgcacttactcatggatggtacttcttcagcctcgttagacagcctggtgatggaggatgaagaaaccatgtgcttttcattcagttctggacttagtctcccttttcttccttcagcaagttatttttgttagttccttatcaaaaagtgtacataaaaattaggcaactccaaacatgcctccagggttaatgtgtgaaataataagataatatatgtaaagtggaattagctcctaggcatagggaaagtgcagaatattgccgtgttgtcatttacagttctgttgatgtcgataacgtttgtgggtgtaattggtagtgttctgtccctccaaggagttaataaaacaaagcaaacataggcctgttaggtttctgtggctactgaatatttgtttctcaaaacacttgactgatatttgataattgaatgcagcagaaatacggacgattaaagtccacaaataattccaaagtttacttgatctagtagtttttacctttacctaaagggtaaagcagaataaattaccggaaggatctacttgggtttccctttccttcacatttgtggactcctggggatccaggaagtaattcagaaatgactgttcaaaagcccatgcaaggccgggcgcggtggctaacgcttgtaatcccagcgctttgggaggccaaggtgggcggatgacctgaggtcaggagttcgagacc

SEQ ID NO: 278020 - DNA, 440 bp, Homo sapiens
aggctcccagactctgtagtgaagaggcatgtaaagagacaaatgagagcatgccatgcaaactgctaaagttagcctttgcctttttcccagagactctctaggaatttttcccatctgctgactaggagcattcaaattctcagcacagaaggttcttgctgttttgctgcaccaagttcttggaaatcacatacagatccccctaaaggagattggaacagtgcaatatttggggactgcattctccacccaaggatttagcatcaaatgaaaaacaggttcatgttctgacaaggtagtcacaacatttggccattttcttgggtacaagctaagacctcagaagacattactgatcaacacatcctgtttagcagtagtgacagaacattgtgcattaaaaattcaatgatatttaactttgaaattataaatta

SEQ ID NO: 278021 - DNA, 770 bp, Homo sapiens
aggctcccagactctgtagtgaagaggcatgtaaagagacaaatgagagcatgccatgcaaactgctaaagttagcctttgcctttttcccagagactctctaggaatttttcccatctgctgactaggaggtaagccccgacctaaatttttgtcttgttgtaggttaattaagactggtgttagattcagctcctaaggcctaagagaatttaaggttgtcttctgggaaggacacccaacagcagcattggaattggaaaaaaagtgtaggattttgctgagtgagcagggggaaagcaatgtaaagcccaagagaatatcttttgaacaaacgtccttttcattttggtttagaaatagaaacgtggtaaaaggaggcgactgttttctgaaggcttgtagcacgaaaacaggccaactggccagcaactagttgtctatcagtttctctactcacatacatctgccttttccagactgccagcgcggagcactagtttgactttgggtgctcttcaaatagctggcattgataaggcattcccagaagactgtgttacttagtaatcttgtcggtacattttttcactgggcagagattttccaaacagagagctgccagctttcaagacgtcagagtgctttttcatcccaggggaggagctgcggtggctgagccgacgctgcgcgcacagccgcctgtggttttccgcgcattgtgaggaatgaggggtggaggtggtattagacgcagccgaatcctccct

SEQ ID NO: 278022 - DNA, 1301 bp, Homo sapiens
tttttttttttcctaaggaatgtttgaattttattgtacttttttttttaaagaaaagagaatatcataatcttacacaatttctttcaaatggataaacttagacaatttatcaatgcttccttacatttttacaccacgctgaactccaacaggtttttgttttaaggtaaaccaggtttttggtccttccctgtggagaagttactttcaagtcagtgaaagttcttggcccatgattaaaagtctttgccaattagtactcaacaacttcaattcatttttttctggttcaagatgagtaggagcctaataaggctgtgataaaagggcaaaaggcactgagagccaaaagcggattaatgagctcctccatttatttgtcttcctaacagctgaactgttacaactattgacactcttcaaaaggttccgctctgaaccctgtccaggcactgcaggctccaatggacatcttcaaatccagagaatggaggggcaagagcttcccctgtgtgatgccaaaaccaacaaagccccatggatcaggtaatgaaacttcagcttttccccctttgagatttatttactggcagctgacaaggggcaaattcagctcgaattgtgcagtcaaggccctgtcaagcttttagaggcacccttgtcttgaagcaccttcatgactggcatttcactcaaaagccctcggcactggtccttaacagcttatgacatcacaaaggacactccagacagatgcctacatggcatcctgcagcattttaaaagagaattagtggttttaattatggtcgtagtatgaaagggaaccatgcaagctccacaggagacctttgatcagacccttttgctagtacaatgccacggaactgtgactattcctggtaaggggccttttcttgctgaatgactcaccagtgatctttgaatgcagacaagcttctagccctccctcttcattagtgagcatttctatacaggggcctatatagtgcttggagtctaggagctatacaattggggggaaaagaagccctacagattctggcctctacttaggaagtgctgaaggactctgagtgactttattcattaaaacaggttgctattaattaactgtcataataaaataaagaactattatttgcatttcttactatgttctctttagtaatatgtataaaagatgcttgtaacagaaatgaatttattgggccacttccccatcccccccaatccctgcctttttttcccctttgcattttgcagcagcaggagcc

SEQ ID NO: 278023 - DNA, 1067 bp, Homo sapiens
  misc_feature (1065)..(1065): n is a, c, g, or t
  misc_feature (1067)..(1067): n is a, c, g, or t
tttttttttttcctaaggaatgtttgaattttattgtacttttttttttaaagaaaagagaatatcataatcttacacaatttctttcaaatggataaacttagacaatttatcaatgcttccttacatttttacaccacgctgaactccaacaggtttttgttttaaggtaaaccaggtttttggtccttccctgtggagaagttactttcaagtcagtgaaagttcttggcccatgattaaaagtctttgccaattagtactcaacaacttcaattcatttttttctggttcaagatgagtaggagcctaataaggctgtgataaaagggcaaaaggcactgagagccaaaagcggattaatgagctcctccatttatttgtcttcctaacagctgaactgttacaactattgacactcttcaaaaggttccgctctgaaccctgtccaggcactgcaggctccaatggacatcttcaaatccagagaatggaggggcaagagcttcccctgtgtgatgccaaaaccaacaaagccccatggatcaggtaatgaaacttcagcttttccccctttgagatttatttactggcagctgacaaggggcaaattcagctcgaattgtgcagtcaaggccctgtcaagcttttagaggcacccttgtcttgaagcaccttcatgactggcatttcactcaaaagccctcggcactggtccttaacagcttatgacatcacaaaggacactccagacagatgcctacatggcatcctgcagcattttaaaagagaattagtggttttaattatggtcgtagtatgaaagggaaccatgcaagctccacaggagacctttgatcagacccttttgctagtacaatgccacggaactgtgactattcctggtaaggggccttttcttgctgaatgactcaccagtgatctttgaatgcagacaagcttctagccctccctcttcattagtgagcatttctatacaggggcctatatagtgcttggagtctaggagctatacaattgggtctagatctctgagtccaaaancn

SEQ ID NO: 278024 - DNA, 421 bp, Homo sapiens
cagtcatctggtgaaagactggaagtcagaagacttttcaaaagcttctcactgaaatgaaaaaaaatcaaggcctggaaaggttctttgatgcacagttgacaactaatggcagagtgggcctagaagctgggcctccttactgccagacagaactccagcatgctgccttctataatcagggtaatgagctataggatggtagatgatgcagcattcaaagacttggaagtagaaggtgccatgcatctaaccatcatggtatccacacaaccagcaccctcttccctcctctctccccattgttctgtaagtaggagaacgagaaggacatgttctctttctgttgttttatggtattttgtgggtagcaagtaacaatattaacaattaataaaaaaaaaaattagaaggcatctca

SEQ ID NO: 278025 - DNA, 223 bp, Homo sapiens
tttttttttttcctaaggaatgtttgaattttattgtacttttttttttaaagaaaagagaatatcataatcttacacaatttctttcaaatggataaacttagacaatttatcaatgcttccttacatttttacaccacgctgaactccaacaggtttttgttttaaggtaaaccaggtttttggtccttccctgtggactgaccggcaggcacgagggggg

SEQ ID NO: 278026 - DNA, 1267 bp, Homo sapiens
tttttttttttcctaaggaatgtttgaattttattgtacttttttttttaaagaaaagagaatatcataatcttacacaatttctttcaaatggataaacttagacaatttatcaatgcttccttacatttttacaccacgctgaactccaacaggtttttgttttaaggtaaaccaggtttttggtccttccctgtggagaagttactttcaagtcagtgaaagttcttggcccatgattaaaagtctttgccaattagtactcaacaacttcaattcatttttttctggttcaagatgagtaggagcctaataaggctgtgataaaagggcaaaaggcactgagagccaaaagcggattaatgagctcctccatttatttgtcttcctaacagctgaactgttacaactattgacactcttcaaaaggttccgctctgaaccctgtccaggcactgcaggctccaatggacatcttcaaatccagagaatggaggggcaagagcttcccctgtgtgatgccaaaaccaacaaagccccatggatcaggtaatgaaacttcagcttttccccctttgagatttatttactggcagctgacaaggggcaaattcagctcgaattgtgcagtcaaggccctgtcaagcttttagaggcacccttgtcttgaagcaccttcatgactggcatttcactcaaaagccctcggcactggtccttaacagcttatgacatcacaaaggacactccagacagatgcctacatggcatcctgcagcattttaaaagagaattagtggttttaattatggtcgtagtatgaaagggaaccatgcaagctccacaggagacctttgatcagacccttttgctagtacaatgccacggaactgtgactattcctgaaaaaaaatcaaggcctggaaaggttctttgatgcacagttgacaactaatggcagagtgggcctagaagctgggcctccttactgccagacagaactccagcatgctgccttctataatcagggtaatgagctataggatggtagatgatgcagcattcaaagacttggaagtagaaggtgccatgcatctaaccatcatggtatccacacaaccagcaccctcttccctcctctctccccattgttctgtaagtaggagaacgagaaggacatgttctctttctgttgttttatggtattttgtgggtagcaagtaacaatattaacaattaataaaaaaaaaaattagaaggcatctca

SEQ ID NO: 278027 - DNA, 946 bp, Homo sapiens
tttttttttttcctaaggaatgtttgaattttattgtacttttttttttaaagaaaagagaatatcataatcttacacaatttctttcaaatggataaacttagacaatttatcaatgcttccttacatttttacaccacgctgaactccaacaggtttttgttttaaggtaaaccaggtttttggtccttccctgtggagaagttactttcaagtcagtgaaagttcttggcccatgattaaaagtctttgccaattagtactcaacaacttcaattcatttttttctggttcaagatgagtaggagcctaataaggctgtgataaaagggcaaaaggcactgagagccaaaagcggattaatgagctcctccatttatttgtcttcctaacagctgaactgttacaactattgacactcttcaaaaggttccgctctgaaccctgtccaggcactgcaggctccaatggacatcttcaaatccagagaatggaggggcaagagcttcccctgtgtgatgccaaaaccaacaaagccccatggatcaggtaatgaaacttcagcttttccccctttgagatttatttactggcagctgacaaggggcaaattcagctcgaattgtgcagtcaaggccctgtcaagcttttagaggcacccttgtcttgaagcaccttcatgactggcatttcactcaaaagccctcggcactggtccttaacagcttatgacatcacaaaggacactccagacagatgcctacatggcatcctgcagcattttaaaagagaattagtggttttaattatggtcgtagtatgaaagggaaccatgcaagctccacaggagacctttgatcagacccttttgctagtacaatgccacgcaaagatcactggtgagtcattcagcaaaaaaggccccttaccaggaatagtcacatca

SEQ ID NO: 278028 - DNA, 364 bp, Homo sapiens
aaaaaaaatcaaggcctggaaaggttctttgatgcacagttgacaactaatggcagagtgggcctagaagctgggcctccttactgccagacagaactccagcatgctgccttctataatcaggtattttgctatcctcaagtggggtgtctcggagggatctgcctttgcccccatggcttgcttcttatggactgctctcccctccctctcttgctgccttgccctaccatctgtttggttagctccttctgatctttcaagatgacactccaatgacatcctctctggaagccttcccttcctccctccctcaccagcctacttcccagcttgctctggtccagggctctgggtttctgta

SEQ ID NO: 278029 - DNA, 2748 bp, Homo sapiens
agcagctagcagggagatgctgggggatagacagggctgctggggactgttgtacaggctgtgcactgctcaagggtatccagagcccagctttgtatctaccaggaagaaggggctcccctcccctcccttcctcttccctcccctctcctttcctctcctctcctttcctttcctttttttttttttttttgagatggagtcttgctttgtcgccctggctggagtgcaatggcatgatctcggctcactgcaacctctgcctcctcggttcaagcaattctcctgcctcagcctcctgagtagctggaattacaggtgcacaccaccacgcctggctaatttttttgtatttttagtagagacggggtttcaccatgttggtcaggctggtcttgaactcctgacctcgtgatccgcccacctcggcctcccaaagtgttgggattacaggcgtgagccaccatgcctagcctttttttttccccccctggaaaaggtgtagccataggcgctgactgaggtcctgggaacaagtctccagagggcagtggcactcaaacccacgtacctggctggcctcccagaatgtgagctgagcccaagcatgctgtgaagccaagatgcagaggttgatgaaggcacagcccatggagatgtggaagtagaaggggaagagtttgctctgcactagtccgaagggatccagttctgacagccaagaccactcctctcataaaataataccggatattaggtgaagatcccgaaagccccgaggaaaccctaaatctcatcctgaggacaccgatcccaccaaagccccgaggaaacgccaaatctcatcccgaggacaccgatcccaccgttaggaaccgggacctcaatccgcagcacccggattccgagaacagaggcgtcggggccaaatgggctgaatctggtacctcactcccacgcccccgggtggacagcgaccctcctcggccgcgtcccctcgtgggtttcccccaaccaataattcgtcccgcctcccagctgagcccgaagccaatcgggtcgtagatctgcacctttctatcccgccctcctgggtattgactaatcgtagaaacccccctgggatcccgccccctccacgggcttttatccaattacgccgcggctactaagcgcagctgaagcgtgaaggcgccaatgaggccttcggctactccggcaggggcggaactaaaatgccggccacacccctctctgtgactcagtctctgagcgttttaatacgatggtgtccccgcgggatcaaacttcagcgtcacagctgaggactggcttcgtggtccctgatgggagagcatgaacaggtggtatgtgaagcccttggagaccagctcttccaaagtcaaagccaagaccattgtgatgattcccgactcccagaagctcctgcgatgtgaacttgagtcactcaagagccagttacaggcccagaccaaggctttcgagttcctgaaccactcagtgaccatgttggagaaggagagctgcttgcagcaaatcaagattcagcagcttgaagaggtgctgagccccacaggccgccagggagagaaggaggagcacaagtggggcatggagcagggccggcaggagctgtatggggccctgacccaaggccttcaggggctggagaagaccctgcgtgacagtgaggagatgcagcgggcccgcaccactcgctgcctgcagctgctggcccaggagatccgggacagcaagaagttcctgtgggaggagctggaactggtgcgggaggaggtgaccttcatctatcagaagctccaagcgcaggaggatgagatctcagagaacttggtgaacattcagaaaatgcagaaaacgcaggtgaaatgccgcaaaatcctgaccaagatgaagcagcagggtcatgagacagccgcctgtccggagactgaagagataccgcagggagccagtggctgctggaaggatgacctccagaaggaactgagtgatatatggtctgctgtgcacgtgctgcagaactccatagacagcctcactttgtgctcgggggcctgtcccaaggcctcgagcctaagaggccacaaggggcaccagtgcctgagccctccactcccctcctgggactctgactccgactctgaccaggacctctcccagccacctttcagcaagagcggccgctccttcccacccgcttgagcagccgggactgctctccctgaagacccctccagagagaaaataaactagcccagaccctcctctagccccgactgttagtcttgctgcttcctgtgcctaggaatccccctgccctcctagtttacccctcattgttgggggggaggggtgtagagaccccaggggtcattcgggatgtgtgggcttggaatcaggggacatctgaagccagatttaatatatgacaaggcaaggagtcattctgtccagacacgagcagccagacagacttccacactggccacagagccttcctttctggggggccctggcgaatggggaaactgaggcccagagagggagaggcgcggcccagggacatactctgaagcccctccctcctattaccctcggagccccgcccaccccagggtcctccctctctacttccattcttggttccttcctacaatcgatgctaacacgccccgcctccaagatcacggaggccccgcccca

SEQ ID NO: 278030 - DNA, 3613 bp, Homo sapiens
agcagctagcagggagatgctgggggatagacagggctgctggggactgttgtacaggctgtgcactgctcaagggtatccagagcccagctttgtatctaccaggaagaaggggctcccctcccctcccttcctcttccctcccctctcctttcctctcctctcctttcctttcctttttttttttttttttgagatggagtcttgctttgtcgccctggctggagtgcaatggcatgatctcggctcactgcaacctctgcctcctcggttcaagcaattctcctgcctcagcctcctgagtagctggaattacaggtgcacaccaccacgcctggctaatttttttgtatttttagtagagacggggtttcaccatgttggtcaggctggtcttgaactcctgacctcgtgatccgcccacctcggcctcccaaagtgttgggattacaggcgtgagccaccatgcctagcctttttttttccccccctggaaaaggtgtagccataggcgctgactgaggtcctgggaacaagtctccagagggcagtggcactcaaacccacgtacctggctggcctcccagaatgtgagctgagcccaagcatgctgtgaagccaagatgcagaggttgatgaaggcacagcccatggagatgtggaagtagaaggggaagagtttgctctgcactagtccgaagggatccagttctgacagccaagaccactcctctcataaaataataccggatattaggtgaagatcccgaaagccccgaggaaaccctaaatctcatcctgaggacaccgatcccaccaaagccccgaggaaacgccaaatctcatcccgaggacaccgatcccaccgttaggaaccgggacctcaatccgcagcacccggattccgagaacagaggcgtcggggccaaatgggctgaatctggtacctcactcccacgcccccgggtggacagcgaccctcctcggccgcgtcccctcgtgggtttcccccaaccaataattcgtcccgcctcccagctgagcccgaagccaatcgggtcgtagatctgcacctttctatcccgccctcctgggtattgactaatcgtagaaacccccctgggatcccgccccctccacgggcttttatccaattacgccgcggctactaagcgcagctgaagcgtgaaggcgccaatgaggccttcggctactccggcaggggcggaactaaaatgccggccacacccctctctgtgactcagtctctgagcgttttaatacgatggtgtccccgcgggatcaaacttcagcgtcacagctgaggactggcttcgtggtccctgatgggagagcatgaacaggtggtatgtggctcttcctcggacaaggctctggaagcgtacagctcactggtccaggactccagagccagagaccttgggatgccctgcttctggggacacagtgaggactgcagactgcaggccagggtggggctcagggccttcgccacatgaggctgccccctcccccagtccagacctgcagaagcagtgctgtaatgaccaggacattttgaagaggcatcacaacgtagctaaggtcacccccacccgggaaaccccttcaatgcagaaaaccactgcaatctactgctgtggggcttagggaaggggctgtaaggcagagagactcccatgaatgcacccactgtgtttcttcagcacctagaacagcacctggcactcagcaggccctggctaagcaagtcttaaatgaatggatgaaggaatgaatggaaggaaagagtgtggttgtgtgtcttccatggggatttggctgtgatcgtctctcagccacataagtgcacttctgagcatatgtagcccaagggggaggtgcatgaatatgcctggagtgcagctttgcctgcacttacggtttgggacacctagaactgaggagatccaactcttgtccagccctcaaaactgggttgaggtgagcaaggaggcagctcagggacaaatttctactcccatctcatctctcttccttagaagcccttggagaccagctcttccaaagtcaaagccaagaccattgtgatgattcccgactcccagaagctcctgcgatgtgaacttgagtcactcaagagccagttacaggcccagaccaaggctttcgagttcctgaaccactcagtgaccatgttggagaaggagagctgcttgcagcaaatcaagattcagcagcttgaagaggtgctgagccccacaggccgccagggagagaaggaggagcacaagtggggcatggagcagggccggcaggagctgtatggggccctgacccaaggccttcaggggctggagaagaccctgcgtgacagtgaggagatgcagcgggcccgcaccactcgctgcctgcagctgctggcccaggagatccgggacagcaagaagttcctgtgggaggagctggaactggtgcgggaggaggtgaccttcatctatcagaagctccaagcgcaggaggatgagatctcagagaacttggtgaacattcagaaaatgcagaaaacgcaggtgaaatgccgcaaaatcctgaccaagatgaagcagcagggtcatgagacagccgcctgtccggagactgaagagataccgcagggagccagtggctgctggaaggatgacctccagaaggaactgagtgatatatggtctgctgtgcacgtgctgcagaactccatagacagcctcactttgtgctcgggggcctgtcccaaggcctcgagcctaagaggccacaaggggcaccagtgcctgagccctccactcccctcctgggactctgactccgactctgaccaggacctctcccagccacctttcagcaagagcggccgctccttcccacccggtgcagatcctccccagtccccccctccacccatttccctcctgacctgcccttgactcccacagtctagaccctcagaacaggcccagatcctgatctgggcatgcggtccctgacctgcagccccggagtcccctggacctggccaggccctgacccaccctctctctccacagcttgagcagccgggactgctctccctgaagacccctccagagagaaaataaactagcccagaccctcctctagccccgactgttagtcttgctgcttcctgtgcctaggaatccccctgccctcctagtttacccctcattgttgggggggaggggtgtagagaccccaggggtcattcgggatgtgtgggcttggaatcaggggacatctgaagccagatttaatatatgacaaggcaaggagtcattctgtccagacacgagcagccagacagacttccacactggccacagagccttcctttctggggggccctggcgaatggggaaactgaggcccagagagggagaggcgcggcccagggacatactctgaagcccctccctcctattaccctcggagccccgcccaccccagggtcctccctctctacttccattcttggttccttcctacaatcgatgctaacacgccccgcctccaagatcacggaggccccgcccca

SEQ ID NO: 278031 - DNA, 2874 bp, Homo sapiens
cgggtgtagatttcacaacccagggggcggagccaggatgatgaccccgccccctccctaaataattctcccgggagggacacggaagcagcaaccgggatgggacggggagagaggaggcactactggggacctaagctggttctcaaatgcctctccttttcccctccaagcctcccaggcttcctatggtccctaagtcccgggttctcagcgtgacattccagagcaaacacagctccccattactctataccaggcactggcatggattaatttatctaatcacaacatcccagtaagatatgccctgcctctcctgctcacactctatggctggcattcacctgtggggccaggtcgaaactcctggcttggccgtcaatgccttactggagctgctctgctaacctcctgctgcttcctctcggacctcgattcagccatcatgaatttaccagcatagagcatgtgattccacacctccaagcttttgcacatgctgctccctgccagcgaccctcttttggccggcctaccccgggaccctgactactctgtgtcctgcctctactcacctccctcaccctccagcatgtgtttgcctgctaacatgaagtgtgacaagtactggggctcttcctcggacaaggctctggaagcgtacagctcactggtccaggactccagagccagagaccttgggatgccctgcttctggggacacagtgaggactgcagactgcaggccagggtggggctcagggccttcgccacatgaggctgccccctcccccagtccagacctgcagaagcagtgctgtaatgaccaggacattttgaagaggcatcacaacgtagctaaggtcacccccacccgggaaaccccttcaatgcagaaaaccactgcaatctactgctgtggggcttagggaaggggctgtaaggcagagagactcccatgaatgcacccactgtgtttcttcagcacctagaacagcacctggcactcagcaggccctggctaagcaagtcttaaatgaatggatgaaggaatgaatggaaggaaagagtgtggttgtgtgtcttccatggggatttggctgtgatcgtctctcagccacataagtgcacttctgagcatatgtagcccaagggggaggtgcatgaatatgcctggagtgcagctttgcctgcacttacggtttgggacacctagaactgaggagatccaactcttgtccagccctcaaaactgggttgaggtgagcaaggaggcagctcagggacaaatttctactcccatctcatctctcttccttagaagcccttggagaccagctcttccaaagtcaaagccaagaccattgtgatgattcccgactcccagaagctcctgcgatgtgaacttgagtcactcaagagccagttacaggcccagaccaaggctttcgagttcctgaaccactcagtgaccatgttggagaaggagagctgcttgcagcaaatcaagattcagcagcttgaagaggtgctgagccccacaggccgccagggagagaaggaggagcacaagtggggcatggagcagggccggcaggagctgtatggggccctgacccaaggccttcaggggctggagaagaccctgcgtgacagtgaggagatgcagcgggcccgcaccactcgctgcctgcagctgctggcccaggagatccgggacagcaagaagttcctgtgggaggagctggaactggtgcgggaggaggtgaccttcatctatcagaagctccaagcgcaggaggatgagatctcagagaacttggtgaacattcagaaaatgcagaaaacgcaggtgaaatgccgcaaaatcctgaccaagatgaagcagcagggtcatgagacagccgcctgtccggagactgaagagataccgcagggagccagtggctgctggaaggatgacctccagaaggaactgagtgatatatggtctgctgtgcacgtgctgcagaactccatagacagcctcactttgtgctcgggggcctgtcccaaggcctcgagcctaagaggccacaaggggcaccagtgcctgagccctccactcccctcctgggactctgactccgactctgaccaggacctctcccagccacctttcagcaagagcggccgctccttcccacccggtgcagatcctccccagtccccccctccacccatttccctcctgacctgcccttgactcccacagtctagaccctcagaacaggcccagatcctgatctgggcatgcggtccctgacctgcagccccggagtcccctggacctggccaggccctgacccaccctctctctccacagcttgagcagccgggactgctctccctgaagacccctccagagagaaaataaactagcccagaccctcctctagccccgactgttagtcttgctgcttcctgtgcctaggaatccccctgccctcctagtttacccctcattgttgggggggaggggtgtagagaccccaggggtcattcgggatgtgtgggcttggaatcaggggacatctgaagccagatttaatatatgacaaggcaaggagtcattctgtccagacacgagcagccagacagacttccacactggccacagagccttcctttctggggggccctggcgaatggggaaactgaggcccagagagggagaggcgcggcccagggacatactctgaagcccctccctcctattaccctcggagccccgcccaccccagggtcctccctctctacttccattcttggttccttcctacaatcgatgctaacacgccccgcctccaagatcacggaggccccgcccca

SEQ ID NO: 278032 - DNA, 3143 bp, Homo sapiens
agcagctagcagggagatgctgggggatagacagggctgctggggactgttgtacaggctgtgcactgctcaagggtatccagagcccagctttgtatctaccaggaagaaggggctcccctcccctcccttcctcttccctcccctctcctttcctctcctctcctttcctttcctttttttttttttttttgagatggagtcttgctttgtcgccctggctggagtgcaatggcatgatctcggctcactgcaacctctgcctcctcggttcaagcaattctcctgcctcagcctcctgagtagctggaattacaggtgcacaccaccacgcctggctaatttttttgtatttttagtagagacggggtttcaccatgttggtcaggctggtcttgaactcctgacctcgtgatccgcccacctcggcctcccaaagtgttgggattacaggcgtgagccaccatgcctagcctttttttttccccccctggaaaaggtgtagccataggcgctgactgaggtcctgggaacaagtctccagagggcagtggcactcaaacccacgtacctggctggcctcccagaatgtgagctgagcccaagcatgctgtgaagccaagatgcagaggttgatgaaggcacagcccatggagatgtggaagtagaaggggaagagtttgctctgcactagtccgaagggatccagttctgacagccaagaccactcctctcataaaataataccggatattaggtgaagatcccgaaagccccgaggaaaccctaaatctcatcctgaggacaccgatcccaccaaagccccgaggaaacgccaaatctcatcccgaggacaccgatcccaccgttaggaaccgggacctcaatccgcagcacccggattccgagaacagaggcgtcggggccaaatgggctgaatctggtacctcactcccacgcccccgggtggacagcgaccctcctcggccgcgtcccctcgtgggtttcccccaaccaataattcgtcccgcctcccagctgagcccgaagccaatcgggtcgtagatctgcacctttctatcccgccctcctgggtattgactaatcgtagaaacccccctgggatcccgccccctccacgggcttttatccaattacgccgcggctactaagcgcagctgaagcgtgaaggcgccaatgaggccttcggctactccggcaggggcggaactaaaatgccggccacacccctctctgtgactcagtctctgagcgttttaatacgatggtgtccccgcgggatcaaacttcagcgtcacagctgaggactggcttcgtggtccctgatgggagagcatgaacaggtggtatgtgaagcccttggagaccagctcttccaaagtcaaagccaagaccattgtgatgattcccgactcccagaagctcctgcgatgtgaacttgagtcactcaagagccagttacaggcccagaccaaggctttcgagttcctgaaccactcagtgaccatgttggagaaggagagctgcttgcagcaaatcaagattcagcagcttgaagaggtgctgagccccacaggccgccagggagagaaggaggagcacaagtggggcatggagcagggccggcaggagctgtatggggccctgacccaaggccttcaggggctggagaagaccctgcgtgacagtgaggagatgcagcgggcccgcaccactcgctgcctgcagctgctggcccaggagatccgggacagcaagaagttcctgtgggaggagctggaactggtgcgggaggaggtgaccttcatctatcagaagctccaagcgcaggaggatgagatctcagagaacttggtgaacattcagaaaatgcagaaaacgcaggtgaaatgccgcaaaatcctgaccaagatgaagcagcagggtcatgagacagccgcctgtccggagactgaagagataccgcagggagccagtggctgctggaaggatgacctccagaaggaactgagtgatatatggtgatgcccagcctgcagtctgacccctgaccctcctctgaacccgttcccccaacgggatctggcagtgaccaccagaacctggagcccacctgagtccagacttccctcaccccctaggactcaccccaccacggcccccaaccttagctgtactgctgtctacaccctgagcagtgtggagtctcccagcgcccccagctccttgtcttcttgcaggtctgctgtgcacgtgctgcagaactccatagacagcctcactttgtgctcgggggcctgtcccaaggcctcgagcctaagaggccacaaggggcaccagtgcctgagccctccactcccctcctgggactctgactccgactctgaccaggacctctcccagccacctttcagcaagagcggccgctccttcccacccggtgcagatcctccccagtccccccctccacccatttccctcctgacctgcccttgactcccacagtctagaccctcagaacaggcccagatcctgatctgggcatgcggtccctgacctgcagccccggagtcccctggacctggccaggccctgacccaccctctctctccacagcttgagcagccgggactgctctccctgaagacccctccagagagaaaataaactagcccagaccctcctctagccccgactgttagtcttgctgcttcctgtgcctaggaatccccctgccctcctagtttacccctcattgttgggggggaggggtgtagagaccccaggggtcattcgggatgtgtgggcttggaatcaggggacatctgaagccagatttaatatatgacaaggcaaggagtcattctgtccagacacgagcagccagacagacttccacactggccacagagccttcctttctggggggccctggcgaatggggaaactgaggcccagagagggagaggcgcggcccagggacatactctgaagcccctccctcctattaccctcggagccccgcccaccccagggtcctccctctctacttccattcttggttccttcctacaatcgatgctaacacgccccgcctccaagatcacggaggccccgcccca

SEQ ID NO: 278033 - DNA, 3359 bp, Homo sapiens
agcagctagcagggagatgctgggggatagacagggctgctggggactgttgtacaggctgtgcactgctcaagggtatccagagcccagctttgtatctaccaggaagaaggggctcccctcccctcccttcctcttccctcccctctcctttcctctcctctcctttcctttcctttttttttttttttttgagatggagtcttgctttgtcgccctggctggagtgcaatggcatgatctcggctcactgcaacctctgcctcctcggttcaagcaattctcctgcctcagcctcctgagtagctggaattacaggtgcacaccaccacgcctggctaatttttttgtatttttagtagagacggggtttcaccatgttggtcaggctggtcttgaactcctgacctcgtgatccgcccacctcggcctcccaaagtgttgggattacaggcgtgagccaccatgcctagcctttttttttccccccctggaaaaggtgtagccataggcgctgactgaggtcctgggaacaagtctccagagggcagtggcactcaaacccacgtacctggctggcctcccagaatgtgagctgagcccaagcatgctgtgaagccaagatgcagaggttgatgaaggcacagcccatggagatgtggaagtagaaggggaagagtttgctctgcactagtccgaagggatccagttctgacagccaagaccactcctctcataaaataataccggatattaggtgaagatcccgaaagccccgaggaaaccctaaatctcatcctgaggacaccgatcccaccaaagccccgaggaaacgccaaatctcatcccgaggacaccgatcccaccgttaggaaccgggacctcaatccgcagcacccggattccgagaacagaggcgtcggggccaaatgggctgaatctggtacctcactcccacgcccccgggtggacagcgaccctcctcggccgcgtcccctcgtgggtttcccccaaccaataattcgtcccgcctcccagctgagcccgaagccaatcgggtcgtagatctgcacctttctatcccgccctcctgggtattgactaatcgtagaaacccccctgggatcccgccccctccacgggcttttatccaattacgccgcggctactaagcgcagctgaagcgtgaaggcgccaatgaggccttcggctactccggcaggggcggaactaaaatgccggccacacccctctctgtgactcagtctctgagcgttttaatacgatggtgtccccgcgggatcaaacttcagcgtcacagctgaggactggcttcgtggtccctgatgggagagcatgaacaggtggtatgtggctcttcctcggacaaggctctggaagcgtacagctcactggtccaggactccagagccagagaccttgggatgccctgcttctggggacacagtgaggactgcagactgcaggccagggtggggctcagggccttcgccacatgaggctgccccctcccccagtccagacctgcagaagcagtgctgtaatgaccaggacattttgaagaggcatcacaacgtagctaaggtcacccccacccgggaaaccccttcaatgcagaaaaccactgcaatctactgctgtggggcttagggaaggggctgtaaggcagagagactcccatgaatgcacccactgtgtttcttcagcacctagaacagcacctggcactcagcaggccctggctaagcaagtcttaaatgaatggatgaaggaatgaatggaaggaaagagtgtggttgtgtgtcttccatggggatttggctgtgatcgtctctcagccacataagtgcacttctgagcatatgtagcccaagggggaggtgcatgaatatgcctggagtgcagctttgcctgcacttacggtttgggacacctagaactgaggagatccaactcttgtccagccctcaaaactgggttgaggtgagcaaggaggcagctcagggacaaatttctactcccatctcatctctcttccttagaagcccttggagaccagctcttccaaagtcaaagccaagaccattgtgatgattcccgactcccagaagctcctgcgatgtgaacttgagtcactcaagagccagttacaggcccagaccaaggctttcgagttcctgaaccactcagtgaccatgttggagaaggagactggaactggtgcgggaggaggtgaccttcatctatcagaagctccaagcgcaggaggatgagatctcagagaacttggtgaacattcagaaaatgcagaaaacgcaggtgaaatgccgcaaaatcctgaccaagatgaagcagcagggtcatgagacagccgcctgtccggagactgaagagataccgcagggagccagtggctgctggaaggatgacctccagaaggaactgagtgatatatggtctgctgtgcacgtgctgcagaactccatagacagcctcactttgtgctcgggggcctgtcccaaggcctcgagcctaagaggccacaaggggcaccagtgcctgagccctccactcccctcctgggactctgactccgactctgaccaggacctctcccagccacctttcagcaagagcggccgctccttcccacccggtgcagatcctccccagtccccccctccacccatttccctcctgacctgcccttgactcccacagtctagaccctcagaacaggcccagatcctgatctgggcatgcggtccctgacctgcagccccggagtcccctggacctggccaggccctgacccaccctctctctccacagcttgagcagccgggactgctctccctgaagacccctccagagagaaaataaactagcccagaccctcctctagccccgactgttagtcttgctgcttcctgtgcctaggaatccccctgccctcctagtttacccctcattgttgggggggaggggtgtagagaccccaggggtcattcgggatgtgtgggcttggaatcaggggacatctgaagccagatttaatatatgacaaggcaaggagtcattctgtccagacacgagcagccagacagacttccacactggccacagagccttcctttctggggggccctggcgaatggggaaactgaggcccagagagggagaggcgcggcccagggacatactctgaagcccctccctcctattaccctcggagccccgcccaccccagggtcctccctctctacttccattcttggttccttcctacaatcgatgctaacacgccccgcctccaagatcacggaggccccgcccca

SEQ ID NO: 278034 - DNA, 2748 bp, Homo sapiens
agcagctagcagggagatgctgggggatagacagggctgctggggactgttgtacaggctgtgcactgctcaagggtatccagagcccagctttgtatctaccaggaagaaggggctcccctcccctcccttcctcttccctcccctctcctttcctctcctctcctttcctttcctttttttttttttttttgagatggagtcttgctttgtcgccctggctggagtgcaatggcatgatctcggctcactgcaacctctgcctcctcggttcaagcaattctcctgcctcagcctcctgagtagctggaattacaggtgcacaccaccacgcctggctaatttttttgtatttttagtagagacggggtttcaccatgttggtcaggctggtcttgaactcctgacctcgtgatccgcccacctcggcctcccaaagtgttgggattacaggcgtgagccaccatgcctagcctttttttttccccccctggaaaaggtgtagccataggcgctgactgaggtcctgggaacaagtctccagagggcagtggcactcaaacccacgtacctggctggcctcccagaatgtgagctgagcccaagcatgctgtgaagccaagatgcagaggttgatgaaggcacagcccatggagatgtggaagtagaaggggaagagtttgctctgcactagtccgaagggatccagttctgacagccaagaccactcctctcataaaataataccggatattaggtgaagatcccgaaagccccgaggaaaccctaaatctcatcctgaggacaccgatcccaccaaagccccgaggaaacgccaaatctcatcccgaggacaccgatcccaccgttaggaaccgggacctcaatccgcagcacccggattccgagaacagaggcgtcggggccaaatgggctgaatctggtacctcactcccacgcccccgggtggacagcgaccctcctcggccgcgtcccctcgtgggtttcccccaaccaataattcgtcccgcctcccagctgagcccgaagccaatcgggtcgtagatctgcacctttctatcccgccctcctgggtattgactaatcgtagaaacccccctgggatcccgccccctccacgggcttttatccaattacgccgcggctactaagcgcagctgaagcgtgaaggcgccaatgaggccttcggctactccggcaggggcggaactaaaatgccggccacacccctctctgtgactcagtctctgagcgttttaatacgatggtgtccccgcgggatcaaacttcagcgtcacagctgaggactggcttcgtggtccctgatgggagagcatgaacaggtggtatgtgaagcccttggagaccagctcttccaaagtcaaagccaagaccattgtgatgattcccgactcccagaagctcctgcgatgtgaacttgagtcactcaagagccagttacaggcccagaccaaggctttcgagttcctgaaccactcagtgaccatgttggagaaggagagctgcttgcagcaaatcaagattcagcagcttgaagaggtgctgagccccacaggccgccagggagagaaggaggagcacaagtggggcatggagcagggccggcaggagctgtatggggccctgacccaaggccttcaggggctggagaagaccctgcgtgacagtgaggagatgcagcgggcccgcaccactcgctgcctgcagctgctggcccaggagatccgggacagcaagaagttcctgtgggaggagctggaactggtgcgggaggaggtgaccttcatctatcagaagctccaagcgcaggaggatgagatctcagagaacttggtgaacattcagaaaatgcagaaaacgcaggtgaaatgccgcaaaggcctgtcccaaggcctcgagcctaagaggccacaaggggcaccagtgcctgagccctccactcccctcctgggactctgactccgactctgaccaggacctctcccagccacctttcagcaagagcggccgctccttcccacccggtgcagatcctccccagtccccccctccacccatttccctcctgacctgcccttgactcccacagtctagaccctcagaacaggcccagatcctgatctgggcatgcggtccctgacctgcagccccggagtcccctggacctggccaggccctgacccaccctctctctccacagcttgagcagccgggactgctctccctgaagacccctccagagagaaaataaactagcccagaccctcctctagccccgactgttagtcttgctgcttcctgtgcctaggaatccccctgccctcctagtttacccctcattgttgggggggaggggtgtagagaccccaggggtcattcgggatgtgtgggcttggaatcaggggacatctgaagccagatttaatatatgacaaggcaaggagtcattctgtccagacacgagcagccagacagacttccacactggccacagagccttcctttctggggggccctggcgaatggggaaactgaggcccagagagggagaggcgcggcccagggacatactctgaagcccctccctcctattaccctcggagccccgcccaccccagggtcctccctctctacttccattcttggttccttcctacaatcgatgctaacacgccccgcctccaagatcacggaggccccgcccca

SEQ ID NO: 278035 - DNA, 2308 bp, Homo sapiens
agcagctagcagggagatgctgggggatagacagggctgctggggactgttgtacaggctgtgcactgctcaagggtatccagagcccagctttgtatctaccaggaagaaggggctcccctcccctcccttcctcttccctcccctctcctttcctctcctctcctttcctttcctttttttttttttttttgagatggagtcttgctttgtcgccctggctggagtgcaatggcatgatctcggctcactgcaacctctgcctcctcggttcaagcaattctcctgcctcagcctcctgagtagctggaattacaggtgcacaccaccacgcctggctaatttttttgtatttttagtagagacggggtttcaccatgttggtcaggctggtcttgaactcctgacctcgtgatccgcccacctcggcctcccaaagtgttgggattacaggcgtgagccaccatgcctagcctttttttttccccccctggaaaaggtgtagccataggcgctgactgaggtcctgggaacaagtctccagagggcagtggcactcaaacccacgtacctggctggcctcccagaatgtgagctgagcccaagcatgctgtgaagccaagatgcagaggttgatgaaggcacagcccatggagatgtggaagtagaaggggaagagtttgctctgcactagtccgaagggatccagttctgacagccaagaccactcctctcataaaataataccggatattaggtgaagatcccgaaagccccgaggaaaccctaaatctcatcctgaggacaccgatcccaccaaagccccgaggaaacgccaaatctcatcccgaggacaccgatcccaccgttaggaaccgggacctcaatccgcagcacccggattccgagaacagaggcgtcggggccaaatgggctgaatctggtacctcactcccacgcccccgggtggacagcgaccctcctcggccgcgtcccctcgtgggtttcccccaaccaataattcgtcccgcctcccagctgagcccgaagccaatcgggtcgtagatctgcacctttctatcccgccctcctgggtattgactaatcgtagaaacccccctgggatcccgccccctccacgggcttttatccaattacgccgcggctactaagcgcagctgaagcgtgaaggcgccaatgaggccttcggctactccggcaggggcggaactaaaatgccggccacacccctctctgtgactcagtctctgagcgttttaatacgatggtgtccccgcgggatcaaacttcagcgtcacagctgaggactggcttcgtggtccctgatgggagagcatgaacaggtggtatgtgaagcccttggagaccagctcttccaaagtcaaagccaagaccattgtgatgattcccgactcccagaagctcctgcgatgtgaacttgagtcactcaagagccagttacaggcccagaccaaggctttcgagttcctgaaccactcagtgaccatgttggagaaggagagctgcttgcagcaaatcaagattcagcagcttgaagaggtgctgagccccacaggccgccagggagagaaggaggagcacaagtggggcatggagcagggccggcaggagctgtatggggccctgacccaaggccttcaggggctggagaagaccctgcgtgacagtgaggagatgcagcgggcccgcaccactcgctgcctgcagctgctggcccaggagatccgggacagatcctgaccaagatgaagcagcagggtcatgagacagccgcctgtccggagactgaagagataccgcagggagccagtggctgctggaaggatgacctccagaaggaactgagtgatatatggtgatgcccagcctgcagtctgacccctgaccctcctctgaacccgttcccccaacgggatctggcagtgaccaccagaacctggagcccacctgagtccagacttccctcaccccctaggactcaccccaccacggcccccaaccttagctgtactgctgtctacaccctgagcagtgtggagtctcccagcgcccccagctccttgtcttcttgcaggtctgctgtgcacgtgctgcagaactccatagacagcctcactttgtgctcgggggcctgtcccaaggcctcgagcctaagagccacaggggcaccatgcctgacccttcactccctccggggctttgattccaatgtgaccagaaccttcccagccccttttagcagagcgggcgttcttcccacccgttg

SEQ ID NO: 278036 - DNA, 2440 bp, Homo sapiens
agcagctagcagggagatgctgggggatagacagggctgctggggactgttgtacaggctgtgcactgctcaagggtatccagagcccagctttgtatctaccaggaagaaggggctcccctcccctcccttcctcttccctcccctctcctttcctctcctctcctttcctttcctttttttttttttttttgagatggagtcttgctttgtcgccctggctggagtgcaatggcatgatctcggctcactgcaacctctgcctcctcggttcaagcaattctcctgcctcagcctcctgagtagctggaattacaggtgcacaccaccacgcctggctaatttttttgtatttttagtagagacggggtttcaccatgttggtcaggctggtcttgaactcctgacctcgtgatccgcccacctcggcctcccaaagtgttgggattacaggcgtgagccaccatgcctagcctttttttttccccccctggaaaaggtgtagccataggcgctgactgaggtcctgggaacaagtctccagagggcagtggcactcaaacccacgtacctggctggcctcccagaatgtgagctgagcccaagcatgctgtgaagccaagatgcagaggttgatgaaggcacagcccatggagatgtggaagtagaaggggaagagtttgctctgcactagtccgaagggatccagttctgacagccaagaccactcctctcataaaataataccggatattaggtgaagatcccgaaagccccgaggaaaccctaaatctcatcctgaggacaccgatcccaccaaagccccgaggaaacgccaaatctcatcccgaggacaccgatcccaccgttaggaaccgggacctcaatccgcagcacccggattccgagaacagaggcgtcggggccaaatgggctgaatctggtacctcactcccacgcccccgggtggacagcgaccctcctcggccgcgtcccctcgtgggtttcccccaaccaataattcgtcccgcctcccagctgagcccgaagccaatcgggtcgtagatctgcacctttctatcccgccctcctgggtattgactaatcgtagaaacccccctgggatcccgccccctccacgggcttttatccaattacgccgcggctactaagcgcagctgaagcgtgaaggcgccaatgaggccttcggctactccggcaggggcggaactaaaatgccggccacacccctctctgtgactcagtctctgagcgttttaatacgatggtgtccccgcgggatcaaacttcagcgtcacagctgaggactggcttcgtggtccctgatgggagagcatgaacaggtggtatgtgaagcccttggagaccagctcttccaaagtcaaagccaagaccattgtgatgattcccgactcccagaagctcctgcgatgtgaacttgagtcactcaagagccagttacaggcccagaccaaggctttcgagttcctgaaccactcaggaaggatgacctccagaaggaactgagtgatatatggtctgctgtgcacgtgctgcagaactccatagacagcctcactttgtgctcgggggcctgtcccaaggcctcgagcctaagaggccacaaggggcaccagtgcctgagccctccactcccctcctgggactctgactccgactctgaccaggacctctcccagccacctttcagcaagagcggccgctccttcccacccggtgcagatcctccccagtccccccctccacccatttccctcctgacctgcccttgactcccacagtctagaccctcagaacaggcccagatcctgatctgggcatgcggtccctgacctgcagccccggagtcccctggacctggccaggccctgacccaccctctctctccacagcttgagcagccgggactgctctccctgaagacccctccagagagaaaataaactagcccagaccctcctctagccccgactgttagtcttgctgcttcctgtgcctaggaatccccctgccctcctagtttacccctcattgttgggggggaggggtgtagagaccccaggggtcattcgggatgtgtgggcttggaatcaggggacatctgaagccagatttaatatatgacaaggcaaggagtcattctgtccagacacgagcagccagacagacttccacactggccacagagccttcctttctggggggccctggcgaatggggaaactgaggcccagagagggagaggcgcggcccagggacatactctgaagcccctccctcctattaccctcggagccccgcccaccccagggtcctccctctctacttccattcttggttccttcctacaatcgatgctaacacgccccgcctccaagatcacggaggccccgcccca

SEQ ID NO: 278037 - DNA, 2397 bp, Homo sapiens
agcagctagcagggagatgctgggggatagacagggctgctggggactgttgtacaggctgtgcactgctcaagggtatccagagcccagctttgtatctaccaggaagaaggggctcccctcccctcccttcctcttccctcccctctcctttcctctcctctcctttcctttcctttttttttttttttttgagatggagtcttgctttgtcgccctggctggagtgcaatggcatgatctcggctcactgcaacctctgcctcctcggttcaagcaattctcctgcctcagcctcctgagtagctggaattacaggtgcacaccaccacgcctggctaatttttttgtatttttagtagagacggggtttcaccatgttggtcaggctggtcttgaactcctgacctcgtgatccgcccacctcggcctcccaaagtgttgggattacaggcgtgagccaccatgcctagcctttttttttccccccctggaaaaggtgtagccataggcgctgactgaggtcctgggaacaagtctccagagggcagtggcactcaaacccacgtacctggctggcctcccagaatgtgagctgagcccaagcatgctgtgaagccaagatgcagaggttgatgaaggcacagcccatggagatgtggaagtagaaggggaagagtttgctctgcactagtccgaagggatccagttctgacagccaagaccactcctctcataaaataataccggatattaggtgaagatcccgaaagccccgaggaaaccctaaatctcatcctgaggacaccgatcccaccaaagccccgaggaaacgccaaatctcatcccgaggacaccgatcccaccgttaggaaccgggacctcaatccgcagcacccggattccgagaacagaggcgtcggggccaaatgggctgaatctggtacctcactcccacgcccccgggtggacagcgaccctcctcggccgcgtcccctcgtgggtttcccccaaccaataattcgtcccgcctcccagctgagcccgaagccaatcgggtcgtagatctgcacctttctatcccgccctcctgggtattgactaatcgtagaaacccccctgggatcccgccccctccacgggcttttatccaattacgccgcggctactaagcgcagctgaagcgtgaaggcgccaatgaggccttcggctactccggcaggggcggaactaaaatgccggccacacccctctctgtgactcagtctctgagcgttttaatacgatggtgtccccgcgggatcaaacttcagcgtcacagctgaggactggcttcgtggtccctgatgggagagcatgaacaggtggtatgtgaagcccttggagaccagctcttccaaagtcaaagccaagaccattgtgatgattcccgactcccagaagctcctgcgatgtgaacttgagtcactcaagagccaggaaggatgacctccagaaggaactgagtgatatatggtctgctgtgcacgtgctgcagaactccatagacagcctcactttgtgctcgggggcctgtcccaaggcctcgagcctaagaggccacaaggggcaccagtgcctgagccctccactcccctcctgggactctgactccgactctgaccaggacctctcccagccacctttcagcaagagcggccgctccttcccacccggtgcagatcctccccagtccccccctccacccatttccctcctgacctgcccttgactcccacagtctagaccctcagaacaggcccagatcctgatctgggcatgcggtccctgacctgcagccccggagtcccctggacctggccaggccctgacccaccctctctctccacagcttgagcagccgggactgctctccctgaagacccctccagagagaaaataaactagcccagaccctcctctagccccgactgttagtcttgctgcttcctgtgcctaggaatccccctgccctcctagtttacccctcattgttgggggggaggggtgtagagaccccaggggtcattcgggatgtgtgggcttggaatcaggggacatctgaagccagatttaatatatgacaaggcaaggagtcattctgtccagacacgagcagccagacagacttccacactggccacagagccttcctttctggggggccctggcgaatggggaaactgaggcccagagagggagaggcgcggcccagggacatactctgaagcccctccctcctattaccctcggagccccgcccaccccagggtcctccctctctacttccattcttggttccttcctacaatcgatgctaacacgccccgcctccaagatcacggaggccccgcccca

SEQ ID NO: 278038 - DNA, 2924 bp, Homo sapiens
agcagctagcagggagatgctgggggatagacagggctgctggggactgttgtacaggctgtgcactgctcaagggtatccagagcccagctttgtatctaccaggaagaaggggctcccctcccctcccttcctcttccctcccctctcctttcctctcctctcctttcctttcctttttttttttttttttgagatggagtcttgctttgtcgccctggctggagtgcaatggcatgatctcggctcactgcaacctctgcctcctcggttcaagcaattctcctgcctcagcctcctgagtagctggaattacaggtgcacaccaccacgcctggctaatttttttgtatttttagtagagacggggtttcaccatgttggtcaggctggtcttgaactcctgacctcgtgatccgcccacctcggcctcccaaagtgttgggattacaggcgtgagccaccatgcctagcctttttttttccccccctggaaaaggtgtagccataggcgctgactgaggtcctgggaacaagtctccagagggcagtggcactcaaacccacgtacctggctggcctcccagaatgtgagctgagcccaagcatgctgtgaagccaagatgcagaggttgatgaaggcacagcccatggagatgtggaagtagaaggggaagagtttgctctgcactagtccgaagggatccagttctgacagccaagaccactcctctcataaaataataccggatattaggtgaagatcccgaaagccccgaggaaaccctaaatctcatcctgaggacaccgatcccaccaaagccccgaggaaacgccaaatctcatcccgaggacaccgatcccaccgttaggaaccgggacctcaatccgcagcacccggattccgagaacagaggcgtcggggccaaatgggctgaatctggtacctcactcccacgcccccgggtggacagcgaccctcctcggccgcgtcccctcgtgggtttcccccaaccaataattcgtcccgcctcccagctgagcccgaagccaatcgggtcgtagatctgcacctttctatcccgccctcctgggtattgactaatcgtagaaacccccctgggatcccgccccctccacgggcttttatccaattacgccgcggctactaagcgcagctgaagcgtgaaggcgccaatgaggccttcggctactccggcaggggcggaactaaaatgccggccacacccctctctgtgactcagtctctgagcgttttaatacgatggtgtccccgcgggatcaaacttcagcgtcacagctgaggactggcttcgtggtccctgatgggagagcatgaacaggtggtatgtgaagcccttggagaccagctcttccaaagtcaaagccaagaccattgtgatgattcccgactcccagaagctcctgcgatgtgaacttgagtcactcaagagccagttacaggcccagaccaaggctttcgagttcctgaaccactcagtgaccatgttggagaaggagagctgcttgcagcaaatcaagattcagcagcttgaagaggtgctgagccccacaggccgccagggagagaaggaggagcacaagtggggcatggagcagggccggcaggagctgtatggggccctgacccaaggccttcaggggctggagaagaccctgcgtgacagtgaggagatgcagcgggcccgcaccactcgctgcctgcagctgctggcccaggagatccgggacagcaagaagttcctgtgggaggagctggaactggtgcgggaggaggtgaccttcatctatcagaagctccaagcgcaggaggatgagatctcagagaacttggtgaacattcagaaaatgcagaaaacgcaggtgaaatgccgcaaaatcctgaccaagatgaagcagcagggtcatgagacagccgcctgtccggagactgaagagataccgcagggagccagtggctgctggaaggatgacctccagaaggaactgagtgatatatggtctgctgtgcacgtgctgcagaactccatagacagcctcactttgtgctcgggggcctgtcccaaggcctcgagcctaagaggccacaaggggcaccagtgcctgagccctccactcccctcctgggactctgactccgactctgaccaggacctctcccagccacctttcagcaagagcggccgctccttcccacccggtgcagatcctccccagtccccccctccacccatttccctcctgacctgcccttgactcccacagtctagaccctcagaacaggcccagatcctgatctgggcatgcggtccctgacctgcagccccggagtcccctggacctggccaggccctgacccaccctctctctccacagcttgagcagccgggactgctctccctgaagacccctccagagagaaaataaactagcccagaccctcctctagccccgactgttagtcttgctgcttcctgtgcctaggaatccccctgccctcctagtttacccctcattgttgggggggaggggtgtagagaccccaggggtcattcgggatgtgtgggcttggaatcaggggacatctgaagccagatttaatatatgacaaggcaaggagtcattctgtccagacacgagcagccagacagacttccacactggccacagagccttcctttctggggggccctggcgaatggggaaactgaggcccagagagggagaggcgcggcccagggacatactctgaagcccctccctcctattaccctcggagccccgcccaccccagggtcctccctctctacttccattcttggttccttcctacaatcgatgctaacacgccccgcctccaagatcacggaggccccgcccca

SEQ ID NO: 278039 - DNA, 2998 bp, Homo sapiens
agcagctagcagggagatgctgggggatagacagggctgctggggactgttgtacaggctgtgcactgctcaagggtatccagagcccagctttgtatctaccaggaagaaggggctcccctcccctcccttcctcttccctcccctctcctttcctctcctctcctttcctttcctttttttttttttttttgagatggagtcttgctttgtcgccctggctggagtgcaatggcatgatctcggctcactgcaacctctgcctcctcggttcaagcaattctcctgcctcagcctcctgagtagctggaattacaggtgcacaccaccacgcctggctaatttttttgtatttttagtagagacggggtttcaccatgttggtcaggctggtcttgaactcctgacctcgtgatccgcccacctcggcctcccaaagtgttgggattacaggcgtgagccaccatgcctagcctttttttttccccccctggaaaaggtgtagccataggcgctgactgaggtcctgggaacaagtctccagagggcagtggcactcaaacccacgtacctggctggcctcccagaatgtgagctgagcccaagcatgctgtgaagccaagatgcagaggttgatgaaggcacagcccatggagatgtggaagtagaaggggaagagtttgctctgcactagtccgaagggatccagttctgacagccaagaccactcctctcataaaataataccggatattaggtgaagatcccgaaagccccgaggaaaccctaaatctcatcctgaggacaccgatcccaccaaagccccgaggaaacgccaaatctcatcccgaggacaccgatcccaccgttaggaaccgggacctcaatccgcagcacccggattccgagaacagaggcgtcggggccaaatgggctgaatctggtacctcactcccacgcccccgggtggacagcgaccctcctcggccgcgtcccctcgtgggtttcccccaaccaataattcgtcccgcctcccagctgagcccgaagccaatcgggtcgtagatctgcacctttctatcccgccctcctgggtattgactaatcgtagaaacccccctgggatcccgccccctccacgggcttttatccaattacgccgcggctactaagcgcagctgaagcgtgaaggcgccaatgaggccttcggctactccggcaggggcggaactaaaatgccggccacacccctctctgtgactcagtctctgagcgttttaatacgatggtgtccccgcgggatcaaacttcagcgtcacagctgaggactggcttcgtggtccctgatgggagagcatgaacaggtggtatgtgaagcccttggagaccagctcttccaaagtcaaagccaagaccattgtgatgattcccgactcccagaagctcctgcgatgtgaacttgagtcactcaagagccagttacaggcccagaccaaggctttcgagttcctgaaccactcagtgaccatgttggagaaggagagctgcttgcagcaaatcaagattcagcagcttgaagaggtgctgagccccacaggccgccagggagagaaggaggagcacaagtggggcatggagcagggccggcaggagctgtatggggccctgacccaaggccttcaggggctggagaagaccctgcgtgacagtgaggagatgcagcgggcccgcaccactcgctgcctgcagctgctggcccaggagatccgggacagatcctgaccaagatgaagcagcagggtcatgagacagccgcctgtccggagactgaagagataccgcagggagccagtggctgctggaaggatgacctccagaaggaactgagtgatatatggtgatgcccagcctgcagtctgacccctgaccctcctctgaacccgttcccccaacgggatctggcagtgaccaccagaacctggagcccacctgagtccagacttccctcaccccctaggactcaccccaccacggcccccaaccttagctgtactgctgtctacaccctgagcagtgtggagtctcccagcgcccccagctccttgtcttcttgcaggtctgctgtgcacgtgctgcagaactccatagacagcctcactttgtgctcgggggcctgtcccaaggcctcgagcctaagaggccacaaggggcaccagtgcctgagccctccactcccctcctgggactctgactccgactctgaccaggacctctcccagccacctttcagcaagagcggccgctccttcccacccggtgcagatcctccccagtccccccctccacccatttccctcctgacctgcccttgactcccacagtctagaccctcagaacaggcccagatcctgatctgggcatgcggtccctgacctgcagccccggagtcccctggacctggccaggccctgacccaccctctctctccacagcttgagcagccgggactgctctccctgaagacccctccagagagaaaataaactagcccagaccctcctctagccccgactgttagtcttgctgcttcctgtgcctaggaatccccctgccctcctagtttacccctcattgttgggggggaggggtgtagagaccccaggggtcattcgggatgtgtgggcttggaatcaggggacatctgaagccagatttaatatatgacaaggcaaggagtcattctgtccagacacgagcagccagacagacttccacactggccacagagccttcctttctggggggccctggcgaatggggaaactgaggcccagagagggagaggcgcggcccagggacatactctgaagcccctccctcctattaccctcggagccccgcccaccccagggtcctccctctctacttccattcttggttccttcctacaatcgatgctaacacgccccgcctccaagatcacggaggccccgcccca

SEQ ID NO: 278040 - DNA, 3349 bp, Homo sapiens
agcagctagcagggagatgctgggggatagacagggctgctggggactgttgtacaggctgtgcactgctcaagggtatccagagcccagctttgtatctaccaggaagaaggggctcccctcccctcccttcctcttccctcccctctcctttcctctcctctcctttcctttcctttttttttttttttttgagatggagtcttgctttgtcgccctggctggagtgcaatggcatgatctcggctcactgcaacctctgcctcctcggttcaagcaattctcctgcctcagcctcctgagtagctggaattacaggtgcacaccaccacgcctggctaatttttttgtatttttagtagagacggggtttcaccatgttggtcaggctggtcttgaactcctgacctcgtgatccgcccacctcggcctcccaaagtgttgggattacaggcgtgagccaccatgcctagcctttttttttccccccctggaaaaggtgtagccataggcgctgactgaggtcctgggaacaagtctccagagggcagtggcactcaaacccacgtacctggctggcctcccagaatgtgagctgagcccaagcatgctgtgaagccaagatgcagaggttgatgaaggcacagcccatggagatgtggaagtagaaggggaagagtttgctctgcactagtccgaagggatccagttctgacagccaagaccactcctctcataaaataataccggatattaggtgaagatcccgaaagccccgaggaaaccctaaatctcatcctgaggacaccgatcccaccaaagccccgaggaaacgccaaatctcatcccgaggacaccgatcccaccgttaggaaccgggacctcaatccgcagcacccggattccgagaacagaggcgtcggggccaaatgggctgaatctggtacctcactcccacgcccccgggtggacagcgaccctcctcggccgcgtcccctcgtgggtttcccccaaccaataattcgtcccgcctcccagctgagcccgaagccaatcgggtcgtagatctgcacctttctatcccgccctcctgggtattgactaatcgtagaaacccccctgggatcccgccccctccacgggcttttatccaattacgccgcggctactaagcgcagctgaagcgtgaaggcgccaatgaggccttcggctactccggcaggggcggaactaaaatgccggccacacccctctctgtgactcagtctctgagcgttttaatacgatggtgtccccgcgggatcaaacttcagcgtcacagctgaggactggcttcgtggtccctgatgggagagcatgaacaggtggtatgtggctcttcctcggacaaggctctggaagcgtacagctcactggtccaggactccagagccagagaccttgggatgccctgcttctggggacacagtgaggactgcagactgcaggccagggtggggctcagggccttcgccacatgaggctgccccctcccccagtccagacctgcagaagcagtgctgtaatgaccaggacattttgaagaggcatcacaacgtagctaaggtcacccccacccgggaaaccccttcaatgcagaaaaccactgcaatctactgctgtggggcttagggaaggggctgtaaggcagagagactcccatgaatgcacccactgtgtttcttcagcacctagaacagcacctggcactcagcaggccctggctaagcaagtcttaaatgaatggatgaaggaatgaatggaaggaaagagtgtggttgtgtgtcttccatggggatttggctgtgatcgtctctcagccacataagtgcacttctgagcatatgtagcccaagggggaggtgcatgaatatgcctggagtgcagctttgcctgcacttacggtttgggacacctagaactgaggagatccaactcttgtccagccctcaaaactgggttgaggtgagcaaggaggcagctcagggacaaatttctactcccatctcatctctcttccttagaagcccttggagaccagctcttccaaagtcaaagccaagaccattgtgatgattcccgactcccagaagctcctgcgatgtgaacttgagtcactcaagagccagttacaggcccagaccaaggctttcgagttcctgaaccactcagtgaccatgttggagaaggagagctgcttgcagcaaatcaagattcagcagcttgaagaagcgcaggaggatgagatctcagagaacttggtgaacattcagaaaatgcagaaaacgcaggtgaaatgccgcaaaatcctgaccaagatgaagcagcagggtcatgagacagccgcctgtccggagactgaagagataccgcagggagccagtggctgctggaaggatgacctccagaaggaactgagtgatatatggtctgctgtgcacgtgctgcagaactccatagacagcctcactttgtgctcgggggcctgtcccaaggcctcgagcctaagaggccacaaggggcaccagtgcctgagccctccactcccctcctgggactctgactccgactctgaccaggacctctcccagccacctttcagcaagagcggccgctccttcccacccggtgcagatcctccccagtccccccctccacccatttccctcctgacctgcccttgactcccacagtctagaccctcagaacaggcccagatcctgatctgggcatgcggtccctgacctgcagccccggagtcccctggacctggccaggccctgacccaccctctctctccacagcttgagcagccgggactgctctccctgaagacccctccagagagaaaataaactagcccagaccctcctctagccccgactgttagtcttgctgcttcctgtgcctaggaatccccctgccctcctagtttacccctcattgttgggggggaggggtgtagagaccccaggggtcattcgggatgtgtgggcttggaatcaggggacatctgaagccagatttaatatatgacaaggcaaggagtcattctgtccagacacgagcagccagacagacttccacactggccacagagccttcctttctggggggccctggcgaatggggaaactgaggcccagagagggagaggcgcggcccagggacatactctgaagcccctccctcctattaccctcggagccccgcccaccccagggtcctccctctctacttccattcttggttccttcctacaatcgatgctaacacgccccgcctccaagatcacggaggccccgcccca

SEQ ID NO: 278041 - DNA, 2632 bp, Homo sapiens
agcagctagcagggagatgctgggggatagacagggctgctggggactgttgtacaggctgtgcactgctcaagggtatccagagcccagctttgtatctaccaggaagaaggggctcccctcccctcccttcctcttccctcccctctcctttcctctcctctcctttcctttcctttttttttttttttttgagatggagtcttgctttgtcgccctggctggagtgcaatggcatgatctcggctcactgcaacctctgcctcctcggttcaagcaattctcctgcctcagcctcctgagtagctggaattacaggtgcacaccaccacgcctggctaatttttttgtatttttagtagagacggggtttcaccatgttggtcaggctggtcttgaactcctgacctcgtgatccgcccacctcggcctcccaaagtgttgggattacaggcgtgagccaccatgcctagcctttttttttccccccctggaaaaggtgtagccataggcgctgactgaggtcctgggaacaagtctccagagggcagtggcactcaaacccacgtacctggctggcctcccagaatgtgagctgagcccaagcatgctgtgaagccaagatgcagaggttgatgaaggcacagcccatggagatgtggaagtagaaggggaagagtttgctctgcactagtccgaagggatccagttctgacagccaagaccactcctctcataaaataataccggatattaggtgaagatcccgaaagccccgaggaaaccctaaatctcatcctgaggacaccgatcccaccaaagccccgaggaaacgccaaatctcatcccgaggacaccgatcccaccgttaggaaccgggacctcaatccgcagcacccggattccgagaacagaggcgtcggggccaaatgggctgaatctggtacctcactcccacgcccccgggtggacagcgaccctcctcggccgcgtcccctcgtgggtttcccccaaccaataattcgtcccgcctcccagctgagcccgaagccaatcgggtcgtagatctgcacctttctatcccgccctcctgggtattgactaatcgtagaaacccccctgggatcccgccccctccacgggcttttatccaattacgccgcggctactaagcgcagctgaagcgtgaaggcgccaatgaggccttcggctactccggcaggggcggaactaaaatgccggccacacccctctctgtgactcagtctctgagcgttttaatacgatggtgtccccgcgggatcaaacttcagcgtcacagctgaggactggcttcgtggtccctgatgggagagcatgaacaggtggtatgtgaagcccttggagaccagctcttccaaagtcaaagccaagaccattgtgatgattcccgactcccagaagctcctgcgatgtgaacttgagtcactcaagagccagttacaggcccagaccaaggctttcgagttcctgaaccactcagtgaccatgttggagaaggagagctgcttgcagcaaatcaagattcagcagcttgaagaggtgctgagccccacaggccgccagggagagaaggaggagcacaagtggggcatggagcagggccggcaggagctgtatggggccctgacccaaggccttcaggggctggagaagaccctgcgtgacagtgagggaaggatgacctccagaaggaactgagtgatatatggtctgctgtgcacgtgctgcagaactccatagacagcctcactttgtgctcgggggcctgtcccaaggcctcgagcctaagaggccacaaggggcaccagtgcctgagccctccactcccctcctgggactctgactccgactctgaccaggacctctcccagccacctttcagcaagagcggccgctccttcccacccggtgcagatcctccccagtccccccctccacccatttccctcctgacctgcccttgactcccacagtctagaccctcagaacaggcccagatcctgatctgggcatgcggtccctgacctgcagccccggagtcccctggacctggccaggccctgacccaccctctctctccacagcttgagcagccgggactgctctccctgaagacccctccagagagaaaataaactagcccagaccctcctctagccccgactgttagtcttgctgcttcctgtgcctaggaatccccctgccctcctagtttacccctcattgttgggggggaggggtgtagagaccccaggggtcattcgggatgtgtgggcttggaatcaggggacatctgaagccagatttaatatatgacaaggcaaggagtcattctgtccagacacgagcagccagacagacttccacactggccacagagccttcctttctggggggccctggcgaatggggaaactgaggcccagagagggagaggcgcggcccagggacatactctgaagcccctccctcctattaccctcggagccccgcccaccccagggtcctccctctctacttccattcttggttccttcctacaatcgatgctaacacgccccgcctccaagatcacggaggccccgcccca

SEQ ID NO: 278042 - DNA, 3086 bp, Homo sapiens
agcagctagcagggagatgctgggggatagacagggctgctggggactgttgtacaggctgtgcactgctcaagggtatccagagcccagctttgtatctaccaggaagaaggggctcccctcccctcccttcctcttccctcccctctcctttcctctcctctcctttcctttcctttttttttttttttttgagatggagtcttgctttgtcgccctggctggagtgcaatggcatgatctcggctcactgcaacctctgcctcctcggttcaagcaattctcctgcctcagcctcctgagtagctggaattacaggtgcacaccaccacgcctggctaatttttttgtatttttagtagagacggggtttcaccatgttggtcaggctggtcttgaactcctgacctcgtgatccgcccacctcggcctcccaaagtgttgggattacaggcgtgagccaccatgcctagcctttttttttccccccctggaaaaggtgtagccataggcgctgactgaggtcctgggaacaagtctccagagggcagtggcactcaaacccacgtacctggctggcctcccagaatgtgagctgagcccaagcatgctgtgaagccaagatgcagaggttgatgaaggcacagcccatggagatgtggaagtagaaggggaagagtttgctctgcactagtccgaagggatccagttctgacagccaagaccactcctctcataaaataataccggatattaggtgaagatcccgaaagccccgaggaaaccctaaatctcatcctgaggacaccgatcccaccaaagccccgaggaaacgccaaatctcatcccgaggacaccgatcccaccgttaggaaccgggacctcaatccgcagcacccggattccgagaacagaggcgtcggggccaaatgggctgaatctggtacctcactcccacgcccccgggtggacagcgaccctcctcggccgcgtcccctcgtgggtttcccccaaccaataattcgtcccgcctcccagctgagcccgaagccaatcgggtcgtagatctgcacctttctatcccgccctcctgggtattgactaatcgtagaaacccccctgggatcccgccccctccacgggcttttatccaattacgccgcggctactaagcgcagctgaagcgtgaaggcgccaatgaggccttcggctactccggcaggggcggaactaaaatgccggccacacccctctctgtgactcagtctctgagcgttttaatacgatggtgtccccgcgggatcaaacttcagcgtcacagctgaggactggcttcgtggtccctgatgggagagcatgaacaggtggtatgtggctcttcctcggacaaggctctggaagcgtacagctcactggtccaggactccagagccagagaccttgggatgccctgcttctggggacacagtgaggactgcagactgcaggccagggtggggctcagggccttcgccacatgaggctgccccctcccccagtccagacctgcagaagcagtgctgtaatgaccaggacattttgaagaggcatcacaacgtagctaaggtcacccccacccgggaaaccccttcaatgcagaaaaccactgcaatctactgctgtggggcttagggaaggggctgtaaggcagagagactcccatgaatgcacccactgtgtttcttcagcacctagaacagcacctggcactcagcaggccctggctaagcaagtcttaaatgaatggatgaaggaatgaatggaaggaaagagtgtggttgtgtgtcttccatggggatttggctgtgatcgtctctcagccacataagtgcacttctgagcatatgtagcccaagggggaggtgcatgaatatgcctggagtgcagctttgcctgcacttacggtttgggacacctagaactgaggagatccaactcttgtccagccctcaaaactgggttgaggtgagcaaggaggcagctcagggacaaatttctactcccatctcatctctcttccttagaagcccttggagaccagctcttccaaagtcaaagccaagaccattgtgatgattcccgactcccagaagctcctgcgatgtgaacttgagtcactcaagagccaggaaggatgacctccagaaggaactgagtgatatatggtctgctgtgcacgtgctgcagaactccatagacagcctcactttgtgctcgggggcctgtcccaaggcctcgagcctaagaggccacaaggggcaccagtgcctgagccctccactcccctcctgggactctgactccgactctgaccaggacctctcccagccacctttcagcaagagcggccgctccttcccacccggtgcagatcctccccagtccccccctccacccatttccctcctgacctgcccttgactcccacagtctagaccctcagaacaggcccagatcctgatctgggcatgcggtccctgacctgcagccccggagtcccctggacctggccaggccctgacccaccctctctctccacagcttgagcagccgggactgctctccctgaagacccctccagagagaaaataaactagcccagaccctcctctagccccgactgttagtcttgctgcttcctgtgcctaggaatccccctgccctcctagtttacccctcattgttgggggggaggggtgtagagaccccaggggtcattcgggatgtgtgggcttggaatcaggggacatctgaagccagatttaatatatgacaaggcaaggagtcattctgtccagacacgagcagccagacagacttccacactggccacagagccttcctttctggggggccctggcgaatggggaaactgaggcccagagagggagaggcgcggcccagggacatactctgaagcccctccctcctattaccctcggagccccgcccaccccagggtcctccctctctacttccattcttggttccttcctacaatcgatgctaacacgccccgcctccaagatcacggaggccccgcccca

SEQ ID NO: 278043 - DNA, 1043 bp, Homo sapiens
gcaggggaggcaaagaggctcagacaaggaatctggagttcaatgacgggagacgcacagggcagagcgaaaggtagggtggcgggagcagggtcccggacactcaccggtcatgctgccagtctgggtgctgactgaccgcccggccctcgcgctctccagattttgcatctgcccagcttctttcatcccaaacctagcgtcctctgctgccaaggaaacctctcccagtcagacatgatctcggccctagcgcccccgcctctcgcctcctctcagcaactgtaaggcaacggcccactaggcgcagccagatgacgcctcaagcttgaccgccacttcagggctcctcgtgtgacgtcatagagaggcggggctttggcgccagagggctgcccctcggccggtgaccgagttaagcaccgagctgtaaatcgcttgagacctgtatttggttgttttgttggttttgccaagtaaggtcacttgaggatttcttggctcgaggtcccaggttgcgcagactctgactgcatcgagttgagaattttggtcagaatgttaaagtggaaacctaccccaggctgtcatgacttttgcattctggtaaccaactgatcctacccggacccatgatgcataactcagctggtcctgtggcgcacacccagaggccgactcaatgcatgaagactgttttccacacccctatgatttcatccccaaccaagcagcagcatccattccctagccccctgcccaccaaattatccataaaaactctggcttctgagttctcagcaaaactgattttagtaataactccagttcttccacttggctggccttagttaattaaacttattctttactatagtaccgtgttcccagtgaattggttttgtctgtgtagcaggcaggacaacccatcaggcaatcacacagttactctgcagtgcttctttttattttgcttttcaaacaaatttcaaatattattagattgaaataaactatacaaatagcttttcctcacaaaaatg

SEQ ID NO: 278044 - DNA, 698 bp, Homo sapiens
aacgcgctgtgctcgcggccgtccggcccgtccggcagccccgggtcagcccggtgaactaagcggacccgggatggccgagccgggggccggcgttctgtgctccgtttgctcaccctgaccgtggcacccgcataagccgtctgtgtgttccagagaggccagccctgcatgtgctgtccgtgagcgtgcttggacctacgcataggacccagctgagcgggacatttacacgactgctggggtcgagggcagaacagggggaaactgtgttctggcggaggcacagcaccccgggagcacccagagcctgaagaacaccgggatgccgcagacaaagaagaagatgaagtaggggatgaagaaggctcctgcagaagagagagaggcagggctgagccacacccgggctcttcctcagcctccatcctttcagaccctcctcccccaacaaacccgccctccaccatcctgttcttaatctccctcctgacactttccaagggcccactcctgcctgcgtgcagtcctgagtgttaggcaggcacaggtgggaatgttctgatctgaaccctacacagaatgagaaaggccttggaagggaaattagtgaaaacttaggtggaaattctaatatatgcactatttattttcttagtgtgctttacaaatctagtcaatagattatttttggaata

SEQ ID NO: 278045 - DNA, 491 bp, Homo sapiens
tttgtcatgtgaacctccttcccatcatacacttgaagcccttttatattacatgattcggttagttggtagtaattgaaaaagccagattgggaattttaaagataatgcatacatatcttaaacattataattaaaagtatatccatttcaccaatcttttgatgtagtggtgagactgtttttgtgtctaagactgctgttcagagttcccaattctctttccagtattaactacacagggagtctcaaacctggctgtaccctgagaacttttaaaaactttggatgcctggaccccagtacagactattgaacctgaatgggaaggagggtggcctggtttttaagcttcccaggtaattctagtgtgcagtctgagagccactcaggcactttcatcatctttggtttcccgttttgctttatttaaagtgaagtatgaatttagacacttctgagtgcagagtacttttgagattaagtcccac

SEQ ID NO: 278046 - DNA, 453 bp, Homo sapiens
ccaacttgctcgagcagggctgggtagaccggcgcgctcccggggacggtggggggggcagtcccggtttcggccatcgctggggtgggctcggagcggccgcaccgggcagcaaccccactcccactcggaggccccctgccctctcccccacttccccccggcccatggtgcgaggctgggagccgccgcccgggctggactgcgttcggagccttctggactgcctgtgaaatggaggataggagaaacatttccttcccaggcccccccgccacacaaacccccaacccccacggctacctcctggcgacctcaacacacgtgcagaacctggccttgcttctggggatcagtggcctttgggaatgaaaggtttagaagaaactgcccctctgactcccgtacccagccatactaagagaaccaaccaggaaactgagaacctgagtc

SEQ ID NO: 278047 - DNA, 693 bp, Homo sapiens
ccaacttgctcgagcagggctgggtagaccggcgcgctcccggggacggtggggggggcagtcccggtttcggccatcgctggggtgggctcggagcggccgcaccgggcagcaaccccactcccactcggaggccccctgccctctcccccacttccccccggcccatggtgcgaggctgggagccgccgcccgggctggactgcgtattaactacacagggagtctcaaacctggctgtaccctgagaacttttaaaaactttggatgcctggaccccagtacagactattgaacctgaatgggaaggagggtggcctggtttttaagcttcccagttttacttgcttccaacaggaaggcaagttttcctccttccatgacgatgaaaggcaggtaactcctttatggaatttgagctggcttccaacagggaagatgaggttttttttcctgcctctagaatagtagagagcagtctacagcctgagacccatcactaggacacaattgaagaaactggtagttttaccaaggctttgactggaatggtgcactttcctataaggaatcaaacttgacttaagaagccaataaagcccttggaaaaactggcctcatattttgtgtacacagtccgtgtacagggtttctggcctgtggacatgagacttcacaacctgctaaaaatct

SEQ ID NO: 278048 - DNA, 1763 bp, Homo sapiens
agagcagaatcagcatgaggagcagacaccccaggagagctatctctgaagggcacaaatcagaaggcaccatgcctcctaataaagaggccagcggtctcagtagttcaccagcggggctcatctgcctccctccaatctctgaggagctacagcttgtgtggacgcaagcagcccagaccagtgagctagacagcaatgaacacctgctcaaaaccttcagctactttccctatcccagcctagcagacattgcccttctctgcctacgttatgggttgcagatggagaaagtcaagacttggtttatggcccagcgcctccgctgtggtattagctggtcatctgaagaaatagaagagactcgagcccgagtagtctaccgtcgggaccaactccatttcaaatcccttctctcttttactcatcatgcgggacggcccccagaggaggtgcctcctcctccagtgccagctccagagcaagttggtattggaataggtcctccaactcttagcaagcctacccagacgaaaggattgaaggtagagcctgaggagccctctcagatgccaccactgccacagagtcaccagaaattaaaggagtccctgatgacacctggcagtggagcattcccctaccaatcagatttttggcaacatcttcaaagcagtggcctctcaaaggagcaggcaggcaggggtcccaaccagtcacatggcataggtactgcttcctggaaccactccacaaccgtcccccagccacaagctcgggataaacccccaccaattgcattaattgccagtagttgtaaggaggagtcagcatctagtgttactccctcttcttcctctacctcttcttctttccaggtactggctaatggagctactgccgcctctaaacccctccagccactaggctgtgtcccacagtcagtgtcacccagtgaacaggcattacccccacatctggaaccagcctggccccaagggctacggcataactcagtaccaggtagagttggccccacagagtacctttccccagatatgcaacgccagcgaaagaccaagcgcaaaaccaaagagcagctggctatccttaaatccttttttttacagtgccagtgggcacggcgtgaggattaccaaaagttagaacagatcactggtttacctcggcctgagatcattcagtggtttggtgacacacgctatgccttgaagcatgggcaactaaagtggtttcgggacaacgcagtacctggtgcccctagtttccaagacccagcaattcctacaccaccaccatcaacccgctccttgaacgaaagggctgagacaccacctctgccgatccctccacccccaccggatatacaacccttggagaggtactgggcagcccaccaacagctacgggaaactgatatccctcaattgagtcaggcatcaaggcttagcacccagcaggtgctggattggtttgactctcgattacctcagccagctgaggtggtagtttgtctagatgaagaagaggaagaggaggaggaagaactgccagaagatgatgaggaagaggaggaggaggaggaagatgatgatgatgatgatgatgatgtgatcatacaagactgagtggggagctgggggaggggaggtctgttactgaaagatgaaccaacttagtaactgtttaaacaaagaaaccacatttttaaaattaccttgtggcagagaactaaaaaaaat

SEQ ID NO: 278049 - DNA, 1856 bp, Homo sapiens
ccaacttgctcgagcagggctgggtagaccggcgcgctcccggggacggtggggggggcagtcccggtttcggccatcgctggggtgggctcggagcggccgcaccgggcagcaaccccactcccactcggaggccccctgccctctcccccacttccccccggcccatggtgcgaggctgggagccgccgcccgggctggactgcgctatctctgaagggcacaaatcagaaggcaccatgcctcctaataaagaggccagcggtctcagtagttcaccagcggggctcatctgcctccctccaatctctgaggagctacagcttgtgtggacgcaagcagcccagaccagtgagctagacagcaatgaacacctgctcaaaaccttcagctactttccctatcccagcctagcagacattgcccttctctgcctacgttatgggttgcagatggagaaagtcaagacttggtttatggcccagcgcctccgctgtggtattagctggtcatctgaagaaatagaagagactcgagcccgagtagtctaccgtcgggaccaactccatttcaaatcccttctctcttttactcatcatgcgggacggcccccagaggaggtgcctcctcctccagtgccagctccagagcaagttggtattggaataggtcctccaactcttagcaagcctacccagacgaaaggattgaaggtagagcctgaggagccctctcagatgccaccactgccacagagtcaccagaaattaaaggagtccctgatgacacctggcagtggagcattcccctaccaatcagatttttggcaacatcttcaaagcagtggcctctcaaaggagcaggcaggcaggggtcccaaccagtcacatggcataggtactgcttcctggaaccactccacaaccgtcccccagccacaagctcgggataaacccccaccaattgcattaattgccagtagttgtaaggaggagtcagcatctagtgttactccctcttcttcctctacctcttcttctttccaggtactggctaatggagctactgccgcctctaaacccctccagccactaggctgtgtcccacagtcagtgtcacccagtgaacaggcattacccccacatctggaaccagcctggccccaagggctacggcataactcagtaccaggtagagttggccccacagagtacctttccccagatatgcaacgccagcgaaagaccaagcgcaaaaccaaagagcagctggctatccttaaatccttttttttacagtgccagtgggcacggcgtgaggattaccaaaagttagaacagatcactggtttacctcggcctgagatcattcagtggtttggtgacacacgctatgccttgaagcatgggcaactaaagtggtttcgggacaacgcagtacctggtgcccctagtttccaagacccagcaattcctacaccaccaccatcaacccgctccttgaacgaaagggctgagacaccacctctgccgatccctcaattgagtcaggcatcaaggcttagcacccagcaggtgctggattggtttgactctcgattacctcagccagctgaggtggtagtttgtctagatgaagaagaggaagaggaggaggaagaactgccagaagatgatgaggaagaggaggaggaggaggaagatgatgatgatgatgatgatgatgtgatcatacaagactgagtggggagctgggggaggggaggtctgttactgaaagatgaaccaacttagtaactgtttaaacaaagaaaccacatttttaaaattaccttgtggcagagaactaaaaaaaat

SEQ ID NO: 278050 - DNA, 754 bp, Homo sapiens
ccaacttgctcgagcagggctgggtagaccggcgcgctcccggggacggtggggggggcagtcccggtttcggccatcgctggggtgggctcggagcggccgcaccgggcagcaaccccactcccactcggaggccccctgccctctcccccacttccccccggcccatggtgcgaggctgggagccgccgcccgggctggactgcggtgagtgatccccagccccttggacttcccctcccagctcgtgtacggtctcccacctctggagccccatccccgcgctggtggggggataattctaggttcgaagtggcccggttctctcttttttctcctctggacttttcggttccctcccctgttgtaactaggggagggtgagtgtctgtgtaggggagggcaagaaggttgggttggggcgcccttggcgagagtaggattgagattcgcctgcctcatggggcttatcgtcccaagtgcaataactttttgttccctgacccagttcggagccttctggactgcctgtgaaatggaggataggagaaacatttccttcccaggcccccccgccacacaaacccccaacccccacggctacctcctggcgacctcaacacacgtgcagaacctggccttgcttctggggatcagtggcctttgggaatgaaaggtttagaagaaactgcccctctgactcccgtacccagccatactaagagaaccaaccaggaaactgagaacctgagtc

SEQ ID NO: 278051 - DNA, 1931 bp, Homo sapiens
ccaacttgctcgagcagggctgggtagaccggcgcgctcccggggacggtggggggggcagtcccggtttcggccatcgctggggtgggctcggagcggccgcaccgggcagcaaccccactcccactcggaggccccctgccctctcccccacttccccccggcccatggtgcgaggctgggagccgccgcccgggctggactgcgctatctctgaagggcacaaatcagaaggcaccatgcctcctaataaagaggccagcggtctcagtagttcaccagcggggctcatctgcctccctccaatctctgaggagctacagcttgtgtggacgcaagcagcccagaccagtgagctagacagcaatgaacacctgctcaaaaccttcagctactttccctatcccagcctagcagacattgcccttctctgcctacgttatgggttgcagatggagaaagtcaagacttggtttatggcccagcgcctccgctgtggtattagctggtcatctgaagaaatagaagagactcgagcccgagtagtctaccgtcgggaccaactccatttcaaatcccttctctcttttactcatcatgcgggacggcccccagaggaggtgcctcctcctccagtgccagctccagagcaagttggtattggaataggtcctccaactcttagcaagcctacccagacgaaaggattgaaggtagagcctgaggagccctctcagatgccaccactgccacagagtcaccagaaattaaaggagtccctgatgacacctggcagtggagcattcccctaccaatcagatttttggcaacatcttcaaagcagtggcctctcaaaggagcaggcaggcaggggtcccaaccagtcacatggcataggtactgcttcctggaaccactccacaaccgtcccccagccacaagctcgggataaacccccaccaattgcattaattgccagtagttgtaaggaggagtcagcatctagtgttactccctcttcttcctctacctcttcttctttccaggtactggctaatggagctactgccgcctctaaacccctccagccactaggctgtgtcccacagtcagtgtcacccagtgaacaggcattacccccacatctggaaccagcctggccccaagggctacggcataactcagtaccaggtagagttggccccacagagtacctttccccagatatgcaacgccagcgaaagaccaagcgcaaaaccaaagagcagctggctatccttaaatccttttttttacagtgccagtgggcacggcgtgaggattaccaaaagttagaacagatcactggtttacctcggcctgagatcattcagtggtttggtgacacacgctatgccttgaagcatgggcaactaaagtggtttcgggacaacgcagtacctggtgcccctagtttccaagacccagcaattcctacaccaccaccatcaacccgctccttgaacgaaagggctgagacaccacctctgccgatccctccacccccaccggatatacaacccttggagaggtactgggcagcccaccaacagctacgggaaactgatatccctcaattgagtcaggcatcaaggcttagcacccagcaggtgctggattggtttgactctcgattacctcagccagctgaggtggtagtttgtctagatgaagaagaggaagaggaggaggaagaactgccagaagatgatgaggaagaggaggaggaggaggaagatgatgatgatgatgatgatgatgtgatcatacaagactgagtggggagctgggggaggggaggtctgttactgaaagatgaaccaacttagtaactgtttaaacaaagaaaccacatttttaaaattaccttgtggcagagaactaaaaaaaat

SEQ ID NO: 278052 - DNA, 1815 bp, Homo sapiens
agcggaggatcaagattaaggacggcgatgccacaggacacgatatctccgaagggcgccgatcataacgcgcctatggcctactaggtatacaggagccgactacccggtcgtcgcatcgattgaacggagctggagggctcactgctgaacttccgcgcatggcacagtctgcattgtatgcgagctcatcacgctctgcggtgcgcaggccaagatacgcacggagaccgaggtgagctagacagcaatgaacacctgctcaaaaccttcagctactttccctatcccagcctagcagacattgcccttctctgcctacgttatgggttgcagatggagaaagtcaagacttggtttatggcccagcgcctccgctgtggtattagctggtcatctgaagaaatagaagagactcgagcccgagtagtctaccgtcgggaccaactccatttcaaatcccttctctcttttactcatcatgcgggacggcccccagaggaggtgcctcctcctccagtgccagctccagagcaagttggtattggaataggtcctccaactcttagcaagcctacccagacgaaaggattgaaggtagagcctgaggagccctctcagatgccaccactgccacagagtcaccagaaattaaaggagtccctgatgacacctggcagtggagcattcccctaccaatcagatttttggcaacatcttcaaagcagtggcctctcaaaggagcaggcaggcaggggtcccaaccagtcacatggcataggtactgcttcctggaaccactccacaaccgtcccccagccacaagctcgggataaacccccaccaattgcattaattgccagtagttgtaaggaggagtcagcatctagtgttactccctcttcttcctctacctcttcttctttccaggtactggctaatggagctactgccgcctctaaacccctccagccactaggctgtgtcccacagtcagtgtcacccagtgaacaggcattacccccacatctggaaccagcctggccccaagggctacggcataactcagtaccaggtagagttggccccacagagtacctttccccagatatgcaacgccagcgaaagaccaagcgcaaaaccaaagagcagctggctatccttaaatccttttttttacagtgccagtgggcacggcgtgaggattaccaaaagttagaacagatcactggtttacctcggcctgagatcattcagtggtttggtgacacacgctatgccttgaagcatgggcaactaaagtggtttcgggacaacgcagtacctggtgcccctagtttccaagacccagcaattcctacaccaccaccatcaacccgctccttgaacgaaagggctgagacaccacctctgccgatccctccacccccaccggatatacaacccttggagaggtactgggcagcccaccaacagctacgggaaactgatatccctcaattgagtcaggcatcaaggcttagcacccagcaggtgctggattggtttgactctcgattacctcagccagctgaggtggtagtttgtctagatgaagaagaggaagaggaggaggaagaactgccagaagatgatgaggaagaggaggaggaggaggaagatgatgatgatgatgatgatgatgtgatcatacaagactgagtggggagctgggggaggggaggtctgttactgaaagatgaaccaacttagtaactgtttaaacaaagaaaccacatttttaaaattaccttgtggcagagaactaaaaaaaat

SEQ ID NO: 278053 - DNA, 937 bp, Homo sapiens
ctttctccattagcgccccccctacattgctatttccctccctccccccttttcgtttccggcgctcccgccttctctccgcagagctcttctctgagcctgttggggggagggaggggggcgtggaggaactggggttcgcgggagcacgagctgcagcaccacttccggaaagttcaggagccctggaaaggagaaggaataagacggcaggaggaagagagagagagggtagaatggaagaatctcacttcaattctaacccgtacttctggccttctatccccacagtctcaggtcagatcgagaacacaatgttcatcaacaagatgaaggatcagctgttgccagagaagggctgtggtctggccccacctcactaccccaccttgctgacagtgcctgcctcagtgtccctgccctcaggcatcagtatggacacagagtccaagtcagaccagctgaccccacacagccaagcgtccgttacccagaatatcacggtggtccctgtgccgtctacaggactgatgactgctggtgagcaactctgctcttctccaatctgaggtgttgatcttccatgatcagtaccccaggctggagggctccaaggacatggggagtgggatatgtgtttgattattcaatcaaatttttattaagtgcctactgtgtgcctagcaatgtgctaggcattgtgggggatacaaagaagtagaagatgcggtccctgcctttgaggaggtgacattctttccttctctgaatcaaggagtctcctgttctcagaggtggagaagagaagggagtcaatcaaggggtaaatctcactgttaccaggggggtggggacaagggttaggagaccattatttttctacagggtttgggatttcctgtgtactctgggttgggtcggcgggggggtgaggggt

SEQ ID NO: 278054 - DNA, 2881 bp, Homo sapiens
ctttctccattagcgccccccctacattgctatttccctccctccccccttttcgtttccggcgctcccgccttctctccgcagagctcttctctgagcctgttggggggagggaggggggcgtggaggaactggggttcgcgggagcacgagctgcagcaccacttccggaaagttcaggagccctggaaaggagaaggaataagacggcaggaggaagagagagagagggtagaatggaagaatctcacttcaattctaacccgtacttctggccttctatccccacagtctcaggtcagatcgagaacacaatgttcatcaacaagatgaaggatcagctgttgccagagaagggctgtggtctggccccacctcactaccccaccttgctgacagtgcctgcctcagtgtccctgccctcaggcatcagtatggacacagagtccaagtcagaccagctgaccccacacagccaagcgtccgttacccagaatatcacggtggtccctgtgccgtctacaggactgatgactgctggagtctcctgttctcagaggtggagaagagaagggagtcaatcaaggggtccgggtttggtaatcacgtccccctcaggctctcttgtgaccacagcatcatcagctcagaccttccccatttcggctcccatgattgtctcagctcttccccctggctcacaagccctgcaggttgtccctgacctctccaagaaggtagcatcgaccctaaccgaggaaggaggcggaggtggtggtggaggtggcagtgtggctcctaagccaccccggggccggaagaagaagcggatgctggaatcagggctgcccgagatgaatgacccttatgtcctctcccctgaggatgatgatgaccatcagaaagacggcaagacctacaggtgccggatgtgctcactgacattctactccaagtcggagatgcagatccactccaagtcacacaccgagaccaagccccacaagtgcccacattgctccaagaccttcgccaacagctcctacctggcccagcacatccgtatacactcaggggctaagccctacagttgtaacttctgtgagaaatccttccgccagctctcccaccttcagcagcacacccgaatccacactggtgatagaccatacaaatgtgcacacccaggctgtgagaaagccttcacacaactctccaatctgcagtcccacagacggcaacacaacaaagataaacccttcaagtgccacaactgtcatcgggcgtacacggatgcagcctcactagaggtgcacctgtctacgcacacagtgaagcatgccaaggtgtacacctgcactatctgcagtcgggcatacacatcagaaacataccttatgaaacatatgcgcaaacacaacccgcctgatcttcagcaacaggtgcaggcagcagcagcagcggcagcagtggcccaggcccaggctcaagctcaagcccaggctcaggctcaggctcaagcccaggcccaggcccaggcctcccaggcatcacagcagcagcagcagcagcagcagcagcagcagcagcagcaacagccaccaccacacttccagtctcctggggcagccccccagggtgggggtggtggggacagcaatcccaaccctccaccccagtgttcctttgacctgaccccgtataagacggcggagcatcataaggacatctgcctcactgtcaccaccagcaccatccaggtggagcacctggccagctcttagagatccgtgctgccacccactgggaagaggaagaagtagtcctggtgtcttctttctccaactcttggtgggaaaagtccttttcttccttgacaggccttggctccatctccttgggcctctgtcacggctttccttcacaggataccatcctttttctgaactcttcttcaaaaggaacatcagccctcctgattgcaaaggaatactgagctgatggtgtcatccagcagcctcccctcccaagcaaagcttctaaaactgggggtcggtgctcaagggaaggatttgctatgacctcatagaaccttgtccagtgtggccacttaccctatccttaccctccttatcctcaaagtttgggctgatgtaagactagaggctggccctcccagataacagagaaaagggagccccaaatgcaaccagcctcttgttctattcttgcctgcaaaagaacagaggtttctcaaatgcctcagtccctgagagccatttcttcccctacatcgtctcactttgcttcctattgactgctggtagaaggagatttggggtaggggctagacctccttttatttgaagggggcaagggctgagatgtggtccccaaggggccagaaattcccaagttggtcacaggtggcttagaagtgtgtgttatggttttacggatttccttgaagcctctctccttctctgcctacaaagacctatactctcaagtctccccaacccacccccaaggagctgtgggaggctttgtgtaatctgtgcaaactccaaaacaggggtgttgcggagaagggagagttcaaggtaaactcaaggactggacttagctccctaggtgccacagtcagatgccggacacggatttatatataaatatatatatataaatatattatacccactcatcacggccatctttgttgtaaccatttctgtgtttataaatgcattatctctgagaattttcatatttgatgttttgtttatttttgtcctttttttccctctctccacccctgtcctctagccacagcatttttctttttgtccttggggtgggggaggggggagggatggaattc

SEQ ID NO: 278055 - DNA, 3717 bp, Homo sapiens
actgtgtgtgtgtccgtcccggaaccggaagtggttgtggaggagcgggcgatgggaaggaatgggggggtttagggggcgggtgcctgtctggtgggtggcagagttcagctccctggaggggaaggagggacgtcccaaggaagggtctttgagaaaggggtaggggacgacatcaggagaaggctcccaggaactgtctcaggggagcgaaggttttgaggggacagctggggtctccagtagatagaccacggtgcaggctgagggaggtacttcttggcacaaggcctcgggtaggcagggggcgaagtcctcgaagaagtggggggaaggctagaggaagtggctgggcctgaactggcactgtgcctgccacaaggtcttgtgcatcccccagccctcagctttgccttctgaagccactcctcaggggcacagaccctcctcctcctccatctctaatgttctctgacccctggttacctgtggcctgggaacgaacaaggaccagtctctgagcctaggagtgaaacccaaacgctggtgatagaattcgtcttagtttctgggaattggatttatttctcttgtatccacgtagagggtagcactagactgctgttattatatccacccgtctttggattgctggctggggggtctgcctgccttccagactgactgctgacaaataattcctgaggttctccacagttctctggtggctgcaccctgcctggcccctgtaacctagacaatttgtttacagaaagttcaggagccctggaaaggagaaggaataagacggcaggaggaagagagagagagggtagaatggaagaatctcacttcaattctaacccgtacttctggccttctatccccacagtctcaggtcagatcgagaacacaatgttcatcaacaagatgaaggatcagctgttgccagagaagggctgtggtctggccccacctcactaccccaccttgctgacagtgcctgcctcagtgtccctgccctcaggcatcagtatggacacagagtccaagtcagaccagctgaccccacacagccaagcgtccgttacccagaatatcacggtggtccctgtgccgtctacaggactgatgactgctggtgagcaactctgctcttctccaatctgaggtgttgatcttccatgatcagtaccccaggctggagggctccaaggacatggggagtgggatatgtgtttgattattcaatcaaatttttattaagtgcctactgtgtgcctagcaatgtgctaggcattgtgggggatacaaagaagtagaagatgcggtccctgcctttgaggaggtgacattctttccttctctgaatcaaggagtctcctgttctcagaggtggagaagagaagggagtcaatcaaggggtccgggtttggtaatcacgtccccctcaggctctcttgtgaccacagcatcatcagctcagaccttccccatttcggctcccatgattgtctcagctcttccccctggctcacaagccctgcaggttgtccctgacctctccaagaaggtagcatcgaccctaaccgaggaaggaggcggaggtggtggtggaggtggcagtgtggctcctaagccaccccggggccggaagaagaagcggatgctggaatcagggctgcccgagatgaatgacccttatgtcctctcccctgaggatgatgatgaccatcagaaagacggcaagacctacaggtgccggatgtgctcactgacattctactccaagtcggagatgcagatccactccaagtcacacaccgagaccaagccccacaagtgcccacattgctccaagaccttcgccaacagctcctacctggcccagcacatccgtatacactcaggggctaagccctacagttgtaacttctgtgagaaatccttccgccagctctcccaccttcagcagcacacccgaatccacactggtgatagaccatacaaatgtgcacacccaggctgtgagaaagccttcacacaactctccaatctgcagtcccacagacggcaacacaacaaagataaacccttcaagtgccacaactgtcatcgggcgtacacggatgcagcctcactagaggtgcacctgtctacgcacacagtgaagcatgccaaggtgtacacctgcactatctgcagtcgggcatacacatcagaaacataccttatgaaacatatgcgcaaacacaacccgcctgatcttcagcaacaggtgcaggcagcagcagcagcggcagcagtggcccaggcccaggctcaagctcaagcccaggctcaggctcaggctcaagcccaggcccaggcccaggcctcccaggcatcacagcagcagcagcagcagcagcagcagcagcagcagcagcaacagccaccaccacacttccagtctcctggggcagccccccagggtgggggtggtggggacagcaatcccaaccctccaccccagtgttcctttgacctgaccccgtataagacggcggagcatcataaggacatctgcctcactgtcaccaccagcaccatccaggtggagcacctggccagctcttagagatccgtgctgccacccactgggaagaggaagaagtagtcctggtgtcttctttctccaactcttggtgggaaaagtccttttcttccttgacaggccttggctccatctccttgggcctctgtcacggctttccttcacaggataccatcctttttctgaactcttcttcaaaaggaacatcagccctcctgattgcaaaggaatactgagctgatggtgtcatccagcagcctcccctcccaagcaaagcttctaaaactgggggtcggtgctcaagggaaggatttgctatgacctcatagaaccttgtccagtgtggccacttaccctatccttaccctccttatcctcaaagtttgggctgatgtaagactagaggctggccctcccagataacagagaaaagggagccccaaatgcaaccagcctcttgttctattcttgcctgcaaaagaacagaggtttctcaaatgcctcagtccctgagagccatttcttcccctacatcgtctcactttgcttcctattgactgctggtagaaggagatttggggtaggggctagacctccttttatttgaagggggcaagggctgagatgtggtccccaaggggccagaaattcccaagttggtcacaggtggcttagaagtgtgtgttatggttttacggatttccttgaagcctctctccttctctgcctacaaagacctatactctcaagtctccccaacccacccccaaggagctgtgggaggctttgtgtaatctgtgcaaactccaaaacaggggtgttgcggagaagggagagttcaaggtaaactcaaggactggacttagctccctaggtgccacagtcagatgccggacacggatttatatataaatatatatatataaatatattatacccactcatcacggccatctttgttgtaaccatttctgtgtttataaatgcattatctctgagaattttcatatttgatgttttgtttatttttgtcctttttttccctctctccacccctgtcctctagccacagcatttttctttttgtccttggggtgggggaggggggagggatggaattc

SEQ ID NO: 278056 - DNA, 3665 bp, Homo sapiens
actgtgtgtgtgtccgtcccggaaccggaagtggttgtggaggagcgggcgatgggaaggaatgggggggtttagggggcgggtgcctgtctggtgggtggcagagttcagctccctggaggggaaggagggacgtcccaaggaagggtctttgagaaaggggtaggggacgacatcaggagaaggctcccaggaactgtctcaggggagcgaaggttttgaggggacagctggggtctccagtagatagaccacggtgcaggctgagggaggtacttcttggcacaaggcctcgggtaggcagggggcgaagtcctcgaagaagtggggggaaggctagaggaagtggctgggcctgaactggcactgtgcctgccacaaggtcttgtgcatcccccagccctcagctttgccttctgaagccactcctcaggggcacagaccctcctcctcctccatctctaatgttctctgacccctggttacctgtggcctgggaacgaacaaggaccagtctctgagcctaggagtgaaacccaaacgctggtgatagaattcgtcttagtttctgggaattggatttatttctcttgtatccacgtagagggtagcactagactgctgttattatatccacccgtctttggattgctggctggggggtctgcctgccttccagactgactgctgacaaataattcctgaggttctccacagttctctggtggctgcaccctgcctggcccctgtaacctagacaatttgtttacagaaagttcaggagccctggaaaggagaaggaataagacggcaggaggaagagagagagagggtagaatggaagaatctcacttcaattctaacccgtacttctggccttctatccccacagtctcaggtcagatcgagaacacaatgttcatcaacaagatgaaggatcagctgttgccagagaagggctgtggtctggccccacctcactaccccaccttgctgacagtgcctgcctcagtgtccctgccctcaggcatcagtatggacacagagtccaagtcagaccagctgaccccacacagccaagcgtccgttacccagaatatcacggtggtccctgtgccgtctacaggactgatgactgctggagtctcctgttctcagaggtggagaagagaagggagtcaatcaaggggtccgggtttggtaatcacgtccccctcaggctctcttgtgaccacagcatcatcagctcagaccttccccatttcggctcccatgattgtctcagctcttccccctggctcacaagccctgcaggttgtccctgacctctccaagaaggtagcatcgaccctaaccgaggaaggaggcggaggtggtggtggaggtggcagtgtggctcctaagccaccccggggccggaagaagaagcggatgctggaatcagggctgcccgagatgaatgacccttatgtcctctcccctgaggatgatgatgaccatcagaaagacggcaagacctacaggtgccggatgtgctcactgacattctactccaagtcggagatgcagatccactccaagtcacacaccgagaccaagccccacaagtgcccacattgctccaagaccttcgccaacagctcctacctggcccagcacatccgtatacactcaggggctaagccctacagttgtaacttctgtgagaaatccttccgccagctctcccaccttcagcagcacacccggatccactccaagatgcacacggagaccatcaagccccacaagtgcccgcactgctccaagaccttcgccaacacctcctacctggcccagcacctccgtatccactcgggggccaagccctacaactgttcctactgccagaaggccttccgccagctctcccacctccagcagcacacacgaatccacactggtgatagaccatacaaatgtgcacacccaggctgtgagaaagccttcacacaactctccaatctgcagtcccacagacggcaacacaacaaagataaacccttcaagtgccacaactgtcatcgggcgtacacggatgcagcctcactagaggtgcacctgtctacgcacacagtgaagcatgccaaggtgtacacctgcactatctgcagtcgggcatacacatcagaaacataccttatgaaacatatgcgcaaacacaacccgcctgatcttcagcaacaggtgcaggcagcagcagcagcggcagcagtggcccaggcccaggctcaagctcaagcccaggctcaggctcaggctcaagcccaggcccaggcccaggcctcccaggcatcacagcagcagcagcagcagcagcagcagcagcagcagcagcaacagccaccaccacacttccagtctcctggggcagccccccagggtgggggtggtggggacagcaatcccaaccctccaccccagtgttcctttgacctgaccccgtataagacggcggagcatcataaggacatctgcctcactgtcaccaccagcaccatccaggtggagcacctggccagctcttagagatccgtgctgccacccactgggaagaggaagaagtagtcctggtgtcttctttctccaactcttggtgggaaaagtccttttcttccttgacaggccttggctccatctccttgggcctctgtcacggctttccttcacaggataccatcctttttctgaactcttcttcaaaaggaacatcagccctcctgattgcaaaggaatactgagctgatggtgtcatccagcagcctcccctcccaagcaaagcttctaaaactgggggtcggtgctcaagggaaggatttgctatgacctcatagaaccttgtccagtgtggccacttaccctatccttaccctccttatcctcaaagtttgggctgatgtaagactagaggctggccctcccagataacagagaaaagggagccccaaatgcaaccagcctcttgttctattcttgcctgcaaaagaacagaggtttctcaaatgcctcagtccctgagagccatttcttcccctacatcgtctcactttgcttcctattgactgctggtagaaggagatttggggtaggggctagacctccttttatttgaagggggcaagggctgagatgtggtccccaaggggccagaaattcccaagttggtcacaggtggcttagaagtgtgtgttatggttttacggatttccttgaagcctctctccttctctgcctacaaagacctatactctcaagtctccccaacccacccccaaggagctgtgggaggctttgtgtaatctgtgcaaactccaaaacaggggtgttgcggagaagggagagttcaaggtaaactcaaggactggacttagctccctaggtgccacagtcagatgccggacacggatttatatataaatatatatatataaatatattatacccactcatcacggccatctttgttgtaaccatttctgtgtttataaatgcattatctctgagaattttcatatttgatgttttgtttatttttgtcctttttttccctctctccacccctgtcctctagccacagcatttttctttttgtccttggggtgggggaggggggagggatggaattc

SEQ ID NO: 278057 - DNA, 3103 bp, Homo sapiens
ctttctccattagcgccccccctacattgctatttccctccctccccccttttcgtttccggcgctcccgccttctctccgcagagctcttctctgagcctgttggggggagggaggggggcgtggaggaactggggttcgcgggagcacgagctgcagcaccacttccgggtgagtgcaaggggagggcagcaaggagggggggccacccactacctcgcgcccccgccctgcgggtgtctcgcgcgcgttccgtgcgtgtgagtgtgtgggtctgtctcgctccagaagtgcgtgcccgcgcgctgcgccttgcgctttttcccctccctcgccccttcctggtcctcccaccctcctaggctccctcctttcccagcaaacgccgcccctcccgcgccctggctcaggctctggcgccgccgcagccgtcgccgcccgaaagttcaggagccctggaaaggagaaggaataagacggcaggaggaagagagagagagggtagaatggaagaatctcacttcaattctaacccgtacttctggccttctatccccacagtctcaggtcagatcgagaacacaatgttcatcaacaagatgaaggatcagctgttgccagagaagggctgtggtctggccccacctcactaccccaccttgctgacagtgcctgcctcagtgtccctgccctcaggcatcagtatggacacagagtccaagtcagaccagctgaccccacacagccaagcgtccgttacccagaatatcacggtggtccctgtgccgtctacaggactgatgactgctggtccgggtttggtaatcacgtccccctcaggctctcttgtgaccacagcatcatcagctcagaccttccccatttcggctcccatgattgtctcagctcttccccctggctcacaagccctgcaggttgtccctgacctctccaagaaggtagcatcgaccctaaccgaggaaggaggcggaggtggtggtggaggtggcagtgtggctcctaagccaccccggggccggaagaagaagcggatgctggaatcagggctgcccgagatgaatgacccttatgtcctctcccctgaggatgatgatgaccatcagaaagacggcaagacctacaggtgccggatgtgctcactgacattctactccaagtcggagatgcagatccactccaagtcacacaccgagaccaagccccacaagtgcccacattgctccaagaccttcgccaacagctcctacctggcccagcacatccgtatacactcaggggctaagccctacagttgtaacttctgtgagaaatccttccgccagctctcccaccttcagcagcacacccgaatccacactggtgatagaccatacaaatgtgcacacccaggctgtgagaaagccttcacacaactctccaatctgcagtcccacagacggcaacacaacaaagataaacccttcaagtgccacaactgtcatcgggcgtacacggatgcagcctcactagaggtgcacctgtctacgcacacagtgaagcatgccaaggtgtacacctgcactatctgcagtcgggcatacacatcagaaacataccttatgaaacatatgcgcaaacacaacccgcctgatcttcagcaacaggtgcaggcagcagcagcagcggcagcagtggcccaggcccaggctcaagctcaagcccaggctcaggctcaggctcaagcccaggcccaggcccaggcctcccaggcatcacagcagcagcagcagcagcagcagcagcagcagcagcagcaacagccaccaccacacttccagtctcctggggcagccccccagggtgggggtggtggggacagcaatcccaaccctccaccccagtgttcctttgacctgaccccgtataagacggcggagcatcataaggacatctgcctcactgtcaccaccagcaccatccaggtggagcacctggccagctcttagagatccgtgctgccacccactgggaagaggaagaagtagtcctggtgtcttctttctccaactcttggtgggaaaagtccttttcttccttgacaggccttggctccatctccttgggcctctgtcacggctttccttcacaggataccatcctttttctgaactcttcttcaaaaggaacatcagccctcctgattgcaaaggaatactgagctgatggtgtcatccagcagcctcccctcccaagcaaagcttctaaaactgggggtcggtgctcaagggaaggatttgctatgacctcatagaaccttgtccagtgtggccacttaccctatccttaccctccttatcctcaaagtttgggctgatgtaagactagaggctggccctcccagataacagagaaaagggagccccaaatgcaaccagcctcttgttctattcttgcctgcaaaagaacagaggtttctcaaatgcctcagtccctgagagccatttcttcccctacatcgtctcactttgcttcctattgactgctggtagaaggagatttggggtaggggctagacctccttttatttgaagggggcaagggctgagatgtggtccccaaggggccagaaattcccaagttggtcacaggtggcttagaagtgtgtgttatggttttacggatttccttgaagcctctctccttctctgcctacaaagacctatactctcaagtctccccaacccacccccaaggagctgtgggaggctttgtgtaatctgtgcaaactccaaaacaggggtgttgcggagaagggagagttcaaggtaaactcaaggactggacttagctccctaggtgccacagtcagatgccggacacggatttatatataaatatatatatataaatatattatacccactcatcacggccatctttgttgtaaccatttctgtgtttataaatgcattatctctgagaattttcatatttgatgttttgtttatttttgtcctttttttccctctctccacccctgtcctctagccacagcatttttctttttgtccttggggtgggggaggggggagggatggaattc

SEQ ID NO: 278058 - DNA, 2375 bp, Homo sapiens
gacaatgatctgggggaaatgaaataggattaggatcaggactgaacaacatgacgccatctcctttttctcccaatcctaggtccgggtttggtaatcacgtccccctcaggctctcttgtgaccacagcatcatcagctcagaccttccccatttcggctcccatgattgtctcagctcttccccctggctcacaagccctgcaggttgtccctgacctctccaagaaggtagcatcgaccctaaccgaggaaggaggcggaggtggtggtggaggtggcagtgtggctcctaagccaccccggggccggaagaagaagcggatgctggaatcagggctgcccgagatgaatgacccttatgtcctctcccctgaggatgatgatgaccatcagaaagacggcaagacctacaggtgccggatgtgctcactgacattctactccaagtcggagatgcagatccactccaagtcacacaccgagaccaagccccacaagtgcccacattgctccaagaccttcgccaacagctcctacctggcccagcacatccgtatacactcaggggctaagccctacagttgtaacttctgtgagaaatccttccgccagctctcccaccttcagcagcacacccgaatccacactggtgatagaccatacaaatgtgcacacccaggctgtgagaaagccttcacacaactctccaatctgcagtcccacagacggcaacacaacaaagataaacccttcaagtgccacaactgtcatcgggcgtacacggatgcagcctcactagaggtgcacctgtctacgcacacagtgaagcatgccaaggtgtacacctgcactatctgcagtcgggcatacacatcagaaacataccttatgaaacatatgcgcaaacacaacccgcctgatcttcagcaacaggtgcaggcagcagcagcagcggcagcagtggcccaggcccaggctcaagctcaagcccaggctcaggctcaggctcaagcccaggcccaggcccaggcctcccaggcatcacagcagcagcagcagcagcagcagcagcagcagcagcagcaacagccaccaccacacttccagtctcctggggcagccccccagggtgggggtggtggggacagcaatcccaaccctccaccccagtgttcctttgacctgaccccgtataagacggcggagcatcataaggacatctgcctcactgtcaccaccagcaccatccaggtggagcacctggccagctcttagagatccgtgctgccacccactgggaagaggaagaagtagtcctggtgtcttctttctccaactcttggtgggaaaagtccttttcttccttgacaggccttggctccatctccttgggcctctgtcacggctttccttcacaggataccatcctttttctgaactcttcttcaaaaggaacatcagccctcctgattgcaaaggaatactgagctgatggtgtcatccagcagcctcccctcccaagcaaagcttctaaaactgggggtcggtgctcaagggaaggatttgctatgacctcatagaaccttgtccagtgtggccacttaccctatccttaccctccttatcctcaaagtttgggctgatgtaagactagaggctggccctcccagataacagagaaaagggagccccaaatgcaaccagcctcttgttctattcttgcctgcaaaagaacagaggtttctcaaatgcctcagtccctgagagccatttcttcccctacatcgtctcactttgcttcctattgactgctggtagaaggagatttggggtaggggctagacctccttttatttgaagggggcaagggctgagatgtggtccccaaggggccagaaattcccaagttggtcacaggtggcttagaagtgtgtgttatggttttacggatttccttgaagcctctctccttctctgcctacaaagacctatactctcaagtctccccaacccacccccaaggagctgtgggaggctttgtgtaatctgtgcaaactccaaaacaggggtgttgcggagaagggagagttcaaggtaaactcaaggactggacttagctccctaggtgccacagtcagatgccggacacggatttatatataaatatatatatataaatatattatacccactcatcacggccatctttgttgtaaccatttctgtgtttataaatgcattatctctgagaattttcatatttgatgttttgtttatttttgtcctttttttccctctctccacccctgtcctctagccacagcatttttctttttgtccttggggtgggggaggggggagggatggaattc

SEQ ID NO: 278059 - DNA, 2309 bp, Homo sapiens
actgtgtgtgtgtccgtcccggaaccggaagtggttgtggaggagcgggcgatgggaaggaatgggggggtttagggggcgggtgcctgtctggtgggtggcagagttcagctccctggaggggaaggagggacgtcccaaggaagggtctttgagaaaggggtaggggacgacatcaggagaaggctcccaggaactgtctcaggggagcgaaggttttgaggggacagctggggtctccagtagatagaccacggtgcaggctgagggaggtacttcttggcacaaggcctcgggtaggcagggggcgaagtcctcgaagaagtggggggaaggctagaggaagtggctgggcctgaactggcactgtgcctgccacaaggtcttgtgcatcccccagccctcagctttgccttctgaagccactcctcaggggcacagaccctcctcctcctccatctctaatgttctctgacccctggttacctgtggcctgggaacgaacaaggaccagtctctgagcctaggagtgaaacccaaacgctggtgatagaattcgtcttagtttctgggaattggatttatttctcttgtatccacgtagagggtagcactagactgctgttattatatccacccgtctttggattgctggctggggggtctgcctgccttccagactgactgctgacaaataattcctgaggttctccacagttctctggtggctgcaccctgcctggcccctgtaacctagacaatttgtttacagaaagttcaggagccctggaaaggagaaggaataagacggcaggaggaagagagagagagggtagaatggaagaatctcacttcaattctaacccgtacttctggccttctatccccacagtctcaggtcagatcgagaacacaatgttcatcaacaagatgaaggatcagctgttgccagagaagggctgtggtctggccccacctcactaccccaccttgctgacagtgcctgcctcagtgtccctgccctcaggcatcagtatggacacagagtccaagtcagaccagctgaccccacacagccaagcgtccgttacccagaatatcacggtggtccctgtgccgtctacaggactgatgactgctggagtctcctgttctcagaggtggagaagagaagggagtcaatcaaggggtccgggtttggtaatcacgtccccctcaggctctcttgtgaccacagcatcatcagctcagaccttccccatttcggctcccatgattgtctcagctcttccccctggctcacaagccctgcaggttgtccctgacctctccaagaaggtagcatcgaccctaaccgaggaaggaggcggaggtggtggtggaggtggcagtgtggctcctaagccaccccggggccggaagaagaagcggatgctggaatcagggctgcccgagatgaatgacccttatgtcctctcccctgaggatgatgatgaccatcagaaagacggcaagacctacaggtgccggatgtgctcactgacattctactccaagtcggagatgcagatccactccaagtcacacaccgagaccaagccccacaagtgcccacattgctccaagaccttcgccaacagctcctacctggcccagcacatccgtatacactcaggggctaagccctacagttgtaacttctgtgagaaatccttccgccagctctcccaccttcagcagcacacccgaatccacactggtgatagaccatacaaatgtgcacacccaggctgtgagaaagccttcacacaactctccaatctgcagtcccacagacggcaacacaacaaagataaacccttcaagtgccacaactgtcatcgggcgtacacggatgcagcctcactagaggtgcacctgtctacgcacacagtgaagcatgccaaggtgtacacctgcactatctgcagtcgggcatacacatcagaaacataccttatgaaacatatgcgcaaacacaacccgcctgatcttcagcaacaggtgcaggcagcagcagcagcggcagcagtggcccaggcccaggctcaagctcaagcccaggctcaggctcaggctcaagcccaggcccaggcccaggcctcccaggcatcacagcagcagcagcagcagcagcagcagcagcagcagcagcaacagccaccaccacacttccagtctcctggggcagccccccagggtgggggtggttttcatagttactattttcttctgatttttattatctatttcgttaggccattgttttt

SEQ ID NO: 278060 - DNA, 1853 bp, Homo sapiens
actgtgtgtgtgtccgtcccggaaccggaagtggttgtggaggagcgggcgatgggaaggaatgggggggtttagggggcgggtgcctgtctggtgggtggcagagttcagctccctggaggggaaggagggacgtcccaaggaagggtctttgagaaaggggtaggggacgacatcaggagaaggctcccaggaactgtctcaggggagcgaaggttttgaggggacagctggggtctccagtagatagaccacggtgcaggctgagggaggtacttcttggcacaaggcctcgggtaggcagggggcgaagtcctcgaagaagtggggggaaggctagaggaagtggctgggcctgaactggcactgtgcctgccacaaggtcttgtgcatcccccagccctcagctttgccttctgaagccactcctcaggggcacagaccctcctcctcctccatctctaatgttctctgacccctggttacctgtggcctgggaacgaacaaggaccagtctctgagcctaggagtgaaacccaaacgctggtgatagaattcgtcttagtttctgggaattggatttatttctcttgtatccacgtagagggtagcactagactgctgttattatatccacccgtctttggattgctggctggggggtctgcctgccttccagactgactgctgacaaataattcctgaggttctccacagttctctggtggctgcaccctgcctggcccctgtaacctagacaatttgtttacagaaagttcaggagccctggaaaggagaaggaataagacggcaggaggaagagagagagagggtagaatggaagaatctcacttcaattctaacccgtacttctggccttctatccccacagtctcaggtcagatcgagaacacaatgttcatcaacaagatgaaggatcagctgttgccagagaagggctgtggtctggccccacctcactaccccaccttgctgacagtgcctgcctcagtgtccctgccctcaggcatcagtatggacacagagtccaagtcagaccagctgaccccacacagccaagcgtccgttacccagaatatcacggtggtccctgtgccgtctacaggactgatgactgctggagtctcctgttctcagaggtggagaagagaagggagtcaatcaaggggtccgggtttggtaatcacgtccccctcaggctctcttgtgaccacagcatcatcagctcagaccttccccatttcggctcccatgattgtctcagctcttccccctggctcacaagccctgcaggttgtccctgacctctccaagaaggtagcatcgaccctaaccgaggaaggaggcggaggtggtggtggaggtggcagtgtggctcctaagccaccccggggccggaagaagaagcggatgctggaatcagggctgcccgagatgaatgacccttatgtcctctcccctgaggatgatgatgaccatcagaaagacggcaagacctacaggtgccggatgtgctcactgacattctactccaagtcggagatgcagatccactccaagtcacacaccgagaccaagccccacaagtgcccacattgctccaagaccttcgccaacagctcctacctggcccagcacatccgtatacactcaggggctaagccctacagttgtaacttctgtgagaaatccttccgccagctctcccaccttcagcagcacacccgaatccacactggtgatagaccatacaaatgtgcacacccaggctgtgagaaagccttcacacaactctccaatctgcagtctctaatcactagtgaattccggcc

SEQ ID NO: 278061 - DNA, 1817 bp, Homo sapiens
tactgggattacaggtgtgagccaccgcacctggcccagttagatattttccatgagactccagaaaaggttgtaaagttgtttcattcaggggtctttgaaaaaaatagcagctcattcctttgccagttgaatgttgagtgacttctaaaggttcctctcttttttttctcagtagtgagccactgaaagtgctacttgagttttgctcagtcttggctccagaaaaccagtataaagcttactctgcttacagcagaatcagagcctggggtgctagttacaagtaatctcttttccttcctctttatccctcaacttctttttaccatctccctcaggaaacataccttatgaaacatatgcgcaaacacaacccgcctgatcttcagcaacaggtgcaggcagcagcagcagcggcagcagtggcccaggcccaggctcaagctcaagcccaggctcaggctcaggctcaagcccaggcccaggcccaggcctcccaggcatcacagcagcagcagcagcagcagcagcagcagcagcagcagcaacagccaccaccacacttccagtctcctggggcagccccccagggtgggggtggtggggacagcaatcccaaccctccaccccagtgttcctttgacctgaccccgtataagacggcggagcatcataaggacatctgcctcactgtcaccaccagcaccatccaggtggagcacctggccagctcttagagatccgtgctgccacccactgggaagaggaagaagtagtcctggtgtcttctttctccaactcttggtgggaaaagtcctttttccatctccttgggcctctgtcacggctttccttcacaggataccatcctttttctgaactcttcttcaaaaggaacatcagccctcctgattgcaaaggaatactgagctgatggtgtcatccagcagcctcccctcccaagcaaagcttctaaaactgggggtcggtgctcaagggaaggatttgctatgacctcatagaaccttgtccagtgtggccacttaccctatccttaccctccttatcctcaaagtttgggctgatgtaagactagaggctggccctcccagataacagagaaaagggagccccaaatgcaaccagcctcttgttctattcttgcctgcaaaagaacagaggtttctcaaatgcctcagtccctgagagccatttcttcccctacatcgtctcactttgcttcctattgactgctggtagaaggagatttggggtaggggctagacctccttttatttgaagggggcaagggctgagatgtggtccccaaggggccagaaattcccaagttggtcacaggtggcttagaagtgtgtgttatggttttacggatttccttgaagcctctctccttctctgcctacaaagacctatactctcaagtctccccaacccacccccaaggagctgtgggaggctttgtgtaatctgtgcaaactccaaaacaggggtgttgcggagaagggagagttcaaggtaaactcaaggactggacttagctccctaggtgccacagtcagatgccggacacggatttatatataaatatatatatataaatatattatacccactcatcacggccatctttgttgtaaccatttctgtgtttataaatgcattatctctgagaattttcatatttgatgttttgtttatttttgtcctttttttccctctctccacccctgtcctctagccacagcatttttctttttgtccttggggtgggggaggggggagggatggaattc

SEQ ID NO: 278062 - DNA, 454 bp, Homo sapiens
cagcagagaggagcctcagcttgagctgagtgatgcaggcattgaccagaagcaaatcatcagtacctgatccacatcagagaggaaggctggtgcctcttggaggcccatctgatgtgcctccttaggagagcaggatgggcctggagaagatttgttgagccagttcctaaatggtcttgctgacattctttcccttttttctcttatcctgtgcagaatccacactggtgatagaccatacaaatgtgcacacccaggctgtgagaaagccttcacacaactctccaatctgcaggtaaatgttccaccctccacacaagaccttgagtctgagacatggggccatttgaatagtatcgtggttctcaaatgttttcaggactcctttacactcaaacattattgagggacccaaagagtttttgtttatgtgggtaatagctgtctacat

SEQ ID NO: 278063 - DNA, 799 bp, Homo sapiens
gacaatgatctgggggaaatgaaataggattaggatcaggactgaacaacatgacgccatctcctttttctcccaatcctaggtccgggtttggtaatcacgtccccctcaggctctcttgtgaccacagcatcatcagctcagaccttccccatttcggctcccatgattgtctcagctcttccccctggctcacaagccctgcaggttgtccctgacctctccaagaaggtagcatcgaccctaaccgaggaaggaggcggaggtggtggtggaggtggcagtgtggctcctaagccaccccggggccggaagaagaagcggatgctggaatcagggctgcccgagatgaatgacccttatgtcctctcccctgaggatgatgatgaccatcagaaagacggcaagacctacaggtgccggatgtgctcactgacattctactccaagtcggagatgcagatccactccaagtcacacaccgagaccaagccccacaagtgcccacattgctccaagaccttcgccaacagctcctacctggcccagcacatccgtatacactcaggggctaagccctacagttgtaacttctgtgagaaatccttccgccagctctcccaccttcagcagcacacccggtaaggctgctcttggtttaccccaccacctggccgtgaaccctaagaccatgttgcctgcacctactcctctctccacatgtattattctttccctttcacctttgcccattggtagcctcaacctcctattactgtctgtggaaattatatatcct

SEQ ID NO: 278064 - DNA, 3482 bp, Homo sapiens
actgtgtgtgtgtccgtcccggaaccggaagtggttgtggaggagcgggcgatgggaaggaatgggggggtttagggggcgggtgcctgtctggtgggtggcagagttcagctccctggaggggaaggagggacgtcccaaggaagggtctttgagaaaggggtaggggacgacatcaggagaaggctcccaggaactgtctcaggggagcgaaggttttgaggggacagctggggtctccagtagatagaccacggtgcaggctgagggaggtacttcttggcacaaggcctcgggtaggcagggggcgaagtcctcgaagaagtggggggaaggctagaggaagtggctgggcctgaactggcactgtgcctgccacaaggtcttgtgcatcccccagccctcagctttgccttctgaagccactcctcaggggcacagaccctcctcctcctccatctctaatgttctctgacccctggttacctgtggcctgggaacgaacaaggaccagtctctgagcctaggagtgaaacccaaacgctggtgatagaattcgtcttagtttctgggaattggatttatttctcttgtatccacgtagagggtagcactagactgctgttattatatccacccgtctttggattgctggctggggggtctgcctgccttccagactgactgctgacaaataattcctgaggttctccacagttctctggtggctgcaccctgcctggcccctgtaacctagacaatttgtttacagaaagttcaggagccctggaaaggagaaggaataagacggcaggaggaagagagagagagggtagaatggaagaatctcacttcaattctaacccgtacttctggccttctatccccacagtctcaggtcagatcgagaacacaatgttcatcaacaagatgaaggatcagctgttgccagagaagggctgtggtctggccccacctcactaccccaccttgctgacagtgcctgcctcagtgtccctgccctcaggcatcagtatggacacagagtccaagtcagaccagctgaccccacacagccaagcgtccgttacccagaatatcacggtggtccctgtgccgtctacaggactgatgactgctggagtctcctgttctcagaggtggagaagagaagggagtcaatcaaggggtccgggtttggtaatcacgtccccctcaggctctcttgtgaccacagcatcatcagctcagaccttccccatttcggctcccatgattgtctcagctcttccccctggctcacaagccctgcaggttgtccctgacctctccaagaaggtagcatcgaccctaaccgaggaaggaggcggaggtggtggtggaggtggcagtgtggctcctaagccaccccggggccggaagaagaagcggatgctggaatcagggctgcccgagatgaatgacccttatgtcctctcccctgaggatgatgatgaccatcagaaagacggcaagacctacaggtgccggatgtgctcactgacattctactccaagtcggagatgcagatccactccaagtcacacaccgagaccaagccccacaagtgcccacattgctccaagaccttcgccaacagctcctacctggcccagcacatccgtatacactcaggggctaagccctacagttgtaacttctgtgagaaatccttccgccagctctcccaccttcagcagcacacccgaatccacactggtgatagaccatacaaatgtgcacacccaggctgtgagaaagccttcacacaactctccaatctgcagtcccacagacggcaacacaacaaagataaacccttcaagtgccacaactgtcatcgggcgtacacggatgcagcctcactagaggtgcacctgtctacgcacacagtgaagcatgccaaggtgtacacctgcactatctgcagtcgggcatacacatcagaaacataccttatgaaacatatgcgcaaacacaacccgcctgatcttcagcaacaggtgcaggcagcagcagcagcggcagcagtggcccaggcccaggctcaagctcaagcccaggctcaggctcaggctcaagcccaggcccaggcccaggcctcccaggcatcacagcagcagcagcagcagcagcagcagcagcagcagcagcaacagccaccaccacacttccagtctcctggggcagccccccagggtgggggtggtggggacagcaatcccaaccctccaccccagtgttcctttgacctgaccccgtataagacggcggagcatcataaggacatctgcctcactgtcaccaccagcaccatccaggtggagcacctggccagctcttagagatccgtgctgccacccactgggaagaggaagaagtagtcctggtgtcttctttctccaactcttggtgggaaaagtccttttcttccttgacaggccttggctccatctccttgggcctctgtcacggctttccttcacaggataccatcctttttctgaactcttcttcaaaaggaacatcagccctcctgattgcaaaggaatactgagctgatggtgtcatccagcagcctcccctcccaagcaaagcttctaaaactgggggtcggtgctcaagggaaggatttgctatgacctcatagaaccttgtccagtgtggccacttaccctatccttaccctccttatcctcaaagtttgggctgatgtaagactagaggctggccctcccagataacagagaaaagggagccccaaatgcaaccagcctcttgttctattcttgcctgcaaaagaacagaggtttctcaaatgcctcagtccctgagagccatttcttcccctacatcgtctcactttgcttcctattgactgctggtagaaggagatttggggtaggggctagacctccttttatttgaagggggcaagggctgagatgtggtccccaaggggccagaaattcccaagttggtcacaggtggcttagaagtgtgtgttatggttttacggatttccttgaagcctctctccttctctgcctacaaagacctatactctcaagtctccccaacccacccccaaggagctgtgggaggctttgtgtaatctgtgcaaactccaaaacaggggtgttgcggagaagggagagttcaaggtaaactcaaggactggacttagctccctaggtgccacagtcagatgccggacacggatttatatataaatatatatatataaatatattatacccactcatcacggccatctttgttgtaaccatttctgtgtttataaatgcattatctctgagaattttcatatttgatgttttgtttatttttgtcctttttttccctctctccacccctgtcctctagccacagcatttttctttttgtccttggggtgggggaggggggagggatggaattc

SEQ ID NO: 278065 - DNA, 3575 bp, Homo sapiens
actgtgtgtgtgtccgtcccggaaccggaagtggttgtggaggagcgggcgatgggaaggaatgggggggtttagggggcgggtgcctgtctggtgggtggcagagttcagctccctggaggggaaggagggacgtcccaaggaagggtctttgagaaaggggtaggggacgacatcaggagaaggctcccaggaactgtctcaggggagcgaaggttttgaggggacagctggggtctccagtagatagaccacggtgcaggctgagggaggtacttcttggcacaaggcctcgggtaggcagggggcgaagtcctcgaagaagtggggggaaggctagaggaagtggctgggcctgaactggcactgtgcctgccacaaggtcttgtgcatcccccagccctcagctttgccttctgaagccactcctcaggggcacagaccctcctcctcctccatctctaatgttctctgacccctggttacctgtggcctgggaacgaacaaggaccagtctctgagcctaggagtgaaacccaaacgctggtgatagaattcgtcttagtttctgggaattggatttatttctcttgtatccacgtagagggtagcactagactgctgttattatatccacccgtctttggattgctggctggggggtctgcctgccttccagactgactgctgacaaataattcctgaggttctccacagttctctggtggctgcaccctgcctggcccctgtaacctagacaatttgtttacagaaagttcaggagccctggaaaggagaaggaataagacggcaggaggaagagagagagagggtagaatggaagaatctcacttcaattctaacccgtacttctggccttctatccccacagtctcaggtcagatcgagaacacaatgttcatcaacaagatgaaggatcagctgttgccagagaagggctgtggtctggccccacctcactaccccaccttgctgacagtgcctgcctcagtgtccctgccctcaggcatcagtatggacacagagtccaagtcagaccagctgaccccacacagccaagcgtccgttacccagaatatcacggtggtccctgtgccgtctacaggactgatgactgctggagtctcctgttctcagaggtggagaagagaagggagtcaatcaaggggtccgggtttggtaatcacgtccccctcaggctctcttgtgaccacagcatcatcagctcagaccttccccatttcggctcccatgattgtctcagctcttccccctggctcacaagccctgcaggttgtccctgacctctccaagaaggtagcatcgaccctaaccgaggaaggaggcggaggtggtggtggaggtggcagtgtggctcctaagccaccccggggccggaagaagaagcggatgctggaatcagggctgcccgagatgaatgacccttatgtcctctcccctgaggatgatgatgaccatcagaaagacggcaagacctacaggagcgaagggaactgcggcacaggaaatggacagagccttgggctcatggattcagttcccggctccaccacgaatttgctgtgtgaccctgggtgccggatgtgctcactgacattctactccaagtcggagatgcagatccactccaagtcacacaccgagaccaagccccacaagtgcccacattgctccaagaccttcgccaacagctcctacctggcccagcacatccgtatacactcaggggctaagccctacagttgtaacttctgtgagaaatccttccgccagctctcccaccttcagcagcacacccgaatccacactggtgatagaccatacaaatgtgcacacccaggctgtgagaaagccttcacacaactctccaatctgcagtcccacagacggcaacacaacaaagataaacccttcaagtgccacaactgtcatcgggcgtacacggatgcagcctcactagaggtgcacctgtctacgcacacagtgaagcatgccaaggtgtacacctgcactatctgcagtcgggcatacacatcagaaacataccttatgaaacatatgcgcaaacacaacccgcctgatcttcagcaacaggtgcaggcagcagcagcagcggcagcagtggcccaggcccaggctcaagctcaagcccaggctcaggctcaggctcaagcccaggcccaggcccaggcctcccaggcatcacagcagcagcagcagcagcagcagcagcagcagcagcagcaacagccaccaccacacttccagtctcctggggcagccccccagggtgggggtggtggggacagcaatcccaaccctccaccccagtgttcctttgacctgaccccgtataagacggcggagcatcataaggacatctgcctcactgtcaccaccagcaccatccaggtggagcacctggccagctcttagagatccgtgctgccacccactgggaagaggaagaagtagtcctggtgtcttctttctccaactcttggtgggaaaagtccttttcttccttgacaggccttggctccatctccttgggcctctgtcacggctttccttcacaggataccatcctttttctgaactcttcttcaaaaggaacatcagccctcctgattgcaaaggaatactgagctgatggtgtcatccagcagcctcccctcccaagcaaagcttctaaaactgggggtcggtgctcaagggaaggatttgctatgacctcatagaaccttgtccagtgtggccacttaccctatccttaccctccttatcctcaaagtttgggctgatgtaagactagaggctggccctcccagataacagagaaaagggagccccaaatgcaaccagcctcttgttctattcttgcctgcaaaagaacagaggtttctcaaatgcctcagtccctgagagccatttcttcccctacatcgtctcactttgcttcctattgactgctggtagaaggagatttggggtaggggctagacctccttttatttgaagggggcaagggctgagatgtggtccccaaggggccagaaattcccaagttggtcacaggtggcttagaagtgtgtgttatggttttacggatttccttgaagcctctctccttctctgcctacaaagacctatactctcaagtctccccaacccacccccaaggagctgtgggaggctttgtgtaatctgtgcaaactccaaaacaggggtgttgcggagaagggagagttcaaggtaaactcaaggactggacttagctccctaggtgccacagtcagatgccggacacggatttatatataaatatatatatataaatatattatacccactcatcacggccatctttgttgtaaccatttctgtgtttataaatgcattatctctgagaattttcatatttgatgttttgtttatttttgtcctttttttccctctctccacccctgtcctctagccacagcatttttctttttgtccttggggtgggggaggggggagggatggaattc

SEQ ID NO: 278066 - DNA, 3151 bp, Homo sapiens
ctttctccattagcgccccccctacattgctatttccctccctccccccttttcgtttccggcgctcccgccttctctccgcagagctcttctctgagcctgttggggggagggaggggggcgtggaggaactggggttcgcgggagcacgagctgcagcaccacttccgggtgagtgcaaggggagggcagcaaggagggggggccacccactacctcgcgcccccgccctgcgggtgtctcgcgcgcgttccgtgcgtgtgagtgtgtgggtctgtctcgctccagaagtgcgtgcccgcgcgctgcgccttgcgctttttcccctccctcgccccttcctggtcctcccaccctcctaggctccctcctttcccagcaaacgccgcccctcccgcgccctggctcaggctctggcgccgccgcagccgtcgccgcccgaaagttcaggagccctggaaaggagaaggaataagacggcaggaggaagagagagagagggtagaatggaagaatctcacttcaattctaacccgtacttctggccttctatccccacagtctcaggtcagatcgagaacacaatgttcatcaacaagatgaaggatcagctgttgccagagaagggctgtggtctggccccacctcactaccccaccttgctgacagtgcctgcctcagtgtccctgccctcaggcatcagtatggacacagagtccaagtcagaccagctgaccccacacagccaagcgtccgttacccagaatatcacggtggtccctgtgccgtctacaggactgatgactgctggagtctcctgttctcagaggtggagaagagaagggagtcaatcaaggggtccgggtttggtaatcacgtccccctcaggctctcttgtgaccacagcatcatcagctcagaccttccccatttcggctcccatgattgtctcagctcttccccctggctcacaagccctgcaggttgtccctgacctctccaagaaggtagcatcgaccctaaccgaggaaggaggcggaggtggtggtggaggtggcagtgtggctcctaagccaccccggggccggaagaagaagcggatgctggaatcagggctgcccgagatgaatgacccttatgtcctctcccctgaggatgatgatgaccatcagaaagacggcaagacctacaggtgccggatgtgctcactgacattctactccaagtcggagatgcagatccactccaagtcacacaccgagaccaagccccacaagtgcccacattgctccaagaccttcgccaacagctcctacctggcccagcacatccgtatacactcaggggctaagccctacagttgtaacttctgtgagaaatccttccgccagctctcccaccttcagcagcacacccgaatccacactggtgatagaccatacaaatgtgcacacccaggctgtgagaaagccttcacacaactctccaatctgcagtcccacagacggcaacacaacaaagataaacccttcaagtgccacaactgtcatcgggcgtacacggatgcagcctcactagaggtgcacctgtctacgcacacagtgaagcatgccaaggtgtacacctgcactatctgcagtcgggcatacacatcagaaacataccttatgaaacatatgcgcaaacacaacccgcctgatcttcagcaacaggtgcaggcagcagcagcagcggcagcagtggcccaggcccaggctcaagctcaagcccaggctcaggctcaggctcaagcccaggcccaggcccaggcctcccaggcatcacagcagcagcagcagcagcagcagcagcagcagcagcagcaacagccaccaccacacttccagtctcctggggcagccccccagggtgggggtggtggggacagcaatcccaaccctccaccccagtgttcctttgacctgaccccgtataagacggcggagcatcataaggacatctgcctcactgtcaccaccagcaccatccaggtggagcacctggccagctcttagagatccgtgctgccacccactgggaagaggaagaagtagtcctggtgtcttctttctccaactcttggtgggaaaagtccttttcttccttgacaggccttggctccatctccttgggcctctgtcacggctttccttcacaggataccatcctttttctgaactcttcttcaaaaggaacatcagccctcctgattgcaaaggaatactgagctgatggtgtcatccagcagcctcccctcccaagcaaagcttctaaaactgggggtcggtgctcaagggaaggatttgctatgacctcatagaaccttgtccagtgtggccacttaccctatccttaccctccttatcctcaaagtttgggctgatgtaagactagaggctggccctcccagataacagagaaaagggagccccaaatgcaaccagcctcttgttctattcttgcctgcaaaagaacagaggtttctcaaatgcctcagtccctgagagccatttcttcccctacatcgtctcactttgcttcctattgactgctggtagaaggagatttggggtaggggctagacctccttttatttgaagggggcaagggctgagatgtggtccccaaggggccagaaattcccaagttggtcacaggtggcttagaagtgtgtgttatggttttacggatttccttgaagcctctctccttctctgcctacaaagacctatactctcaagtctccccaacccacccccaaggagctgtgggaggctttgtgtaatctgtgcaaactccaaaacaggggtgttgcggagaagggagagttcaaggtaaactcaaggactggacttagctccctaggtgccacagtcagatgccggacacggatttatatataaatatatatatataaatatattatacccactcatcacggccatctttgttgtaaccatttctgtgtttataaatgcattatctctgagaattttcatatttgatgttttgtttatttttgtcctttttttccctctctccacccctgtcctctagccacagcatttttctttttgtccttggggtgggggaggggggagggatggaattc

SEQ ID NO: 278067 - DNA, 2872 bp, Homo sapiens
actgtgtgtgtgtccgtcccggaaccggaagtggttgtggaggagcgggcgatgggaaggaatgggggggtttagggggcgggtgcctgtctggtgggtggcagagttcagctccctggaggggaaggagggacgtcccaaggaagggtctttgagaaagggaaagttcaggagccctggaaaggagaaggaataagacggcaggaggaagagagagagagggtagaatggaagaatctcacttcaattctaacccgtacttctggccttctatccccacagtctcaggtcagatcgagaacacaatgttcatcaacaagatgaaggatcagctgttgccagagaagggctgtggtctggccccacctcactaccccaccttgctgacagtgcctgcctcagtgtccctgccctcaggcatcagtatggacacagagtccaagtcagaccagctgaccccacacagccaagcgtccgttacccagaatatcacggtggtccctgtgccgtctacaggactgatgactgctggagtctcctgttctcagaggtggagaagagaagggagtcaatcaaggggtccgggtttggtaatcacgtccccctcaggctctcttgtgaccacagcatcatcagctcagaccttccccatttcggctcccatgattgtctcagctcttccccctggctcacaagccctgcaggttgtccctgacctctccaagaaggtagcatcgaccctaaccgaggaaggaggcggaggtggtggtggaggtggcagtgtggctcctaagccaccccggggccggaagaagaagcggatgctggaatcagggctgcccgagatgaatgacccttatgtcctctcccctgaggatgatgatgaccatcagaaagacggcaagacctacaggtgccggatgtgctcactgacattctactccaagtcggagatgcagatccactccaagtcacacaccgagaccaagccccacaagtgcccacattgctccaagaccttcgccaacagctcctacctggcccagcacatccgtatacactcaggggctaagccctacagttgtaacttctgtgagaaatccttccgccagctctcccaccttcagcagcacacccgaatccacactggtgatagaccatacaaatgtgcacacccaggctgtgagaaagccttcacacaactctccaatctgcagtcccacagacggcaacacaacaaagataaacccttcaagtgccacaactgtcatcgggcgtacacggatgcagcctcactagaggtgcacctgtctacgcacacagtgaagcatgccaaggtgtacacctgcactatctgcagtcgggcatacacatcagaaacataccttatgaaacatatgcgcaaacacaacccgcctgatcttcagcaacaggtgcaggcagcagcagcagcggcagcagtggcccaggcccaggctcaagctcaagcccaggctcaggctcaggctcaagcccaggcccaggcccaggcctcccaggcatcacagcagcagcagcagcagcagcagcagcagcagcagcagcaacagccaccaccacacttccagtctcctggggcagccccccagggtgggggtggtggggacagcaatcccaaccctccaccccagtgttcctttgacctgaccccgtataagacggcggagcatcataaggacatctgcctcactgtcaccaccagcaccatccaggtggagcacctggccagctcttagagatccgtgctgccacccactgggaagaggaagaagtagtcctggtgtcttctttctccaactcttggtgggaaaagtccttttcttccttgacaggccttggctccatctccttgggcctctgtcacggctttccttcacaggataccatcctttttctgaactcttcttcaaaaggaacatcagccctcctgattgcaaaggaatactgagctgatggtgtcatccagcagcctcccctcccaagcaaagcttctaaaactgggggtcggtgctcaagggaaggatttgctatgacctcatagaaccttgtccagtgtggccacttaccctatccttaccctccttatcctcaaagtttgggctgatgtaagactagaggctggccctcccagataacagagaaaagggagccccaaatgcaaccagcctcttgttctattcttgcctgcaaaagaacagaggtttctcaaatgcctcagtccctgagagccatttcttcccctacatcgtctcactttgcttcctattgactgctggtagaaggagatttggggtaggggctagacctccttttatttgaagggggcaagggctgagatgtggtccccaaggggccagaaattcccaagttggtcacaggtggcttagaagtgtgtgttatggttttacggatttccttgaagcctctctccttctctgcctacaaagacctatactctcaagtctccccaacccacccccaaggagctgtgggaggctttgtgtaatctgtgcaaactccaaaacaggggtgttgcggagaagggagagttcaaggtaaactcaaggactggacttagctccctaggtgccacagtcagatgccggacacggatttatatataaatatatatatataaatatattatacccactcatcacggccatctttgttgtaaccatttctgtgtttataaatgcattatctctgagaattttcatatttgatgttttgtttatttttgtcctttttttccctctctccacccctgtcctctagccacagcatttttctttttgtccttggggtgggggaggggggagggatggaattc

SEQ ID NO: 278068 - DNA, 1964 bp, Homo sapiens
gagttttgaccctgtgggccccctgtgaaggtcttagtgttccctaaagatccccatgcctcattttaagaaccactggactggtgagacgggcataagctgtcttgggatcctggtatgtgctacatgaggtatgcttccacccttagcctgtagcttctcaagtttcatttgaaacaatttctactttcttcagatagagggagaagctgggaggcctgacacctacctttttgctttccatcgaggtcaagggggcaggaggaaagagtacaatgtattcattctggtttctcccaattttctcagtcccacagacggcaacacaacaaagataaacccttcaagtgccacaactgtcatcgggcgtacacggatgcagcctcactagaggtgcacctgtctacgcacacagtgaagcatgccaaggtgtacacctgcactatctgcagtcgggcatacacatcagaaacataccttatgaaacatatgcgcaaacacaacccgcctgatcttcagcaacaggtgcaggcagcagcagcagcggcagcagtggcccaggcccaggctcaagctcaagcccaggctcaggctcaggctcaagcccaggcccaggcccaggcctcccaggcatcacagcagcagcagcagcagcagcagcagcagcagcagcagcaacagccaccaccacacttccagtctcctggggcagccccccagggtgggggtggtggggacagcaatcccaaccctccaccccagtgttcctttgacctgaccccgtataagacggcggagcatcataaggacatctgcctcactgtcaccaccagcaccatccaggtggagcacctggccagctcttagagatccgtgctgccacccactgggaagaggaagaagtagtcctggtgtcttctttctccaactcttggtgggaaaagtccttttcttccttgacaggccttggctccatctccttgggcctctgtcacggctttccttcacaggataccatcctttttctgaactcttcttcaaaaggaacatcagccctcctgattgcaaaggaatactgagctgatggtgtcatccagcagcctcccctcccaagcaaagcttctaaaactgggggtcggtgctcaagggaaggatttgctatgacctcatagaaccttgtccagtgtggccacttaccctatccttaccctccttatcctcaaagtttgggctgatgtaagactagaggctggccctcccagataacagagaaaagggagccccaaatgcaaccagcctcttgttctattcttgcctgcaaaagaacagaggtttctcaaatgcctcagtccctgagagccatttcttcccctacatcgtctcactttgcttcctattgactgctggtagaaggagatttggggtaggggctagacctccttttatttgaagggggcaagggctgagatgtggtccccaaggggccagaaattcccaagttggtcacaggtggcttagaagtgtgtgttatggttttacggatttccttgaagcctctctccttctctgcctacaaagacctatactctcaagtctccccaacccacccccaaggagctgtgggaggctttgtgtaatctgtgcaaactccaaaacaggggtgttgcggagaagggagagttcaaggtaaactcaaggactggacttagctccctaggtgccacagtcagatgccggacacggatttatatataaatatatatatataaatatattatacccactcatcacggccatctttgttgtaaccatttctgtgtttataaatgcattatctctgagaattttcatatttgatgttttgtttatttttgtcctttttttccctctctccacccctgtcctctagccacagcatttttctttttgtccttggggtgggggaggggggagggatggaattc

SEQ ID NO: 278069 - DNA, 1837 bp, Homo sapiens
tactgggattacaggtgtgagccaccgcacctggcccagttagatattttccatgagactccagaaaaggttgtaaagttgtttcattcaggggtctttgaaaaaaatagcagctcattcctttgccagttgaatgttgagtgacttctaaaggttcctctcttttttttctcagtagtgagccactgaaagtgctacttgagttttgctcagtcttggctccagaaaaccagtataaagcttactctgcttacagcagaatcagagcctggggtgctagttacaagtaatctcttttccttcctctttatccctcaacttctttttaccatctccctcaggaaacataccttatgaaacatatgcgcaaacacaacccgcctgatcttcagcaacaggtgcaggcagcagcagcagcggcagcagtggcccaggcccaggctcaagctcaagcccaggctcaggctcaggctcaagcccaggcccaggcccaggcctcccaggcatcacagcagcagcagcagcagcagcagcagcagcagcagcagcaacagccaccaccacacttccagtctcctggggcagccccccagggtgggggtggtggggacagcaatcccaaccctccaccccagtgttcctttgacctgaccccgtataagacggcggagcatcataaggacatctgcctcactgtcaccaccagcaccatccaggtggagcacctggccagctcttagagatccgtgctgccacccactgggaagaggaagaagtagtcctggtgtcttctttctccaactcttggtgggaaaagtccttttcttccttgacaggccttggctccatctccttgggcctctgtcacggctttccttcacaggataccatcctttttctgaactcttcttcaaaaggaacatcagccctcctgattgcaaaggaatactgagctgatggtgtcatccagcagcctcccctcccaagcaaagcttctaaaactgggggtcggtgctcaagggaaggatttgctatgacctcatagaaccttgtccagtgtggccacttaccctatccttaccctccttatcctcaaagtttgggctgatgtaagactagaggctggccctcccagataacagagaaaagggagccccaaatgcaaccagcctcttgttctattcttgcctgcaaaagaacagaggtttctcaaatgcctcagtccctgagagccatttcttcccctacatcgtctcactttgcttcctattgactgctggtagaaggagatttggggtaggggctagacctccttttatttgaagggggcaagggctgagatgtggtccccaaggggccagaaattcccaagttggtcacaggtggcttagaagtgtgtgttatggttttacggatttccttgaagcctctctccttctctgcctacaaagacctatactctcaagtctccccaacccacccccaaggagctgtgggaggctttgtgtaatctgtgcaaactccaaaacaggggtgttgcggagaagggagagttcaaggtaaactcaaggactggacttagctccctaggtgccacagtcagatgccggacacggatttatatataaatatatatatataaatatattatacccactcatcacggccatctttgttgtaaccatttctgtgtttataaatgcattatctctgagaattttcatatttgatgttttgtttatttttgtcctttttttccctctctccacccctgtcctctagccacagcatttttctttttgtccttggggtgggggaggggggagggatggaattc

SEQ ID NO: 278070 - DNA, 654 bp, Homo sapiens
aaggaggagcgcacgaggaggaggaggggtgttggcgcgtgtgtttcacactcgcctccctggcgttcgcgagctgacccgaggagtggtaatctcacgcggcaaagcagggaggaagaaaaaaaggagacaaaagaaaaaaagacttttatctgggcagaaagtcacaatgcctagcggccaaacgtttgtgagcggtgaagttggttgactgctcaagtttgcagagcttcagcagtaggttactttctctggacggtttctgctatctttgctcttttcgagctctagcatcgtttgcaaatatttcaatgacttggaccaagtgcagagttttacttcatagctcacccttttagattcggagtacagaaaaaggcatcgtggagttttagggttggttttcatcaatcctttccaaggcctttactttctacatggagaaacgtgtagagggagaggttgtgaattgccaaagacatgccgttagattccagatctcctgtgtttgaccaaagttcttgaccaaagttcttaatatcttatttgaaccaaattatattgtatttggaatattgggtagccacaggcccttggacttcagtgatattccaaactattgatggcaaatgacattatggagatctgagtaaa

SEQ ID NO: 278071 - DNA, 462 bp, Homo sapiens
actaaagagatttcaagttttatttagcaacttgtactctacctttttgcaaaactttatgaagattgcatcactaaagagagcaagcacacagatttggtaagttcagtaatgtttacaaaataataggtgatgcatgccaacattgttaatactgagattaggaggggctttccaggacttaagttacaaatcaatgttctcttcaccactattcaggaaaaaaaaaaatctgacgatcaaagaagcccctcctcacactaccaaaggtttaaagacaacggaaaaaagtggtatagacagatcctcaaagcctctcaccatgtcctattctcaatgagacatagcctaagaaaacggaatctaaaagcaagacagatacattaccaacaaatacagtagtttgtagatgaaaacaaaaaatgatttaacaaaaataaaataatccattgaaagctgata

SEQ ID NO: 278072 - DNA, 515 bp, Homo sapiens
aaggaggagcgcacgaggaggaggaggggtgttggcgcgtgtgtttcacactcgcctccctggcgttcgcgagctgacccgaggagtggtaatctcacgcggcaaagcagggaggaagaaaaaaaggagacaaaagaaaaaaagacttttatctgggcagaaagtcacaatgcctagcggccaaacgtttgtgagcggtgaagttggttgactgctcaagtttgcagagcttcagcaattgcatcactaaagagagcaagcacacagatttggaaaaaaaaaaatctgacgatcaaagaagcccctcctcacactaccaaaggtttaaagacaacggaaaaaagtggtatagacagatcctcaaagcctctcaccatgtcctattctcaatgagacatagcctaagaaaacggaatctaaaagcaagacagatacattaccaacaaatacagtagtttgtagatgaaaacaaaaaatgatttaacaaaaataaaataatccattgaaagctgata

SEQ ID NO: 278073 - DNA, 2034 bp, Homo sapiens
taattataaaagaggtttaattttcgactcacagttccacatggctgggaaggcctcaggaaacttaacaatcacggtggaaggcacctcttcacagggcggcaagagtgagaatgagagccagtaggggaaatgccaggcacttataaaaccatcagatctcatgaaagctcactatcatgagaatagcatgagggaaactgcccccatgattcaattacctaccacaacacctgggaattatgaggattaaaattcaagatgagacttgggtggggatacatccaaaccatatcaatccatatatggctgaaatttacatcagacaatggtaaatatctatgttcaaagtccattgatgctttgagattctgagctattttctggtatggaaaacagacttagcatctccatctccattggatgtatgctgcctcctgtgatgatcaaggaatgcaatggttctcccaagtccacagtgcacatttgccttaaagtgcctgctgcaattttctggtcgtcggctccaaccctggctaagccaacacaaagtgtctcctcggtaactgctattaaaaaaaaaagatactgctattcaattcagcaagtgcatcatccatccaacagtcaaacaaacattagtaccacaagtacatttcaagaagccccaaatatcttaaatctcttttgccacttatggaccagttatccattaattcatccaagggattttctaaatcatttgtattacctaatataaaagagtacttccaaactttaccctttcagaattacaaaggcttacactaagcttttaggacttgacaagctatacttacactctacaattgcacagcattcgtttttaaataagttctgagtaaacaatgtttattacacacaggtttttaataacttgcttgagataatgttcatattgacctagatatactgaagaaaccatgagattatgaaataaattcacagatttgagtttctgccttgccatccaattagctgtgtgataaacttcagttttctcattttttaaaatgtaatactccctcttttaaatcatggtaatgagagctaagatagtagatatgagactagtagactatagattccttaacaaataatgagcatttggcactatttatgtttttcagttaaaaacagccagccttagctttagtattattcactctggtgctacagctaaagagctgaccctttaatggttgtattgtttagttgggaaaggggtcttgattgaacaatgatcaaaagggggcaaatggtttatccaaggacaaacaggaatgcaggaaacttctgtacaaagttatggatatagaacatccttgcagactatttgtttcacgactttaacatggcctactaatgagaataaaataagcaacaatcactcaagaatctcttgactgggtgcggtgactcgcacctgtaatcccagcattttgggaggctgaggcaggcggatcgcttgagctcaggagtttgagaccagctgggcaacatggtgaaaccccatctccaccaaaaatacaaaaaaattagctgggtgtggtggcatgcacctgtagtcccagctactcaagtggctaaggtgagagggtggcttgagcccgggaggcagaggttgcagtgagccatgattgcaccactgcactctaacttgggcaacaaagcaagaccccatctcaaaaaaaaaaaaaagtctcacagtgggccaggcgtggtggttcacacctgtaatcccaacactttgggaggctttgggaggctgaggtgggaggattgcttgagccaaggaattcgagaaaagcctgggcaacatggtgaaaccctgtctctaccaaaaacacacaaagaaattagctgggcatggtggcatgcacttgtagttcagctaaggtgggaggatcacttgagcccaggaggtggaggctgcaatgagctgagatagtgcctctgcactccagcctgcgtgacaaagtgagaccctctctc

SEQ ID NO: 278074 - DNA, 1251 bp, Homo sapiens
caggtatggagagggggttcagcgagcctgacaactttcttctgccctctcttgccccagaaacagcagaggcaggagagagactccctctggctcctatcccacctctttgcatgggaccctgtgccaaacacccaagtttaagagaagagtagagctgtggcatctccagaccaggcctttccacccacccacccccagttaccctcccagccacctgctgcatctgttcctgcctgcagccctaggatcagggcaaggtttggcaagaaggaagatctgcactactttgcggcctctgctcctccggttcccccaccccagcttcctgctcaatgctgatcagggacaggtggcgcaggtgagcctgacaggcccccacaggagcccagatggacaagcctcagcgttaccctgcaggcttcttcctgtgaggaaagccagcatcacggatctcagccagcaccgtcagaagctgaaccagcaccgtatgggctagggtgggaggctcagccacaggcagaagggtgggaagggcctggagtctgtggctggtgaggaaggaaggagggtgtattgtctagactgaacatggtacacattctgcatgtatagcagagcagccagcaggtagcaatcctggctgtccttctatgctggatcccagatggactctggcccttacctccccacctgagattagggtgagtgtgtttgctctggctgagagcagagctgagagcaggtatacagagctggaagtggaccatggaaaacatcgataaccatgcatcctcttgcttggccacctcctgaaactgctccacctttgaagtttgaactttagtccctccacactctgactgctgcctccttcctcccagctctctcactgagttatcttcactgtacctgttccagcatatccccactatctctctttctcctgatctgtgctgtcttattctcctccttaggcttcctattacctgggattccatgattcattccttcagaccctctcctgccagtatgctaaaccctccctctctctttcttatcccgctgtcccattggcccagcctggatgaatctatcaataaaacaactagagaatggtggtcagtgagacactatagaattactaaggagaagatgcctctggagtttggatcgggtgttacaggtacaagtaggtatgttgcagaggaaaataaatatcaaactgtatactaaaattacattttaaaa

SEQ ID NO: 278075 - DNA, 1792 bp, Homo sapiens
gatgggggagagaaggcgttcaccttggctctgctggcgttttccttggggccctccagctgcagccagatgtgggggttgtccggacagtccttcggaaggacgctcacccccacgctgaagatgcgctccacatggggctgctgttcccgaaccttgttctcagcctccgcagacaccgcaaagcgatctggggacgcggggcgggccccccaggtcctggtgaacgagggcggtggctttgaccgggcctctggctccttcgtagcccctgtccggggtgtctacagcttccggttccatgtggtgaaggtgtacaaccgccaaactgtccaggtgagcctgatgctgaacacgtggcctgtcatctcagcctttgccaatgatcctgacgtgacccgggaggcagccaccagctctgtgctactgcccttggaccctggggaccgagtgtctctgcgcctgcgtcgggggaatctactgggtggttggaaatactcaagtttctctggcttcctcatcttccctctctgaggacccaagtctttcaagcacaagaatccagcccctgacaactttcttctgccctctcttgccccagaaacagcagaggcaggagagagactccctctggctcctatcccacctctttgcatgggaccctgtgccaaacacccaagtttaagagaagagtagagctgtggcatctccagaccaggcctttccacccacccacccccagttaccctcccagccacctgctgcatctgttcctgcctgcagccctaggatcagggcaaggtttggcaagaaggaagatctgcactactttgcggcctctgctcctccggttcccccaccccagcttcctgctcaatgctgatcagggacaggtggcgcaggtgagcctgacaggcccccacaggagcccagatggacaagcctcagcgttaccctgcaggcttcttcctgtgaggaaagccagcatcacggatctcagccagcaccgtcagaagctgaaccagcaccgtatgggctagggtgggaggctcagccacaggcagaagggtgggaagggcctggagtctgtggctggtgaggaaggaaggagggtgtattgtctagactgaacatggtacacattctgcatgtatagcagagcagccagcaggtagcaatcctggctgtccttctatgctggatcccagatggactctggcccttacctccccacctgagattagggtgagtgtgtttgctctggctgagagcagagctgagagcaggtatacagagctggaagtggaccatggaaaacatcgataaccatgcatcctcttgcttggccacctcctgaaactgctccacctttgaagtttgaactttagtccctccacactctgactgctgcctccttcctcccagctctctcactgagttatcttcactgtacctgttccagcatatccccactatctctctttctcctgatctgtgctgtcttattctcctccttaggcttcctattacctgggattccatgattcattccttcagaccctctcctgccagtatgctaaaccctccctctctctttcttatcccgctgtcccattggcccagcctggatgaatctatcaataaaacaactagagaatggtggtcagtgagacactatagaattactaaggagaagatgcctctggagtttggatcgggtgttacaggtacaagtaggtatgttgcagaggaaaataaatatcaaactgtatactaaaattacattttaaaa

SEQ ID NO: 278076 - DNA, 867 bp, Homo sapiens
gatgggggagagaaggcgttcaccttggctctgctggcgttttccttggggccctccagctgcagccagatgtgggggttgtccggacagtccttcggaaggacgctcacccccacgctgaagatgcgctccacatggggctgctgttcccgaaccttgttctcagcctccgcagacaccgcaaagcgatctggggacgcggggcgggccccccaggtcctggtgaacgagggcggtggctttgaccgggcctctggctccttcgtagcccctgtccggggtgtctacagcttccggttccatgtggtgaaggtgtacaaccgccaaactgtccaggtgagcctgatgctgaacacgtggcctgtcatctcagcctttgccaatgatcctgacgtgacccgggaggcagccaccagctctgtgctactgcccttggaccctggggaccgagtgtctctgcgcctgcgtcgggggaatctactgggtggttggaaatactcaagtttctctggcttcctcatcttccctctctgaggacccaagtctttcaagcacaagaatccagcccctgacaactttcttctgccctctcttgccccagaaacagcagaggcaggagagagactccctctggctcctatcccacctctttgcatgggaccctgtgccaaacacccaagtttaagagaagagtagagctgtggcatctccagaccaggccttactactgatatacttgtagtgaccttatcacttatctagttcatctaatggtgcttttatccctaggatctggccctggttttgcaacaggcgtacatttttcccctcttatccgcttcaagtccctcctatacccttctcctc

SEQ ID NO: 278077 - DNA, 1869 bp, Homo sapiens
agcgggcgggtgcgcgagccgcgcgctcccgccgcccgcgtcgccatctttttccccctccgtctgtctgtctgctgttggctttgtccgtctgcagcgccgcccctcggctccccgccaccggctcggctcggcccggagccccttccgctcgccggggcccagtcccggagcgccccggcccggctggcttgggctgcggtcccgggtccattgtccggcggtccgtctgtccggaggcggggcccagggacccagagcgcagcgcagcgccgaggcgccggatacagatcacttggattcagtcgagtttgctttgctccgtgggaactgcaccagagctggaggttagcatcttgcaaggaggtagtaacatatccagtcgtgaaactgggaaagaccagagctcttgcatcagggaaacatgtcccgtcggaaacagacaaatccaaataaagttcactgtgacagtgagggtgatgaagaggagacgacacaagatgaagtctcttcccacacatcagaggaagatggaggggtggtcaaagtggagaaagagttagaaaatacagaacagcctgttggtgggaacgaagtggtagagcacgaggtcacagggaatttgaattctgaccccttgcttgaactctgccagtgtcccctctgccagctagactgcgggagccgggagcagttgattgctcacgtgtaccagcacactgcagcagtggtgagcgccaagagctacatgtgtcctgtctgtggccgggcccttagctccccggggtcattgggtcgccacctcttaatccactcggaggaccagcgatctaactgtgctgtgtgtggagcccggttcaccagccatgccacttttaacagtgagaaacttcctgaagtactaaatatggaatccctacccacagtccacaatgagggtccctccagtgctgaggggaaggatattgcctttagtcctccagtgtaccctgctggaattctgcttgtgtgcaacaactgtgctgcctaccgtaaactgctggaagcccagactcccagtgtacgcaagtgggctctacgtcgacagaatgagcctttggaagtacggctgcagcggctggaacgagagcgcacggccaagaagagccggcgggacaatgagacccccgaggagcgggaggtgaggcgcatgagggaccgtgaagccaagcgcttgcagcgcatgcaggagacagacgagcagcgggcacgccggctgcagcgggatcgggaggccatgaggctgaagcgggccaatgaaaccccggaaaagcggcaggcccggctcatccgagagcgagaggccaagcggctcaagaggaggctggagaaaatggacatgatgttgcgagctcagtttggccaggacccttctgccatggcagccttagcagctgaaatgaacttcttccagctgcctgtaagtggggtggagttggacagccagcttctgggcaagatggcctttgaagagcagaacagcagctctctgcactgaaccacaccctcctgcctgccctccttcccacctacctacccacccacccacacccacagccacgaggaccagtgctgctgccacccacgaggccctgtccttgctgccagaggcaggcctgggtttattgcaggtggacctgagcagcccttgcatatgggaacaggatgatggggtcaggagggacctggctcaaggcagctctggacaagggagcaggcagtccagagaactggcctccccagcccactgccacaggctgtgcttctaggactgtgggcccctgtgtggcccatgaagttgtgaagtcaaataaattaattttatcttta

SEQ ID NO: 278078 - DNA, 1828 bp, Homo sapiens
agcgggcgggtgcgcgagccgcgcgctcccgccgcccgcgtcgccatctttttccccctccgtctgtctgtctgctgttggctttgtccgtctgcagcgccgcccctcggctccccgccaccggctcggctcggcccggagccccttccgctcgccggggcccagtcccggagcgccccggcccggctggcttgggctgcggtcccgggtccattgtccggcggtccgtctgtccggaggcggggcccagggacccagagcgcagcgcagcgccgaggcgccggatacagatcacttggattcagtcgagtttgctttgctccgtgggaactgcaccagagctggaggttagcatcttgcaaggaggtagtaacatatccagtcgtgaaactgggaaagaccagagctcttgcatcagggaaacatgtcccgtcggaaacagacaaatccaaataaagttcactgggatcaagtatttgctgggctagaagagcaagcccgccaggcgatgatgaaaactgattttcctggagaccttggcagtcagcgacaagctatccaacaactaagagatcaggactccagtagcagtgacagtgagggtgatgaagaggagacgacacaagatgaagtctcttcccacacatcagaggaagatggaggggtggtcaaagtggagaaagagttagaaaatacagaacagcctgttggtgggaacgaagtggtagagcacgaggtcacagggaatttgaattctgaccccttgcttgaactctgccagtgtcccctctgccagctagactgcgggagccgggagcagttgattgctcacgtgtaccagtgagaaacttcctgaagtactaaatatggaatccctacccacagtccacaatgagggtccctccagtgctgaggggaaggatattgcctttagtcctccagtgtaccctgctggaattctgcttgtgtgcaacaactgtgctgcctaccgtaaactgctggaagcccagactcccagtgtacgcaagtgggctctacgtcgacagaatgagcctttggaagtacggctgcagcggctggaacgagagcgcacggccaagaagagccggcgggacaatgagacccccgaggagcgggaggtgaggcgcatgagggaccgtgaagccaagcgcttgcagcgcatgcaggagacagacgagcagcgggcacgccggctgcagcgggatcgggaggccatgaggctgaagcgggccaatgaaaccccggaaaagcggcaggcccggctcatccgagagcgagaggccaagcggctcaagaggaggctggagaaaatggacatgatgttgcgagctcagtttggccaggacccttctgccatggcagccttagcagctgaaatgaacttcttccagctgcctgtaagtggggtggagttggacagccagcttctgggcaagatggcctttgaagagcagaacagcagctctctgcactgaaccacaccctcctgcctgccctccttcccacctacctacccacccacccacacccacagccacgaggaccagtgctgctgccacccacgaggccctgtccttgctgccagaggcaggcctgggtttattgcaggtggacctgagcagcccttgcatatgggaacaggatgatggggtcaggagggacctggctcaaggcagctctggacaagggagcaggcagtccagagaactggcctccccagcccactgccacaggctgtgcttctaggactgtgggcccctgtgtggcccatgaagttgtgaagtcaaataaattaattttatcttta

SEQ ID NO: 278079 - DNA, 1847 bp, Homo sapiens
agcgggcgggtgcgcgagccgcgcgctcccgccgcccgcgtcgccatctttttccccctccgtctgtctgtctgctgttggctttgtccgtctgcagcgccgcccctcggctccccgccaccggctcggctcggcccggagccccttccgctcgccggggcccagtcccggagcgccccggcccggctggcttgggctgcggtcccgggtccattgtccggcggtccgtctgtccggaggcggggcccagggacccagagcgcagcgcagcgccgaggcgccggatacagatcacttggattcagtcgagtttgctttgctccgtgggaactgcaccagagctggaggttagcatcttgcaaggaggtagtaacatatccagtcgtgaaactgggaaagaccagagctcttgcatcagggaaacatgtcccgtcggaaacagacaaatccaaataaagttcactgggatcaagtatttgctgggctagaagagcaagcccgccaggcgatgatgaaaactgattttcctggagaccttggcagtcagcgacaagctatccaacaactaagagatcaggactccagtagcagtgagttctgcaccttctggtgacagtgagggtgatgaagaggagacgacacaagatgaagtctcttcccacacatcagaggaagatggaggggtggtcaaagtggagaaagagttagaaaatacagaacagcctgttggtgggaacgaagtggtagagcacgaggtcacagggaatttgaattctgaccccttgcttgaactctgccagtgtcccctctgccagctagactgcgggagccgggagcagttgattgctcacgtgtaccagtgagaaacttcctgaagtactaaatatggaatccctacccacagtccacaatgagggtccctccagtgctgaggggaaggatattgcctttagtcctccagtgtaccctgctggaattctgcttgtgtgcaacaactgtgctgcctaccgtaaactgctggaagcccagactcccagtgtacgcaagtgggctctacgtcgacagaatgagcctttggaagtacggctgcagcggctggaacgagagcgcacggccaagaagagccggcgggacaatgagacccccgaggagcgggaggtgaggcgcatgagggaccgtgaagccaagcgcttgcagcgcatgcaggagacagacgagcagcgggcacgccggctgcagcgggatcgggaggccatgaggctgaagcgggccaatgaaaccccggaaaagcggcaggcccggctcatccgagagcgagaggccaagcggctcaagaggaggctggagaaaatggacatgatgttgcgagctcagtttggccaggacccttctgccatggcagccttagcagctgaaatgaacttcttccagctgcctgtaagtggggtggagttggacagccagcttctgggcaagatggcctttgaagagcagaacagcagctctctgcactgaaccacaccctcctgcctgccctccttcccacctacctacccacccacccacacccacagccacgaggaccagtgctgctgccacccacgaggccctgtccttgctgccagaggcaggcctgggtttattgcaggtggacctgagcagcccttgcatatgggaacaggatgatggggtcaggagggacctggctcaaggcagctctggacaagggagcaggcagtccagagaactggcctccccagcccactgccacaggctgtgcttctaggactgtgggcccctgtgtggcccatgaagttgtgaagtcaaataaattaattttatcttta

SEQ ID NO: 278080 - DNA, 1995 bp, Homo sapiens
agcgggcgggtgcgcgagccgcgcgctcccgccgcccgcgtcgccatctttttccccctccgtctgtctgtctgctgttggctttgtccgtctgcagcgccgcccctcggctccccgccaccggctcggctcggcccggagccccttccgctcgccggggcccagtcccggagcgccccggcccggctggcttgggctgcggtcccgggtccattgtccggcggtccgtctgtccggaggcggggcccagggacccagagcgcagcgcagcgccgaggcgccggatacagatcacttggattcagtcgagtttgctttgctccgtgggaactgcaccagagctggaggttagcatcttgcaaggaggtagtaacatatccagtcgtgaaactgggaaagaccagagctcttgcatcagggaaacatgtcccgtcggaaacagacaaatccaaataaagttcactgggatcaagtatttgctgggctagaagagcaagcccgccaggcgatgatgaaaactgattttcctggagaccttggcagtcagcgacaagctatccaacaactaagagatcaggactccagtagcagtgacagtgagggtgatgaagaggagacgacacaagatgaagtctcttcccacacatcagaggaagatggaggggtggtcaaagtggagaaagagttagaaaatacagaacagcctgttggtgggaacgaagtggtagagcacgaggtcacagggaatttgaattctgaccccttgcttgaactctgccagtgtcccctctgccagctagactgcgggagccgggagcagttgattgctcacgtgtaccagcacactgcagcagtggtgagcgccaagagctacatgtgtcctgtctgtggccgggcccttagctccccggggtcattgggtcgccacctcttaatccactcggaggaccagcgatctaactgtgctgtgtgtggagcccggttcaccagccatgccacttttaacagtgagaaacttcctgaagtactaaatatggaatccctacccacagtccacaatgagggtccctccagtgctgaggggaaggatattgcctttagtcctccagtgtaccctgctggaattctgcttgtgtgcaacaactgtgctgcctaccgtaaactgctggaagcccagactcccagtgtacgcaagtgggctctacgtcgacagaatgagcctttggaagtacggctgcagcggctggaacgagagcgcacggccaagaagagccggcgggacaatgagacccccgaggagcgggaggtgaggcgcatgagggaccgtgaagccaagcgcttgcagcgcatgcaggagacagacgagcagcgggcacgccggctgcagcgggatcgggaggccatgaggctgaagcgggccaatgaaaccccggaaaagcggcaggcccggctcatccgagagcgagaggccaagcggctcaagaggaggctggagaaaatggacatgatgttgcgagctcagtttggccaggacccttctgccatggcagccttagcagctgaaatgaacttcttccagctgcctgtaagtggggtggagttggacagccagcttctgggcaagatggcctttgaagagcagaacagcagctctctgcactgaaccacaccctcctgcctgccctccttcccacctacctacccacccacccacacccacagccacgaggaccagtgctgctgccacccacgaggccctgtccttgctgccagaggcaggcctgggtttattgcaggtggacctgagcagcccttgcatatgggaacaggatgatggggtcaggagggacctggctcaaggcagctctggacaagggagcaggcagtccagagaactggcctccccagcccactgccacaggctgtgcttctaggactgtgggcccctgtgtggcccatgaagttgtgaagtcaaataaattaattttatcttta

SEQ ID NO: 278081 - DNA, 2014 bp, Homo sapiens
agcgggcgggtgcgcgagccgcgcgctcccgccgcccgcgtcgccatctttttccccctccgtctgtctgtctgctgttggctttgtccgtctgcagcgccgcccctcggctccccgccaccggctcggctcggcccggagccccttccgctcgccggggcccagtcccggagcgccccggcccggctggcttgggctgcggtcccgggtccattgtccggcggtccgtctgtccggaggcggggcccagggacccagagcgcagcgcagcgccgaggcgccggatacagatcacttggattcagtcgagtttgctttgctccgtgggaactgcaccagagctggaggttagcatcttgcaaggaggtagtaacatatccagtcgtgaaactgggaaagaccagagctcttgcatcagggaaacatgtcccgtcggaaacagacaaatccaaataaagttcactgggatcaagtatttgctgggctagaagagcaagcccgccaggcgatgatgaaaactgattttcctggagaccttggcagtcagcgacaagctatccaacaactaagagatcaggactccagtagcagtgagttctgcaccttctggtgacagtgagggtgatgaagaggagacgacacaagatgaagtctcttcccacacatcagaggaagatggaggggtggtcaaagtggagaaagagttagaaaatacagaacagcctgttggtgggaacgaagtggtagagcacgaggtcacagggaatttgaattctgaccccttgcttgaactctgccagtgtcccctctgccagctagactgcgggagccgggagcagttgattgctcacgtgtaccagcacactgcagcagtggtgagcgccaagagctacatgtgtcctgtctgtggccgggcccttagctccccggggtcattgggtcgccacctcttaatccactcggaggaccagcgatctaactgtgctgtgtgtggagcccggttcaccagccatgccacttttaacagtgagaaacttcctgaagtactaaatatggaatccctacccacagtccacaatgagggtccctccagtgctgaggggaaggatattgcctttagtcctccagtgtaccctgctggaattctgcttgtgtgcaacaactgtgctgcctaccgtaaactgctggaagcccagactcccagtgtacgcaagtgggctctacgtcgacagaatgagcctttggaagtacggctgcagcggctggaacgagagcgcacggccaagaagagccggcgggacaatgagacccccgaggagcgggaggtgaggcgcatgagggaccgtgaagccaagcgcttgcagcgcatgcaggagacagacgagcagcgggcacgccggctgcagcgggatcgggaggccatgaggctgaagcgggccaatgaaaccccggaaaagcggcaggcccggctcatccgagagcgagaggccaagcggctcaagaggaggctggagaaaatggacatgatgttgcgagctcagtttggccaggacccttctgccatggcagccttagcagctgaaatgaacttcttccagctgcctgtaagtggggtggagttggacagccagcttctgggcaagatggcctttgaagagcagaacagcagctctctgcactgaaccacaccctcctgcctgccctccttcccacctacctacccacccacccacacccacagccacgaggaccagtgctgctgccacccacgaggccctgtccttgctgccagaggcaggcctgggtttattgcaggtggacctgagcagcccttgcatatgggaacaggatgatggggtcaggagggacctggctcaaggcagctctggacaagggagcaggcagtccagagaactggcctccccagcccactgccacaggctgtgcttctaggactgtgggcccctgtgtggcccatgaagttgtgaagtcaaataaattaattttatcttta

SEQ ID NO: 278082 - DNA, 1874 bp, Homo sapiens
gggggaggggaggatgggcgtgggcgtgcagaccggggggtatcagtccccgcgtctgggtctcgcagaaaagcttctaaatttagatttcggagattgtgttgtctaagggtttgtctgagccgcctcggaagacctccggctcttgtcaggctcttgtctgatacagatcacttggattcagtcgagtttgctttgctccgtgggaactgcaccagagctggaggttagcatcttgcaaggaggtagtaacatatccagtcgtgaaactgggaaagaccagagctcttgcatcagggaaacatgtcccgtcggaaacagacaaatccaaataaagttcactgggatcaagtatttgctgggctagaagagcaagcccgccaggcgatgatgaaaactgattttcctggagaccttggcagtcagcgacaagctatccaacaactaagagatcaggactccagtagcagtgacagtgagggtgatgaagaggagacgacacaagatgaagtctcttcccacacatcagaggaagatggaggggtggtcaaagtggagaaagagttagaaaatacagaacagcctgttggtgggaacgaagtggtagagcacgaggtcacagggaatttgaattctgaccccttgcttgaactctgccagtgtcccctctgccagctagactgcgggagccgggagcagttgattgctcacgtgtaccagcacactgcagcagtggtgagcgccaagagctacatgtgtcctgtctgtggccgggcccttagctccccggggtcattgggtcgccacctcttaatccactcggaggaccagcgatctaactgtgctgtgtgtggagcccggttcaccagccatgccacttttaacagtgagaaacttcctgaagtactaaatatggaatccctacccacagtccacaatgagggtccctccagtgctgaggggaaggatattgcctttagtcctccagtgtaccctgctggaattctgcttgtgtgcaacaactgtgctgcctaccgtaaactgctggaagcccagactcccagtgtacgcaagtgggctctacgtcgacagaatgagcctttggaagtacggctgcagcggctggaacgagagcgcacggccaagaagagccggcgggacaatgagacccccgaggagcgggaggtgaggcgcatgagggaccgtgaagccaagcgcttgcagcgcatgcaggagacagacgagcagcgggcacgccggctgcagcgggatcgggaggccatgaggctgaagcgggccaatgaaaccccggaaaagcggcaggcccggctcatccgagagcgagaggccaagcggctcaagaggaggctggagaaaatggacatgatgttgcgagctcagtttggccaggacccttctgccatggcagccttagcagctgaaatgaacttcttccagctgcctgtaagtggggtggagttggacagccagcttctgggcaagatggcctttgaagagcagaacagcagctctctgcactgaaccacaccctcctgcctgccctccttcccacctacctacccacccacccacacccacagccacgaggaccagtgctgctgccacccacgaggccctgtccttgctgccagaggcaggcctgggtttattgcaggtggacctgagcagcccttgcatatgggaacaggatgatggggtcaggagggacctggctcaaggcagctctggacaagggagcaggcagtccagagaactggcctccccagcccactgccacaggctgtgcttctaggactgtgggcccctgtgtggcccatgaagttgtgaagtcaaataaattaattttatcttta

SEQ ID NO: 278083 - DNA, 1564 bp, Homo sapiens
ggggaaaatgacatgtgctaacaataaccttttttattgcaggttagcatcttgcaaggaggtagtaacatatccagtcgtgaaactgggaaagaccagagctcttgcatcagggaaacatgtcccgtcggaaacagacaaatccaaataaagttcactgtgacagtgagggtgatgaagaggagacgacacaagatgaagtctcttcccacacatcagaggaagatggaggggtggtcaaagtggagaaagagttagaaaatacagaacagcctgttggtgggaacgaagtggtagagcacgaggtcacagggaatttgaattctgaccccttgcttgaactctgccagtgtcccctctgccagctagactgcgggagccgggagcagttgattgctcacgtgtaccagcacactgcagcagtggtgagcgccaagagctacatgtgtcctgtctgtggccgggcccttagctccccggggtcattgggtcgccacctcttaatccactcggaggaccagcgatctaactgtgctgtgtgtggagcccggttcaccagccatgccacttttaacagtgagaaacttcctgaagtactaaatatggaatccctacccacagtccacaatgagggtccctccagtgctgaggggaaggatattgcctttagtcctccagtgtaccctgctggaattctgcttgtgtgcaacaactgtgctgcctaccgtaaactgctggaagcccagactcccagtgtacgcaagtgggctctacgtcgacagaatgagcctttggaagtacggctgcagcggctggaacgagagcgcacggccaagaagagccggcgggacaatgagacccccgaggagcgggaggtgaggcgcatgagggaccgtgaagccaagcgcttgcagcgcatgcaggagacagacgagcagcgggcacgccggctgcagcgggatcgggaggccatgaggctgaagcgggccaatgaaaccccggaaaagcggcaggcccggctcatccgagagcgagaggccaagcggctcaagaggaggctggagaaaatggacatgatgttgcgagctcagtttggccaggacccttctgccatggcagccttagcagctgaaatgaacttcttccagctgcctgtaagtggggtggagttggacagccagcttctgggcaagatggcctttgaagagcagaacagcagctctctgcactgaaccacaccctcctgcctgccctccttcccacctacctacccacccacccacacccacagccacgaggaccagtgctgctgccacccacgaggccctgtccttgctgccagaggcaggcctgggtttattgcaggtggacctgagcagcccttgcatatgggaacaggatgatggggtcaggagggacctggctcaaggcagctctggacaagggagcaggcagtccagagaactggcctccccagcccactgccacaggctgtgcttctaggactgtgggcccctgtgtggcccatgaagttgtgaagtcaaataaattaattttatcttta

SEQ ID NO: 278084 - DNA, 1897 bp, Homo sapiens
gggggaggggaggatgggcgtgggcgtgcagaccggggggtatcagtccccgcgtctgggtctcgcagaaaagcttctaaatttagatttcggagattgtgttgtctaagggtttgtctgagccgcctcggaagacctccggctcttgtcaggctcttgtctggtaattcctgggaatttacctgggctcatgcttgaagaagcagagggaccatctcggctgattagacacgccccagacccaaccccaggggtcaggtgaacagccaggcggctaagtgaccagctttcttgtcctctcctttttggcagatacagatcacttggattcagtcgagtttgctttgctccgtgggaactgcaccagagctggaggttagcatcttgcaaggaggtagtaacatatccagtcgtgaaactgggaaagaccagagctcttgcatcagggaaacatgtcccgtcggaaacagacaaatccaaataaagttcactgtgacagtgagggtgatgaagaggagacgacacaagatgaagtctcttcccacacatcagaggaagatggaggggtggtcaaagtggagaaagagttagaaaatacagaacagcctgttggtgggaacgaagtggtagagcacgaggtcacagggaatttgaattctgaccccttgcttgaactctgccagtgtcccctctgccagctagactgcgggagccgggagcagttgattgctcacgtgtaccagcacactgcagcagtggtgagcgccaagagctacatgtgtcctgtctgtggccgggcccttagctccccggggtcattgggtcgccacctcttaatccactcggaggaccagcgatctaactgtgctgtgtgtggagcccggttcaccagccatgccacttttaacagtgagaaacttcctgaagtactaaatatggaatccctacccacagtccacaatgagggtccctccagtgctgaggggaaggatattgcctttagtcctccagtgtaccctgctggaattctgcttgtgtgcaacaactgtgctgcctaccgtaaactgctggaagcccagactcccagtgtacgcaagtgggctctacgtcgacagaatgagcctttggaagtacggctgcagcggctggaacgagagcgcacggccaagaagagccggcgggacaatgagacccccgaggagcgggaggtgaggcgcatgagggaccgtgaagccaagcgcttgcagcgcatgcaggagacagacgagcagcgggcacgccggctgcagcgggatcgggaggccatgaggctgaagcgggccaatgaaaccccggaaaagcggcaggcccggctcatccgagagcgagaggccaagcggctcaagaggaggctggagaaaatggacatgatgttgcgagctcagtttggccaggacccttctgccatggcagccttagcagctgaaatgaacttcttccagctgcctgtaagtggggtggagttggacagccagcttctgggcaagatggcctttgaagagcagaacagcagctctctgcactgaaccacaccctcctgcctgccctccttcccacctacctacccacccacccacacccacagccacgaggaccagtgctgctgccacccacgaggccctgtccttgctgccagaggcaggcctgggtttattgcaggtggacctgagcagcccttgcatatgggaacaggatgatggggtcaggagggacctggctcaaggcagctctggacaagggagcaggcagtccagagaactggcctccccagcccactgccacaggctgtgcttctaggactgtgggcccctgtgtggcccatgaagttgtgaagtcaaataaattaattttatcttta

SEQ ID NO: 278085 - DNA, 1967 bp, Homo sapiens
agcgggcgggtgcgcgagccgcgcgctcccgccgcccgcgtcgccatctttttccccctccgtctgtctgtctgctgttggctttgtccgtctgcagcgccgcccctcggctccccgccaccggctcggctcggcccggagccccttccgctcgccggggcccagtcccggagcgccccggcccggctggcttgggctgcggtcccgggtccattgtccggcggtccgtctgtccggaggcggggcccagggacccagagcgcagcgcagcgccgaggcgccggatacagatcacttggattcagtcgagtttgctttgctccgtgggaactgcaccagagctggaggtctgaaaaagaactgtgtttgatatgcagatatgctagaagactgcctgaaagctgcttcctttgccacttcctgtggaggcctgtctttgccatttgcggtttctttattcttttggttagcatcttgcaaggaggtagtaacatatccagtcgtgaaactgggaaagaccagagctcttgcatcagggaaacatgtcccgtcggaaacagacaaatccaaataaagttcactgggatcaagtatttgctgggctagaagagcaagcccgccaggcgatgatgaaaactgattttcctggagaccttggcagtcagcgacaagctatccaacaactaagagatcaggactccagtagcagtcacagggaatttgaattctgaccccttgcttgaactctgccagtgtcccctctgccagctagactgcgggagccgggagcagttgattgctcacgtgtaccagcacactgcagcagtggtgagcgccaagagctacatgtgtcctgtctgtggccgggcccttagctccccggggtcattgggtcgccacctcttaatccactcggaggaccagcgatctaactgtgctgtgtgtggagcccggttcaccagccatgccacttttaacagtgagaaacttcctgaagtactaaatatggaatccctacccacagtccacaatgagggtccctccagtgctgaggggaaggatattgcctttagtcctccagtgtaccctgctggaattctgcttgtgtgcaacaactgtgctgcctaccgtaaactgctggaagcccagactcccagtgtacgcaagtgggctctacgtcgacagaatgagcctttggaagtacggctgcagcggctggaacgagagcgcacggccaagaagagccggcgggacaatgagacccccgaggagcgggaggtgaggcgcatgagggaccgtgaagccaagcgcttgcagcgcatgcaggagacagacgagcagcgggcacgccggctgcagcgggatcgggaggccatgaggctgaagcgggccaatgaaaccccggaaaagcggcaggcccggctcatccgagagcgagaggccaagcggctcaagaggaggctggagaaaatggacatgatgttgcgagctcagtttggccaggacccttctgccatggcagccttagcagctgaaatgaacttcttccagctgcctgtaagtggggtggagttggacagccagcttctgggcaagatggcctttgaagagcagaacagcagctctctgcactgaaccacaccctcctgcctgccctccttcccacctacctacccacccacccacacccacagccacgaggaccagtgctgctgccacccacgaggccctgtccttgctgccagaggcaggcctgggtttattgcaggtggacctgagcagcccttgcatatgggaacaggatgatggggtcaggagggacctggctcaaggcagctctggacaagggagcaggcagtccagagaactggcctccccagcccactgccacaggctgtgcttctaggactgtgggcccctgtgtggcccatgaagttgtgaagtcaaataaattaattttatcttta

SEQ ID NO: 278086 - DNA, 1580 bp, Homo sapiens
gggggaggggaggatgggcgtgggcgtgcagaccggggggtatcagtccccgcgtctgggtctcgcagaaaagcttctaaatttagatttcggagattgtgttgtctaagggtttgtctgagccgcctcggaagacctccggctcttgtcaggctcttgtctgatacagatcacttggattcagtcgagtttgctttgctccgtgggaactgcaccagagctggaggttagcatcttgcaaggaggtagtaacatatccagtcgtgaaactgggaaagaccagagctcttgcatcagggaaacatgtcccgtcggaaacagacaaatccaaataaagttcactgggatcaagtatttgctgggctagaagagcaagcccgccaggcgatgatgaaaactgattttcctggagaccttggcagtcagcgacaagctatccaacaactaagagatcaggactccagtagcagtgagttctgcaccttctggtcacagggaatttgaattctgaccccttgcttgaactctgccagtgtcccctctgccagctagactgcgggagccgggagcagttgattgctcacgtgtaccagtgagaaacttcctgaagtactaaatatggaatccctacccacagtccacaatgagggtccctccagtgctgaggggaaggatattgcctttagtcctccagtgtaccctgctggaattctgcttgtgtgcaacaactgtgctgcctaccgtaaactgctggaagcccagactcccagtgtacgcaagtgggctctacgtcgacagaatgagcctttggaagtacggctgcagcggctggaacgagagcgcacggccaagaagagccggcgggacaatgagacccccgaggagcgggaggtgaggcgcatgagggaccgtgaagccaagcgcttgcagcgcatgcaggagacagacgagcagcgggcacgccggctgcagcgggatcgggaggccatgaggctgaagcgggccaatgaaaccccggaaaagcggcaggcccggctcatccgagagcgagaggccaagcggctcaagaggaggctggagaaaatggacatgatgttgcgagctcagtttggccaggacccttctgccatggcagccttagcagctgaaatgaacttcttccagctgcctgtaagtggggtggagttggacagccagcttctgggcaagatggcctttgaagagcagaacagcagctctctgcactgaaccacaccctcctgcctgccctccttcccacctacctacccacccacccacacccacagccacgaggaccagtgctgctgccacccacgaggccctgtccttgctgccagaggcaggcctgggtttattgcaggtggacctgagcagcccttgcatatgggaacaggatgatggggtcaggagggacctggctcaaggcagctctggacaagggagcaggcagtccagagaactggcctccccagcccactgccacaggctgtgcttctaggactgtgggcccctgtgtggcccatgaagttgtgaagtcaaataaattaattttatcttta

SEQ ID NO: 278087 - DNA, 1345 bp, Homo sapiens
ggtcagaagaaaccatcccgctgcagaccctgcgctgctacaacgactacaccagccacatcacctgcaggtggcagaccacccaggatgcccagcggctcgtcaacgtgacagtgagggtgatgaagaggagacgacacaagatgaagtctcttcccacacatcagaggaagatggaggggtggtcaaagtggagaaagagttagaaaatacagaacagcctgttggtgggaacgaagtggtagagcacgaggtcacagggaatttgaattctgaccccttgcttgaactctgccagtgtcccctctgccagctagactgcgggagccgggagcagttgattgctcacgtgtaccagtgagaaacttcctgaagtactaaatatggaatccctacccacagtccacaatgagggtccctccagtgctgaggggaaggatattgcctttagtcctccagtgtaccctgctggaattctgcttgtgtgcaacaactgtgctgcctaccgtaaactgctggaagcccagactcccagtgtacgcaagtgggctctacgtcgacagaatgagcctttggaagtacggctgcagcggctggaacgagagcgcacggccaagaagagccggcgggacaatgagacccccgaggagcgggaggtgaggcgcatgagggaccgtgaagccaagcgcttgcagcgcatgcaggagacagacgagcagcgggcacgccggctgcagcgggatcgggaggccatgaggctgaagcgggccaatgaaaccccggaaaagcggcaggcccggctcatccgagagcgagaggccaagcggctcaagaggaggctggagaaaatggacatgatgttgcgagctcagtttggccaggacccttctgccatggcagccttagcagctgaaatgaacttcttccagctgcctgtaagtggggtggagttggacagccagcttctgggcaagatggcctttgaagagcagaacagcagctctctgcactgaaccacaccctcctgcctgccctccttcccacctacctacccacccacccacacccacagccacgaggaccagtgctgctgccacccacgaggccctgtccttgctgccagaggcaggcctgggtttattgcaggtggacctgagcagcccttgcatatgggaacaggatgatggggtcaggagggacctggctcaaggcagctctggacaagggagcaggcagtccagagaactggcctccccagcccactgccacaggctgtgcttctaggactgtgggcccctgtgtggcccatgaagttgtgaagtcaaataaattaattttatcttta

SEQ ID NO: 278088 - DNA, 1752 bp, Homo sapiens
gccgaagccaccgcgaagcgtgggggaatgaggcgaagaggatacagatcacttggattcagtcgagtttgctttgctccgtgggaactgcaccagagctggaggttagcatcttgcaaggaggtagtaacatatccagtcgtgaaactgggaaagaccagagctcttgcatcagggaaacatgtcccgtcggaaacagacaaatccaaataaagttcactgggatcaagtatttgctgggctagaagagcaagcccgccaggcgatgatgaaaactgattttcctggagaccttggcagtcagcgacaagctatccaacaactaagagatcaggactccagtagcagtgacagtgagggtgatgaagaggagacgacacaagatgaagtctcttcccacacatcagaggaagatggaggggtggtcaaagtggagaaagagttagaaaatacagaacagcctgttggtgggaacgaagtggtagagcacgaggtcacagggaatttgaattctgaccccttgcttgaactctgccagtgtcccctctgccagctagactgcgggagccgggagcagttgattgctcacgtgtaccagcacactgcagcagtggtgagcgccaagagctacatgtgtcctgtctgtggccgggcccttagctccccggggtcattgggtcgccacctcttaatccactcggaggaccagcgatctaactgtgctgtgtgtggagcccggttcaccagccatgccacttttaacagtgagaaacttcctgaagtactaaatatggaatccctacccacagtccacaatgagggtccctccagtgctgaggggaaggatattgcctttagtcctccagtgtaccctgctggaattctgcttgtgtgcaacaactgtgctgcctaccgtaaactgctggaagcccagactcccagtgtacgcaagtgggctctacgtcgacagaatgagcctttggaagtacggctgcagcggctggaacgagagcgcacggccaagaagagccggcgggacaatgagacccccgaggagcgggaggtgaggcgcatgagggaccgtgaagccaagcgcttgcagcgcatgcaggagacagacgagcagcgggcacgccggctgcagcgggatcgggaggccatgaggctgaagcgggccaatgaaaccccggaaaagcggcaggcccggctcatccgagagcgagaggccaagcggctcaagaggaggctggagaaaatggacatgatgttgcgagctcagtttggccaggacccttctgccatggcagccttagcagctgaaatgaacttcttccagctgcctgtaagtggggtggagttggacagccagcttctgggcaagatggcctttgaagagcagaacagcagctctctgcactgaaccacaccctcctgcctgccctccttcccacctacctacccacccacccacacccacagccacgaggaccagtgctgctgccacccacgaggccctgtccttgctgccagaggcaggcctgggtttattgcaggtggacctgagcagcccttgcatatgggaacaggatgatggggtcaggagggacctggctcaaggcagctctggacaagggagcaggcagtccagagaactggcctccccagcccactgccacaggctgtgcttctaggactgtgggcccctgtgtggcccatgaagttgtgaagtcaaataaattaattttatcttta

SEQ ID NO: 278089 - DNA, 1723 bp, Homo sapiens
agcgggcgggtgcgcgagccgcgcgctcccgccgcccgcgtcgccatctttttccccctccgtctgtctgtctgctgttggctttgtccgtctgcagcgccgcccctcggctccccgccaccggctcggctcggcccggagccccttccgctcgccggggcccagtcccggagcgccccggcccggctggcttgggctgcggtcccgggtccattgtccggcggtccgtctgtccggaggcggggcccagggacccagagcgcagcgcagcgccgaggcgccggatacagatcacttggattcagtcgagtttgctttgctccgtgggaactgcaccagagctggaggttagcatcttgcaaggaggtagtaacatatccagtcgtgaaactgggaaagaccagagctcttgcatcagggaaacatgtcccgtcggaaacagacaaatccaaataaagttcactgtcacagggaatttgaattctgaccccttgcttgaactctgccagtgtcccctctgccagctagactgcgggagccgggagcagttgattgctcacgtgtaccagcacactgcagcagtggtgagcgccaagagctacatgtgtcctgtctgtggccgggcccttagctccccggggtcattgggtcgccacctcttaatccactcggaggaccagcgatctaactgtgctgtgtgtggagcccggttcaccagccatgccacttttaacagtgagaaacttcctgaagtactaaatatggaatccctacccacagtccacaatgagggtccctccagtgctgaggggaaggatattgcctttagtcctccagtgtaccctgctggaattctgcttgtgtgcaacaactgtgctgcctaccgtaaactgctggaagcccagactcccagtgtacgcaagtgggctctacgtcgacagaatgagcctttggaagtacggctgcagcggctggaacgagagcgcacggccaagaagagccggcgggacaatgagacccccgaggagcgggaggtgaggcgcatgagggaccgtgaagccaagcgcttgcagcgcatgcaggagacagacgagcagcgggcacgccggctgcagcgggatcgggaggccatgaggctgaagcgggccaatgaaaccccggaaaagcggcaggcccggctcatccgagagcgagaggccaagcggctcaagaggaggctggagaaaatggacatgatgttgcgagctcagtttggccaggacccttctgccatggcagccttagcagctgaaatgaacttcttccagctgcctgtaagtggggtggagttggacagccagcttctgggcaagatggcctttgaagagcagaacagcagctctctgcactgaaccacaccctcctgcctgccctccttcccacctacctacccacccacccacacccacagccacgaggaccagtgctgctgccacccacgaggccctgtccttgctgccagaggcaggcctgggtttattgcaggtggacctgagcagcccttgcatatgggaacaggatgatggggtcaggagggacctggctcaaggcagctctggacaagggagcaggcagtccagagaactggcctccccagcccactgccacaggctgtgcttctaggactgtgggcccctgtgtggcccatgaagttgtgaagtcaaataaattaattttatcttta

SEQ ID NO: 278090 - DNA, 1706 bp, Homo sapiens
agcgggcgggtgcgcgagccgcgcgctcccgccgcccgcgtcgccatctttttccccctccgtctgtctgtctgctgttggctttgtccgtctgcagcgccgcccctcggctccccgccaccggctcggctcggcccggagccccttccgctcgccggggcccagtcccggagcgccccggcccggctggcttgggctgcggtcccgggtccattgtccggcggtccgtctgtccggaggcggggcccagggacccagagcgcagcgcagcgccgaggcgccggatacagatcacttggattcagtcgagtttgctttgctccgtgggaactgcaccagagctggaggttagcatcttgcaaggaggtagtaacatatccagtcgtgaaactgggaaagaccagagctcttgcatcagggaaacatgtcccgtcggaaacagacaaatccaaataaagttcactgggatcaagtatttgctgggctagaagagcaagcccgccaggcgatgatgaaaactgattttcctggagaccttggcagtcagcgacaagctatccaacaactaagagatcaggactccagtagcagtgacagtgagggtgatgaagaggagacgacacaagatgaagtctcttcccacacatcagaggaagatggaggggtggtcaaagtggagaaagagttagaaaatacagaacagcctgttggtgggaacgaagtggtagagcacgaggtcacagggaatttgaattctgaccccttgcttgaactctgccagtgtcccctctgccagctagactgcgggagccgggagcagttgattgctcacgtgtaccagtgagaaacttcctgaagtactaaatatggaatccctacccacagtccacaatgagggtccctccagtgctgaggggaaggatattgcctttagtcctccagtgtaccctgctggaattctgcttgtgtgcaacaactgtgctgcctaccgtaaactgctggaagcccagactcccagtgtacgcaagtgggctctacgtcgacagaatgagcctttggaagtacggctgcagcggctggaacgagagcgcacggccaagaagagccggcgggacaatgagacccccgaggagcgggaggtgaggcgcatgagggaccgtgaagccaagcgcttgcagcgcatgcaggagacagacgagcagcgggcacgccggctgcagcgggatcgggaggccatgaggctgaagcgggccaatgaaaccccggaaaagcggcaggcccggctcatccgagagcgagaggccaagcggctcaagaggaggctggagaaaatggacatgatgttgcgagctcagtttggccaggacccttctgccatggcagccttagcagctgaaatgaacttcttccagctgcctgtaagtggggtggagttggacagccagcttctgggcaagatggcctttgaagagcagaacagcagctctctgctgaacaaacctcttggtggccttcttccataactaacaacaacaaaccaagcagagacagtgtgttgcaccaagaggctgtctgtgcagagaggctggttatgcagtggctgagagctggttggaaagtgtggggcggaggaaggaaggattggagaggagggaaaggtccccagagggggttaatgggccgtggaaatgggaaattttaaaaag

SEQ ID NO: 278091 - DNA, 3386 bp, Homo sapiens
agtgggccgttgccttacagttgctgagaggaggcgagaggcgggggcgctagggccgagatcatgtctgactgggagaggtttccttggcagcagaggacgctaggtttgggatgaaagaagctgggcagatgcaaaatctggagagcgcgagggccgggcggtcagtcagcacccagactggcagcatgaccggtcagataccaaggctttctaaagtcaaccttttcactctgctcagcctctggatggagctctttccagcagaagcccagcggcaaaaatctcagaaaaatgaagagggaaagcatggacccttaggagataatgaagagaggaccagagtatctactgacaaaagacaggtaaagagaactggtcttgtggtggtgaaaaacatgaaaattgttggtctccactgttctagtgaagatttacatgccgggcagattgctcttattaaacatgggtcaaggctgaaaaactgtgatctttatttttccagaaaaccatgttctgcttgtttgaaaatgattgtaaatgctggagttaaccgaatttcatactggcctgctgatccagaaataagtttgcttacggaggcttctagttctgaagatgcaaagttagatgccaaagcagtggaaagattgaagtcaaacagtcgggcccatgtgtgtgtcttacttcaacctttggtgtgttatatggtgcagtttgtagaggagacctcttacaaatgtgactttattcaaaaaattacaaaaacattgccggatgctaacactgacttttattatgaatgtaaacaagaaagaataaaagaatatgaaatgttatttttggtttcaaatgaagaaatgcataagcaaatactgatgactataggtttggagaacctgtgtgaaaatccatactttagcaatctaaggcaaaacatgaaagaccttatcctacttttggccacagtagcttccagtgtgccgaactttaaacacttcggattttaccgtagcaatccagaacagattaatgaaattcacaatcaaagtttgccacaggaaattgcaaggcactgcatggttcaggccaggttattggcatatcgaactgaggatcataaaacaggagttggggcagtcatttgggcagaagggaaatctagaagttgtgatggaacaggtgccatgtactttgtaggatgtggttacaatgcttttcctgttggatctgagtatgctgacttcccacacatggatgacaagcagaaagacagagaaataaggaaattcagatacatcatacatgcggaacagaatgccttgacatttaggtgtcaagaaataaaaccagaagaaagaagcatgatttttgtgacaaagtgcccatgtgatgagtgtgtacctttaattaaaggtgcaggcataaaacaaatctatgcaggagatgtagatgttggaaaaaagaaggcagacatctcttacatgaggttcggggagcttgaaggtgttagcaaatttacgtggcagctgaatccatcaggagcttatggtcttgaacaaaatgagcctgaaaggagagaaaatggtgtgttgagacctgtcccacagaaggaagagcagcaccaggacaagaagctgcgcctcggaatccactaagaaggcctgtctacactgcaggggaacctcaagaacttttcattgcacttctaaaattcagccttgttcattcagaaaataaggatggattttgtgaataattgaaaagattttttaaggaagctaatttatttctaggatacaaatggtgttaataagaatatttgtcttttagatttatgtgtgggttttccataatgtagtagtgtgttattttattacacgaaatgagggagcaataacttcaaccaatgtaatcaccaacagggactgatttctatttatcttgactttatattagccaatttgaaagggtctgcttcacaagaggtcatgcctctgcagggaatcacacaccttttgagaaatattaattcttttgaattacaagagtgacagttagtaaactgctccagggaaataagtgtcatcttttaagagtcagtgtatagcaaaccaaaagatcacatttatacccaaagctttctagtaatcagaatttacttaattagaattgactcataaaaataaagttagtggactttgtctccatttttaaagtatattttgtaaatgttaattctgtggtcctgtttatcacagactttgggtagcaataggaagagagtgttattctgagacagtgtcgctgcttgatatcactgactcttgaaatcactaacagtgaacctcaaatttggttatgatgttaacagagaagaaatatttgagtctggaatattgaaactagctttcctagaattccattaataaatgctgctcccccatatagtcttcccttctgtataattaacataggttgtctcatggctttgatcttcaaaaggaagagccttttaaaaacatttgccaacctcaagaataaatactgaaagtcttgaaagtatggtcatttcagctattccagattgctgtctgtgatttctcacatttttatttgctgagaaacattcagaaaattattccaaaaatgaaggtacattttctgttctctcctaggttagagaggggtggcctggggtgcttcatgagaaatgtcttcctggatctgcggtggtcaggtttgcctctgcttttgttccctgcctttccgccacatcacacggcctcactgggcttcctaccagtttctcagaattacacgcacgaccatccaaacattggctccatgccagggctgtgactgcagcctgtgtaggaccatggggagttcagagtcatcatacaaggcagccaagaactgccataaacactacacagatggagggcatgggataggacaggagaggaggtgatgtacacttagaggtaactaaggctagtttgaaaaccgtgaattaagatattcttatcagtataaaaacactgagattgcttacctcccaaattgctttattgtattaactctcatgcttcagctcttggatttgttgtttctaactaacatgtcatgtacaccaaacattttataaatcaatcagtaaatattttgtaagacccaaaatcctggcatattgccaggtctgtggatttgcctgttgggtgttgggatgggatatcagaggaagaagcatacaagtgggaaaaactgtgattagaaagggaaaaataggcatttccacagtactattaagagaggcatgataatgccattttttttcttctgtacaactggtcagatttcaataaataatcattgatggttta

SEQ ID NO: 278092 - DNA, 3736 bp, Homo sapiens
agtgggccgttgccttacagttgctgagaggaggcgagaggcgggggcgctagggccgagatcatgtctgactgggagaggtttccttggcagcagaggacgctaggtttgggatgaaagaagctgggcagatgcaaaatctggagagcgcgagggccgggcggtcagtcagcacccagactggcagcatgaccggtgagtgtccgggaccctgctcccgccaccctacctttcgctctgccctgtgcgtctcccgtcattgaactccagattccttgtctgagcctctttgcctcccctgctgcttttggatgtctcctgcccgccctctgcgtgtcccctccgcggtcgccaggaccaatcggctcggtcgcactggcttttgaagtctcgctttttacccctgttagctacttctcacaggacctagagctggggcctctgaggtcaaagagcctgaacatttccaaacggcgcttttgccttgatttccaaattaaccgcacgtgacgctttcctgtatttcgactgctttaccgtcgaaggtcagataccaaggctttctaaagtcaaccttttcactctgctcagcctctggatggagctctttccagcagaagcccagcggcaaaaatctcagaaaaatgaagagggaaagcatggacccttaggagataatgaagagaggaccagagtatctactgacaaaagacaggtaaagagaactggtcttgtggtggtgaaaaacatgaaaattgttggtctccactgttctagtgaagatttacatgccgggcagattgctcttattaaacatgggtcaaggctgaaaaactgtgatctttatttttccagaaaaccatgttctgcttgtttgaaaatgattgtaaatgctggagttaaccgaatttcatactggcctgctgatccagaaataagtttgcttacggaggcttctagttctgaagatgcaaagttagatgccaaagcagtggaaagattgaagtcaaacagtcgggcccatgtgtgtgtcttacttcaacctttggtgtgttatatggtgcagtttgtagaggagacctcttacaaatgtgactttattcaaaaaattacaaaaacattgccggatgctaacactgacttttattatgaatgtaaacaagaaagaataaaagaatatgaaatgttatttttggtttcaaatgaagaaatgcataagcaaatactgatgactataggtttggagaacctgtgtgaaaatccatactttagcaatctaaggcaaaacatgaaagaccttatcctacttttggccacagtagcttccagtgtgccgaactttaaacacttcggattttaccgtagcaatccagaacagattaatgaaattcacaatcaaagtttgccacaggaaattgcaaggcactgcatggttcaggccaggttattggcatatcgaactgaggatcataaaacaggagttggggcagtcatttgggcagaagggaaatctagaagttgtgatggaacaggtgccatgtactttgtaggatgtggttacaatgcttttcctgttggatctgagtatgctgacttcccacacatggatgacaagcagaaagacagagaaataaggaaattcagatacatcatacatgcggaacagaatgccttgacatttaggtgtcaagaaataaaaccagaagaaagaagcatgatttttgtgacaaagtgcccatgtgatgagtgtgtacctttaattaaaggtgcaggcataaaacaaatctatgcaggagatgtagatgttggaaaaaagaaggcagacatctcttacatgaggttcggggagcttgaaggtgttagcaaatttacgtggcagctgaatccatcaggagcttatggtcttgaacaaaatgagcctgaaaggagagaaaatggtgtgttgagacctgtcccacagaaggaagagcagcaccaggacaagaagctgcgcctcggaatccactaagaaggcctgtctacactgcaggggaacctcaagaacttttcattgcacttctaaaattcagccttgttcattcagaaaataaggatggattttgtgaataattgaaaagattttttaaggaagctaatttatttctaggatacaaatggtgttaataagaatatttgtcttttagatttatgtgtgggttttccataatgtagtagtgtgttattttattacacgaaatgagggagcaataacttcaaccaatgtaatcaccaacagggactgatttctatttatcttgactttatattagccaatttgaaagggtctgcttcacaagaggtcatgcctctgcagggaatcacacaccttttgagaaatattaattcttttgaattacaagagtgacagttagtaaactgctccagggaaataagtgtcatcttttaagagtcagtgtatagcaaaccaaaagatcacatttatacccaaagctttctagtaatcagaatttacttaattagaattgactcataaaaataaagttagtggactttgtctccatttttaaagtatattttgtaaatgttaattctgtggtcctgtttatcacagactttgggtagcaataggaagagagtgttattctgagacagtgtcgctgcttgatatcactgactcttgaaatcactaacagtgaacctcaaatttggttatgatgttaacagagaagaaatatttgagtctggaatattgaaactagctttcctagaattccattaataaatgctgctcccccatatagtcttcccttctgtataattaacataggttgtctcatggctttgatcttcaaaaggaagagccttttaaaaacatttgccaacctcaagaataaatactgaaagtcttgaaagtatggtcatttcagctattccagattgctgtctgtgatttctcacatttttatttgctgagaaacattcagaaaattattccaaaaatgaaggtacattttctgttctctcctaggttagagaggggtggcctggggtgcttcatgagaaatgtcttcctggatctgcggtggtcaggtttgcctctgcttttgttccctgcctttccgccacatcacacggcctcactgggcttcctaccagtttctcagaattacacgcacgaccatccaaacattggctccatgccagggctgtgactgcagcctgtgtaggaccatggggagttcagagtcatcatacaaggcagccaagaactgccataaacactacacagatggagggcatgggataggacaggagaggaggtgatgtacacttagaggtaactaaggctagtttgaaaaccgtgaattaagatattcttatcagtataaaaacactgagattgcttacctcccaaattgctttattgtattaactctcatgcttcagctcttggatttgttgtttctaactaacatgtcatgtacaccaaacattttataaatcaatcagtaaatattttgtaagacccaaaatcctggcatattgccaggtctgtggatttgcctgttgggtgttgggatgggatatcagaggaagaagcatacaagtgggaaaaactgtgattagaaagggaaaaataggcatttccacagtactattaagagaggcatgataatgccattttttttcttctgtacaactggtcagatttcaataaataatcattgatggttta

SEQ ID NO: 278093 - DNA, 3721 bp, Homo sapiens
agtgggccgttgccttacagttgctgagaggaggcgagaggcgggggcgctagggccgagatcatgtctgactgggagaggtttccttggcagcagaggacgctaggtttgggatgaaagaagctgggcagatgcaaaatctggagagcgcgagggccgggcggtcagtcagcacccagactggcagcatgaccggtgagtgtccgggaccctgctcccgccaccctacctttcgctctgccctgtgcgtctcccgtcattgaactccagattccttgtctgagcctctttgcctcccctgctgcttttggatgtctcctgcccgccctctgcgtgtcccctccgcggtcgccaggaccaatcggctcggtcgcactggcttttgaagtctcgctttttacccctgttagctacttctcacaggacctagagctggggcctctgaggtcaaagagcctgaacatttccaaacggcgcttttgccttgatttccaaattaaccgcacgtgacgctttcctgtatttcgactgctttaccgtcgaaggtcagataccaaggctttctaaagtcaaccttttcactctgctcagcctctggatggagctctttccagcagaagcccagcggcaaaaatctcagaaaaatgaagagggaaagcatggacccttaggagataatgaagagaggaccagagtatctactgacaaaagacagaaaaccatgttctgcttgtttgaaaatgattgtaaatggattactgggagcagctaagatgcctagatgaaaggtttaccatcactgctggttaggaaatggattatgagaactcgaacagagggaaggtgaaatgcaaccggaggaaacactctgatatgagctggagttaaccgaatttcatactggcctgctgatccagaaataagtttgcttacggaggcttctagttctgaagatgcaaagttagatgccaaagcagtggaaagattgaagtcaaacagtcgggcccatgtgtgtgtcttacttcaacctttggtgtgttatatggtgcagtttgtagaggagacctcttacaaatgtgactttattcaaaaaattacaaaaacattgccggatgctaacactgacttttattatgaatgtaaacaagaaagaataaaagaatatgaaatgttatttttggtttcaaatgaagaaatgcataagcaaatactgatgactataggtttggagaacctgtgtgaaaatccatactttagcaatctaaggcaaaacatgaaagaccttatcctacttttggccacagtagcttccagtgtgccgaactttaaacacttcggattttaccgtagcaatccagaacagattaatgaaattcacaatcaaagtttgccacaggaaattgcaaggcactgcatggttcaggccaggttattggcatatcgaactgaggatcataaaacaggagttggggcagtcatttgggcagaagggaaatctagaagttgtgatggaacaggtgccatgtactttgtaggatgtggttacaatgcttttcctgttggatctgagtatgctgacttcccacacatggatgacaagcagaaagacagagaaataaggaaattcagatacatcatacatgcggaacagaatgccttgacatttaggtgtcaagaaataaaaccagaagaaagaagcatgatttttgtgacaaagtgcccatgtgatgagtgtgtacctttaattaaaggtgcaggcataaaacaaatctatgcaggagatgtagatgttggaaaaaagaaggcagacatctcttacatgaggttcggggagcttgaaggtgttagcaaatttacgtggcagctgaatccatcaggagcttatggtcttgaacaaaatgagcctgaaaggagagaaaatggtgtgttgagacctgtcccacagaaggaagagcagcaccaggacaagaagctgcgcctcggaatccactaagaaggcctgtctacactgcaggggaacctcaagaacttttcattgcacttctaaaattcagccttgttcattcagaaaataaggatggattttgtgaataattgaaaagattttttaaggaagctaatttatttctaggatacaaatggtgttaataagaatatttgtcttttagatttatgtgtgggttttccataatgtagtagtgtgttattttattacacgaaatgagggagcaataacttcaaccaatgtaatcaccaacagggactgatttctatttatcttgactttatattagccaatttgaaagggtctgcttcacaagaggtcatgcctctgcagggaatcacacaccttttgagaaatattaattcttttgaattacaagagtgacagttagtaaactgctccagggaaataagtgtcatcttttaagagtcagtgtatagcaaaccaaaagatcacatttatacccaaagctttctagtaatcagaatttacttaattagaattgactcataaaaataaagttagtggactttgtctccatttttaaagtatattttgtaaatgttaattctgtggtcctgtttatcacagactttgggtagcaataggaagagagtgttattctgagacagtgtcgctgcttgatatcactgactcttgaaatcactaacagtgaacctcaaatttggttatgatgttaacagagaagaaatatttgagtctggaatattgaaactagctttcctagaattccattaataaatgctgctcccccatatagtcttcccttctgtataattaacataggttgtctcatggctttgatcttcaaaaggaagagccttttaaaaacatttgccaacctcaagaataaatactgaaagtcttgaaagtatggtcatttcagctattccagattgctgtctgtgatttctcacatttttatttgctgagaaacattcagaaaattattccaaaaatgaaggtacattttctgttctctcctaggttagagaggggtggcctggggtgcttcatgagaaatgtcttcctggatctgcggtggtcaggtttgcctctgcttttgttccctgcctttccgccacatcacacggcctcactgggcttcctaccagtttctcagaattacacgcacgaccatccaaacattggctccatgccagggctgtgactgcagcctgtgtaggaccatggggagttcagagtcatcatacaaggcagccaagaactgccataaacactacacagatggagggcatgggataggacaggagaggaggtgatgtacacttagaggtaactaaggctagtttgaaaaccgtgaattaagatattcttatcagtataaaaacactgagattgcttacctcccaaattgctttattgtattaactctcatgcttcagctcttggatttgttgtttctaactaacatgtcatgtacaccaaacattttataaatcaatcagtaaatattttgtaagacccaaaatcctggcatattgccaggtctgtggatttgcctgttgggtgttgggatgggatatcagaggaagaagcatacaagtgggaaaaactgtgattagaaagggaaaaataggcatttccacagtactattaagagaggcatgataatgccattttttttcttctgtacaactggtcagatttcaataaataatcattgatggttta

SEQ ID NO: 278094 - DNA, 3371 bp, Homo sapiens
agtgggccgttgccttacagttgctgagaggaggcgagaggcgggggcgctagggccgagatcatgtctgactgggagaggtttccttggcagcagaggacgctaggtttgggatgaaagaagctgggcagatgcaaaatctggagagcgcgagggccgggcggtcagtcagcacccagactggcagcatgaccggtcagataccaaggctttctaaagtcaaccttttcactctgctcagcctctggatggagctctttccagcagaagcccagcggcaaaaatctcagaaaaatgaagagggaaagcatggacccttaggagataatgaagagaggaccagagtatctactgacaaaagacagaaaaccatgttctgcttgtttgaaaatgattgtaaatggattactgggagcagctaagatgcctagatgaaaggtttaccatcactgctggttaggaaatggattatgagaactcgaacagagggaaggtgaaatgcaaccggaggaaacactctgatatgagctggagttaaccgaatttcatactggcctgctgatccagaaataagtttgcttacggaggcttctagttctgaagatgcaaagttagatgccaaagcagtggaaagattgaagtcaaacagtcgggcccatgtgtgtgtcttacttcaacctttggtgtgttatatggtgcagtttgtagaggagacctcttacaaatgtgactttattcaaaaaattacaaaaacattgccggatgctaacactgacttttattatgaatgtaaacaagaaagaataaaagaatatgaaatgttatttttggtttcaaatgaagaaatgcataagcaaatactgatgactataggtttggagaacctgtgtgaaaatccatactttagcaatctaaggcaaaacatgaaagaccttatcctacttttggccacagtagcttccagtgtgccgaactttaaacacttcggattttaccgtagcaatccagaacagattaatgaaattcacaatcaaagtttgccacaggaaattgcaaggcactgcatggttcaggccaggttattggcatatcgaactgaggatcataaaacaggagttggggcagtcatttgggcagaagggaaatctagaagttgtgatggaacaggtgccatgtactttgtaggatgtggttacaatgcttttcctgttggatctgagtatgctgacttcccacacatggatgacaagcagaaagacagagaaataaggaaattcagatacatcatacatgcggaacagaatgccttgacatttaggtgtcaagaaataaaaccagaagaaagaagcatgatttttgtgacaaagtgcccatgtgatgagtgtgtacctttaattaaaggtgcaggcataaaacaaatctatgcaggagatgtagatgttggaaaaaagaaggcagacatctcttacatgaggttcggggagcttgaaggtgttagcaaatttacgtggcagctgaatccatcaggagcttatggtcttgaacaaaatgagcctgaaaggagagaaaatggtgtgttgagacctgtcccacagaaggaagagcagcaccaggacaagaagctgcgcctcggaatccactaagaaggcctgtctacactgcaggggaacctcaagaacttttcattgcacttctaaaattcagccttgttcattcagaaaataaggatggattttgtgaataattgaaaagattttttaaggaagctaatttatttctaggatacaaatggtgttaataagaatatttgtcttttagatttatgtgtgggttttccataatgtagtagtgtgttattttattacacgaaatgagggagcaataacttcaaccaatgtaatcaccaacagggactgatttctatttatcttgactttatattagccaatttgaaagggtctgcttcacaagaggtcatgcctctgcagggaatcacacaccttttgagaaatattaattcttttgaattacaagagtgacagttagtaaactgctccagggaaataagtgtcatcttttaagagtcagtgtatagcaaaccaaaagatcacatttatacccaaagctttctagtaatcagaatttacttaattagaattgactcataaaaataaagttagtggactttgtctccatttttaaagtatattttgtaaatgttaattctgtggtcctgtttatcacagactttgggtagcaataggaagagagtgttattctgagacagtgtcgctgcttgatatcactgactcttgaaatcactaacagtgaacctcaaatttggttatgatgttaacagagaagaaatatttgagtctggaatattgaaactagctttcctagaattccattaataaatgctgctcccccatatagtcttcccttctgtataattaacataggttgtctcatggctttgatcttcaaaaggaagagccttttaaaaacatttgccaacctcaagaataaatactgaaagtcttgaaagtatggtcatttcagctattccagattgctgtctgtgatttctcacatttttatttgctgagaaacattcagaaaattattccaaaaatgaaggtacattttctgttctctcctaggttagagaggggtggcctggggtgcttcatgagaaatgtcttcctggatctgcggtggtcaggtttgcctctgcttttgttccctgcctttccgccacatcacacggcctcactgggcttcctaccagtttctcagaattacacgcacgaccatccaaacattggctccatgccagggctgtgactgcagcctgtgtaggaccatggggagttcagagtcatcatacaaggcagccaagaactgccataaacactacacagatggagggcatgggataggacaggagaggaggtgatgtacacttagaggtaactaaggctagtttgaaaaccgtgaattaagatattcttatcagtataaaaacactgagattgcttacctcccaaattgctttattgtattaactctcatgcttcagctcttggatttgttgtttctaactaacatgtcatgtacaccaaacattttataaatcaatcagtaaatattttgtaagacccaaaatcctggcatattgccaggtctgtggatttgcctgttgggtgttgggatgggatatcagaggaagaagcatacaagtgggaaaaactgtgattagaaagggaaaaataggcatttccacagtactattaagagaggcatgataatgccattttttttcttctgtacaactggtcagatttcaataaataatcattgatggttta

SEQ ID NO: 278095 - DNA, 3511 bp, Homo sapiens
agtgggccgttgccttacagttgctgagaggaggcgagaggcgggggcgctagggccgagatcatgtctgactgggagaggtttccttggcagcagaggacgctaggtttgggatgaaagaagctgggcagatgcaaaatctggagagcgcgagggccgggcggtcagtcagcacccagactggcagcatgaccggtcagataccaaggctttctaaagtcaaccttttcactctgctcagcctctggatggagctctttccagcagaagcccagcggcaaaaatctcagaaaaatgaagagggaaagcatggacccttaggagataatgaagagaggaccagagtatctactgacaaaagacaggtaaagagaactggtcttgtggtggtgaaaaacatgaaaattgttggtctccactgttctagtgaagatttacatgccgggcagattgctcttattaaacatgggtcaaggctgaaaaactgtgatctttatttttccagaaaaccatgttctgcttgtttgaaaatgattgtaaatggattactgggagcagctaagatgcctagatgaaaggtttaccatcactgctggttaggaaatggattatgagaactcgaacagagggaaggtgaaatgcaaccggaggaaacactctgatatgagctggagttaaccgaatttcatactggcctgctgatccagaaataagtttgcttacggaggcttctagttctgaagatgcaaagttagatgccaaagcagtggaaagattgaagtcaaacagtcgggcccatgtgtgtgtcttacttcaacctttggtgtgttatatggtgcagtttgtagaggagacctcttacaaatgtgactttattcaaaaaattacaaaaacattgccggatgctaacactgacttttattatgaatgtaaacaagaaagaataaaagaatatgaaatgttatttttggtttcaaatgaagaaatgcataagcaaatactgatgactataggtttggagaacctgtgtgaaaatccatactttagcaatctaaggcaaaacatgaaagaccttatcctacttttggccacagtagcttccagtgtgccgaactttaaacacttcggattttaccgtagcaatccagaacagattaatgaaattcacaatcaaagtttgccacaggaaattgcaaggcactgcatggttcaggccaggttattggcatatcgaactgaggatcataaaacaggagttggggcagtcatttgggcagaagggaaatctagaagttgtgatggaacaggtgccatgtactttgtaggatgtggttacaatgcttttcctgttggatctgagtatgctgacttcccacacatggatgacaagcagaaagacagagaaataaggaaattcagatacatcatacatgcggaacagaatgccttgacatttaggtgtcaagaaataaaaccagaagaaagaagcatgatttttgtgacaaagtgcccatgtgatgagtgtgtacctttaattaaaggtgcaggcataaaacaaatctatgcaggagatgtagatgttggaaaaaagaaggcagacatctcttacatgaggttcggggagcttgaaggtgttagcaaatttacgtggcagctgaatccatcaggagcttatggtcttgaacaaaatgagcctgaaaggagagaaaatggtgtgttgagacctgtcccacagaaggaagagcagcaccaggacaagaagctgcgcctcggaatccactaagaaggcctgtctacactgcaggggaacctcaagaacttttcattgcacttctaaaattcagccttgttcattcagaaaataaggatggattttgtgaataattgaaaagattttttaaggaagctaatttatttctaggatacaaatggtgttaataagaatatttgtcttttagatttatgtgtgggttttccataatgtagtagtgtgttattttattacacgaaatgagggagcaataacttcaaccaatgtaatcaccaacagggactgatttctatttatcttgactttatattagccaatttgaaagggtctgcttcacaagaggtcatgcctctgcagggaatcacacaccttttgagaaatattaattcttttgaattacaagagtgacagttagtaaactgctccagggaaataagtgtcatcttttaagagtcagtgtatagcaaaccaaaagatcacatttatacccaaagctttctagtaatcagaatttacttaattagaattgactcataaaaataaagttagtggactttgtctccatttttaaagtatattttgtaaatgttaattctgtggtcctgtttatcacagactttgggtagcaataggaagagagtgttattctgagacagtgtcgctgcttgatatcactgactcttgaaatcactaacagtgaacctcaaatttggttatgatgttaacagagaagaaatatttgagtctggaatattgaaactagctttcctagaattccattaataaatgctgctcccccatatagtcttcccttctgtataattaacataggttgtctcatggctttgatcttcaaaaggaagagccttttaaaaacatttgccaacctcaagaataaatactgaaagtcttgaaagtatggtcatttcagctattccagattgctgtctgtgatttctcacatttttatttgctgagaaacattcagaaaattattccaaaaatgaaggtacattttctgttctctcctaggttagagaggggtggcctggggtgcttcatgagaaatgtcttcctggatctgcggtggtcaggtttgcctctgcttttgttccctgcctttccgccacatcacacggcctcactgggcttcctaccagtttctcagaattacacgcacgaccatccaaacattggctccatgccagggctgtgactgcagcctgtgtaggaccatggggagttcagagtcatcatacaaggcagccaagaactgccataaacactacacagatggagggcatgggataggacaggagaggaggtgatgtacacttagaggtaactaaggctagtttgaaaaccgtgaattaagatattcttatcagtataaaaacactgagattgcttacctcccaaattgctttattgtattaactctcatgcttcagctcttggatttgttgtttctaactaacatgtcatgtacaccaaacattttataaatcaatcagtaaatattttgtaagacccaaaatcctggcatattgccaggtctgtggatttgcctgttgggtgttgggatgggatatcagaggaagaagcatacaagtgggaaaaactgtgattagaaagggaaaaataggcatttccacagtactattaagagaggcatgataatgccattttttttcttctgtacaactggtcagatttcaataaataatcattgatggttta

SEQ ID NO: 278096 - DNA, 3246 bp, Homo sapiens
agtgggccgttgccttacagttgctgagaggaggcgagaggcgggggcgctagggccgagatcatgtctgactgggagaggtttccttggcagcagaggacgctaggtttgggatgaaagaagctgggcagatgcaaaatctggagagcgcgagggccgggcggtcagtcagcacccagactggcagcatgaccggtcagataccaaggctttctaaagtcaaccttttcactctgctcagcctctggatggagctctttccagcagaagcccagcggcaaaaatctcagaaaaatgaagagggaaagcatggacccttaggagataatgaagagaggaccagagtatctactgacaaaagacagaaaaccatgttctgcttgtttgaaaatgattgtaaatgctggagttaaccgaatttcatactggcctgctgatccagaaataagtttgcttacggaggcttctagttctgaagatgcaaagttagatgccaaagcagtggaaagattgaagtcaaacagtcgggcccatgtgtgtgtcttacttcaacctttggtgtgttatatggtgcagtttgtagaggagacctcttacaaatgtgactttattcaaaaaattacaaaaacattgccggatgctaacactgacttttattatgaatgtaaacaagaaagaataaaagaatatgaaatgttatttttggtttcaaatgaagaaatgcataagcaaatactgatgactataggtttggagaacctgtgtgaaaatccatactttagcaatctaaggcaaaacatgaaagaccttatcctacttttggccacagtagcttccagtgtgccgaactttaaacacttcggattttaccgtagcaatccagaacagattaatgaaattcacaatcaaagtttgccacaggaaattgcaaggcactgcatggttcaggccaggttattggcatatcgaactgaggatcataaaacaggagttggggcagtcatttgggcagaagggaaatctagaagttgtgatggaacaggtgccatgtactttgtaggatgtggttacaatgcttttcctgttggatctgagtatgctgacttcccacacatggatgacaagcagaaagacagagaaataaggaaattcagatacatcatacatgcggaacagaatgccttgacatttaggtgtcaagaaataaaaccagaagaaagaagcatgatttttgtgacaaagtgcccatgtgatgagtgtgtacctttaattaaaggtgcaggcataaaacaaatctatgcaggagatgtagatgttggaaaaaagaaggcagacatctcttacatgaggttcggggagcttgaaggtgttagcaaatttacgtggcagctgaatccatcaggagcttatggtcttgaacaaaatgagcctgaaaggagagaaaatggtgtgttgagacctgtcccacagaaggaagagcagcaccaggacaagaagctgcgcctcggaatccactaagaaggcctgtctacactgcaggggaacctcaagaacttttcattgcacttctaaaattcagccttgttcattcagaaaataaggatggattttgtgaataattgaaaagattttttaaggaagctaatttatttctaggatacaaatggtgttaataagaatatttgtcttttagatttatgtgtgggttttccataatgtagtagtgtgttattttattacacgaaatgagggagcaataacttcaaccaatgtaatcaccaacagggactgatttctatttatcttgactttatattagccaatttgaaagggtctgcttcacaagaggtcatgcctctgcagggaatcacacaccttttgagaaatattaattcttttgaattacaagagtgacagttagtaaactgctccagggaaataagtgtcatcttttaagagtcagtgtatagcaaaccaaaagatcacatttatacccaaagctttctagtaatcagaatttacttaattagaattgactcataaaaataaagttagtggactttgtctccatttttaaagtatattttgtaaatgttaattctgtggtcctgtttatcacagactttgggtagcaataggaagagagtgttattctgagacagtgtcgctgcttgatatcactgactcttgaaatcactaacagtgaacctcaaatttggttatgatgttaacagagaagaaatatttgagtctggaatattgaaactagctttcctagaattccattaataaatgctgctcccccatatagtcttcccttctgtataattaacataggttgtctcatggctttgatcttcaaaaggaagagccttttaaaaacatttgccaacctcaagaataaatactgaaagtcttgaaagtatggtcatttcagctattccagattgctgtctgtgatttctcacatttttatttgctgagaaacattcagaaaattattccaaaaatgaaggtacattttctgttctctcctaggttagagaggggtggcctggggtgcttcatgagaaatgtcttcctggatctgcggtggtcaggtttgcctctgcttttgttccctgcctttccgccacatcacacggcctcactgggcttcctaccagtttctcagaattacacgcacgaccatccaaacattggctccatgccagggctgtgactgcagcctgtgtaggaccatggggagttcagagtcatcatacaaggcagccaagaactgccataaacactacacagatggagggcatgggataggacaggagaggaggtgatgtacacttagaggtaactaaggctagtttgaaaaccgtgaattaagatattcttatcagtataaaaacactgagattgcttacctcccaaattgctttattgtattaactctcatgcttcagctcttggatttgttgtttctaactaacatgtcatgtacaccaaacattttataaatcaatcagtaaatattttgtaagacccaaaatcctggcatattgccaggtctgtggatttgcctgttgggtgttgggatgggatatcagaggaagaagcatacaagtgggaaaaactgtgattagaaagggaaaaataggcatttccacagtactattaagagaggcatgataatgccattttttttcttctgtacaactggtcagatttcaataaataatcattgatggttta

SEQ ID NO: 278097 - DNA, 3332 bp, Homo sapiens
agtgggccgttgccttacagttgctgagaggaggcgagaggcgggggcgctagggccgagatcatgtctgactgggagaggtttccttggcagcagaggacgctaggtttgggatgaaagaagctgggcagatgcaaaatctggagagcgcgagggccgggcggtcagtcagcacccagactggcagcatgaccggtcagataccaaggctttctaaagtcaaccttttcactctgctcagcctctggatggagctctttccagcagaagcccagcggcaaaaatctcagaaaaatgaagagggaaagcatggacccttaggagataatgaagagaggaccagagtatctactgacaaaagacaggtaaagagaactggtcttgtggtggtgaaaaacatgaaaattgttggtctccactgttctagtgaagatttacatgccgggcagattgctcttattaaacatgggtcaaggctgaaaaactgtgatctttatttttccagaaaaccatgttctgcttgtttgaaaatgattgtaaatgctggagttaaccgaatttcatactggcctgctgatccagaaataagtttgcttacggaggcttctagttctgaagatgcaaagttagatgccaaagcagtggaaagattgaagtcaaacagtcgggcccatgtgtgtgtcttacttcaacctttggtgtgttatatggtgcagtttgtagaggagacctcttacaaatgtgactttattcaaaaaattacaaaaacattgccggatgctaacactgacttttattatgaatgtaaacaagaaagaataaaagaatatgaaatgttatttttggtttcaaatgaagaaatgcataagcaaatactgatgactataggtttggagaacctgtgtgaaaatccatactttagcaatctaaggcaaaacatgaaagaccttatcctacttttggccacagtagcttccagtgtgccgaactttaaacacttcggattttaccgtagcaatccagaacagattaatgaaattcacaatcaaagtttgccacaggaaattgcaaggcactgcatggttcaggccaggttattggcatatcgaactgaggatcataaaacaggagttggggcagtcatttgggcagaagggaaatctagaagttgtgatggaacaggtgccatgtactttgtaggatgtggttacaatgcttttcctgttggatctgagtatgctgacttcccacacatggatgacaagcagaaagacagagaaataaggaaattcagatacatcatacatgcggaacagaatgccttgacatttaggtgtcaagaaataaaaccagaagaaagaagcatgatttttgtgacaaagtgcccatgtgatgagtgtgtacctttaattaaaggtgcaggcataaaacaaatctatgcaggagatgtagatgttggaaaaaagaaggcagacatctcttacatgaggttcggggagcttgaaggtgttagcaaatttacgtggcagctgaatccatcaggagcttatggtcttgaacaaaatgagcctgaaaggagagaaaatggtgtgttgagacctgtcccacagaaggaagagcagcaccaggacaagaagctgcgcctcggaatccactaagaaggcctgtctacactgcaggggaacctcaagaacttttcattgcacttctaaaattcagccttgttcattcagaaaataaggatggattttgtgaataattgaaaagattttttaaggaagctaatttatttctaggatacaaatggtgttaataagaatatttgtcttttagatttatgtgtgggttttccataatgtagtagtgtgttattttattacacgaaatgagggagcaataacttcaaccaatgtaatcaccaacagggactgatttctatttatcttgactttatattagccaatttgaaagggtctgcttcacaagaggtcatgcctctgcagggaatcacacaccttttgagaaatattaattcttttgaattacaagagtgacagttagtaaactgctccagggaaataagtgtcatcttttaagagtcagtgtatagcaaaccaaaagatcacatttatacccaaagctttctagtaatcagaatttacttaattagaattgactcataaaaataaagttagtggactttgtctccatttttaaagtatattttgtaaatgttaattctgtggtcctgtttatcacagactttgggtagcaataggaagagagtgttattctgagacagtgtcgctgcttgatatcactgactcttgaaatcactaacagtgaacctcaaatttggttatgatgttaacagagaagaaatatttgagtctggaatattgaaactagctttcctagaattccattaataaatgctgctcccccatatagtcttcccttctgtataattaacataggttgtctcatggctttgatcttcaaaaggaagagccttttaaaaacatttgccaacctcaagaataaatactgaaagtcttgaaagtatggtcatttcagctattccagattgctgtctgtgatttctcacatttttatttgctgagaaacattcagaaaattattccaaaaatgaaggtacattttctgttctctcctaggttagagaggggtggcctggggtgcttcatgagaaatgtcttcctggatctgcggtggtcaggtttgcctctgcttttgttccctgcctttccgccacatcacacggcctcactgggcttcctaccagtttctcagaattacacgcacgaccatccaaacattggctccatgccagggctgtgactgcagcctgtgtaggaccatggggagttcagagtcatcatacaaggcagccaagaactgccataaacactacacagatggagggcatgggataggacaggagaggaggtgatgtacacttagaggtaactaaggctagtttgaaaaccgtgaattaagatattcttatcagtataaaaacactgagattgcttacctcccaaattgctttattgtattaactctcatgcttcagctcttggatttgttgtttctaactaacatgtcatgtacaccaaacattttataaatcaatcagtaaatattttgtaagacccaaaatcctggcatattgccaggtctgtggatttgcctgttgggtgttgggatgggatatcagaggaagaagcatacaagtgggaaaaactgtgattagaaagggatcttctgtacaactggtcagatttcaataaataatcattgatggttta

SEQ ID NO: 278098 - DNA, 421 bp, Homo sapiens
ataggtgacttggtaatagacatttattatattgagggttctagatatactgcaatgatagggtggattttataatgaaaaccctaaattcagcatgtatctcataattacctttcgtattttgtatttcagctggagttaaccgaatttcatactggcctgctgatccagaaataagtttgcttacggaggcttctagttctgaagatgcaaagttagatgccaaagcagtggaaagattgaagtcaaacagtcgggcccatgtgtgtgtcttacttcaacctttggtgtgttatatggtgcagtttgtagaggagacctcttacaaatgtgactttattcaaaaaattacaaaaacattgccggatgctaacactgacttttattatgaatgtaaacaagaaagaataaaagaatatga

SEQ ID NO: 278099 - DNA, 3333 bp, Homo sapiens
agtgggccgttgccttacagttgctgagaggaggcgagaggcgggggcgctagggccgagatcatgtctgactgggagaggtttccttggcagcagaggacgctaggtttgggatgaaagaagctgggcagatgcaaaatctggagagcgcgagggccgggcggtcagtcagcacccagactggcagcatgaccggtcagataccaaggctttctaaagtcaaccttttcactctgctcagcctctggatggagctctttccagcagaagcccagcggcaaaaatctcagaaaaatgaagagggaaagcatggacccttaggagataatgaagagaggaccagagtatctactgacaaaagacaggattactgggagcagctaagatgcctagatgaaaggtttaccatcactgctggttaggaaatggattatgagaactcgaacagagggaaggtgaaatgcaaccggaggaaacactctgatatgagctggagttaaccgaatttcatactggcctgctgatccagaaataagtttgcttacggaggcttctagttctgaagatgcaaagttagatgccaaagcagtggaaagattgaagtcaaacagtcgggcccatgtgtgtgtcttacttcaacctttggtgtgttatatggtgcagtttgtagaggagacctcttacaaatgtgactttattcaaaaaattacaaaaacattgccggatgctaacactgacttttattatgaatgtaaacaagaaagaataaaagaatatgaaatgttatttttggtttcaaatgaagaaatgcataagcaaatactgatgactataggtttggagaacctgtgtgaaaatccatactttagcaatctaaggcaaaacatgaaagaccttatcctacttttggccacagtagcttccagtgtgccgaactttaaacacttcggattttaccgtagcaatccagaacagattaatgaaattcacaatcaaagtttgccacaggaaattgcaaggcactgcatggttcaggccaggttattggcatatcgaactgaggatcataaaacaggagttggggcagtcatttgggcagaagggaaatctagaagttgtgatggaacaggtgccatgtactttgtaggatgtggttacaatgcttttcctgttggatctgagtatgctgacttcccacacatggatgacaagcagaaagacagagaaataaggaaattcagatacatcatacatgcggaacagaatgccttgacatttaggtgtcaagaaataaaaccagaagaaagaagcatgatttttgtgacaaagtgcccatgtgatgagtgtgtacctttaattaaaggtgcaggcataaaacaaatctatgcaggagatgtagatgttggaaaaaagaaggcagacatctcttacatgaggttcggggagcttgaaggtgttagcaaatttacgtggcagctgaatccatcaggagcttatggtcttgaacaaaatgagcctgaaaggagagaaaatggtgtgttgagacctgtcccacagaaggaagagcagcaccaggacaagaagctgcgcctcggaatccactaagaaggcctgtctacactgcaggggaacctcaagaacttttcattgcacttctaaaattcagccttgttcattcagaaaataaggatggattttgtgaataattgaaaagattttttaaggaagctaatttatttctaggatacaaatggtgttaataagaatatttgtcttttagatttatgtgtgggttttccataatgtagtagtgtgttattttattacacgaaatgagggagcaataacttcaaccaatgtaatcaccaacagggactgatttctatttatcttgactttatattagccaatttgaaagggtctgcttcacaagaggtcatgcctctgcagggaatcacacaccttttgagaaatattaattcttttgaattacaagagtgacagttagtaaactgctccagggaaataagtgtcatcttttaagagtcagtgtatagcaaaccaaaagatcacatttatacccaaagctttctagtaatcagaatttacttaattagaattgactcataaaaataaagttagtggactttgtctccatttttaaagtatattttgtaaatgttaattctgtggtcctgtttatcacagactttgggtagcaataggaagagagtgttattctgagacagtgtcgctgcttgatatcactgactcttgaaatcactaacagtgaacctcaaatttggttatgatgttaacagagaagaaatatttgagtctggaatattgaaactagctttcctagaattccattaataaatgctgctcccccatatagtcttcccttctgtataattaacataggttgtctcatggctttgatcttcaaaaggaagagccttttaaaaacatttgccaacctcaagaataaatactgaaagtcttgaaagtatggtcatttcagctattccagattgctgtctgtgatttctcacatttttatttgctgagaaacattcagaaaattattccaaaaatgaaggtacattttctgttctctcctaggttagagaggggtggcctggggtgcttcatgagaaatgtcttcctggatctgcggtggtcaggtttgcctctgcttttgttccctgcctttccgccacatcacacggcctcactgggcttcctaccagtttctcagaattacacgcacgaccatccaaacattggctccatgccagggctgtgactgcagcctgtgtaggaccatggggagttcagagtcatcatacaaggcagccaagaactgccataaacactacacagatggagggcatgggataggacaggagaggaggtgatgtacacttagaggtaactaaggctagtttgaaaaccgtgaattaagatattcttatcagtataaaaacactgagattgcttacctcccaaattgctttattgtattaactctcatgcttcagctcttggatttgttgtttctaactaacatgtcatgtacaccaaacattttataaatcaatcagtaaatattttgtaagacccaaaatcctggcatattgccaggtctgtggatttgcctgttgggtgttgggatgggatatcagaggaagaagcatacaagtgggaaaaactgtgattagaaagggaaaaataggcatttccacagtactattaagagaggcatgataatgccattttttttcttctgtacaactggtcagatttcaataaataatcattgatggttta

SEQ ID NO: 278100 - DNA, 3565 bp, Homo sapiens
  misc_feature (3392)..(3394): n is a, c, g, or t
  misc_feature (3396)..(3397): n is a, c, g, or t
  misc_feature (3402)..(3402): n is a, c, g, or t
  misc_feature (3418)..(3418): n is a, c, g, or t
  misc_feature (3430)..(3430): n is a, c, g, or t
  misc_feature (3464)..(3464): n is a, c, g, or t
  misc_feature (3469)..(3470): n is a, c, g, or t
  misc_feature (3479)..(3479): n is a, c, g, or t
  misc_feature (3484)..(3484): n is a, c, g, or t
  misc_feature (3487)..(3487): n is a, c, g, or t
  misc_feature (3489)..(3489): n is a, c, g, or t
agtgggccgttgccttacagttgctgagaggaggcgagaggcgggggcgctagggccgagatcatgtctgactgggagaggtttccttggcagcagaggacgctaggtttgggatgaaagaagctgggcagatgcaaaatctggagagcgcgagggccgggcggtcagtcagcacccagactggcagcatgaccggtcagataccaaggctttctaaagtcaaccttttcactctgctcagcctctggatggagctctttccagcagaagcccagcggcaaaaatctcagaaaaatgaagagggaaagcatggacccttaggagataatgaagagaggaccagagtatctactgacaaaagacaggtaaagagaactggtcttgtggtggtgaaaaacatgaaaattgttggtctccactgttctagtgaagatttacatgccgggcagattgctcttattaaacatgggtcaaggctgaaaaactgtgatctttatttttccagaaaaccatgttctgcttgtttgaaaatgattgtaaatgctggagttaaccgaatttcatactggcctgctgatccagaaataagtttgcttacggaggcttctagttctgaagatgcaaagttagatgccaaagcagtggaaagattgaagtcaaacagtcgggcccatgtgtgtgtcttacttcaacctttggtgtgttatatggtgcagtttgtagaggagacctcttacaaatgtgactttattcaaaaaattacaaaaacattgccggatgctaacactgacttttattatgaatgtaaacaagaaagaataaaagaatatgaaatgttatttttggtttcaaatgaagaaatgcataagcaaatactgatgactataggtttggagaacctgtgtgaaaatccatactttagcaatctaaggcaaaacatgaaagaccttatcctacttttggccacagtagcttccagtgtgccgaactttaaacacttcggattttaccgtagcaatccagaacagattaatgaaattcacaatcaaagtttgccacaggaaattgcaaggcactgcatggttcaggccaggttattggcatatcgaactgaggatcataaaacaggagttggggcagtcatttgggcagaagggaaatctagaagttgtgatggaacaggtgccatgtactttgtaggatgtggttacaatgcttttcctgttggatctgagtatgctgacttcccacacatggatgacaagcagaaagacagagaaataaggaaattcagatacatcatacatgcggaacagaatgccttgacatttaggtgtcaagaaataaaaccagaagaaagaagcatgatttttgtgacaaagtgcccatgtgatgagtgtgtacctttaattaaaggtgcaggcataaaacaaatctatgcaggagatgtagatgttggaaaaaagaaggcagacatctcttacatgaggttcggggagcttgaaggtgttagcaaatttacgtggcagctgaatccatcaggagcttatggtcttgaacaaaatgagcctgaaaggagagaaaatggtgtgttgagacctgtcccacagaaggaagagcagcaccaggacaagaagctgcgcctcggaatccactaagaaggcctgtctacactgcaggggaacctcaagaacttttcattgcacttctaaaattcagccttgttcattcagaaaataaggatggattttgtgaataattgaaaagattttttaaggaagctaatttatttctaggatacaaatggtgttaataagaatatttgtcttttagatttatgtgtgggttttccataatgtagtagtgtgttattttattacacgaaatgagggagcaataacttcaaccaatgtaatcaccaacagggactgatttctatttatcttgactttatattagccaatttgaaagggtctgcttcacaagaggtcatgcctctgcagggaatcacacaccttttgagaaatattaattcttttgaattacaagagtgacagttagtaaactgctccagggaaataagtgtcatcttttaagagtcagtgtatagcaaaccaaaagatcacatttatacccaaagctttctagtaatcagaatttacttaattagaattgactcataaaaataaagttagtggactttgtctccatttttaaagtatattttgtaaatgttaattctgtggtcctgtttatcacagactttgggtagcaataggaagagagtgttattctgagacagtgtcgctgcttgatatcactgactcttgaaatcactaacagtgaacctcaaatttggttatgatgttaacagagaagaaatatttgagtctggaatattgaaactagctttcctagaattccattaataaatgctgctcccccatatagtcttcccttctgtataattaacataggttgtctcatggctttgatcttcaaaaggaagagccttttaaaaacatttgccaacctcaagaataaatactgaaagtcttgaaagtatggtcatttcagctattccagattgctgtctgtgatttctcacatttttatttgctgagaaacattcagaaaattattccaaaaatgaaggtacattttctgttctctcctaggttagagaggggtggcctggggtgcttcatgagaaatgtcttcctggatctgcggtggtcaggtttgcctctgcttttgttccctgcctttccgccacatcacacggcctcactgggcttcctaccagtttctcagaattacacgcacgaccatccaaacattggctccatgccagggctgtgactgcagcctgtgtaggaccatggggagttcagagtcatcatacaaggcagccaagaactgccataaacactacacagatggagggcatgggataggacaggagaggaggtgatgtacacttagaggtaactaaggctagtttgaaaaccgtgaattaagatattcttatcagtataaaaacactgagattgcttacctcccaaattgctttattgtattaactctcatgcttcagctcttggatttgttgtttctaactaacatgtcatgtacaccaaacattttataaatcaatcagtaaatattttgtaagacccaaaatcctggcatattgccaggtctgtggatttgcctgttgggtgttgggatgggatatcagaggaagaagcatacaagtgggaaaaactgtgattagaaagggaaaaataggcatttccacagtactattaagagaggcatgataatgccattttttttcttctgtacaactggtcagatttcaataaataatcattgatggtttaaaaaannnanntcacntactaccagacaaccntagccaaaccanttacccaaataaagttaggcgatagaaattgaancctgnngcatagatntagtnccnangggaaagatgataaatttgaccatggcatactttgcaaggactaacccgtatacttgtgaataatgaataacttga

SEQ ID NO: 278101 - DNA, 3618 bp, Homo sapiens
  misc_feature (3445)..(3447): n is a, c, g, or t
  misc_feature (3449)..(3450): n is a, c, g, or t
  misc_feature (3455)..(3455): n is a, c, g, or t
  misc_feature (3471)..(3471): n is a, c, g, or t
  misc_feature (3483)..(3483): n is a, c, g, or t
  misc_feature (3517)..(3517): n is a, c, g, or t
  misc_feature (3522)..(3523): n is a, c, g, or t
  misc_feature (3532)..(3532): n is a, c, g, or t
  misc_feature (3537)..(3537): n is a, c, g, or t
  misc_feature (3540)..(3540): n is a, c, g, or t
  misc_feature (3542)..(3542): n is a, c, g, or t
agtgggccgttgccttacagttgctgagaggaggcgagaggcgggggcgctagggccgagatcatgtctgactgggagaggtttccttggcagcagaggacgctaggtttgggatgaaagaagctgggcagatgcaaaatctggagagcgcgagggccgggcggtcagtcagcacccagactggcagcatgaccggtcagataccaaggctttctaaagtcaaccttttcactctgctcagcctctggatggagctctttccagcagaagcccagcggcaaaaatctcagaaaaatgaagagggaaagcatggacccttaggagataatgaagagaggaccagagtatctactgacaaaagacaggtaaagagaactggtcttgtggtggtgaaaaacatgaaaattgttggtctccactgttctagtgaagatttacatgccgggcagattgctcttattaaacatgggtcaaggctgaaaaactgtgatctttatttttccagaaaaccatgttctgcttgtttgaaaatgattgtaaatgctggagttaaccgaatttcatactggcctgctgatccagaaataagtttgcttacggaggcttctagttctgaagatgcaaagttagatgccaaagcagtggaaagattgaagtcaaacagtcgggcccatgtgtgtgtcttacttcaacctttggtgtgttatatggtgcagtttgtagaggagacctcttacaaatgtgactttattcaaaaaattacaaaaacattgccggatgctaacactgacttttattatgaatgtaaacaagaaagaataaaagaatatgaaatgttatttttggtttcaaatgaagaaatgcataagcaaatactgatgactataggtttggagaacctgtgtgaaaatccatactttagcaatctaaggcaaaacatgaaagaccttatcctacttttggccacagtagcttccagtgtgccgaactttaaacacttcggattttaccgtagcaatccagaacagattaatgaaattcacaatcaaagtttgccacaggaaattgcaaggcactgcatggttcaggccaggttattggcatatcgaactgaggatcataaaacaggagttggggcagtcatttgggcagaagggaaatctagaagttgtgatggaacaggtgccatgtactttgtaggatgtggttacaatgcttttcctgttggatctgagtatgctgacttcccacacatggatgacaagcagaaagacagagaaataaggaaattcagatacatcatacatgcggaacagaatgccttgacatttaggtgtcaagaaataaaaccagaagaaagaagcatgatttttgtgacaaagtgcccatgtgatgagtgtgtacctttaattaaaggtgcaggcataaaacaaatctatgcaggagatgtagatgttggaaaaaagaaggcagacatctcttacatgaggttcggggagcttgaaggtgttagcaaatttacgtggcagctgaatccatcaggagcttatggtcttgaacaaaatgagcctgaaaggagagaaaatggtgtgttgagacctgtcccacagaaggaagagcagcaccaggacaagaagctgcgcctcggaatccactaagaaggcctgtctacactgcaggggaacctcaagaacttttcattgcacttctaaaattcagccttgttcattcagaaaataaggatggattttgtgaataattgaaaagattttttaaggaagctaatttatttctaggatacaaatggtgttaataagaatatttgtcttttagatttatgtgtgggttttccataatgtagtagtgtgttattttattacacgaaatgagggagcaataacttcaaccaatgtaatcaccaacagggactgatttctatttatcttgactttatattagccaatttgaaagggtctgcttcacaagaggtcatgcctctgcagggaatcacacaccttttgagaaatattaattcttttgaattacaagagtgacagttagtaaactgctccagggaaataagtgtcatcttttaagagtcagtgtatagcaaaccaaaagatcacatttatacccaaagctttctagtaatcagaatttacttaattagaattgactcataaaaataaagttagtggactttgtctccatttttaaagtatattttgtaaatgttaattctgtggtcctgtttatcacagactttgggtagcaataggaagagagtgttattctgagacagtgtcgctgcttgatatcactgactcttgaaatcactaacagtgaacctcaaatttggttatgatgttaacagagaagaaatatttgagtctggaatattgaaactagctttcctagaattccattaataaatgctgctcccccatatagtcttcccttctgtataattaacataggttgtctcatggctttgatcttcaaaaggaagagccttttaaaaacatttgccaacctcaagaataaatactgaaagtcttgaaagtatggtcatttcagctattccagattgctgtctgtgatttctcacatttttatttgctgagaaacattcagaaaattattccaaaaatgaaggtacattttctgttctctcctaggttagagaggggtggcctggggtgcttcatgagaaatgtcttcctggatctgcggtggtcaggtttgcctctgcttttgttccctgcctttccgccacatcacacggcctcactgggcttcctaccagtttctcagaattacacgcacgaccatccaaacattggctccatgccagggctgtgactgcagcctgtgtaggaccatggggagttcagagtcatcatacaaggcagccaagaactgccataaacactacacagatggagggcatgggataggacaggagaggaggtgatgtacacttagaggtaactaaggctagtttgaaaaccgtgaattaagatattcttatcagtataaaaacactgagattgcttacctcccaaattgctttattgtattaactctcatgcttcagctcttggatttgttgtttctaactaacatgtcatgtacaccaaacattttataaatcaatcagtaaatattttgtaagacccaaaatcctggcatattgccaggtctgtggatttgcctgttgggtgttgggatgggatatcagaggaagaagcatacaagtgggaaaaactgtgattagaaagggaaaaataggcatttccacagtactattaagagaggcatgataatgccattttttttcttctgtacaactggtcagatttcaataaataatcattgatggtttaagaagtggacaatagaactagcagcttgacctcgagccgaattcggtacgagcaaaaannnanntcacntactaccagacaaccntagccaaaccanttacccaaataaagttaggcgatagaaattgaancctgnngcatagatntagtnccnangggaaagatgataaatttgaccatggcatactttgcaaggactaacccgtatacttgtgaataatgaataacttga

SEQ ID NO: 278102 - DNA, 1506 bp, Homo sapiens
agccaggtgcaagagaaaccaagccgcatcacttatttattcacactcgaaaagacacctcgtggacatttcagttaagactttcctatcagttctttctcagattctgggcacatagatcgcatgacggtttgcatcataatggcgtcttcagttgtgttctttagacatgacattctatatttgcctaggagacacacaggatttttcttcccttttgtaaagcaatgagctctttctgaatgatcttgaaaacacacggctccttccctctctgtttcccccacttttgggtagagctgtgacttgggagaaacacttctgtattagaagagtggtgagagggagcataaatggagttggtcaactctgggtccagaagacatcgtgggtggagaggactcgaaacctcagtgccactctgccccatcgaggccaagtcagattggaagccccattttgccagtgtctgaattcttaagcgatgctagaaatctagatttctaagaattgtcttggggctgcagttgataaaggaatctacaatcaactttttaacccagtccagagttgttgtatgtacactcgagacccaaaggaaggacagagaattttcctcacctcagcccaaaaggaggctggaatgcatgcttgcctgccacagtttccacttacttaccaccatcagtcagcaggcttttaggagagaattgcacgtgtgatttatttgcaaatcctttcaggtcctggaggagagatacttggtacacaatgcactttgtcatcacgtgtcaacatcccctcaatgcagggagcagcactacacgatgtaaaggtggaactggattgtgctgggatccttcaatcagcatttcatttagagctgcagcatttgcagagccatttgcaattgatgccagccccttggagggggtcagcgtgtagaagacaaaggacagccataaagccactgaatgcaaactttatatttacagtcagtaagtttataaatatatattacattcttacaatctacagtacattctacacgcagatggatttggaagcgggcagcggctgcagtattcaacagaacatgacacaggtaagaatggaaagaaatatgaggacgttactgaaagcaaaggattctcattgaaaaggggtgacagcttaatcacccaaccaaacaaggtaggtaagcttgcggacaggagcaggtgacttactggctgcagaaacctcagtctcaagagcaccacagttgcaggggagagggctaaggttgggagggtaaactggtgaaatttacacacacatgatctaaagagaattcaattctatggagaggaagaaggagtaaagacacacactcaaaattacagagatgagatggagaggaagcagggagaagataggttcaaaggaggagagagatacagagacagacacacagagagactggaaaacagacaactgaagagcagagagagagagaaaatgacc

SEQ ID NO: 278103 - DNA, 348 bp, Homo sapiens
caaaacccccttcttcccataggatatcttatgagattattgttccagagtactcactttgggaaatgttgctttggaccctggggagccattgaagtgttttaagcatgggagaaatatgaacaggtttgagtataagggatataatttgtgacagggatcctggagagaggtgggcccaaatcatcatggtcagtttatagaagtgttcatcgaggtcctccagcatcatagtccatgactccccagggctccatttgactggaataggattatgaggaaaacttatttggaacccctctgagaatcagtccaggtagccaagattttttgatttggttgagatct

SEQ ID NO: 278104 - DNA, 547 bp, Homo sapiens
gcgatgaggacgcgctcgggacactcacgttttctgcaccggcttccgccgcttgcgactggcgtaggtgatgttggcgctgctgctgttcatggtgcccagccgacggcggcggctactccccgggcactggcggccgggtccccggaacccggtgtaggctgggaccactgcggcggccggcgccgggttccgcgaagccgcgcccgctccacctgcgtcctctcgggacagtggcgtgggcgccgcgcctcaacgcctcggcgtcacgcaggcttccgcagcccgcgccagtacagtgttgtgaaccacttgtcatgggataaccaaaattaaacctggaatcgcagaagaaacaaattttttgaagaaattggatgtacttttttaaaatttttcattcaactaaaactttgttaactgtttcttggttgtggtcttctctaaattgtaatctttggcattcacttccaaagtatccaccactaaacttcataacatttattgtgtctcttcatcattaaactttgatgaatttacaaagtgt

SEQ ID NO: 278105 - DNA, 554 bp, Homo sapiens
ttttagcttgcaacaccatgaaaaaattactgagacactaggaatgctgtgaactgagaaagtttgggacctttggcataactaaatccttcatttaacagatggagtctcagtctgtcactaaggctggagtgcagtggcgcgatctcggctcactgcaacctccacctcccgggttcacgcgattctccagcctcagccttccacgtagctgggactacaggtgcatgccaccacacccagttttcctcaataggtgaactcagaaaacaggagaattacactaagtgctcattactttcctagtgttgtgaaccacttgtcatgggataaccaaaattaaacctggaatcgcagaagaaacaaattttttgaagaaattggatgtacttttttaaaatttttcattcaactaaaactttgttaactgtttcttggttgtggtcttctctaaattgtaatctttggcattcacttccaaagtatccaccactaaacttcataacatttattgtgtctcttcatcattaaactttgatgaatttacaaagtgt

SEQ ID NO: 278106 - DNA, 560 bp, Homo sapiens
gaagacgacagaaggggcctccttcctgccaccttgtgaagaagataaaaataaaaatgaagtcaccagccctcaggggtctgtcaaggcaacacacaaaatctccagttaccttctggtggatgacgtttggagacacatcgcgtccgtcacaggacacacttccgatggatttacagcaactcctgggggtcacgaaggtgtgttccaaggccacatctccaacctcacagagaggacaggaagtgatcagtaccccaactagcaagagtggcccgttcattggccgaggttcttgaggatagagtgggaggtgggagcgtccctcgtgctgccttcatttttcctaccctcagctcaggggtctgtgctagaggaagacacacgaaggctactgtgcccccaccacaagagagggaaacagggagacgcgtgggtctggagccaagcgtatctctctgtacccatcgcacacgaatttgaatcatctgctctttggaatcgcctacaccctgctgcacccacgatgtggctgtaactccattaaagaattgaatacc

SEQ ID NO: 278107 - DNA, 472 bp, Homo sapiens
tgaaggttgagtttcactggggacctacctctatctgcctagtaatctgtgtctcctgtagctatcatcatcactgattttctacgtacagatttcaattccaaacaaaaatatatgagaacgttcatttctccatacaactggctgggtcattggccttatcccgcaccgaagttgaaacttacaccatctgttcacatcatcagttcttctggttctcatgcttttgaacttcaactggcacaattccactggctctccttagtctccaggttgcagatggcagattataaatctccttagcctccacctttataatcctaactattactgacacctctttgaggacaaaggaagtagctttctgcaagccaaaaagacctcagaaaaacaacaaatcttccaaactcttgattttgactttttgcctccagaattgtgaagaaataaatatctgttatttaaaaaaaaa

SEQ ID NO: 278108 - DNA, 448 bp, Homo sapiens
gacacaaacagcagaacaacagacaccaggagctacttgaagggaccggcgtgagagtatggaggctgaagccatagaaaggagaaattattccagctgaggccaaaacatgaaccaaggctgggtcattggccttatcccgcaccgaagttgaaacttacaccatctgttcacatcatcagttcttctggttctcatgcttttgaacttcaactggcacaattccactggctctccttagtctccaggttgcagatggcagattataaatctccttagcctccacctttataatcctaactattactgacacctctttgaggacaaaggaagtagctttctgcaagccaaaaagacctcagaaaaacaacaaatcttccaaactcttgattttgactttttgcctccagaattgtgaagaaataaatatctgttatttaaaaaaaaa

SEQ ID NO: 278109 - DNA, 410 bp, Homo sapiens
gtgtgttcttccgccaatgtgttcctctcgacgtccagccacttctgtgcctgcctgcctgtcttggggtttttacaggcacaggataggggacgtggcaggccaggtggtcttggaaaatgcaaacttgggcatgaaaacaggagcgcttgtcctcccctatatgcgtgtgcacaggacctgaggtgaagccctagccagggacctgcccttctctacccagcgctttccttctctcatcccgagtcagtactaatcctaactattactgacacctctttgaggacaaaggaagtagctttctgcaagccaaaaagacctcagaaaaacaacaaatcttccaaactcttgattttgactttttgcctccagaattgtgaagaaataaatatctgttatttaaaaaaaaa

SEQ ID NO: 278110 - DNA, 81 bp, Homo sapiens
aatgaactgtttatattatctccgttgagtcaatacattataatgtattaaaatggaaaggtacaaaattgaaataaatac

SEQ ID NO: 278111 - DNA, 380 bp, Homo sapiens
tctggtaagtaaccagaaaatctttgccagttcgagtggttggaaggtgagatgtatgaaaatattcctaaggtcagcagtcactacataggcttaacttttcaattacttaattattacaatatcttaagcagaatcactatgactctgacttttgtttttaatcttatgagttcagtgatgtaagactaattttactgaaatatgctcacaaaagtcacaacagtagtgaccattttgggaatgattattaacatcaaatctcaatttctgttgatttctaaggcaccattatacatctaagaaaaaaagtaaagctgtcaatttaattgtaaaatgtcactgattgtaagacacaccttgatttaaaaaacctcaaa

SEQ ID NO: 278112 - DNA, 337 bp, Homo sapiens
aacttccttttttagaaactgattcagcagtacagaaagaacttagaaaccagacacctgctccatctgcagctcaaacttctgctccctctaagtaccaccgaactcgatctgggggagccagggatgaacgatatcgatcagatatccacacagaagcagttcaggctgcactggcaaagcataaagaacagaagatggctttgcccatgccaaccaaaaggcgatccacatttgttcagtctcctgcagatgcctgcacacctcctgacacatcttcggcctctgaggatgagggctctctgagacgccaagctgcgctctctgctgccttgca

SEQ ID NO: 278113 - DNA, 828 bp, Homo sapiens
ggctctaggtggcgggtcttggtttgcggaaggggctggagtcgctgcttctcggtgaccggcgcgtggcccggccaatcctgccgccgccacccacccgcaaccgcgtccgttgacggtcgggtccttggtcgccgggtccttgcgggcaccacagagcggggtggcgtccgctccctcgagtcctcggtgccagggaattcaccgctcaccaccccctgccccgccttgggtcctgctcggggaccaaaccactggaaggcagtggcgggaaacgggcgcctgtgccggaggtcctgatgaggggggtccaaggcttggggacttgtgcgggaaatgtgggtttaagtgccttcaaggtgtttttagtccattgggatgttgatcagcgttcatagctggcgctgatgcaggtcaccgggaagggaatgtgtgggtttatggccacgcataatctcttttagtcgtgtttaacttagcagggtagctctccatcctggctgggttttgttttgttttattttttattttacagagtttttctcagtgtgtaatgtttgtttttaaatcgcagataatcctgatgtaaaccattgacatagccagaaaatcaccaggctgtgattttccaaactcagcttcataacctattctgtgtgagctgtgatttttctatgattctgttttcctctttgggtactggtgggccctgaatgatggaccaccgttttcaccctgtaccttttcaaagtacacttgctgatcttagaactgtctgcagtgtcttaaggacatttgtattcacatgccttttaaaagctagccaga

SEQ ID NO: 278114 - DNA, 1200 bp, Homo sapiens
ggctctaggtggcgggtcttggtttgcggaaggggctggagtcgctgcttctcggtgaccggcgcgtggcccggccaatcctgccgccgccacccacccgcaaccgcgtccgttgacggtcgggtccttggtcgccgggtccttgcgggcaccacagagcggggtggcgtccgctccctcgagtcctcggtgccagggaattcaccgctcaccaccccctgccccgccttgggtcctgctcggggaccaaaccactggaaggcagtggcgggaaacgggcgcctgtgccggagagttgagggaacatgagccatttgcagagcttattgttagacaccctcttgggaaccaagcatgtggacagtgcagccctcatcaaaatccaggagcggagcttgtgtgtagcatcaccaggtttcaatgtaacgcccagtgatgtccgaacactggtgaatggatttgccaagaaccctttgcaagcccgaagagaaggactgtatttcaagggaaaagattacagatgtgtccgggcagatgaatattctctttatgccaaaaatgagaacactggtgtggttgttgtgaagacccatctgtatcttctggtagcaacttacactgagggcatgtatcctagcatctgtgtggaagccacagagagcctgggagactacctaagaaaaaaaggaagttaagtcatcagaggcccatgaaagacacttttattattttagaagaaaattgaagagcctaaagaaaaaatattttatggttgaaaaaacactagacagaaggcactaaaaaagaagaatgaattaagggagcaatttttattacttccagagatcctcttctttcactggaattacttgatcaactgttttttaataagtgttggtcatcggcatggaatgagagagcactgatcatttcacagagcatatctattgggaggctcctttctgtgaggctcttgtactcctacacaccttgctaagtatgccaagaatgcaaggctctcaccactctttatccaagacatttctcagggttaggttgcagcaagcaaccttgaaaaatgaagggatgtctcccatcaggacagagagcaagcttgcttactgtttgctataaaagcagtggagtccctgagctcagtgttacccctcctgtaatacaactccctgcatgtgtgaaatc

SEQ ID NO: 278115 - DNA, 478 bp, Homo sapiens
cggaaggccagggcgggcgagcccccgaggcccgagggagagggaagagcgccgggcccgggtcgcggaggcgggcgccgccggaacgcgaagcgcggggctactgcgggcaggcgcgagttcgcgcagcaccgcccccggcgtgacctgctggtcgcttccggcgcgggaggagaatgtggccgccttgcgggacgctccggaccctggccttggcgcggtcgcggggagcccgggcgagcagcagcgccgtgagttctgaggccaagaaccttctccacttgagaagccttcctgggggaggctgagtgggccaggcctggagccacgtaccaacactttatacccaggggaatggatcccaagggcccagataacgcccccaacttcttggggttcacacgcgtcctgagacatctgggaactgcctctgcctgggccaaagctattccattaaaactttattgctgtgcttact

SEQ ID NO: 278116 - DNA, 1955 bp, Homo sapiens
cggaaggccagggcgggcgagcccccgaggcccgagggagagggaagagcgccgggcccgggtcgcggaggcgggcgccgccggaacgcgaagcgcggggctactgcgggcaggcgcgagttcgcgcagcaccgcccccggcgtgacctgctggtcgcttccggcgcgggaggagaatgtggccgccttgcgggacgctccggaccctggccttggcgcggtcgcggggagcccgggcctgcagcggggatgggggcgtttcctacacgcagggccagagtccggagccgcggacccgcgagtatttctactacgtggaccaccagggccagcttttcctggatgattccaaaatgaagaatttcatcacctgcttcaaagacccgcagttcctggtcaccttcttctcccgcctgagacccaaccgcagcgggcgctacgaggccgctttccccttcctctcgccctgcggcagagagcgcaacttcctgcgctgcgaggaccggccggtggtcttcacgcacctgctgaccgcggaccacgggcctccgcgcctctcctactgcggcggtggcgaggccctggccgtgcccttcgagccggcgcgcctgctgcccctggccgccaacgggcgcctgtaccacccggcgccggagcgtgcgggcggcgtgggcctggtgcgctccgccctggccttcgagctcagcgcctgcttcgagtacgggcccggcgcgcctgcgctgccctcgcacgtgcgctggcagggccgccgcctcgccctcaccatggacctggccccgctgctgctcgcggctcggtcgccctgagcggggccaagggaaaggcgggaggccgcgggcgcctctcgccccgctcccccgggactccacgccccggaaagcccgcgccacccgcgctcgcggcagcctagtgcgcctgcgcgctcggccccgcccccacccggcgctgtccttggtgctgccgcggcccggccctcccggacaccccggctccgccacggcgcgcgccccccgcgcacccgactccggcgccctccgggattggcctgcgctcgagacgtcaggcacaggcggcgggcgcggggctctggtgcgcgtgcgcgagcgtcccccgccccctcccagcccggcgactgctcgggcccggccgccacctgcacggcgggggagccgctcgccgcgggagcgtcaggtgaggggacgcccgacccaaggtcaccaggcgtgggggcgctgggggatcggggaccatcccggctctgaccctggtgcgctccgagaagggcgtgggtcctggagggggatggggaacgcggaggccacgccctccctgagcccggccgaaaatcaaccggctctcgtgggtagcagaggaggccgtgggggatacaggcaccaggtcgcagcgctgcagaggtgcgcaagggccgcccaaagaccagcttgggcctcgcactgcgcccgaggcagacacagggcgttccatcctcttccctccccgctcccgcacagaggggcgcccaggaggcagtgacagtcgtcgcggaatcctgcgtgtgacaccccgcccctgcccagcggattagggagttgtcctctggtaaaaggatttctgggctgcttccagcttggggccctcatccctgccctggcaggcctttctacaccgatctgcatctagtggggggtcagcgtgagcagcagcgccgtgagttctgaggccaagaaccttctccacttgagaagccttcctgggggaggctgagtgggccaggcctggagccacgtaccaacactttatacccaggggaatggatcccaagggcccagataacgcccccaacttcttggggttcacacgcgtcctgagacatctgggaactgcctctgcctgggccaaagctattccattaaaactttattgctgtgcttact

SEQ ID NO: 278117 - DNA, 2604 bp, Homo sapiens
  misc_feature (1968)..(1968): n is a, c, g, or t
  misc_feature (2603)..(2604): n is a, c, g, or t
cggaaggccagggcgggcgagcccccgaggcccgagggagagggaagagcgccgggcccgggtcgcggaggcgggcgccgccggaacgcgaagcgcggggctactgcgggcaggcgcgagttcgcgcagcaccgcccccggcgtgacctgctggtcgcttccggcgcgggaggagaatgtggccgccttgcgggacgctccggaccctggccttggcgcggtcgcggggagcccgggcctgcagcggggatgggggcgtttcctacacgcagggccagagtccggagccgcggacccgcgagtatttctactacgtggaccaccagggccagcttttcctggatgattccaaaatgaagaatttcatcacctgcttcaaagacccgcagttcctggtcaccttcttctcccgcctgagacccaaccgcagcgggcgctacgaggccgctttccccttcctctcgccctgcggcagagagcgcaacttcctgcgctgcgaggaccggccggtggtcttcacgcacctgctgaccgcggaccacgggcctccgcgcctctcctactgcggcggtggcgaggccctggccgtgcccttcgagccggcgcgcctgctgcccctggccgccaacgggcgcctgtaccacccggcgccggagcgtgcgggcggcgtgggcctggtgcgctccgccctggccttcgagctcagcgcctgcttcgagtacgggcccggcgcgcctgcgctgccctcgcacgtgcgctggcagggccgccgcctcgccctcaccatggacctggccccgctgctgctcgcggctcggtcgccctgagcggggccaagggaaaggcgggaggccgcgggcgcctctcgccccgctcccccgggactccacgccccggaaagcccgcgccacccgcgctcgcggcagcctagtgcgcctgcgcgctcggccccgcccccacccggcgctgtccttggtgctgccgcggcccggccctcccggacaccccggctccgccacggcgcgcgccccccgcgcacccgactccggcgccctccgggattggcctgcgctcgagacgtcaggcacaggcggcgggcgcggggctctggtgcgcgtgcgcgagcgtcccccgccccctcccagcccggcgactgctcgggcccggccgccacctgcacggcgggggagccgctcgccgcgggagcgtcaggtgaggggacgcccgacccaaggtcaccaggcgtgggggcgctgggggatcggggaccatcccggctctgaccctggtgcgctccgagaagggcgtgggtcctggagggggatggggaacgcggaggccacgccctccctgagcccggccgaaaatcaaccggctctcgtgggtagcagaggaggccgtgggggatacaggcaccaggtcgcagcgctgcagaggtgcgcaagggccgcccaaagaccagcttgggcctcgcactgcgcccgaggcagacacagggcgttccatcctcttccctccccgctcccgcacagaggggcgcccaggaggcagtgacagtcgtcgcggaatcctgcgtgtgacaccccgcccctgcccagcggattagggagttgtcctctggtaaaaggatttctgggctgcttccagcttggggccctcatccctgccctggcaggcctttctacaccgatctgcatctagtggggggtcagcgtgagcagcagcgccgtgagttctgaggccaagaaccttctccacttgagaagccttcctgggggaggctgagtgggccaggcctggagccacgtaccaacactttatacccaggggaatggatcccaagggcccagataacgcccccaacttcttggggttcacacgcgtcctgagacatctgggaactgcctctgcctgggccaaagctattccattaaaactttattgctgtgcttactaaaaaaaaaaaanaaaaaaaaaaaaaaaaaaaaaaaaaaaaaaaaaaaaaaaaaaggggggggggcgcaaaaaaattcccccgggggggcccatttataacgcgcgaccgccagtttttgcgggaccaagaggggcccccccaaaaggagaggcgcgcaataaataagcacaggagcgcggcgcgggccgttacacccgcgcgggggagcggaacaaaggcccaggacggcgcacacgtgcggaaaggcacccatctccgcggcgggggggccatctcggggcccaaccaccgaggaggataaacgcccccaagggaaaataacctttcaacggggcctagtcgggccacccacgcgccaaggcgcgcggggaaaaaagtggcacccgcgactagaattggcacaactctgccgggcgcggcaaaaaaagggcacaccacaggaaagaagcacagaagagaagagcgacgacacgcagaagaaagagcagagaaagcgacaacgagaagaggaacacaagacaagagaaagcaagaacaaacaagaaacaaaggagcgacagcagacgaggaagagagacagacgaagacgagcaccagacagcaacgccgacaccaacaaagacaggaagaagagacgcagcgacann

SEQ ID NO: 278118 - DNA, 1871 bp, Homo sapiens
cggaaggccagggcgggcgagcccccgaggcccgagggagagggaagagcgccgggcccgggtcgcggaggcgggcgccgccggaacgcgaagcgcggggctactgcgggcaggcgcgagttcgcgcagcaccgcccccggcgtgacctgctggtcgcttccggcgcgggaggagaatgtggccgccttgcgggacgctccggaccctggccttggcgcggtcgcggggagcccgggcctgcagcggggatgggggcgtttcctacacgcagggccagagtccggagccgcggacccgcgagtatttctactacgtggaccaccagggccagcttttcctggatgattccaaaatgaagaatttcatcacctgcttcaaaggtaatgctgtgcctccctctccagccccttctttctcccttccgggcagcccctgatgggctccccgactctgccgacgggcccagcgcaccaaggagtgggcgtcctgcgctcaggagccccgctgagtgaggccgggcgaacctcttaccgtcggcgcctgccctcggtatggtcctgggcccggaggccttgggagcccagcgcgctgagtacacgcacccttcatcccccagacccgcagttcctggtcaccttcttctcccgcctgagacccaaccgcagcgggcgctacgaggccgctttccccttcctctcgccctgcggcagagagcgcaacttcctgcgctgcgaggaccggccggtggtcttcacgcacctgctgaccgcggaccacgggcctccgcgcctctcctactgcggcggtggcgaggccctggccgtgcccttcgagccggcgcgcctgctgcccctggccgccaacgggcgcctgtaccacccggcgccggagcgtgcgggcggcgtgggcctggtgcgctccgccctggccttcgagctcagcgcctgcttcgagtacgggcccggcgcgcctgcgctgccctcgcacgtgcgctggcagggccgccgcctcgccctcaccatggacctggccccgctgctgctcgcggctcggtcgccctgagcggggccaagggaaaggcgggaggccgcgggcgcctctcgccccgctcccccgggactccacgccccggaaagcccgcgccacccgcgctcgcggcagcctagtgcgcctgcgcgctcggccccgcccccacccggcgctgtccttggtgctgccgcggcccggccctcccggacaccccggctccgccacggcgcgcgccccccgcgcacccgactccggcgccctccgggattggcctgcgctcgagacgtcaggcacaggcggcgggcgcggggctctggtgcgcgtgcgcgagcgtcccccgccccctcccagcccggcgactgctcgggcccggccgccacctgcacggcgggggagccgctcgccgcgggagcgtcagaggggcgcccaggaggcagtgacagtcgtcgcggaatcctgcgtgtgacaccccgcccctgcccagcggattagggagttgtcctctggtaaaaggatttctgggctgcttccagcttggggccctcatccctgccctggcaggcctttctacaccgatctgcatctagtggggggtcagcgtgagcagcagcgccgtgagttctgaggccaagaaccttctccacttgagaagccttcctgggggaggctgagtgggccaggcctggagccacgtaccaacactttatacccaggggaatggatcccaagggcccagataacgcccccaacttcttggggttcacacgcgtcctgagacatctgggaactgcctctgcctgggccaaagctattccattaaaactttattgctgtgcttact

SEQ ID NO: 278119 - DNA, 1752 bp, Homo sapiens
cggaaggccagggcgggcgagcccccgaggcccgagggagagggaagagcgccgggcccgggtcgcggaggcgggcgccgccggaacgcgaagcgcggggctactgcgggcaggcgcgagttcgcgcagcaccgcccccggcgtgacctgctggtcgcttccggcgcgggaggagaatgtggccgccttgcgggacgctccggaccctggccttggcgcggtcgcggggagcccgggcctgcagcggggatgggggcgtttcctacacgcagggccagagtccggagccgcggacccgcgagtatttctactacgtggaccaccagggccagcttttcctggatgattccaaaatgaagaatttcatcacctgcttcaaagacccgcagttcctggtcaccttcttctcccgcctgagacccaaccgcagcgggcgctacgaggccgctttccccttcctctcgccctgcggcagagagcgcaacttcctgcgctgcgaggaccggccggtggtcttcacgcacctgctgaccgcggaccacgggcctccgcgcctctcctactgcggcggtggcgaggccctggccgtgcccttcgagccggcgcgcctgctgcccctggccgccaacgggcgcctgtaccacccggcgccggagcgtgcgggcggcgtgggcctggtgcgctccgccctggccttcgagctcaggagcagcagcgccgtgagttctgaggccaagaaccttctccacttgagaagccttcctgggggaggctgagtgggccaggcctggagccacgtaccaacactttatacccaggggaatggatcccaagggcccagataacgcccccaacttcttggggttcacacgcgtcctgagacatctgggaactgcctctgcctgggccaaagctattccattaaaactttattgctgtgcttacttatttctagtgactttaaataatcatgtgagttacaatttagggcaagatttaaacaccaaggccacttggtcctgtccctttccacatgactcgaaaggaggaagagctgatggacaggcaaatgtttggggaggccggccagatgaggctgggagacaggacacctgcagccctgttttccctggcttcgggtgggctggctggcttagcccagatccctacttttaaaactgggctccttgttcctgaaaccagaccccagccttcccatttctttacgacaagtacatgtatatggtcccccagcaaactccctgctccttgctgatctcagaggtcacactgctcccagagcccacttgggaagccacaccagaaacccagttggtggcccaaggcgtcccctgtcccaccccagctttcccagggccccatctatccccaaagacaggacacctttctggggaccggcatgggaagcacagacccatggctcctgaaccgaatttcctattatttttctcatcccccaattctctgacaggttacctgagaaaaaggcccaattctagttaagctggtcccacccctaggccagcaggagcaggtgctggacaaagctgtgccttgacttccctggggctcgtagctcctctgaggccagctctgcccaggcccccacaggataacaaggaggcgtgtctgcccagggcctgctctccccctcctagccatgcttgggtaatgggaccccgggctttgtcacctaagcaaagttctcaagccataccctgtacttccagc

SEQ ID NO: 278120 - DNA, 1635 bp, Homo sapiens
cggaaggccagggcgggcgagcccccgaggcccgagggagagggaagagcgccgggcccgggtcgcggaggcgggcgccgccggaacgcgaagcgcggggctactgcgggcaggcgcgagttcgcgcagcaccgcccccggcgtgacctgctggtcgcttccggcgcgggaggagaatgtggccgccttgcgggacgctccggaccctggccttggcgcggtcgcggggagcccgggcctgcagcggggatgggggcgtttcctacacgcagggccagagtccggagccgcggacccgcgagtatttctactacgtggaccaccagggccagcttttcctggatgattccaaaatgaagaatttcatcacctgcttcaaagacccgcagttcctggtcaccttcttctcccgcctgagacccaaccgcagcgggcgctacgaggccgctttccccttcctctcgccctgcggcagagagcgcaacttcctgcgctgcgaggaccggccggtggtcttcacgcacctgctgaccgcggaccacgggcctccgcgcctctcctactgcggcggtggcgaggccctggccgtgcccttcgagccggcgcgcctgctgcccctggccgccaacgggcgcctgtaccacccggcgccggagcgtgcgggcggcgtgggcctggtgcgctccgccctggccttcgagctcagcgcctgcttcgagtacgggcccggcgcgcctgcgctgccctcgcacgtgcgctggcagggccgccgcctcgccctcaccatggacctggccccgctgctgctcgcggctcggtcgccctgagcggggccaagggaaaggcgggaggccgcgggcgcctctcgccccgctcccccgggactccacgccccggaaagcccgcgccacccgcgctcgcggcagcctagtgcgcctgcgcgctcggccccgcccccacccggcgctgtccttggtgctgccgcggcccggccctcccggacaccccggctccgccacggcgcgcgccccccgcgcacccgactccggcgccctccgggattggcctgcgctcgagacgtcaggcacaggcggcgggcgcggggctctggtgcgcgtgcgcgagcgtcccccgccccctcccagcccggcgactgctcgggcccggccgccacctgcacggcgggggagccgctcgccgcgggagcgtcagaggggcgcccaggaggcagtgacagtcgtcgcggaatcctgcgtgtgacaccccgcccctgcccagcggattagggagttgtcctctggtaaaaggatttctgggctgcttccagcttggggccctcatccctgccctggcaggcctttctacaccgatctgcatctagtggggggtcagcgtgagcagcagcgccgtgagttctgaggccaagaaccttctccacttgagaagccttcctgggggaggctgagtgggccaggcctggagccacgtaccaacactttatacccaggggaatggatcccaagggcccagataacgcccccaacttcttggggttcacacgcgtcctgagacatctgggaactgcctctgcctgggccaaagctattccattaaaactttattgctgtgcttact

SEQ ID NO: 278121 - DNA, 2441 bp, Homo sapiens
cggaaggccagggcgggcgagcccccgaggcccgagggagagggaagagcgccgggcccgggtcgcggaggcgggcgccgccggaacgcgaagcgcggggctactgcgggcaggcgcgagttcgcgcagcaccgcccccggcgtgacctgctggtcgcttccggcgcgggaggagaatgtggccgccttgcgggacgctccggaccctggccttggcgcggtcgcggggagcccgggcctgcagcggggatgggggcgtttcctacacgcagggccagagtccggagccgcggacccgcgagtatttctactacgtggaccaccagggccagcttttcctggatgattccaaaatgaagaatttcatcacctgcttcaaagacccgcagttcctggtcaccttcttctcccgcctgagacccaaccgcagcgggcgctacgaggccgctttccccttcctctcgccctgcggcagagagcgcaacttcctgcgctgcgaggaccggccggtggtcttcacgcacctgctgaccgcggaccacgggcctccgcgcctctcctactgcggcggtggcgaggccctggccgtgcccttcgagccggcgcgcctgctgcccctggccgccaacgggcgcctgtaccacccggcgccggagcgtgcgggcggcgtgggcctggtgcgctccgccctggccttcgagctcagcgcctgcttcgagtacgggcccggcgcgcctgcgctgccctcgcacgtgcgctggcagggccgccgcctcgccctcaccatggacctggccccgctgctgctcgcggctcggtcgccctgagcggggccaagggaaaggcgggaggccgcgggcgcctctcgccccgctcccccgggactccacgccccggaaagcccgcgccacccgcgctcgcggcagcctagtgcgcctgcgcgctcggccccgcccccacccggcgctgtccttggtgctgccgcggcccggccctcccggacaccccggctccgccacggcgcgcgccccccgcgcacccgactccggcgccctccgggattggcctgcgctcgagacgtcaggcacaggcggcgggcgcggggctctggtgcgcgtgcgcgagcgtcccccgccccctcccagcccggcgactgctcgggcccggccgccacctgcacggcgggggagccgctcgccgcgggagcgtcagaggggcgcccaggaggcagtgacagtcgtcgcggaatcctgcgtgtgacaccccgcccctgcccagcggattagggagttgtcctctggtaaaaggatttctgggctgcttccagcttggggccctcatccctgccctggcaggcctttctacaccgatctgcatctagtggggggtcagcgtgagcagcagcgccgtgagttctgaggccaagaaccttctccacttgagaagccttcctgggggaggctgagtgggccaggcctggagccacgtaccaacactttatacccaggggaatggatcccaagggcccagataacgcccccaacttcttggggttcacacgcgtcctgagacatctgggaactgcctctgcctgggccaaagctattccattaaaactttattgctgtgcttacttatttctagtgactttaaataatcatgtgagttacaatttagggcaagatttaaacaccaaggccacttggtcctgtccctttccacatgactcgaaaggaggaagagctgatggacaggcaaatgtttggggaggccggccagatgaggctgggagacaggacacctgcagccctgttttccctggcttcgggtgggctggctggcttagcccagatccctacttttaaaactgggctccttgttcctgaaaccagaccccagccttcccatttctttacgacaagtacatgtatatggtcccccagcaaactccctgctccttgctgatctcagaggtcacactgctcccagagcccacttgggaagccacaccagaaacccagttggtggcccaaggcgtcccctgtcccaccccagctttcccagggccccatctatccccaaagacaggacacctttctggggaccggcatgggaagcacagacccatggctcctgaaccgaatttcctattatttttctcatcccccaattctctgacaggttacctgagaaaaaggcccaattctagttaagctggtcccacccctaggccagcaggagcaggtgctggacaaagctgtgccttgacttccctggggctcgtagctcctctgaggccagctctgcccaggcccccacaggataacaaggaggcgtgtctgcccagggcctgctctccccctcctagccatgcttgggtaatgggaccccgggctttgtcacctaagcaaagttctcaagccataccctgtacttccagc

SEQ ID NO: 278122 - DNA, 2284 bp, Homo sapiens
  misc_feature (1648)..(1648): n is a, c, g, or t
  misc_feature (2283)..(2284): n is a, c, g, or t
cggaaggccagggcgggcgagcccccgaggcccgagggagagggaagagcgccgggcccgggtcgcggaggcgggcgccgccggaacgcgaagcgcggggctactgcgggcaggcgcgagttcgcgcagcaccgcccccggcgtgacctgctggtcgcttccggcgcgggaggagaatgtggccgccttgcgggacgctccggaccctggccttggcgcggtcgcggggagcccgggcctgcagcggggatgggggcgtttcctacacgcagggccagagtccggagccgcggacccgcgagtatttctactacgtggaccaccagggccagcttttcctggatgattccaaaatgaagaatttcatcacctgcttcaaagacccgcagttcctggtcaccttcttctcccgcctgagacccaaccgcagcgggcgctacgaggccgctttccccttcctctcgccctgcggcagagagcgcaacttcctgcgctgcgaggaccggccggtggtcttcacgcacctgctgaccgcggaccacgggcctccgcgcctctcctactgcggcggtggcgaggccctggccgtgcccttcgagccggcgcgcctgctgcccctggccgccaacgggcgcctgtaccacccggcgccggagcgtgcgggcggcgtgggcctggtgcgctccgccctggccttcgagctcagcgcctgcttcgagtacgggcccggcgcgcctgcgctgccctcgcacgtgcgctggcagggccgccgcctcgccctcaccatggacctggccccgctgctgctcgcggctcggtcgccctgagcggggccaagggaaaggcgggaggccgcgggcgcctctcgccccgctcccccgggactccacgccccggaaagcccgcgccacccgcgctcgcggcagcctagtgcgcctgcgcgctcggccccgcccccacccggcgctgtccttggtgctgccgcggcccggccctcccggacaccccggctccgccacggcgcgcgccccccgcgcacccgactccggcgccctccgggattggcctgcgctcgagacgtcaggcacaggcggcgggcgcggggctctggtgcgcgtgcgcgagcgtcccccgccccctcccagcccggcgactgctcgggcccggccgccacctgcacggcgggggagccgctcgccgcgggagcgtcagaggggcgcccaggaggcagtgacagtcgtcgcggaatcctgcgtgtgacaccccgcccctgcccagcggattagggagttgtcctctggtaaaaggatttctgggctgcttccagcttggggccctcatccctgccctggcaggcctttctacaccgatctgcatctagtggggggtcagcgtgagcagcagcgccgtgagttctgaggccaagaaccttctccacttgagaagccttcctgggggaggctgagtgggccaggcctggagccacgtaccaacactttatacccaggggaatggatcccaagggcccagataacgcccccaacttcttggggttcacacgcgtcctgagacatctgggaactgcctctgcctgggccaaagctattccattaaaactttattgctgtgcttactaaaaaaaaaaaanaaaaaaaaaaaaaaaaaaaaaaaaaaaaaaaaaaaaaaaaaaggggggggggcgcaaaaaaattcccccgggggggcccatttataacgcgcgaccgccagtttttgcgggaccaagaggggcccccccaaaaggagaggcgcgcaataaataagcacaggagcgcggcgcgggccgttacacccgcgcgggggagcggaacaaaggcccaggacggcgcacacgtgcggaaaggcacccatctccgcggcgggggggccatctcggggcccaaccaccgaggaggataaacgcccccaagggaaaataacctttcaacggggcctagtcgggccacccacgcgccaaggcgcgcggggaaaaaagtggcacccgcgactagaattggcacaactctgccgggcgcggcaaaaaaagggcacaccacaggaaagaagcacagaagagaagagcgacgacacgcagaagaaagagcagagaaagcgacaacgagaagaggaacacaagacaagagaaagcaagaacaaacaagaaacaaaggagcgacagcagacgaggaagagagacagacgaagacgagcaccagacagcaacgccgacaccaacaaagacaggaagaagagacgcagcgacann

SEQ ID NO: 278123 - DNA, 1591 bp, Homo sapiens
cggggagttgggtcggtccgggccgaggctcctacatgggccgcgtccctgctgcgttgtgcagcttcggactctgtcctacaagtccccagccccggcgctgacttctcgccgctgccagggagacacccgggccgccctgcctttttttggaagccctgtcaaaaggcagctgcatgtccgggaggcagcaggccaggtagtctccgcggaggaggtggtacaactgattacaaacttgaaaagagggaaaaggtgcggaaagaattggctgaccagggagcagagcttttcctggatgattccaaaatgaagaatttcatcacctgcttcaaagacccgcagttcctggtcaccttcttctcccgcctgagacccaaccgcagcgggcgctacgaggccgctttccccttcctctcgccctgcggcagagagcgcaacttcctgcgctgcgaggaccggccggtggtcttcacgcacctgctgaccgcggaccacgggcctccgcgcctctcctactgcggcggtggcgaggccctggccgtgcccttcgagccggcgcgcctgctgcccctggccgccaacgggcgcctgtaccacccggcgccggagcgtgcgggcggcgtgggcctggtgcgctccgccctggccttcgagctcagcgcctgcttcgagtacgggcccggcgcgcctgcgctgccctcgcacgtgcgctggcagggccgccgcctcgccctcaccatggacctggccccgctgctgctcgcggctcggtcgccctgagcggggccaagggaaaggcgggaggccgcgggcgcctctcgccccgctcccccgggactccacgccccggaaagcccgcgccacccgcgctcgcggcagcctagtgcgcctgcgcgctcggccccgcccccacccggcgctgtccttggtgctgccgcggcccggccctcccggacaccccggctccgccacggcgcgcgccccccgcgcacccgactccggcgccctccgggattggcctgcgctcgagacgtcaggcacaggcggcgggcgcggggctctggtgcgcgtgcgcgagcgtcccccgccccctcccagcccggcgactgctcgggcccggccgccacctgcacggcgggggagccgctcgccgcgggagcgtcagaggggcgcccaggaggcagtgacagtcgtcgcggaatcctgcgtgtgacaccccgcccctgcccagcggattagggagttgtcctctggtaaaaggatttctgggctgcttccagcttggggccctcatccctgccctggcaggcctttctacaccgatctgcatctagtggggggtcagcgtgagcagcagcgccgtgagttctgaggccaagaaccttctccacttgagaagccttcctgggggaggctgagtgggccaggcctggagccacgtaccaacactttatacccaggggaatggatcccaagggcccagataacgcccccaacttcttggggttcacacgcgtcctgagacatctgggaactgcctctgcctgggccaaagctattccattaaaactttattgctgtgcttact

SEQ ID NO: 278124 - DNA, 2006 bp, Homo sapiens
cggaaggccagggcgggcgagcccccgaggcccgagggagagggaagagcgccgggcccgggtcgcggaggcgggcgccgccggaacgcgaagcgcggggctactgcgggcaggcgcgagttcgcgcagcaccgcccccggcgtgacctgctggtcgcttccggcgcgggaggagaatgtggccgccttgcgggacgctccggaccctggccttggcgcggtcgcggggagcccgggcctgcagcggggatgggggcgtttcctacacgcagggccagagtccggagccgcggacccgcgagtatttctactacgtggaccaccagggccagcttttcctggatgattccaaaatgaagaatttcatcacctgcttcaaagacccgcagttcctggtcaccttcttctcccgcctgagacccaaccgcagcgggcgctacgaggccgctttccccttcctctcgccctgcggcagagagcgcaacttcctgcgctgcgaggaccggccggtggtcttcacgcacctgctgaccgcggaccacgggcctccgcgcctctcctactgcggcggtggcgaggccctggccgtgcccttcgagccggcgcgcctgctgcccctggccgccaacgggcgcctgtaccacccggcgccggagcgtgcgggcggcgtgggcctggtgcgctccgccctggccttcgagctcagcgcctgcttcgagtacgggcccggcgcgcctgcgctgccctcgcacgtgcgctggcagggccgccgcctcgccctcaccatggacctggccccgctgctgctcgcggctcggtcgccctgagcggggccaagggaaaggcgggaggccgcgggcgcctctcgccccgctcccccgggactccacgccccggaaagcccgcgccacccgcgctcgcggcagcctagtgcgcctgcgcgctcggccccgcccccacccggcgctgtccttggtgctgccgcggcccggccctcccggacaccccggctccgccacggcgcgcgccccccgcgcacccgactccggcgccctccgggattggcctgcgctcgagacgtcaggcacaggcggcgggcgcggggctctggtgcgcgtgcgcgagcgtcccccgccccctcccagcccggcgactgctcgggcccggccgccacctgcacggcgggggagccgctcgccgcgggagcgtcaggagggcacgcgtctgcggctgaaccgcggaagggccggtgaggaaccgggcctcgggagatggccctgagggcccccgcactgctgccgctgctgctgctactactgccgctccgcgccgccggctgcccagcagcctgccgctgctacagcgccacggtggagtgtggcgccctgcggttgcgcgtcgtcccgctgggaatcccgccagggacgcagacactgttcctgcaggacaacaacatcgcccgcctagagccgggagccctggcgccactcgccgctctgcgccggctctacctgcacaacaacagcctgcgcgccctggaggccggcgccttccgcgcgcagccgcgcctgctggagctggcgctcactagcaaccggctgcgcggcttgcgcagcggcgccttcgtaggcctggcccagctgcgcgtgctctacctggcgggcaaccagctggcgcggctgctggatttcaccttcttgcacctgccgcgactgcaggagcttcacctgcaagaaaacagcattgagctgctggaggaccaggctctagcggggctgtcctccctagcactgctggacctcagcaggaaccagctgggcaccatcagccgagaggccctgcagcccctggccagtctgcaagtcctgcgcctcacagagaacccatggcgctgtgactgcgccctgcactggctgggtgcctggatcaaggagggcggccagcggctgctcacctccagggacaggaagatcatgtgtgcagagcccccgcgcctggcgctccag

SEQ ID NO: 278125 - DNA, 778 bp, Homo sapiens
tcacaactaaaggtcgtcatctgggcaaatgaaccactctgacttggagattaggggctcagacagccgtggatgagagtccagctctactacttattagccttgattagactgtgagagggatgggaaagactggtgcttggggtggccatctgacccctgatggacaggagaccaggacaagcccactggatgagccggaggggtccaggaggagggagttgagagctcctgctagggttgacacattctggtaaggagttcatctgctgtccaccaggggagacaataaaaaggtcaacacagctcccacctcgaagcagctgccagtttattacatgaagtgtcaggctgtggactgcaggcatgccattttgtcttgcaaattcccgggcacacgaatgattccagggttcctccagcactttggtattacttgaaagcaatcttaagggatctagaatgaaccaacgcccaaaaaggatcccttagcagcggtgatatcaaagaaacacttttgaagaactaattttccacccagatttccccaattttaaaagcaatgggcaaagccttctccactcctaaacttcctggaactgtcttttggctatatcaggcccctgaagttagagtctttgaaagactccaaactccaaattctatgcttttattctcaggctcctcataattctacagcacaccagactgctgaccactctccgtaccacttttaaattatttcttcccacagctttcttaacaatgaacctttgaa

SEQ ID NO: 278126 - DNA, 1690 bp, Homo sapiens
gtgttctcaacttagaaatcatattttgcaacaatgggaaagaacatgtagtgtgtgcaaaattcttgcaaaacatccctctttctccgtaaatcatgcttgcttgtactgaaatgcttgtattagggaacagagaggcacctgccccttagagcctaaatgaagtaagttttgattagaagttaccactgaatctcccttaaagagagttgtgactgggactccgtttgttccctaggggagacaataaaaaggtcaacacagctcccacctcgaagcagctgccagtttattacatgaagtgtcaggctgtggactgcaggcatgccattttgtcttgcaagaacaggtgggatcagaggtccttgactgatcagaatacactgctttcaaccaaaacattattagcattgatttcttaaaaaataatagcaaagtagaaaacctttagctggtctgtttcttcgtgtcctgaaacttccttattagtgtaattaaaagtactaagttaagaattagcctgggaaaggaccctacttatggcaaagtcttcagaaaagtaaagagcaaaaccagatatgtgccttgttctcatggtgctgacagtatagcgaagaggaaatactttaatcatacgaataaataaatgtaaagttagaactgtgcaactgctacgaagagaggatatagcactaaaaagccctagaatgggagatttgacctggccagggatgtcaagaaatgcttccaagaggaagtggttcttgagctgagattggaattaactgggcaaagggctccgggtagagaaaacagcatgctcaggtactatgttggaggacatatggggagttcgagaaactccaaaactgccagtgtgactgaagcaaagggagctagagtgttaggagcttataatccccactaaaggattttgtcttagcccaagagcaaagagataccagtggagactgctaagcaggaggacaacatgacacatttgtgcttttaaaggtttactctagctttagtgtggagagtggctgggagaagtcagaacagatacaagtgcacagtttgggtgccagaacagtcttccaggatgtgaagatgtgatactgaacttggacagtggtagtagaaatggagagatgtggatagactcagatatttaaatacatatacaaatgatgagagcattataaaaagaggatcgtggaagccaagattctgtgctgcaatggatcaaagtattttctgtggtttgagattttctaagatactctctctttacagaattcccgggcacacgaatgattccagggttcctccagcactttggtattacttgaaagcaatcttaagggatctagaatgaaccaacgcccaaaaaggatcccttagcagcggtgatatcaaagaaacacttttgaagaactaattttccacccagatttccccaattttaaaagcaatgggcaaagccttctccactcctaaacttcctggaactgtcttttggctatatcaggcccctgaagttagagtctttgaaagactccaaactccaaattctatgcttttattctcaggctcctcataattctacagcacaccagactgctgaccactctccgtaccacttttaaattatttcttcccacagctttcttaacaatgaacctttgaa

SEQ ID NO: 278127 - DNA, 1629 bp, Homo sapiens
gtgttctcaacttagaaatcatattttgcaacaatgggaaagaacatgtagtgtgtgcaaaattcttgcaaaacatccctctttctccgtaaatcatgcttgcttgtactgaaatgcttgtattagggaacagagaggcacctgccccttagagcctaaatgaagtaagttttgattagaagttaccactgaatctcccttaaagagagttgtgactgggactccgtttgttccctaggggagacaataaaaaggtcaacacagctcccacctcgaagcagagaacaggtgggatcagaggtccttgactgatcagaatacactgctttcaaccaaaacattattagcattgatttcttaaaaaataatagcaaagtagaaaacctttagctggtctgtttcttcgtgtcctgaaacttccttattagtgtaattaaaagtactaagttaagaattagcctgggaaaggaccctacttatggcaaagtcttcagaaaagtaaagagcaaaaccagatatgtgccttgttctcatggtgctgacagtatagcgaagaggaaatactttaatcatacgaataaataaatgtaaagttagaactgtgcaactgctacgaagagaggatatagcactaaaaagccctagaatgggagatttgacctggccagggatgtcaagaaatgcttccaagaggaagtggttcttgagctgagattggaattaactgggcaaagggctccgggtagagaaaacagcatgctcaggtactatgttggaggacatatggggagttcgagaaactccaaaactgccagtgtgactgaagcaaagggagctagagtgttaggagcttataatccccactaaaggattttgtcttagcccaagagcaaagagataccagtggagactgctaagcaggaggacaacatgacacatttgtgcttttaaaggtttactctagctttagtgtggagagtggctgggagaagtcagaacagatacaagtgcacagtttgggtgccagaacagtcttccaggatgtgaagatgtgatactgaacttggacagtggtagtagaaatggagagatgtggatagactcagatatttaaatacatatacaaatgatgagagcattataaaaagaggatcgtggaagccaagattctgtgctgcaatggatcaaagtattttctgtggtttgagattttctaagatactctctctttacagaattcccgggcacacgaatgattccagggttcctccagcactttggtattacttgaaagcaatcttaagggatctagaatgaaccaacgcccaaaaaggatcccttagcagcggtgatatcaaagaaacacttttgaagaactaattttccacccagatttccccaattttaaaagcaatgggcaaagccttctccactcctaaacttcctggaactgtcttttggctatatcaggcccctgaagttagagtctttgaaagactccaaactccaaattctatgcttttattctcaggctcctcataattctacagcacaccagactgctgaccactctccgtaccacttttaaattatttcttcccacagctttcttaacaatgaacctttgaa

SEQ ID NO: 278128 - DNA, 3040 bp, Homo sapiens
gcgggtggtgccggtggcggcggcgggggagcgcgggacaggaggcttcggggaagatggacccggcgccctcgctgggctgcagcctcaaggatgtgaagtggagctcggtggccgtgccgctcgacctcctggtcagcacttaccggctgccccagatcgcgcgcctggacaacggagagtgcgtagaagggctgcgggaaaatgactatctgctgattcattcctgccgccagtggaccaccatcactgcccacagcttggaggagggtcactatgtcattgggccaaagatagagattccggtacattatgcagggcaattcaagctgctggaacaagaccgagatataaaggagccagtgcaatatttcaacagtgtggaggaggtggctaaggcatttcctgaacgcgtgtacgtcatggaggatatcacattcaacgtgaaggttgcttcaggtgaatgcaatgaagacactgaagtttacaacatcaccctgtgtactggggatgaactcactctaatggggcaggcagaaatcctttatgcaaagacattcaaggaaaagtcacgactcaacacaatcttcaaaaagattgggaagctcaattccatcagcaagctgggaaaaggcaaaatgccgtgcctcatttgtatgaatcaccggaccaacgaaagcattagccttccattccagtgcaagggcagatttagcacccgaagtcccctggaacttcagatgcaagagggcgaacacaccatccgcaacattgtggagaaaaccaggcttcctgtgaatgtgactgtgccaagccctccaccgagaaacccatacgacctccacttcatccgtgaggggcaccgctataagtttgtgaacatccagaccaagacggtggtggtttgctgtgtgctgcggaacaacaagatcctccccatgcactttcctttgcacttgactgtccccaagttcagcctcccagaacacctggtgaagggagagagctggcccgaaaccctggtccatcactggctaggtatctgccaagaacagttcgacatcgatgagtattcacgggctgtccgtgatgtgaaaaccgactggaatgaagaatgcaagagccccaagaagggtcggtgctctggccacaaccacgtgcccaattcgctcagctacgcccgcgatgagctcacccagtccttccaccgactctcggtctgtgtgtatggcaacaatctccatggcaacagtgaggtgaaccttcatggttgcagggacctggggggagattgggctccctttcctcatgacatcctgccctatcaggactctggagatagtgggagcgactaccttttcccagaagctagtgaagaatcagcaggcatcccgggaaagtcagaacttccctacgaagagctgtggctggaggaaggcaagcccagccatcagcctctcactcgctctctgagcgagaagaacagatgtgatcagtttagaggttctgtccgatccaaatgtgcgacttctcctcttcccatccctgggactctgggagcagcagtgaagtcttcagatactgccctacctccacctccagtgcctcccaaatctgaagccgtcagagaagaatgccggctcctgaacgccccacctgttccaccccgaagcgcaaagcctttgtccaccagtccctccatccctcctcgcacagtcaagccagcgcggcaacagactcgctctcccagccccaccttgtcctactattcttcagggctacacaacatcgtcactaaaactgacacaaatccttctgaaagcactcctgtttcctgctatccatgtaaccgagtgaaaactgattctgtggacctgaaatccccgtttggaagtccttctgctgaagctgtgtcctctcggctctcatggcctaaccattattcaggagcatcagaaagccagaccaggagtgacttcctgctggatccaagcaggagttatagttaccctagacaaaagacgccaggcacaccaaagagaaactgcccagcaccttttgattttgatggctgtgagctcctggccagccccactagcccagtcactgcagaattcagtagcagcgtctctggttgtcccaagtcagccagctactctctggagagcacagatgtgaaatctcttgcagctggtgtgacaaagcagagtacgtcatgccctgccttaccccccagggctccaaaactagtggaagagaaggtcgcctccgaaacatctcctttgcctctgaaaattgatggtgctgaggaagaccccaagtctgggtcaccagatctctcggaggaccagtattttgttaaaaagggcatgcaggacatcttctctgcctcctaccctttctcatctccgctccatctccagctggcccccagatcctgtggcgacggttccccatggcagccacctgctgacctatcaggactctctatagaggaagtgtccaagtcactacggttcattggtttgtccgaagatgtcatatcattctttgttactgaaaagattgatgggaacctgcttgttcagctaacggaagaaatcctctcagaggatttcaaattgagcaaattgcaggtgaagaagataatgcaattcattaatggctggaggcccaaaatatagccaaataacccccggccagcatggaacaaaactgatcaatgcgtgtgctagaaggggtgggctgggacacaatttcatgtttttgcactaaaaaccttctctgtaaatagggataagagaaactcttactatgcagattacgtttttgaatggtgaacaggctattttgtacatcaataaaaatgctgtacagaacacttggaggtgtgccttgtacgtcactcaacaaacactcagcagctgctaaaagaaaaaaaggcatgtgcagagaaatcattcttacccaagtaggtttatgtgagaaggtatgatatttattacaaaatagccaaagctgaaagacataaaaatcttta

SEQ ID NO: 278129 - DNA, 2880 bp, Homo sapiens
gcgggtggtgccggtggcggcggcgggggagcgcgggacaggaggcttcggggaagatggacccggcgccctcgctgggctgcagcctcaaggatgtgaagtggagctcggtggccgtgccgctcgacctcctggtcagcacttaccggctgccccagatcgcgcgcctggacaacggagagtgcgtagaagggctgcgggaaaatgactatctgctgattcattcctgccgccagtggaccaccatcactgcccacagcttggaggagggtcactatgtcattgggccaaagatagagattccggtacattatgcagggcaattcaagctgctggaacaagaccgagatataaaggagccagtgcaatatttcaacagtgtggaggaggtggctaaggcatttcctgaacgcgtgtacgtcatggaggatatcacattcaacgtgaaggttgcttcaggtgaatgcaatgaagacactgaagtttacaacatcaccctgtgtactggggatgaactcactctaatggggcaggcagaaatcctttatgcaaagacattcaaggaaaagtcacgactcaacacaatcttcaaaaagattgggaagctcaattccatcagcaagctgggaaaaggcaaaatgccgtgcctcatttgtatgaatcaccggaccaacgaaagcattagccttccattccagtgcaagggcagatttagcacccgaagtcccctggaacttcagatgcaagagggcgaacacaccatccgcaacattgtggagaaaaccaggcttcctgtgaatgtgactgtgccaagccctccaccgagaaacccatacgacctccacttcatccgtgaggggcaccgctataagtttgtgaacatccagaccaagacggtggtggtttgctgtgtgctgcggaacaacaagatcctccccatgcactttcctttgcacttgactgtccccaagttcagcctcccagaacacctggtgaagggagagagctggcccgaaaccctggtccatcactggctaggtatctgccaagaacagttcgacatcgatgagtattcacgggctgtccgtgatgtgaaaaccgactggaatgaagaatgcaagagccccaagaagggtcggtgctctggccacaaccacgtgcccaattcgctcagctacgcccgcgatgagctcacccagtccttccaccgactctcggtctgtgtgtatggcaacaatctccatggcaacagtgaggtgaaccttcatggttgcagggacctggggggagattgggctccctttcctcatgacatcctgccctatcaggactctggagatagtgggagcgactaccttttcccagaagctagtgaagaatcagcaggcatcccgggaaagtcagaacttccctacgaagagctgtggctggaggaaggcaagcccagccatcagcctctcactcgctctctgagcgagaagaacagatgtgatcagtttagaggttctgtccgatccaaatgtgcgacttctcctcttcccatccctgggactctgggagcagcagtgaagtcttcagatactgccctacctccacctccagtgcctcccaaatctgaagccgtcagagaagaatgccggctcctgaacgccccacctgttccaccccgaagcgcaaagcctttgtccaccagtccctccatccctcctcgcacagtcaagccagcgcggcaacagactcgctctcccagccccaccttgtcctactattcttcagggctacacaacatcgtcactaaaactgacacaaatccttctgaaagcactcctgtttcctgctatccatgtaaccgagtgaaaactgattctgtggacctgaaatccccgtttggaagtccttctgctgaagctgtgtcctctcggctctcatggcctaaccattattcaggagcatcagaaagccagaccaggagtgacttcctgctggatccaagcaggagttatagttaccctagacaaaagacgccaggcacaccaaagagaaactgcccagcaccttttgattttgatggctgtgagctcctggccagccccactagcccagtcactgcagaattcagtagcagcgtctctggttgtcccaagtcagccagctactctctggagagcacagatgtgaaatctcttgcagctggtgtgacaaagcagagtacgtcatgccctgccttaccccccagggctccaaaactagtggaagagaaggtcgcctccgaaacatctcctttgcctctgaaaattgatggtgctgaggaagaccccaagtctgggtcaccagatctctcggaggaccagtattttgttaaaaagggcatgcaggacatcttctctgcctcctaccctttctcatctccgctccatctccagctggcccccagatcctgtggcgacggttccccatggcagccacctgctgacctatcaggactctctatagaggaagtgtccaagtcactacggttcattggtttgtccgaagatgtcatatcattctttgttactgaaaagattgatgggaacctgcttgttcagctaacggaagaaatcctctcagaggatttcaaattgagcaaattgcaggtgaagaagataatgcaattcattaatggctggaggcccaaaatatagccaaataacccccggccagcatggaacaaaactgatcaatgcgtgtgctagaaggggtgggctgggacacaatttcatgtttttgcactaaaaaccttctctgtaaatagggataagagaaactcttactatgcagattacgtttttgaatggtgaacaggctattttgtacatcaataaaaatgctgtacagaac

SEQ ID NO: 278130 - DNA, 2807 bp, Homo sapiens
aagaggccgggcatggtgactcaagccagtaatcccagcactttgggaggctgaggcgggtggatcacgaggtcaggagaccgagactatcctgggctaacacggagagtgcgtagaagggctgcgggaaaatgactatctgctgattcattcctgccgccagtggaccaccatcactgcccacagcttggaggagggtcactatgtcattgggccaaagatagagattccggtacattatgcagggcaattcaagctgctggaacaagaccgagatataaaggagccagtgcaatatttcaacagtgtggaggaggtggctaaggcatttcctgaacgcgtgtacgtcatggaggatatcacattcaacgtgaaggttgcttcaggtgaatgcaatgaagacactgaagtttacaacatcaccctgtgtactggggatgaactcactctaatggggcaggcagaaatcctttatgcaaagacattcaaggaaaagtcacgactcaacacaatcttcaaaaagattgggaagctcaattccatcagcaagctgggaaaaggcaaaatgccgtgcctcatttgtatgaatcaccggaccaacgaaagcattagccttccattccagtgcaagggcagatttagcacccgaagtcccctggaacttcagatgcaagagggcgaacacaccatccgcaacattgtggagaaaaccaggcttcctgtgaatgtgactgtgccaagccctccaccgagaaacccatacgacctccacttcatccgtgaggggcaccgctataagtttgtgaacatccagaccaagacggtggtggtttgctgtgtgctgcggaacaacaagatcctccccatgcactttcctttgcacttgactgtccccaagttcagcctcccagaacacctggtgaagggagagagctggcccgaaaccctggtccatcactggctaggtatctgccaagaacagttcgacatcgatgagtattcacgggctgtccgtgatgtgaaaaccgactggaatgaagaatgcaagagccccaagaagggtcggtgctctggccacaaccacgtgcccaattcgctcagctacgcccgcgatgagctcacccagtccttccaccgactctcggtctgtgtgtatggcaacaatctccatggcaacagtgaggtgaaccttcatggttgcagggacctggggggagattgggctccctttcctcatgacatcctgccctatcaggactctggagatagtgggagcgactaccttttcccagaagctagtgaagaatcagcaggcatcccgggaaagtcagaacttccctacgaagagctgtggctggaggaaggcaagcccagccatcagcctctcactcgctctctgagcgagaagaacagatgtgatcagtttagaggttctgtccgatccaaatgtgcgacttctcctcttcccatccctgggactctgggagcagcagtgaagtcttcagatactgccctacctccacctccagtgcctcccaaatctgaagccgtcagagaagaatgccggctcctgaacgccccacctgttccaccccgaagcgcaaagcctttgtccaccagtccctccatccctcctcgcacagtcaagccagcgcggcaacagactcgctctcccagccccaccttgtcctactattcttcagggctacacaacatcgtcactaaaactgacacaaatccttctgaaagcactcctgtttcctgctatccatgtaaccgagtgaaaactgattctgtggacctgaaatccccgtttggaagtccttctgctgaagctgtgtcctctcggctctcatggcctaaccattattcaggagcatcagaaagccagaccaggagtgacttcctgctggatccaagcaggagttatagttaccctagacaaaagacgccaggcacaccaaagagaaactgcccagcaccttttgattttgatggctgtgagctcctggccagccccactagcccagtcactgcagaattcagtagcagcgtctctggttgtcccaagtcagccagctactctctggagagcacagatgtgaaatctcttgcagctggtgtgacaaagcagagtacgtcatgccctgccttaccccccagggctccaaaactagtggaagagaaggtcgcctccgaaacatctcctttgcctctgaaaattgatggtgctgaggaagaccccaagtctgggtcaccagatctctcggaggaccagtattttgttaaaaagggcatgcaggacatcttctctgcctcctaccctttctcatctccgctccatctccagctggcccccagatcctgtggcgacggttccccatggcagccacctgctgacctatcaggactctctatagaggaagtgtccaagtcactacggttcattggtttgtccgaagatgtcatatcattctttgttactgaaaagattgatgggaacctgcttgttcagctaacggaagaaatcctctcagaggatttcaaattgagcaaattgcaggtgaagaagataatgcaattcattaatggctggaggcccaaaatatagccaaataacccccggccagcatggaacaaaactgatcaatgcgtgtgctagaaggggtgggctgggacacaatttcatgtttttgcactaaaaaccttctctgtaaatagggataagagaaactcttactatgcagattacgtttttgaatggtgaacaggctattttgtacatcaataaaaatgctgtacagaac

SEQ ID NO: 278131 - DNA, 2069 bp, Homo sapiens
gcgggtggtgccggtggcggcggcgggggagcgcgggacaggaggcttcggggaagatggacccggcgccctcgctgggctgcagcctcaaggatgtgaagtggagctcggtggccgtgccgctcgacctcctggtcagcacttaccggctgccccagatcgcgcgcctggacaacggagagtgcgtagaagggctgcgggaaaatgactatctgctgattcattcctgccgccagtggaccaccatcactgcccacagcttggaggagggtcactatgtcattgggccaaagatagagattccggtacattatgcagggcaattcaagctgctggaacaagaccgagatataaaggagccagtgcaatatttcaacagtgtggaggaggtggctaaggcatttcctgaacgcgtgtacgtcatggaggatatcacattcaacgtgaaggttgcttcaggtgaatgcaatgaagacactgaagtttacaacatcaccctgtgtactggggatgaactcactctaatggggcaggcagaaatcctttatgcaaagacattcaaggaaaagtcacgactcaacacaatcttcaaaaagattgggaagctcaattccatcagcaagctgggaaaaggcaaaatgccgtgcctcatttgtatgaatcaccggaccaacgaaagcattagccttccattccagtgcaagggcagatttagcacccgaagtcccctggaacttcagatgcaagagggcgaacacaccatccgcaacattgtggagaaaaccaggcttcctgtgaatgtgactgtgccaagccctccaccgagaaacccatacgacctccacttcatccgtgaggggcaccgctataagtttgtgaacatccagaccaagacggtggtggtttgctgtgtgctgcggaacaacaagatcctccccatgcactttcctttgcacttgactgtccccaagttcagcctcccagaacacctggtgaagggagagagctggcccgaaaccctggtccatcactggctaggtatctgccaagaacagttcgacatcgatgagtattcacgggctgtccgtgatgtgaaaaccgactggaatgaagaatgcaagagccccaagaagggtcggtgctctggccacaaccacgtgcccaattcgctcagctacgcccgcgatgagctcacccagtccttccaccgactctcggtctgtgtgtatggcaacaatctccatggcaacagtgaggtgaaccttcatggttgcagggacctggggggagattgggctccctttcctcatgacatcctgccctatcaggactctggagatagtgggagcgactaccttttcccagaagctagtgaagaatcagcaggcatcccgggaaagtcagaacttccctacgaagagctgtggctggaggaaggcaagcccagccatcagcctctcactcgctctctgagcgagaagaacagatgtgatcagtttagaggttctgtccgatccaaatgtgcgacttctcctcttcccatccctgggactctgggagcagcagtgaagtcttcagatactgccctacctccacctccagtgcctcccaaatctgaagccagacagggttttatcacattgcccagactggtctcaaagtcctgagctcaagccatccgctcgcctcggcctcccaaagtgctgagattacaggtattttcacctacagcaatctacctgactagatctacttgtctgccatctacagagcaagtaactgaggcctcaatagacaggttgtgctactgcgcaggaatgagttcccggttcatctttcattacttcactcttctccagactgtgctatattacctcacactatgcatctccctttttataatgagagttactgcaattttaaatatctcattttgcttcacagtcatcaatcctttgttgacaaaaatctaccttactgataatgccccaaccaaatataaatcaactactttctcttgcatacatgaagtgaaataaatagaacagcatgttttattctaagcagaa

SEQ ID NO: 278132 - DNA, 2188 bp, Homo sapiens
  misc_feature (2135)..(2135): n is a, c, g, or t
  misc_feature (2138)..(2139): n is a, c, g, or t
gcgggtggtgccggtggcggcggcgggggagcgcgggacaggaggcttcggggaagatggacccggcgccctcgctgggctgcagcctcaaggatgtgaagtggagctcggtggccgtgccgctcgacctcctggtcagcacttaccggctgccccagatcgcgcgcctggacaacggagagtgcgtagaagggctgcgggaaaatgactatctgctgattcattcctgccgccagtggaccaccatcactgcccacagcttggaggagggtcactatgtcattgggccaaagatagagattccggtacattatgcagggcaattcaagctgctggaacaagaccgagatataaaggagccagtgcaatatttcaacagtgtggaggaggtggctaaggcatttcctgaacgcgtgtacgtcatggaggatatcacattcaacgtgaaggttgcttcaggtgaatgcaatgaagacactgaagtttacaacatcaccctgtgtactggggatgaactcactctaatggggcaggcagaaatcctttatgcaaagacattcaaggaaaagtcacgactcaacacaatcttcaaaaagattgggaagctcaattccatcagcaagctgggaaaaggcaaaatgccgtgcctcatttgtatgaatcaccggaccaacgaaagcattagccttccattccagtgcaagggcagatttagcacccgaagtcccctggaacttcagatgcaagagggcgaacacaccatccgcaacattgtggagaaaaccaggcttcctgtgaatgtgactgtgccaagccctccaccgagaaacccatacgacctccacttcatccgtgaggggcaccgctataagtttgtgaacatccagaccaagacggtggtggtttgctgtgtgctgcggaacaacaagatcctccccatgcactttcctttgcacttgactgtccccaagttcagcctcccagaacacctggtgaagggagagagctggcccgaaaccctggtccatcactggctaggtatctgccaagaacagttcgacatcgatgagtattcacgggctgtccgtgatgtgaaaaccgactggaatgaagaatgcaagagccccaagaagggtcggtgctctggccacaaccacgtgcccaattcgctcagctacgcccgcgatgagctcacccagtccttccaccgactctcggtctgtgtgtatggcaacaatctccatggcaacagtgaggtgaaccttcatggttgcagggacctggggggagattgggctccctttcctcatgacatcctgccctatcaggactctggagatagtgggagcgactaccttttcccagaagctagtgaagaatcagcaggcatcccgggaaagtcagaacttccctacgaagagctgtggctggaggaaggcaagcccagccatcagcctctcactcgctctctgagcgagaagaacagatgtgatcagtttagaggttctgtccgatccaaatgtgcgacttctcctcttcccatccctgggactctgggagcagcagtgaagtcttcagatactgccctacctccacctccagtgcctcccaaatctgaagccgtcagagaagaatgccggctcctgaacgccccacctgttccaccccgaagcgcaaagcctttgtccaccagtccctccatccctcctcgcacagtcaagccagcgcggcaacagactcgctctcccagccccaccttgtcctactattcttcagggctacacaacataatggaagagccaatgtcttgggaagaaaagatgccacaccagtctgagaaattcagaggtaaaggccaactagattctcctggaaacaacccgggggctgccatcagttctcacaagtcagcatctggttctttccactttgacacgagcagacagcaccttcaagcagacaacaccttcgaccaggactaaaatggaaagggtcccattggtatctacactgaatttccatccagacaggagtccccttttgaccatcactgttgagtggtcatttccttttgtctggatacttccagggctctgagatcattcttctggaacacagtcattccattgttgcgnggnncttaaatgggacaaatcttttgaaagcactctgtgtccgggatccacgc

SEQ ID NO: 278133 - DNA, 2205 bp, Homo sapiens
tggcgcgcggcggcggcgacccctacagcgatctcagcaagggcgtgctgcgctgccggaccgtggaggacgtgctcacgcccctcgaagactgcttcatgctggacgccagcaccgtgctggacttcggcgtcctggccagcataatggaaagcggctatactcgcatcccggtgttcgaagacgagcagtccaatattgtagatattctctacgtcaaagacttggcctttgtggaccccgatgactgcacccccctcaagactatcactcgcttctataaccacccggtgcactttgtcttccatgacaccaagttggatgccatgctggaggagttcaagaaggggaagtcccacctggccatcgtgcagaaggtaaacaacgagggtgagggtgaccccttctacgaggtcctgggcctggtcaccctggaggacgtgatcgaggagatcatcaagtcggagatcctggacgagtccgacatgtacaccgagacaccgtggtgaagaggaagcctgcttctctgatggcccctctgaagcggaaggaggagttctccttgttcaaggtgtctgatgatgaatataaagtaacaatctcgcctcagctgctcttggccacccagcgcttcctgtcccgagaagtggatgtattcagcccgctgcgcatctctgagaaggtcctgctgcacctgttgaagcatcccagtgtcaaccaggaagtgaggtttgacgagagcaaccggctggccacacaccactacctgtaccagcgcagccagccggtggattacttcattctcatcctgcagggcagggttgaagtggagatcgggaaagagggtctgaagtttgagaatggggccttcacgtactatggagtgtcggccctaactgtgccatcctcggttcaccagtccccggtgtcctcgctccagcccatccgccatgacctgcagcccgacccaggtgacggcacgcattcatctgcgtattgtcccgactacaccgtgagggcgctctctgatctgcagctcatcaaggttacgcgactgcagtacctcaatgcactcctggctacccgagcccagaacctgccacagtcccctgagaacaccgacctgcaggttattccaggcagcagaccaggctccttggtgagaagaccaccacagcggcagggtccagccacagcaggcccggcgtcccggtggaaggcagccctgggcggaacccaggcgtttaacggctcactaggcagccccagatctggggaacagatgagcacgtggggagctggagtgagctgagcagaagttttgtgcccgcctgcccccatcccctccaggccacgttttagatggcccttgtagttgcgggtcctgggtgtcctcagaactagacatcaatgcctggatccttcagccggccctgccctcctttaggagacaggagtcaccagggcacagccctccaggcccgcctcaggaaggaatgaaaggaatgccatcatctctagttcccagggcccagccttccccttctcccccggggcagggacagtgcggcatattcagattcagacctctttgggctgagccaccttgtgagtgcagttactgcctttgtgtggccgtgacctctatttgtttgcttttaatttgccaacctatcgctgctggcagcactttttgagcaagccgagagcacccattttggctgggggttcagatcgatggccttgtccatgttgtcctttctggcttccctgatggtgtcatgtttcagcgcatgcgccccagcctttcccatgtgccaaaccagaagctccactgcccgtaggctgtccctgtagccctgctccctccctggaggctgctcttctgattctgagagctggcctagtggtgctgagggcccctttctgcttctctgcccacctgctgagttgccactcgcagtgttgtcagttcccgtgttctgagaagaggtcatgcctgggaggaagggatcgtcatgctgcatcgaatcctctctccgccgtgtggcccccaggagagtagctgcctgttgcacctgctccacacctccccacagcctccctgcaggtgctgtgtggccgtgatgtgcagagagcagtgagggagggttcatgaaccaggtggatcctctttaaaaaaaaaaaagtttttgttatatctct

SEQ ID NO: 278134 - DNA, 3545 bp, Homo sapiens
tgaccgagttccaacatgccagaggctgttcacattggagacctgctgcggctactcaagtacccagatgtcattcaggaactcaagtttgacgagcactataagtactacgcccgccattacctgtacacccgaaataagccggccgactacttcatcctcatcctgcaggggaaggtggaggtggaggcagggaaggagaacatgaagtttgagacgggcgccttctcctactatgggactatggccctgacctcggtcccctccgggaagtcccacctggccatcgtgcagaaggtaaacaacgagggtgagggtgaccccttctacgaggtcctgggcctggtcaccctggaggacgtgatcgaggagatcatcaagtcggagatcctggacgagtccgacatgtacactgacaaccgaagccggaagcgggtgtctgagaagaacaagcgtgacttctctgccttcaaggatgcggacaatgagctcaaagtgaaaatctccccgcagctcctcctggccgctcatcgcttcctagccacagaggtctctcagtttagcccctccctgatatcagagaagatcctgctgcggctactcaagtacccagatgtcattcaggaactcaagtttgacgagcacaataagtactacgcccgccattacctgtacacccgaaataagccggccgactacttcatcctcatcctgcaggggaaggtggaggtggaggcagggaaggagaacatgaagtttgagacgggcgccttctcctactatgggactatggccctgacctcggtcccctccgaccgttccccagcacaccccaccccactcagccgctcagcctccctcagttacccagaccgcacagacgtctcaactgcagcaaccttggcaggcagcagcaaccagtttggcagctctgtcctgggccagtacatctctgacttcagcgtccgggcactcgtggacttgcagtacatcaagatcactcggcagcagtaccagaacgggctgctggcttctcgcatggagaacagccctcagtttcccatagacgggtgcaccacccacatggagaacttggccgagaagtctgagctgcctgtggtggacgagaccacaactcttctcaacgagcgtaactccttgctgcacaaagcctcccacgagaatgccatctgacaggagggcccggggccccctgcccaccctgcgggggcctccccagtgggcccacatgaagagagggaacctgttagtccagaaaggatacggatagatagcctgtctgactgaacagccagatggcccccagcctatgggggatctggcctctgccagggacctctgagtagctctgaggtggcactgtccagccctggatagggggggcagtgggccagctaccgtaagcaaaggctgttttttactgagagaatttctaaagtaggctcatcacttttttttaaatatcattttgggaagggaagacagggttaaggaactttatttaaaaaaaaaatatttttttcctaaaaactataaaagaggaagggtttcttgtcccgggaagcaacggacataatctgttcccagccatggccttccagcttgtgtccctgattcagggagctctcccttcctcctcctcctcctcctccggaggtgggatcccagagcctgccagtggaggcttatctgttgggaggaagacagctcttcacagaagcaaagaacaaaatggcatggagatcagctgcctgagcacctgcgctgtagcttatctgacaacgctgaggccacgagctcctgggtagctgtgatcagggacatgataatctgagctatgcagaggagcacatctgttgtcaactgctgtacccagaaatctagaactctgccgacagcctctcctggtgagtcgggactcagctgaggacacatccccaccctgcctcccatctggccctttggacaactggccctttgtgacagggctgactcaagtgttaggcagggtctcaggcctttgattgctcacccctgctccccaggccctgccctcacttttaccaaaggttctccctcggcgggagggcatctgtgttggaggtgatttgtctgggttcttccttttggttccagaaggaactgtcagtcatcagcatctgcgttgttagcagtcagtaccacccccgccccacaatgacagtcaaggctgacttgttgactgaagcctttttcccagaccccttatttcgaatccccaagcttcagtccctcttgggggtggagacaagaggacatgtgggaagccacggaagcaggttctttatgtcctctcctctgtggctggcaaggctcacctggccttatccacccacttatggaacctcaggagaggagggctcctcctaaaggcatgcagcttgcagcccctctttctcacacgtgtgatcctagcgtgagaggtcatcctgcccttgctgaagttagtagtactgtactaagagctctgccctcatgtgaattcctgccctggcgcctcttccctggggctgaatcaggccctgctgcaaaactccaggcttcccagggttggggaggctgtgggaccaaggtccatgttggtccttccactgggtgcagcaggagctgggtcccgagagcctggcaggtgaaactctgcaggccttccgcctgattattatttattcactcctttcctcaccccaagtgccctgctctccaggtgcctagagtatcctaactcttaggaccagggattgtcttgcaccaagtatgcctacccctggccagtctgaggtctcctagccatagaactgactcctggaagcctggagagaaggtggtgacacccatgggttctcaactgtaaggaaaaaagacaccagacttttgttccctagtgggggaaagcccttagtcttgtacaggagcagcttgctcccaagtccttttggaagctggcagagctatattcctgacagccctgactgccaggtagagcaaaagacattggtgggggtatgtgaagcaaaaggggcaggtgcacacacctccacagtgacctctgtgcacacggttaccaccaactggctggccctcctcctcttccctggcccattgatcatcccttctcacagagggtcatcattatttccaaatattgtttgtctgatgacttcctcttcccagtgcaatttttcccttcctatttcaacctctggttcctgggatgagccataccctggaactggcccacccactgtgtcttccacgtaagggagacctttgcaaagggcatccaaatgggtaggcaggtgacagccgccgtatttattttgcataatattttaatttgtatatttttgtgatttattttggcgttatgagtttgactctcggggagttttgttgttatgactcttgtgtcttttgtcacaaaacaatgatatttgctaaacgatatatggaatttatttttgattggtaataaaaaatcaaatatg

SEQ ID NO: 278135 - DNA, 4938 bp, Homo sapiens
  misc_feature (124)..(124): n is a, c, g, or t
catgaggctggcgagctgcaacaagtcgtgtgggacgaacccggatggcatcatcttcgtgtccgagggcagcaccgtgaacctgaggctgtacggctacagcctgggcaacatctccagcaanctgatctccttcaccgaggtggacgatgccgagaccctccacaagtccaccagcttgcctcgagctcaccaaggacctggtcgtccagcagctggtcaacgtgagccgcgggaacacgtccggcgtgctggtggtgctcaccaagttcctccggaggagcgagagcatgaagctgtatgcactgtgcacccgggcccagcccgacgggccctggctgaagtggacggacaaggactcactgctcttcatggtggaggagcctgggaggttcctgcctctctggctgcacattctcctaattacggtgctgctggtgctgtcgggcatattttctggcctcaacctcgggcttatggccctggaccccatggagctgcgcatcgtgcagaactgtggcaccgagaaggagaggcgctatgcccgcaagattgagcccatccggcgcaagggcaactaccttctctgctcgttgctcctagggaacgtgctggtcaacacctccctcacaatccttctagacaacctcatcgggtccggcctcatggcggtggcctcctccaccattggcattgtcatctttggggagatcctacctcaggccctgtgctcccgacatgggctggctgtgggtgccaacaccatccttctcaccaaattctttatgctactcaccttccccctcagttttcccattagcaagctcctggacttttttctgggccaggagattcgcactgtttacaaccgggagaagctgatggagatgttgaaggtgacggagccctataatgacctcgtgaaagaggagctcaatatgatccagggtgccctggaactacggaccaaaactgtagaggatatcatgacccagctccaggactgcttcatgatccgcagcgatgccatcctggacttcaacaccatgtcggagataatggaaagcggctatactcgcatcccggtgttcgaagacgagcagtccaatattgtagatattctctacgtcaaagacttggcctttgtggaccccgatgactgcacccccctcaagactatcactcgcttctataaccacccggtgcactttgtcttccatgacaccaagttggatgccatgctggaggagttcaagaaggggaagtcccacctggccatcgtgcagaaggtaaacaacgagggtgagggtgaccccttctacgaggtcctgggcctggtcaccctggaggacgtgatcgaggagatcatcaagtcggagatcctggacgagtccgacatgtacactgacaaccgaagccggaagcgggtgtctgagaagaacaagcgtgacttctctgccttcaaggatgcggacaatgagctcaaagtgaaaatctccccgcagctcctcctggccgctcatcgcttcctagccacagaggtctctcagtttagcccctccctgatatcagagaagatcctgctgcggctactcaagtacccagatgtcattcaggaactcaagtttgacgagcacaataagtactacgcccgccattacctgtacacccgaaataagccggccgactacttcatcctcatcctgcaggggaaggtggaggtggaggcagggaaggagaacatgaagtttgagacgggcgccttctcctactatgggactatggccctgacctcggtcccctccgaccgttccccagcacaccccaccccactcagccgctcagcctccctcagttacccagaccgcacagacgtctcaactgcagcaaccttggcaggcagcagcaaccagtttggcagctctgtcctgggccagtacatctctgacttcagcgtccgggcactcgtggacttgcagtacatcaagatcactcggcagcagtaccagaacgggctgctggcttctcgcatggagaacagccctcagtttcccatagacgggtgcaccacccacatggagaacttggccgagaagtctgagctgcctgtggtggacgagaccacaactcttctcaacgagcgtaactccttgctgcacaaagcctcccacgagaatgccatctgacaggagggcccggggccccctgcccaccctgcgggggcctccccagtgggcccacatgaagagagggaacctgttagtccagaaaggatacggatagatagcctgtctgactgaacagccagatggcccccagcctatgggggatctggcctctgccagggacctctgagtagctctgaggtggcactgtccagccctggatagggggggcagtgggccagctaccgtaagcaaaggctgttttttactgagagaatttctaaagtaggctcatcacttttttttaaatatcattttgggaagggaagacagggttaaggaactttatttaaaaaaaaaatatttttttcctaaaaactataaaagaggaagggtttcttgtcccgggaagcaacggacataatctgttcccagccatggccttccagcttgtgtccctgattcagggagctctcccttcctcctcctcctcctcctccggaggtgggatcccagagcctgccagtggaggcttatctgttgggaggaagacagctcttcacagaagcaaagaacaaaatggcatggagatcagctgcctgagcacctgcgctgtagcttatctgacaacgctgaggccacgagctcctgggtagctgtgatcagggacatgataatctgagctatgcagaggagcacatctgttgtcaactgctgtacccagaaatctagaactctgccgacagcctctcctggtgagtcgggactcagctgaggacacatccccaccctgcctcccatctggccctttggacaactggccctttgtgacagggctgactcaagtgttaggcagggtctcaggcctttgattgctcacccctgctccccaggccctgccctcacttttaccaaaggttctccctcggcgggagggcatctgtgttggaggtgatttgtctgggttcttccttttggttccagaaggaactgtcagtcatcagcatctgcgttgttagcagtcagtaccacccccgccccacaatgacagtcaaggctgacttgttgactgaagcctttttcccagaccccttatttcgaatccccaagcttcagtccctcttgggggtggagacaagaggacatgtgggaagccacggaagcaggttctttatgtcctctcctctgtggctggcaaggctcacctggccttatccacccacttatggaacctcaggagaggagggctcctcctaaaggcatgcagcttgcagcccctctttctcacacgtgtgatcctagcgtgagaggtcatcctgcccttgctgaagttagtagtactgtactaagagctctgccctcatgtgaattcctgccctggcgcctcttccctggggctgaatcaggccctgctgcaaaactccaggcttcccagggttggggaggctgtgggaccaaggtccatgttggtccttccactgggtgcagcaggagctgggtcccgagagcctggcaggtgaaactctgcaggccttccgcctgattattatttattcactcctttcctcaccccaagtgccctgctctccaggtgcctagagtatcctaactcttaggaccagggattgtcttgcaccaagtatgcctacccctggccagtctgaggtctcctagccatagaactgactcctggaagcctggagagaaggtggtgacacccatgggttctcaactgtaaggaaaaaagacaccagacttttgttccctagtgggggaaagcccttagtcttgtacaggagcagcttgctcccaagtccttttggaagctggcagagctatattcctgacagccctgactgccaggtagagcaaaagacattggtgggggtatgtgaagcaaaaggggcaggtgcacacacctccacagtgacctctgtgcacacggttaccaccaactggctggccctcctcctcttccctggcccattgatcatcccttctcacagagggtcatcattatttccaaatattgtttgtctgatgacttcctcttcccagtgcaatttttcccttcctatttcaacctctggttcctgggatgagccataccctggaactggcccacccactgtgtcttccacgtaagggagacctttgcaaagggcatccaaatgggtaggcaggtgacagccgccgtatttattttgcataatattttaatttgtatatttttgtgatttattttggcgttatgagtttgactctcggggagttttgttgttatgactcttgtgtcttttgtcacaaaacaatgatatttgctaaacgatatatggaatttatttttgattggtaataaaaaatcaaatatgtataaatcctggtgaatctacaacttgcctgtttgttctgtcagtattcagtatgttgttgagataaaagtggctgtggctggctgtctcttgtgatgggacaagggcaataaaggattctaggaccattcagcagtgaaatgcaatcagaaatggaatttctaaatatagtcaaggctgtcgtcacaggagtgagagggacgtggctgctggcagacatacaggacagatgtgctcagctgccataagcatgagtcctgtgaaacagatcccatagggcccttggcttgtgagtactggaagggcagtgggcttcagcaaattgcccctcctccctacccatgggactgaaagaagcttgatccaaaagtatgagtaatattgttttataacatgcagct

SEQ ID NO: 278136 - DNA, 4537 bp, Homo sapiens
  misc_feature (124)..(124): n is a, c, g, or t
catgaggctggcgagctgcaacaagtcgtgtgggacgaacccggatggcatcatcttcgtgtccgagggcagcaccgtgaacctgaggctgtacggctacagcctgggcaacatctccagcaanctgatctccttcaccgaggtggacgatgccgagaccctccacaagtccaccagcttgcctcgagctcaccaaggacctggtcgtccagcagctggtcaacgtgagccgcgggaacacgtccggcgtgctggtggtgctcaccaagttcctccggaggagcgagagcatgaagctgtatgcactgtgcacccgggcccagcccgacgggccctggctgaagtggacggacaaggactcactgctcttcatggtggaggagcctgggaggttcctgcctctctggctgcacattctcctaattacggtgctgctggtgctgtcgggcatattttctggcctcaacctcgggcttatggccctggaccccatggagctgcgcatcgtgcagaactgtggcaccgagaaggagaggcgctatgcccgcaagattgagcccatccggcgcaagggcaactaccttctctgctcgttgctcctagggaacgtgctggtcaacacctccctcacaatccttctagacaacctcatcgggtccggcctcatggcggtggcctcctccaccattggcattgtcatctttggggagatcctacctcaggccctgtgctcccgacatgggctggctgtgggtgccaacaccatccttctcaccaaattctttatgctactcaccttccccctcagttttcccattagcaagctcctggacttttttctgggccaggagattcgcactgtttacaaccgggagaagctgatggagatgttgaaggtgacggagccctataatgacctcgtgaaagaggagctcaatatgatccagggtgccctggaactacggaccaaaactgtagaggatatcatgacccagctccaggactgcttcatgatccgcagcgatgccatcctggacttcaacaccatgtcggagataatggaaagcggctatactcgcatcccggtgttcgaagacgagcagtccaatattgtagatattctctacgtcaaagacttggcctttgtggaccccgatgactgcacccccctcaagactatcactcgcttctataaccacccggtgcactttgtcttccatgacaccaagttggatgccatgctggaggagttcaagaaggggaagtcccacctggccatcgtgcagaaggtaaacaacgagggtgagggtgaccccttctacgaggtcctgggcctggtcaccctggaggacgtgatcgaggagatcatcaagtcggagatcctggacgagtccgacatgtacactgacaaccgaagccggaagcgggtgtctgagaagaacaagcgtgacttctctgccttcaaggatgcggacaatgagctcaaagtgaaaatctccccgcagctcctcctggccgctcatcgcttcctagccacagaggtctctcagtttagcccctccctgatatcagagaagatcctgctgcggctactcaagtacccagatgtcattcaggaactcaagtttgacgagcacaataagtactacgcccgccattacctgtacacccgaaataagccggccgactacttcatcctcatcctgcaggggaaggtggaggtggaggcagggaaggagaacatgaagtttgagacgggcgccttctcctactatgggactatggccctgacctcggtcccctccgaccgttccccagcacaccccaccccactcagccgctcagcctccctcagttacccagaccgcacagacgtctcaactgcagcaaccttggcaggcagcagcaaccagtttggcagctctgtcctgggccagtacatctctgacttcagcgtccgggcactcgtggacttgcagtacatcaagatcactcggcagcagtaccagaacgggctgctggcttctcgcatggagaacagccctcagtttcccatagacgggtgcaccacccacatggagaacttggccgagaagtctgagctgcctgtggtggacgagaccacaactcttctcaacgagcgtaactccttgctgcacaaagcctcccacgagaatgccatctgacaggagggcccggggccccctgcccaccctgcgggggcctccccagtgggcccacatgaagagagggaacctgttagtccagaaaggatacggatagatagcctgtctgactgaacagccagatggcccccagcctatgggggatctggcctctgccagggacctctgagtagctctgaggtggcactgtccagccctggatagggggggcagtgggccagctaccgtaagcaaaggctgttttttactgagagaatttctaaagtaggctcatcacttttttttaaatatcattttgggaagggaagacagggttaaggaactttatttaaaaaaaaaatatttttttcctaaaaactataaaagaggaagggtttcttgtcccgggaagcaacggacataatctgttcccagccatggccttccagcttgtgtccctgattcagggagctctcccttcctcctcctcctcctcctccggaggtgggatcccagagcctgccagtggaggcttatctgttgggaggaagacagctcttcacagaagcaaagaacaaaatggcatggagatcagctgcctgagcacctgcgctgtagcttatctgacaacgctgaggccacgagctcctgggtagctgtgatcagggacatgataatctgagctatgcagaggagcacatctgttgtcaactgctgtacccagaaatctagaactctgccgacagcctctcctggtgagtcgggactcagctgaggacacatccccaccctgcctcccatctggccctttggacaactggccctttgtgacagggctgactcaagtgttaggcagggtctcaggcctttgattgctcacccctgctccccaggccctgccctcacttttaccaaaggttctccctcggcgggagggcatctgtgttggaggtgatttgtctgggttcttccttttggttccagaaggaactgtcagtcatcagcatctgcgttgttagcagtcagtaccacccccgccccacaatgacagtcaaggctgacttgttgactgaagcctttttcccagaccccttatttcgaatccccaagcttcagtccctcttgggggtggagacaagaggacatgtgggaagccacggaagcaggttctttatgtcctctcctctgtggctggcaaggctcacctggccttatccacccacttatggaacctcaggagaggagggctcctcctaaaggcatgcagcttgcagcccctctttctcacacgtgtgatcctagcgtgagaggtcatcctgcccttgctgaagttagtagtactgtactaagagctctgccctcatgtgaattcctgccctggcgcctcttccctggggctgaatcaggccctgctgcaaaactccaggcttcccagggttggggaggctgtgggaccaaggtccatgttggtccttccactgggtgcagcaggagctgggtcccgagagcctggcaggtgaaactctgcaggccttccgcctgattattatttattcactcctttcctcaccccaagtgccctgctctccaggtgcctagagtatcctaactcttaggaccagggattgtcttgcaccaagtatgcctacccctggccagtctgaggtctcctagccatagaactgactcctggaagcctggagagaaggtggtgacacccatgggttctcaactgtaaggaaaaaagacaccagacttttgttccctagtgggggaaagcccttagtcttgtacaggagcagcttgctcccaagtccttttggaagctggcagagctatattcctgacagccctgactgccaggtagagcaaaagacattggtgggggtatgtgaagcaaaaggggcaggtgcacacacctccacagtgacctctgtgcacacggttaccaccaactggctggccctcctcctcttccctggcccattgatcatcccttctcacagagggtcatcattatttccaaatattgtttgtctgatgacttcctcttcccagtgcaatttttcccttcctatttcaacctctggttcctgggatgagccataccctggaactggcccacccactgtgtcttccacgtaagggagacctttgcaaagggcatccaaatgggtaggcaggtgacagccgccgtatttattttgcataatattttaatttgtatatttttgtgatttattttggcgttatgagtttgactctcggggagttttgttgttatgactcttgtgtcttttgtcacaaaacaatgatatttgctaaacgatatatggaatttatttttgattggtaataaaaaatcaaatatg

SEQ ID NO: 278137 - DNA, 595 bp, Homo sapiens
ttttaagtctgtggtttttattttctgtttggttgatttgttttggtagactttttaatacttgttgcacaatagttctaaacaaactaattcatttgctttaacgaagtcagaccttatgcagtcagaccttctacatgcttctgtttgtccctaagaatgacttcctgttcctgggtggggtgtccctgggcttccatgggatgaggtgagacatgagggtgagagtgggcatcggagtggcctttggcatgacaacctctgctctccctgcagaccgttccccagcacaccccaccccactcagccgctcagcctccctcagttacccagaccgcacagacgtctcaactgcagcaaccttggcaggcagcagcaaccagtttggcagctctgtcctgggccagtacatctctgacttcagcgtccgggcactcgtggacttgcagtacatcaaggtgagtgcctcactgccctgtctgggcagtgctatcttctgctcaggaatcagctactactttcatccaccaaacccagcatggtgggcccaaacccgagatgcctttttcttctggagatggggtcttgctctgtc

SEQ ID NO: 278138 - DNA, 2582 bp, Homo sapiens
gctccaggagccggctgagcgcgccccgcggggggctccgcagcccttacaaggaatttggtggcgcttggggtggccccgcccgccaggctccaccggcccctcctccccgcggggtggcagcccgctggacgcggggccgagggcgcggacgccgacgggtccggggccgcgcgctccagggaagcctgcatcccgctcccctgggccccgacgggcgggcgcactgcgcggggcccaccggccgcagacctgcgtggccgtccagggcgtcgccatgtcctcggtgtttggaaaaccccgcgcgggcagcgggcctcagagcgcgcccctcgaggtcaacctggccatcctggggcgccgcggggctggcaagtctgaggacacctacagctccgaggagactgtggaccaccagcctgtccacctgagggtcatggacactgcagacctggacacccccaggaactgcgagcgctacctgaactgggcccatgccttcctggtggtgtacagcgtcgacagccgccagagctttgatagcagcagcagctacctggagctgcttgccttgcacgcgaaggagacacagcgcagcatccctgccctgctgctgggcaacaagctggacatggctcagtacaggcaagtcaccaaggcagagggtgtggctttggcaggcaggtttgggtgcctgtttttcgaggtctctgcctgtctggactttgagcacgtgcagcatgtcttccacgaggcagtgcgagaggcacggcgggagctggagaagagccccctgacccggcccctcttcatctccgaggagagggccctgccccaccaggccccgctcactgcgcggcatgggctggccagctgcaccttcaacacgctctccaccatcaacctgaaggagatgcccactgtggcccaggccaagctggtcaccgtgaagtcatcccgggcccagagcaagcgcaaggcgcctaccctgactctcctgaagggcttcaagatcttctgaggccccctccccaggaagcctaggctcggtggctggacaggactgcagcaggacagggactggcttctcaccaccagcctttccgtctgatggacagcagaccccgcctccagcaccaagcagtgtccctacactcaattcactgtgtgagctggagtggcaggcagggatgctgcttctgttccctccaggccttggtcttcatggtaaccaccgcgtctgtggccgtagagggaaacagccactgtgacaacccagagacctggggtcagccttaagtaggaagaaattgcagtgtctatcctgctgccatcagcccttcctgctccagctacagttgggccagctgtggccttagtggatggtctgggtggatggctctgtcaatgtcaggcccgagaacagcctgcggaatgacagcctggggtccttgtgccacctggtggacgggaaaggcagggcggctgcagtttcagaggccagagcctggccctcctgtcatctgctgacttcacagaaggcccaggctacaaaccccacagtttatccaaggaaaatctagttaaaataatccaatggacagaagccccaggaaggggtatttccaacacttggcgtctcaatgaggataaaagggagggactgtaggttgtccagcataaggagccccagagttctttcaccagcagacagattctccatgtgttttcccactgttaaggactctgtccaaagaacctcagcatcagctccctcaagcttaatgatccaggctgcagaagaaagttgtcactccagtgagttacccagggctccagggagcccacagcagcatcagacccatccaggggctacagggcctgcccccctgcaggtagaaacacagtatacccgtttgtcatctggtttggcaggacccaggaccctcagcaatgagtctgagtgttcaaagcccactttagaacctaaagcattttgggttaataaagcaaaattttgcttatgttatttggtggtgtcaccgcagcttataccaagacaccatggctcagacatgggatcaggacacacctttgagatcccactgttagcaagaaaaggctgtccaaggcaggcagtgtggtagttgtctgattttgtttaccacacgccaggtcccagggaagtcttgcacagactcttagcagacaagcagggaaaagagagggtcctggtgggtggaaggattgggaaggggattctgggcctggaagcctgctccttcccctctcagcagtctcaggactactgttggattgcaaacagcatctctgacccagtcttcggactcattctgtaaatggaggagctgaggtcagaggggggctgtgaactactcaagaccacatgcttgcagtcctacaggcttcccgacccacaggccagctacggattttgcacttttgctccaggccacttgtgtgtgtatgtgtgtgtgtaccactgccatctgaacaaactatgcaataccacctgctcccttccaggagcattttaataaaagattttttttaataacaga

SEQ ID NO: 278139 - DNA, 2690 bp, Homo sapiens
gctccaggagccggctgagcgcgccccgcggggggctccgcagcccttacaaggaatttggtggcgcttggggtggccccgcccgccaggctccaccggcccctcctccccgcggggtggcagcccgctggacgcggggccgagggcgcggacgccgacgggtccggggccgcgcgctccagggaagcctgcatcccgctcccctgggccccgacgggcgggcgcactgcgcggggcccaccggccgcagacctgcgtggccgtccagggcgtcgccatgtcctcggtgtttggaaaaccccgcgcgggcagcgggcctcagagcgcgcccctcgaggtcaacctggccatcctggggcgccgcggggctggcaagtctgccctgaccgtgaagtttctgaccaagaggtttatcagtgaatatgaccccaacttggaggacacctacagctccgaggagactgtggaccaccagcctgtccacctgagggtcatggacactgcagacctggacacccccaggaactgcgagcgctacctgaactgggcccatgccttcctggtggtgtacagcgtcgacagccgccagagctttgatagcagcagcagctacctggagctgcttgccttgcacgcgaaggagacacagcgcagcatccctgccctgctgctgggcaacaagctggacatggctcagtacaggcaagtcaccaaggcagagggtgtggctttggcaggcaggtttgggtgcctgtttttcgaggtctctgcctgtctggactttgagcacgtgcagcatgtcttccacgaggcagtgcgagaggcacggcgggagctggagaagagccccctgacccggcccctcttcatctccgaggagagggccctgccccaccaggccccgctcactgcgcggcatgggctggccagctgcaccttcaacacgctctccaccatcaacctgaaggagatgcccactgtggcccaggccaagctggtcaccgtgaagtcatcccgggcccagagcaagcgcaaggcgcctaccctgactctcctgaagggcttcaagatcttctgaggccccctccccaggaagcctaggctcggtggctggacaggactgcagcaggacagggactggcttctcaccaccagcctttccgtctgatggacagcagaccccgcctccagcaccaagcagtgtccctacactcaattcactgtgtgagctggagtggcaggcagggatgctgcttctgttccctccaggccttggtcttcatggtaaccaccgcgtctgtggccgtagagggaaacagccactgtgacaacccagagacctggggtcagccttaagtaggaagaaattgcagtgtctatcctgctgccatcagcccttcctgctccagctacagttgggccagctgtggccttagtggatggtctgggtggatggctctgtcaatgtcaggcccgagaacagcctgcggaatgacagcctggggtccttgtgccacctggtggacgggaaaggcagggcggctgcagtttcagaggccagagcctggccctcctgtcatctgctgacttcacagaaggcccaggctacaaaccccacagtttatccaaggaaaatctagttaaaataatccaatggacagaagccccaggaaggggtatttccaacacttggcgtctcaatgaggataaaagggagggactgtaggttgtccagcataaggagccccagagttctttcaccagcagacagattctccatgtgttttcccactgttaaggactctgtccaaagaacctcagcatcagctccctcaagcttaatgatccaggctgcagaagaaagttgtcactccagtgagttacccagggctccagggagcccacagcagcatcagacccatccaggggctacagggcctgcccccctgcaggtagaaacacagtatacccgtttgtcatctggtttggcaggacccaggaccctcagcaatgagtctgagtgttcaaagcccactttagaacctaaagcattttgggttaataaagcaaaattttgcttatgttatttggtggtgtcaccgcagcttataccaagacaccatggctcagacatgggatcaggacacacctttgagatcccactgttagcaagaaaaggctgtccaaggcaggcagtgtggtagttgtctgattttgtttaccacacgccaggtcccagggaagtcttgcacagactcttagcagacaagcagggaaaagagagggtcctggtgggtggaaggattgggaaggggattctgggcctggaagcctgctccttcccctctcagcagtctcaggactactgttggattgcaaacagcatctctgacccagtcttcggactcattctgtaaatggaggagctgaggtcagaggggggctgtgaactactcaagaccacatgcttgcagtcctacaggcttcccgacccacaggccagctacggattttgcacttttgctccaggccacttgtgtgtgtatgtgtgtgtgtaccactgccatctgaacaaactatgcaataccacctgctcccttccaggagcattttaataaaagattttttttaataacagaattttagtttgcttgcagttcattcattgtgtctgctaagaaaaaaaaaaa

SEQ ID NO: 278140 - DNA, 2639 bp, Homo sapiens
gctccaggagccggctgagcgcgccccgcggggggctccgcagcccttacaaggaatttggtggcgcttggggtggccccgcccgccaggctccaccggcccctcctccccgcggggtggcagcccgctggacgcggggccgagggcgcggacgccgacgggtccggggccgcgcgctccagggaagcctgcatcccgctcccctgggccccgacgggcgggcgcactgcgcggggcccaccggccgcagacctgcgtggccgtccagggcgtcgccatgtcctcggtgtttggaaaaccccgcgcgggcagcgggcctcagagcgcgcccctcgaggtcaacctggccatcctggggcgccgcggggctggcaagtctgccctgaccgtgaagtttctgaccaagaggtttatcagtgaatatgaccccaacttggaggacacctacagctccgaggagactgtggaccaccagcctgtccacctgagggtcatggacactgcagacctggacacccccaggaactgcgagcgctacctgaactgggcccatgccttcctggtggtgtacagcgtcgacagccgccagagctttgatagcagcagcagctacctggagctgcttgccttgcacgcgaaggagacacagcgcagcatccctgccctgctgctgggcaacaagctggacatggctcagtacaggcaagtcaccaaggcagagggtgtggctttggcaggcaggtttgggtgcctgtttttcgaggtctctgcctgtctggactttgagcacgtgcagcatgtcttccacgaggcagtgcgagaggcacggcgggagctggagaagagccccctgacccggcccctcttcatctccgaggagagggccctgccccaccaggccccgctcactgcgcggcatgggctggccagctgcaccttcaacacgctctccaccatcaacctgaaggagatgcccactgtggcccaggccaagctggtcaccgtgaagtcatcccgggcccagagcaagcgcaaggcgcctaccctgactctcctgaagggcttcaagatcttctgaggccccctccccaggaagcctaggctcggtggctggacaggactgcagcaggacagggactggcttctcaccaccagcctttccgtctgatggacagcagaccccgcctccagcaccaagcagtgtccctacactcaattcactgtgtgagctggagtggcaggcagggatgctgcttctgttccctccaggccttggtcttcatggtaaccaccgcgtctgtggccgtagagggaaacagccactgtgacaacccagagacctggggtcagccttaagtaggaagaaattgcagtgtctatcctgctgccatcagcccttcctgctccagctacagttgggccagctgtggccttagtggatggtctgggtggatggctctgtcaatgtcaggcccgagaacagcctgcggaatgacagcctggggtccttgtgccacctggtggacgggaaaggcagggcggctgcagtttcagaggccagagcctggccctcctgtcatctgctgacttcacagaaggcccaggctacaaaccccacagtttatccaaggaaaatctagttaaaataatccaatggacagaagccccaggaaggggtatttccaacacttggcgtctcaatgaggataaaagggagggactgtaggttgtccagcataaggagccccagagttctttcaccagcagacagattctccatgtgttttcccactgttaaggactctgtccaaagaacctcagcatcagctccctcaagcttaatgatccaggctgcagaagaaagttgtcactccagtgagttacccagggctccagggagcccacagcagcatcagacccatccaggggctacagggcctgcccccctgcaggtagaaacacagtatacccgtttgtcatctggtttggcaggacccaggaccctcagcaatgagtctgagtgttcaaagcccactttagaacctaaagcattttgggttaataaagcaaaattttgcttatgttatttggtggtgtcaccgcagcttataccaagacaccatggctcagacatgggatcaggacacacctttgagatcccactgttagcaagaaaaggctgtccaaggcaggcagtgtggtagttgtctgattttgtttaccacacgccaggtcccagggaagtcttgcacagactcttagcagacaagcagggaaaagagagggtcctggtgggtggaaggattgggaaggggattctgggcctggaagcctgctccttcccctctcagcagtctcaggactactgttggattgcaaacagcatctctgacccagtcttcggactcattctgtaaatggaggagctgaggtcagaggggggctgtgaactactcaagaccacatgcttgcagtcctacaggcttcccgacccacaggccagctacggattttgcacttttgctccaggccacttgtgtgtgtatgtgtgtgtgtaccactgccatctgaacaaactatgcaataccacctgctcccttccaggagcattttaataaaagattttttttaataacaga

SEQ ID NO: 278141 - DNA, 1527 bp, Homo sapiens
ccagactgcgcgtacggtggcactgacagatgctagcattcttgtccacttccgggccgttgatcgtcactggtgtgaaatcggtgtttgctgagacgtgccagggtgaagtaggaaatgtgagcaacatgaagagatgatgtactctgtgtgagtactggaagagcttggagcgactatccctggagccaatcgtgccttgcgtggtcctagcctgactacgttcgtgacccacgtctcgctgggcccatatagatggctcctcgtggagctttcatgggtcgtgggtcggatggtcgtgagcccagataagagccatggtgaaggacaagcactgagcggtctttgcttccgaaactggtgagaccgtccataggaaggtgagggatggaagctattccaggagcgccaggaacctgggccagcttggatctattctggtctgacgttgctctagcacagtgtgcactagagacgtagggaagacgcgcagcattgtataattccaagtgttagatactttacctcttaaaataatccaatggacagaagccccaggaaggggtatttccaacacttggcgtctcaatgaggataaaagggagggactgtaggttgtccagcataaggagccccagagttctttcaccagcagacagattctccatgtgttttcccactgttaaggactctgtccaaagaacctcagcatcagctccctcaagcttaatgatccaggctgcagaagaaagttgtcactccagtgagttacccagggctccagggagcccacagcagcatcagacccatccaggggctacagggcctgcccccctgcaggtagaaacacagtatacccgtttgtcatctggtttggcaggacccaggaccctcagcaatgagtctgagtgttcaaagcccactttagaacctaaagcattttgggttaataaagcaaaattttgcttatgttatttggtggtgtcaccgcagcttataccaagacaccatggctcagacatgggatcaggacacacctttgagatcccactgttagcaagaaaaggctgtccaaggcaggcagtgtggtagttgtctgattttgtttaccacacgccaggtcccagggaagtcttgcacagactcttagcagacaagcagggaaaagagagggtcctggtgggtggaaggattgggaaggggattctgggcctggaagcctgctccttcccctctcagcagtctcaggactactgttggattgcaaacagcatctctgacccagtcttcggactcattctgtaaatggaggagctgaggtcagaggggggctgtgaactactcaagaccacatgcttgcagtcctacaggcttcccgacccacaggccagctacggattttgcacttttgctccaggccacttgtgtgtgtatgtgtgtgtgtaccactgccatctgaacaaactatgcaataccacctgctcccttccaggagcattttaataaaagattttttttaataacaga

SEQ ID NO: 278142 - DNA, 394 bp, Homo sapiens
gaacccgacgttgtgcagcccttcagacaaacctggccgcacccaaaaagaacatgcatggatggaaaagcaaagcctgcaacctgaaacgagccaccccatccctcatcacttgtcttttcaaagttggcattcaacagttcttgcacaggtgtcgcctagacagtttctctgtatgaagtctgcactgaaggagtggggaagaccttgaggatcttctgatggagttcatctttctgcagccccggagactgtaattcagacaccgcccccaaaagaagtctggaaactttgagtctcgccacgtgcaggccagaggagtccaacaccattatcaccctctatgcacagactgctggctgccaaactaacatatctaaggcacgtgctcaag

SEQ ID NO: 278143 - DNA, 546 bp, Homo sapiens
agcgggggcggggcccggagggagtctgggagggcccgaaagtttgcccaagtcgctggggcggccggccggggtgcaagcagtcgggccgggctcccacgacccccgcgcggggcgggcccaggcaggaagtgggcgcacttactggccccctcgatcttgtcggcgccccggctccacgtgatctggcgcgtctccagcttgacctggaaggtcttccgctcgggtcgctgcgacttcttggagtagaacaaagtcatgacggtgcccacctcgaggctgcggcagagcaccgccaaaattgaggacacccacggtcgcggtggagcctgtctgacatgttgagccaggcagtgggtcggctgccaggcacagcaggacaacttactgcatttcagaggaatgatggtccacaatttactgatgaggaaacagagattcagagaagttctacaatttgccccaaagccacataacatgactaggtgggaactagaacccaagtcggcctgactccatgagttttctgcctcacaggagatccac

SEQ ID NO: 278144 - DNA, 343 bp, Homo sapiens
ttgtcccggcccctgaggcgcaggcctatcagcctcctgtgtcttaagcagagtggagacgggggtggatccaggcgcaccagttccacgccacaggcttctgcagttcctgcaaactgttcccatcccgccccgcgttgcacgtcgggatttggagttcgcgatgctgagagctgtttccacgtggcgattccgacttgacccgtcgtgctccggcgcccgcctagggggaccgaggagtttgtcatttcttgcctcgttagggtgcggaacgaaaaccatttgatttatcctagaaaaggaaaggctgaagccaactaagtaaaagttttccattaaatga

SEQ ID NO: 278145 - DNA, 363 bp, Homo sapiens
agcccacaggggtctgaggttgatcccggaggcgcgaggagtcgcctatcagcctcctgtgtcttaagcagagtggagacgggggtggatccaggcgcaccagttccacgccacaggcttctgcagttcctgcaaactgttcccatcccgccccgcgttgcacgtcgggatttggagttcgcgatgctgagagctgtttccacgtggcgattccgacttgacccgtcgtgctccggcgcccgcctagggggaccgaggagtttgtcatttcttgcctcgttagggtgcggaacgaaaaccatttgatttatcctagaaaaggaaaggctgaagccaactaagtaaaagttttccattaaatga

SEQ ID NO: 278146 - DNA, 954 bp, Homo sapiens
taccttttttttactgtacaaatgctttatttctattcaatatttagaagacagttataaacaagatgcattcaatagcatggtggcagatgaacatcaggaaggaacatccatgagcttccatccacggaacctcaccatggatacgcttgtgatcaagggcctggtctcccctcaagacacggtcacagatcagaggccacaccatcctagcagtggagcaggaccagctgggacagggtccttctgtgacacctgctgcatcaccaggctgggtgaacggacacaattgccagaactcacagaatagaagtatcagcaccgaaacctcacaggaaaaatgtaactgaaataaaatctggcctttgtgaaaccctggaaataccacaaccctcaactagaaacaccaataccagctcctccacgagtttccagctccacaacctaagacatcagaggcagcattggttcctcacgtagagtccagctccgggaccctcatatttgaactgcagggccatctcatccctggatctccagctgcaccacactcaaattagaacaacatcagctcctccccaggtctccacctgcacagccctcgaatgggaacgtcagctcctccccgggtctccagctgcagggccctaaaactagaacatcagctcccgcctgggtcgccagcagcaccaccctcaaactggaacatcagatccccacgggtctccagctgcagggccctcaaactggaacatcagctccccaccagatctccagctgcacggacctcaaactggaacatcagctccccgccgggtctccagctgcactgcctgcaaactggaacatgagctccctgccgggtctccagctgcatggccctcaaactggaacatcagctccccaccagattgccagctgcacggccctcaaactggaatatcagctccaccc

SEQ ID NO: 278147 - DNA, 1149 bp, Homo sapiens
taccttttttttactgtacaaatgctttatttctattcaatatttagaagacagttataaacaagatgcattcaatagcatggtggcagatgaacatcaggaaggaacatccatgagcttccatccacggaacctcaccatggatacgcttgtgatcaagggcctggtctcccctcaagacacggtcacagatcagaggccacaccatcctagcagtggagcaggaccagctgggacagggtccttctgtgacacctgctgcatcaccaggctgggtgaacggacacaattgccagaactcacagaatagaagtatcagcaccgaaacctcacaggaaaaatggtaagttctaagtttctccattaatagtaactctcagattaatctctgtcatccatcgcttctccaagaaatgactttttagggtgatgtgccaggcgccatgttggagggctggtggtagcggcttggggaggtgctcactctgtcggtctcactctctcacacgcttcccctggctcccttcgttcccccccaccccacttggcctgcgtgctggagggtgtgcgagggagtgggaggatgtcggggggtggggggaggcgttccggtccccaagagacccgcggagggagacggaggctgtgagggactctgggaagccatggacgtcgacaggctccaggaggcgctggaagattttgagaagaggcaaaaaagaaagtctgtcctgtcctggatcagttcctttgtcatgtagccaagactggagaaacagattcagtggtcccaatttaaaggctattttattttcaaactggagaaagtgatagatgatttcagaacttcagctcctgcgccaagaggtcctcccaaccctaaagtcgaatatattccctttgatgaaacaaagggaagaatactgaaaactgtcactggatttaaccgtatcccttttactattcagcgactatgtgaattgttaacagatccaaggagaaactatacaggaacagacaaatttctcagaggagtagaaaagaacgtgatggttgttagctgtgtttatccttcttcagagaaaaacaattccaatagtttaaatcgaatgaatggtgtgatgtttcctggaaatgcaccaagctata

SEQ ID NO: 278148 - DNA, 1179 bp, Homo sapiens
tacttgtcactccctgaaaaggaccttttctttgactcacaggcccaagacacaggacagggctgctgggcatccagggtgacactgactttggtgatcagcctgtttttgatggcccctggcctcgccccagacccggtcacaggctgcccatgttgccgatacatgctcgggcagggatggactgctcctcagcatggcagaagatggcaaccaggtttcactttacatcatatctgttggcagtggctgtgctgatcatttgaaaattccactcagatttggaagaaaaacattccagattgattactgatgtctgccattcagaggggaaagggaaatgatggcatctgtgctgtgcattgtcatcctgggccacccaatgcaaccacatgcttgctcagcaaagggaaaactccacagagctgagctcctggtggggcaacatggtggcagatagatgggtcaattggaagccccaagatttttctgtttctccaaagtaaaatgtccatgctcttacatgtctttcctagatggcagaggcaaatgcaaagcaggaagacaagggaagataaatgccattggctttagccctaaatcatgctgttcactcagctttttcttgagttgactccacatgtctacctgtgaccagtggatcagtgcttcagatccatgaatatacaatacttcaggggttatccagttttataccccaccttgcacctcgggcaggcaatggggagccaaccagaccctgactacacacaccacaccctgtgatggatggtgaagagctcaaggtggccaacagtgggctccaggtgcctctcaggtcattccacatctatctcacgacctgagccagtaaggggcatggataggacctcagacaggacttctgtgccaaccccaaagaaccagccaggacatgcctccgggagaggcgtttgcatttgggtagaacactgcctgatgattgagaccacctgggctggaaacaggacagtcacacaaatgcctggcagggcaaggggagcataggagcctggcatgaaggagaaagggtcatgtacgtggttgtgagggtcctccctggcatgccccggcctggggtctggctgggtttgagggtttcctgcttctgaggggcccgatccagatgagaagggtggc

SEQ ID NO: 278149 - DNA, 812 bp, Homo sapiens
ccaccatgcctggccaggttccatgttatgtgccaactctgcttcgtgacagccaccagagccccacattcagggttatgaggctgcttctggctcactatgaggagttggtagacagattctttggctgaaggttgtttggagatcaaaaagtgcagatagaaaatggaggcgcagataaggaagccacctacaaggcaggtctcttcacctccaggccagagctgagatccctgtgctgatagggaattctccaacttccagacagcctggggctgccctttgcgtacatgggagggtctcttcctctgcgcttgcacatggaggccctccctggtccagttttataccccaccttgcacctcgggcaggcaatggggagccaaccagaccctgactacacacaccacaccctgtgatggatggtgaagagctcaaggtggccaacagtgggctccaggtgcctctcaggtcattccacatctatctcacgacctgagccagtaaggggcatggataggacctcagacaggacttctgtgccaaccccaaagaaccagccaggacatgcctccgggagaggcgtttgcatttgggtagaacactgcctgatgattgagaccacctgggctggaaacaggacagtcacacaaatgcctggcagggcaaggggagcataggagcctggcatgaaggagaaagggtcatgtacgtggttgtgagggtcctccctggcatgccccggcctggggtctggctgggtttgagggtttcctgcttctgaggggcccgatccagatgagaagggtggc

SEQ ID NO: 278150 - DNA, 532 bp, Homo sapiens
ggagcggctctgccttcccgagcgcgggacgcggcgccctgggggaggagggcgaagcgacgcggcgatggctccgcgggcactcccggggtccgccgtcctagccgctgctgtcttcgtgggaggcgccgtgagttcgccgctggtggctccggacaatgggagcagccgcacattgcactccagaacagagacgaccccgtcgcccagcaacgatactgggaatggacacccagaatatattgcatacgcgcttgtccctgtgttctttatcatgggtctctttggcgtcctcatttgccacctgcttaagaagaaaggctatcgttgtacaacagaagcagagcaagatatcgaagaggaaaaggttgaaaagatagaattgaatgacagtgtgaatgaaaacagtgacactgttgggcaaatcgtccactacatcatgaaaaatgaaggtgtgaacattttagtgttccaaaacaattcagtattcctatcctttattaaaaacctgcttcgaagagtcaagatttat

SEQ ID NO: 278151 - DNA, 882 bp, Homo sapiens
ggagcggctctgccttcccgagcgcgggacgcggcgccctgggggaggagggcgaagcgacgcggcgatggctccgcgggcactcccggggtccgccgtcctagccgctgctgtcttcgtgggaggcgccgtgagttcgccgctggtggctccggacaatgggagcagccgcacattgcactccagaacagagacgaccccgtcgcccagcaacgatactgggaatggacacccagaatatattgcatacgcgcttgtccctgtgttctttatcatgggtctctttggcgtcctcatttgccacctgcttaagaagaaaggctatcgttgtacaacagaagcagagcaagatatcgaagaggaaaaggttgaaaagatagaattgaatgacagtgtgaatgaaaacagtgacactgttgggcaaatcgtccactacatcatgaaaaatgaagcgaatgctgatgtcttaaaggcgatggtagcagataacagcctgtatgatcctgaaagccaccgtgcccggcctgtgaatgaatgtctttaatacataaagagccttcacaaaatcaatatacaaagattggccgggtgcagtggctcatgcctgtaatcattgcagtttgggaagccaaggtggaaggatcgctggaatccaggagttcaagaccagcctgggcaatagagtgagaccctgtctctataaaaataattaaaacaaagctgaaggagaccttgctatgcagccccctgccgcttgtgcacccttgtcgacccacacgcagcttcaggagggcggcgcacacctggggtagtcacagtgcaggactctggctcaatagcgcctttggctgggtttggaccttcgggagggcggtacacgtc

SEQ ID NO: 278152 - DNA, 398 bp, Homo sapiens
ggctggtctcaaactcctggccacaagcaatcctcccactttggcctctcaaaatgctgggattataggcatgagctgttgtgcctgaccgtgaatcatattattattgcttaagataaactgtcatcgcatggtcatgagaactgagtacctgctgtctgaggtctgttcacaaagtccatttgtacaattggaagacgcttttttttttctttcaatttaaactgcttctgtcatcacagggagagagatcaccttcgctgatatttcctttaaccagttgctctttttgttttcctccccacattagccccgtgacccccagcacaccagggagcccgccagtgagtcctgggcctttgtcaccaggggggacgccagggaagcacgtctgtggc

SEQ ID NO: 278153 - DNA, 667 bp, Homo sapiens
atcacatgggaaaagcaggagcaagagagagaaagggggaggggcacatacatttaaacagccagatctcgagagaactcttggaattaattatattttacttaaatttctttagcctgaattctagaaaaaaatgtacagtggtagaaggaatggggtgggatgggatgggacagggtaagaatagattataattcttctgtgtttttaaatattcaggcagattaatatgtgatatgatgcttacccttggttaaagatctacattttttgttttctcttgcagcaatgacttgacttgaagagctctaagagactgaaaacttatatgaagttgccttgggaatatttttatatattttatacagtttctatcatggagtcagcaggcacgtggataaaacctaaaagggaatattattgctgtgccatatacagaattcagtttgctttgaaacaagttttggttgaaagagtctgttgaaaattttattatacttccagggaaggaaagagctgtttttatcttcttaaccactcccagcctctactcttcccagcccctaatcccaggccttggtgtccacactgtagtttttccattatgatgagtatgtgcagtgatactattcatgtacagtctgagcttatgctcaggggtgtgtgt

SEQ ID NO: 278154 - DNA, 1191 bp, Homo sapiens
ggagcggctctgccttcccgagcgcgggacgcggcgccctgggggaggagggcgaagcgacgcggcgatggctccgcgggcactcccggggtccgccgtcctagccgctgctgtcttcgtgggaggcgccgtgagttcgccgctggtggctccggacaatgggagcagccgcacattgcactccagaacagagacgaccccgtcgcccagcaacgatactgggaatggacacccagaatatattgcatacgcgcttgtccctgtgttctttatcatgggtctctttggcgtcctcatttgccacctgcttaagaagaaaggctatcgttgtacaacagaagcagagcaagatatcgaagaggaaaaggttgaaaagatagaattgaatgacagtgtgaatgaaaacagtgacactgttgggcaaatcgtccactacatcatgaaaaatgaagcgaatgctgatgtcttaaaggcgatggtagcagataacagcctgtatgatcctgaaagccccgtgacccccagcacaccagggagcccgccagtgagtcctgggcctttgtcaccaggggggacgccagggaagcacgtctgtggccatcatctgcatacggtgggcggtgttgtcgagagggatgtgtgtcatcggtgtaggcacaagcggtggcactttataaagcccactaacaagtccagagagagcagaccacggcgccaaggcgaggtcacggtcctttctgttggcagatttagagttacaaaagtggagcacaagtcaaaccagaaggaacggagaagcctgatgtctgttagtggggctgaaaccgtcaatggggaggtgccggcaacacctgtgaagagagaacgcagtggcacagagtagcagcaatgacttgacttgaagagctctaagagactgaaaacttatatgaagttgccttgggaatatttttatatattttatacagtttctatcatggagtcagcaggcacgtggataaaacctaaaagggaatattattgctgtgccatatacagaattcagtttgctttgaaacaagttttggttgaaagagtctgttgaaaattttattatacttccagggaaggaaagagctgtttttatcttcttaaccactcccagcctctactcttcccagcccctaatcccaggccttggtgtccacactg

SEQ ID NO: 278155 - DNA, 1266 bp, Homo sapiens
ggaaatcctcatctttcccagtgggaagttagtaagaatataaaacagaaaaattaagaagtagcaatataaacatattactaagataaataaaggcaaatatcaaaagaatcaactaaaagagctaaaagtggtttccttcggagagcaggcaataggagtaaaggtgaggaactggagaactagctgagtgcagaagcgtatgcctgtaatccagcactgaggctgaggcaggaggatctcttgagcctagaagtttgagaccagcctgggcaacaaagcgagaccctgcctctacaaaaaattaaaaaattagctgggcacagtggcatgtgcctgtagtctcagctacttgggaggctgaggtgggagaactgtcagagcccaggaggtcaatgctacagtgagccatgttcatgccactgtattccaccctgggtgacagagaacctgtctcaaacaaaccaacaaaaaattgcagagctactggttttgtaacaagctttgtagaactgtttgacttttctaaacaatgtgcatggataattttaataaaaacaaaaactgtatttgaaagagacagaacacttaccaatatacttttcttgctttttgaatagaggtaacagtctgaacttcttttaatgtttgctttgttttcttttctgctgacttgaatgcctatttatagaaaagagttttaaaaacaatttgttaagaatgtatttaaataacaccaaagtaaataatggggcaagaatttttttaaatgtcacaaaatggcacaatctacacacacacacacaaacacacacacacacaaatacgcatacttgaaagtaatgaagaaatgaaaatatttttgcctgaagtattaaaataatctaaactaaagaattactacatgaaaatatttgcccaagacctacaaagtaataaataccttgtcattttctagatactgagtacctatcatatgcttggttctaggctagatgccattagagatataagagtgaacaagatggacaaagcccccactcccaccccactaggtctagaagagacaactattaatcatataatcctttaaataaatatataatggtgagtgcttctaaagatgctacaggaatataacaaggaaacccgatttacactgggttatggtcaaagaaggtatctctaaggaaatgacatttaagctgaatcctcaacgactaacggggttatcaggcaaagaataggaaaaagggcattacaagc

SEQ ID NO: 278156 - DNA, 1482 bp, Homo sapiens
agaaagagagcgatagagtgcgagagcgagtgcccggagcatcctggccctgagacagctgggccagccccgcagggctctgcagcatgtgggagctccgctccatagccttctccagggctgtgttcgcagagttcctggccacactcctcttcgtcttctttggcctcggctctgccctcaactggccacaggccctgccctctgtgctacagattgccatggcgtttggcttgggtattggcaccctggtacaggctctgggccacataagcggggcccacatcaaccctgccgtgactgtggcctgcctggtgggctgccacgtctccgttctccgagccgccttctacgtggctgcccagctgctgggggctgtggccggagccgctctgctccatgagatcacgccagcagacatccgcggggacctggctgtcaatgctctcagcaacagcacgacggctggccaggcggtgactgtggagctcttcctgacactgcagctggtgctctgcatcttcgcctccaccgatgagcgccgcggagagaacccgggcacccctgctctctccataggcttctctgtggccctgggccacctccttgggatccattacaccggctgctctatgaatcctgcccgctccctggctccagctgtcgtcactggcaaatttgatgaccactgggtcttctggatcggacccctggtgggcgccatcctgggctccctcctctacaactacgtgctgtttccgccagccaagagcctgtcggagcgcctggcagtgctgaagggcctggagccggacaccgattgggaggagcgcgaggtgcgacggcggcagtcggtggagctgcactcgccgcagagcctgccacggggtaccaaggcctgagggccgccagcggcctctaaggccccgacggacgcttgtgaggcccgaggcagaagggcccaccccgtccctcctctcccgcaggtctgaagttggccccccagcgcagagtagctgcttcctggacgtgcgcgcccaggccagtgctgtgagcaggcggggaggaggctgccggagggagccctgagcctggcaggtcccctgccctgaggctgtgagcagctagtggtggcttctccagcctttttcagggaactgggaacttaggggactgagctggggagggaggcaggtgggtggtaagagggaaactctggagagcctgcacccaggtactgagtggggagtgtacagacccctgccttgggggttctgggaatgatgcaactggttttactagtgtgcaagtgtgttcatccccaagttctcttttgtcctcacatgcagagttgtgcatgcccctgagtgtgaacaggtttgcctacgttggtgcaagtgtgcatggctggggacttctcacttccccttgcaccccttcctccccaacctgcaataaatccgcttctcctgcaaaaaatga

SEQ ID NO: 278157 - DNA, 2318 bp, Homo sapiens
agactagcgcgcaagcgccgcggcctcaggcgaacgaacgggcggtgtagtgcaggtccgccatggctgaggcgtcacggtggcaccgaggcggggcttcgaaacataagttgcattacagaaaggaagtagaaattacaaccacacttcaggaattgttactctactttatttttttaataaacctatgtatattgacttttgggatggtaaacccacatatgtattacttaaacaaggttatgtcatctctatttttggacacttctgtgcctggtgaagaaagaaccaactttaagtccattcgcagcataactgatttttggaagtttatggaaggaccccttttggaaggtctgtactgggattcatggtacaataaccagcagctgtataatttaaagaacagcagtcgcatctactatgaaaatatacttctaggagttcccagagttcgtcaactaaaagtccgcaacaacacatgcaaagtctattcatcttttcagtctttgatgagtgaatgttatggcaaatatacttctgcaaatgaagacctctctaattttggccttcaaattaatactgaatggagatattctacttctaataccaactccccttggcactggggatttcttggtgtttaccgaaatgggggatacattttcactttatcaaaatcgaaatctgaaaccaaaaacaagttcattgaccttcgactgaacagctggatcacaagagggactagagttatttttattgatttttccttatataatgctaatgtaaatctattttgtattatcagattggtggcagaattccctgcaactggaggaatacttacttcatggcagttttactctgtgaagctcctcagatatgttagctactatgactattttattgcttcctgtgaaatcacattctgtatttttctttttgtcttcacaacacaagaagtcaaaaaaataaaagaatttaagtctgcctatttcaaaagtatttggaactggctagaattgctacttttgctgttgtgttttgtggctgtttccttcaacacatactataatgtacaaatttttctcttacttggacagctgttgaaaagtactgaaaaatattcagatttctattttcttgcatgctggcacatttattacaataatataattgctattaccatcttttttgcatggataaagatattcaaattcataagctttaacaagacaatgtctcagctgtcatcaaccttgtcccgttgtgttaaagacatagtaggatttgccatcatgttttttataatattctttgcttatgcccagttaggatttcttgtttttggatcacaagttgatgacttttccacttttcagaattccatatttgcacaatttcgaattgttcttggagattttaattttgctggtattcagcaagccaatcctatcttgggacccatttacttcatcactttcatcttttttgtgttctttgtcctgctgaatatgttcttggcaattattaatgatacctattctgaagtgaaagctgactattcaataggcagaaggccagattttgaacttggcaaaatgattaaacagagttacaaaaatgttctcgagaaattcagactgaagaaagctcaaaaagatgaagacaagaaaaccaaaggcagcggagatttggctgaacaagccagaagagaaggctttgacgaaaatgagattcaaaacgcagagcagatgaaaaaatggaaagagaggcttgagaaaaagtattattctatggaaattcaagatgactaccagcctgtcactcaagaagaatttcgagaactttttttatatgctgtggagctggagaaggaattacactacatcaatttgaagctaaatcaagtggtgagaaaggtttcagctctatagtattgagacaagtggagagacagagtctcactctgtcgcccaggctggaacagcggtgcgacagtggcctcaacatcctccaaacagagaatcaagtgatcctcttgcctcagcctcccaagtatctgggactacacgcgaacaccaccacccctggctaatttaaacaaaatttttatacagtctgggtcccactatattgcccaggctggtcttgaactcctggcctcaagggatcctcctgcctcagcttcaaaaactgctgggattataggcatgagccactgtgcctggctagatttttttttaatttttgaaatacagtaatgttttatttaaaaatgggaatgacaataaatatttgcaaatcacacttgaaaa

SEQ ID NO: 278158 - DNA, 1412 bp, Homo sapiens
gatacggatctcgctctaacgcccaggctggagtgagactgtcacacacacacacaaaagaaaaaaaaatgttggtttaaagaaaggcactctctaagatagtttctctgaccagaagagtacacacttatcaagcaaccacagagtgtatggcactaggcatcaccatcctctctgaggaaggtaatcataacccttataaaggatccactttgtctacctagcattattgctggagcaggaagtatcatacaaatttactgtagaggttttgaatcacatctgggtgcatgtctcctctttaacctttttctagtgctaaggttattttccacaacacacaggccctttttatctgtagctgggaaaagggtatttggacactgtaaggaaagcaggtggtagtgagaacagtgcacaggaaggttcagcaatacaaattttgtggtacaaagggcttgtttttggatacgtagacagactggagtacacacattgactaaccaatgcagtaattacaaagagggggttttgaagtcatctgactgagaagctgctgggaaggccaaaaatacccacagatacactttgaatctaattactagttacatttgctaaataacagaggtacagaaagaacatcttagctttgatcacaagaaagagaaaataatttagatggagatgctaaagggaaaaggcagtgaaatgtaatttataatttgtttacaaagcttccctaactatgctagacagcaattacaccaatcaagtcctctgaagtgactttgctgatgcacagatctaaaatctaggcagggcaaaaagtcagcagggctcaaaatctgagggctggagaggagaacagcttaagatcctcaatcctgtgatgcttgtgtgccaaagacttgaaatagagaactaaagattgcagcctttacttgtcctctaccctgacaggagattcaaaacgcagagcagatgaaaaaatggaaagagaggcttgagaaaaagtattattctatggaaattcaagatgactaccagcctgtcactcaagaagaatttcgagagtaagcttatgttctaaccagactattatgggatatcatgacatgcgcattaaggacatgagttaaacacattattttcctgaacccaaaactttactctattaggatgcctttatttactttctatccagttttaaagttgcatatgactccatttgcttacaaggtgagaagcttttgattacatccctgttatctctaaataacagaaactgccatctatatttgatttgcataacagatcttgttctccacatagctttagaatattagatctataactggccacaagaggcatgttttaggagcttacaattctatcttcccaaagcatttcgc

SEQ ID NO: 278159 - DNA, 2290 bp, Homo sapiens
agactagcgcgcaagcgccgcggcctcaggcgaacgaacgggcggtgtagtgcaggtccgccatggctgaggcgtcacggtggcaccgaggcggggcttcgaaacataagttgcattacagaaaggaagtagaaattacaaccacacttcaggaattgttactctactttatttttttaataaacctatgtatatgttatgtcatctctatttttggacacttctgtgcctggtgaagaaagaaccaactttaagtccattcgcagcataactgatttttggaagtttatggaaggaccccttttggaaggtctgtactgggattcatggtacaataaccagcagctgtataatttaaagaacagcagtcgcatctactatgaaaatatacttctaggagttcccagagttcgtcaactaaaagtccgcaacaacacatgcaaagtctattcatcttttcagtctttgatgagtgaatgttatggcaaatatacttctgcaaatgaagacctctctaattttggccttcaaattaatactgaatggagatattctacttctaataccaactccccttggcactggggatttcttggtgtttaccgaaatgggggatacattttcactttatcaaaatcgaaatctgaaaccaaaaacaagttcattgaccttcgactgaacagctggatcacaagagggactagagttatttttattgatttttccttatataatgctaatgtaaatctattttgtattatcagattggtggcagaattccctgcaactggaggaatacttacttcatggcagttttactctgtgaagctcctcagatatgttagctactatgactattttattgcttcctgtgaaatcacattctgtatttttctttttgtcttcacaacacaagaagtcaaaaaaataaaagaatttaagtctgcctatttcaaaagtatttggaactggctagaattgctacttttgctgttgtgttttgtggctgtttccttcaacacatactataatgtacaaatttttctcttacttggacagctgttgaaaagtactgaaaaatattcagatttctattttcttgcatgctggcacatttattacaataatataattgctattaccatcttttttgcatggataaagatattcaaattcataagctttaacaagacaatgtctcagctgtcatcaaccttgtcccgttgtgttaaagacatagtaggatttgccatcatgttttttataatattctttgcttatgcccagttaggatttcttgtttttggatcacaagttgatgacttttccacttttcagaattccatatttgcacaatttcgaattgttcttggagattttaattttgctggtattcagcaagccaatcctatcttgggacccatttacttcatcactttcatcttttttgtgttctttgtcctgctgaatatgttcttggcaattattaatgatacctattctgaagtgaaagctgactattcaataggcagaaggccagattttgaacttggcaaaatgattaaacagagttacaaaaatgttctcgagaaattcagactgaagaaagctcaaaaagatgaagacaagaaaaccaaaggcagcggagatttggctgaacaagccagaagagaaggctttgacgaaaatgagattcaaaacgcagagcagatgaaaaaatggaaagagaggcttgagaaaaagtattattctatggaaattcaagatgactaccagcctgtcactcaagaagaatttcgagaactttttttatatgctgtggagctggagaaggaattacactacatcaatttgaagctaaatcaagtggtgagaaaggtttcagctctatagtattgagacaagtggagtggcaccacaaccaagtacaaaatgagattctctctgagtgcctgacaaaacgaatttaagtaccagccaagtacacacgatgatagcttcaaggaatacaactgactttatgatatgaattttcaaggaacgtatcttatatggattttgaagaatcttgtttgcttataagaacttcaagaagcctaagcttggctttaattttcttgtactctctgtactcctcaagcactggaacacgatcctctttctgggcattcctaggggagaaaataaaatttgtaatgttctagagatcatttggaaaaaaagatccaaaagttgtcttaatatgagacatactgttactaaacataagttcaaataaaaagttgttctg

SEQ ID NO: 278160 - DNA, 2226 bp, Homo sapiens
agactagcgcgcaagcgccgcggcctcaggcgaacgaacgggcggtgtagtgcaggtccgccatggctgaggcgtcacggtggcaccgaggcggggcttcgaaacataagttgcattacagaaaggaagtagaaattacaaccacacttcaggaattgttactctactttatttttttaataaacctatgtatattgacttttgggatggtaaacccacatatgtattacttaaacaaggttatgtcatctctatttttggacacttctgtgcctggtgaagaaagaaccaactttaagtccattcgcagcataactgatttttggaagtttatggaaggaccccttttggaaggtctgtactgggattcatggtacaataaccagcagctgtataatttaaagaacagcagtcgcatctactatgaaaatatacttctaggagttcccagagttcgtcaactaaaagtccgcaacaacacatgcaaagtctattcatcttttcagtctttgatgagtgaatgttatggcaaatatacttctgcaaatgaagacctctctaattttggccttcaaattaatactgaatggagatattctacttctaataccaactccccttggcactggggatttcttggtgtttaccgaaatgggggatacattttcactttatcaaaatcgaaatctgaaaccaaaaacaagttcattgaccttcgactgaacagctggatcacaagagggactagagttatttttattgatttttccttatataatgctaatgtaaatctattttgtattatcagattggtggcagaattccctgcaactggaggaatacttacttcatggcagttttactctgtgaagctcctcagatatgttagctactatgactattttattgcttcctgtgaaatcacattctgtatttttctttttgtcttcacaacacaagaagtcaaaaaaataaaagaatttaagtctgcctatttcaaaagtatttggaactggctagaattgctacttttgctgttgtgttttgtggctgtttccttcaacacatactataatgtacaaatttttctcttacttggacagctgttgaaaagtactgaaaaatattcagatttctattttcttgcatgctggcacatttattacaataatataattgctattaccatcttttttgcatggataaagatattcaaattcataagctttaacaagacaatgtctcagctgtcatcaaccttgtcccgttgtgttaaagacatagtaggatttgccatcatgttttttataatattctttgcttatgcccagttaggatttcttgtttttggatcacaagttgatgacttttccacttttcagaattccatatttgcacaatttcgaattgttcttggagattttaattttgctggtattcagcaagccaatcctatcttgggacccatttacttcatcactttcatcttttttgtgttctttgtcctgctgaatatgttcttggcaattattaatgatacctattctgaagtgaaagctgactattcaataggcagaaggccagattttgaacttggcaaaatgattaaacagagttacaaaaatgttctcgagaaattcagactgaagaaagctcaaaaagatgaagacaagaaaaccaaaggcagcggagatttggctgaacaagccagaagagaaggctttgacgaaaatgagattcaaaacgcagagcagatgaaaaaatggaaagagaggcttgagaaaaagtattattctatggaaattcaagatgactaccagcctgtcactcaagaagaatttcgagatggcaccacaaccaagtacaaaatgagattctctctgagtgcctgacaaaacgaatttaagtaccagccaagtacacacgatgatagcttcaaggaatacaactgactttatgatatgaattttcaaggaacgtatcttatatggattttgaagaatcttgtttgcttataagaacttcaagaagcctaagcttggctttaattttcttgtactctctgtactcctcaagcactggaacacgatcctctttctgggcattcctaggggagaaaataaaatttgtaatgttctagagatcatttggaaaaaaagatccaaaagttgtcttaatatgagacatactgttactaaacataagttcaaataaaaagttgttctg

SEQ ID NO: 278161 - DNA, 2334 bp, Homo sapiens
agactagcgcgcaagcgccgcggcctcaggcgaacgaacgggcggtgtagtgcaggtccgccatggctgaggcgtcacggtggcaccgaggcggggcttcgaaacataagttgcattacagaaaggaagtagaaattacaaccacacttcaggaattgttactctactttatttttttaataaacctatgtatattgacttttgggatggtaaacccacatatgtattacttaaacaaggttatgtcatctctatttttggacacttctgtgcctggtgaagaaagaaccaactttaagtccattcgcagcataactgatttttggaagtttatggaaggaccccttttggaaggtctgtactgggattcatggtacaataaccagcagctgtataatttaaagaacagcagtcgcatctactatgaaaatatacttctaggagttcccagagttcgtcaactaaaagtccgcaacaacacatgcaaagtctattcatcttttcagtctttgatgagtgaatgttatggcaaatatacttctgcaaatgaagacctctctaattttggccttcaaattaatactgaatggagatattctacttctaataccaactccccttggcactggggatttcttggtgtttaccgaaatgggggatacattttcactttatcaaaatcgaaatctgaaaccaaaaacaagttcattgaccttcgactgaacagctggatcacaagagggactagagttatttttattgatttttccttatataatgctaatgtaaatctattttgtattatcagattggtggcagaattccctgcaactggaggaatacttacttcatggcagttttactctgtgaagctcctcagatatgttagctactatgactattttattgcttcctgtgaaatcacattctgtatttttctttttgtcttcacaacacaagaagtcaaaaaaataaaagaatttaagtctgcctatttcaaaagtatttggaactggctagaattgctacttttgctgttgtgttttgtggctgtttccttcaacacatactataatgtacaaatttttctcttacttggacagctgttgaaaagtactgaaaaatattcagatttctattttcttgcatgctggcacatttattacaataatataattgctattaccatcttttttgcatggataaagatattcaaattcataagctttaacaagacaatgtctcagctgtcatcaaccttgtcccgttgtgttaaagacatagtaggatttgccatcatgttttttataatattctttgcttatgcccagttaggatttcttgtttttggatcacaagttgatgacttttccacttttcagaattccatatttgcacaatttcgaattgttcttggagattttaattttgctggtattcagcaagccaatcctatcttgggacccatttacttcatcactttcatcttttttgtgttctttgtcctgctgaatatgttcttggcaattattaatgatacctattctgaagtgaaagctgactattcaataggcagaaggccagattttgaacttggcaaaatgattaaacagagttacaaaaatgttctcgagaaattcagactgaagaaagctcaaaaagatgaagacaagaaaaccaaaggcagcggagatttggctgaacaagccagaagagaaggctttgacgaaaatgagattcaaaacgcagagcagatgaaaaaatggaaagagaggcttgagaaaaagtattattctatggaaattcaagatgactaccagcctgtcactcaagaagaatttcgagaactttttttatatgctgtggagctggagaaggaattacactacatcaatttgaagctaaatcaagtggtgagaaaggtttcagctctatagtattgagacaagtggagtggcaccacaaccaagtacaaaatgagattctctctgagtgcctgacaaaacgaatttaagtaccagccaagtacacacgatgatagcttcaaggaatacaactgactttatgatatgaattttcaaggaacgtatcttatatggattttgaagaatcttgtttgcttataagaacttcaagaagcctaagcttggctttaattttcttgtactctctgtactcctcaagcactggaacacgatcctctttctgggcattcctaggggagaaaataaaatttgtaatgttctagagatcatttggaaaaaaagatccaaaagttgtcttaatatgagacatactgttactaaacataagttcaaataaaaagttgttctg

SEQ ID NO: 278162 - DNA, 610 bp, Homo sapiens
aggtccgccatggctgaggcgtcacggtggcaccgaggcggtgaggggtcctcttaaggagtgggagggacaggggcgatttggcagttccagacaccctgaaaggaactctgcggccccaaattcgtttgagagatgtgactgccgacacctttagccctcacagcctcccctggggaagcggagagggacagatggtcccattgcacagacgggaaaactgaagccctgagcgaggtggcgctcgcctcttgccggaggctcgagctgggcgttgtcacctgtcgagtgaccgtcgctaggccggtctctaaagtccttggttgatctggggagtcgtgaccttgacagaattcaagccgaggtgtttttcccctgtccagcagaaaccagccttcccaagaagctgtattgagggtggagaaaacggttaggacagatgagaggttttacttgtttcgtattttgctttttcatcttaagactggcgagaagacatcatgatataaaatctgttagtggccgggcgcagtggctcaagcctgtaatcccaacactttgggaggccgaggcgggcggatcacaaggtcaagagatcgagaccatcctg

SEQ ID NO: 278163 - DNA, 988 bp, Homo sapiens
  misc_feature (16)..(16): n is a, c, g, or t
gctggggtgaatcggncgagggtacccgactcaacgtgagacgcaccgcccggactcaccatgcgtgaatgcatctcagtccacgtggggcaggcaggtgtccagatgggcaatgcctgctgggagctctattgcttggaacatgggattcagcctgatgggcagatgcccagtgacaagaccattggtggaggggacgactccttcaccaccttcttctgtgaaactggtgctggaaaacacgtaccccgggcagtttttgtggatctggagcctacggtcattgatgagatccgaaatggcccataccgacagctcttccacccagagcagctcatcactgggaaagaggatgctgccaacaactatgcccgtggtcactataccattggcaaggagatcattgacccagtgctggatcggatccgcaagctgtctgaccagtgcacaggacttcagggcttcctggtgttccacagctttggtgggggcactggctctggcttcacctcactcctgatggagcggctctctgttgactatggcaagaaatccaagctggaattctccatctacccagccccccaggtgtctacagccgtggtcgagccctacaactctatcctgaccacccacaccaccctggagcactcagactgtgccttcatggtggacaacgaagcaatctatgacatctgccgccgcaacctagacatcgagcgcccaacctacaccaacctcaatcgcctcattagccaaattgtctcctccatcacagcttctctgcgctttgacggggccctcaatgtggacctgacagagttccagaccaacctggtgccctaccctcattccctggcactatgccagtctttttgcggaaggttcccgagcgcgtgggggggatccatgcgttggcttccaccaagtaggggcccggggatgccggcgcgcgggtggccggttgttcgcccaaacctttggggcc

SEQ ID NO: 278164 - DNA, 769 bp, Homo sapiens
agcggcagttctcactgagacctgtcaccccgactcaacgtgagacgcaccgcccggactcaccatgcgtgaatgcatctcagtccacgtggggcaggcaggtgtccagatgggcaatgcctgctgggagctctattgcttggaacatgggattcagcctgatgggcagatgcccagtgacaagaccattggtggaggggacgactccttcaccaccttcttctgtgaaactggtgctggaaaacacgtaccccgggcagtttttgtggatctggagcctacggtcattgatcgccgaggcctgggcccgcctggaccacaagttcgacctgatgtatgccaagagggcgtttgtgcactggtatgtgggtgagggcatggaggagggtgagttctccgaggcccgtgaggatatggctgccctggagaaggattatgaggaggtgggcatcgactcctatgaggacgaggatgagggagaagaataaagcagctgcctggagcctattcactatgtttattgcaaaatcctttcgaaataaacagtttccttccaaaaaaaaaagaagaaacaaaaaaaactttggtggcgcgcccggggccccgagaaagttttaaacccttcggtggggcccgcgcgccctgggtaggaccgggccctacgggtccaaggaacacgggcgaacaggcggttctcccaaaaaaaccgcgggggcccgcgttttgacaacccggggtcggggcgcggccccacgggcccgggcgtaac

SEQ ID NO: 278165 - DNA, 311 bp, Homo sapiens
tcccgctttttattggcacctcgctattaatcggcacctcgctatttatcggcacccacaccaccctggagcactcagactgtgccttcatggtggacaacgaagcaatctatgacatctgccgccgcaacctagacatcgagcgcccaacctacaccaacctcaatcgcctcattagccaaattgtctcctccatcacagcttctctgcgctttgacggggccctcaatgtggacctgacagagttccagaccaacctggtgccctaccctcgatgatagcgaggtgccgatgatagcgaggtgccgata

SEQ ID NO: 278166 - DNA, 2240 bp, Homo sapiens
  misc_feature (1635)..(1635): n is a, c, g, or t
  misc_feature (2240)..(2240): n is a, c, g, or t
agcggcagttctcactgagacctgtcaccccgactcaacgtgagacgcaccgcccggactcaccatgcgtgaatgcatctcagtccacgtggggcaggcaggtgtccagatgggcaatgcctgctgggagctctattgcttggaacatgggattcagcctgatgggcagatgcccagtgacaagaccattggtggaggggacgactccttcaccaccttcttctgtgaaactggtgctggaaaacacgtaccccgggcagtttttgtggatctggagcctacggtcattgatgagatccgaaatggcccataccgacagctcttccacccagagcagctcatcactgggaaagaggatgctgccaacaactatgcccgtggtcactataccattggcaaggagatcattgacccagtgctggatcggatccgcaagctgtctgaccagtgcacaggacttcagggcttcctggtgttccacagctttggtgggggcactggctctggcttcacctcactcctgatggagcggctctctgttgactatggcaagaaatccaagctggaattctccatctacccagccccccaggtgtctacagccgtggtcgagccctacaactctatcctgaccacccacaccaccctggagcactcagactgtgccttcatggtggacaacgaagcaatctatgacatctgccgccgcaacctagacatcgagcgcccaacctacaccaacctcaatcgcctcattagccaaattgtctcctccatcacagcttctctgcgctttgacggggccctcaatgtggacctgacagagttccagaccaacctggtgccctaccctcgcatccacttccccctggccacctatgcaccagtcatctctgcagaaaaggcataccacgagcagctgtcggtggcagagatcaccaatgcctgctttgagcctgccaaccagatggtaaagtgtgatccccggcacggcaagtacatggcctgctgcctgctgtaccgtggagatgtggtgcccaaggatgtcaacgctgccattgccgccatcaagaccaagcgcagcattcagtttgtggactggtgccccacaggcttcaaggttggtatcaactaccagcctcccactgtggtgcctgggggtgacctggccaaggtgcagcgtgccgtgtgcatgctgagcaacacgaccgccatcgccgaggcctgggcccgcctggaccacaagttcgacctgatgtatgccaagagggcgtttgtgcactggtatgtgggtgagggcatggaggagggtgagttctccgaggcccgtgaggatatggctgccctggagaaggattatgaggaggtgggcatcgactcctatgaggacgaggatgagggagaagaataaagcagctgcctggagcctattcactatgtttattgcaaaatcctttcgaaataaacagtttcctttgcgaaaaaaagaataagatacaaataactacatctagaatacataagtagaacaataagaaacaaaaagggggcggcggtcgacaaatgatttcccccgtgggggggcgccacttctactataacacccaatttgttttttgccaacgggggtcccanaaatgagcggggtgctataaaatgccaaaggtgcacttcggcgcgcgcactataaaagcacggccgtggtcgtcgaggaagacatctgtacagcatggtagcgcctctgtgagagagaggcacttatgtcacgagggaggggacaagccattttcggcgcacccatgtccccctgacagagagttgtttatggcccgcctagcggcggcacactaattttaaaccactgtgctaaatcgttgccgtcttacagggtgtttgttcgcaacaaccaccgagggggtactcgattactgatcgaccgctcggcgagaagaaaatgtttggcgttcaacaccggaggcacttaatttgtacattgaggacccacaatttattttaccggcagagcgctttctccttcaaactatcacgcgtgcgacgtggaccagatatgaaaaccatcgagcaggcagacgcaccagcgacactgaacattcgtaagtgccaaagataacactcaccatagtcggcaatttgttccaccacgagcgaaaaacgaagaacacgacggaggaacggagcgaccgaggacgttcgaacagccaaaaaaaaatacgcacttn

SEQ ID NO: 278167 - DNA, 1149 bp, Homo sapiens
agcggcagttctcactgagacctgtcaccccgactcaacgtgagacgcaccgcccggactcaccatgcgtgaatgcatctcagtccacgtggggcaggcaggtgtccagatgggcaatgcctgctgggagctctattgcttggaacatgggattcagcctgatgggcagatgcccagtgacaagaccattggtggaggggacgactccttcaccaccttcttctgtgaaactggtgctggaaaacacgtaccccgggcagtttttgtggatctggagcctacggtcattgatgagatccgaaatggcccataccgacagctcttccacccagagcagctcatcactgggaaagaggatgctgccaacaactatgcccgtggtcactataccattggcaaggagatcattgacccagtgctggatcggatccgcaagctgtctgaccagtgcacaggacttcagggcttcctggtgttccacagctttggtgggggcactggctctggcttcacctcactcctgatggagcggctctctgttgactatggcaagaaatccaagctggaattctccatctacccagccccccaggtgtctacagccgtggtcgagccctacaactctatcctgaccacccacaccaccctggagcactcagactgtgccttcatggtggacaacgaagcaatctatgacatctgccgccgcaacctagacatcgagcgcccaacctacaccaacctcaatcgcctcattagccaaattgtctcctccatcacagcttctctgcgctttgacggggccctcaatgtggacctgacagagttccagaccaacctggtgccctaccctcgcatccacttccccctggccacctatgcaccagtcatctctgcagaaaaggcataccacgagcagctgtcggtggcagagatcaccaatgcctgctttgagcctgccaaccagatggtaaagtgtgatccccggcacggcaagtacatggcctgctgcctgctgtaccgtggagatgtggtgcccaaggatgtcaacgctgccattgccgccatcaagaccaagcgcagcattcagtttgtggactggtccgataaacgagtgccgatgaatgggatcctctagaacagccagca

SEQ ID NO: 278168 - DNA, 2888 bp, Homo sapiens
  misc_feature (17)..(17): n is a, c, g, or t
  misc_feature (19)..(19): n is a, c, g, or t
  misc_feature (21)..(21): n is a, c, g, or t
  misc_feature (24)..(24): n is a, c, g, or t
  misc_feature (29)..(29): n is a, c, g, or t
  misc_feature (32)..(32): n is a, c, g, or t
aagtaggctagtagagncngntgntaatnggncgaggccgactcaacgtgagacgcaccgcccggactcaccatgcgtgaatgcatctcagtccacgtggggcaggcaggtgtccagatgggcaatgcctgctgggagctctattgcttggaacatgggattcagcctgatgggcagatgcccagtgacaagaccattggtggaggggacgactccttcaccaccttcttctgtgaaactggtgctggaaaacacgtaccccgggcagtttttgtggatctggagcctacggtcattgatgagatccgaaatggcccataccgacagctcttccacccagagcagctcatcactgggaaagaggatgctgccaacaactatgcccgtggtcactataccattggcaaggagatcattgacccagtgctggatcggatccgcaagctgtctgaccagtgcacaggacttcagggcttcctggtgttccacagctttggtgggggcactggctctggcttcacctcactcctgatggagcggctctctgttgactatggcaagaaatccaagctggaattctccatctacccagccccccaggtgtctacagccgtggtcgagccctacaactctatcctgaccacccacaccaccctggagcactcagactgtgccttcatggtggacaacgaagcaatctatgacatctgccgccgcaacctagacatcgagcgcccaacctacaccaacctcaatcgcctcattagccaaattgtctcctccatcacagcttctctgcgctttgacggggccctcaatgtggacctgacagagttccagaccaacctggtgccctaccctcgcatccacttccccctggccacctatgcaccagtcatctctgcagaaaaggcataccacgagcagctgtcggtggcagagatcaccaatgcctgctttgagcctgccaaccagatggtaaagtgtgatccccggcacggcaagtacatggcctgctgcctgctgtaccgtggagatgtggtgcccaaggatgtcaacgctgccattgccgccatcaagaccaagcgcagcattcagtttgtggactggtgccccacaggcttcaaggttggtatcaactaccagcctcccactgtggtgcctgggggtgacctggccaaggtgcagcgtgccgtgtgcatgctgagcaacacgaccgccatcgccgaggcctgggcccgcctggaccacaagttcgacctgatgtatgccaagagggcgtttgtgcactggtatgtgggtgagggcatggaggagggtgagttctccgaggcccgtgaggatatggctgccctggagaaggattatgaggaggtgggcatcgactcctatgaggacgaggatgagggagaagaataaagcagctgcctggagcctattcactatgtttattgcaaaatcctttcgaaataaacagtttccttgcacggtttcttgttccctctgagtgcttgagcttctgctgccttccccttcatgctgctgctgctctgtttgctgttcatgacccttatcccttccatcgctgaaggtgagacctgcaaaggggttcttgccaggcccaggaagcataaccccagggactttaaattgaagtcctagggttactcagtatagggaggaaatgaggaccaaaatccaggcacaaactgttgaaggatgagtcttcagctcctttccaagtaggagtataatccagtggtttctgtctttgaaagttagactgctaccctgttcttcctgctgcctctacatttaccaactctggaagcaaggcttggcccaggctcctctgtgcattatgagggtttgggagtggggctgggctggcccagagttcctgggcatggagccacgtcataagcttgggggatgggagggaacacaggcgatctcctagagttgtttgtgccactgcacctctgagcagctttgcatagcttcctgtcttgctgctttgctggagctggggctgtgccattaaaagtcaggtcatctcccctctgtttgtgatttctttctggcctcagcctctgtgctagctagtgggagactcctgctagggccctggggaaagcttcaactttgctaacaggagccccaggccccatgctgatgtcatactgtggggtagacatggttcgggggaggaggcttggatcacaaaagagcaggagatgccaaccctgcccttgcctttcctccctggtgattcagggaacagagcccttccctagggaacaggtttgaagcccagctaagacagggcccctgtttactcagcagagtaggcaggaagtggcagctggatactgccacaccacactgcctcattaatcattaaccatgtatgagcttgaacgatcagggagacacaggccaaaacagctgccgctgccacctccactcccctcgcccctaggctgaggatgggagacctgtaatctacctgtctcaaagcttcctcaggtgtctccacccagaggcccttgcctagcaaaccggctaggcagctttgactaagctactcaccccaggagtgaaggaaggaaagaactagttgagtgtttttagggggccctagttcttgacacaggcagatgccagcttgagcccaagcagctttaagttttgatctaagacaagctagaactgtccactgctaaccaacctcctgtagaatgaagtcacaccattgccgactctgcaccattcctccttcccaggcagttcgcctgaatatggcaacctgactttgggccccttgcacctcttctctcactccaggaacactgagactaagatctacaccaacctgcttccacttt

SEQ ID NO: 278169 - DNA, 2867 bp, Homo sapiens
ggcctggtggcgaattcggcacgagggtgagacgcaccgcccggactcaccatgcgtgaatgcatctcagtccacgtggggcaggcaggtgtccagatgggcaatgcctgctgggagctctattgcttggaacatgggattcagcctgatgggcagatgcccagtgacaagaccattggtggaggggacgactccttcaccaccttcttctgtgaaactggtgctggaaaacacgtaccccgggcagtttttgtggatctggagcctacggtcattgatgagatccgaaatggcccataccgacagctcttccacccagagcagctcatcactgggaaagaggatgctgccaacaactatgcccgtggtcactataccattggcaaggagatcattgacccagtgctggatcggatccgcaagctgtctgaccagtgcacaggacttcagggcttcctggtgttccacagctttggtgggggcactggctctggcttcacctcactcctgatggagcggctctctgttgactatggcaagaaatccaagctggaattctccatctacccagccccccaggtgtctacagccgtggtcgagccctacaactctatcctgaccacccacaccaccctggagcactcagactgtgccttcatggtggacaacgaagcaatctatgacatctgccgccgcaacctagacatcgagcgcccaacctacaccaacctcaatcgcctcattagccaaattgtctcctccatcacagcttctctgcgctttgacggggccctcaatgtggacctgacagagttccagaccaacctggtgccctaccctcgcatccacttccccctggccacctatgcaccagtcatctctgcagaaaaggcataccacgagcagctgtcggtggcagagatcaccaatgcctgctttgagcctgccaaccagatggtaaagtgtgatccccggcacggcaagtacatggcctgctgcctgctgtaccgtggagatgtggtgcccaaggatgtcaacgctgccattgccgccatcaagaccaagcgcagcattcagtttgtggactggtgccccacaggcttcaaggttggtatcaactaccagcctcccactgtggtgcctgggggtgacctggccaaggtgcagcgtgccgtgtgcatgctgagcaacacgaccgccatcgccgaggcctgggcccgcctggaccacaagttcgacctgatgtatgccaagagggcgtttgtgcactggtatgtgggtgagggcatggaggagggtgagttctccgaggcccgtgaggatatggctgccctggagaaggattatgaggaggtgggcatcgactcctatgaggacgaggatgagggagaagaataaagcagctgcctggagcctattcactatgtttattgcaaaatcctttcgaaataaacagtttccttgcacggtttcttgttccctctgagtgcttgagcttctgctgccttccccttcatgctgctgctgctctgtttgctgttcatgacccttatcccttccatcgctgaaggtgagacctgcaaaggggttcttgccaggcccaggaagcataaccccagggactttaaattgaagtcctagggttactcagtatagggaggaaatgaggaccaaaatccaggcacaaactgttgaaggatgagtcttcagctcctttccaagtaggagtataatccagtggtttctgtctttgaaagttagactgctaccctgttcttcctgctgcctctacatttaccaactctggaagcaaggcttggcccaggctcctctgtgcattatgagggtttgggagtggggctgggctggcccagagttcctgggcatggagccacgtcataagcttgggggatgggagggaacacaggcgatctcctagagttgtttgtgccactgcacctctgagcagctttgcatagcttcctgtcttgctgctttgctggagctggggctgtgccattaaaagtcaggtcatctcccctctgtttgtgatttctttctggcctcagcctctgtgctagctagtgggagactcctgctagggccctggggaaagcttcaactttgctaacaggagccccaggccccatgctgatgtcatactgtggggtagacatggttcgggggaggaggcttggatcacaaaagagcaggagatgccaaccctgcccttgcctttcctccctggtgattcagggaacagagcccttccctagggaacaggtttgaagcccagctaagacagggcccctgtttactcagcagagtaggcaggaagtggcagctggatactgccacaccacactgcctcattaatcattaaccatgtatgagcttgaacgatcagggagacacaggccaaaacagctgccgctgccacctccactcccctcgcccctaggctgaggatgggagacctgtaatctacctgtctcaaagcttcctcaggtgtctccacccagaggcccttgcctagcaaaccggctaggcagctttgactaagctactcaccccaggagtgaaggaaggaaagaactagttgagtgtttttagggggccctagttcttgacacaggcagatgccagcttgagcccaagcagctttaagttttgatctaagacaagctagaactgtccactgctaaccaacctcctgtagaatgaagtcacaccattgccgactctgcaccattcctccttcccaggcagttcgcctgaatatggcaacctgactttgggccccttgcacctcttctctcactccaggaacactgagactaagatctacaccaacctgcttccacttt

SEQ ID NO: 278170 - DNA, 992 bp, Homo sapiens
agcggcagttctcactgagacctgtcaccccgactcaacgtgagacgcaccgcccggactcaccatgcgtgaatgcatctcagtccacgtggggcaggcaggtgtccagatgggcaatgcctgctgggagctctattgcttggaacatgggattcagcctgatgggcagatgcccagtgacaagaccattggtggaggggacgactccttcaccaccttcttctgtgaaactggtgctggaaaacacgtaccccgggcagtttttgtggatctggagcctacggtcattgatgagatccgaaatggcccataccgacagctcttccacccagagcagctcatcactgggaaagaggatgctgccaacaactatgcccgtggtcactataccattggcaaggagatcattgacccagtgctggatcggatccgcaagctgtctgaccagtgcacaggacttcagggcttcctggtgttccacagctttggtgggggcactggctctggcttcacctcactcctgatggagcggctctctgttgactatggcaagaaatccaagctggaattctccatctacccagccccccaggtgtctacagccgtggtcgagccctacaactctatcctgaccacccacaccaccctggagcactcagactgtgccttcatggtggacaacgaagcaatctatgacatctgccgccgcaacctagacatcgagcgcccaacctacaccaacctcaatcgcctcattagccaaattgtctcctccatcacagcttctctgcgctttgacggggccctcaatgtggacctgacagagttccagaccaacctggtgccctaccctcattccctggcactatgccagtctttttgcggaaggttcccgagcgcgtgggggggatccatgcgttggcttccaccaagtaggggcccggggatgccggcgcgcgggtggccggttgttcgcccaaacctttggggcc

SEQ ID NO: 278171 - DNA, 2836 bp, Homo sapiens
ggactgcgcgggcggtttagcagcgtgaatgcatctcagtccacgtggggcaggcaggtgtccagatgggcaatgcctgctgggagctctattgcttggaacatgggattcagcctgatgggcagatgcccagtgacaagaccattggtggaggggacgactccttcaccaccttcttctgtgaaactggtgctggaaaacacgtaccccgggcagtttttgtggatctggagcctacggtcattgatgagatccgaaatggcccataccgacagctcttccacccagagcagctcatcactgggaaagaggatgctgccaacaactatgcccgtggtcactataccattggcaaggagatcattgacccagtgctggatcggatccgcaagctgtctgaccagtgcacaggacttcagggcttcctggtgttccacagctttggtgggggcactggctctggcttcacctcactcctgatggagcggctctctgttgactatggcaagaaatccaagctggaattctccatctacccagccccccaggtgtctacagccgtggtcgagccctacaactctatcctgaccacccacaccaccctggagcactcagactgtgccttcatggtggacaacgaagcaatctatgacatctgccgccgcaacctagacatcgagcgcccaacctacaccaacctcaatcgcctcattagccaaattgtctcctccatcacagcttctctgcgctttgacggggccctcaatgtggacctgacagagttccagaccaacctggtgccctaccctcgcatccacttccccctggccacctatgcaccagtcatctctgcagaaaaggcataccacgagcagctgtcggtggcagagatcaccaatgcctgctttgagcctgccaaccagatggtaaagtgtgatccccggcacggcaagtacatggcctgctgcctgctgtaccgtggagatgtggtgcccaaggatgtcaacgctgccattgccgccatcaagaccaagcgcagcattcagtttgtggactggtgccccacaggcttcaaggttggtatcaactaccagcctcccactgtggtgcctgggggtgacctggccaaggtgcagcgtgccgtgtgcatgctgagcaacacgaccgccatcgccgaggcctgggcccgcctggaccacaagttcgacctgatgtatgccaagagggcgtttgtgcactggtatgtgggtgagggcatggaggagggtgagttctccgaggcccgtgaggatatggctgccctggagaaggattatgaggaggtgggcatcgactcctatgaggacgaggatgagggagaagaataaagcagctgcctggagcctattcactatgtttattgcaaaatcctttcgaaataaacagtttccttgcacggtttcttgttccctctgagtgcttgagcttctgctgccttccccttcatgctgctgctgctctgtttgctgttcatgacccttatcccttccatcgctgaaggtgagacctgcaaaggggttcttgccaggcccaggaagcataaccccagggactttaaattgaagtcctagggttactcagtatagggaggaaatgaggaccaaaatccaggcacaaactgttgaaggatgagtcttcagctcctttccaagtaggagtataatccagtggtttctgtctttgaaagttagactgctaccctgttcttcctgctgcctctacatttaccaactctggaagcaaggcttggcccaggctcctctgtgcattatgagggtttgggagtggggctgggctggcccagagttcctgggcatggagccacgtcataagcttgggggatgggagggaacacaggcgatctcctagagttgtttgtgccactgcacctctgagcagctttgcatagcttcctgtcttgctgctttgctggagctggggctgtgccattaaaagtcaggtcatctcccctctgtttgtgatttctttctggcctcagcctctgtgctagctagtgggagactcctgctagggccctggggaaagcttcaactttgctaacaggagccccaggccccatgctgatgtcatactgtggggtagacatggttcgggggaggaggcttggatcacaaaagagcaggagatgccaaccctgcccttgcctttcctccctggtgattcagggaacagagcccttccctagggaacaggtttgaagcccagctaagacagggcccctgtttactcagcagagtaggcaggaagtggcagctggatactgccacaccacactgcctcattaatcattaaccatgtatgagcttgaacgatcagggagacacaggccaaaacagctgccgctgccacctccactcccctcgcccctaggctgaggatgggagacctgtaatctacctgtctcaaagcttcctcaggtgtctccacccagaggcccttgcctagcaaaccggctaggcagctttgactaagctactcaccccaggagtgaaggaaggaaagaactagttgagtgtttttagggggccctagttcttgacacaggcagatgccagcttgagcccaagcagctttaagttttgatctaagacaagctagaactgtccactgctaaccaacctcctgtagaatgaagtcacaccattgccgactctgcaccattcctccttcccaggcagttcgcctgaatatggcaacctgactttgggccccttgcacctcttctctcactccaggaacactgagactaagatctacaccaacctgcttccacttt

SEQ ID NO: 278172 - DNA, 3083 bp, Homo sapiens
cacagccggcccgagtctcctgggaggcagggctggaagggcaggggtgaaggccagctgtggccctatgggaaggaccgcctcgcctgctcccgacctaagtcagaacacctggatgaccggtgcctccaggacgcaggtgcaggtgagactcgccctgccacagcaccctgcatctccgcggaggccctcgggagcccagcgtgtctgctcaaaacgaggaaagaatggttaaagcccgaatcgcgactcttaatcccagcgggacagcgtgaatgcatctcagtccacgtggggcaggcaggtgtccagatgggcaatgcctgctgggagctctattgcttggaacatgggattcagcctgatgggcagatgcccagtgacaagaccattggtggaggggacgactccttcaccaccttcttctgtgaaactggtgctggaaaacacgtaccccgggcagtttttgtggatctggagcctacggtcattgatgagatccgaaatggcccataccgacagctcttccacccagagcagctcatcactgggaaagaggatgctgccaacaactatgcccgtggtcactataccattggcaaggagatcattgacccagtgctggatcggatccgcaagctgtctgaccagtgcacaggacttcagggcttcctggtgttccacagctttggtgggggcactggctctggcttcacctcactcctgatggagcggctctctgttgactatggcaagaaatccaagctggaattctccatctacccagccccccaggtgtctacagccgtggtcgagccctacaactctatcctgaccacccacaccaccctggagcactcagactgtgccttcatggtggacaacgaagcaatctatgacatctgccgccgcaacctagacatcgagcgcccaacctacaccaacctcaatcgcctcattagccaaattgtctcctccatcacagcttctctgcgctttgacggggccctcaatgtggacctgacagagttccagaccaacctggtgccctaccctcgcatccacttccccctggccacctatgcaccagtcatctctgcagaaaaggcataccacgagcagctgtcggtggcagagatcaccaatgcctgctttgagcctgccaaccagatggtaaagtgtgatccccggcacggcaagtacatggcctgctgcctgctgtaccgtggagatgtggtgcccaaggatgtcaacgctgccattgccgccatcaagaccaagcgcagcattcagtttgtggactggtgccccacaggcttcaaggttggtatcaactaccagcctcccactgtggtgcctgggggtgacctggccaaggtgcagcgtgccgtgtgcatgctgagcaacacgaccgccatcgccgaggcctgggcccgcctggaccacaagttcgacctgatgtatgccaagagggcgtttgtgcactggtatgtgggtgagggcatggaggagggtgagttctccgaggcccgtgaggatatggctgccctggagaaggattatgaggaggtgggcatcgactcctatgaggacgaggatgagggagaagaataaagcagctgcctggagcctattcactatgtttattgcaaaatcctttcgaaataaacagtttccttgcacggtttcttgttccctctgagtgcttgagcttctgctgccttccccttcatgctgctgctgctctgtttgctgttcatgacccttatcccttccatcgctgaaggtgagacctgcaaaggggttcttgccaggcccaggaagcataaccccagggactttaaattgaagtcctagggttactcagtatagggaggaaatgaggaccaaaatccaggcacaaactgttgaaggatgagtcttcagctcctttccaagtaggagtataatccagtggtttctgtctttgaaagttagactgctaccctgttcttcctgctgcctctacatttaccaactctggaagcaaggcttggcccaggctcctctgtgcattatgagggtttgggagtggggctgggctggcccagagttcctgggcatggagccacgtcataagcttgggggatgggagggaacacaggcgatctcctagagttgtttgtgccactgcacctctgagcagctttgcatagcttcctgtcttgctgctttgctggagctggggctgtgccattaaaagtcaggtcatctcccctctgtttgtgatttctttctggcctcagcctctgtgctagctagtgggagactcctgctagggccctggggaaagcttcaactttgctaacaggagccccaggccccatgctgatgtcatactgtggggtagacatggttcgggggaggaggcttggatcacaaaagagcaggagatgccaaccctgcccttgcctttcctccctggtgattcagggaacagagcccttccctagggaacaggtttgaagcccagctaagacagggcccctgtttactcagcagagtaggcaggaagtggcagctggatactgccacaccacactgcctcattaatcattaaccatgtatgagcttgaacgatcagggagacacaggccaaaacagctgccgctgccacctccactcccctcgcccctaggctgaggatgggagacctgtaatctacctgtctcaaagcttcctcaggtgtctccacccagaggcccttgcctagcaaaccggctaggcagctttgactaagctactcaccccaggagtgaaggaaggaaagaactagttgagtgtttttagggggccctagttcttgacacaggcagatgccagcttgagcccaagcagctttaagttttgatctaagacaagctagaactgtccactgctaaccaacctcctgtagaatgaagtcacaccattgccgactctgcaccattcctccttcccaggcagttcgcctgaatatggcaacctgactttgggccccttgcacctcttctctcactccaggaacactgagactaagatctacaccaacctgcttccacttt

SEQ ID NO: 278173 - DNA, 2834 bp, Homo sapiens
tcccctctctctatccctcagcgtgaatgcatctcagtccacgtggggcaggcaggtgtccagatgggcaatgcctgctgggagctctattgcttggaacatgggattcagcctgatgggcagatgcccagtgacaagaccattggtggaggggacgactccttcaccaccttcttctgtgaaactggtgctggaaaacacgtaccccgggcagtttttgtggatctggagcctacggtcattgatgagatccgaaatggcccataccgacagctcttccacccagagcagctcatcactgggaaagaggatgctgccaacaactatgcccgtggtcactataccattggcaaggagatcattgacccagtgctggatcggatccgcaagctgtctgaccagtgcacaggacttcagggcttcctggtgttccacagctttggtgggggcactggctctggcttcacctcactcctgatggagcggctctctgttgactatggcaagaaatccaagctggaattctccatctacccagccccccaggtgtctacagccgtggtcgagccctacaactctatcctgaccacccacaccaccctggagcactcagactgtgccttcatggtggacaacgaagcaatctatgacatctgccgccgcaacctagacatcgagcgcccaacctacaccaacctcaatcgcctcattagccaaattgtctcctccatcacagcttctctgcgctttgacggggccctcaatgtggacctgacagagttccagaccaacctggtgccctaccctcgcatccacttccccctggccacctatgcaccagtcatctctgcagaaaaggcataccacgagcagctgtcggtggcagagatcaccaatgcctgctttgagcctgccaaccagatggtaaagtgtgatccccggcacggcaagtacatggcctgctgcctgctgtaccgtggagatgtggtgcccaaggatgtcaacgctgccattgccgccatcaagaccaagcgcagcattcagtttgtggactggtgccccacaggcttcaaggttggtatcaactaccagcctcccactgtggtgcctgggggtgacctggccaaggtgcagcgtgccgtgtgcatgctgagcaacacgaccgccatcgccgaggcctgggcccgcctggaccacaagttcgacctgatgtatgccaagagggcgtttgtgcactggtatgtgggtgagggcatggaggagggtgagttctccgaggcccgtgaggatatggctgccctggagaaggattatgaggaggtgggcatcgactcctatgaggacgaggatgagggagaagaataaagcagctgcctggagcctattcactatgtttattgcaaaatcctttcgaaataaacagtttccttgcacggtttcttgttccctctgagtgcttgagcttctgctgccttccccttcatgctgctgctgctctgtttgctgttcatgacccttatcccttccatcgctgaaggtgagacctgcaaaggggttcttgccaggcccaggaagcataaccccagggactttaaattgaagtcctagggttactcagtatagggaggaaatgaggaccaaaatccaggcacaaactgttgaaggatgagtcttcagctcctttccaagtaggagtataatccagtggtttctgtctttgaaagttagactgctaccctgttcttcctgctgcctctacatttaccaactctggaagcaaggcttggcccaggctcctctgtgcattatgagggtttgggagtggggctgggctggcccagagttcctgggcatggagccacgtcataagcttgggggatgggagggaacacaggcgatctcctagagttgtttgtgccactgcacctctgagcagctttgcatagcttcctgtcttgctgctttgctggagctggggctgtgccattaaaagtcaggtcatctcccctctgtttgtgatttctttctggcctcagcctctgtgctagctagtgggagactcctgctagggccctggggaaagcttcaactttgctaacaggagccccaggccccatgctgatgtcatactgtggggtagacatggttcgggggaggaggcttggatcacaaaagagcaggagatgccaaccctgcccttgcctttcctccctggtgattcagggaacagagcccttccctagggaacaggtttgaagcccagctaagacagggcccctgtttactcagcagagtaggcaggaagtggcagctggatactgccacaccacactgcctcattaatcattaaccatgtatgagcttgaacgatcagggagacacaggccaaaacagctgccgctgccacctccactcccctcgcccctaggctgaggatgggagacctgtaatctacctgtctcaaagcttcctcaggtgtctccacccagaggcccttgcctagcaaaccggctaggcagctttgactaagctactcaccccaggagtgaaggaaggaaagaactagttgagtgtttttagggggccctagttcttgacacaggcagatgccagcttgagcccaagcagctttaagttttgatctaagacaagctagaactgtccactgctaaccaacctcctgtagaatgaagtcacaccattgccgactctgcaccattcctccttcccaggcagttcgcctgaatatggcaacctgactttgggccccttgcacctcttctctcactccaggaacactgagactaagatctacaccaacctgcttccacttt

SEQ ID NO: 278174 - DNA, 2899 bp, Homo sapiens
ggctgggctgcaggatggcgcccatcctgcccgggacaaggcgggtcacctctggggcctcaccgcaggttccacttcctttctggcgtgaatgcatctcagtccacgtggggcaggcaggtgtccagatgggcaatgcctgctgggagctctattgcttggaacatgggattcagcctgatgggcagatgcccagtgacaagaccattggtggaggggacgactccttcaccaccttcttctgtgaaactggtgctggaaaacacgtaccccgggcagtttttgtggatctggagcctacggtcattgatgagatccgaaatggcccataccgacagctcttccacccagagcagctcatcactgggaaagaggatgctgccaacaactatgcccgtggtcactataccattggcaaggagatcattgacccagtgctggatcggatccgcaagctgtctgaccagtgcacaggacttcagggcttcctggtgttccacagctttggtgggggcactggctctggcttcacctcactcctgatggagcggctctctgttgactatggcaagaaatccaagctggaattctccatctacccagccccccaggtgtctacagccgtggtcgagccctacaactctatcctgaccacccacaccaccctggagcactcagactgtgccttcatggtggacaacgaagcaatctatgacatctgccgccgcaacctagacatcgagcgcccaacctacaccaacctcaatcgcctcattagccaaattgtctcctccatcacagcttctctgcgctttgacggggccctcaatgtggacctgacagagttccagaccaacctggtgccctaccctcgcatccacttccccctggccacctatgcaccagtcatctctgcagaaaaggcataccacgagcagctgtcggtggcagagatcaccaatgcctgctttgagcctgccaaccagatggtaaagtgtgatccccggcacggcaagtacatggcctgctgcctgctgtaccgtggagatgtggtgcccaaggatgtcaacgctgccattgccgccatcaagaccaagcgcagcattcagtttgtggactggtgccccacaggcttcaaggttggtatcaactaccagcctcccactgtggtgcctgggggtgacctggccaaggtgcagcgtgccgtgtgcatgctgagcaacacgaccgccatcgccgaggcctgggcccgcctggaccacaagttcgacctgatgtatgccaagagggcgtttgtgcactggtatgtgggtgagggcatggaggagggtgagttctccgaggcccgtgaggatatggctgccctggagaaggattatgaggaggtgggcatcgactcctatgaggacgaggatgagggagaagaataaagcagctgcctggagcctattcactatgtttattgcaaaatcctttcgaaataaacagtttccttgcacggtttcttgttccctctgagtgcttgagcttctgctgccttccccttcatgctgctgctgctctgtttgctgttcatgacccttatcccttccatcgctgaaggtgagacctgcaaaggggttcttgccaggcccaggaagcataaccccagggactttaaattgaagtcctagggttactcagtatagggaggaaatgaggaccaaaatccaggcacaaactgttgaaggatgagtcttcagctcctttccaagtaggagtataatccagtggtttctgtctttgaaagttagactgctaccctgttcttcctgctgcctctacatttaccaactctggaagcaaggcttggcccaggctcctctgtgcattatgagggtttgggagtggggctgggctggcccagagttcctgggcatggagccacgtcataagcttgggggatgggagggaacacaggcgatctcctagagttgtttgtgccactgcacctctgagcagctttgcatagcttcctgtcttgctgctttgctggagctggggctgtgccattaaaagtcaggtcatctcccctctgtttgtgatttctttctggcctcagcctctgtgctagctagtgggagactcctgctagggccctggggaaagcttcaactttgctaacaggagccccaggccccatgctgatgtcatactgtggggtagacatggttcgggggaggaggcttggatcacaaaagagcaggagatgccaaccctgcccttgcctttcctccctggtgattcagggaacagagcccttccctagggaacaggtttgaagcccagctaagacagggcccctgtttactcagcagagtaggcaggaagtggcagctggatactgccacaccacactgcctcattaatcattaaccatgtatgagcttgaacgatcagggagacacaggccaaaacagctgccgctgccacctccactcccctcgcccctaggctgaggatgggagacctgtaatctacctgtctcaaagcttcctcaggtgtctccacccagaggcccttgcctagcaaaccggctaggcagctttgactaagctactcaccccaggagtgaaggaaggaaagaactagttgagtgtttttagggggccctagttcttgacacaggcagatgccagcttgagcccaagcagctttaagttttgatctaagacaagctagaactgtccactgctaaccaacctcctgtagaatgaagtcacaccattgccgactctgcaccattcctccttcccaggcagttcgcctgaatatggcaacctgactttgggccccttgcacctcttctctcactccaggaacactgagactaagatctacaccaacctgcttccacttt

SEQ ID NO: 278175 - DNA, 2856 bp, Homo sapiens
gcaccaaggttaaccggaaaacccaccgcccggactcaccatgcgtgaatgcatctcagtccacgtggggcaggcaggtgtccagatgggcaatgcctgctgggagctctattgcttggaacatgggattcagcctgatgggcagatgcccagtgacaagaccattggtggaggggacgactccttcaccaccttcttctgtgaaactggtgctggaaaacacgtaccccgggcagtttttgtggatctggagcctacggtcattgatgagatccgaaatggcccataccgacagctcttccacccagagcagctcatcactgggaaagaggatgctgccaacaactatgcccgtggtcactataccattggcaaggagatcattgacccagtgctggatcggatccgcaagctgtctgaccagtgcacaggacttcagggcttcctggtgttccacagctttggtgggggcactggctctggcttcacctcactcctgatggagcggctctctgttgactatggcaagaaatccaagctggaattctccatctacccagccccccaggtgtctacagccgtggtcgagccctacaactctatcctgaccacccacaccaccctggagcactcagactgtgccttcatggtggacaacgaagcaatctatgacatctgccgccgcaacctagacatcgagcgcccaacctacaccaacctcaatcgcctcattagccaaattgtctcctccatcacagcttctctgcgctttgacggggccctcaatgtggacctgacagagttccagaccaacctggtgccctaccctcgcatccacttccccctggccacctatgcaccagtcatctctgcagaaaaggcataccacgagcagctgtcggtggcagagatcaccaatgcctgctttgagcctgccaaccagatggtaaagtgtgatccccggcacggcaagtacatggcctgctgcctgctgtaccgtggagatgtggtgcccaaggatgtcaacgctgccattgccgccatcaagaccaagcgcagcattcagtttgtggactggtgccccacaggcttcaaggttggtatcaactaccagcctcccactgtggtgcctgggggtgacctggccaaggtgcagcgtgccgtgtgcatgctgagcaacacgaccgccatcgccgaggcctgggcccgcctggaccacaagttcgacctgatgtatgccaagagggcgtttgtgcactggtatgtgggtgagggcatggaggagggtgagttctccgaggcccgtgaggatatggctgccctggagaaggattatgaggaggtgggcatcgactcctatgaggacgaggatgagggagaagaataaagcagctgcctggagcctattcactatgtttattgcaaaatcctttcgaaataaacagtttccttgcacggtttcttgttccctctgagtgcttgagcttctgctgccttccccttcatgctgctgctgctctgtttgctgttcatgacccttatcccttccatcgctgaaggtgagacctgcaaaggggttcttgccaggcccaggaagcataaccccagggactttaaattgaagtcctagggttactcagtatagggaggaaatgaggaccaaaatccaggcacaaactgttgaaggatgagtcttcagctcctttccaagtaggagtataatccagtggtttctgtctttgaaagttagactgctaccctgttcttcctgctgcctctacatttaccaactctggaagcaaggcttggcccaggctcctctgtgcattatgagggtttgggagtggggctgggctggcccagagttcctgggcatggagccacgtcataagcttgggggatgggagggaacacaggcgatctcctagagttgtttgtgccactgcacctctgagcagctttgcatagcttcctgtcttgctgctttgctggagctggggctgtgccattaaaagtcaggtcatctcccctctgtttgtgatttctttctggcctcagcctctgtgctagctagtgggagactcctgctagggccctggggaaagcttcaactttgctaacaggagccccaggccccatgctgatgtcatactgtggggtagacatggttcgggggaggaggcttggatcacaaaagagcaggagatgccaaccctgcccttgcctttcctccctggtgattcagggaacagagcccttccctagggaacaggtttgaagcccagctaagacagggcccctgtttactcagcagagtaggcaggaagtggcagctggatactgccacaccacactgcctcattaatcattaaccatgtatgagcttgaacgatcagggagacacaggccaaaacagctgccgctgccacctccactcccctcgcccctaggctgaggatgggagacctgtaatctacctgtctcaaagcttcctcaggtgtctccacccagaggcccttgcctagcaaaccggctaggcagctttgactaagctactcaccccaggagtgaaggaaggaaagaactagttgagtgtttttagggggccctagttcttgacacaggcagatgccagcttgagcccaagcagctttaagttttgatctaagacaagctagaactgtccactgctaaccaacctcctgtagaatgaagtcacaccattgccgactctgcaccattcctccttcccaggcagttcgcctgaatatggcaacctgactttgggccccttgcacctcttctctcactccaggaacactgagactaagatctacaccaacctgcttccacttt

SEQ ID NO: 278176 - DNA, 2854 bp, Homo sapiens
gtcatttcgcaacctgactctcttaactaccacggctaacgcgtgaatgcatctcagtccacgtggggcaggcaggtgtccagatgggcaatgcctgctgggagctctattgcttggaacatgggattcagcctgatgggcagatgcccagtgacaagaccattggtggaggggacgactccttcaccaccttcttctgtgaaactggtgctggaaaacacgtaccccgggcagtttttgtggatctggagcctacggtcattgatgagatccgaaatggcccataccgacagctcttccacccagagcagctcatcactgggaaagaggatgctgccaacaactatgcccgtggtcactataccattggcaaggagatcattgacccagtgctggatcggatccgcaagctgtctgaccagtgcacaggacttcagggcttcctggtgttccacagctttggtgggggcactggctctggcttcacctcactcctgatggagcggctctctgttgactatggcaagaaatccaagctggaattctccatctacccagccccccaggtgtctacagccgtggtcgagccctacaactctatcctgaccacccacaccaccctggagcactcagactgtgccttcatggtggacaacgaagcaatctatgacatctgccgccgcaacctagacatcgagcgcccaacctacaccaacctcaatcgcctcattagccaaattgtctcctccatcacagcttctctgcgctttgacggggccctcaatgtggacctgacagagttccagaccaacctggtgccctaccctcgcatccacttccccctggccacctatgcaccagtcatctctgcagaaaaggcataccacgagcagctgtcggtggcagagatcaccaatgcctgctttgagcctgccaaccagatggtaaagtgtgatccccggcacggcaagtacatggcctgctgcctgctgtaccgtggagatgtggtgcccaaggatgtcaacgctgccattgccgccatcaagaccaagcgcagcattcagtttgtggactggtgccccacaggcttcaaggttggtatcaactaccagcctcccactgtggtgcctgggggtgacctggccaaggtgcagcgtgccgtgtgcatgctgagcaacacgaccgccatcgccgaggcctgggcccgcctggaccacaagttcgacctgatgtatgccaagagggcgtttgtgcactggtatgtgggtgagggcatggaggagggtgagttctccgaggcccgtgaggatatggctgccctggagaaggattatgaggaggtgggcatcgactcctatgaggacgaggatgagggagaagaataaagcagctgcctggagcctattcactatgtttattgcaaaatcctttcgaaataaacagtttccttgcacggtttcttgttccctctgagtgcttgagcttctgctgccttccccttcatgctgctgctgctctgtttgctgttcatgacccttatcccttccatcgctgaaggtgagacctgcaaaggggttcttgccaggcccaggaagcataaccccagggactttaaattgaagtcctagggttactcagtatagggaggaaatgaggaccaaaatccaggcacaaactgttgaaggatgagtcttcagctcctttccaagtaggagtataatccagtggtttctgtctttgaaagttagactgctaccctgttcttcctgctgcctctacatttaccaactctggaagcaaggcttggcccaggctcctctgtgcattatgagggtttgggagtggggctgggctggcccagagttcctgggcatggagccacgtcataagcttgggggatgggagggaacacaggcgatctcctagagttgtttgtgccactgcacctctgagcagctttgcatagcttcctgtcttgctgctttgctggagctggggctgtgccattaaaagtcaggtcatctcccctctgtttgtgatttctttctggcctcagcctctgtgctagctagtgggagactcctgctagggccctggggaaagcttcaactttgctaacaggagccccaggccccatgctgatgtcatactgtggggtagacatggttcgggggaggaggcttggatcacaaaagagcaggagatgccaaccctgcccttgcctttcctccctggtgattcagggaacagagcccttccctagggaacaggtttgaagcccagctaagacagggcccctgtttactcagcagagtaggcaggaagtggcagctggatactgccacaccacactgcctcattaatcattaaccatgtatgagcttgaacgatcagggagacacaggccaaaacagctgccgctgccacctccactcccctcgcccctaggctgaggatgggagacctgtaatctacctgtctcaaagcttcctcaggtgtctccacccagaggcccttgcctagcaaaccggctaggcagctttgactaagctactcaccccaggagtgaaggaaggaaagaactagttgagtgtttttagggggccctagttcttgacacaggcagatgccagcttgagcccaagcagctttaagttttgatctaagacaagctagaactgtccactgctaaccaacctcctgtagaatgaagtcacaccattgccgactctgcaccattcctccttcccaggcagttcgcctgaatatggcaacctgactttgggccccttgcacctcttctctcactccaggaacactgagactaagatctacaccaacctgcttccacttt

SEQ ID NO: 278177 - DNA, 2653 bp, Homo sapiens
  misc_feature (16)..(16): n is a, c, g, or t
gctggggtgaatcggncgagggtacccgactcaacgtgagacgcaccgcccggactcaccatgatgagatccgaaatggcccataccgacagctcttccacccagagcagctcatcactgggaaagaggatgctgccaacaactatgcccgtggtcactataccattggcaaggagatcattgacccagtgctggatcggatccgcaagctgtctgaccagtgcacaggacttcagggcttcctggtgttccacagctttggtgggggcactggctctggcttcacctcactcctgatggagcggctctctgttgactatggcaagaaatccaagctggaattctccatctacccagccccccaggtgtctacagccgtggtcgagccctacaactctatcctgaccacccacaccaccctggagcactcagactgtgccttcatggtggacaacgaagcaatctatgacatctgccgccgcaacctagacatcgagcgcccaacctacaccaacctcaatcgcctcattagccaaattgtctcctccatcacagcttctctgcgctttgacggggccctcaatgtggacctgacagagttccagaccaacctggtgccctaccctcgcatccacttccccctggccacctatgcaccagtcatctctgcagaaaaggcataccacgagcagctgtcggtggcagagatcaccaatgcctgctttgagcctgccaaccagatggtaaagtgtgatccccggcacggcaagtacatggcctgctgcctgctgtaccgtggagatgtggtgcccaaggatgtcaacgctgccattgccgccatcaagaccaagcgcagcattcagtttgtggactggtgccccacaggcttcaaggttggtatcaactaccagcctcccactgtggtgcctgggggtgacctggccaaggtgcagcgtgccgtgtgcatgctgagcaacacgaccgccatcgccgaggcctgggcccgcctggaccacaagttcgacctgatgtatgccaagagggcgtttgtgcactggtatgtgggtgagggcatggaggagggtgagttctccgaggcccgtgaggatatggctgccctggagaaggattatgaggaggtgggcatcgactcctatgaggacgaggatgagggagaagaataaagcagctgcctggagcctattcactatgtttattgcaaaatcctttcgaaataaacagtttccttgcacggtttcttgttccctctgagtgcttgagcttctgctgccttccccttcatgctgctgctgctctgtttgctgttcatgacccttatcccttccatcgctgaaggtgagacctgcaaaggggttcttgccaggcccaggaagcataaccccagggactttaaattgaagtcctagggttactcagtatagggaggaaatgaggaccaaaatccaggcacaaactgttgaaggatgagtcttcagctcctttccaagtaggagtataatccagtggtttctgtctttgaaagttagactgctaccctgttcttcctgctgcctctacatttaccaactctggaagcaaggcttggcccaggctcctctgtgcattatgagggtttgggagtggggctgggctggcccagagttcctgggcatggagccacgtcataagcttgggggatgggagggaacacaggcgatctcctagagttgtttgtgccactgcacctctgagcagctttgcatagcttcctgtcttgctgctttgctggagctggggctgtgccattaaaagtcaggtcatctcccctctgtttgtgatttctttctggcctcagcctctgtgctagctagtgggagactcctgctagggccctggggaaagcttcaactttgctaacaggagccccaggccccatgctgatgtcatactgtggggtagacatggttcgggggaggaggcttggatcacaaaagagcaggagatgccaaccctgcccttgcctttcctccctggtgattcagggaacagagcccttccctagggaacaggtttgaagcccagctaagacagggcccctgtttactcagcagagtaggcaggaagtggcagctggatactgccacaccacactgcctcattaatcattaaccatgtatgagcttgaacgatcagggagacacaggccaaaacagctgccgctgccacctccactcccctcgcccctaggctgaggatgggagacctgtaatctacctgtctcaaagcttcctcaggtgtctccacccagaggcccttgcctagcaaaccggctaggcagctttgactaagctactcaccccaggagtgaaggaaggaaagaactagttgagtgtttttagggggccctagttcttgacacaggcagatgccagcttgagcccaagcagctttaagttttgatctaagacaagctagaactgtccactgctaaccaacctcctgtagaatgaagtcacaccattgccgactctgcaccattcctccttcccaggcagttcgcctgaatatggcaacctgactttgggccccttgcacctcttctctcactccaggaacactgagactaagatctacaccaacctgcttccacttt

SEQ ID NO: 278178 - DNA, 2594 bp, Homo sapiens
ccggtccctatccggtccggggttgaccgacagctcttccacccagagcagctcatcactgggaaagaggatgctgccaacaactatgcccgtggtcactataccattggcaaggagatcattgacccagtgctggatcggatccgcaagctgtctgaccagtgcacaggacttcagggcttcctggtgttccacagctttggtgggggcactggctctggcttcacctcactcctgatggagcggctctctgttgactatggcaagaaatccaagctggaattctccatctacccagccccccaggtgtctacagccgtggtcgagccctacaactctatcctgaccacccacaccaccctggagcactcagactgtgccttcatggtggacaacgaagcaatctatgacatctgccgccgcaacctagacatcgagcgcccaacctacaccaacctcaatcgcctcattagccaaattgtctcctccatcacagcttctctgcgctttgacggggccctcaatgtggacctgacagagttccagaccaacctggtgccctaccctcgcatccacttccccctggccacctatgcaccagtcatctctgcagaaaaggcataccacgagcagctgtcggtggcagagatcaccaatgcctgctttgagcctgccaaccagatggtaaagtgtgatccccggcacggcaagtacatggcctgctgcctgctgtaccgtggagatgtggtgcccaaggatgtcaacgctgccattgccgccatcaagaccaagcgcagcattcagtttgtggactggtgccccacaggcttcaaggttggtatcaactaccagcctcccactgtggtgcctgggggtgacctggccaaggtgcagcgtgccgtgtgcatgctgagcaacacgaccgccatcgccgaggcctgggcccgcctggaccacaagttcgacctgatgtatgccaagagggcgtttgtgcactggtatgtgggtgagggcatggaggagggtgagttctccgaggcccgtgaggatatggctgccctggagaaggattatgaggaggtgggcatcgactcctatgaggacgaggatgagggagaagaataaagcagctgcctggagcctattcactatgtttattgcaaaatcctttcgaaataaacagtttccttgcacggtttcttgttccctctgagtgcttgagcttctgctgccttccccttcatgctgctgctgctctgtttgctgttcatgacccttatcccttccatcgctgaaggtgagacctgcaaaggggttcttgccaggcccaggaagcataaccccagggactttaaattgaagtcctagggttactcagtatagggaggaaatgaggaccaaaatccaggcacaaactgttgaaggatgagtcttcagctcctttccaagtaggagtataatccagtggtttctgtctttgaaagttagactgctaccctgttcttcctgctgcctctacatttaccaactctggaagcaaggcttggcccaggctcctctgtgcattatgagggtttgggagtggggctgggctggcccagagttcctgggcatggagccacgtcataagcttgggggatgggagggaacacaggcgatctcctagagttgtttgtgccactgcacctctgagcagctttgcatagcttcctgtcttgctgctttgctggagctggggctgtgccattaaaagtcaggtcatctcccctctgtttgtgatttctttctggcctcagcctctgtgctagctagtgggagactcctgctagggccctggggaaagcttcaactttgctaacaggagccccaggccccatgctgatgtcatactgtggggtagacatggttcgggggaggaggcttggatcacaaaagagcaggagatgccaaccctgcccttgcctttcctccctggtgattcagggaacagagcccttccctagggaacaggtttgaagcccagctaagacagggcccctgtttactcagcagagtaggcaggaagtggcagctggatactgccacaccacactgcctcattaatcattaaccatgtatgagcttgaacgatcagggagacacaggccaaaacagctgccgctgccacctccactcccctcgcccctaggctgaggatgggagacctgtaatctacctgtctcaaagcttcctcaggtgtctccacccagaggcccttgcctagcaaaccggctaggcagctttgactaagctactcaccccaggagtgaaggaaggaaagaactagttgagtgtttttagggggccctagttcttgacacaggcagatgccagcttgagcccaagcagctttaagttttgatctaagacaagctagaactgtccactgctaaccaacctcctgtagaatgaagtcacaccattgccgactctgcaccattcctccttcccaggcagttcgcctgaatatggcaacctgactttgggccccttgcacctcttctctcactccaggaacactgagactaagatctacaccaacctgcttccacttt

SEQ ID NO: 278179 - DNA, 3121 bp, Homo sapiens
agcggcagttctcactgagacctgtcaccccgactcaacgtgagacgcaccgcccggactcaccatgcgtgaatgcatctcagtccacgtggggcaggcaggtgtccagatgggcaatgcctgctgggagctctattgcttggaacatgggattcagcctgatgggcagatgcccagtgacaagaccattggtggaggggacgactccttcaccaccttcttctgtgaaactggtgctggaaaacacgtaccccgggcagtttttgtggatctggagcctacggtcattgatgagatccgaaatggcccataccgacagctcttccacccagagcagctcatcactgggaaagaggatgctgccaacaactatgcccgtggtcactataccattggcaaggagatcattgacccagtgctggatcggatccgcaagctggtgagagtgtgtcttgggagggagggaacttttgagactgtgctaatggtcaggaatattttttttcagatcctttcaggaggtcatctctaactatacatggtctcgagtgtggtgctgctatggcatcctcagtatttgccctgactgctgatgtatcttacgctttatggagccaggtgatagagtccctcaggcccctcccctacctaaactgttctttctcgttcttgcctttcagtctgaccagtgcacaggacttcagggcttcctggtgttccacagctttggtgggggcactggctctggcttcacctcactcctgatggagcggctctctgttgactatggcaagaaatccaagctggaattctccatctacccagccccccaggtgtctacagccgtggtcgagccctacaactctatcctgaccacccacaccaccctggagcactcagactgtgccttcatggtggacaacgaagcaatctatgacatctgccgccgcaacctagacatcgagcgcccaacctacaccaacctcaatcgcctcattagccaaattgtctcctccatcacagcttctctgcgctttgacggggccctcaatgtggacctgacagagttccagaccaacctggtgccctaccctcgcatccacttccccctggccacctatgcaccagtcatctctgcagaaaaggcataccacgagcagctgtcggtggcagagatcaccaatgcctgctttgagcctgccaaccagatggtaaagtgtgatccccggcacggcaagtacatggcctgctgcctgctgtaccgtggagatgtggtgcccaaggatgtcaacgctgccattgccgccatcaagaccaagcgcagcattcagtttgtggactggtgccccacaggcttcaaggttggtatcaactaccagcctcccactgtggtgcctgggggtgacctggccaaggtgcagcgtgccgtgtgcatgctgagcaacacgaccgccatcgccgaggcctgggcccgcctggaccacaagttcgacctgatgtatgccaagagggcgtttgtgcactggtatgtgggtgagggcatggaggagggtgagttctccgaggcccgtgaggatatggctgccctggagaaggattatgaggaggtgggcatcgactcctatgaggacgaggatgagggagaagaataaagcagctgcctggagcctattcactatgtttattgcaaaatcctttcgaaataaacagtttccttgcacggtttcttgttccctctgagtgcttgagcttctgctgccttccccttcatgctgctgctgctctgtttgctgttcatgacccttatcccttccatcgctgaaggtgagacctgcaaaggggttcttgccaggcccaggaagcataaccccagggactttaaattgaagtcctagggttactcagtatagggaggaaatgaggaccaaaatccaggcacaaactgttgaaggatgagtcttcagctcctttccaagtaggagtataatccagtggtttctgtctttgaaagttagactgctaccctgttcttcctgctgcctctacatttaccaactctggaagcaaggcttggcccaggctcctctgtgcattatgagggtttgggagtggggctgggctggcccagagttcctgggcatggagccacgtcataagcttgggggatgggagggaacacaggcgatctcctagagttgtttgtgccactgcacctctgagcagctttgcatagcttcctgtcttgctgctttgctggagctggggctgtgccattaaaagtcaggtcatctcccctctgtttgtgatttctttctggcctcagcctctgtgctagctagtgggagactcctgctagggccctggggaaagcttcaactttgctaacaggagccccaggccccatgctgatgtcatactgtggggtagacatggttcgggggaggaggcttggatcacaaaagagcaggagatgccaaccctgcccttgcctttcctccctggtgattcagggaacagagcccttccctagggaacaggtttgaagcccagctaagacagggcccctgtttactcagcagagtaggcaggaagtggcagctggatactgccacaccacactgcctcattaatcattaaccatgtatgagcttgaacgatcagggagacacaggccaaaacagctgccgctgccacctccactcccctcgcccctaggctgaggatgggagacctgtaatctacctgtctcaaagcttcctcaggtgtctccacccagaggcccttgcctagcaaaccggctaggcagctttgactaagctactcaccccaggagtgaaggaaggaaagaactagttgagtgtttttagggggccctagttcttgacacaggcagatgccagcttgagcccaagcagctttaagttttgatctaagacaagctagaactgtccactgctaaccaacctcctgtagaatgaagtcacaccattgccgactctgcaccattcctccttcccaggcagttcgcctgaatatggcaacctgactttgggccccttgcacctcttctctcactccaggaacactgagactaagatctacaccaacctgcttccacttt

SEQ ID NO: 278180 - DNA, 2532 bp, Homo sapiens
taggcagtaactatacggttctaaggttaagctgcattagtgaatcggcagtacgaggattgacccagtgctggatcggatccgcaagctgtctgaccagtgcacaggacttcagggcttcctggtgttccacagctttggtgggggcactggctctggcttcacctcactcctgatggagcggctctctgttgactatggcaagaaatccaagctggaattctccatctacccagccccccaggtgtctacagccgtggtcgagccctacaactctatcctgaccacccacaccaccctggagcactcagactgtgccttcatggtggacaacgaagcaatctatgacatctgccgccgcaacctagacatcgagcgcccaacctacaccaacctcaatcgcctcattagccaaattgtctcctccatcacagcttctctgcgctttgacggggccctcaatgtggacctgacagagttccagaccaacctggtgccctaccctcgcatccacttccccctggccacctatgcaccagtcatctctgcagaaaaggcataccacgagcagctgtcggtggcagagatcaccaatgcctgctttgagcctgccaaccagatggtaaagtgtgatccccggcacggcaagtacatggcctgctgcctgctgtaccgtggagatgtggtgcccaaggatgtcaacgctgccattgccgccatcaagaccaagcgcagcattcagtttgtggactggtgccccacaggcttcaaggttggtatcaactaccagcctcccactgtggtgcctgggggtgacctggccaaggtgcagcgtgccgtgtgcatgctgagcaacacgaccgccatcgccgaggcctgggcccgcctggaccacaagttcgacctgatgtatgccaagagggcgtttgtgcactggtatgtgggtgagggcatggaggagggtgagttctccgaggcccgtgaggatatggctgccctggagaaggattatgaggaggtgggcatcgactcctatgaggacgaggatgagggagaagaataaagcagctgcctggagcctattcactatgtttattgcaaaatcctttcgaaataaacagtttccttgcacggtttcttgttccctctgagtgcttgagcttctgctgccttccccttcatgctgctgctgctctgtttgctgttcatgacccttatcccttccatcgctgaaggtgagacctgcaaaggggttcttgccaggcccaggaagcataaccccagggactttaaattgaagtcctagggttactcagtatagggaggaaatgaggaccaaaatccaggcacaaactgttgaaggatgagtcttcagctcctttccaagtaggagtataatccagtggtttctgtctttgaaagttagactgctaccctgttcttcctgctgcctctacatttaccaactctggaagcaaggcttggcccaggctcctctgtgcattatgagggtttgggagtggggctgggctggcccagagttcctgggcatggagccacgtcataagcttgggggatgggagggaacacaggcgatctcctagagttgtttgtgccactgcacctctgagcagctttgcatagcttcctgtcttgctgctttgctggagctggggctgtgccattaaaagtcaggtcatctcccctctgtttgtgatttctttctggcctcagcctctgtgctagctagtgggagactcctgctagggccctggggaaagcttcaactttgctaacaggagccccaggccccatgctgatgtcatactgtggggtagacatggttcgggggaggaggcttggatcacaaaagagcaggagatgccaaccctgcccttgcctttcctccctggtgattcagggaacagagcccttccctagggaacaggtttgaagcccagctaagacagggcccctgtttactcagcagagtaggcaggaagtggcagctggatactgccacaccacactgcctcattaatcattaaccatgtatgagcttgaacgatcagggagacacaggccaaaacagctgccgctgccacctccactcccctcgcccctaggctgaggatgggagacctgtaatctacctgtctcaaagcttcctcaggtgtctccacccagaggcccttgcctagcaaaccggctaggcagctttgactaagctactcaccccaggagtgaaggaaggaaagaactagttgagtgtttttagggggccctagttcttgacacaggcagatgccagcttgagcccaagcagctttaagttttgatctaagacaagctagaactgtccactgctaaccaacctcctgtagaatgaagtcacaccattgccgactctgcaccattcctccttcccaggcagttcgcctgaatatggcaacctgactttgggccccttgcacctcttctctcactccaggaacactgagactaagatctacaccaacctgcttccacttt

SEQ ID NO: 278181 - DNA, 3415 bp, Homo sapiens
agcggcagttctcactgagacctgtcaccccgactcaacgtgagacgcaccgcccggactcaccatgcgtgaatgcatctcagtccacgtggggcaggcaggtgtccagatgggcaatgcctgctgggagctctattgcttggaacatgggattcagcctgatgggcagatgcccagtgacaagaccattggtggaggggacgactccttcaccaccttcttctgtgaaactggtgctggaaaacacgtaccccgggcagtttttgtggatctggagcctacggtcattggtgagaggaagtggggacaaaattgaagggggtggagcatgactcaaagcttctccctggagagagagggtatttagaccaggcattcctagccctgaaaattcctagccgtacttgaagctgcagaaggcaagctgatctgagactggcctgggcagctggtctgggtttctctcacactctggtatctcaggctggcaggaggatgagtccttccatgcatctggccacagctaccaccctgggggaggaaggtccctgctgagcatagctttgtggtttttgcccttccagatgagatccgaaatggcccataccgacagctcttccacccagagcagctcatcactgggaaagaggatgctgccaacaactatgcccgtggtcactataccattggcaaggagatcattgacccagtgctggatcggatccgcaagctggtgagagtgtgtcttgggagggagggaacttttgagactgtgctaatggtcaggaatattttttttcagatcctttcaggaggtcatctctaactatacatggtctcgagtgtggtgctgctatggcatcctcagtatttgccctgactgctgatgtatcttacgctttatggagccaggtgatagagtccctcaggcccctcccctacctaaactgttctttctcgttcttgcctttcagtctgaccagtgcacaggacttcagggcttcctggtgttccacagctttggtgggggcactggctctggcttcacctcactcctgatggagcggctctctgttgactatggcaagaaatccaagctggaattctccatctacccagccccccaggtgtctacagccgtggtcgagccctacaactctatcctgaccacccacaccaccctggagcactcagactgtgccttcatggtggacaacgaagcaatctatgacatctgccgccgcaacctagacatcgagcgcccaacctacaccaacctcaatcgcctcattagccaaattgtctcctccatcacagcttctctgcgctttgacggggccctcaatgtggacctgacagagttccagaccaacctggtgccctaccctcgcatccacttccccctggccacctatgcaccagtcatctctgcagaaaaggcataccacgagcagctgtcggtggcagagatcaccaatgcctgctttgagcctgccaaccagatggtaaagtgtgatccccggcacggcaagtacatggcctgctgcctgctgtaccgtggagatgtggtgcccaaggatgtcaacgctgccattgccgccatcaagaccaagcgcagcattcagtttgtggactggtgccccacaggcttcaaggttggtatcaactaccagcctcccactgtggtgcctgggggtgacctggccaaggtgcagcgtgccgtgtgcatgctgagcaacacgaccgccatcgccgaggcctgggcccgcctggaccacaagttcgacctgatgtatgccaagagggcgtttgtgcactggtatgtgggtgagggcatggaggagggtgagttctccgaggcccgtgaggatatggctgccctggagaaggattatgaggaggtgggcatcgactcctatgaggacgaggatgagggagaagaataaagcagctgcctggagcctattcactatgtttattgcaaaatcctttcgaaataaacagtttccttgcacggtttcttgttccctctgagtgcttgagcttctgctgccttccccttcatgctgctgctgctctgtttgctgttcatgacccttatcccttccatcgctgaaggtgagacctgcaaaggggttcttgccaggcccaggaagcataaccccagggactttaaattgaagtcctagggttactcagtatagggaggaaatgaggaccaaaatccaggcacaaactgttgaaggatgagtcttcagctcctttccaagtaggagtataatccagtggtttctgtctttgaaagttagactgctaccctgttcttcctgctgcctctacatttaccaactctggaagcaaggcttggcccaggctcctctgtgcattatgagggtttgggagtggggctgggctggcccagagttcctgggcatggagccacgtcataagcttgggggatgggagggaacacaggcgatctcctagagttgtttgtgccactgcacctctgagcagctttgcatagcttcctgtcttgctgctttgctggagctggggctgtgccattaaaagtcaggtcatctcccctctgtttgtgatttctttctggcctcagcctctgtgctagctagtgggagactcctgctagggccctggggaaagcttcaactttgctaacaggagccccaggccccatgctgatgtcatactgtggggtagacatggttcgggggaggaggcttggatcacaaaagagcaggagatgccaaccctgcccttgcctttcctccctggtgattcagggaacagagcccttccctagggaacaggtttgaagcccagctaagacagggcccctgtttactcagcagagtaggcaggaagtggcagctggatactgccacaccacactgcctcattaatcattaaccatgtatgagcttgaacgatcagggagacacaggccaaaacagctgccgctgccacctccactcccctcgcccctaggctgaggatgggagacctgtaatctacctgtctcaaagcttcctcaggtgtctccacccagaggcccttgcctagcaaaccggctaggcagctttgactaagctactcaccccaggagtgaaggaaggaaagaactagttgagtgtttttagggggccctagttcttgacacaggcagatgccagcttgagcccaagcagctttaagttttgatctaagacaagctagaactgtccactgctaaccaacctcctgtagaatgaagtcacaccattgccgactctgcaccattcctccttcccaggcagttcgcctgaatatggcaacctgactttgggccccttgcacctcttctctcactccaggaacactgagactaagatctacaccaacctgcttccacttt

SEQ ID NO: 278182 - DNA, 964 bp, Homo sapiens
  misc_feature (17)..(17): n is a, c, g, or t
  misc_feature (19)..(19): n is a, c, g, or t
  misc_feature (21)..(21): n is a, c, g, or t
  misc_feature (24)..(24): n is a, c, g, or t
  misc_feature (29)..(29): n is a, c, g, or t
  misc_feature (32)..(32): n is a, c, g, or t
  misc_feature (874)..(874): n is a, c, g, or t
  misc_feature (876)..(876): n is a, c, g, or t
  misc_feature (878)..(880): n is a, c, g, or t
  misc_feature (885)..(885): n is a, c, g, or t
  misc_feature (892)..(892): n is a, c, g, or t
  misc_feature (896)..(897): n is a, c, g, or t
  misc_feature (900)..(900): n is a, c, g, or t
  misc_feature (908)..(909): n is a, c, g, or t
  misc_feature (914)..(915): n is a, c, g, or t
aagtaggctagtagagncngntgntaatnggncgaggccgactcaacgtgagacgcaccgcccggactcaccatgcgtgaatgcatctcagtccacgtggggcaggcaggtgtccagatgggcaatgcctgctgggagctctattgcttggaacatgggattcagcctgatgggcagatgcccagtgacaagaccattggtggaggggacgactccttcaccaccttcttctgtgaaactggtgctggaaaacacgtaccccgggcagtttttgtggatctggagcctacggtcattgatgagatccgaaatggcccataccgacagctcttccacccagagcagctcatcactgggaaagaggatgctgccaacaactatgcccgtggtcactataccattggcaaggagatcattgacccagtgctggatcggatccgcaagctgtctgaccagtgcacaggacttcagggcttcctggtgttccacagctttggtgggggcactggctctggcttcacctcactcctgatggagcggctctctgttgactatggcaagaaatccaagctggaattctccatctacccagccccccaggtgtctacagccgtggtcgagccctacaactctatcctgaccacccacaccaccctggagcactcagactgtgccttcatggtggacaacgaagcaatctatgacatctgccgccgcaacctagacatcgagcgcccaacctacaccaacctcaatcgcctcattagccaaattgtctcctccatcacagcttctctgcgctttgacggggccctcaatgtggacctgacagagttccagaccaacctggtgccctaccctcttccctggcctntncnnnttttngaaggtncccnncgnggggggannccgcnnttggcccccagtgttgtgtcccggaatcgcctcgaatgtacgaaatccc

SEQ ID NO: 278183 - DNA, 2880 bp, Homo sapiens
agcggcagttctcactgagacctgtcaccccgactcaacgtgagacgcaccgcccggactcaccatgcgtgaatgcatctcagtccacgtggggcaggcaggtgtccagatgggcaatgcctgctgggagctctattgcttggaacatgggattcagcctgatgggcagatgcccagtgacaagaccattggtggaggggacgactccttcaccaccttcttctgtgaaactggtgctggaaaacacgtaccccgggcagtttttgtggatctggagcctacggtcattgatgagatccgaaatggcccataccgacagctcttccacccagagcagctcatcactgggaaagaggatgctgccaacaactatgcccgtggtcactataccattggcaaggagatcattgacccagtgctggatcggatccgcaagctgtctgaccagtgcacaggacttcagggcttcctggtgttccacagctttggtgggggcactggctctggcttcacctcactcctgatggagcggctctctgttgactatggcaagaaatccaagctggaattctccatctacccagccccccaggtgtctacagccgtggtcgagccctacaactctatcctgaccacccacaccaccctggagcactcagactgtgccttcatggtggacaacgaagcaatctatgacatctgccgccgcaacctagacatcgagcgcccaacctacaccaacctcaatcgcctcattagccaaattgtctcctccatcacagcttctctgcgctttgacggggccctcaatgtggacctgacagagttccagaccaacctggtgccctaccctcgcatccacttccccctggccacctatgcaccagtcatctctgcagaaaaggcataccacgagcagctgtcggtggcagagatcaccaatgcctgctttgagcctgccaaccagatggtaaagtgtgatccccggcacggcaagtacatggcctgctgcctgctgtaccgtggagatgtggtgcccaaggatgtcaacgctgccattgccgccatcaagaccaagcgcagcattcagtttgtggactggtgccccacaggcttcaaggttggtatcaactaccagcctcccactgtggtgcctgggggtgacctggccaaggtgcagcgtgccgtgtgcatgctgagcaacacgaccgccatcgccgaggcctgggcccgcctggaccacaagttcgacctgatgtatgccaagagggcgtttgtgcactggtatgtgggtgagggcatggaggagggtgagttctccgaggcccgtgaggatatggctgccctggagaaggattatgaggaggtgggcatcgactcctatgaggacgaggatgagggagaagaataaagcagctgcctggagcctattcactatgtttattgcaaaatcctttcgaaataaacagtttccttgcacggtttcttgttccctctgagtgcttgagcttctgctgccttccccttcatgctgctgctgctctgtttgctgttcatgacccttatcccttccatcgctgaaggtgagacctgcaaaggggttcttgccaggcccaggaagcataaccccagggactttaaattgaagtcctagggttactcagtatagggaggaaatgaggaccaaaatccaggcacaaactgttgaaggatgagtcttcagctcctttccaagtaggagtataatccagtggtttctgtctttgaaagttagactgctaccctgttcttcctgctgcctctacatttaccaactctggaagcaaggcttggcccaggctcctctgtgcattatgagggtttgggagtggggctgggctggcccagagttcctgggcatggagccacgtcataagcttgggggatgggagggaacacaggcgatctcctagagttgtttgtgccactgcacctctgagcagctttgcatagcttcctgtcttgctgctttgctggagctggggctgtgccattaaaagtcaggtcatctcccctctgtttgtgatttctttctggcctcagcctctgtgctagctagtgggagactcctgctagggccctggggaaagcttcaactttgctaacaggagccccaggccccatgctgatgtcatactgtggggtagacatggttcgggggaggaggcttggatcacaaaagagcaggagatgccaaccctgcccttgcctttcctccctggtgattcagggaacagagcccttccctagggaacaggtttgaagcccagctaagacagggcccctgtttactcagcagagtaggcaggaagtggcagctggatactgccacaccacactgcctcattaatcattaaccatgtatgagcttgaacgatcagggagacacaggccaaaacagctgccgctgccacctccactcccctcgcccctaggctgaggatgggagacctgtaatctacctgtctcaaagcttcctcaggtgtctccacccagaggcccttgcctagcaaaccggctaggcagctttgactaagctactcaccccaggagtgaaggaaggaaagaactagttgagtgtttttagggggccctagttcttgacacaggcagatgccagcttgagcccaagcagctttaagttttgatctaagacaagctagaactgtccactgctaaccaacctcctgtagaatgaagtcacaccattgccgactctgcaccattcctccttcccaggcagttcgcctgaatatggcaacctgactttgggccccttgcacctcttctctcactccaggaacactgagactaagatctacaccaacctgcttccacttt

SEQ ID NO: 278184 - DNA, 2876 bp, Homo sapiens
  misc_feature (16)..(16): n is a, c, g, or t
gctggggtgaatcggncgagggtacccgactcaacgtgagacgcaccgcccggactcaccatgcgtgaatgcatctcagtccacgtggggcaggcaggtgtccagatgggcaatgcctgctgggagctctattgcttggaacatgggattcagcctgatgggcagatgcccagtgacaagaccattggtggaggggacgactccttcaccaccttcttctgtgaaactggtgctggaaaacacgtaccccgggcagtttttgtggatctggagcctacggtcattgatgagatccgaaatggcccataccgacagctcttccacccagagcagctcatcactgggaaagaggatgctgccaacaactatgcccgtggtcactataccattggcaaggagatcattgacccagtgctggatcggatccgcaagctgtctgaccagtgcacaggacttcagggcttcctggtgttccacagctttggtgggggcactggctctggcttcacctcactcctgatggagcggctctctgttgactatggcaagaaatccaagctggaattctccatctacccagccccccaggtgtctacagccgtggtcgagccctacaactctatcctgaccacccacaccaccctggagcactcagactgtgccttcatggtggacaacgaagcaatctatgacatctgccgccgcaacctagacatcgagcgcccaacctacaccaacctcaatcgcctcattagccaaattgtctcctccatcacagcttctctgcgctttgacggggccctcaatgtggacctgacagagttccagaccaacctggtgccctaccctcgcatccacttccccctggccacctatgcaccagtcatctctgcagaaaaggcataccacgagcagctgtcggtggcagagatcaccaatgcctgctttgagcctgccaaccagatggtaaagtgtgatccccggcacggcaagtacatggcctgctgcctgctgtaccgtggagatgtggtgcccaaggatgtcaacgctgccattgccgccatcaagaccaagcgcagcattcagtttgtggactggtgccccacaggcttcaaggttggtatcaactaccagcctcccactgtggtgcctgggggtgacctggccaaggtgcagcgtgccgtgtgcatgctgagcaacacgaccgccatcgccgaggcctgggcccgcctggaccacaagttcgacctgatgtatgccaagagggcgtttgtgcactggtatgtgggtgagggcatggaggagggtgagttctccgaggcccgtgaggatatggctgccctggagaaggattatgaggaggtgggcatcgactcctatgaggacgaggatgagggagaagaataaagcagctgcctggagcctattcactatgtttattgcaaaatcctttcgaaataaacagtttccttgcacggtttcttgttccctctgagtgcttgagcttctgctgccttccccttcatgctgctgctgctctgtttgctgttcatgacccttatcccttccatcgctgaaggtgagacctgcaaaggggttcttgccaggcccaggaagcataaccccagggactttaaattgaagtcctagggttactcagtatagggaggaaatgaggaccaaaatccaggcacaaactgttgaaggatgagtcttcagctcctttccaagtaggagtataatccagtggtttctgtctttgaaagttagactgctaccctgttcttcctgctgcctctacatttaccaactctggaagcaaggcttggcccaggctcctctgtgcattatgagggtttgggagtggggctgggctggcccagagttcctgggcatggagccacgtcataagcttgggggatgggagggaacacaggcgatctcctagagttgtttgtgccactgcacctctgagcagctttgcatagcttcctgtcttgctgctttgctggagctggggctgtgccattaaaagtcaggtcatctcccctctgtttgtgatttctttctggcctcagcctctgtgctagctagtgggagactcctgctagggccctggggaaagcttcaactttgctaacaggagccccaggccccatgctgatgtcatactgtggggtagacatggttcgggggaggaggcttggatcacaaaagagcaggagatgccaaccctgcccttgcctttcctccctggtgattcagggaacagagcccttccctagggaacaggtttgaagcccagctaagacagggcccctgtttactcagcagagtaggcaggaagtggcagctggatactgccacaccacactgcctcattaatcattaaccatgtatgagcttgaacgatcagggagacacaggccaaaacagctgccgctgccacctccactcccctcgcccctaggctgaggatgggagacctgtaatctacctgtctcaaagcttcctcaggtgtctccacccagaggcccttgcctagcaaaccggctaggcagctttgactaagctactcaccccaggagtgaaggaaggaaagaactagttgagtgtttttagggggccctagttcttgacacaggcagatgccagcttgagcccaagcagctttaagttttgatctaagacaagctagaactgtccactgctaaccaacctcctgtagaatgaagtcacaccattgccgactctgcaccattcctccttcccaggcagttcgcctgaatatggcaacctgactttgggccccttgcacctcttctctcactccaggaacactgagactaagatctacaccaacctgcttccacttt

SEQ ID NO: 278185 - DNA, 532 bp, Homo sapiens
cgtccccaccctccccgagactcaattccgtggggagtcgggccctcgacactgtgctgacccccggccacccacctccatcttggccgcggtggtccctagccctcgcctccgcagagcgctctggggccccggcggcccccactccaagcagcgtccccccacgggctgctgcgcccgctacctggccccggcgctggctgggtcgcggtgacagccgcgcgcccccgcagcccgcggctcccacgcgcgcgccgccccacaggtggccctcgccccggcccacccgcgcctcccaggcccagcctcacctgctgccgagagaggacagtgatcccccaaaagccggaggtggaggaggaggaggaagaggaggaaggagctggaggagccggggactcgcccgctgaagatgctcttgtcaagacaatgaatgagaagcagccgtgcgcccgcctccggggtggccgcgccccttggggcggagctcttccaggcccgccctgcgctcccgggcccccgctgcggccgc

SEQ ID NO: 278186 - DNA, 529 bp, Homo sapiens
gcctctgcaacagagcctggcgtggtgttgccccactgcatgtttgttgactgactggctgatggatgcagagcccgtccttcctaatggttcagactcaggcgtcatcagcccagatggctccgagggaagggagaggccactccgactgctctgaggtccagggaaggggcctgtgctgccgcttggagggtgccatgcccagagcctctgcccctagcctcagcctcgcctactcactgggggctccagcacccccggccaccccaggactcccgaagaggctgctaggtcggcctgcccaaagagcggtgaggagcgtatgtgaagagccccagtcttgaggagcagcctgtatctggagagaggggagccccggaccagaggtgggggacaggaagccatcgccccaccctgcctcctcccccaccacaggtaccaggcccggaaaccacggaaaggggaacttggtcttttcttgttttgctctcaaccccttcctgtctccaagcccagggcagctgccccg

SEQ ID NO: 278187 - DNA, 327 bp, Homo sapiens
cacccccatgtaaactgcacacaggaagggagaggccactccgactgctctgaggtccaggtggccctcgccccggcccacccgcgcctcccaggcccagcctcacctgctgccgagagaggacagtgatcccccaaaagccggaggtggaggaggaggaggaagaggaggaaggagctggaggagccggggactcgcccgctgaagatgctcttgtcaagacaatgaatgagaagcagccgtgcgcccgcctccggggtggccgcgccccttggggcggagctcttccaggcccgccctgcgctcccgggcccccgctgcggccgc

SEQ ID NO: 278188 - DNA, 702 bp, Homo sapiens
gcctctgcaacagagcctggcgtggtgttgccccactgcatgtttgttgactgactggctgatggatgcagagcccgtccttcctaatggttcagactcaggcgtcatcagcccagatggctccgagggaagggagaggccactccgactgctctgaggtccagggaaggggcctgtgctgccgcttggagggtgccatgcccagagcctctgcccctagcctcagcctcgcctactcactgggggctccagcacccccggccaccccaggactcccgaagaggctgctaggtcggcctgcccaaagagcggtgaggagcgtatgtgaagagccccagtcttgaggagcagcctgtatctggagagaggggagccccggaccagaggtgggggacaggaagccatcgccccaccctgcctcctcccccaccacaggtggccctcgccccggcccacccgcgcctcccaggcccagcctcacctgctgccgagagaggacagtgatcccccaaaagccggaggtggaggaggaggaggaagaggaggaaggagctggaggagccggggactcgcccgctgaagatgctcttgtcaagacaatgaatgagaagcagccgtgcgcccgcctccggggtggccgcgccccttggggcggagctcttccaggcccgccctgcgctcccgggcccccgctgcggccgc

SEQ ID NO: 278189 - DNA, 361 bp, Homo sapiens
gcctctgcaacagagcctggcgtggtgttgccccactgcatgtttgttgactgactggctgatggatgcagagcccgtccttcctaatggttcagactcaggcgtcatcagcccagatggctccgagggaagggagaggccactccgactgctctgaggtccagggaaggggcctgtgctgccgcttggagggtgccatgcccagagcctctgcccctagcctcagcctcgcccgctgaagatgctcttgtcaagacaatgaatgagaagcagccgtgcgcccgcctccggggtggccgcgccccttggggcggagctcttccaggcccgccctgcgctcccgggcccccgctgcggccgc

SEQ ID NO: 278190 - DNA, 969 bp, Homo sapiens
tactagctggttgatatggaaacatcctccacttatctctcaagaaaataaacacaaatcagccaaaagtaattggtaccaaattactgaaagtacagctattccaaggcccgaattctatttacaatgctagtagtgaaaaggtcttcttaattatcagcagacagcaagttttcaagtctttttccaaaatcacattaagacttaatgttatgctgttatttgttccatcgttcaaaagaaaaatgagatgacaatctttttgtaatagtatatcctcttcttccagtcaatacctgagtaccaagcaagcagcactcaaatattgggggcagtggaaaaatggaactaccatataagcaagattaaggatggtgacaacttcacgtgcttgctgaaaactccatacacagagatttaggtcctttaaagtacacaaacatttagtttggtcacaagttagatttaatcctgtgcgttttaatttttagatgtaaacaatggcaaataataatgaccaacatataagccagaaacagagcctcacacacagaaaacttggcaccaaaactcaagatttaaaataagaaaaaaaaaaaaaaagtccattaacatactcacgtgtggtgctagaaaatttaatacgatgcacagcagctgaaatgcgttatcttacagatgcaacctacattaacaagtaagttatataacaaaccattctagccacagacacttagtgtacttgcccttattattatgtacctgatgtccaaaaaagcacaacaatttaagactttgggcactttatgtagcagatatataaaaagcaaagcaggaattaagagcaaatgaatttaataatactgatataaggcagcttttaatctattcacaggaaaaggaaaaatttatattatctcctaaatattatagcatgtaatatgaagagttaataatctcgtccattct

SEQ ID NO: 278191 - DNA, 480 bp, Homo sapiens
tactagctggttgatatggaaacatcctccacttatctctcaagaaaataaacacaaatcagccaaaagtaattggtaccaaattactgaaagtacagctattccaaggcccgaattctatttacaatgctagtagtgaaaaggtcttcttaattatcagcagacagcaagttttcaagtctttttccaaaatcacattaagacttaatgttatgctgttatttgttccatcgttcaaaagaaaaatgagatgacaatctttttgtaatagtatatcctcttcttccagtcaatacctgagtaccaagcaagcagcactcaaatattgggggcagtggaaaaatggaactaccatataagcaagattaaggatggtgacaacttcacgtgcttgctgaaaactccatacacagagatttaggtcctttaaagtacacaaacatttagtttggtgttacattctgatgtggagcggccgca

SEQ ID NO: 278192 - DNA, 846 bp, Homo sapiens
ctcgggtgtcctcaccacaggtctgcgcctccggcctgcgggatcgaagggaaaggaatccgatccggggaggcaagcctgggagacgtcctttattcaggaataatggacaaataaaaattccatatattcagctgggtgcagtggctaacacctgtaatcccagtactttgggaggctgaggtgtgcagatcgcttgaggtcaggagtttgagaccagcctggccatcacgctgaatgaactgggatttcttggagaagtggtagagccaagctctggaaccggaaatacgcaaggtgaggctggaacacgttgtcaaatcagaaaacaagaggcttcgggcatgtgggcatgtccaaaggactaaagaaccaacctgaataagctccctctggccaaagatggacttaatgagcatcatcatggtaataattgtaatggattagggccaggtgcagtggctcatgcctgtaatcctagaactctgggaggcaaggcagaaggatcacttgagcccaggagtttgagaccaccctgggcaaaatagtgagacctcatctctacaaaaaccttaacaatttagctggcttgggccggctgtggtggctcaagtctgtaatcacagcgcttcgggaggccgaagcaggtggatcacctgaggtcaggagttggagaccagcctggccaaaatggtgaaatcccgtttttactaaaaatacaaaaatcagctgggcatggtggcggatgcctataatcccagctactcgggaggctgaggcaggagaatcgcatgaacctgggaggtggagtttgcagtgagccgagatcatgccactgcactccag

SEQ ID NO: 278193 - DNA, 648 bp, Homo sapiens
agtcagctggtgggaattaggcatttttgtgacttggagctccagagttgctgaggaggagcccaagacaatgggaggggagatgggaacagacacctagaggttacagtggcagggccatggaaaagacggctcctctgcctgacccacactggagccaccctttggccacttcttccctccaagaaaacttgggatctcgggccctcaggcctggacacaatcataggggctgactggctcagaggtccccaaagattgcgggggtacagtggggacaatcagcatctctgtgcctctcctgagtgagaactgagtagggggacatgaagggagagataaacaacttacccgcggtcacccagcagcctggggctggaactctgggtaaactgagacatcatccccggggcacgggtgggcagctgccccaggggacctgcctggactaatgagatattctgtgtctgtctgtccatccatccaggtgcaagttcttcagtctgactgagacaccagaggattacactatcattgtcgatgaggaaggattcctaggtaagtgcttctctccctaggggctcggctggaccatgccccgaagtcagggctggctacccacctccttatttctgtccccaacccacc

SEQ ID NO: 278194 - DNA, 1596 bp, Homo sapiens
cgaacacgagctgctccccgcgccggcacccgcgcgccgctgctccgccggcgctgcctccctcgacccgtggctccccctcgcaacttggcgggcctcctcccttttgtccggcccggtccggccgccgccgccccccgcgcctggcgccgagctcccgggtccccgggccggctgtcggtgccggcagggcgcggagggggcgggggccgcggctcgtcccccagcggatgagctgccgcggacggggcgcgggcggacgatggaactccacatcctggagcaccggctgcaagttgccagcgtcgccaaggagagtatcccgctgttcacctacgggcctgatcaaacttgccttcctgttctccaagaccaggtgcaagttcttcagtctgactgagacaccagaggattacactatcattgtcgatgaggaaggattcctagagctgccctcctcagagcacctgagtgtggcggatgccacctggctggccctgaacgtggtgtccggcggtggcagcttctccagctcccagcctattggcatgaccaagatcgccaagtcagtcatcgccccactggctgaccagaacatatccgtgttcatgctgtccacgtatcagacagacttcatcctggtgctcaagcgggacctgccctttgtcacccacacgttgtcatcagagttcaccatcctgtggtcagtggctagactgtagcagccgagaacctcggcatcaccagtggcttcgtgaagcccaagctggtccagatgccggtcatccacccactgtccagcccgagcaacaggttctgtgtcaccagcctggaccccgacacgctgcctgctgttgccacactcctcatggatgtcatgtcctacttcaatgggtgaggatacaactagaagccagcagtctacaggctggaagaaggccctcaccagaacccaacccttggacttcagcctccagaactgtgagaaatacatacctgctgtttgtcagacaccagtctatggaattctgttacagtagcctgaactcagacatagcccttttccatttataaggtggttttaccttatattttatgtaaaaggtccattttatttatttttgaattgttgatttttttttaagagacacgtgtttactatgttacccaggctggactccaactcctggactattgatcctcctgtctccacctcccgagttgctggaactacaggctaacagctctgttttaaagatgagaaaatgggccccacgcagtggctcacacctgtaatcccagcacttagggaggctgagccaggtggagccacttgaggtcaggtgttcgagattagcctggccaacatggcaaaaccccgtctctactaaaaatacaaaaaaaattagccgggcatgatggcgcgtgcctgtaatcccagctacttgggagtctgaggcaggagaattgcttgagcccaggaggcagaggttgcagtgagccgagactatgccactgcactccagcctaggtgacaaagagagactctacctcaaaaaataaaaataattaaaaaataaagatgagaaaatggag

SEQ ID NO: 278195 - DNA, 1254 bp, Homo sapiens
acttcgcaaataaaaaaaccagttcctttcccagcctcataagaacaaatatgggcacagcaggcccctatggcacctcctgggagggaagtcagtgtgggcaccaggatcaggcctgactgcagagcgcttcttggcctgctgactgagccccttaaatgactttgttttggaaaccagaaaacggattttttctgagatgttaggaaataatattttaacagaggccttgctctctagtctctggtttgaaggtatcattgtttggtttctccttctgagcacaagactcccctgttctgttctgttctgttctttttccttccctgcagagaagagaacagaagaataacagcagaagatacgcagcctgtaatggactgaatatctgtgtccccctaaacccacatattgaaatccttcccccagtgtgatgctgtttggaagtggggcctttgggaggtgattgggtcataggggtgcagccctcatggatggatgaatgcccttctaagcccaggccagagggctagcttgctgtttctcctccaggtgaggatacaactagaagccagcagtctacaggctggaagaaggccctcaccagaacccaacccttggacttcagcctccagaactgtgagaaatacatacctgctgtttgtcagacaccagtctatggaattctgttacagtagcctgaactcagacatagcccttttccatttataaggtggttttaccttatattttatgtaaaaggtccattttatttatttttgaattgttgatttttttttaagagacacgtgtttactatgttacccaggctggactccaactcctggactattgatcctcctgtctccacctcccgagttgctggaactacaggctaacagctctgttttaaagatgagaaaatgggccccacgcagtggctcacacctgtaatcccagcacttagggaggctgagccaggtggagccacttgaggtcaggtgttcgagattagcctggccaacatggcaaaaccccgtctctactaaaaatacaaaaaaaattagccgggcatgatggcgcgtgcctgtaatcccagctacttgggagtctgaggcaggagaattgcttgagcccaggaggcagaggttgcagtgagccgagactatgccactgcactccagcctaggtgacaaagagagactctacctcaaaaaataaaaataattaaaaaataaagatgagaaaatggag

SEQ ID NO: 278196 - DNA, 1784 bp, Homo sapiens
caatattataataatctttgttctacaattataacctaggaaaaaccaggccatacagagataggagctgaagggacatgctgagaagtgaccagaaggcaggagtgtgaaccctctgtcatgcccggacagggccactagagggctccctggtctagtggtaatgccagtgcctgggaaggcacccgttacttagcagaccttggtctagcagtggtgccagtgcctgggaagataactgttacttagcagaccgggaaagggagactccctttccctgggggagttagagaagacgctgctccaccacctcttgtggaaggcctgacatcagtcaggcccgcccacagccatccggaggcctaaccgtctccctgtgatgctgtgcttcagcagtcaccctcctgtttcactttcatgttccgctctgtacacctggctccaccttctagatggcagtagcagaattagtgaaagtattagtctttgatctttctgagaagagcatagaagtagtaatgatgtaagctgtcctctctctctccgcctcggctacctaaaaggaggagaaaaacccacagacctagtagggctggacatctacagtgccacccctgaaaagcactgctctgcatcacttaccaggctgggcaaaggcctccatgcctgctacctaagctggcctcagctcgtccagcctggcctgggcctggccagtgggaggtgctgctgagaagccagagccctgggctgtcctggacggccagcagggggcttgctggcatgaacccttcacagctgagcctgtcagggtgagggcgtgcacaaaaaagtatccacagatgttgtgcagcagaaataaagaaacattctaaccttttaagacaaaaagacagtatcgcttcttggccttttggccaagatcaagtgtagataaaaacattgtaagtcatgattcccttggaatacgatcagtattgtgagggaagagaggcaaacccccagcccatcaccacacactgcagctcacacacttcaggttttgtgctcccagacaatgcctgtcctcatgagagcactgttgtctgcgccgggaaatcatcctctgacctgttcacaagtcttctagatgaagattttcagcgggtttggatctatttaaaaagcggtaactgcaaagaggcacctaatccacttgatttgcctgtttttgagaggtactcctggcagttatgaaggtcattaaaagtatcagaataaattgaactttttttttttttgaaacggagtcttgctgggtcggctcactgcaacctccatctcccaaattcaagcgattctcctgtctcagcctcccgagtagctgggactacaggctcatgccaccacacccagctaattttgttgtatttttagtagagacggggtttcaccatgttggccaggatggtctcaatctcttgacctcgtgatctgcccgccttggcctcccaaagtgctgggattacaggcctgagccaccgcacccagccctaaactgaactttcaactgaacttcagaaaatgttgaaccatgattttaaaaaatgtttctcactttgctctaagcccttttttaagagcaaaaaggcattttgcagtgttaaccaatgaaatattttaaaacacttatttcgtcaactcatgttacattttaaatgtgtataatatagaagaattagtatatgtttatataacttacaattttttaaaaaactgatacaaatgtccaaaagttgggagtc

SEQ ID NO: 278197 - DNA, 1045 bp, Homo sapiens
  misc_feature (217)..(217): n is a, c, g, or t
cagcatattgctattgaaaaatagctattaggagaccttgcacaatttgtgaaacattgttaggctcattgtactgtgtaaaatcaggaaagaatttgggaacatactgatacaacaaaaagataggttgtcaaaccctcacttcaccagaaagctaaattaaccagataagtctttctgaaagttttagtgtcttagtttgttcctgcgctgtaanagaataccttagactgggtaacctataaataataggaatttatttctcacagttttggaggctggaccccgacacgctgcctgctgttgccacactcctcatggatgtcatgtcctacttcaatgggtgaggatacaactagaagccagcagtctacaggctggaagaaggccctcaccagaacccaacccttggacttcagcctccagaactgtgagaaatacatacctgctgtttgtcagacaccagtctatggaattctgttacagtagcctgaactcagacatagcccttttccatttataaggtggttttaccttatattttatgtaaaaggtccattttatttatttttgaattgttgatttttttttaagagacacgtgtttactatgttacccaggctggactccaactcctggactattgatcctcctgtctccacctcccgagttgctggaactacaggctaacagctctgttttaaagatgagaaaatgggccccacgcagtggctcacacctgtaatcccagcacttagggaggctgagccaggtggagccacttgaggtcaggtgttcgagattagcctggccaacatggcaaaaccccgtctctactaaaaatacaaaaaaaattagccgggcatgatggcgcgtgcctgtaatcccagctacttgggagtctgaggcaggagaattgcttgagcccaggaggcagaggttgcagtgagccgagactatgccactgcactccagcctaggtgacaaagagagactctacctcaaaaaataaaaataattaaaaaataaagatgagaaaatggag

SEQ ID NO: 278198 - DNA, 1397 bp, Homo sapiens
caatattataataatctttgttctacaattataacctaggaaaaaccaggccatacagagataggagctgaagggacatgctgagaagtgaccagaaggcaggagtgtgaaccctctgtcatgcccggacagggccactagagggctccctggtctagtggtaatgccagtgcctgggaaggcacccgttacttagcagaccttggtctagcagtggtgccagtgcctgggaagataactgttacttagcagaccgggaaagggagactccctttccctgggggagttagagaagacgctgctccaccacctcttgtggaaggcctgacatcagtcaggcccgcccacagccatccggaggcctaaccgtctccctgtgatgctgtgcttcagcagtcaccctcctgtttcactttcatgttccgctctgtacacctggctccaccttctagatggcagtagcagaattagtgaaagtattagtctttgatctttctgagaagagcatagaagtagtaatgatgtaagctgtcctctctctctccgcctcggctacctaaaaggaggagaaaaacccacagacctagtagggctggacatctacagtgccacccctgaaaagcactgctctgcatcacttaccaggctgggcaaaggcctccatgcctgctacctaagctggcctcagctcgtccagcctggcctgggcctggccagtgggaggtgctgctgagaagccagagccctgggctgtcctggacggccagcagggggcttgctggcatgaacccttcacagctgagcctgtcagggtgagggcgtgcacaaaaaagtatccacagatgttgtgcagcagaaataaagaaacattctaaccttttaagacaaaaagacagtatcgcttcttggccttttggccaagatcaagtgtagataaaaacattgtaagtcatgattcccttggaatacgatcagtattgtgagggaagagaggcaaacccccagcccatcaccacacactgcagctcacacacttcaggttttgtgctcccagacaatgcctgtcctcatgagagcactgttgtctgcgccgggaaatcatcctctgacctgttcacaagtcttctagatgaagattttcagcgggtttggatctatttaaaaagcggtaactgcaaagaggcacctaatccacttgatttgcctgtttttgagaggtactcctggcagttatgaaggtcattaaaagtatcagaataaattgaactttttttttttttgaaacggagtcgttgcagtgagccgagactatgccactgcactccagcctaggtgacaaagagagactctacctcaaaaaataaaaataattaaaaaataaagatgagaaaatggag

SEQ ID NO: 278199 - DNA, 1346 bp, Homo sapiens
caatattataataatctttgttctacaattataacctaggaaaaaccaggccatacagagataggagctgaagggacatgctgagaagtgaccagaaggcaggagtgtgaaccctctgtcatgcccggacagggccactagagggctccctggtctagtggtaatgccagtgcctgggaaggcacccgttacttagcagaccttggtctagcagtggtgccagtgcctgggaagataactgttacttagcagaccgggaaagggagactccctttccctgggggagttagagaagacgctgctccaccacctcttgtggaaggcctgacatcagtcaggcccgcccacagccatccggaggcctaaccgtctccctgtgatgctgtgcttcagcagtcaccctcctgtttcactttcatgttccgctctgtacacctggctccaccttctagatggcagtagcagaattagtgaaagtattagtctttgatctttctgagaagagcatagaagtagtaatgatgtaagctgtcctctctctctccgcctcggctacctaaaaggaggagaaaaacccacagacctagtagggctggacatctacagtgccacccctgaaaagcactgctctgcatcacttaccaggctgggcaaaggcctccatgcctgctacctaagctggcctcagctcgtccagcctggcctgggcctggccagtgggaggtgctgctgagaagccagagccctgggctgtcctggacggccagcagggggcttgctggcatgaacccttcacagctgagcctgtcagggtgagggcgtgcacaaaaaagtatccacagatgttgtgcagcagaaataaagaaacattctaaccttttaagacaaaaagacagtatcgcttcttggccttttggccaagatcaagtgtagataaaaacattgtaagtcatgattcccttggaatacgatcagtattgtgagggaagagaggcaaacccccagcccatcaccacacactgcagctcacacacttcaggttttgtgctcccagacaatgcctgtcctcatgagagcactgttgtctgcgccgggaaatcatcctctgacctgttcacaagtcttctagatgaagattttcagcgggtttggatctatttaaaaagcggtaactgcaaagaggcacctaatccacttgatttgcctgtttttgagaggtactcctggcagttatgaaggtcattaaaagtatcagaataaattgaactttttttttttttgaaacggagtctggcgggggccgggctcacgggacaacgggcgggggtaccggagctcggaatccg

SEQ ID NO: 278200 - DNA, 934 bp, Homo sapiens
cgaacacgagctgctccccgcgccggcacccgcgcgccgctgctccgccggcgctgcctccctcgacccgtggctccccctcgcaacttggcgggcctcctcccttttgtccggcccggtccggccgccgccgccccccgcgcctggcgccgagctcccgggtccccgggccggctgtcggtgccggcagggcgcggagggggcgggggccgcggctcgtcccccagcggatgagctgccgcggacggggcgcgggcggacgatggaactccacatcctggagcaccggctgcaagttgccagcgtcgccaaggagagtatcccgctgttcacctacgggcctgatcaaacttgccttcctgttctccaagaccaggtgcaagttcttcagtctgactgagacaccagaggattacactatcattgtcgatgaggaaggattcctagagctgccctcctcagagcacctgagtgtggcggatgccacctggctggccctgaacgtggtgtccggcggtggcagcttctccagctcccagcctattggcatgaccaagatcgccaagtcagtcatcgccccactggctgaccagaacatatccgtgttcatgctgtccacgtatcagacagacttcatcctgcaaagtgctgggattacaggcctgagccaccgcacccagccctaaactgaactttcaactgaacttcagaaaatgttgaaccatgattttaaaaaatgtttctcactttgctctaagcccttttttaagagcaaaaaggcattttgcagtgttaaccaatgaaatattttaaaacacttatttcgtcaactcatgttacattttaaatgtgtataatatagaagaattagtatatgtttatataacttacaattttttaaaaaactgatacaaatgtccaaaagttgggagtc

SEQ ID NO: 278201 - DNA, 247 bp, Homo sapiens
ccccactggctgaccagaacatatccgtgttcatgctgtccacgtatcagacagacttcatcctgtggtgagctgaccatcacagacacgccttgcacacttgggcccgcctctgacacactcactcccatctcccaccccttgcagccttgcccttccacgctattccagggtgggggcagagtctcagggtgagaggttggtgccccagggccaccaggcacacacagcctcaacttcttgcccc

SEQ ID NO: 278202 - DNA, 318 bp, Homo sapiens
tgagtctctcagggcctgcggctgagccctccccagccctcttcccaggccctgcactcaccagagctgctgctttcagtcccagcctcagtgcctgacatctttgtgctcttacagtccagatgccggtcatccacccactgtccagcccgagcaacaggttctgtgtcaccagcctggaccccgacacgctgcctgctgttgccacactcctcatggatgtcatgtcctacttcaatgggtagggctgccttgggcatgaggggtcgccggctggaccagggggaggcacggctctgcctaggagtcttagtctga

SEQ ID NO: 278203 - DNA, 834 bp, Homo sapiens
caatattataataatctttgttctacaattataacctaggaaaaaccaggccatacagagataggagctgaagggacatgctgagaagtgaccagaaggcaggagtgtgaaccctctgtcatgcccggacagggccactagagggctccctggtctagtggtaatgccagtgcctgggaaggcacccgttacttagcagaccttggtctagcagtggtgccagtgcctgggaagataactgttacttagcagaccgggaaagggagactccctttccctgggggagttagagaagacgctgctccaccacctcttgtggaaggcctgacatcagtcaggcccgcccacagccatccggaggcctaaccgtctccctgtgatgctgtgcttcagcagtcaccctcctgtttcactttcatgttccgctctgtacacctggctccaccttctagatggcagtagcagaattagtgaaagtattagtctttgatctttctgagaagagcatagaagtagtaatgatgtaagctgtcctctctctctccgcctcggctacctaaaaggtaaagacccctgtctggtggacacgtgactcatgtgaccttatctatcgatagagatgactcgcactccttaccctgccccctttgccttgaatacagctctcatctccgaccgggaggagaagacccacaggactagtagggtgggattcacagggcaccctgaaaggatgggcggatccttccaggcgggaaagcgcaagcgggacggtgtcaagcgcaacggctggcggcagggggcgtggcaccgggggcgagacaggggcggtgc

SEQ ID NO: 278204 - DNA, 506 bp, Homo sapiens
tactaaaacctctcttttatttctcagacctccaggtgaaggtacaagacattacaatgcagtggtaccagcagctgcaggatgcttccatgcagtgtgtgttgacctttgagggcctgaccaacagcaaggacagtcaggtaggggagaggtatatggcagtaattttgtggacttgatggttctcagagaatgatcacttcgtgtcccaaaggaatgtagctggcatgtcactttacctgattctaagtgacatctactcagctcttcagaacactgctttctcactgttctcttctggcaggccaaaaagataaagatggacctccagaaggctgctaccatcccagtgagccaaatctctaccattgcaggttggtcagaggggttgagaacatgacctttcatttcattgtattatctttcagactccaaatctatgtatctgtaaggttcctataaaagtatattcaaacaaatgtttacagttggatcgggtacatata

SEQ ID NO: 278205 - DNA, 3369 bp, Homo sapiens
aggcgttaggggcggggctgtgctgcgcgcgcgtcccggaagcagaagcctgtgtggccttcccggcggctgattcgagggcttgtttggtcagaaggggggcgtcagagaagctgccccttagccaaccatgccgtctgagggtcgctgctgggagaccttgaaggccctacgcagttccgacaaaggtcgcctttgctactaccgcgactggctgctgcggcgcgaggatgttttagaagaatgtatgtctcttcccaagctatcttcttattctggatgggtggtagagcacgtcctaccccatatgcaggagaaccaacctctgtctgagacttcgccatcctctacgtcagcttcagccctagatcaaccctcatttgttcccaaatctcctgacgcaagctctgccttttccccagcctcccctgcaacaccaaatggaaccaagggcaaagatgagtcccagcacacagaatctatggtacttcagtcctcacgggggatcaaagtggaaggctgcgtccgaatgtacgaactggtacacagaatgaaaggaacagagggcctgaggctatggcaggaggagcaggagaggaaggtgcaagccctctcggagatggcatctgaacaactgaagcggtttgatgaatggaaggaactgaagcagcataaagaattccaggacttgcgggaagtaatggagaagagctccagagaagccttgggacaccaagagaagctaaaagctgagcaccgtcacagagcaaagattctcaacctgaagctgcgggaagcagagcagcagcgcgtgaagcaagcagaacaggagcggcttcggaaggaagaaggccagatccgcctgcgggccctctatgctctgcaggaggagatgctgcagctcagccagcagctggatgcctctgagcagcacaaagccctgcttaaggtcgacctggctgccttccagacccgaggcaaccagctgtgcagcctcatctcagggatcatccgggcctcttcagagagcagctatcccacagcagagagtcaagctgaggctgagcgagctctgcgggaaatgcgggacctcctgatgaacttggggcaggagatcaccagagcctgcgaagacaagaggaggcaggatgaagaagaggcccaggtaaagctgcaagaggcacagatgcagcagggaccagaggcccacaaagagcccccagctcccagccagggcccaggagggaaacagaatgaagacctccaggtgaaggtacaagacattacaatgcagtggtaccagcagctgcaggatgcttccatgcagtgtgtgttgacctttgagggcctgaccaacagcaaggacagtcaggccaaaaagataaagatggacctccagaaggctgctaccatcccagtgagccaaatctctaccattgcaggctcaaaactgaaggagatctttgacaagatccacagcctgctctctggaaaacctgttcaatctggtgggcgctctgtgtctgtcacacttaacccacaggggctggactttgttcaatacaaactggcagagaaatttgtgaaacaaggcgaggaggaagtggcctctcaccatgaagcagcattccccattgcagttgtggcatccgggatctgggagctccaccccagagtgggggacctcattcttgctcatctacataagaagtgtccttactctgttcctttctatcccactttcaaggagggaatggctttggaagactatcagaggatgcttggttaccaagtaaaggattccaaagtggagcagcaagacaactttctaaaacgcatgtcagggatgatccgtctctacgctgctatcatccagctccggtggccatatggaaaccgacaggagattcaccctcatggcttaaatcatggatggcgctggttggcacagatcttaaacatggagcccttgtcagatgtgacagccaccctcctctttgacttcctggaggtgtgtgggaatgccctcatgaagcaataccaggttcagttctggaagatgctaattctcatcaaagaggactactttcccagaattgaagctatcacaagctcaggacagatgggctccttcatacgcctcaagcagttcttggagaaatgtttgcaacacaaggacattcctgtccccaagggctttctgacttcctccttctggcgctcctgatgtcactccatcacccaccatcaccgctgctgcaaagaggcaataataaaggaactgaagacagctgtatttgggagaagtcatgtcagattcagaaatttgccattatgtatttttatgtatttatgccttgtgactaggagaggagattttcatgggtcacaaaattcttggaggtcccttagtagatttggtagttccttaagagatccacgtgataaaataaatggagttggcctttcttgttttttgcaaaagtgataaaaggtctttagcacttggtctcctcccttgtctctagtgtctttcagaaagttggcaataccttaacaaatgcactctgagctggagggagcccaccatttgcacccacctacccaccctcacccctgttcagatgaatttccagaaagagctaaggctcataaggttcccttttaagtattatttaatagttgaggccagatacttacatgcaagtctgggttatggttgttttgcctttctcagcttgtgaagtcattctaaagctagaggaagtatgtgatatacacatggactaaggctcaggtgacactatggctagattaacatctgggattaggactggaaacacatgtcattttgaactaagggaaactctttgtcatcctaatttggaatttggtccctggatggctagggatccatgaaccaggcaggtaccttttttgtttttgttttgttttgtttcttttctgtttgaattaagatgggctaagatggggcttgcaacattaaacatgagctgagcatccataagcattgaattgggattaaataaagatgttgggcaggaactgaacactgctaatatgatgataaatatgcctgactaaagccactacagaaatccagagattggctgttaaaatttgttttgtggaaagactaattctctttgatactgcagaggcagtggccatggatctgttcctctgtgctaaatgtcttgtggcagggtgtgtttgtgggggagtgttcactggtactcttgagtggcctgaagtgacccattctatgaattgttaattaaggtgccaaaaaaaattaataataaagcttggttttttgaaaaacccattgctgataaaaaaaaacaa

SEQ ID NO: 278206 - DNA, 2301 bp, Homo sapiens
tactaaaacctctcttttatttctcagacctccaggtgaaggtacaagacattacaatgcagtggtaccagcagctgcaggatgcttccatgcagtgtgtgttgacctttgagggcctgaccaacagcaaggacagtcaggtaggggagaggtatatggcagtaattttgtggacttgatggttctcagagaatgatcacttcgtgtcccaaaggaatgtagctggcatgtcactttacctgattctaagtgacatctactcagctcttcagaacactgctttctcactgttctcttctggcaggccaaaaagataaagatggacctccagaaggctgctaccatcccagtgagccaaatctctaccattgcaggctcaaaactgaaggagatctttgacaagatccacagcctgctctctggaaaacctgttcaatctggtgggcgctctgtgtctgtcacacttaacccacaggggctggactttgttcaatacaaactggcagagaaatttgtgaaacaaggcgaggaggaagtggcctctcaccatgaagcagcattccccattgcagttgtggcatccgggatctgggagctccaccccagagtgggggacctcattcttgctcatctacataagaagtgtccttactctgttcctttctatcccactttcaaggagggaatggctttggaagactatcagaggatgcttggttaccaagtaaaggattccaaagtggagcagcaagacaactttctaaaacgcatgtcagggatgatccgtctctacgctgctatcatccagctccggtggccatatggaaaccgacaggagattcaccctcatggcttaaatcatggatggcgctggttggcacagatcttaaacatggagcccttgtcagatgtgacagccaccctcctctttgacttcctggaggtgtgtgggaatgccctcatgaagcaataccaggttcagttctggaagatgctaattctcatcaaagaggactactttcccagaattgaagctatcacaagctcaggacagatgggctccttcatacgcctcaagcagttcttggagaaatgtttgcaacacaaggacattcctgtccccaagggctttctgacttcctccttctggcgctcctgatgtcactccatcacccaccatcaccgctgctgcaaagaggcaataataaaggaactgaagacagctgtatttgggagaagtcatgtcagattcagaaatttgccattatgtatttttatgtatttatgccttgtgactaggagaggagattttcatgggtcacaaaattcttggaggtcccttagtagatttggtagttccttaagagatccacgtgataaaataaatggagttggcctttcttgttttttgcaaaagtgataaaaggtctttagcacttggtctcctcccttgtctctagtgtctttcagaaagttggcaataccttaacaaatgcactctgagctggagggagcccaccatttgcacccacctacccaccctcacccctgttcagatgaatttccagaaagagctaaggctcataaggttcccttttaagtattatttaatagttgaggccagatacttacatgcaagtctgggttatggttgttttgcctttctcagcttgtgaagtcattctaaagctagaggaagtatgtgatatacacatggactaaggctcaggtgacactatggctagattaacatctgggattaggactggaaacacatgtcattttgaactaagggaaactctttgtcatcctaatttggaatttggtccctggatggctagggatccatgaaccaggcaggtaccttttttgtttttgttttgttttgtttcttttctgtttgaattaagatgggctaagatggggcttgcaacattaaacatgagctgagcatccataagcattgaattgggattaaataaagatgttgggcaggaactgaacactgctaatatgatgataaatatgcctgactaaagccactacagaaatccagagattggctgttaaaatttgttttgtggaaagactaattctctttgatactgcagaggcagtggccatggatctgttcctctgtgctaaatgtcttgtggcagggtgtgtttgtgggggagtgttcactggtactcttgagtggcctgaagtgacccattctatgaattgttaattaaggtgccaaaaaaaattaataataaagcttggttttttgaaaaacccattgctgataaaaaaaaacaa

SEQ ID NO: 278207 - DNA, 2240 bp, Homo sapiens
aggcgttaggggcggggctgtgctgcgcgcgcgtcccggaagcagaagcctgtgtggccttcccggcggctgattcgagggcttgtttggtcagaaggggggcgtcagagaagctgccccttagccaaccatgccgtctgagggtcgctgctgggagaccttgaaggccctacgcagttccgacaaaggtcgcctttgctactaccgcgactggctgctgcggcgcgaggatgttttagaagaatgtatgtctcttcccaagctatcttcttattctggatgggtggtagagcacgtcctaccccatatgcaggagaaccaacctctgtctgagacttcgccatcctctacgtcagcttcagccctagatcaaccctcatttgttcccaaatctcctgacgcaagctctgccttttccccagcctcccctgcaacaccaaatggaaccaagggcaaagatgagtcccagcacacagaatctatggtacttcagtcctcacgggggatcaaagtggaaggctgcgtccgaatgtacgaactggtacacagaatgaaaggaacagagggcctgaggctatggcaggaggagcaggagaggaaggtgcaagccctctcggagatggcatctgaacaactgaagcggtttgatgaatggaaggaactgaagcagcataaagaattccaggacttgcgggaagtaatggagaagagctccagagaagccttgggacaccaagagaagctaaaagctgagcaccgtcacagagcaaagattctcaacctgaagctgcgggaagcagagcagcagcgcgtgaagcaagcagaacaggagcggcttcggaaggaagaaggccagatccgcctgcgggccctctatgctctgcaggaggagatgctgcagctcagccagcagctggatgcctctgagcagcacaaagccctgcttaaggtcgacctggctgccttccagacccgaggcaaccagctgtgcagcctcatctcagggatcatccgggcctcttcagagagcagctatcccacagcagagagtcaagctgaggctgagcgagctctgcgggaaatgcgggacctcctgatgaacttggggcaggagatcaccagagcctgcgaagacaagaggaggcaggatgaagaagaggcccaggtaaagctgcaagaggcacagatgcagcagggaccagaggcccacaaagagcccccagctcccagccagggcccaggagggaaacagaatgaagacctccaggtgaaggtacaagacattacaatgcagtggtaccagcagctgcaggatgcttccatgcagtgtgtgttgacctttgagggcctgaccaacagcaaggacagtcaggccaaaaagataaagatggacctccagaaggctgctaccatcccagtgagccaaatctctaccattgcaggctcaaaactgaaggagatctttgacaagatccacagcctgctctctggaaaacctgttcaatctggtgggcgctctgtgtctgtcacacttaacccacaggggctggactttgttcaatacaaactggcagagaaatttgtgaaacaaggcgaggaggaagtggcctctcaccatgaagcagcattccccattgcagttgtggcatccgggatctgggagctccaccccagagtgggggacctcattcttgctcatctacataagaagtgtccttactctgttcctttctatcccactttcaaggagggaatggctttggaagactatcagaggatgcttggttaccaagtaaaggattccaaagtggagcagcaagacaactttctaaaacgcatgtcagggatgatccgtctctacgctgctatcatccagctccggtggccatatggaaaccgacaggagattcaccctcatggcttaaatcatggatggcgctggttggcacagatcttaaacatggagcccttgtcagatgtgacagccaccctcctctttgacttcctggaggtgtgtgggaatgccctcatgaagcaataccaggttcagttctggaagatgctaattctcatcaaagaggactactttcccaggtatcaggcttgttgagcagacagcaggggattaagtaactcataaccaggcctcagatacccaagggtgctattacctgctggttttgattcaagttttgttcatatctattatagtttttttcttttttttttttttttttttt

SEQ ID NO: 278208 - DNA, 1262 bp, Homo sapiens
aggcgttaggggcggggctgtgctgcgcgcgcgtcccggaagcagaagcctgtgtggccttcccggcggctgattcgagggcttgtttggtcagaaggggggcgtcagagaagctgccccttagccaaccatgccgtctgagggtcgctgctgggagaccttgaaggccctacgcagttccgacaaaggtcgcctttgctactaccgcgactggctgctgcggcgcgaggatgttttagaagaatgtatgtctcttcccaagctatcttcttattctggatgggtggtagagcacgtcctaccccatatgcaggagaaccaacctctgtctgagacttcgccatcctctacgtcagcttcagccctagatcaaccctcatttgttcccaaatctcctgacgcaagctctgccttttccccagcctcccctgcaacaccaaatggaaccaagggcaaagatgagtcccagcacacagaatctatggtacttcagtcctcacgggggatcaaagtggaaggctgcgtccgaatgtacgaactggtacacagaatgaaaggaacagagggcctgaggctatggcaggaggagcaggagaggaaggtgcaagccctctcggagatggcatctgaacaactgaagcggtttgatgaatggaaggaactgaagcagcataaagaattccaggacttgcgggaagtaatggagaagagctccagagaagccttgggacaccaagagaagctaaaagctgagcaccgtcacagagcaaagcagcgcgtgaagcaagcagaacaggagcggcttcggaaggaagaaggccagatccgcctgcgggccctctatgctctgcaggaggagatgctgcagctcagccagcagctggatgcctctgagcagcacaaagccctgcttaaggtcgacctggctgccttccagacccgaggcaaccagctgtgcagcctcatctcagggatcatccgggcctcttcagagagcagctatcccacagcagagagtcaagctgaggctgagcgagctctgcgggaaatgcgggacctcctgatgaacttggggcaggagatcaccagagcctgcgaagacaagaggaggcaggatgaagaagaggcccaggtaaagctgcaagaggcacagatgcagcagggaccagaggcccacaaagagcccccagctcccagccagggcccaggagggaaacagaatgaagactccagtgaacgtccagacttccatgcgtggtaca

SEQ ID NO: 278209 - DNA, 2199 bp, Homo sapiens
aggcgttaggggcggggctgtgctgcgcgcgcgtcccggaagcagaagcctgtgtggccttcccggcggctgattcgagggcttgtttggtcagaaggggggcgtcagagaagctgccccttagccaaccatgccgtctgagggtcgctgctgggagaccttgaaggccctacgcagttccgacaaaggtcgcctttgctactaccgcgactggctgctgcggcgcgaggtgagcggtggccccggaggacgtaggcctttccggcccctcgcgaccgaaaccttctccctagccgttggcacgttctgctcccgggaacccgtgcagtctaacaacctgcatttatttcttgacttctgtgtgtacatccctctgtcctggggtttctgtcctcttcagcctattttagcgtttcggggagctcccctgacttcacaggtgccccgcgctctgaaggcttcattgctaccctccgccagttgggcgccttctccgttctgctgttgtcaaagcaatctcggccccaggttcagttaacttactgtatgtctcatgtgctgggagctctagagtttgcgacgaacgattgacacgacctaatccattgctactagtgaaatgaccaaatttttagattgatttggcagacctggaaagtgaatgggggcgtggtcaccgtacctagcatttgcaaagctctgcgcgagaagtggagggatgtggagagttaaggccgagctcccattcccgagtcgctgctagttagctacagataaggcgttgtcctgcatcctcagacttcttgggaaacaatcctaaagtatttccctgtcttttatgttgttgacagttttgaaaaatacagaccttacattctgtaggttgactgccagcatatgtgctttcaaaccaccagaccaaggttaagcattcttggcaggaataccacagaaatgatgccatggctttctcagtaagtcacatgaggaggcacacagatgtcaacccatcccaacactggtgatgctaatcttgatcacctggttacgttattatctgcctggtctctccgtttaaaattcgtcatttttcccttagtaattgttgggaagtaataataccagtatccttttttctgggcaaaccttaatcctccatggctttagcattcattgatgttttccacatgaatcgatacctctatgacgttgccagatcctgtttctttatatccgctattccttctgcatttgttagttggcattctactgtaaggaggtgctttctattttattcagtgagttgtaatccattacttttattatttatttattttattttaaatgtcccagattttgtaagcttgtatcaaaataatcacatgcaaggctaggcgtggtggctcaggcccgtaatcccagcacgttgggaggccgagggggacggatcacttgaggtcaagagttcgcgaccagcctggccaacatggtgaaaccgcatctctactaaaaatacaaaattagccgagcatggtggtgcatgcctgtaatcccagctactcgggagactgaggcatgagaattgcttgaaccctggaagcagaggttgcagtgagccgagattgtgctgctgcactcaagcctgggtgacagagtgagactgtgtctcaaaaaaaaaaaatgtagccttgtaaatatgtacaacaattatgtattcataagaattaaaaagaaaaatgtcccagatttggctactgggcacctcattaagttggttcctgtgttcctgtgacatatttccatctttcattgacatttctttactttttgacacaataaagatgtcccaggtgcaagtttccctgtcttaatcctggaatcagctatttctccacaagaggctgactcttttgaagtggaggatggtgctgtattggcaaaccaagatctgggagttgagtgtgttgagattcttgattgggtaccattgcttctaggccttctcagtagacagagctaggaaataatacatatctaaatatcatgacttcatactgataaatgccacttccaacccagcacttcacttttctttctaatcttaccccatccatgtttgtaaatatgttacctagcagtgagaagtttggctcctgttattctcaatatgtttacttatttgctcaatcagtttacttt

SEQ ID NO: 278210 - DNA, 279 bp, Homo sapiens
aaaaaaaaaaggaaaagaaaaagagattgatctgtggttatatcttttaatttctctctatcatgctcaggctcaaaactgaaggagatctttgacaagatccacagcctgctctctggaaaacctgttcaatctggtgggcgctctgtgtctgtcacacttaacccacaggggctggactttgttcaatacaaactggcagagaaatttgtggtgagaaaccttgttgctagaggtatgggaagcagaggctggtgtacaagatttcagcctttttct

SEQ ID NO: 278211 - DNA, 2452 bp, Homo sapiens
aggcgttaggggcggggctgtgctgcgcgcgcgtcccggaagcagaagcctgtgtggccttcccggcggctgattcgagggcttgtttggtcagaaggggggcgtcagagaagctgccccttagccaaccatgccgtctgagggtcgctgctgggagaccttgaaggccctacgcagttccgacaaaggtcgcctttgctactaccgcgactggctgctgcggcgcgaggatgttttagaagaatgtatgtctcttcccaagctatcttcttattctggatgggtggtagagcacgtcctaccccatatgcaggagaaccaacctctgtctgagacttcgccatcctctacgtcagcttcagccctagatcaaccctcatttgttcccaaatctcctgacgcaagctctgccttttccccagcctcccctgcaacaccaaatggaaccaagggcaaagatgagtcccagcacacagaatctatggtacttcagtcctcacgggggatcaaagtggaaggctgcgtccgaatgtacgaactggtacacagaatgaaaggaacagagggcctgaggctatggcaggaggagcaggagaggaaggtgcaagccctctcggagatggcatctgaacaactgaagcggtttgatgaatggaaggaactgaagcagcataaagaattccaggacttgcgggaagtaatggagaagagctccagagaagccttgggacaccaagagaagctaaaagctgagcaccgtcacagagcaaagattctcaacctgaagctgcgggaagcagagcagcagcgcgtgaagcaagcagaacaggagcggcttcggaaggaagaaggccagatccgcctgcgggccctctatgctctgcaggaggagatgctgcagctcagccagcagctggatgcctctgagcagcacaaagccctgcttaaggtcgacctggctgccttccagacccgaggcaaccagctgtgcagcctcatctcagggatcatccgggcctcttcagagagcagctatcccacagcagagagtcaagctgaggctgagcgagctctgcgggaaatgcgggacctcctgatgaacttggggcaggagatcaccagagcctgcgaagacaagaggaggcaggatgaagaagaggcccaggtaaagctgcaagaggcacagatgcagcagggaccagaggcccacaaagagcccccagctcccagccagggcccaggagggaaacagaatgaagacctccaggtgaaggtacaagacattacaatgcagtggtaccagcagctgcaggatgcttccatgcagtgtgtgttgacctttgagggcctgaccaacagcaaggacagtcaggccaaaaagataaagatggacctccagaaggctgctaccatcccagtgagccaaatctctaccattgcaggctcaaaactgaaggagatctttgacaagatccacagcctgctctctggaaaacctgttcaatctggtgggcgctctgtgtctgtcacacttaacccacaggggctggactttgttcaatacaaactggcagagaaatttgtgaaacaaggcgaggaggaagtggcctctcaccatgaagcagcattccccattgcagttgtggcatccgggatctgggagctccaccccagagtgggggacctcattcttgctcatctacataagaagtgtccttactctgttcctttctatcccactttcaaggagggaatggctttggaagactatcagaggatgcttggttaccaagtaaaggattccaaagtggagcagcaagacaactttctaaaacgcatgtcagggatgatccgtctctacgctgctatcatccagctccggtggccatatggaaaccgacaggagattcaccctcatggcttaaatcatggatggcgctggttggcacagatcttaaacatggagcccttgtcagatgtgacagccaccctcctctttgacttcctggaggtgtgtgggaatgccctcatgaagcaataccaggttcagttctggaagatgctaattctcatcaaagaggactactttcccaggtatcaggcttgttgagcagacagcaggggattaagtaactcataaccaggcctcagatacccaagggtgctattacctgctggttttgattcaagttaaaaacacctgtactaagtatgacatctttcctactccagtccctctcgttgatatttgaataaatgcttttgaaccttaatgagagtctgtcttaaatatcattgcccaaacaaaaacacaaattaggggctgagcacagtggcttatgcctataattatgcctataattgcagctctttgggaggccacaggaggaggatcacttgagcccaggtgttcaaaaccagcctgggcaatatagcaagaccccatctctac

SEQ ID NO: 278212 - DNA, 3494 bp, Homo sapiens
aggcgttaggggcggggctgtgctgcgcgcgcgtcccggaagcagaagcctgtgtggccttcccggcggctgattcgagggcttgtttggtcagaaggggggcgtcagagaagctgccccttagccaaccatgccgtctgagggtcgctgctgggagaccttgaaggccctacgcagttccgacaaaggtcgcctttgctactaccgcgactggctgctgcggcgcgaggctggttgtggtgactcatgcccataatcccaacactttgcgaggctgaggcaggacgagtgcttgaggccagttcaagctgggagccaggcttggtgtctcacacctgcaatcccagcactttggatgttttagaagaatgtatgtctcttcccaagctatcttcttattctggatgggtggtagagcacgtcctaccccatatgcaggagaaccaacctctgtctgagacttcgccatcctctacgtcagcttcagccctagatcaaccctcatttgttcccaaatctcctgacgcaagctctgccttttccccagcctcccctgcaacaccaaatggaaccaagggcaaagatgagtcccagcacacagaatctatggtacttcagtcctcacgggggatcaaagtggaaggctgcgtccgaatgtacgaactggtacacagaatgaaaggaacagagggcctgaggctatggcaggaggagcaggagaggaaggtgcaagccctctcggagatggcatctgaacaactgaagcggtttgatgaatggaaggaactgaagcagcataaagaattccaggacttgcgggaagtaatggagaagagctccagagaagccttgggacaccaagagaagctaaaagctgagcaccgtcacagagcaaagattctcaacctgaagctgcgggaagcagagcagcagcgcgtgaagcaagcagaacaggagcggcttcggaaggaagaaggccagatccgcctgcgggccctctatgctctgcaggaggagatgctgcagctcagccagcagctggatgcctctgagcagcacaaagccctgcttaaggtcgacctggctgccttccagacccgaggcaaccagctgtgcagcctcatctcagggatcatccgggcctcttcagagagcagctatcccacagcagagagtcaagctgaggctgagcgagctctgcgggaaatgcgggacctcctgatgaacttggggcaggagatcaccagagcctgcgaagacaagaggaggcaggatgaagaagaggcccaggtaaagctgcaagaggcacagatgcagcagggaccagaggcccacaaagagcccccagctcccagccagggcccaggagggaaacagaatgaagacctccaggtgaaggtacaagacattacaatgcagtggtaccagcagctgcaggatgcttccatgcagtgtgtgttgacctttgagggcctgaccaacagcaaggacagtcaggccaaaaagataaagatggacctccagaaggctgctaccatcccagtgagccaaatctctaccattgcaggctcaaaactgaaggagatctttgacaagatccacagcctgctctctggaaaacctgttcaatctggtgggcgctctgtgtctgtcacacttaacccacaggggctggactttgttcaatacaaactggcagagaaatttgtgaaacaaggcgaggaggaagtggcctctcaccatgaagcagcattccccattgcagttgtggcatccgggatctgggagctccaccccagagtgggggacctcattcttgctcatctacataagaagtgtccttactctgttcctttctatcccactttcaaggagggaatggctttggaagactatcagaggatgcttggttaccaagtaaaggattccaaagtggagcagcaagacaactttctaaaacgcatgtcagggatgatccgtctctacgctgctatcatccagctccggtggccatatggaaaccgacaggagattcaccctcatggcttaaatcatggatggcgctggttggcacagatcttaaacatggagcccttgtcagatgtgacagccaccctcctctttgacttcctggaggtgtgtgggaatgccctcatgaagcaataccaggttcagttctggaagatgctaattctcatcaaagaggactactttcccagaattgaagctatcacaagctcaggacagatgggctccttcatacgcctcaagcagttcttggagaaatgtttgcaacacaaggacattcctgtccccaagggctttctgacttcctccttctggcgctcctgatgtcactccatcacccaccatcaccgctgctgcaaagaggcaataataaaggaactgaagacagctgtatttgggagaagtcatgtcagattcagaaatttgccattatgtatttttatgtatttatgccttgtgactaggagaggagattttcatgggtcacaaaattcttggaggtcccttagtagatttggtagttccttaagagatccacgtgataaaataaatggagttggcctttcttgttttttgcaaaagtgataaaaggtctttagcacttggtctcctcccttgtctctagtgtctttcagaaagttggcaataccttaacaaatgcactctgagctggagggagcccaccatttgcacccacctacccaccctcacccctgttcagatgaatttccagaaagagctaaggctcataaggttcccttttaagtattatttaatagttgaggccagatacttacatgcaagtctgggttatggttgttttgcctttctcagcttgtgaagtcattctaaagctagaggaagtatgtgatatacacatggactaaggctcaggtgacactatggctagattaacatctgggattaggactggaaacacatgtcattttgaactaagggaaactctttgtcatcctaatttggaatttggtccctggatggctagggatccatgaaccaggcaggtaccttttttgtttttgttttgttttgtttcttttctgtttgaattaagatgggctaagatggggcttgcaacattaaacatgagctgagcatccataagcattgaattgggattaaataaagatgttgggcaggaactgaacactgctaatatgatgataaatatgcctgactaaagccactacagaaatccagagattggctgttaaaatttgttttgtggaaagactaattctctttgatactgcagaggcagtggccatggatctgttcctctgtgctaaatgtcttgtggcagggtgtgtttgtgggggagtgttcactggtactcttgagtggcctgaagtgacccattctatgaattgttaattaaggtgccaaaaaaaattaataataaagcttggttttttgaaaaacccattgctgataaaaaaaaacaa

SEQ ID NO: 278213 - DNA, 2773 bp, Homo sapiens
aggcgttaggggcggggctgtgctgcgcgcgcgtcccggaagcagaagcctgtgtggccttcccggcggctgattcgagggcttgtttggtcagaaggggggcgtcagagaagctgccccttagccaaccatgccgtctgagggtcgctgctgggagaccttgaaggccctacgcagttccgacaaaggtcgcctttgctactaccgcgactggctgctgcggcgcgaggatgttttagaagaatgtatgtctcttcccaagctatcttcttattctggatgggtggtagagcacgtcctaccccatatgcaggagaaccaacctctgtctgagacttcgccatcctctacgtcagcttcagccctagatcaaccctcatttgttcccaaatctcctgacgcaagctctgccttttccccagcctcccctgcaacaccaaatggaaccaagggcaaagatgagtcccagcacacagaatctatggtacttcagtcctcacgggggatcaaagtggaaggctgcgtccgaatgtacgaactggtacacagaatgaaaggaacagagggcctgaggctatggcaggaggagcaggagaggaaggtgcaagccctctcggagatggcatctgaacaactgaagcggtttgatgaatggaaggaactgaagcagcataaagaattccaggacttgcgggaagtaatggagaagagctccagagaagccttgggacaccaagagaagctaaaagctgagcaccgtcacagagcaaagattctcaacctgaagctgcgggaagcagagcagcagcgcgtgaagcaagcagaacaggagcggcttcggaaggaagaaggccagatccgcctgcgggccctctatgctctgcaggaggagatgctgcagctcagccagcagctggatgcctctgagcagcacaaagccctgcttaaggtcgacctggctgccttccagacccgaggcaaccagctgtgcagcctcatctcagggatcatccgggcctcttcagagagcagctatcccacagcagagagtcaagctgaggctgagcgagctctgcgggaaatgcgggacctcctgatgaacttggggcaggagatcaccagagcctgcgaagacaagaggaggcaggatgaagaagaggcccaggtaaagctgcaagaggcacagatgcagcagggaccagaggcccacaaagagcccccagctcccagccagggcccaggagggaaacagaatgaagacctccaggtgaaggtacaagacattacaatgcagtggtaccagcagctgcaggatgcttccatgcagtgtgtgttgacctttgagggcctgaccaacagcaaggacagtcaggccaaaaagataaagatggacctccagaaggctgctaccatcccagtgagccaaatctctaccattgcaggctcaaaactgaaggagatctttgacaagatccacagcctgctctctggaaaacctgttcaatctggtgggcgctctgtgtctgtcacacttaacccacaggggctggactttgttcaatacaaactggcagagaaatttgtgaaacaaggcgaggaggaagtggcctctcaccatgaagcagcattccccattgcagttgtggcatccgggatctgggagctccaccccagagtgggggacctcattcttgctcatctacataagaagtgtccttactctgttcctttctatcccactttcaaggagggaatggctttggaagactatcagaggatgcttggttaccaagtaaaggattccaaagtggagcagcaagacaactttctaaaacgcatgtcagggatgatccgtctctacgctgctatcatccagctccggtggccatatggaaaccgacaggagattcaccctcatggcttaaatcatggatggcgctggttggcacagatcttaaacatggagcccttgtcagatgtgacagccaccctcctctttgacttcctggaggtgtgtgggaatgccctcatgaagcaataccaggttcagttctggaagatgctaattctcatcaaagaggactactttcccagaattgaagctatcacaagctcaggacagatgggctccttcatacgcctcaagcagttcttggagaaatgtttgcaacacaaggacattcctgtccccaagggctttctgacttcctccttctggcgctcctgatgtcactccatcacccaccatcaccgctgctgcaaagaggcaataataaaggaactgaagacagctgtatttgggagaagtcatgtcagattcagaaatttgccattatgtatttttatgtatttatgccttgtgactaggagaggagattttcatgggtcacaaaattcttggaggtcccttagtagatttggtagttccttaagagatccacgtgataaaataaatggagttgggcaggaactgaacactgctaatatgatgataaatatgcctgactaaagccactacagaaatccagagattggctgttaaaatttgttttgtggaaagactaattctctttgatactgcagaggcagtggccatggatctgttcctctgtgctaaatgtcttgtggcagggtgtgtttgtgggggagtgttcactggtactcttgagtggcctgaagtgacccattctatgaattgttaattaaggtgccaaaaaaaattaataataaagcttggttttttgaaaaacccattgctgataaaaaaaaacaa

SEQ ID NO: 278214 - DNA, 277 bp, Homo sapiens
gtgaggaccaggcaggagggcctccctcgaggcgagatggccgcacggtctctagcgcgcagggctctcagagtcgcaggcggtgacgcccggtcggggggcccggtcgcaagggacacacagctgggggcgcaatggcgctggatcgccgaaggtctggttgaaaacttgaacccgcctggagcggatgcctaagaaaatgcaggcccgctgaagcctccccgccgggccctgggccctgaaagcctccggcagtttcccgtgaccccgcggccgc

SEQ ID NO: 278215 - DNA, 300 bp, Homo sapiens
gtgaggaccaggcaggagggcctccctcgaggcgagatggccgcacggtctctagcgcgcagggctctcagagtcgcaggcggtgacgcccggtcggggggcccggtcgcaagggacacacagctgggggcgcaatgtcacccgcattgacgttccctaggcgctggatcgccgaaggtctggttgaaaacttgaacccgcctggagcggatgcctaagaaaatgcaggcccgctgaagcctccccgccgggccctgggccctgaaagcctccggcagtttcccgtgaccccgcggccgc

SEQ ID NO: 278216 - DNA, 204 bp, Homo sapiens
ggcgcgccaacccgggtcaccgccctgcacagcgggagaagtcacccgcattgacgttccctaggcgctggatcgccgaaggtctggttgaaaacttgaacccgcctggagcggatgcctaagaaaatgcaggcccgctgaagcctccccgccgggccctgggccctgaaagcctccggcagtttcccgtgaccccgcggccgc

SEQ ID NO: 278217 - DNA, 656 bp, Homo sapiens
ctaatgggatgtcagtattctaatgaacacagcctgagaaatgttgctgtaatcctgacacttcaatcttgcagcaaaccttgtgctgaaattttctgcatcagaaatcattctggaatcctttttacctggcactgactaaagagatatgggtgttccttcccagaagtctgttcaggagtgagccactggagagcagaagattttggagaggtctcaaaagaaatttctataacaatttcttgatttctgtatgaaacacataaatatattagtagagtatgattccatctagtgaaaatttaaactcataatacatacactgaataatataaataacatagtatgcattctcatcactgattggcagtaagctctaggtatgccacatcctcagtgggtaagtctcctctcagttttcctacctaattgccagcctgtgggtccttttacctctcccatgctaactgctagcgaaggcttaatggcaactaacagtggttgactaccccgttgtgtgtcacgtactttgcatctgtgatatcatttaatattttattagagtgaaaaagtaaaagaaatcatttttggggcttcaactaccacagcagcaggtgccacagcatgacacagagcagtgctagtctgcaaactgt

SEQ ID NO: 278218 - DNA, 1210 bp, Homo sapiens
gtgctccttgccggggtgggggtcgttaccgagtgggaacttctgcaaatcctgacttttgtcacttcgcgccccgcacaagatgtcctgccggcggtgcgattggtcccgttgcttcgaggggaaactgaggccacttagtccgggcacttacccgcagctagttaaggactaggctctgatggagacgcttgttacgacctcaatggcctgtagaatctgggaggccgcctccgacctaagcccaaaaagcacatgatcgggctcacagggggcggccagaggtgaaaacagccaacgctttacaacgacgctgtgcggggcacttcgtgtgtgtcatcccgtctcatcctcgggtgataggaactgttcattcgggaaaattgcaaacaactaaatacccctcaccaggagctggcccattatagcaactctgagacctctctaccgcaggctcttaaaatgggttttcatcccaacagaatttttctgaggaacttgatatacaaattctataatttatattggaagaatgaagatacaagaatagtttttctttctgcacaaaaaggataaagaaggagcactcaccagataccaaggcgtgctacaaagccatggtaattgtgcagcttaacagtggatgtaactgcttctttgctgtggcagattgtattttctgaaggccccaacagtctctcctgtccctcctcctcttctgaaaccttgatacttccctatgaagaggtagggtctaatacttccctccttcaacctgaagccccgccttgggcttgtgacttgcttgtaaccagtcaaatacagtggaagagttactacgtgacttccagggctaggtcagaaaaggatgcagcctcagggttcaacacacacttgggcctggagccaccatgcaagaaggctgccatgctgcgagggagcaaaggcacgtggagggacatacacaggggctgtggctggcagtcctggcctttgagtcatccttgtttaagtgccaggcacacacgttaactacctttaggtaattccatacctcaggtgtcatgtcaccccaagcccttgagccttcccatctgaagccccaggctgtatggagaagaaacaagatgttcctgccacgctctttctgaactgctgacatacagaatctgtgaccataataaaatggttgttttgtgccattaaaaaa

SEQ ID NO: 278219 - DNA, 914 bp, Homo sapiens
gtgctccttgccggggtgggggtcgttaccgagtgggaacttctgcaaatcctgacttttgtcacttcgcgccccgcacaagatgtcctgccggcggtgcgattggtcccgttgcttcgaggggaaactgaggccacttagtccgggcacttacccgcagctagttaaggactaggctctgatggagacgcttgttacgacctcaatggcctgtagaatctgggaggccgcctccgacctaagcccaaaaagcacatgatcgggctcacagggggcggccagaggtgaaaacagccaacgctttacaacgacgctgtgcggggcacttcgtgtgtgtcatcccgtctcatcctcgggtgataggaactgttcattcgggaaaattgcaaacaactaaatacccctcaccaggagctggcccattatagcaactctgagacctctctaccgcaggctcttaaaatgggacaccgccgcccgcccctcgggcaccggacacaggcgcggctgaggactgacggccccctggaagccactcgggagtcctagattttgctgaaggaagaaggggctggagaaaataaaagggcaggagtctggagtgtgataactgtggcttcgtctcatttccacccgccaagactaaaacttccctcatctgctcagcgggaagaaacagaagttcttggccatggtgtgacagtgacaccgagagaagcccgattcactcccaggtttctgctcacaggtcacctggccagggatgccctccctgaccaccctgaatgcaacagcaacaccgaccctgcctgtgcagtggacactatactgctcttacccttcctggttatttgttactgctcacctggttactgcttaccacatttggttatttggtatcccttcccatgagg

SEQ ID NO: 278220 - DNA, 658 bp, Homo sapiens
tgtgagaccccagctcaaagacgacacacggagaagggagccaagcagcactgaccgatgtgggcagcgttattgccgaccaggaatttgtccctggacttcccctccgcactgctccatgctcaccttcctcttctcgggggtctccaccagctgccagctgttggccttgaggtggtagagttcatcgaacttcatgctgatatcctcgatggacagctgtagcaggtcccagaaccctgccaggtcctgggctgtggggcgtgggttggcatcagggttctgtgggccagatggggatcagtggggccagctcagcagaggcttgtcctgctccccccaaccccccaacaagcagggttcctctgggccctgccagcacccgcgggggctcttgaggcctagtgtctggggaagaaacagaagttcttggccatggtgtgacagtgacaccgagagaagcccgattcactcccaggtttctgctcacaggtcacctggccagggatgccctccctgaccaccctgaatgcaacagcaacaccgaccctgcctgtgcagtggacactatactgctcttacccttcctggttatttgttactgctcacctggttactgcttaccacatttggttatttggtatcccttcccatgagg

SEQ ID NO: 278221 - DNA, 549 bp, Homo sapiens
ttcttctccccagatctctacagacttcctctctccctctcttcaggtttctgctcacaggtcacctggccagggatgccctccctgaccaccctgaatgcaacagcaacaccgaccctgcctgtgcagtggacactatactgctcttacccttcctggttatttgttactgctcacctggttactgcttaccacatttggttatttggtatcccttcccatgaggggagggattttgttttgttcactgcgacatccccagaagctacaacagtacctggcataaggtaggtactcaataaatattcactgagtgaatgacggtcaggacaaggtagagatatggacctattattccacactgtcctgaagcaccttgccatacagttggacaagatatcaataagatcagagagacaaggggccaggcatggtggctcacgcctgtaatcccagcactttgggaggctgcggtgggcggatcacgaggtcaggagatcaagaccatcctggctaacacggtgaaactccatctctattaaaattaca

SEQ ID NO: 278222 - DNA, 5935 bp, Homo sapiens
agtgccgccactggaaccaggagatgcggcgcaggagctgtcgctgtgtttgctttaacctgagtcttgttccttattgtggttcctgctgtggttttgatcatgttgttaccctcggacgtagcccggcttgtattgggttacttacagcaagaaaacctcatttctacctgccagacttttattttggaaagttcagatttaaaagaatatgcagaacattgtacagatgaagggtttattccagcctgcttactgtccttatttggaaaaaacttgacaacaattttaaatgagtatgtagctatgaaaacaaaagaaacatcaaataatgtcccagcaataatgtcatctctatggaagaaattggaccatacactttctcagatcaggagcatgcaaagttccccaaggtttgctggcagtcagagagcccgaacgagaactggaattgcagaaatcaaacggcagagaaagcttgcatctcaaacagctccagccagtgcagagttgctcactttaccttacctttcaggacagtttaccactcctccttccacaggtacacaggttactcgaccaagtggccaaatttcagatccatcgaggtcatattttgtagtggtcaaccactcacagtcacaagatactgtaaccactggagaagctttaaatgtcattcctggtgctcaggaaaagaaagcacatgccagtttaatgtctcccggtagacgcaaaagtgaatctcagagaaaaagtaccactttgtctggccctcattcaacaatacggaatttccaagatccaaacgcttttgcagtagaaaaacaaatggttattgaaaatgcacgagaaaaaatactaagcaacaaatctcttcaagaaaagctagcagaaaacataaataaatttttaactagtgataacaatattgcccaagtacctaagcaaacagataacaaccctacggagccagagacttcaattgatgaattcctaggacttccgagtgaaattcacatgtctgaagaagctatacaggacatattggaacagacagaatcagacccagcatttcaggcactctttgatctctttgactatggcaaaacaaagaataataaaaatatatcacaaagtatttccagtcaacctatggaatccaatcccagtatagtcttagcagatgaaactaatctagcagttaaaggttcttttgaaacagaagaatctgatggtcagtctggtcagcccgctttttgtacatcctatcagaatgatgacccattaaatgctttgaagaatagcaacaaccatgatgtgcttagacaagaagaccaggaaaatttttcccaaataagtaccagcatacagaaaaaggcctttaaaacagctgtacccactgaacagaagtgtgacattgacattacctttgagtccgtgcctaatttgaatgactttaaccaaagagggaattctaatgctgaatgtaatccacattgtgctgaattatacaccaatcagatgtccactgaaactgaaatggctatagggattgaaaagaactctttgtcttcaaatgtaccgagtgaatctcagttacagcctgatcagcctgatataccaataacttcatttgtttcacttggttgtgaagctaacaatgaaaacttaattctctctgggaagagttctcaacttttatcccaagatacttcattaactggaaagccatctaaaaaaagtcaattttgtgaaaattctaatgatacagtaaaacttaaaattaattttcatggttccaagtcatcagattctagtgaaattcacaagagtaaaatagaaattaatgtgttagaaccagttatgtcacagctatcaaattgccaagataattcttgtcttcaaagtgaaatactacctgtgtctgttgaaagttcacatttaaatgtatctggacaagtagaaattcatcttggagattcgctgtcttctactaaacaaccatctaatgattcagcatctgttgagttaaatcatacagaaaatgaagctcaggcatccaagtctgagaattcacaggagccttcatcttctgtaaaagaagagaatactatttttctctctttaggtggaaatgctaactgtgagaaagttgcactgacgcctccagaaggcactcctgtagaaaacagtcactctcttcctccagaatctgtgtgttcttcagtgggagattctcaccctgagtcccaaaatactgatgataaaccttctagcaacaactcagcagagatagatgcatcaaatatcgtctctctcaaagttatcattagtgatgatccatttgtttcctcagatactgaacttaccagtgctgtttctagtattaatggagaaaacctgccaactataatcttgtcttctcctactaaatcacctactaaaaatgcagaactagttaaatgcctatcttcagaagaaactgtaggtgctgttgtatatgccgaagtaggggattcagcctcaatggaacagagtcttttaacattcaaatctgaagactctgcagtaaacaatactcagaatgaagatggcattgctttttcagctaatgttacaccatgtgtttccaaggatggaggatatatacagttgatgccagccacaagcacagcttttggcaattcaaataacattctgatagctacctgtgtgactgatccaacagcgttaggaacatctgtaagtcagtctaatgtagtggtgttgcctggaaattctgcacctatgactgctcaacctctaccacctcagttacagacaccaccaaggtcaaacagtgtatttgctgtcaaccaagctgtgtcaccaaacttttcacaaggatctgccataataattgcctctccagtccagcctgtactccaaggaatggtagggatgatcccagtatctgtggttggacagaatggaaataacttttctactcctcctcggcaggttcttcatatgcctttgacagcacctgtatgcaatagaagtatccctcaattccccgtccctccaaaatctcagaaggctcagggactaagaaacaagccttgtataggaaaacaagtaaataatttggtggattcgtcaggtcattcagttggatgtcatgcacaaaaaactgaagtttctgacaaaagtattgccacagatcttgggaaaaaatcagaagaaaccacagttcccttcccagaagagagtatagttccagctgctaaaccatgccacagacgtgtactctgtttcgacagcactactgctcctgtggcaaatacgcaggggccaaaccataagatggtgtcccaaaacaaagaaaggaatgcagtctcttttcctaatcttgactcacccaatgtgtcctccaccttaaaacccccttctaataatgctatcaaaagagagaaagagaagcctcctctgcctaagattttatctaaatcggaaagtgccattagccggcataccaccataagagaaactcaatcagaaaagaaagtttcaccaacagaaattgtgcttgaatctttccataaagcaacagctaataaggagaatgaattatgcagcgatgtagaaagacagaaaaatccagaaaattcaaaactatctattgggcagcaaaatgggggtttgcgaagtgagaaatctatagcttcactgcaagaaatgaccaaaaaacaaggcacatcttcaaacaataaaaatgtactttcagtaggtacagctgtgaaggatctaaaacaagaacaaactaaatccgccagttctttgattaccacagaaatgttacaggatatacagaggcacagctcagtaagtaggcttgctgatagtagtgatttacctgtgccccggacacctggctcaggggcaggggaaaaacataaagaagaacctatagatattatcaaggccccctctagtaggcgtttcagtgaagacagtagtacatcaaaagtaatggtccctcctgtcaccccagacttgcctgcctgcagccctgccagtgaaacaggaagtgaaaacagtgtaaatatggctgcccacacattaatgattctctccagggcagccatttctaggactacttcagcaactcctctgaaagataacacacaacagtttagagcatcttcaaggagcaccacaaaaaagcggaaaattgaggaattagatgaacgtgagcgaaactctcgtccttctagtaaaaatcttacaaattcatcaataccaatgaaaaagaagaaaattaagaaaaagaagcttcccagttcatttccagcaggaatggatgtagacaaatttttgttatcattgcattatgatgagtaaacattctggacacataagaacagtaggtgttaaaaactcatatcccttaaactgagtgtagggaatgggatattgacagaatctgaaagcatgacctgcactttcattgtactgaaacttcactttatatctaaatcatgctgtttctgaaacagcttcctagtttgtaaatagacttacttggtatatttttattttgggaaaaacgtttgcagaaatgtaagtaaagccaatctgcaaaactgtatagctttgacaattccatattgtaaatactgtgtaaatcttgttgaaatagaggttaaatcaacctaatgttcttacactgtgttttttgacttcttatgatccctaattctgagacttactcatctggaatagtttctcacttgttttggaggaaaatgatgcttattcttataaattaccttcagtaactattcaataagacatttaaatacacaatcactaagtactacaaaataataaccacctcaactgatagcaaaatatctaattagaaatcaacagtttgatgagtttttttcctagagtgaattactacccctttcttataattgctgtaagtattatatttctggaatttcacactttacctactctgatcactctgttctctttgttttaaagagagaattttgtaaaccatttattgaatgttctgatctttcatttataacttaagattttttacagaactttaagtggttagactattgagccataaaattttggtttgtagtagagatttctcggtatgtacttttcccctaaatgctggggatttaaagaattgcactaattcatagaactctttacattgtagtgaccaatgcacatataatttaaatcttgtgttctatgtgagagtttatgtggaggattatcttctggtgttgtgtccatcataagatgtaaaaagagaaatcatagttttatattttagtttctcctacaatgggtatgttaaataactatatctatacttagatatagtgcattgtctgtgtcccttaaagtgttacaaagagtttctctcaaaaggtccttaaggagagtgagagatgagagaggtgccttctctgtattagactcacacacatcagtccagttgaagaattggtttaaacttttaaatgagaacagaaattataattagtacctgaccaattgtgcctagatattaaagtatgttctctttagtactttccgttcaattaaatatcagtatattagggatttttttctacaggtgtatattttgttgaagagtcactttcctcaaccatttttttgtactgggcctttaaaaaaataaatccatccaactttaacacaacatttctcagtgtagaaatcatgtcttcttaattgctgaaccttactgcaaaaacttgtgatgtaagaaatttgtatggtgtggcagtggtctattcctaaggaactaaatatcatatagttaatgtttatttaactcagcttgagactgtactacagttaggtttgaataaatattttcattaacttc

SEQ ID NO: 278223 - DNA, 3942 bp, Homo sapiens
agtgccgccactggaaccaggagatgcggcgcaggagctgtcgctgtgtttgctttaacctgagtcttgttccttattgtggttcctgctgtggttttgatcatgttgttaccctcggacgtagcccggcttgtattgggttacttacagcaagaaaacctcatttctacctgccagacttttattttggaaagttcagatttaaaagaatatgcagaacattgtacagatgaagggtttattccagcctgcttactgtccttatttggaaaaaacttgacaacaattttaaatgagtatgtagctatgaaaacaaaagaaacatcaaataatgtcccagcaataatgtcatctctatggaagaaattggaccatacactttctcagatcaggagcatgcaaagttccccaaggtttgctggcagtcagagagcccgaacgagaactggaattgcagaaatcaaacggcagagaaagcttgcatctcaaacagctccagccagtgcagagttgctcactttaccttacctttcaggacagtttaccactcctccttccacaggtacacaggttactcgaccaagtggccaaatttcagatccatcgaggtcatattttgtagtggtcaaccactcacagtcacaagatactgtaaccactggagaagctttaaatgtcattcctggtgctcaggaaaagaaagcacatgccagtttaatgtctcccggtagacgcaaaagtgaatctcagagaaaaagtaccactttgtctggccctcattcaacaatacggaatttccaagatccaaacgcttttgcagtagaaaaacaaatggttattgaaaatgcacgagaaaaaatactaagcaacaaatctcttcaagaaaagctagcagaaaacataaataaatttttaactagtgataacaatattgcccaagtacctaagcaaacagataacaaccctacggagccagagacttcaattgatgaattcctaggacttccgagtgaaattcacatgtctgaagaagctatacaggacatattggaacagacagaatcagacccagcatttcaggcactctttgatctctttgactatggcaaaacaaagaataataaaaatatatcacaaagtatttccagtcaacctatggaatccaatcccagtatagtcttagcagatgaaactaatctagcagttaaaggttcttttgaaacagaagaatctgatggtcagtctggtcagcccgctttttgtacatcctatcagaatgatgacccattaaatgctttgaagaatagcaacaaccatgatgtgcttagacaagaagaccaggaaaatttttcccaaataagtaccagcatacagaaaaaggcctttaaaacagctgtacccactgaacagaagtgtgacattgacattacctttgagtccgtgcctaatttgaatgactttaaccaaagagggaattctaatgctgaatgtaatccacattgtgctgaattatacaccaatcagatgtccactgaaactgaaatggctatagggattgaaaagaactctttgtcttcaaatgtaccgagtgaatctcagttacagcctgatcagcctgatataccaataacttcatttgtttcacttggttgtgaagctaacaatgaaaacttaattctctctgggaagagttctcaacttttatcccaagatacttcattaactggaaagccatctaaaaaaagtcaattttgtgaaaattctaatgatacagtaaaacttaaaattaattttcatggttccaagtcatcagattctagtgaaattcacaagagtaaaatagaaattaatgtgttagaaccagttatgtcacagctatcaaattgccaagataattcttgtcttcaaagtgaaatactacctgtgtctgttgaaagttcacatttaaatgtatctggacaagtagaaattcatcttggagattcgctgtcttctactaaacaaccatctaatgattcagcatctgttgagttaaatcatacagaaaatgaagctcaggcatccaagtctgagaattcacaggagccttcatcttctgtaaaagaagagaatactatttttctctctttaggtggaaatgctaactgtgagaaagttgcactgacgcctccagaaggcactcctgtagaaaacagtcactctcttcctccagaatctgtgtgttcttcagtgggagattctcaccctgagtcccaaaatactgatgataaaccttctagcaacaactcagcagagatagatgcatcaaatatcgtctctctcaaagttatcattagtgatgatccatttgtttcctcagatactgaacttaccagtgctgtttctagtattaatggagaaaacctgccaactataatcttgtcttctcctactaaatcacctactaaaaatgcagaactagttaaatgcctatcttcagaagaaactgtaggtgctgttgtatatgccgaagtaggggattcagcctcaatggaacagagtcttttaacattcaaatctgaagactctgcagtaaacaatactcagaatgaagatggcattgctttttcagctaatgttacaccatgtgtttccaaggatggaggatatatacagttgatgccagccacaagcacagcttttggcaattcaaataacattctgatagctacctgtgtgactgatccaacagcgttaggaacatctgtaagtcagtctaatgtagtggtgttgcctggaaattctgcacctatgactgctcaacctctaccacctcagttacagacaccaccaaggtcaaacagtgtatttgctgtcaaccaagctgtgtcaccaaacttttcacaaggatctgccataataattgcctctccagtccagcctgtactccaaggaatggtagggatgatcccagtatctgtggttggacagaatggaaataacttttctactcctcctcggcaggttcttcatatgcctttgacagcacctgtatgcaatagaagtatccctcaattccccgtccctccaaaatctcagaaggctcagggactaagaaacaagccttgtataggaaaacaagtaaataatttggtggattcgtcaggtcattcagttggatgtcatgcacaaaaaactgaagtttctgacaaaagtattgccacagatcttgggaaaaaatcagaagaaaccacagttcccttcccagaagagagtatagttccagctgctaaaccatgccacagacgtgtactctgtttcgacagcactactgctcctgtggcaaatacgcaggggccaaaccataagatggtgtcccaaaacaaagaaaggaatgcagtctcttttcctaatcttgactcacccaatgtgtcctccaccttaaaacccccttctaataatgctatcaaaagagagaaagagaagcctcctctgcctaagattttatctaaatcggaaagtgccattagccggcataccaccataagagaaactcaatcagaaaagaaagtttcaccaacagaaattgtgcttgaatctttccataaagcaacagctaataaggagaatggtgatatactatcttcttgatgtgcagttttatttagttagctagtattttgttgaggacttttgcatctatgctcatcagggatagtggtctgcagttttctttttattatgtcctttcctggttttgatattagatcagggaagatttcctcaattgtttgttcaaataagttttccaaacttgtagccttgtcttctccctcaggaatgccaatcattcttaggtttggccttttcacataatctcatatttcttagagactttgtccacttcttttgattatttttctttatctttgtctaattggataatttgaaagccttgtcttg

SEQ ID NO: 278224 - DNA, 485 bp, Homo sapiens
gcccctcgaggccaagaattcgggcaagagggtgtatattttgttgaagagtcactttcctcaaccatttttttgtactgggcctttaaaaaaataaatccatccaactttaacacaacatttctcagtgtagaaatcatgtcttcttaattgctgaaccttactgcaaaaacttgtgatgtaagaaatttgtatggtgtggcagtggtctattcctaaggaactaaatatcatatagttaatgtttatttaactcagcttgagactgtactacagttaggtttgaataaatattttcattaacttcaaaagtttgaattactttacattggcagtcttgtttagaaactgattaaattcctttgcaagtcagttctttttgggagtttgtacaatgctgaaaatcacagttttcttcttattcaattcatagttgtatgtactaagcactgaaaattcatatacaaataaaataagtttacttt

SEQ ID NO: 278225 - DNA, 281 bp, Homo sapiens
ttgagactatattgtactttggattttattgtaaaaccttaaggcataaagactgtattttattaatcttagtgtcttttaccatgctttacacatggtaggcactcagtacatgttaattgaatttaatgtaaaataataatcactaatgctttttatcccattacaagtttagaaaactattcagtttctttggcttactgttatgttttcttgaaatacagctggagaagctttagtgattattattttacattaaattcaattaacatgtacgtcga

SEQ ID NO: 278226 - DNA, 5563 bp, Homo sapiens
tatagatcgagctcggtaccgaatctcgaccaagtggccaaatttcagatccatcgaggtcatattttgtagtggtcaaccactcacagtcacaagatactgtaaccactggagaagctttaaatgtcattcctggtgctcaggaaaagaaagcacatgccagtttaatgtctcccggtagacgcaaaagtgaatctcagagaaaaagtaccactttgtctggccctcattcaacaatacggaatttccaagatccaaacgcttttgcagtagaaaaacaaatggttattgaaaatgcacgagaaaaaatactaagcaacaaatctcttcaagaaaagctagcagaaaacataaataaatttttaactagtgataacaatattgcccaagtacctaagcaaacagataacaaccctacggagccagagacttcaattgatgaattcctaggacttccgagtgaaattcacatgtctgaagaagctatacaggacatattggaacagacagaatcagacccagcatttcaggcactctttgatctctttgactatggcaaaacaaagaataataaaaatatatcacaaagtatttccagtcaacctatggaatccaatcccagtatagtcttagcagatgaaactaatctagcagttaaaggttcttttgaaacagaagaatctgatggtcagtctggtcagcccgctttttgtacatcctatcagaatgatgacccattaaatgctttgaagaatagcaacaaccatgatgtgcttagacaagaagaccaggaaaatttttcccaaataagtaccagcatacagaaaaaggcctttaaaacagctgtacccactgaacagaagtgtgacattgacattacctttgagtccgtgcctaatttgaatgactttaaccaaagagggaattctaatgctgaatgtaatccacattgtgctgaattatacaccaatcagatgtccactgaaactgaaatggctatagggattgaaaagaactctttgtcttcaaatgtaccgagtgaatctcagttacagcctgatcagcctgatataccaataacttcatttgtttcacttggttgtgaagctaacaatgaaaacttaattctctctgggaagagttctcaacttttatcccaagatacttcattaactggaaagccatctaaaaaaagtcaattttgtgaaaattctaatgatacagtaaaacttaaaattaattttcatggttccaagtcatcagattctagtgaaattcacaagagtaaaatagaaattaatgtgttagaaccagttatgtcacagctatcaaattgccaagataattcttgtcttcaaagtgaaatactacctgtgtctgttgaaagttcacatttaaatgtatctggacaagtagaaattcatcttggagattcgctgtcttctactaaacaaccatctaatgattcagcatctgttgagttaaatcatacagaaaatgaagctcaggcatccaagtctgagaattcacaggagccttcatcttctgtaaaagaagagaatactatttttctctctttaggtggaaatgctaactgtgagaaagttgcactgacgcctccagaaggcactcctgtagaaaacagtcactctcttcctccagaatctgtgtgttcttcagtgggagattctcaccctgagtcccaaaatactgatgataaaccttctagcaacaactcagcagagatagatgcatcaaatatcgtctctctcaaagttatcattagtgatgatccatttgtttcctcagatactgaacttaccagtgctgtttctagtattaatggagaaaacctgccaactataatcttgtcttctcctactaaatcacctactaaaaatgcagaactagttaaatgcctatcttcagaagaaactgtaggtgctgttgtatatgccgaagtaggggattcagcctcaatggaacagagtcttttaacattcaaatctgaagactctgcagtaaacaatactcagaatgaagatggcattgctttttcagctaatgttacaccatgtgtttccaaggatggaggatatatacagttgatgccagccacaagcacagcttttggcaattcaaataacattctgatagctacctgtgtgactgatccaacagcgttaggaacatctgtaagtcagtctaatgtagtggtgttgcctggaaattctgcacctatgactgctcaacctctaccacctcagttacagacaccaccaaggtcaaacagtgtatttgctgtcaaccaagctgtgtcaccaaacttttcacaaggatctgccataataattgcctctccagtccagcctgtactccaaggaatggtagggatgatcccagtatctgtggttggacagaatggaaataacttttctactcctcctcggcaggttcttcatatgcctttgacagcacctgtatgcaatagaagtatccctcaattccccgtccctccaaaatctcagaaggctcagggactaagaaacaagccttgtataggaaaacaagtaaataatttggtggattcgtcaggtcattcagttggatgtcatgcacaaaaaactgaagtttctgacaaaagtattgccacagatcttgggaaaaaatcagaagaaaccacagttcccttcccagaagagagtatagttccagctgctaaaccatgccacagacgtgtactctgtttcgacagcactactgctcctgtggcaaatacgcaggggccaaaccataagatggtgtcccaaaacaaagaaaggaatgcagtctcttttcctaatcttgactcacccaatgtgtcctccaccttaaaacccccttctaataatgctatcaaaagagagaaagagaagcctcctctgcctaagattttatctaaatcggaaagtgccattagccggcataccaccataagagaaactcaatcagaaaagaaagtttcaccaacagaaattgtgcttgaatctttccataaagcaacagctaataaggagaatgaattatgcagcgatgtagaaagacagaaaaatccagaaaattcaaaactatctattgggcagcaaaatgggggtttgcgaagtgagaaatctatagcttcactgcaagaaatgaccaaaaaacaaggcacatcttcaaacaataaaaatgtactttcagtaggtacagctgtgaaggatctaaaacaagaacaaactaaatccgccagttctttgattaccacagaaatgttacaggatatacagaggcacagctcagtaagtaggcttgctgatagtagtgatttacctgtgccccggacacctggctcaggggcaggggaaaaacataaagaagaacctatagatattatcaaggccccctctagtaggcgtttcagtgaagacagtagtacatcaaaagtaatggtccctcctgtcaccccagacttgcctgcctgcagccctgccagtgaaacaggaagtgaaaacagtgtaaatatggctgcccacacattaatgattctctccagggcagccatttctaggactacttcagcaactcctctgaaagataacacacaacagtttagagcatcttcaaggagcaccacaaaaaagcggaaaattgaggaattagatgaacgtgagcgaaactctcgtccttctagtaaaaatcttacaaattcatcaataccaatgaaaaagaagaaaattaagaaaaagaagcttcccagttcatttccagcaggaatggatgtagacaaatttttgttatcattgcattatgatgagtaaacattctggacacataagaacagtaggtgttaaaaactcatatcccttaaactgagtgtagggaatgggatattgacagaatctgaaagcatgacctgcactttcattgtactgaaacttcactttatatctaaatcatgctgtttctgaaacagcttcctagtttgtaaatagacttacttggtatatttttattttgggaaaaacgtttgcagaaatgtaagtaaagccaatctgcaaaactgtatagctttgacaattccatattgtaaatactgtgtaaatcttgttgaaatagaggttaaatcaacctaatgttcttacactgtgttttttgacttcttatgatccctaattctgagacttactcatctggaatagtttctcacttgttttggaggaaaatgatgcttattcttataaattaccttcagtaactattcaataagacatttaaatacacaatcactaagtactacaaaataataaccacctcaactgatagcaaaatatctaattagaaatcaacagtttgatgagtttttttcctagagtgaattactacccctttcttataattgctgtaagtattatatttctggaatttcacactttacctactctgatcactctgttctctttgttttaaagagagaattttgtaaaccatttattgaatgttctgatctttcatttataacttaagattttttacagaactttaagtggttagactattgagccataaaattttggtttgtagtagagatttctcggtatgtacttttcccctaaatgctggggatttaaagaattgcactaattcatagaactctttacattgtagtgaccaatgcacatataatttaaatcttgtgttctatgtgagagtttatgtggaggattatcttctggtgttgtgtccatcataagatgtaaaaagagaaatcatagttttatattttagtttctcctacaatgggtatgttaaataactatatctatacttagatatagtgcattgtctgtgtcccttaaagtgttacaaagagtttctctcaaaaggtccttaaggagagtgagagatgagagaggtgccttctctgtattagactcacacacatcagtccagttgaagaattggtttaaacttttaaatgagaacagaaattataattagtacctgaccaattgtgcctagatattaaagtatgttctctttagtactttccgttcaattaaatatcagtatattagggatttttttctacaggtgtatattttgttgaagagtcactttcctcaaccatttttttgtactgggcctttaaaaaaataaatccatccaactttaacacaacatttctcagtgtagaaatcatgtcttcttaattgctgaaccttactgcaaaaacttgtgatgtaagaaatttgtatggtgtggcagtggtctattcctaaggaactaaatatcatatagttaatgtttatttaactcagcttgagactgtactacagttaggtttgaataaatattttcattaacttcaaaagtttgaattactttacattggcagtcttgtttagaaactgattaaattcctttgcaagtcagttctttttgggagtttgtacaatgctgaaaatcacagttttcttcttattcaattcatagttgtatgtactaagcactgaaaattcatatacaaataaaataagtttacttt

SEQ ID NO: 278227 - DNA, 1194 bp, Homo sapiens
aagcagtggtatcaacagagtgcccattacggccctttcttataattgctgtaagtattatatttctggaatttcacactttacctactctgatcactctgttctctttgttttaaagagagaattttgtaaaccatttattgaatgttctgatctttcatttataacttaagattttttacagaactttaagtggttagactattgagccataaaattttggtttgtagtagagatttctcggtatgtacttttcccctaaatgctggggatttaaagaattgcactaattcatagaactctttacattgtagtgaccaatgcacatataatttaaatcttgtgttctatgtgagagtttatgtggaggattatcttctggtgttgtgtccatcataagatgtaaaaagagaaatcatagttttatattttagtttctcctacaatgggtatgttaaataactatatctatacttagatatagtgcattgtctgtgtcccttaaagtgttacaaagagtttctctcaaaaggtccttaaggagagtgagagatgagagaggtgccttctctgtattagactcacacacatcagtccagttgaagaattggtttaaacttttaaatgagaacagaaattataattagtacctgaccaattgtgcctagatattaaagtatgttctctttagtactttccgttcaattaaatatcagtatattagggatttttttctacaggtgtatattttgttgaagagtcactttcctcaaccatttttttgtactgggcctttaaaaaaataaatccatccaactttaacacaacatttctcagtgtagaaatcatgtcttcttaattgctgaaccttactgcaaaaacttgtgatgtaagaaatttgtatggtgtggcagtggtctattcctaaggaactaaatatcatatagttaatgtttatttaactcagcttgagactgtactacagttaggtttgaataaatattttcattaacttcaaaagtttgaattactttacattggcagtcttgtttagaaactgattaaattcctttgcaagtcagttctttttgggagtttgtacaatgctgaaaatcacagttttcttcttattcaattcatagttgtatgtactaagcactgaaaattcatatacaaataaaataagtttacttt

SEQ ID NO: 278228 - DNA, 1190 bp, Homo sapiens
agtgccgccactggaaccaggagatgcggcgcaggagctgtcgctgtgtttgctttaacctgagtcttgttccttattgtggttcctgctgtggttttgatcatgttgttaccctcggacgtagcccggcttgtattgggttacttacagcaagaaaacctcatttctacctgccagacttttattttggaaagttcagatttaaaagaatatgcagaacattgtacagatgaagggtttattccagcctgcttactggtgagttatttgttccttaagggaaatatttcatcaacacaagagactaaaaacatagtcataaaatcagcttatcagaaaaaaaaaattgaaattggcagaaatttggtggtttatattcatgcatgactggtaagacccaaagaagaccagcttttctttttacaaatttatgccaaaactattaaatgaattacaactttgactccgagagttagtttcaaaatgacaccctcgtttctgattagtttcgctgctgctgtctccaagcctttttttttcttcctgacctgtatctggctgctccttttagacaaatataaaacagatattttgatatattattgtcatctcttttgttaaatatcactagaccaacaaaccatcatttggtacatagtggataccttccagaactacatcatttcacatggtgtttgccattttattttaatcatggctccttaaaggctatcacagataacatgaatgtctgcttaggaaactgaaaatgatgcaaaactaaagttaagcagggtcatagaatacagaatatacacaaatccattatattccgtatgcctgcaatgaacaattggattttgaaaatacccgtttataatagcaacaaacaaacaaacaaaatgcttagagataatctaacaaaatatgtgtgaaatccaaatgctcaaaattgcctgagatctaaggcctgaataaaaggagaattgtattgtgtgtacaaattgagagactcaatattgttaaggtgttagttcctcccaatttaattatagatttttcacagtcaaaatgcctgcaagcatttttatagataacacaaagctgaattctaagttttaaatggaaaagaaactagaatagcctaaacagtttctgaaaaagaacaacttggaggactcacattacca

SEQ ID NO: 278229 - DNA, 829 bp, Homo sapiens
ttttctctctttaggtggaaatgctaactgtgagaaagttgcactgacgcctccagaaggcactcctgtagaaaacagtcactctcttcctccagaatctgtgtgttcttcagtgggagattctcaccctgagtcccaaaatactgatgataaaccttctagcaacaactcagcagagatagatgcatcaaatatcgtctctctcaaagttatcattagtgatgatccatttgtttcctcagatactgaacttaccagtgctgtttctagtattaatggagaaaacctgccaactataatcttgtcttctcctactaaatcacctactaaaaatgcagaactagttaaatgcctatcttcagaagaaactgtaggtgctgttgtatatgccgaagtaggggattcagcctcaatggaacagagtcttttaacattcaaatctgaagactctgcagtaaacaatactcagaatgaagatggcattgctttttcagctaatgttacaccatgtgtttccaaggatggaggatatatacagttgatgccagccacaagcacagcttttggcaattcaaataacattctgatagctacctgtgtgactgatccaacagcgttaggaacatctgtaagtcagtctaatgtagtggtgttgcctggaaattctgcacctatgactgctcaacctctaccacctcagttacagacaccaccaaggtcaaacagtgtatttgctgtcaaccaagctgtgtcaccaaacttttcacaaggtaactttaataacataattgaaatttgtttctctgggttgggatctaatttcttttgt

SEQ ID NO: 278230 - DNA, 733 bp, Homo sapiens
gagacggagtctcgctctgtcgcccaggctggagtgcagtggcgcgatctcggctcactgcaagctccgcctcccgggttcacgccattctcctgcctcagcctcccgagtagctgggactacaggcgcccgctaccacgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggccaagttcaggtttcttaattcatggtgttatcaatattaattactgcagaacaaatataatcttggatttataaagcttgattgtattcattttagtttcttctgaaagtcgcataaatttagttgatatatttaggaatcattcttcaatctgtggatgtaacacgttgttatataataggttgcatcatattgacttcttacaattcccaaactaccctgacgttgaatttgttttttaaatgcttatatgtttcagcccgaacgagaactggaattgcagaaatcaaacggcagagaaagcttgcatctcaaacagctccagccagtgcagagttgctcactttaccttacctttcaggacagtttaccactcctccttccacaggtacacaggttactcgaccaagtggccaaatttcagatccatcgaggtcatattttgtagtggtc

SEQ ID NO: 278231 - DNA, 634 bp, Homo sapiens
tagagttaggaatatccttagagagtgtgtggtatatcttatttgttgcatacttgaaacttctgaaaacacatggtagttaagggataagaagctagttaataacagagttgggattagaattcaggagttagcactctcagttcacaaaccaattatctttctgtgcagctaaaatttgttgccatcaagatctccctcattttcaccttttccaaatccttttctacacccagaatgcttagtttatacttcttagactttttccattctactgtattattttttgttgagactatattgtactttggattttattgtaaaaccttaaggcataaagactgtattttattaatcttagtgtcttttaccatgctttacacatggtaggcactcagtacatgttaattgaatttaatgtaaaataataatcactaatgctttttatcccattacaagtttagaaaactattcagtttctttggcttactgttatgttttcttgaaatacagctggagaagctttaaatgtcattcctggtgctcaggaaaagaaagcacatgccagtttaatgtctcccggtagacgcaaaaggtaaatgctttttaaaagagacaagttacccgtatccat

SEQ ID NO: 278232 - DNA, 6113 bp, Homo sapiens
agtgccgccactggaaccaggagatgcggcgcaggagctgtcgctgtgtttgctttaacctgagtcttgttccttattgtggttcctgctgtggttttgatcatgttgttaccctcggacgtagcccggcttgtattgggttacttacagcaagaaaacctcatttctacctgccagacttttattttggaaagttcagatttaaaagaatatgcagaacattgtacagatgaagggtttattccagcctgcttactgtccttatttggaaaaaacttgacaacaattttaaatgagtatgtagctatgaaaacaaaagaaacatcaaataatgtcccagcaataatgtcatctctatggaagaaattggaccatacactttctcagatcaggagcatgcaaagttccccaaggtttgctggcagtcagagagcccgaacgagaactggaattgcagaaatcaaacggcagagaaagcttgcatctcaaacagctccagccagtgcagagttgctcactttaccttacctttcaggacagtttaccactcctccttccacaggtacacaggttactcgaccaagtggccaaatttcagatccatcgaggtcatattttgtagtggtcaaccactcacagtcacaagatactgtaaccactggagaagctttaaatgtcattcctggtgctcaggaaaagaaagcacatgccagtttaatgtctcccggtagacgcaaaagtgaatctcagagaaaaagtaccactttgtctggccctcattcaacaatacggaatttccaagatccaaacgcttttgcagtagaaaaacaaatggttattgaaaatgcacgagaaaaaatactaagcaacaaatctcttcaagaaaagctagcagaaaacataaataaatttttaactagtgataacaatattgcccaagtacctaagcaaacagataacaaccctacggagccagagacttcaattgatgaattcctaggacttccgagtgaaattcacatgtctgaagaagctatacaggacatattggaacagacagaatcagacccagcatttcaggcactctttgatctctttgactatggcaaaacaaagaataataaaaatatatcacaaagtatttccagtcaacctatggaatccaatcccagtatagtcttagcagatgaaactaatctagcagttaaaggttcttttgaaacagaagaatctgatggtcagtctggtcagcccgctttttgtacatcctatcagaatgatgacccattaaatgctttgaagaatagcaacaaccatgatgtgcttagacaagaagaccaggaaaatttttcccaaataagtaccagcatacagaaaaaggcctttaaaacagctgtacccactgaacagaagtgtgacattgacattacctttgagtccgtgcctaatttgaatgactttaaccaaagagggaattctaatgctgaatgtaatccacattgtgctgaattatacaccaatcagatgtccactgaaactgaaatggctatagggattgaaaagaactctttgtcttcaaatgtaccgagtgaatctcagttacagcctgatcagcctgatataccaataacttcatttgtttcacttggttgtgaagctaacaatgaaaacttaattctctctgggaagagttctcaacttttatcccaagatacttcattaactggaaagccatctaaaaaaagtcaattttgtgaaaattctaatgatacagtaaaacttaaaattaattttcatggttccaagtcatcagattctagtgaaattcacaagagtaaaatagaaattaatgtgttagaaccagttatgtcacagctatcaaattgccaagataattcttgtcttcaaagtgaaatactacctgtgtctgttgaaagttcacatttaaatgtatctggacaagtagaaattcatcttggagattcgctgtcttctactaaacaaccatctaatgattcagcatctgttgagttaaatcatacagaaaatgaagctcaggcatccaagtctgagaattcacaggagccttcatcttctgtaaaagaagagaatactatttttctctctttaggtggaaatgctaactgtgagaaagttgcactgacgcctccagaaggcactcctgtagaaaacagtcactctcttcctccagaatctgtgtgttcttcagtgggagattctcaccctgagtcccaaaatactgatgataaaccttctagcaacaactcagcagagatagatgcatcaaatatcgtctctctcaaagttatcattagtgatgatccatttgtttcctcagatactgaacttaccagtgctgtttctagtattaatggagaaaacctgccaactataatcttgtcttctcctactaaatcacctactaaaaatgcagaactagttaaatgcctatcttcagaagaaactgtaggtgctgttgtatatgccgaagtaggggattcagcctcaatggaacagagtcttttaacattcaaatctgaagactctgcagtaaacaatactcagaatgaagatggcattgctttttcagctaatgttacaccatgtgtttccaaggatggaggatatatacagttgatgccagccacaagcacagcttttggcaattcaaataacattctgatagctacctgtgtgactgatccaacagcgttaggaacatctgtaagtcagtctaatgtagtggtgttgcctggaaattctgcacctatgactgctcaacctctaccacctcagttacagacaccaccaaggtcaaacagtgtatttgctgtcaaccaagctgtgtcaccaaacttttcacaaggatctgccataataattgcctctccagtccagcctgtactccaaggaatggtagggatgatcccagtatctgtggttggacagaatggaaataacttttctactcctcctcggcaggttcttcatatgcctttgacagcacctgtatgcaatagaagtatccctcaattccccgtccctccaaaatctcagaaggctcagggactaagaaacaagccttgtataggaaaacaagtaaataatttggtggattcgtcaggtcattcagttggatgtcatgcacaaaaaactgaagtttctgacaaaagtattgccacagatcttgggaaaaaatcagaagaaaccacagttcccttcccagaagagagtatagttccagctgctaaaccatgccacagacgtgtactctgtttcgacagcactactgctcctgtggcaaatacgcaggggccaaaccataagatggtgtcccaaaacaaagaaaggaatgcagtctcttttcctaatcttgactcacccaatgtgtcctccaccttaaaacccccttctaataatgctatcaaaagagagaaagagaagcctcctctgcctaagattttatctaaatcggaaagtgccattagccggcataccaccataagagaaactcaatcagaaaagaaagtttcaccaacagaaattgtgcttgaatctttccataaagcaacagctaataaggagaatgaattatgcagcgatgtagaaagacagaaaaatccagaaaattcaaaactatctattgggcagcaaaatgggggtttgcgaagtgagaaatctatagcttcactgcaagaaatgaccaaaaaacaaggcacatcttcaaacaataaaaatgtactttcagtaggtacagctgtgaaggatctaaaacaagaacaaactaaatccgccagttctttgattaccacagaaatgttacaggatatacagaggcacagctcagtaagtaggcttgctgatagtagtgatttacctgtgccccggacacctggctcaggggcaggggaaaaacataaagaagaacctatagatattatcaaggccccctctagtaggcgtttcagtgaagacagtagtacatcaaaagtaatggtccctcctgtcaccccagacttgcctgcctgcagccctgccagtgaaacaggaagtgaaaacagtgtaaatatggctgcccacacattaatgattctctccagggcagccatttctaggactacttcagcaactcctctgaaagataacacacaacagtttagagcatcttcaaggagcaccacaaaaaagcggaaaattgaggaattagatgaacgtgagcgaaactctcgtccttctagtaaaaatcttacaaattcatcaataccaatgaaaaagaagaaaattaagaaaaagaagcttcccagttcatttccagcaggaatggatgtagacaaatttttgttatcattgcattatgatgagtaaacattctggacacataagaacagtaggtgttaaaaactcatatcccttaaactgagtgtagggaatgggatattgacagaatctgaaagcatgacctgcactttcattgtactgaaacttcactttatatctaaatcatgctgtttctgaaacagcttcctagtttgtaaatagacttacttggtatatttttattttgggaaaaacgtttgcagaaatgtaagtaaagccaatctgcaaaactgtatagctttgacaattccatattgtaaatactgtgtaaatcttgttgaaatagaggttaaatcaacctaatgttcttacactgtgttttttgacttcttatgatccctaattctgagacttactcatctggaatagtttctcacttgttttggaggaaaatgatgcttattcttataaattaccttcagtaactattcaataagacatttaaatacacaatcactaagtactacaaaataataaccacctcaactgatagcaaaatatctaattagaaatcaacagtttgatgagtttttttcctagagtgaattactacccctttcttataattgctgtaagtattatatttctggaatttcacactttacctactctgatcactctgttctctttgttttaaagagagaattttgtaaaccatttattgaatgttctgatctttcatttataacttaagattttttacagaactttaagtggttagactattgagccataaaattttggtttgtagtagagatttctcggtatgtacttttcccctaaatgctggggatttaaagaattgcactaattcatagaactctttacattgtagtgaccaatgcacatataatttaaatcttgtgttctatgtgagagtttatgtggaggattatcttctggtgttgtgtccatcataagatgtaaaaagagaaatcatagttttatattttagtttctcctacaatgggtatgttaaataactatatctatacttagatatagtgcattgtctgtgtcccttaaagtgttacaaagagtttctctcaaaaggtccttaaggagagtgagagatgagagaggtgccttctctgtattagactcacacacatcagtccagttgaagaattggtttaaacttttaaatgagaacagaaattataattagtacctgaccaattgtgcctagatattaaagtatgttctctttagtactttccgttcaattaaatatcagtatattagggatttttttctacaggtgtatattttgttgaagagtcactttcctcaaccatttttttgtactgggcctttaaaaaaataaatccatccaactttaacacaacatttctcagtgtagaaatcatgtcttcttaattgctgaaccttactgcaaaaacttgtgatgtaagaaatttgtatggtgtggcagtggtctattcctaaggaactaaatatcatatagttaatgtttatttaactcagcttgagactgtactacagttaggtttgaataaatattttcattaacttcaaaagtttgaattactttacattggcagtcttgtttagaaactgattaaattcctttgcaagtcagttctttttgggagtttgtacaatgctgaaaatcacagttttcttcttattcaattcatagttgtatgtactaagcactgaaaattcatatacaaataaaataagtttacttt

SEQ ID NO: 278233 - DNA, 5969 bp, Homo sapiens
agtgccgccactggaaccaggagatgcggcgcaggagctgtcgctgtgtttgctttaacctgagtcttgttccttattgtggttcctgctgtggttttgatcatgttgttaccctcggacgtagcccggcttgtattgggttacttacagcaagaaaacctcatttctacctgccagacttttattttggaaagttcagatttaaaagaatatgcagaacattgtacagatgaagggtttattccagcctgcttactgtccttatttggaaaaaacttgacaacaattttaaatgagtatgtagctatgaaaacaaaagaaacatcaaataatgtcccagcaataatgtcatctctatggaagaaattggaccatacactttctcagatcaggagcatgcaaagttccccaaggtttgctggcagtcagagagcccgaacgagaactggaattgcagaaatcaaacggcagagaaagcttgcatctcaaacagctccagccagtgcagagttgctcactttaccttacctttcaggacagtttaccactcctccttccacaggtacacaggttactcgaccaagtggccaaatttcagatccatcgaggtcatattttgtagtggtcaaccactcacagtcacaagatactgtaaccactggagaagctttaaatgtcattcctggtgctcaggaaaagaaagcacatgccagtttaatgtctcccggtagacgcaaaagtgaatctcagagaaaaagtaccactttgtctggccctcattcaacaatacggaatttccaagatccaaacgcttttgcagtagaaaaacaaatggttattgaaaatgcacgagaaaaaatactaagcaacaaatctcttcaagaaaagctagcagaaaacataaataaatttttaactagtgataacaatattgcccaagtacctaagcaaacagataacaaccctacggagccagagacttcaattgatgaattcctaggacttccgagtgaaattcacatgtctgaagaagctatacaggacatattggaacagacagaatcagacccagcatttcaggcactctttgatctctttgactatggcaaaacaaagaataataaaaatatatcacaaagtatttccagtcaacctatggaatccaatcccagtatagtcttagcagatgaaactaatctagcagttaaaggttcttttgaaacagaagaatctgatggtcagtctggtcagcccgctttttgtacatcctatcagaatgatgacccattaaatgctttgaagaatagcaacaaccatgatgtgcttagacaagaagaccaggaaaatttttcccaaataagtaccagcatacagaaaaaggcctttaaaacagctgtacccactgaacagaagtgtgacattgacattacctttgagtccgtgcctaatttgaatgactttaaccaaagagggaattctaatgctgaatgtaatccacattgtgctgaattatacaccaatcagatgtccactgaaactgaaatggctatagggattgaaaagaactctttgtcttcaaatgtaccgagtgaatctcagttacagcctgatcagcctgatataccaataacttcatttgtttcacttggttgtgaagctaacaatgaaaacttaattctctctgggaagagttctcaacttttatcccaagatacttcattaactggaaagccatctaaaaaaagtcaattttgtgaaaattctaatgatacagtaaaacttaaaattaattttcatggttccaagtcatcagattctagtgaaattcacaagagtaaaatagaaattaatgtgttagaaccagttatgtcacagctatcaaattgccaagataattcttgtcttcaaagtgaaatactacctgtgtctgttgaaagttcacatttaaatgtatctggacaagtagaaattcatcttggagattcgctgtcttctactaaacaaccatctaatgattcagcatctgttgagttaaatcatacagaaaatgaagctcaggcatccaagtctgagaattcacaggagccttcatcttctgtaaaagaagagaatactatttttctctctttaggtggaaatgctaactgtgagaaagttgcactgacgcctccagaaggcactcctgtagaaaacagtcactctcttcctccagaatctgtgtgttcttcagtgggagattctcaccctgagtcccaaaatactgatgataaaccttctagcaacaactcagcagagatagatgcatcaaatatcgtctctctcaaagttatcattagtgatgatccatttgtttcctcagatactgaacttaccagtgctgtttctagtattaatggagaaaacctgccaactataatcttgtcttctcctactaaatcacctactaaaaatgcagaactagttaaatgcctatcttcagaagaaactgtaggtgctgttgtatatgccgaagtaggggattcagcctcaatggaacagagtcttttaacattcaaatctgaagactctgcagtaaacaatactcagaatgaagatggcattgctttttcagctaatgttacaccatgtgtttccaaggatggaggatatatacagttgatgccagccacaagcacagcttttggcaattcaaataacattctgatagctacctgtgtgactgatccaacagcgttaggaacatctgtaagtcagtctaatgtagtggtgttgcctggaaattctgcacctatgactgctcaacctctaccacctcagttacagacaccaccaaggtcaaacagtgtatttgctgtcaaccaagctgtgtcaccaaacttttcacaaggatctgccataataattgcctctccagtccagcctgtactccaaggaatggtagggatgatcccagtatctgtggttggacagaatggaaataacttttctactcctcctcggcaggttcttcatatgcctttgacagcacctgtatgcaatagaagtatccctcaattccccgtccctccaaaatctcagaaggctcagggactaagaaacaagccttgtataggaaaacaagtaaataatttggtggattcgtcaggtcattcagttggatgtcatgcacaaaaaactgaagtttctgacaaaagtattgccacagatcttgggaaaaaatcagaagaaaccacagttcccttcccagaagagagtatagttccagctgctaaaccatgccacagacgtgtactctgtttcgacagcactactgctcctgtggcaaatacgcaggggccaaaccataagatggtgtcccaaaacaaagaaaggaatgcagtctcttttcctaatcttgactcacccaatgtgtcctccaccttaaaacccccttctaataatgctatcaaaagagagaaagagaagcctcctctgcctaagattttatctaaatcggaaagtgccattagccggcataccaccataagagaaactcaatcagaaaagaaagtttcaccaacagaaattgtgcttgaatctttccataaagcaacagctaataaggagaatgaattatgcagcgatgtagaaagacagaaaaatccagaaaattcaaaactatctattgggcagcaaaatgggggtttgcgaagtgagaaatctatagcttcactgcaagaaatgaccaaaaaacaaggcacatcttcaaacaataaaaatgtactttcagtaggtacagctgtgaaggatctaaaacaagaacaaactaaatccgccagttctttgattaccacagaaatgttacaggatatacagaggcacagctcagtaagtaggcttgctgatagtagtgatttacctgtgccccggacacctggctcaggggcaggggaaaaacataaagaagaacctatagatattatcaaggccccctctagtaggcgtttcagtgaagacagtagtacatcaaaagtaatggtccctcctgtcaccccagacttgcctgcctgcagccctgccagtgaaacaggaagtgaaaacagtgtaaatatggctgcccacacattaatgattctctccagggcagccatttctaggactacttcagcaactcctctgaaagataacacacaacagtttagagcatcttcaaggagcaccacaaaaaagcggaaaattgaggaattagatgaacgtgagcgaaactctcgtccttctagtaaaaatcttacaaattcatcaataccaatgaaaaagaagaaaattaagaaaaagaagcttcccagttcatttccagcaggaatggatgtagacaaatttttgttatcattgcattatgatgagtaaacattctggacacataagaacagtaggtgttaaaaactcatatcccttaaactgagtgtagggaatgggatattgacagaatctgaaagcatgacctgcactttcattgtactgaaacttcactttatatctaaatcatgctgtttctgaaacagcttcctagtttgtaaatagacttacttggtatatttttattttgggaaaaacgtttgcagaaatgtaagtaaagccaatctgcaaaactgtatagctttgacaattccatattgtaaatactgtgtaaatcttgttgaaatagaggttaaatcaacctaatgttcttacactgtgttttttgacttcttatgatccctaattctgagacttactcatctggaatagtttctcacttgttttggaggaaaatgatgcttattcttataaattaccttcagtaactattcaataagacatttaaatacacaatcactaagtactacaaaataataaccacctcaactgatagcaaaatatctaattagaaatcaacagtttgatgagtttttttcctagagtgaattactacccctttcttataattgctgtaagtattatatttctggaatttcacactttacctactctgatcactctgttctctttgttttaaagagagaattttgtaaaccatttattgaatgttctgatctttcatttataacttaagattttttacagaactttaagtggttagactattgagccataaaattttggtttgtagtagagatttctcggtatgtacttttcccctaaatgctggggatttaaagaattgcactaattcatagaactctttacattgtagtgaccaatgcacatataatttaaatcttgtgttctatgtgagagtttatgtggaggattatcttctggtgttgtgtccatcataagatgtaaaaagagaaatcatagttttatattttagtttctcctacaatgggtatgttaaataactatatctatacttagatatagtgcattgtctgtgtcccttaaagtgttacaaagagtttctctcaaaaggtccttaaggagagtgagagatgagagaggtgccttctctgtattagactcacacacatcagtccagttgaagaattggtttaaacttttaaatgagaacagaaattataattagtacctgaccaattgtgcctagatattaaagtatgttctctttagtactttccgttcaattaaatatcagtatattagggatttttttctacaggtgtatattttgttgaagagtcactttcctcaaccatttttttgtactgggcctttaaaaaaataaatccatccaactttaacacataacaaaaaaaccaatatctaacaacataaaaaaaaaaagacaagttataaaatacaaaacccacccaattactaacaaaaataaatagaccttaccactctaactccaaactatatcacaattaatactctttgtgggcctcctggcccgttttttatattttgctttttggggcgggccggacttgtggcctcttgggccaatcccgctttatgaggggggt

SEQ ID NO: 278234 - DNA, 4700 bp, Homo sapiens
agtgccgccactggaaccaggagatgcggcgcaggagctgtcgctgtgtttgctttaacctgagtcttgttccttattgtggttcctgctgtggttttgatcatgttgttaccctcggacgtagcccggcttgtattgggttacttacagcaagaaaacctcatttctacctgccagacttttattttggaaagttcagatttaaaagaatatgcagaacattgtacagatgaagggtttattccagcctgcttactgtccttatttggaaaaaacttgacaacaattttaaatgagtatgtagctatgaaaacaaaagaaacatcaaataatgtcccagcaataatgtcatctctatggaagaaattggaccatacactttctcagatcaggagcatgcaaagttccccaaggtttgctggcagtcagagagcccgaacgagaactggaattgcagaaatcaaacggcagagaaagcttgcatctcaaacagctccagccagtgcagagttgctcactttaccttacctttcaggacagtttaccactcctccttccacaggtacacaggttactcgaccaagtggccaaatttcagatccatcgaggtcatattttgtagtggtcaaccactcacagtcacaagatactgtaaccactggagaagctttaaatgtcattcctggtgctcaggaaaagaaagcacatgccagtttaatgtctcccggtagacgcaaaagtgaatctcagagaaaaagtaccactttgtctggccctcattcaacaatacggaatttccaagatccaaacgcttttgcagtagaaaaacaaatggttattgaaaatgcacgagaaaaaatactaagcaacaaatctcttcaagaaaagctagcagaaaacataaataaatttttaactagtgataacaatattgcccaagtacctaagcaaacagataacaaccctacggagccagagacttcaattgatgaattcctaggacttccgagtgaaattcacatgtctgaagaagctatacaggacatattggaacagacagaatcagacccagcatttcaggcactctttgatctctttgactatggcaaaacaaagaataataaaaatatatcacaaagtatttccagtcaacctatggaatccaatcccagtatagtcttagcagatgaaactaatctagcagttaaaggttcttttgaaacagaagaatctgatggtcagtctggtcagcccgctttttgtacatcctatcagaatgatgacccattaaatgctttgaagaatagcaacaaccatgatgtgcttagacaagaagaccaggaaaatttttcccaaataagtaccagcatacagaaaaaggcctttaaaacagctgtacccactgaacagaagtgtgacattgacattacctttgagtccgtgcctaatttgaatgactttaaccaaagagggaattctaatgctgaatgtaatccacattgtgctgaattatacaccaatcagatgtccactgaaactgaaatggctatagggattgaaaagaactctttgtcttcaaatgtaccgagtgaatctcagttacagcctgatcagcctgatataccaataacttcatttgtttcacttggttgtgaagctaacaatgaaaacttaattctctctgggaagagttctcaacttttatcccaagatacttcattaactggaaagccatctaaaaaaagtcaattttgtgaaaattctaatgatacagtaaaacttaaaattaattttcatggttccaagtcatcagattctagtgaaattcacaagagtaaaatagaaattaatgtgttagaaccagttatgtcacagctatcaaattgccaagataattcttgtcttcaaagtgaaatactacctgtgtctgttgaaagttcacatttaaatgtatctggacaagtagaaattcatcttggagattcgctgtcttctactaaacaaccatctaatgattcagcatctgttgagttaaatcatacagaaaatgaagctcaggcatccaagtctgagaattcacaggagccttcatcttctgtaaaagaagagaatactatttttctctctttaggtggaaatgctaactgtgagaaagttgcactgacgcctccagaaggcactcctgtagaaaacagtcactctcttcctccagaatctgtgtgttcttcagtgggagattctcaccctgagtcccaaaatactgatgataaaccttctagcaacaactcagcagagatagatgcatcaaatatcgtctctctcaaagttatcattagtgatgatccatttgtttcctcagatactgaacttaccagtgctgtttctagtattaatggagaaaacctgccaactataatcttgtcttctcctactaaatcacctactaaaaatgcagaactagttaaatgcctatcttcagaagaaactgtaggtgctgttgtatatgccgaagtaggggattcagcctcaatggaacagagtcttttaacattcaaatctgaagactctgcagtaaacaatactcagaatgaagatggcattgctttttcagctaatgttacaccatgtgtttccaaggatggaggatatatacagttgatgccagccacaagcacagcttttggcaattcaaataacattctgatagctacctgtgtgactgatccaacagcgttaggaacatctgtaagtcagtctaatgtagtggtgttgcctggaaattctgcacctatgactgctcaacctctaccacctcagttacagacaccaccaaggtcaaacagtgtatttgctgtcaaccaagctgtgtcaccaaacttttcacaaggatctgccataataattgcctctccagtccagcctgtactccaaggaatggtagggatgatcccagtatctgtggttggacagaatggaaataacttttctactcctcctcggcaggttcttcatatgcctttgacagcacctgtatgcaatagaagtatccctcaattccccgtccctccaaaatctcagaaggctcagggactaagaaacaagccttgtataggaaaacaagtaaataatttggtggattcgtcaggtcattcagttggatgtcatgcacaaaaaactgaagtttctgacaaaagtattgccacagatcttgggaaaaaatcagaagaaaccacagttcccttcccagaagagagtatagttccagctgctaaaccatgccacagacgtgtactctgtttcgacagcactactgctcctgtggcaaatacgcaggggccaaaccataagatggtgtcccaaaacaaagaaaggaatgcagtctcttttcctaatcttgactcacccaatgtgtcctccaccttaaaacccccttctaataatgctatcaaaagagagaaagagaagcctcctctgcctaagattttatctaaatcggaaagtgccattagccggcataccaccataagagaaactcaatcagaaaagaaagtttcaccaacagaaattgtgcttgaatctttccataaagcaacagctaataaggagaatgaattatgcagcgatgtagaaagacagaaaaatccagaaaattcaaaactatctattgggcagcaaaatgggggtttgcgaagtgagaaatctatagcttcactgcaagaaatgaccaaaaaacaaggcacatcttcaaacaataaaaatgtactttcagtaggtacagctgtgaaggatctaaaacaagaacaaactaaatccgccagttctttgattaccacagaaatgttacaggatatacagaggcacagctcagtaagtaggcttgctgatagtagtgatttacctgtgccccggacacctggctcaggggcaggggaaaaacataaagaagaacctatagatattatcaaggccccctctagtaggcgtttcagtgaagacagtagtacatcaaaagtaatggtccctcctgtcaccccagacttgcctgcctgcagccctgccagtgaaacaggaagtgaaaacagtgtaaatatggctgcccacacattaatgattctctccagggcagccatttctaggactacttcagcaactcctctgaaagataacacacaacagtttagagcatcttcaaggagcaccacaaaaaagcggaaaattgaggaattagatgaacgtgagcgaaactctcgtccttctagtaaaaatcttacaaattcatcaataccaatgaaaaagaagaaaattaagaaaaagaagcttcccagttcatttccagcaggaatggatgtagacaaatttttgttatcattgcattatgatgagtaaacattctggacacataagaacagtaggtgttaaaaactcatatcccttaaactgagtgtagggaatgggatattgacagaatctgaaagcatgacctgcactttcattgtactgaaacttcactttatatctaaatcatgctgtttctgaaacagcttcctagtttgtaaatagacttacttggtatatttttattttgggaaaaacgtttgcagaaatgtaagtaaagccaatctgcaaaactgtatagctttgacaattccatattgtaaatactgtgtaaatcttgttgaaatagaggttaaatcaaccta

SEQ ID NO: 278235 - DNA, 1573 bp, Homo sapiens
  misc_feature (1520)..(1520): n is a, c, g, or t
agtgccgccactggaaccaggagatgcggcgcaggagctgtcgctgtgtttgctttaacctgagtcttgttccttattgtggttcctgctgtggttttgatcatgttgttaccctcggacgtagcccggcttgtattgggttacttacagcaagaaaacctcatttctacctgccagacttttattttggaaagttcagatttaaaagaatatgcagaacattgtacagatgaagggtttattccagcctgcttactgtccttatttggaaaaaacttgacaacaattttaaatgagtatgtagctatgaaaacaaaagaaacatcaaataatgtcccagcaataatgtcatctctatggaagaaattggaccatacactttctcagatcaggagcatgcaaagttccccaaggtttgctggcagtcagagagcccgaacgagaactggaattgcagaaatcaaacggcagagaaagcttgcatctcaaacagctccagccagtgcagagttgctcactttaccttacctttcaggacagtttaccactcctccttccacaggtacacaggttactcgaccaagtggccaaatttcagatccatcgaggtcatattttgtagtggtcaaccactcacagtcacaagatactgtaaccactggagaagctttaaatgtcattcctggtgctcaggaaaagaaagcacatgccagtttaatgtctcccggtagacgcaaaagtgaatctcagagaaaaagtaccactttgtctggccctcattcaacaatacggaatttccaagatccaaacgcttttgcagtagaaaaacaaatggttattgaaaatgcacgagaaaaaatactaagcaacaaatctcttcaagaaaagctagcagaaaacataaataaatttttaactagtgataacaatattgcccaagtacctaagcaaacagataacaaccctacggagccagagacttcaattgatgaattcctaggacttccgagtgaaattcacatgtctgaagaagctatacaggacatattggaacagacagaatcagacccagcatttcaggcactctttgatctctttgactatggcaaaacaaagaataataaaaatatatcacaaagtatttccagtcaacctatggaatccaatcccagtatagtcttagcagatgaaactaatctagcagttaaaggttcttttgaaacagaagaatctgatggtcagtctggtcagcccgctttttgtacatcctatcagaatgatgacccattaaatgctttgaagaatagcaacaaccatgatgtgcttagacaagaagaccaggaaaatttttcccaaataagtaccagcatacagaaaaaggcctttaaaacagctgtacccactgaacagaagtgtgacattgacattacctttgagtccgtgcctaatttgaatgactttaaccaaagagggaattctaatgctgaatgtaatccacattgtgctgaatttttcccccntccacaattttcccttgaaacttgaaaattgggctttttgggggattggaaaa

SEQ ID NO: 278236 - DNA, 413 bp, Homo sapiens
ggtgggatggccaggcaggatggaaggacaggttgtagttctggctggcggacactaagagtctggaggagacccagccaccagacataggagaaccatgcagccttgctagggtggagttggcttgttgacattcaggtactgttcatcccccaaccgtgtccacaattcctattagccccgcttggattctgtggtctgctgttgcaggctcttatgctctcaaccccactgctctccctgccctcaccatcagatttactcagtaaaatctcggtggttagtcccccagcaactagagaaaaaacacagaattgtactgaacaatcccacttgaaatttataactatagttcttaaggggacccttgccaacctgaccagatttccctacttgatgctcagtcccaaccg

SEQ ID NO: 278237 - DNA, 825 bp, Homo sapiens
ccagtgcgcccttgaaactttcctcgccttccacctcctgctcatctgcttcacaagctgtcgctgtggtgtcggttcgcaggtcgtggcctctcatggccacggtgcttttggccctgctcgtctacctgggggcgctggtcgacgcctaccccatcaaacccgaggctcccggcgaagacgccttcctggggtagctgagccgctgctacgcctatcctcgccactacctcatcctggtcactcagccgtcgtgagcgcaggcgcggggcgggcggacggggacccctggggctctccccctacagccccgctccaccgggggcgtggctagatctgaccgcgcccggccaggccccgccctcaggtatgggaaactaggccgcccagtcgcgcgcctctccaaaacgttcttcccagactgcgaggaccgcctcggcaggtggcggtaaaagcgcccccatcaagtcacataacatcctgcctccgagagcgcggtctggccccaccctggtccatcacttacgacgtctcccaggcttgcctccccggatcggattcctttcccttcgatcccgcaggccggaggcgcagacctgtggtgaggacacccgaggcctcctgggagacctgcagaccacgcccacctcatttacatgttcactcccgaccctggaaacccggatttcgcctccggacagcggcgtctgggcagggttcgggtactgcagtcccgcgtctggatgcccccgccccctgagctgcagggctgtgtgtggtccttccctggtcccaaaataaagagcgaattgcacagaaacggaa

SEQ ID NO: 278238 - DNA, 1212 bp, Homo sapiens
tagaagtaaatgttttattcttccaactaaattccagtactacaagggcagtaaaacaatgatacactggaaaaaaaaaaatgcagcaataaacatttgttaaaaagactgatagaataaataaaactacaaaaaaaaaaaaaatcatacaaacccattctgaaaccccaagaagtcctggaatacagaaatgccctcctccttcactatttcacaggaagcactgcaggctatttgcttaatattgtcctgggattacattctaaaattagtaactggttacagctcggttgtagtgcacaattaaaatcacactaacttcatctgaagtgtcattctacagttttatttacacaaccagtgaagggcatgttctagaataccagctttaatccttttcaaacattaatataagaagccaaattgtaatgatacagcaaaatgaggccactggtattaatacaggtagcaaaggtccacatccaggtggtactgacatcagggaaatttccaaaaccagttgctgctgcctaagagtggttgccactgacgaaagcttgaaataacctgtattcacagaaggggtattggcattgctgcatgtcataattgggacctcttgcaacaactcaacaaggaacaaggcagcccacaaatgcaggatacgtgattcatgaaacatagctagcaggctgttctccatatcgtcgcattatttgatcatgcgtaaacttcacaaacgcatcatattgttctgcaagttttgtgttcaatatttcttcatattcttctcgaactttctcttcacgttctttcaacaaacgttcacagatcatcccaacctgccgtagagtaaataagggctgttctttttttaatggtgaggatgctgcagatgaagtccctggtgaagctggtccactgaggagaaatgcatgtggctgtgcatcagaagtacaacacggatctgtctgttggaaactcgtttctaaatgtcttctcttctgcattcgtttatactcttgttttatgttgtacagaagcatcagaagtacaacacggatctgtctgttggaaactcgtttctaaatgtcttctcttctgcattcgtttatactcttgtcttatgtcgtacagaattgttctgtggtgaggcgggaggagacgtcgccgaagggggatggctccattcggagatacttctgcggcgag

SEQ ID NO: 278239 - DNA, 1064 bp, Homo sapiens
cacctctatattaattccttaaaataaaaaagcttacatatctatataaacagtaaatctgtggctaaacattctatttatgttaccatacataataaattttatttacttaaattatcaaattttactgaattttttgataactaaaacaggactccagtttgatactccaatgacttacacagtgacagccaattagatattttaaatgtctacattgatggtaacgttatgaaaaatataaagtcaaaaaatccacaaccaaattgaggtaaactactaacatcagtttttagtacagggtacctactaatattactgctgatctacacggctagccaatactcttttcctcaggttaccaaggcgggcatgagctataagaaggttaattttctttcctgaactgaaattttctcattctcagagaatataccgcaccagtgtatagaaagtgaaattaaagtacacgtggaaaatgcatttcacacaactgagttcctcagaaactctaataaacacacctcatacctgcaagttttgtgttcaatatttcttcatattcttctcgaactttctcttcacgttctttcaacaaacgttcacagatcatcccaacctgccgtagagtaaataagggctgttctttttttaatggtgaggatgctgcagatgaagtccctatgtacaatgaggacaaaaaatagcacctggtttagagccatgatataaagcagtttctaaatgaagaggttttatttggatctcttcaatcttgatataaaagcattttaaaatcagattttaagcacagcatttcacaagtcttaaaacaaccaaaataataattccatcagctggtgacgctggaaaaacacggcaagatgtaattaagataaaaaagactaaaggtgagtagaaaaaactttaagacataagaaaggttgggcgtggtgctcaccgcctgtaatcaggccgaggtgggcggatcacctgaggtcaggagtttgaaaccagcctggccaacatggtgaaaccctgcctctactaaaaatacataaaaa

SEQ ID NO: 278240 - DNA, 1110 bp, Homo sapiens
tagaagtaaatgttttattcttccaactaaattccagtactacaagggcagtaaaacaatgatacactggaaaaaaaaaaatgcagcaataaacatttgttaaaaagactgatagaataaataaaactacaaaaaaaaaaaaaatcatacaaacccattctgaaaccccaagaagtcctggaatacagaaatgccctcctccttcactatttcacaggaagcactgcaggctatttgcttaatattgtcctgggattacattctaaaattagtaactggttacagctcggttgtagtgcacaattaaaatcacactaacttcatctgaagtgtcattctacagttttatttacacaaccagtgaagggcatgttctagaataccagctttaatccttttcaaacattaatataagaagccaaattgtaatgatacagcaaaatgaggccactggtattaatacaggtagcaaaggtccacatccaggtggtactgacatcagggaaatttccaaaaccagttgctgctgcctaagagtggttgccactgacgaaagcttgaaataacctgtattcacagaaggggtattggcattgctgcatgtcataattgggacctcttgcaacaactcaacaaggaacaaggcagcccacaaatgcaggatacgtgattcatgaaacatagctagcaggctgttctccatatcgtcgcattatttgatcatgcgtaaacttcacaaacgcatcatattgttctgcaagttttgtgttcaatatttcttcatattcttctcgaactttctcttcacgttctttcaacaaacgttcacagatcatcccaacctgccgtagagtaaataagggctgttctttttttaatggtgaggatgctgcagatgaagtccctggtgaagctggtccactgaggagaaatgcatgtggctgtgcatcagaagtacaacacggatctgtctgttggaaactcgtttctaaatgtcttctcttctgcattcgtttatactcttgttttatgttgtacagaactgtggtgaggcgggaggagacgtcgccgaagggggatggctccattcggagatacttctgcggcgag

SEQ ID NO: 278241 - DNA, 451 bp, Homo sapiens
caaaccatgtctctaataaaaatacaaagattggctgggagtggtggttgtctctggttagtgggaatccagtggtaactccttattttgtaccatattattttttaagatgtcatgcattacttgtataaatgtttttttaaaactcagaggagatacagtagcttaaatgactaaagacaacttggattagacttttcccactctaaataataaactttgtaaatgacaagaaatgttattacctggtgaagctggtccactgaggagaaatgcatgtggctgtgcatcagaagtacaacacggatctgtctgttggaaactcgtttctaaatgtcttctcttctgcattcgtttatactcttgttttatgttgtacagaactgtggtgaggcgggaggagacgtcgccgaagggggatggctccattcggagatacttctgcggcgag

SEQ ID NO: 278242 - DNA, 907 bp, Homo sapiens
cagtatggacccctatgggtagcctcagctggtcatggggtcggtggcggatgcgaaaggaagaaactgcatcctagtaatgctagggccatacgagcaatttctggtgcatggcgttgaccatttcggcctgggaggccagataccaccatgtaagcatccccaatcgtctccacctgattgagagggggattaaaaggtcacctctatttatatccatggggatgggaaaaagtagagggagacaagcttgacaccatcattaatcatcctgacatgctggagaccagaatattgactagaaaataagtgccatggtcctgagtctaggggagaggagatgtctagggaatctttaagtcttctttctccacccagcacctggtgaatactcagtaaacatttgcggaatgaatgaacaccctgtctgcagcaggacatggacaaataggctctgccatcaggaaatgggaagcaagaaaacggtaactcaagaggacagaggctggtgaggaggtaaagcaggcccagtgaaatggacctgacagcccaaactgtcagagaggaggaaagcaggcatttgattttggtaattgtgccaaagctatgtaagagaataaatgccattgttttaaggaaatacacagtgaagtttttaggaaatacacactaagtatttagggataaagtagttatccctaaatagtagtctgccacatgccaaacaatgttaggtactttccatacaacgaatctattattcccatcttacagataaaacaactgaggctcagggagattctgtgacttacctaaggccacacagttagcaacaagccaatattcaaatccagatgatttttactcccaaggacaataaatccaactcaataacttcaaaaaaaag

SEQ ID NO: 278243 - DNA, 2637 bp, Homo sapiens
ggccccgcagaggacttgcctccaccgccacctgcaagtccgcccagctggacttctgcgcaggctccaggagttgtttgctgtctctatggcaacccagtagctggagtctgaagatggagaccaacgagtctacggagggatcgcggtcgcggtcgcgatctttagacatacagcccagctccgaaggactggggcccacttcggaaccgtttccttcttcagatgacagtcccaggtcggccctggcagctgcaaccgcagcagctgcagcggctgcatcagctgctgcagctactgcagccttcaccactgccaaagcagctgcattatctacaaagaccccagcgccctgttctgagttcatggagccgtcctctgaccccagccttcttggggagccctgtgcgggacccggctttacccacaatatagcccatgggagtcttggctttgagcccgtctatgtttcctgtattgctcaggacacttgcactacaactgaccatagttctaatcctggccctgttccaggctctagctctgggcctgttcttggttccagctcaggtgctggccatggctctggctctggctctggtcctggctgtggctctgtccctggctctggctctggtcctggtcctggctctggtcctggctctggtcctggtcatggctctggctctcatcctggtcctgcctctgggcctggtccagacactggccctgactctgagctcagcccctgtattcctccagggttcagaaacctggtggcagatcgggtccctaactatacctcctggagtcagcactgcccctgggagccccagaaacaaccaccttgggaatttttgcaagtcttagaaccgggtgcccgaggactatggaaacccccagacattaaagggaagcttatggtttgctatgaaactttgccgcggggccagtgcctcctctacaactgggaggaagagagagccaccaaccacctggatcaagtcccaagcatgcaggatggctctgagagttttttcttccgacacggacaccggggactgctgactatgcaactaaagtcacccatgccctccagcaccacccagaaagactcgtaccagccaccaggaaacgtctattggccacttcgagggaagcgtgaagccatgctggagatgctcctgcagcatcagatctgtaaagaggtgcaggcagaacaggaacccacaaggaagctcttcgaggttgagtctgtgacacaccatgactaccgaatggagctggcacaagcagggactcctgccccaacaaagcctcacgactaccgccaggagcaacctgagaccttctggatacagagggcaccacagctgccgggtgtcagtaacatcaggacattggacacaccattccggaagaactgcagcttctcaacaccagtacccttgtctctggggaaacttttgccctatgaacctgagaattacccctaccaattgggagaaatatcttcccttccctgtcccggaggaaggctgggtggtggaggggggagaatgactcctttctgaggggtgaggagggaagtggggtatggaatatggaatctatttctgtctgcactagagaggtcgggaggaagttaattctcactgtacttgaagaggctttacataaagggttctctctcatcccaagactgctaatttagtgattctgtgagtcactgtgtgcataccccataacctttccttgggattgcccctatcccacactatgacatcagaactttttttattattgttttatatttgaccaaaatattctggtttagatacagatatttacagaaagtagggaggaaggggaccaagccagacagggacaggtatatgtacagggctgagctgcagagggctacaacttccatataaggtagctttttttgtggctcttttccattgcatatgaaaatgtccatttctggtgtgtgcagacatggtggccattgcccacccaggtaccagcagcagaagactatctgacttggaaagaatgggggtttacaggagtccaggaggtcctttccgctctcctaagagccacacctggtgaatactcagtaaacatttgcggaatgaatgaacaccctgtctgcagcaggacatggacaaataggctctgccatcaggaaatgggaagcaagaaaacggtaactcaagaggacagaggctggtgaggaggtaaagcaggcccagtgaaatggacctgacagcccaaactgtcagagaggaggaaagcaggcatttgattttggtaattgtgccaaagctatgtaagagaataaatgccattgttttaaggaaatacacagtgaagtttttaggaaatacacactaagtatttagggataaagtagttatccctaaatagtagtctgccacatgccaaacaatgttaggtactttccatacaacgaatctattattcccatcttacagataaaacaactgaggctcagggagattctgtgacttacctaaggccacacagttagcaacaagccaatattcaaatccagatgatttttactcccaaggacaataaatccaactcaataacttcaaaaaaaag

SEQ ID NO: 278244 - DNA, 2963 bp, Homo sapiens
ggccccgcagaggacttgcctccaccgccacctgcaagtccgcccagctggacttctgcgcaggctccaggagttgtttgctgtctctatggcaacccagtagctggagtctgaagatggagaccaacgagtctacggagggatcgcggtcgcggtcgcgatctttagacatacagcccagctccgaaggactggggcccacttcggaaccgtttccttcttcagatgacagtcccaggtcggccctggcagctgcaaccgcagcagctgcagcggctgcatcagctgctgcagctactgcagccttcaccactgccaaagcagctgcattatctacaaagaccccagcgccctgttctgagttcatggagccgtcctctgaccccagccttcttggggagccctgtgcgggacccggctttacccacaatatagcccatgggagtcttggctttgagcccgtctatgtttcctgtattgctcaggacacttgcactacaactgaccatagttctaatcctggccctgttccaggctctagctctgggcctgttcttggttccagctcaggtgctggccatggctctggctctggctctggtcctggctgtggctctgtccctggctctggctctggtcctggtcctggctctggtcctggctctggtcctggtcatggctctggctctcatcctggtcctgcctctgggcctggtccagacactggccctgactctgagctcagcccctgtattcctccagggttcagaaacctggtggcagatcgggtccctaactatacctcctggagtcagcactgcccctgggagccccagaaacaaccaccttgggaatttttgcaagtcttagaaccgggtgcccgaggactatggaaacccccagacattaaagggaagcttatggtttgctatgaaactttgccgcggggccagtgcctcctctacaactgggaggaagagagagccaccaaccacctggatcaagtcccaagcatgcaggatggctctgagagttttttcttccgacacggacaccggggactgctgactatgcaactaaagtcacccatgccctccagcaccacccagaaagactcgtaccagccaccaggaaacgtctattggccacttcgagggaagcgtgaagccatgctggagatgctcctgcagcatcagatctggtaagggattgggtaaaggggaagagggatggggaggagaaaaattgggtgagaatggccttgacacccctcgggctacatagtaaagaggtgcaggcagaacaggaacccacaaggaagctcttcgaggttgagtctgtgacacaccatgactaccgaatggagctggcacaagcagggactcctgccccaacaaaggtgagaacccaccccccatcccccgccacttgcaccagctgggctctgacaggctgtggccaagtaccaagcccagaggttgagagagagggctgaaggccaggagttactcagtaccctccctcacagcctcacgactaccgccaggagcaacctgagaccttctggatacagagggcaccacagctgccggtgtgtgagggtgactaggtgttgggggcagagcggggcaggaaaggtagggcagagttgttttgttctggcttggggagagtgggatccatcctcatcctggcactcctccagggtgtcagtaacatcaggacattggacacaccattccggaagaactgcagcttctcaacaccagtacccttgtctctggggaaacttttgccctatgaacctgagaattacccctaccaattgggagaaatatcttcccttccctgtcccggaggaaggctgggtggtggaggggggagaatgactcctttctgaggggtgaggagggaagtggggtatggaatatggaatctatttctgtctgcactagagaggtcgggaggaagttaattctcactgtacttgaagaggctttacataaagggttctctctcatcccaagactgctaatttagtgattctgtgagtcactgtgtgcataccccataacctttccttgggattgcccctatcccacactatgacatcagaactttttttattattgttttatatttgaccaaaatattctggtttagatacagatatttacagaaagtagggaggaaggggaccaagccagacagggacaggtatatgtacagggctgagctgcagagggctacaacttccatataaggtagctttttttgtggctcttttccattgcatatgaaaatgtccatttctggtgtgtgcagacatggtggccattgcccacccaggtaccagcagcagaagactatctgacttggaaagaatgggggtttacaggagtccaggaggtcctttccgctctcctaagagccacacctggtgaatactcagtaaacatttgcggaatgaatgaacaccctgtctgcagcaggacatggacaaataggctctgccatcaggaaatgggaagcaagaaaacggtaactcaagaggacagaggctggtgaggaggtaaagcaggcccagtgaaatggacctgacagcccaaactgtcagagaggaggaaagcaggcatttgattttggtaattgtgccaaagctatgtaagagaataaatgccattgttttaaggaaatacacagtgaagtttttaggaaatacacactaagtatttagggataaagtagttatccctaaatagtagtctgccacatgccaaacaatgttaggtactttccatacaacgaatctattattcccatcttacagataaaacaactgaggctcagggagattctgtgacttacctaaggccacacagttagcaacaagccaatattcaaatccagatgatttttactcccaaggacaataaatccaactcaataacttcaaaaaaaag

SEQ ID NO: 278245 - DNA, 1845 bp, Homo sapiens
ggccccgcagaggacttgcctccaccgccacctgcaagtccgcccagctggacttctgcgcaggctccaggagttgtttgctgtctctatggcaacccagtagctggagtctgaagatggagaccaacgagtctacggagggatcgcggtcgcggtcgcgatctttagacatacagcccagctccgaaggactggggcccacttcggaaccgtttccttcttcagatgacagtcccaggtcggccctggcagctgcaaccgcagcagctgcagcggctgcatcagctgctgcagctactgcagccttcaccactgccaaagcagctgcattatctacaaagaccccagcgccctgttctgagttcatggagccgtcctctgaccccagccttcttggggagccctgtgcgggacccggctttacccacaatatagcccatgggagtcttggctttgagcccgtctatgtttcctgtattgctcaggacacttgcactacaactgaccatagttctaatcctggccctgttccaggctctagctctgggcctgttcttggttccagctcaggtgctggccatggctctggctctggctctggtcctggctgtggctctgtccctggctctggctctggtcctggtcctggctctggtcctggctctggtcctggtcatggctctggctctcatcctggtcctgcctctgggcctggtccagacactggccctgactctgagctcagcccctgtattcctccagggttcagaaacctggtggcagatcgggtccctaactatacctcctggagtcagcactgcccctgggagccccagaaacaaccaccttgggaatttttgcaagtcttagaaccgggtgcccgaggactatggaaacccccagacattaaagggaagcttatggtttgctatgaaactttgccgcggggccagtgcctcctctacaactgggaggaagagagagccaccaaccacctggatcaagtcccaagcatgcaggatggctctgagagttttttcttccgacacggacaccggggactgctgactatgcaactaaagtcacccatgccctccagcaccacccagaaagactcgtaccagccaccaggaaacgtctattggccacttcgagggaagcgtgaagccatgctggagatgctcctgcagcatcagatctgtaaagaggtgcaggcagaacaggaacccacaaggaagctcttcgaggttgagtctgtgacacaccatgactaccgaatggagctggcacaagcagggactcctgccccaacaaagcacctggtgaatactcagtaaacatttgcggaatgaatgaacaccctgtctgcagcaggacatggacaaataggctctgccatcaggaaatgggaagcaagaaaacggtaactcaagaggacagaggctggtgaggaggtaaagcaggcccagtgaaatggacctgacagcccaaactgtcagagaggaggaaagcaggcatttgattttggtaattgtgccaaagctatgtaagagaataaatgccattgttttaaggaaatacacagtgaagtttttaggaaatacacactaagtatttagggataaagtagttatccctaaatagtagtctgccacatgccaaacaatgttaggtactttccatacaacgaatctattattcccatcttacagataaaacaactgaggctcagggagattctgtgacttacctaaggccacacagttagcaacaagccaatattcaaatccagatgatttttactcccaaggacaataaatccaactcaataacttcaaaaaaaag

SEQ ID NO: 278246 - DNA, 2221 bp, Homo sapiens
ggccccgcagaggacttgcctccaccgccacctgcaagtccgcccagctggacttctgcgcaggctccaggagttgtttgctgtctctatggcaacccagtagctggagtctgaagatggagaccaacgagtctacggagggatcgcggtcgcggtcgcgatctttagacatacagcccagctccgaaggactggggcccacttcggaaccgtttccttcttcagatgacagtcccagagagccaccaaccacctggatcaagtcccaagcatgcaggatggctctgagagttttttcttccgacacggacaccggggactgctgactatgcaactaaagtcacccatgccctccagcaccacccagaaagactcgtaccagccaccaggaaacgtctattggccacttcgagggaagcgtgaagccatgctggagatgctcctgcagcatcagatctggtaagggattgggtaaaggggaagagggatggggaggagaaaaattgggtgagaatggccttgacacccctcgggctacatagtaaagaggtgcaggcagaacaggaacccacaaggaagctcttcgaggttgagtctgtgacacaccatgactaccgaatggagctggcacaagcagggactcctgccccaacaaaggtgagaacccaccccccatcccccgccacttgcaccagctgggctctgacaggctgtggccaagtaccaagcccagaggttgagagagagggctgaaggccaggagttactcagtaccctccctcacagcctcacgactaccgccaggagcaacctgagaccttctggatacagagggcaccacagctgccggtgtgtgagggtgactaggtgttgggggcagagcggggcaggaaaggtagggcagagttgttttgttctggcttggggagagtgggatccatcctcatcctggcactcctccagggtgtcagtaacatcaggacattggacacaccattccggaagaactgcagcttctcaacaccagtacccttgtctctggggaaacttttgccctatgaacctgagaattacccctaccaattgggagaaatatcttcccttccctgtcccggaggaaggctgggtggtggaggggggagaatgactcctttctgaggggtgaggagggaagtggggtatggaatatggaatctatttctgtctgcactagagaggtcgggaggaagttaattctcactgtacttgaagaggctttacataaagggttctctctcatcccaagactgctaatttagtgattctgtgagtcactgtgtgcataccccataacctttccttgggattgcccctatcccacactatgacatcagaactttttttattattgttttatatttgaccaaaatattctggtttagatacagatatttacagaaagtagggaggaaggggaccaagccagacagggacaggtatatgtacagggctgagctgcagagggctacaacttccatataaggtagctttttttgtggctcttttccattgcatatgaaaatgtccatttctggtgtgtgcagacatggtggccattgcccacccaggtaccagcagcagaagactatctgacttggaaagaatgggggtttacaggagtccaggaggtcctttccgctctcctaagagccacacctggtgaatactcagtaaacatttgcggaatgaatgaacaccctgtctgcagcaggacatggacaaataggctctgccatcaggaaatgggaagcaagaaaacggtaactcaagaggacagaggctggtgaggaggtaaagcaggcccagtgaaatggacctgacagcccaaactgtcagagaggaggaaagcaggcatttgattttggtaattgtgccaaagctatgtaagagaataaatgccattgttttaaggaaatacacagtgaagtttttaggaaatacacactaagtatttagggataaagtagttatccctaaatagtagtctgccacatgccaaacaatgttaggtactttccatacaacgaatctattattcccatcttacagataaaacaactgaggctcagggagattctgtgacttacctaaggccacacagttagcaacaagccaatattcaaatccagatgatttttactcccaaggacaataaatccaactcaataacttcaaaaaaaag

SEQ ID NO: 278247 - DNA, 427 bp, Homo sapiens
ctggctctggctctggtcctggctgtggctctgtccctggctctggctctggtcctggtcctggctctggtcctggctctggtcctggtcatggctctggctctcatcctggtcctgcctctgggcctggtccagacactggccctgactctgagctcagcccctgtattcctccagggttcagaaacctggtggcagatcgggtccctaactatacctcctggagtcagcactgcccctgggagccccagaaacaaccaccttgggaatttttgcaagtcttagaaccgggtgcccgaggactatggaaacccccagacattaaagggaagcttatggtttgctatgaaactttgccgcggggccagtgcctcctctacaactgggaggaagaggtattaaagttttggcctgctcccttttcttg

SEQ ID NO: 278248 - DNA, 2751 bp, Homo sapiens
ggccccgcagaggacttgcctccaccgccacctgcaagtccgcccagctggacttctgcgcaggctccaggagttgtttgctgtctctatggcaacccagtagctggagtctgaagatggagaccaacgagtctacggagggatcgcggtcgcggtcgcgatctttagacatacagcccagctccgaaggactggggcccacttcggaaccgtttccttcttcagatgacagtcccaggtcggccctggcagctgcaaccgcagcagctgcagcggctgcatcagctgctgcagctactgcagccttcaccactgccaaagcagctgcattatctacaaagaccccagcgccctgttctgagttcatggagccgtcctctgaccccagccttcttggggagccctgtgcgggacccggctttacccacaatatagcccatgggagtcttggctttgagcccgtctatgtttcctgtattgctcaggacacttgcactacaactgaccatagttctaatcctggccctgttccaggctctagctctgggcctgttcttggttccagctcaggtgctggccatggctctggctctggctctggtcctggctgtggctctgtccctggctctggctctggtcctggtcctggctctggtcctggctctggtcctggtcatggctctggctctcatcctggtcctgcctctgggcctggtccagacactggccctgactctgagctcagcccctgtattcctccagggttcagaaacctggtggcagatcgggtccctaactatacctcctggagtcagcactgcccctgggagccccagaaacaaccaccttgggaatttttgcaagtcttagaaccgggtgcccgaggactatggaaacccccagacattaaagggaagcttatggtttgctatgaaactttgccgcggggccagtgcctcctctacaactgggaggaagagagagccaccaaccacctggatcaagtcccaagcatgcaggatggctctgagagttttttcttccgacacggacaccggggactgctgactatgcaactaaagtcacccatgccctccagcaccacccagaaagactcgtaccagccaccaggaaacgtctattggccacttcgagggaagcgtgaagccatgctggagatgctcctgcagcatcagatctgtaaagaggtgcaggcagaacaggaacccacaaggaagctcttcgaggttgagtctgtgacacaccatgactaccgaatggagctggcacaagcagggactcctgccccaacaaagcctcacgactaccgccaggagcaacctgagaccttctggatacagagggcaccacagctgccggtgtgtgagggtgactaggtgttgggggcagagcggggcaggaaaggtagggcagagttgttttgttctggcttggggagagtgggatccatcctcatcctggcactcctccagggtgtcagtaacatcaggacattggacacaccattccggaagaactgcagcttctcaacaccagtacccttgtctctggggaaacttttgccctatgaacctgagaattacccctaccaattgggagaaatatcttcccttccctgtcccggaggaaggctgggtggtggaggggggagaatgactcctttctgaggggtgaggagggaagtggggtatggaatatggaatctatttctgtctgcactagagaggtcgggaggaagttaattctcactgtacttgaagaggctttacataaagggttctctctcatcccaagactgctaatttagtgattctgtgagtcactgtgtgcataccccataacctttccttgggattgcccctatcccacactatgacatcagaactttttttattattgttttatatttgaccaaaatattctggtttagatacagatatttacagaaagtagggaggaaggggaccaagccagacagggacaggtatatgtacagggctgagctgcagagggctacaacttccatataaggtagctttttttgtggctcttttccattgcatatgaaaatgtccatttctggtgtgtgcagacatggtggccattgcccacccaggtaccagcagcagaagactatctgacttggaaagaatgggggtttacaggagtccaggaggtcctttccgctctcctaagagccacacctggtgaatactcagtaaacatttgcggaatgaatgaacaccctgtctgcagcaggacatggacaaataggctctgccatcaggaaatgggaagcaagaaaacggtaactcaagaggacagaggctggtgaggaggtaaagcaggcccagtgaaatggacctgacagcccaaactgtcagagaggaggaaagcaggcatttgattttggtaattgtgccaaagctatgtaagagaataaatgccattgttttaaggaaatacacagtgaagtttttaggaaatacacactaagtatttagggataaagtagttatccctaaatagtagtctgccacatgccaaacaatgttaggtactttccatacaacgaatctattattcccatcttacagataaaacaactgaggctcagggagattctgtgacttacctaaggccacacagttagcaacaagccaatattcaaatccagatgatttttactcccaaggacaataaatccaactcaataacttcaaaaaaaag

SEQ ID NO: 278249 - DNA, 2619 bp, Homo sapiens
ggccccgcagaggacttgcctccaccgccacctgcaagtccgcccagctggacttctgcgcaggctccaggagttgtttgctgtctctatggcaacccagtagctggagtctgaagatggagaccaacgagtctacggagggatcgcggtcgcggtcgcgatctttagacatacagcccagctccgaaggactggggcccacttcggaaccgtttccttcttcagatgacagtcccaggtcggccctggcagctgcaaccgcagcagctgcagcggctgcatcagctgctgcagctactgcagccttcaccactgccaaagcagctgcattatctacaaagaccccagcgccctgttctgagttcatggagccgtcctctgaccccagccttcttggggagccctgtgcgggacccggctttacccacaatatagcccatgggagtcttggctttgagcccgtctatgtttcctgtattgctcaggacacttgcactacaactgaccatagttctaatcctggccctgttccaggctctagctctgggcctgttcttggttccagctcaggtgctggccatggctctggctctggctctggtcctggctgtggctctgtccctggctctggctctggtcctggtcctggctctggtcctggctctggtcctggtcatggctctggctctcatcctggtcctgcctctgggcctggtccagacactggccctgactctgagctcagcccctgtattcctccagggttcagaaacctggtggcagatcgggtccctaactatacctcctggagtcagcactgcccctgggagccccagaaacaaccaccttgggaatttttgcaagtcttagaaccgggtgcccgaggactatggaaacccccagacattaaagggaagcttatggtttgctatgaaactttgccgcggggccagtgcctcctctacaactgggaggaagagagagccaccaaccacctggatcaagtcccaagcatgcaggatggctctgagagttttttcttccgacacggacaccggggactgctgactatgcaactaaagtcacccatgccctccagcaccacccagaaagactcgtaccagccaccaggaaacgtctattggccacttcgagggaagcgtgaagccatgctggagatgctcctgcagcatcagatctgtaaagaggtgcaggcagaacaggaacccacaaggaagctcttcgaggttgagtctgtgacacaccatgactaccgaatggagctggcacaagcagggactcctgccccaacaaaggagcaacctgagaccttctggatacagagggcaccacagctgccgggtgtcagtaacatcaggacattggacacaccattccggaagaactgcagcttctcaacaccagtacccttgtctctggggaaacttttgccctatgaacctgagaattacccctaccaattgggagaaatatcttcccttccctgtcccggaggaaggctgggtggtggaggggggagaatgactcctttctgaggggtgaggagggaagtggggtatggaatatggaatctatttctgtctgcactagagaggtcgggaggaagttaattctcactgtacttgaagaggctttacataaagggttctctctcatcccaagactgctaatttagtgattctgtgagtcactgtgtgcataccccataacctttccttgggattgcccctatcccacactatgacatcagaactttttttattattgttttatatttgaccaaaatattctggtttagatacagatatttacagaaagtagggaggaaggggaccaagccagacagggacaggtatatgtacagggctgagctgcagagggctacaacttccatataaggtagctttttttgtggctcttttccattgcatatgaaaatgtccatttctggtgtgtgcagacatggtggccattgcccacccaggtaccagcagcagaagactatctgacttggaaagaatgggggtttacaggagtccaggaggtcctttccgctctcctaagagccacacctggtgaatactcagtaaacatttgcggaatgaatgaacaccctgtctgcagcaggacatggacaaataggctctgccatcaggaaatgggaagcaagaaaacggtaactcaagaggacagaggctggtgaggaggtaaagcaggcccagtgaaatggacctgacagcccaaactgtcagagaggaggaaagcaggcatttgattttggtaattgtgccaaagctatgtaagagaataaatgccattgttttaaggaaatacacagtgaagtttttaggaaatacacactaagtatttagggataaagtagttatccctaaatagtagtctgccacatgccaaacaatgttaggtactttccatacaacgaatctattattcccatcttacagataaaacaactgaggctcagggagattctgtgacttacctaaggccacacagttagcaacaagccaatattcaaatccagatgatttttactcccaaggacaataaatccaactcaataacttcaaaaaaaag

SEQ ID NO: 278250 - DNA, 1895 bp, Homo sapiens
ggccccgcagaggacttgcctccaccgccacctgcaagtccgcccagctggacttctgcgcaggctccaggagttgtttgctgtctctatggcaacccagtagctggagtctgaagatggagaccaacgagtctacggagggatcgcggtcgcggtcgcgatctttagacatacagcccagctccgaaggactggggcccacttcggaaccgtttccttcttcagatgacagtcccagagagccaccaaccacctggatcaagtcccaagcatgcaggatggctctgagagttttttcttccgacacggacaccggggactgctgactatgcaactaaagtcacccatgccctccagcaccacccagaaagactcgtaccagccaccaggaaacgtctattggccacttcgagggaagcgtgaagccatgctggagatgctcctgcagcatcagatctgtaaagaggtgcaggcagaacaggaacccacaaggaagctcttcgaggttgagtctgtgacacaccatgactaccgaatggagctggcacaagcagggactcctgccccaacaaagcctcacgactaccgccaggagcaacctgagaccttctggatacagagggcaccacagctgccgggtgtcagtaacatcaggacattggacacaccattccggaagaactgcagcttctcaacaccagtacccttgtctctggggaaacttttgccctatgaacctgagaattacccctaccaattgggagaaatatcttcccttccctgtcccggaggaaggctgggtggtggaggggggagaatgactcctttctgaggggtgaggagggaagtggggtatggaatatggaatctatttctgtctgcactagagaggtcgggaggaagttaattctcactgtacttgaagaggctttacataaagggttctctctcatcccaagactgctaatttagtgattctgtgagtcactgtgtgcataccccataacctttccttgggattgcccctatcccacactatgacatcagaactttttttattattgttttatatttgaccaaaatattctggtttagatacagatatttacagaaagtagggaggaaggggaccaagccagacagggacaggtatatgtacagggctgagctgcagagggctacaacttccatataaggtagctttttttgtggctcttttccattgcatatgaaaatgtccatttctggtgtgtgcagacatggtggccattgcccacccaggtaccagcagcagaagactatctgacttggaaagaatgggggtttacaggagtccaggaggtcctttccgctctcctaagagccacacctggtgaatactcagtaaacatttgcggaatgaatgaacaccctgtctgcagcaggacatggacaaataggctctgccatcaggaaatgggaagcaagaaaacggtaactcaagaggacagaggctggtgaggaggtaaagcaggcccagtgaaatggacctgacagcccaaactgtcagagaggaggaaagcaggcatttgattttggtaattgtgccaaagctatgtaagagaataaatgccattgttttaaggaaatacacagtgaagtttttaggaaatacacactaagtatttagggataaagtagttatccctaaatagtagtctgccacatgccaaacaatgttaggtactttccatacaacgaatctattattcccatcttacagataaaacaactgaggctcagggagattctgtgacttacctaaggccacacagttagcaacaagccaatattcaaatccagatgatttttactcccaaggacaataaatccaactcaataacttcaaaaaaaag

SEQ ID NO: 278251 - DNA, 1978 bp, Homo sapiens
ggccccgcagaggacttgcctccaccgccacctgcaagtccgcccagctggacttctgcgcaggctccaggagttgtttgctgtctctatggcaacccagtagctggagtctgaagatggagaccaacgagtctacggagggatcgcggtcgcggtcgcgatctttagacatacagcccagctccgaaggactggggcccacttcggaaccgtttccttcttcagatgacagtcccagagagccaccaaccacctggatcaagtcccaagcatgcaggatggctctgagagttttttcttccgacacggacaccggggactgctgactatgcaactaaagtcacccatgccctccagcaccacccagaaagactcgtaccagccaccaggaaacgtctattggccacttcgagggaagcgtgaagccatgctggagatgctcctgcagcatcagatctggtaagggattgggtaaaggggaagagggatggggaggagaaaaattgggtgagaatggccttgacacccctcgggctacatagtaaagaggtgcaggcagaacaggaacccacaaggaagctcttcgaggttgagtctgtgacacaccatgactaccgaatggagctggcacaagcagggactcctgccccaacaaagcctcacgactaccgccaggagcaacctgagaccttctggatacagagggcaccacagctgccgggtgtcagtaacatcaggacattggacacaccattccggaagaactgcagcttctcaacaccagtacccttgtctctggggaaacttttgccctatgaacctgagaattacccctaccaattgggagaaatatcttcccttccctgtcccggaggaaggctgggtggtggaggggggagaatgactcctttctgaggggtgaggagggaagtggggtatggaatatggaatctatttctgtctgcactagagaggtcgggaggaagttaattctcactgtacttgaagaggctttacataaagggttctctctcatcccaagactgctaatttagtgattctgtgagtcactgtgtgcataccccataacctttccttgggattgcccctatcccacactatgacatcagaactttttttattattgttttatatttgaccaaaatattctggtttagatacagatatttacagaaagtagggaggaaggggaccaagccagacagggacaggtatatgtacagggctgagctgcagagggctacaacttccatataaggtagctttttttgtggctcttttccattgcatatgaaaatgtccatttctggtgtgtgcagacatggtggccattgcccacccaggtaccagcagcagaagactatctgacttggaaagaatgggggtttacaggagtccaggaggtcctttccgctctcctaagagccacacctggtgaatactcagtaaacatttgcggaatgaatgaacaccctgtctgcagcaggacatggacaaataggctctgccatcaggaaatgggaagcaagaaaacggtaactcaagaggacagaggctggtgaggaggtaaagcaggcccagtgaaatggacctgacagcccaaactgtcagagaggaggaaagcaggcatttgattttggtaattgtgccaaagctatgtaagagaataaatgccattgttttaaggaaatacacagtgaagtttttaggaaatacacactaagtatttagggataaagtagttatccctaaatagtagtctgccacatgccaaacaatgttaggtactttccatacaacgaatctattattcccatcttacagataaaacaactgaggctcagggagattctgtgacttacctaaggccacacagttagcaacaagccaatattcaaatccagatgatttttactcccaaggacaataaatccaactcaataacttcaaaaaaaag

SEQ ID NO: 278252 - DNA, 5528 bp, Homo sapiens
ggcctccgcccgccagccgctctcctcccgctcgccgttagggaggctctgcacctcagccgccgcctctgtcgccactctctccccctgttccgcgtctgcgtcgccaccaccgccgggggtatccggggggtcgcttaccgggctggccccgcgccacagccgtagctttaacctccccgtcagcggccgccccaggaagaggcttctcggccgcggagccacttggggcctcagttctcgccctcttgccgtcgccgcgggtcctggagaagcggccgcggccagggaacggggcatcgcggttccaacgattaactgctgaagtactgatcgagttctgcatttcttcaatgaggaactacaggctgatcttctgccataatctcaaacagccataaatgacaaaagaatgcttgctcagtgagggtagctggtgcagaagccattttttaaacttaggtatttaagtactgaaagaaaagacagctttgatttctggctgcaaaaaagatatgaggaagagctcctccccttccttgagtaactgcaactccgttcttgctaacaaaatatttggaattccacttgatgagctgcagcagggaggacatccagacaatgaggttccattcatagtccgccacgttgtggactatattgaggaacatggaggtctggagcaacaaggactttttcaagtcaatggaaatgctgagacagtggagtggcttcggcagagatacgacagcggagaagaggtggatttggttaaggaagcagatgttccctcagctattagccttcttagattttttcttcaagaacttcctgaacctgttatccctggcagtttacatattcacttgatgcagctttctcaagattataataatgaagatgaatttggaagaaagttgaggttcctcttgcaacagcttccacctgttaattatagtttgttaaagtttctgtgtagatttttagccaatgtagcatcacatcatgaagaaatttggtctgcaaattctttggctgctgtctttggtccagatgtcttccacatttacacagatgtggaagacatgaaagagcaagaaatagtgagcaggataatggctggacttctggaaaactactatgagttttttgagaatgaagaggaagatttttcatctaatgatttgagttcaattactgaacaggttaatgaactttctgaggaagaagaggaagatgaaaagctggaacatattgaagaacttccagaagagggtgcagaaaaatcaaatgacatgccagaggtggtacaattaaggatgactgaaaacatcctggaatcaaatagtgttacggcaacaagcacccatatatctcccatcagcatcctaccagcctctacagatattttagaaagaacaattagagcagctgtggaacagcacctttttgatcttcagagcagcatagatcatgatcttaagaatttacaacagcaaagtgtggtgtgtaataatgaagcagaaagtattcattgtgatggggaaggatctaataaccagattgatattgctgatgatattattaatgccagtgaaagtaacagagactgttcaaaacctgtggctagcactaatttagacaatgaagctatgcagcaagattgtgtatttgagaatgaagaaaatacccagtctgtaggtatattgttagagccatgcagtgaccgtggtgatagtgaagatggctgtcttgagagggaagaatatttgttatttgacagtgataaattgtcacacttgattctggattctagtagcaagatatgtgatttgaatgccaacactgaatcagaagtaccaggaggtcagagtgttggtgttcaaggggaagcagcgtgtgtcagtattccacatttagatctgaagaatgtttctgatggtgataaatgggaagagccatttcctgcttttaagtcttggcaggaggactctgagtctggagaagctcagctgtctccacaagctggaagaatgaatcatcaccccttggaagaggactgtcctccagtattatcacaccgcagtttagattttggtcaaagccagcgtttcctacatgatccagaaaagttggattcctcatctaaagcactgtcttttactagaattcgaagatcatcctttagttcaaaagatgaaaagagagaggacagaacaccttatcagctggtcaagaaacttcagaagaaaatcagacaatttgaggaacagtttgaaagggaaagaaatagcaagccctcctacagtgatattgctgccaatccaaaggtattaaaatggatgacagagcttacaaaactgcggaagcaaattaaagatgcaaaacacaaaaattctgatggagaatttgtacctcagacacgtccacgtagtaacacacttccaaaaagctttggctcttctctagaccatgaagatgaagagaatgaagatgaacccaaggtcattcagaaggagaaaaaaccatctaaagaagcaacccttgaacttattcttaaaagactgaaagaaaaacgtattgagaggtgtcttccagaagatatcaagaaaatgaccaaagatcatttggtagaagagaaagcttctcttcagaaaagtcttctttactatgaaagtcaacatggaaggccggtgaccaaggaagaaaggcacattgttaaacctctctatgatagatacaggcttgtaaaacaaatgctgacaagagctagcatcactcctgtccttggatctccatccaccaagcgaaggggtcagatgttacagccaatcatagaaggagaaactgcacatttttttgaagaaatcaaggaggaagaagaagatggtgttaatctgtcctctgagttaggtgatatgttgaaaactgcagtacaggtacagtcttcattagaaaactctgaatctgatgttgaagaaaatcaagaaaaactggctctggatctccgattgtcaagttctcgagcagcttctatgcctgaattattggaacaactttggaaagccagagctgaaaaaaagaaactacgcaaaacgttgcgggaatttgaagaagcattttatcaacaaaatggaaggaatgcccagaaagaggatcgtgttccagtgcttgaggagtacagagagtacaagaaaattaaagccaagcttaggcttcttgaagttcttataagcaaacaagattcttcaaaatccatataagatacgttccttgaaaattcatatcataaagtcagttgtattccttgaagctatcatcgtgtgtacttggctggtacttaaattcgttttgtcaggcactcagagaatctcattttgtacttggttgtggtgccactaaacaaaacaaatgatgggagagtaagtaggccctctcaagggagcgtaagtgatgttccatattaaccacagactgtcctctccacctttagcaaacatatggtttacttcattgttttgtactacagatacatccttttagcaaaagactggaattttatcctttcaacttcaagaactttggaaatgcaagctttttgttattaccaactttttgtttctcattactgaagaaaattggaggaaaatcttcatactgaattcttctgttgcctttttcttacagaatgactgaaaatttgaaagaaaagcctataaaagtgcacatacgcaactgtgttctctgttttcctagaaaaccaaaatcaaactgagatttcaagtcgtactatggaacacctttctgtttaattcccaaagtgacatcttctcacaggtagtatgttagtaaaattttgcaattcgctggtcacacagctcccggatgaagataacagttggtagaccaaaaggtgacctcgcttagtatattgaaaacacacaccacacatcacacacagaactgaatcataccacgtgctgcctatgggacttcagttactgtttcctgagttactgtttatccgctggcaatggtgtgatttgtctggatcagatccgcgctattccccaacccacctccagataatgtgagaaaatagccatgtcagtatgtaggaactctgatggtgctcagatttgtgtgttcaatcaatgggcttaaatcagcaaaatattatgcctaaagtaaatctgttcttaacaagggctctaccactgcattttcacatgtaccttcagggggttatctttttttttttcccctcctattttaatcagcaaaatccataccaaaacaacgacaacaacgccctcttaagggaccaccctttggtcaatcataacatgctgtttaaagcagctgtttacaggatgtgtagtggtatgccccttgtcatatactcttagcatatctttttttcctttggctttgcatggcttttcttcaggtactgtctcggtatcattctgctaatcattgttacagaatggtgacttcatttgtgctaacagtacaacagcagatttgggtcaggcttaatctaagtgttaacttttttttctggtgcttttttggattgatgactgtctcactttgactatacccatgttttgcatgcaatgactcatgcatggttttcttaactagctaatattaacaatttattccatataaaaatggaattttgcaacatcctttaataaggtgagggaagcatgaacctcagacttctggcactattacatagtaagcacatgaagtagtttgataataaatagcagttctagtacttcacatttcacccgtgtgtgcaatgcctttttctggggggtggggggtgagggaaaacctggtagtgaatgtgtagttggggaataaagaaaagcactaaatcctgccctttttgtgtggtttccttttgatacaactaggttattcataatgtatacctagaaaagtgaaattgaaaataccaaaagatgtatcatttttatttgaatccatcatgcagtgtacatttcagataatttccttcagtctccagataggagtgtatccaaacatctaattttatgtgcactgtgtatcttatatgaatgttttattttatataccacatgcaaaaatgtccatatgcactatttaaatgttttaaataatatattccttctttataatgctaaatctatatgagtaccatatttttataagtcagtggtctgactggtttcattttagaattaacagctgcttcaatatgttattcaatgttaatgtttggctgtgagtagaatatgtaaaagtggcatggcagcacttatgctctgtgacagtattgtgtgtcatagttgagcagtagctggtagaattaggcagttggtgatagttttactttggtacaaataaaaactgtatatctatatacaaataatatatagatatatatgtccaccagtataatggcattgctgtgtctggcacttcattgtacagacttttataataaaagaacttgaaagttctaa

SEQ ID NO: 278253 - DNA, 432 bp, Homo sapiens
taccaaatggctgtggatggtagtggtgatacatattacctaatagagagaaatgcagagtacctgctatacttcatatgacccaggttttgagggaagataaattactctctgtaaaaagagatgctaagtactacagactattataaatgatagctaattaggggtgtttgactaatctgtattctaatatcctaatttagattggcaacttctcttatctgagtattgggagctccattaatacatggtagtgttctttttgtcagtctgtaggtatattgttagagccatgcagtgaccgtggtgatagtgaagatggctgtcttgagaggtaagcattttttcttgttgctaattaatcattttgagaattggagctcctcacagatttttgaggtgatttttttagatgaatgtcctaataaatat

SEQ ID NO: 278254 - DNA, 5568 bp, Homo sapiens
ggcctccgcccgccagccgctctcctcccgctcgccgttagggaggctctgcacctcagccgccgcctctgtcgccactctctccccctgttccgcgtctgcgtcgccaccaccgccgggggtatccggggggtcgcttaccgggctggccccgcgccacagccgtagctttaacctccccgtcagcggccgccccaggaagaggcttctcggccgcggagccacttggggcctcagttctcgccctcttgccgtcgccgcgggtcctggagaagcggccgcggccagggaacggggcatcgcggttccaacgattaactgctgaagtactgatcgagttctgcatttcttcaatgaggaactacaggctgatcttctgccataatctcaaacagccataaatgacaaaagaatgcttgctcagtgagggtagctggtgcagaagccattttttaaacttaggtatttaagtactgaaagaaaagacagctttgatttctggctgcaaaaaagatatgaggaagagctcctccccttccttgagtaactgcaactccgttcttgctaacaaaatatttggaattccacttgatgagctgcagcagggaggacatccagacaatgaggttccattcatagtccgccacgttgtggactatattgaggaacatggaggtctggagcaacaaggactttttcaagtcaatggaaatgctgagacagtggagtggcttcggcagagatacgacagcggagaagaggtggatttggttaaggaagcagatgttccctcagctattagccttcttagattttttcttcaagaacttcctgaacctgttatccctggcagtttacatattcacttgatgcagctttctcaagattataataatgaagatgaatttggaagaaagttgaggttcctcttgcaacagcttccacctgttaattatagtttgttaaagtttctgtgtagatttttagccaatgtagcatcacatcatgaagaaatttggtctgcaaattctttggctgctgtctttggtccagatgtcttccacatttacacagatgtggaagacatgaaagagcaagaaatagtgagcaggataatggctggacttctggaaaactactatgagttttttgagaatgaagaggaagatttttcatctaatgatttgagttcaattactgaacaggttaatgaactttctgaggaagaagaggaagatgaaaagctggaacatattgaagaacttccagaagagggtgcagaaaaatcaaatgacatgccagaggtggtacaattaaggatgactgaaaacatcctggaatcaaatagtgttacggcaacaagcacccatatatctcccatcagcatcctaccagcctctacagatattttagaaagaacaattagagcagctgtggaacagcacctttttgatcttcagagcagcatagatcatgatcttaagaatttacaacagcaaagtgtggtgtgtaataatgaagcagaaagtattcattgtgatggggaaggatctaataaccagattgatattgctgatgatattattaatgccagtgaaagtaacagagactgttcaaaacctgtggctagcactaatttagacaatgaagctatgcagcaagattgtgtatttgagaatgaagaaaatacccagtctgtaggtatattgttagagccatgcagtgaccgtggtgatagtgaagatggctgtcttgagagggaagaatatttgttatttgacagtgataaattgtcacacttgattctggattctagtagcaagatatgtgatttgaatgccaacactgaatcagaagtaccaggaggtcagagtgttggtgttcaaggggaagcagcgtgtgtcagtattccacatttagatctgaagaatgtttctgatggtgataaatgggaagagccatttcctgcttttaagtcttggcaggaggactctgagtctggagaagctcagctgtctccacaagctggaagaatgaatcatcaccccttggaagaggactgtcctccagtattatcacaccgcagtttagattttggtcaaagccagcgtttcctacatgatccagaaaagttggattcctcatctaaagcactgtcttttactagaattcgaagatcatcctttagttcaaaagatgaaaagagagaggacagaacaccttatcagctggtcaagaaacttcagaagaaaatcagacaatttgaggaacagtttgaaagggaaagaaatagcaagccctcctacagtgatattgctgccaatccaaaggtattaaaatggatgacagagcttacaaaactgcggaagcaaattaaagatgcaaaacacaaaaattctgatggagaatttgtacctcagacacgtccacgtagtaacacacttccaaaaagctttggctcttctctagaccatgaagatgaagagaatgaagatgaacccaaggtcattcagaaggagaaaaaaccatctaaagaagcaacccttgaacttattcttaaaagactgaaagaaaaacgtattgagaggtgtcttccagaagatatcaagaaaatgaccaaagatcatttggtagaagagaaagcttctcttcagaaaagtcttctttactatgaaagtcaacatggaaggccggtgaccaaggaagaaaggcacattgttaaacctctctatgatagatacaggcttgtaaaacaaatgctgacaagagctagcatcactcctgtccttggatctccatccaccaagcgaaggggtcagatgttacagccaatcatagaaggagaaactgcacatttttttgaagaaatcaaggaggaagaagaagatggtgttaatctgtcctctgagttaggtgatatgttgaaaactgcagtacaggtacagtcttcattagaaaactctgaatctgatgttgaagaaaatcaagaaaaactggctctggatctccgattgtcaagttctcgagcagcttctatgcctgaattattggaacaactttggaaagccagagctgaaaaaaagaaactacgcaaaacgttgcgggaatttgaagaagcattttatcaacaaaatggaaggaatgcccagaaagaggatcgtgttccagtgcttgaggagtacagagagtacaagaaaattaaagccaagcttaggcttcttgaagttcttataagcaaacaagattcttcaaaatccatataagatacgttccttgaaaattcatatcataaagtcagttgtattccttgaagctatcatcgtgtgtacttggctggtacttaaattcgttttgtcaggcactcagagaatctcattttgtacttggttgtggtgccactaaacaaaacaaatgatgggagagtaagtaggccctctcaagggagcgtaagtgatgttccatattaaccacagactgtcctctccacctttagcaaacatatggtttacttcattgttttgtactacagatacatccttttagcaaaagactggaattttatcctttcaacttcaagaactttggaaatgcaagctttttgttattaccaactttttgtttctcattactgaagaaaattggaggaaaatcttcatactgaattcttctgttgcctttttcttacagaatgactgaaaatttgaaagaaaagcctataaaagtgcacatacgcaactgtgttctctgttttcctagaaaaccaaaatcaaactgagatttcaagtcgtactatggaacacctttctgtttaattcccaaagtgacatcttctcacaggtagtatgttagtaaaattttgcaattcgctggtcacacagctcccggatgaagataacagttggtagaccaaaaggtgacctcgcttagtatattgaaaacacacaccacacatcacacacagaactgaatcataccacgtgctgcctatgggacttcagttactgtttcctgagttactgtttatccgctggcaatggtgtgatttgtctggatcagatccgcgctattccccaacccacctccagataatgtgagaaaatagccatgtcagtatgtaggaactctgatggtgctcagatttgtgtgttcaatcaatgggcttaaatcagcaaaatattatgcctaaagtaaatctgttcttaacaagggctctaccactgcattttcacatgtaccttcagggggttatctttttttttttcccctcctattttaatcagcaaaatccataccaaaacaacgacaacaacgccctcttaagggaccaccctttggtcaatcataacatgctgtttaaagcagctgtttacaggatgtgtagtggtatgccccttgtcatatactcttagcatatctttttttcctttggctttgcatggcttttcttcaggtactgtctcggtatcattctgctaatcattgttacagaatggtgacttcatttgtgctaacagtacaacagcagatttgggtcaggcttaatctaagtgttaacttttttttctggtgcttttttggattgatgactgtctcactttgactatacccatgttttgcatgcaatgactcatgcatggttttcttaactagctaatattaacaatttattccatataaaaatggaattttgcaacatcctttaataaggtgagggaagcatgaacctcagacttctggcactattacatagtaagcacatgaagtagtttgataataaatagcagttctagtacttcacatttcacccgtgtgtgcaatgcctttttctggggggtggggggtgagggaaaacctggtagtgaatgtgtagttggggaataaagaaaagcactaaatcctgccctttttgtgtggtttccttttgatacaactaggttattcataatgtatacctagaaaagtgaaattgaaaataccaaaagatgtatcatttttatttgaatccatcatgcagtgtacatttcagataatttccttcagtctccagataggagtgtatccaaacatctaattttatgtgcactgtgtatcttatatgaatgttttattttatataccacatgcaaaaatgtccatatgcactatttaaatgttttaaataatatattccttctttataatgctaaatctatatgagtaccatatttttataagtcagtggtctgactggtttcattttagaattaacagctgcttcaatatgttattcaatgttaatgtttggctgtgagtagaatatgtaaaagtggcatggcagcacttatgctctgtgacagtattgtgtgtcatagttgagcagtagctggtagaattaggcagttggtgatagttttactttggtacaaataaaaactgtatatctatatacaaataatatatagatatatatgtccaccagtataatggcattgctgtgtctggcacttcattgtacagacttttataataaaagaacttgaaagttctaagtcattgtaaatgtatgtttgtttttccactgggcttaaa

SEQ ID NO: 278255 - DNA, 5376 bp, Homo sapiens
ggcctccgcccgccagccgctctcctcccgctcgccgttagggaggctctgcacctcagccgccgcctctgtcgccactctctccccctgttccgcgtctgcgtcgccaccaccgccgggggtatccggggggtcgcttaccgggctggccccgcgccacagccgtagctttaacctccccgtcagcggccgccccaggaagaggcttctcggccgcggagccacttggggcctcagttctcgccctcttgccgtcgccgcgggtcctggagaagcggccgcggccagggaacggggcatcgcggttccaacgattaactgctgaagtactgatcgagttctgcatttcttcaatgaggaactacaggctgatcttctgccataatctcaaacagccataaatgacaaaagaatgcttgctcagtgagggtagctggtgcagaagccattttttaaacttaggtatttaagtactgaaaggaggtctggagcaacaaggactttttcaagtcaatggaaatgctgagacagtggagtggcttcggcagagatacgacagcggagaagaggtggatttggttaaggaagcagatgttccctcagctattagccttcttagattttttcttcaagaacttcctgaacctgttatccctggcagtttacatattcacttgatgcagctttctcaagattataataatgaagatgaatttggaagaaagttgaggttcctcttgcaacagcttccacctgttaattatagtttgttaaagtttctgtgtagatttttagccaatgtagcatcacatcatgaagaaatttggtctgcaaattctttggctgctgtctttggtccagatgtcttccacatttacacagatgtggaagacatgaaagagcaagaaatagtgagcaggataatggctggacttctggaaaactactatgagttttttgagaatgaagaggaagatttttcatctaatgatttgagttcaattactgaacaggttaatgaactttctgaggaagaagaggaagatgaaaagctggaacatattgaagaacttccagaagagggtgcagaaaaatcaaatgacatgccagaggtggtacaattaaggatgactgaaaacatcctggaatcaaatagtgttacggcaacaagcacccatatatctcccatcagcatcctaccagcctctacagatattttagaaagaacaattagagcagctgtggaacagcacctttttgatcttcagagcagcatagatcatgatcttaagaatttacaacagcaaagtgtggtgtgtaataatgaagcagaaagtattcattgtgatggggaaggatctaataaccagattgatattgctgatgatattattaatgccagtgaaagtaacagagactgttcaaaacctgtggctagcactaatttagacaatgaagctatgcagcaagattgtgtatttgagaatgaagaaaatacccagtctgtaggtatattgttagagccatgcagtgaccgtggtgatagtgaagatggctgtcttgagagggaagaatatttgttatttgacagtgataaattgtcacacttgattctggattctagtagcaagatatgtgatttgaatgccaacactgaatcagaagtaccaggaggtcagagtgttggtgttcaaggggaagcagcgtgtgtcagtattccacatttagatctgaagaatgtttctgatggtgataaatgggaagagccatttcctgcttttaagtcttggcaggaggactctgagtctggagaagctcagctgtctccacaagctggaagaatgaatcatcaccccttggaagaggactgtcctccagtattatcacaccgcagtttagattttggtcaaagccagcgtttcctacatgatccagaaaagttggattcctcatctaaagcactgtcttttactagaattcgaagatcatcctttagttcaaaagatgaaaagagagaggacagaacaccttatcagctggtcaagaaacttcagaagaaaatcagacaatttgaggaacagtttgaaagggaaagaaatagcaagccctcctacagtgatattgctgccaatccaaaggtattaaaatggatgacagagcttacaaaactgcggaagcaaattaaagatgcaaaacacaaaaattctgatggagaatttgtacctcagacacgtccacgtagtaacacacttccaaaaagctttggctcttctctagaccatgaagatgaagagaatgaagatgaacccaaggtcattcagaaggagaaaaaaccatctaaagaagcaacccttgaacttattcttaaaagactgaaagaaaaacgtattgagaggtgtcttccagaagatatcaagaaaatgaccaaagatcatttggtagaagagaaagcttctcttcagaaaagtcttctttactatgaaagtcaacatggaaggccggtgaccaaggaagaaaggcacattgttaaacctctctatgatagatacaggcttgtaaaacaaatgctgacaagagctagcatcactcctgtccttggatctccatccaccaagcgaaggggtcagatgttacagccaatcatagaaggagaaactgcacatttttttgaagaaatcaaggaggaagaagaagatggtgttaatctgtcctctgagttaggtgatatgttgaaaactgcagtacaggtacagtcttcattagaaaactctgaatctgatgttgaagaaaatcaagaaaaactggctctggatctccgattgtcaagttctcgagcagcttctatgcctgaattattggaacaactttggaaagccagagctgaaaaaaagaaactacgcaaaacgttgcgggaatttgaagaagcattttatcaacaaaatggaaggaatgcccagaaagaggatcgtgttccagtgcttgaggagtacagagagtacaagaaaattaaagccaagcttaggcttcttgaagttcttataagcaaacaagattcttcaaaatccatataagatacgttccttgaaaattcatatcataaagtcagttgtattccttgaagctatcatcgtgtgtacttggctggtacttaaattcgttttgtcaggcactcagagaatctcattttgtacttggttgtggtgccactaaacaaaacaaatgatgggagagtaagtaggccctctcaagggagcgtaagtgatgttccatattaaccacagactgtcctctccacctttagcaaacatatggtttacttcattgttttgtactacagatacatccttttagcaaaagactggaattttatcctttcaacttcaagaactttggaaatgcaagctttttgttattaccaactttttgtttctcattactgaagaaaattggaggaaaatcttcatactgaattcttctgttgcctttttcttacagaatgactgaaaatttgaaagaaaagcctataaaagtgcacatacgcaactgtgttctctgttttcctagaaaaccaaaatcaaactgagatttcaagtcgtactatggaacacctttctgtttaattcccaaagtgacatcttctcacaggtagtatgttagtaaaattttgcaattcgctggtcacacagctcccggatgaagataacagttggtagaccaaaaggtgacctcgcttagtatattgaaaacacacaccacacatcacacacagaactgaatcataccacgtgctgcctatgggacttcagttactgtttcctgagttactgtttatccgctggcaatggtgtgatttgtctggatcagatccgcgctattccccaacccacctccagataatgtgagaaaatagccatgtcagtatgtaggaactctgatggtgctcagatttgtgtgttcaatcaatgggcttaaatcagcaaaatattatgcctaaagtaaatctgttcttaacaagggctctaccactgcattttcacatgtaccttcagggggttatctttttttttttcccctcctattttaatcagcaaaatccataccaaaacaacgacaacaacgccctcttaagggaccaccctttggtcaatcataacatgctgtttaaagcagctgtttacaggatgtgtagtggtatgccccttgtcatatactcttagcatatctttttttcctttggctttgcatggcttttcttcaggtactgtctcggtatcattctgctaatcattgttacagaatggtgacttcatttgtgctaacagtacaacagcagatttgggtcaggcttaatctaagtgttaacttttttttctggtgcttttttggattgatgactgtctcactttgactatacccatgttttgcatgcaatgactcatgcatggttttcttaactagctaatattaacaatttattccatataaaaatggaattttgcaacatcctttaataaggtgagggaagcatgaacctcagacttctggcactattacatagtaagcacatgaagtagtttgataataaatagcagttctagtacttcacatttcacccgtgtgtgcaatgcctttttctggggggtggggggtgagggaaaacctggtagtgaatgtgtagttggggaataaagaaaagcactaaatcctgccctttttgtgtggtttccttttgatacaactaggttattcataatgtatacctagaaaagtgaaattgaaaataccaaaagatgtatcatttttatttgaatccatcatgcagtgtacatttcagataatttccttcagtctccagataggagtgtatccaaacatctaattttatgtgcactgtgtatcttatatgaatgttttattttatataccacatgcaaaaatgtccatatgcactatttaaatgttttaaataatatattccttctttataatgctaaatctatatgagtaccatatttttataagtcagtggtctgactggtttcattttagaattaacagctgcttcaatatgttattcaatgttaatgtttggctgtgagtagaatatgtaaaagtggcatggcagcacttatgctctgtgacagtattgtgtgtcatagttgagcagtagctggtagaattaggcagttggtgatagttttactttggtacaaataaaaactgtatatctatatacaaataatatatagatatatatgtccaccagtataatggcattgctgtgtctggcacttcattgtacagacttttataataaaagaacttgaaagttctaagtcattgtaaatgtatgtttgtttttccactgggcttaaa

SEQ ID NO: 278256 - DNA, 5474 bp, Homo sapiens
ggcctccgcccgccagccgctctcctcccgctcgccgttagggaggctctgcacctcagccgccgcctctgtcgccactctctccccctgttccgcgtctgcgtcgccaccaccgccgggggtatccggggggtcgcttaccgggctggccccgcgccacagccgtagctttaacctccccgtcagcggccgccccaggaagaggcttctcggccgcggagccacttggggcctcagttctcgccctcttgccgtcgccgcgggtcctggagaagcggccgcggccagggaacggggcatcgcggttccaacgattaactgctgaagtactgatcgagttctgcatttcttcaatgaggaactacaggctgatcttctgccataatctcaaacagccataaatgacaaaagaatgcttgctcagtgagggtagctggtgcagaagccattttttaaacttaggtatttaagtactgaaagaaaagacagctttgatttctggctgcaaaaaagatatgaggaagagctcctccccttccttgagtaactgcaactccgttcttgctaacaaaatatttggaattccacttgatgagctgcagcagggaggacatccagacaatgaggttccattcatagtccgccacgttgtggactatattgaggaacatggaggtctggagcaacaaggactttttcaagtcaatggaaatgctgagacagtggagtggcttcggcagagatacgacagcggagaagaggtggatttggttaaggaagcagatgttccctcagctattagccttcttagattttttcttcaagaacttcctgaacctgttatccctggcagtttacatattcacttgatgcagctttctcaagattataataatgaagatgaatttggaagaaagttgaggttcctcttgcaacagcttccacctgttaattatagtttgttaaagtttctgtgtagatttttagccaatgtagcatcacatcatgaagaaatttggtctgcaaattctttggctgctgtctttggtccagatgtcttccacatttacacagatgtggaagacatgaaagagcaagaaatagtgagcaggataatggctggacttctggaaaactactatgagttttttgagaatgaagaggaagatttttcatctaatgatttgagttcaattactgaacaggttaatgaactttctgaggaagaagaggaagatgaaaagctggaacatattgaagaacttccagaagagggtgcagaaaaatcaaatgacatgccagaggtggtacaattaaggatgactgaaaacatcctggaatcaaatagtgttacggcaacaagcacccatatatctcccatcagcatcctaccagcctctacagatattttagaaagaacaattagagcagctgtggaacagcacctttttgatcttcagagcagcatagatcatgatcttaagaatttacaacagcaaagtgtggtgtgtaataatgaagcagaaagtattcattgtgatggggaaggatctaataaccagattgatattgctgatgatattattaatgccagtgaaagtaacagagactgttcaaaacctgtggctagcactaatttagacaatgaagctatgcagcaagattgtgtatttgagaatgaagaaaatacccagtctgtaggtatattgttagagccatgcagtgaccgtggtgatagtgaagatggctgtcttgagagggaagaatatttgttatttgacagtgataaattgtcacacttgattctggattctagtagcaagatatgtgatttgaatgccaacactgaatcagaagtaccaggaggtcagagtgttggtgttcaaggggaagcagcgtgtgtcagtattccacatttagatctgaagaatgtttctgatggtgataaatgggaagagccatttcctgcttttaagtcttggcaggaggactctgagtctggagaagctcagctgtctccacaagctggaagaatgaatcatcaccccttggaagaggactgtcctccagtattatcacaccgcagtttagattttggtcaaagccagcgtttcctacatgatccagaaaagttggattcctcatctaaagcactgtcttttactagaattcgaagatcatcctttagttcaaaagatgaaaagagagaggacagaacaccttatcagctggtcaagaaacttcagaagaaaatcagacaatttgaggaacagtttgaaagggaaagaaatagcaagccctcctacagtgatattgctgccaatccaaaggtattaaaatggatgacagagcttacaaaactgcggaagcaaattaaagatgcaaaacacaaaaattctgatggagaatttgtacctcagacacgtccacgtagtaacacacttccaaaaagctttggctcttctctagaccatgaagatgaagagaatgaagatgaacccaaggtcattcagaaggagaaaaaaccatctaaagaagcaacccttgaacttattcttaaaagactgaaagaaaaacgtattgagaggtgtcttccagaagatatcaagaaaatgaccaaagatcatttggtagaagagaaagcttctcttcagaaaagtcttctttactatgaaagtcaacatggaaggccggtgaccaaggaagaaaggcacattgttaaacctctctatgatagatacaggcttgtaaaacaaatgctgacaagagctagcatcactcctgtccttggatctccatccaccaagcgaaggggtcagatgttacagccaatcatagaaggagaaactgcacatttttttgaagaaatcaaggaggaagaagaagatggtgttaatctgtcctctgagttaggtgatatgttgaaaactgcagtacaggtacagtcttcattagaaaactctgaatctgatgttgaagaaaatcaagaaaaactggctctggatctccgattgtcaagttctcgagcagcttctatgcctgaattattggaacaactttggaaagccagagctgaaaaaaagaaactacgcaaaacgttgcgggaatttgaagaagcattttatcaacaaaatggaaggaatgcccagaaagaggatcgtgttccagtgcttgaggagtacagagagtacaagaaaattaaagccaagcttaggcttcttgaagttcttataagcaaacaagattcttcaaaatccatataagatacgttccttgaaaattcatatcataaagtcagttgtattccttgaagctatcatcgtgtgtacttggctggtacttaaattcgttttgtcaggcactcagagaatctcattttgtacttggttgtggtgccactaaacaaaacaaatgatgggagagtaagtaggccctctcaagggagcgtaagtgatgttccatattaaccacagactgtcctctccacctttagcaaacatatggtttacttcattgttttgtactacagatacatccttttagcaaaagactggaattttatcctttcaacttcaagaactttggaaatgcaagctttttgttattaccaactttttgtttctcattactgaagaaaattggaggaaaatcttcatactgaattcttctgttgcctttttcttacagaatgactgaaaatttgaaagaaaagcctataaaagtgcacatacgcaactgtgttctctgttttcctagaaaaccaaaatcaaactgagatttcaagtcgtactatggaacacctttctgtttaattcccaaagtgacatcttctcacaggtagtatgttagtaaaattttgcaattcgctggtcacacagctcccggatgaagataacagttggtagaccaaaaggtgacctcgcttagtatattgaaaacacacaccacacatcacacacagaactgaatcataccacgtgctgcctatgggacttcagttactgtttcctgagttactgtttatccgctggcaatggtgtgatttgtctggatcagatccgcgctattccccaacccacctccagataatgtgagaaaatagccatgtcagtatgtaggaactctgatggtgctcagatttgtgtgttcaatcaatgggcttaaatcagcaaaatattatgcctaaagtaaatctgttcttaacaagggctctaccactgcattttcacatgtaccttcagggggttatctttttttttttcccctcctattttaatcagcaaaatccataccaaaacaacgacaacaacgccctcttaagggaccaccctttggtcaatcataacatgctgtttaaagcagctgtttacaggatgtgtagtggtatgccccttgtcatatactcttagcatatctttttttcctttggctttgcatggcttttcttcaggtactgtctcggtatcattctgctaatcattgttacagaatggtgacttcatttgtgctaacagtacaacagcagatttgggtcaggcttaatctaagtgttaacttttttttctggtgcttttttggattgatgactgtctcactttgactatacccatgttttgcatgcaatgactcatgcatggttttcttaactagctaatattaacaatttattccatatacttctggcactattacatagtaagcacatgaagtagtttgataataaatagcagttctagtacttcacatttcacccgtgtgtgcaatgcctttttctggggggtggggggtgagggaaaacctggtagtgaatgtgtagttggggaataaagaaaagcactaaatcctgccctttttgtgtggtttccttttgatacaactaggttattcataatgtatacctagaaaagtgaaattgaaaataccaaaagatgtatcatttttatttgaatccatcatgcagtgtacatttcagataatttccttcagtctccagataggagtgtatccaaacatctaattttatgtgcactgtgtatcttatatgaatgttttattttatataccacatgcaaaaatgtccatatgcactatttaaatgttttaaataatatattccttctttataatgctaaatctatatgagtaccatatttttataagtcagtggtctgactggtttcattttagaattaacagctgcttcaatatgttattcaatgttaatgtttggctgtgagtagaatatgtaaaagtggcatggcagcacttatgctctgtgacagtattgtgtgtcatagttgagcagtagctggtagaattaggcagttggtgatagttttactttggtacaaataaaaactgtatatctatatacaaataatatatagatatatatgtccaccagtataatggcattgctgtgtctggcacttcattgtacagacttttataataaaagaacttgaaagttctaa

SEQ ID NO: 278257 - DNA, 5836 bp, Homo sapiens
ggcctccgcccgccagccgctctcctcccgctcgccgttagggaggctctgcacctcagccgccgcctctgtcgccactctctccccctgttccgcgtctgcgtcgccaccaccgccgggggtatccggggggtcgcttaccgggctggccccgcgccacagccgtagctttaacctccccgtcagcggccgccccaggaagaggcttctcggccgcggagccacttggggcctcagttctcgccctcttgccgtcgccgcgggtcctggagaagcggccgcggccagggaacggggcatcgcggttccaacgattaactgctgaagtactgatcgagttctgcatttcttcaatgaggaactacaggctgatcttctgccataatctcaaacagccataaatgacaaaagaatgcttgctcagtgagggtagctggtgcagaagccattttttaaacttaggtatttaagtactgaaagaaaagacagctttgatttctggctgcaaaaaagatatgaggaagagctcctccccttccttgagtaactgcaactccgttcttgctaacaaaatatttggaattccacttgatgagctgcagcagggaggacatccagacaatgaggttccattcatagtccgccacgttgtggactatattgaggaacatggaggtctggagcaacaaggactttttcaagtcaatggaaatgctgagacagtggagtggcttcggcagagatacgacagcggagaagaggtggatttggttaaggaagcagatgttccctcagctattagccttcttagattttttcttcaagaacttcctgaacctgttatccctggcagtttacatattcacttgatgcagctttctcaagattataataatgaagatgaatttggaagaaagttgaggttcctcttgcaacagcttccacctgttaattatagtttgttaaagtttctgtgtagatttttagccaatgtagcatcacatcatgaagaaatttggtctgcaaattctttggctgctgtctttggtccagatgtcttccacatttacacagatgtggaagacatgaaagagcaagaaatagtgagcaggataatggctggacttctggaaaactactatgagttttttgagaatgaagaggaagatttttcatctaatgatttgagttcaattactgaacaggttaatgaactttctgaggaagaagaggaagatgaaaagctggaacatattgaagaacttccagaagagggtgcagaaaaatcaaatgacatgccagaggtggtacaattaaggatgactgaaaacatcctggaatcaaatagtgttacggcaacaagcacccatatatctcccatcagcatcctaccagcctctacagatattttagaaagaacaattagagcagctgtggaacagcacctttttgatcttcagagcagcatagatcatgatcttaagaatttacaacagcaaagtgtggtgtgtaataatgaagcagaaagtattcattgtgatggggaaggatctaataaccagattgatattgctgatgatattattaatgccagtgaaagtaacagagactgttcaaaacctgtggctagcactaatttagacaatgaagctatgcagcaagattgtgtatttgagaatgaagaaaatacccagtctgtaggtatattgttagagccatgcagtgaccgtggtgatagtgaagatggctgtcttgagagggaagaatatttgttatttgacagtgataaattgtcacacttgattctggattctagtagcaagatatgtgatttgaatgccaacactgaatcagaagtaccaggaggtcagagtgttggtgttcaaggggaagcagcgtgtgtcagtattccacatttagatctgaagaatgtttctgatggtgataaatgggaagagccatttcctgcttttaagtcttggcaggaggactctgagtctggagaagctcagctgtctccacaagctggaagaatgaatcatcaccccttggaagaggactgtcctccagtattatcacaccgcagtttagattttggtcaaagccagcgtttcctacatgatccagaaaagttggattcctcatctaaagcactgtcttttactagaattcgaagatcatcctttagttcaaaagatgaaaagagagaggacagaacaccttatcagctggtcaagaaacttcagaagaaaatcagacaatttgaggaacagtttgaaagggaaagaaatagcaagccctcctacagtgatattgctgccaatccaaaggtattaaaatggatgacagagcttacaaaactgcggaagcaaattaaagatgcaaaacacaaaaattctgatggagaatttgtacctcagacacgtccacgtagtaacacacttccaaaaagctttggctcttctctagaccatgaagatgaagagaatgaagatgaacccaaggtcattcagaaggagaaaaaaccatctaaagaagcaacccttgaacttattcttaaaagactgaaagaaaaacgtattgagaggtgtcttccagaagatatcaagaaaatgaccaaagatcatttggtagaagagaaagcttctcttcagaaaagtcttctttactatgaaagtcaacatggaaggccggtgaccaaggaagaaaggcacattgttaaacctctctatgatagatacaggcttgtaaaacaaatgctgacaagagctagcatcactcctgtccttggatctccatccaccaagcgaaggggtcagatgttacagccaatcatagaaggagaaactgcacatttttttgaagaaatcaaggaggaagaagaagatggtgttaatctgtcctctgagttaggtgatatgttgaaaactgcagtacaggtacagtcttcattagaaaactctgaatctgatgttgaagaaaatcaagaaaaactggctctggatctccgattgtcaagttctcgagcagcttctatgcctgaattattggaacaactttggaaagccagagctgaaaaaaagaaactacgcaaaacgttgcgggaatttgaagaagcattttatcaacaaaatggaaggaatgcccagaaagaggatcgtgttccagtgcttgaggagtacagagagtacaagaaaattaaagccaagcttaggcttcttgaagttcttataagcaaacaagattcttcaaaatccatataagatacgttccttgaaaattcatatcataaagtcagttgtattccttgaagctatcatcgtgtgtacttggctggtacttaaattcgttttgtcaggcactcagagaatctcattttgtacttggttgtggtgccactaaacaaaacaaatgatgggagagtaagtaggccctctcaagggagcgtaagtgatgttccatattaaccacagactgtcctctccacctttagcaaacatatggtttacttcattgttttgtactacagatacatccttttagcaaaagactggaattttatcctttcaacttcaagaactttggaaatgcaagctttttgttattaccaactttttgtttctcattactgaagaaaattggaggaaaatcttcatactgaattcttctgttgcctttttcttacagaatgactgaaaatttgaaagaaaagcctataaaagtgcacatacgcaactgtgttctctgttttcctagaaaaccaaaatcaaactgagatttcaagtcgtactatggaacacctttctgtttaattcccaaagtgacatcttctcacaggtagtatgttagtaaaattttgcaattcgctggtcacacagctcccggatgaagataacagttggtagaccaaaaggtgacctcgcttagtatattgaaaacacacaccacacatcacacacagaactgaatcataccacgtgctgcctatgggacttcagttactgtttcctgagttactgtttatccgctggcaatggtgtgatttgtctggatcagatccgcgctattccccaacccacctccagataatgtgagaaaatagccatgtcagtatgtaggaactctgatggtgctcagatttgtgtgttcaatcaatgggcttaaatcagcaaaatattatgcctaaagtaaatctgttcttaacaagggctctaccactgcattttcacatgtaccttcagggggttatctttttttttttcccctcctattttaatcagcaaaatccataccaaaacaacgacaacaacgccctcttaagggaccaccctttggtcaatcataacatgctgtttaaagcagctgtttacaggatgtgtagtggtatgccccttgtcatatactcttagcatatctttttttcctttggctttgcatggcttttcttcaggtactgtctcggtatcattctgctaatcattgttacagaatggtgacttcatttgtgctaacagtacaacagcagatttgggtcaggcttaatctaagtgttaacttttttttctggtgcttttttggattgatgactgtctcactttgactatacccatgttttgcatgcaatgactcatgcatggttttcttaactagctaatattaacaatttattccatataaaaatggaattttgcaacatcctttaataaggtgagggaagcatgaacctcagacttctggcactattacatagtaagcacatgaagtagtttgataataaatagcagttctagtacttcacatttcacccgtgtgtgcaatgcctttttctggggggtggggggtgagggaaaacctggtagtgaatgtgtagttggggaataaagaaaagcactaaatcctgccctttttgtgtggtttccttttgatacaactaggttattcataatgtatacctagaaaagtgaaattgaaaataccaaaagatgtatcatttttatttgaatccatcatgcagtgtacatttcagataatttccttcagtctccagataggagtgtatccaaacatctaattttatgtgcactgtgtatcttatatgaatgttttattttatataccacatgcaaaaatgtccatatgcactatttaaatgttttaaataatatattccttctttataatgctaaatctatatgagtaccatatttttataagtcagtggtctgactggtttcattttagaattaacagctgcttcaatatgttattcaatgttaatgtttggctgtgagtagaatatgtaaaagtggcatggcagcacttatgctctgtgacagtattgtgtgtcatagttgagcagtagctggtagaattaggcagttggtgatagttttactttggtacaaataaaaactgtatatctatatacaaataatatatagatatatatgtccaccagtataatggcattgctgtgtctggcacttcattgtacagacttttataataaaagaacttgaaagttctaaaaaaaaaaaaaaaaaaaaaaaaaaaaaaaagaagaaagaaaaaaaaaaaaaaaaaaaaaaagaaaaaaaaaaaaaaaagagaaaagagaggaaacgcaagaaaaaacaaaacagcaacggcgacgcagagacaggaccaaagaagagaaaaagaaaaacaagaggacgaaaaaaaaaggcagacacagaaacagaagaacaggatgcagcaaaaagaagagaaaaaaaaaaaagaaaccaaacaagacagacgacagaacacaaagaaatacaaagtaggaagacaagaagagtagaataatagaaaa

SEQ ID NO: 278258 - DNA, 5515 bp, Homo sapiens
ggcctccgcccgccagccgctctcctcccgctcgccgttagggaggctctgcacctcagccgccgcctctgtcgccactctctccccctgttccgcgtctgcgtcgccaccaccgccgggggtatccggggggtcgcttaccgggctggccccgcgccacagccgtagctttaacctccccgtcagcggccgccccaggaagaggcttctcggccgcggagccacttggggcctcagttctcgccctcttgccgtcgccgcgggtcctggagaagcggccgcggccagggaacggggcatcgcggttccaacgattaactgctgaagtactgatcgagttctgcatttcttcaatgaggaactacaggctgatcttctgccataatctcaaacagccataaatgacaaaagaatgcttgctcagtgagggtagctggtgcagaagccattttttaaacttaggtatttaagtactgaaagaaaagacagctttgatttctggctgcaaaaaagatatgaggaagagctcctccccttccttgagtaactgcaactccgttcttgctaacaaaatatttggaattccacttgatgagctgcagcagggaggacatccagacaatgaggttccattcatagtccgccacgttgtggactatattgaggaacatggaggtctggagcaacaaggactttttcaagtcaatggaaatgctgagacagtggagtggcttcggcagagatacgacagcggagaagaggtggatttggttaaggaagcagatgttccctcagctattagccttcttagattttttcttcaagaacttcctgaacctgttatccctggcagtttacatattcacttgatgcagctttctcaagattataataatgaagatgaatttggaagaaagttgaggttcctcttgcaacagcttccacctgttaattatagtttgttaaagtttctgtgtagatttttagccaatgtagcatcacatcatgaagaaatttggtctgcaaattctttggctgctgtctttggtccagatgtcttccacatttacacagatgtggaagacatgaaagagcaagaaatagtgagcaggataatggctggacttctggaaaactactatgagttttttgagaatgaagaggaagatttttcatctaatgatttgagttcaattactgaacaggttaatgaactttctgaggaagaagaggaagatgaaaagctggaacatattgaagaacttccagaagagggtgcagaaaaatcaaatgacatgccagaggtggtacaattaaggatgactgaaaacatcctggaatcaaatagtgttacggcaacaagcacccatatatctcccatcagcatcctaccagcctctacagatattttagaaagaacaattagagcagctgtggaacagcacctttttgatcttcagagcagcatagatcatgatcttaagaatttacaacagcaaagtgtggtgtgtaataatgaagcagaaagtattcattgtgatggggaaggatctaataaccagattgatattgctgatgatattattaatgccagtgaaagtaacagagactgttcaaaacctgtggctagcactaatttagacaatgaagctatgcagcaagattgtgtatttgagaatgaagaaaatacccagtctgtaggtatattgttagagccatgcagtgaccgtggtgatagtgaagatggctgtcttgagagggaagaatatttgttatttgacagtgataaattgtcacacttgattctggattctagtagcaagatatgtgatttgaatgccaacactgaatcagaagtaccaggaggtcagagtgttggtgttcaaggggaagcagcgtgtgtcagtattccacatttagatctgaagaatgtttctgatggtgataaatgggaagagccatttcctgcttttaagtcttggcaggaggactctgagtctggagaagctcagctgtctccacaagctggaagaatgaatcatcaccccttggaagaggactgtcctccagtattatcacaccgcagtttagattttggtcaaagccagcgtttcctacatgatccagaaaagttggattcctcatctaaagcactgtcttttactagaattcgaagatcatcctttagttcaaaagatgaaaagagagaggacagaacaccttatcagctggtcaagaaacttcagaagaaaatcagacaatttgaggaacagtttgaaagggaaagaaatagcaagccctcctacagtgatattgctgccaatccaaaggtattaaaatggatgacagagcttacaaaactgcggaagcaaattaaagatgcaaaacacaaaaattctgatggagaatttgtacctcagacacgtccacgtagtaacacacttccaaaaagctttggctcttctctagaccatgaagatgaagagaatgaagatgaacccaaggtcattcagaaggagaaaaaaccatctaaagaagcaacccttgaacttattcttaaaagactgaaagaaaaacgtattgagaggtgtcttccagaagatatcaagaaaatgaccaaagatcatttggtagaagagaaagcttctcttcagaaaagtcttctttactatgaaagtcaacatggaaggccggtgaccaaggaagaaaggcacattgttaaacctctctatgatagatacaggcttgtaaaacaaatgctgacaagagctagcatcactcctgtccttggatctccatccaccaagcgaaggggtcagatgttacagccaatcatagaaggagaaactgcacatttttttgaagaaatcaaggaggaagaagaagatggtgttaatctgtcctctgagttaggtgatatgttgaaaactgcagtacaggtacagtcttcattagaaaactctgaatctgatgttgaagaaaatcaagaaaaactggctctggatctccgattgtcaagttctcgagcagcttctatgcctgaattattggaacaactttggaaagccagagctgaaaaaaagaaactacgcaaaacgttgcgggaatttgaagaagcattttatcaacaaaatggaaggaatgcccagaaagaggatcgtgttccagtgcttgaggagtacagagagtacaagaaaattaaagccaagcttaggcttcttgaagttcttataagcaaacaagattcttcaaaatccatataagatacgttccttgaaaattcatatcataaagtcagttgtattccttgaagctatcatcgtgtgtacttggctggtacttaaattcgttttgtcaggcactcagagaatctcattttgtacttggttgtggtgccactaaacaaaacaaatgatgggagagtaagtaggccctctcaagggagcgtaagtgatgttccatattaaccacagactgtcctctccacctttagcaaacatatggtttacttcattgttttgtactacagatacatccttttagcaaaagactggaattttatcctttcaacttcaagaactttggaaatgcaagctttttgttattaccaactttttgtttctcattactgaagaaaattggaggaaaatcttcatactgaattcttctgttgcctttttcttacagaatgactgaaaatttgaaagaaaagcctataaaagtgcacatacgcaactgtgttctctgttttcctagaaaaccaaaatcaaactgagatttcaagtcgtactatggaacacctttctgtttaattcccaaagtgacatcttctcacaggtagtatgttagtaaaattttgcaattcgctggtcacacagctcccggatgaagataacagttggtagaccaaaaggtgacctcgcttagtatattgaaaacacacaccacacatcacacacagaactgaatcataccacgtgctgcctatgggacttcagttactgtttcctgagttactgtttatccgctggcaatggtgtgatttgtctggatcagatccgcgctattccccaacccacctccagataatgtgagaaaatagccatgtcagtatgtaggaactctgatggtgctcagatttgtgtgttcaatcaatgggcttaaatcagcaaaatattatgcctaaagtaaatctgttcttaacaagggctctaccactgcattttcacatgtaccttcagggggttatctttttttttttcccctcctattttaatcagcaaaatccataccaaaacaacgacaacaacgccctcttaagggaccaccctttggtcaatcataacatgctgtttaaagcagctgtttacaggatgtgtagtggtatgccccttgtcatatactcttagcatatctttttttcctttggctttgcatggcttttcttcaggtactgtctcggtatcattctgctaatcattgttacagaatggtgacttcatttgtgctaacagtacaacagcagatttgggtcaggcttaatctaagtgttaacttttttttctggtgcttttttggattgatgactgtctcactttgactatacccatgttttgcatgcaatgactcatgcatggttttcttaactagctaatattaacaatttattccatataaaaatggaattttgcaacatcctttaataaggtgagggaagcatgaacctcagacttctggcactattacatagtaagcacatgaagtagtttgataataaatagcagttctagtacttcacatttcacccgtgtgtgcaatgcctttttctggggggtggggggtgagggaaaacctggtagtgaatgtgtagttggggaataaagaaaagcactaaatcctgccctttttgtgtggtttccttttgatacaactaggttattcataatgtatacctagaaaagtgaaattgaaaataccaaaagatgtatcatttttatttgaatccatcatgcagtgtacatttcagataatttccttcagtctccagataggagtgtatccaaacatctaattttatgtgcactgtgtatcttatatgaatgttttattttatataccacatgcaaaaatgtccatatgcactatttaaatgttttaaataatatattccttctttataatgctaaatctatatgagtaccatatttttataagtcagtggtctgactggtttcattttagaattaacagctgcttcaatatgttattcaatgttaatgtttggctgtgagtagaatatgtaaaagtggcatggcagcacttatgctctgtgacagtattgtgtgtcatagttgagcagtagctggtagaattaggcagttggtgatagttttactttggtacaatataatggcattgctgtgtctggcacttcattgtacagacttttataataaaagaacttgaaagttctaagtcattgtaaatgtatgtttgtttttccactgggcttaaa

SEQ ID NO: 278259 - DNA, 818 bp, Homo sapiens
cggggaaaaacgacgaggcgaagaagcaagagtggagtctaagtaggccagataaggtgagagaagaggtggggaagaggaaatggtagagcagggtaataagggtacgagagaatcggtgaagggtaggaaggaaagagggagagcgaaaagacgggaggagggtgtgtgaagtgaagaacgcggagaaaggacagtaatgagaaagaggggaaatgccaagtgaggagtggcctgacaccctcattcccatcatagttattctcctctctcatggaaatgttcagtttctggacatctcctttctcttccattcttcacctgaccttccttcctttcttggccagcctgaatattataaagggaattttatttcaaacccaggatcgcacttaagaggaaaagaaacaaaagccagttctttttattgcacatagaacaaggagaaactccaccccttttgttgtctggtatgtttaaaacaagaaagaactttagaaaagtaggatatgagtgaaaattacaaccaatgttgagaactactttttaattttttattacaaaattaggatgatacttcattaaacattgtacatcatttcaaaactgttatctcataatcatgttgcttgttttgaattattcttttaaagtgtaatttttttaagcaaagaatccataaaattacatggcttggatgtaccataacttacttaatccttatgctattgtttaatatgtgggttgtttcagatttttcatgattgtaaataacaaaataaacttccttatacttaagtttctggcagaatctctga

SEQ ID NO: 278260 - DNA, 1823 bp, Homo sapiens
taagtagtagggtagcagggaacagtttgctctcctctgccaataagaggacgagggtgtgtcatatgcaaatatactgccctccaagccccacccccaagataagctacgcccccttctctaggtccctgcagaagtggtgaggagaatgagataaatagttgggagctagagctcgctagagagtctaagattgagctaaatatttcctgatctctcgagaaagggggaggggagtgggaggattaaatgttccttccttcagggcagtggttaggctttctctccaccaaaatctaactttagctgtaaagaagactgcagttatgtagtactttgtatccagggatctcaaagaactttacgcatcatttattgtgaaccttgtttgcaaagatttcagttacttgaggcttgggaggcggataggggataaatgtctgagttatatatatatttacgcaagtaatcgagtttgaggggagagacacaaaacctctggtttagcggtttcctcttgttgtgaagcaccttctagcagttatcttagagatgtaagttcatttacttgtccagcactaaaaggccaaaggggcttgttttctcacccaaaagaccttcctgaggcagctgttcggatacatgcagagcacagcgccctgctcagaaaggaaggttcagagaacaaattgtcgtttaaaactattgggacaaacctacctcttctaaagcttaaaatggtctccagcgtaccaggatttgtgaaggcctgaagttcgtagaatgaaatctatgtggagatgatttaaaagaacggtttcactgagaccaacacatataaaccaagtctacacaagaaacaaagctaaaatcctttcgaaatgagttcctttaagttcttcagtaactaaatcctccagaaaggaaagccgagagaatctagtcctatacaataacaccctctaacaaagatcgctaaaggaagattttagtagatgaatatcttcaataatacatggtcacatacatgtatctgaccatatgatggctctctgcaccaaattcctccaaactattataatatgtattgtctgtagtgctatttatttggcagttaatcatgtattacattgtgacatttcttacagtgaaccattatgtatgtgtttatgttctgccctcaactactcaatgccagtaccttattcttaacacagcaaccaccctttctggtctgtcctcacaccctcattcccatcatagttattctcctctctcatggaaatgttcagtttctggacatctcctttctcttccattcttcacctgaccttccttcctttcttggccagcctgaatattataaagggaattttatttcaaacccaggatcgcacttaagaggaaaagaaacaaaagccagttctttttattgcacatagaacaaggagaaactccaccccttttgttgtctggtatgtttaaaacaagaaagaactttagaaaagtaggatatgagtgaaaattacaaccaatgttgagaactactttttaattttttattacaaaattaggatgatacttcattaaacattgtacatcatttcaaaactgttatctcataatcatgttgcttgttttgaattattcttttaaagtgtaatttttttaagcaaagaatccataaaattacatggcttggatgtaccataacttacttaatccttatgctattgtttaatatgtgggttgtttcagatttttcatgattgtaaataacaaaataaacttccttatacttaagtttctggcagaatctctga

SEQ ID NO: 278261 - DNA, 1347 bp, Homo sapiens
taagtagtagggtagcagggaacagtttgctctcctctgccaataagaggacgagggtgtgtcatatgcaaatatactgccctccaagccccacccccaagataagctacgcccccttctctaggtccctgcagaagtgaccttcctgaggcagctgttcggatacatgcagagcacagcgccctgctcagaaaggaaggttcagagaacaaattgtcgtttaaaactattgggacaaacctacctcttctaaagcttaaaatggtctccagcgtaccaggatttgtgaaggcctgaagttcgtagaatgaaatctatgtggagatgatttaaaagaacggtttcactgagaccaacacatataaaccaagtctacacaagaaacaaagctaaaatcctttcgaaatgagttcctttaagttcttcagtaactaaatcctccagaaaggaaagccgagagaatctagtcctatacaataacaccctctaacaaagatcgctaaaggaagattttagtagatgaatatcttcaataatacatggtcacatacatgtatctgaccatatgatggctctctgcaccaaattcctccaaactattataatatgtattgtctgtagtgctatttatttggcagttaatcatgtattacattgtgacatttcttacagtgaaccattatgtatgtgtttatgttctgccctcaactactcaatgccagtaccttattcttaacacagcaaccaccctttctggtctgtcctcacaccctcattcccatcatagttattctcctctctcatggaaatgttcagtttctggacatctcctttctcttccattcttcacctgaccttccttcctttcttggccagcctgaatattataaagggaattttatttcaaacccaggatcgcacttaagaggaaaagaaacaaaagccagttctttttattgcacatagaacaaggagaaactccaccccttttgttgtctggtatgtttaaaacaagaaagaactttagaaaagtaggatatgagtgaaaattacaaccaatgttgagaactactttttaattttttattacaaaattaggatgatacttcattaaacattgtacatcatttcaaaactgttatctcataatcatgttgcttgttttgaattattcttttaaagtgtaatttttttaagcaaagaatccataaaattacatggcttggatgtaccataacttacttaatccttatgctattgtttaatatgtgggttgtttcagatttttcatgattgtaaataacaaaataaacttccttatacttaagtttctggcagaatctctga

SEQ ID NO: 278262 - DNA, 1498 bp, Homo sapiens
ctggtgaggtgggacttcaatgccttttaggtttacagtcttttcctccccacggcttctctttcctccccgtctcaggcactgggcatttccagtcgatccagcaggtctggcttctctcacatatgcagtaagggttaggggagaaggtcccagctcctcttgtctctagcagagtgtaaactggctctgctgaggaggtggctgtgcttttattccttctcctgagaactgtttatatattaaggagcttcacagcctccaacataaggaaagcaggcctcaaacttcttcatgggaaaagatggcttctcttttttaattgaatgaactagaagaagttcattgttattcatcaacttcaaagagactatatgaggccccttggccaggactacagagcagtattttttaatcagaaattatagccaaaaagaagagaccagaacacatgggtctccagcgtaccaggatttgtgaaggcctgaagttcgtagaatgaaatctatgtggagatgatttaaaagaacggtttcactgctaaaatcctttcgaaatgagttcctttaagttcttcagtaactaaatcctccagaaaggaaagccgagagaatctagtcctatacaataacaccctctaacaaagatcgctaaaggaagattttagtagatgaatatcttcaataatacatggtcacatacatgtatctgaccatatgatggctctctgcaccaaattcctccaaactattataatatgtattgtctgtagtgctatttatttggcagttaatcatgtattacattgtgacatttcttacagtgaaccattatgtatgtgtttatgttctgccctcaactactcaatgccagtaccttattcttaacacagcaaccaccctttctggtctgtcctcacaccctcattcccatcatagttattctcctctctcatggaaatgttcagtttctggacatctcctttctcttccattcttcacctgaccttccttcctttcttggccagcctgaatattataaagggaattttatttcaaacccaggatcgcacttaagaggaaaagaaacaaaagccagttctttttattgcacatagaacaaggagaaactccaccccttttgttgtctggtatgtttaaaacaagaaagaactttagaaaagtaggatatgagtgaaaattacaaccaatgttgagaactactttttaattttttattacaaaattaggatgatacttcattaaacattgtacatcatttcaaaactgttatctcataatcatgttgcttgttttgaattattcttttaaagtgtaatttttttaagcaaagaatccataaaattacatggcttggatgtaccataacttacttaatccttatgctattgtttaatatgtgggttgtttcagatttttcatgattgtaaataacaaaataaacttccttatacttaagtttctggcagaatctctga

SEQ ID NO: 278263 - DNA, 2029 bp, Homo sapiens
taagtagtagggtagcagggaacagtttgctctcctctgccaataagaggacgagggtgtgtcatatgcaaatatactgccctccaagccccacccccaagataagctacgcccccttctctaggtccctgcagaagtggtgaggagaatgagataaatagttgggagctagagctcgctagagagtctaagattgagctaaatatttcctgatctctcgagaaagggggaggggagtgggaggattaaatgttccttccttcagggcagtggttaggctttctctccaccaaaatctaactttagctgtaaagaagactgcagttatgtagtactttgtatccagggatctcaaagaactttacgcatcatttattgtgaaccttgtttgcaaagatttcagttacttgaggcttgggaggcggataggggataaatgtctgagttatatatatatttacgcaagtaatcgagtttgaggggagagacacaaaacctctggtttagcggtttcctcttgttgtgaagcaccttctagcagttatcttagagatgtaagttcatttacttgtccagcactaaaaggccaaaggggcttgttttctcacccaaaagaccttcctgaggcagctgttcggatacatgcagagcacagcgccctgctcagaaaggaaggttcagagaacaaattgtcgtttaaaactattgggacaaacctacctcttctaaagcttaaaatggtctccagcgtaccaggatttgtgaaggcctgaagttcgtagaatgaaatctatgtggagatgatttaaaagaacggtttcactggtttgcatttctttcttttctttttaattaaaaaaaaacaacaaccctggtttccttagggattcagggtggtgttatgcaaaatcggaaaggtacacttggaggagctagcaagtttagcatatcaaagctattagaccaatttgtgcggttaaaactgccattctcatttctcaacagctgtctcctctctgtccctttttagaagaccaacacatataaaccaagtctacacaagaaacaaagctaaaatcctttcgaaatgagttcctttaagttcttcagtaactaaatcctccagaaaggaaagccgagagaatctagtcctatacaataacaccctctaacaaagatcgctaaaggaagattttagtagatgaatatcttcaataatacatggtcacatacatgtatctgaccatatgatggctctctgcaccaaattcctccaaactattataatatgtattgtctgtagtgctatttatttggcagttaatcatgtattacattgtgacatttcttacagtgaaccattatgtatgtgtttatgttctgccctcaactactcaatgccagtaccttattcttaacacagcaaccaccctttctggtctgtcctcacaccctcattcccatcatagttattctcctctctcatggaaatgttcagtttctggacatctcctttctcttccattcttcacctgaccttccttcctttcttggccagcctgaatattataaagggaattttatttcaaacccaggatcgcacttaagaggaaaagaaacaaaagccagttctttttattgcacatagaacaaggagaaactccaccccttttgttgtctggtatgtttaaaacaagaaagaactttagaaaagtaggatatgagtgaaaattacaaccaatgttgagaactactttttaattttttattacaaaattaggatgatacttcattaaacattgtacatcatttcaaaactgttatctcataatcatgttgcttgttttgaattattcttttaaagtgtaatttttttaagcaaagaatccataaaattacatggcttggatgtaccataacttacttaatccttatgctattgtttaatatgtgggttgtttcagatttttcatgattgtaaataacaaaataaacttccttatacttaagtttctggcagaatctctga

SEQ ID NO: 278264 - DNA, 1849 bp, Homo sapiens
taagtagtagggtagcagggaacagtttgctctcctctgccaataagaggacgagggtgtgtcatatgcaaatatactgccctccaagccccacccccaagataagctacgcccccttctctaggtccctgcagaagtggtgaggagaatgagataaatagttgggagctagagctcgctagagagtctaagattgagctaaatatttcctgatctctcgagaaagggggaggggagtgggaggattaaatgttccttccttcagggcagtggttaggctttctctccaccaaaatctaactttagctgtaaagaagactgcagttatgtagtactttgtatccagggatctcaaagaactttacgcatcatttattgtgaaccttgtttgcaaagatttcagttacttgaggcttgggaggcggataggggataaatgtctgagttatatatatatttacgcaagtaatcgagtttgaggggagagacacaaaacctctggtttagcggtttcctcttgttgtgaagcaccttctagcagttatcttagagatgtaagttcatttacttgtccagcactaaaaggccaaaggggcttgttttctcacccaaaagaccttcctgaggcagctgttcggatacatgcagagcacagcgccctgctcagaaaggaaggttcagagaacaaattgtcgtttaaaactattgggacaaacctacctcttctaaagcttaaaatggtctccagcgtaccaggatttgtgaaggcctgaagttcgtagaatgaaatctatgtggagatgatttaaaagaacggtttcactgctgtctcctctctgtccctttttagaagaccaacacatataaaccaagtctacacaagaaacaaagctaaaatcctttcgaaatgagttcctttaagttcttcagtaactaaatcctccagaaaggaaagccgagagaatctagtcctatacaataacaccctctaacaaagatcgctaaaggaagattttagtagatgaatatcttcaataatacatggtcacatacatgtatctgaccatatgatggctctctgcaccaaattcctccaaactattataatatgtattgtctgtagtgctatttatttggcagttaatcatgtattacattgtgacatttcttacagtgaaccattatgtatgtgtttatgttctgccctcaactactcaatgccagtaccttattcttaacacagcaaccaccctttctggtctgtcctcacaccctcattcccatcatagttattctcctctctcatggaaatgttcagtttctggacatctcctttctcttccattcttcacctgaccttccttcctttcttggccagcctgaatattataaagggaattttatttcaaacccaggatcgcacttaagaggaaaagaaacaaaagccagttctttttattgcacatagaacaaggagaaactccaccccttttgttgtctggtatgtttaaaacaagaaagaactttagaaaagtaggatatgagtgaaaattacaaccaatgttgagaactactttttaattttttattacaaaattaggatgatacttcattaaacattgtacatcatttcaaaactgttatctcataatcatgttgcttgttttgaattattcttttaaagtgtaatttttttaagcaaagaatccataaaattacatggcttggatgtaccataacttacttaatccttatgctattgtttaatatgtgggttgtttcagatttttcatgattgtaaataacaaaataaacttccttatacttaagtttctggcagaatctctga

SEQ ID NO: 278265 - DNA, 428 bp, Homo sapiens
aggagaagcgactcccggggccacccatgcttagatctcagagccaggcaagagccaggtcccgggggtccaggagcgcgctcggggctcctcctcgcccgcgccccccgcgcccctcgcgcccccccgcgccccccgcgccccactgcgctcgcgtctgcggggccgggaggaaggggcggcgcagccgggccggggcgggcaccgaggcctggcgggcgggcctggggcgctttcgtgcctgccagggaaaggctggcgaggaggctgggggcggacgcagggaggaaagaagcaatggggtgctcttgcgttttgacattttaaaaagaagtttagattcgcttcccggagccgggatggcagcctgcgctatggttggggaccaacgtggtgcacgggcaggggccggggagagaggcggccgc

SEQ ID NO: 278266 - DNA, 606 bp, Homo sapiens
cagtcatccccccatcgctctctctgctggggcgtgatgtcttaagacctggagagcagccccaagggtggagaagcggctgctgaagggatcagcatgcgctggcacaggaagtctgttttccatgtgtctggaacccagccgaagcttcctggggtaattttaaccagtatccactctagaacaataccaaaaaagcaagactgtgttgggctggaggaaaggcagtaatcaactccatgttccacgtgaggaaactgaagatcatggaaggcaagtcgagagccccaaggttatccagcttcaaggtcaccagtcacccagcttccttctttcgtgcagccagatgcccatcccagtactaggttgcgctgtggggattgtggagtagccctctaccacctagggccctcatgtgtttcctttatttgagacagggtctcactctgtcacccagggtggaagtggcccagtcacagcttactgcagcatcagcctccccaggctcaagtgattaaggcctccctctgcctgccccacccccactgtgtttatattgttgggaaacttaatccacggaaataaagtgtggattatttttattga

SEQ ID NO: 278267 - DNA, 768 bp, Homo sapiens
accgggcatggacagcccggcgggcctgtgaggaccccgcacagccaagatggcggcgtccgtgcgacaggcacgcagcctactaggtgtggcggcgaccctggccccgggttcccgtggctaccgggcgcggccgcccccgcgccgcaggccgggaccccggtggccagaccccgaggacctcctgaccccgcggtggcagctgggaccgcgctacgcggctaagcagttcgcgcgttacggcgccgcctccggggtggtccccggttcgttatggccgtcgccggagcagctgcgggagctggaggccgaagaacgcgaatggtacccgagcctggcgaccatgcaggagtcgctgcgggtgaagcagctggccgaagagcagaagcgtcgggagagggagcagcacatcgcagagtgcatggccaagatgccacagatgattgtgaactggcagcagcagcagcgggagaactgggagaaggcccaggctgacaaggagaggagggcccgactgcaggctgaggcccaggagctcctgggctaccaggtggacccaaggagtgcccgcttccaggagctgctccaggacctagagaagaaggagcgcaagcgcctcaaggaggaaaaacagaaacggaagaaggaggcgcgagctgctgcattggctgcagctgtggctcaagacccagcagcctctggggcacccagctcctgaggctttgtcccttcccaataaagcctgctacctggcagtacccctgaaga

SEQ ID NO: 278268 - DNA, 935 bp, Homo sapiens
accgggcatggacagcccggcgggcctgtgaggaccccgcacagccaagatggcggcgtccgtgcgacaggcacgcagcctactaggtgtggcggcgaccctggccccgggttcccgtggctaccgggcgcggccgcccccgcgccgcaggccgggaccccggtggccagaccccgaggacctcctgaccccgcggtggcagctgggaccgcgctacgcggctaagcagttcgcgcgttacggcgccgcctccggggtggtccccggttcgttatggccgtcgccggagcagctgcgggagctggaggccgaagaacgcgaatggtacccgagcctggcgaccatgcaggagtcgctgcgggtgaagcagctggccgaagagcagaagcgtcgggagagggagcagcacatcgcagagtgcatggccaagatgccacagatgattgtgaactggcagcagcagcagcgggagaactgggagaaggcccaggctgacaaggagaggagggcccgactgcaggctgaggcccaggagctcctgggctaccaggtggacccaaggagtgcccgcttccaggagctgctccaggacctagagaagaaggagcgcaagcgcctcaaggaggaaaaacagaaacggaagaaggaggcgcgagctgctgcattggctgcagctgtggctcaagacccagcagcctctggggcacccagctcctgaggctttgtcccttcccaataaagcctgctacctggcagtacccctgaagagatctgcgtcctctcaaggtgtgcctctctgggtccctggttcctccccaatacttaagagctggggaatccccacttggctgtactcacaaggggacagggactctaggccctgctgactaactggggcttcagtgggaggaaaaggggggtgtacaatgggcaaa

SEQ ID NO: 278269 - DNA, 918 bp, Homo sapiens
  misc_feature (21)..(21): n is a, c, g, or t
  misc_feature (24)..(25): n is a, c, g, or t
agaactaggctagtagagccnggnntaatcggcgaggggcgtccgtgcgacaggcacgcagcctactaggtgtggcggcgaccctggccccgggttcccgtggctaccgggcgcggccgcccccgcgccgcaggccgggaccccggtggccagaccccgaggacctcctgaccccgcggtggcagctgggaccgcgctacgcggctaagcagttcgcgcgttacggcgccgcctccggggtggtccccggttcgttatggccgtcgccggagcagctgcgggagctggaggccgaagaacgcgaatggtacccgagcctggcgaccatgcaggagtcgctgcgggtgaagcagctggccgaagagcagaagcgtcgggagagggagcagcacatcgcagagtgcatggccaagatgccacagatgattgtgaactggcagcagcagcagcgggagaactgggagaaggcccaggctgacaaggagaggagggcccgactgcaggctgaggcccaggagctcctgggctaccaggtggacccaaggagtgcccgcttccaggagctgctccaggacctagagaagaaggagcgcaagcgcctcaaggaggaaaaacagaaacggaagaaggaggcgcgagctgctgcattggctgcagctgtggctcaagacccagcagcctctggggcacccagctcctgaggctttgtcccttcccaataaagcctgctacctggcagtacccctgaagagatctgcgtcctctcaaggtgtgcctctctgggtccctggttcctccccaatacttaagagctggggaatccccacttggctgtactcacaaggggacagggactctaggccctgctgactaactggggcttcagtgggaggaaaaggggggtgtacaatgggcaaa

SEQ ID NO: 278270 - DNA, 258 bp, Homo sapiens
gtgatctacgatccctatgacacgcgctacgcggctaagcagttcgcgcgttacggcgccgcctccggggtggtccccggttcgttatggccgtcgccggagcagctgcgggagctggaggccgaagaacgcgaatggtacccgagcctggcgaccatgcaggagtcgctgcgggtgaagcagctggccgaagagcagaagcgtcgggagaggagcagcacatcgcgtagcgcattgtccatagggatccactagaag

SEQ ID NO: 278271 - DNA, 751 bp, Homo sapiens
  misc_feature (21)..(21): n is a, c, g, or t
  misc_feature (24)..(25): n is a, c, g, or t
agaactaggctagtagagccnggnntaatcggcgaggggcgtccgtgcgacaggcacgcagcctactaggtgtggcggcgaccctggccccgggttcccgtggctaccgggcgcggccgcccccgcgccgcaggccgggaccccggtggccagaccccgaggacctcctgaccccgcggtggcagctgggaccgcgctacgcggctaagcagttcgcgcgttacggcgccgcctccggggtggtccccggttcgttatggccgtcgccggagcagctgcgggagctggaggccgaagaacgcgaatggtacccgagcctggcgaccatgcaggagtcgctgcgggtgaagcagctggccgaagagcagaagcgtcgggagagggagcagcacatcgcagagtgcatggccaagatgccacagatgattgtgaactggcagcagcagcagcgggagaactgggagaaggcccaggctgacaaggagaggagggcccgactgcaggctgaggcccaggagctcctgggctaccaggtggacccaaggagtgcccgcttccaggagctgctccaggacctagagaagaaggagcgcaagcgcctcaaggaggaaaaacagaaacggaagaaggaggcgcgagctgctgcattggctgcagctgtggctcaagacccagcagcctctggggcacccagctcctgaggctttgtcccttcccaataaagcctgctacctggcagtacccctgaaga

SEQ ID NO: 278272 - DNA, 879 bp, Homo sapiens
  misc_feature (772)..(772): n is a, c, g, or t
  misc_feature (775)..(775): n is a, c, g, or t
  misc_feature (879)..(879): n is a, c, g, or t
accgggcatggacagcccggcgggcctgtgaggaccccgcacagccaagatggcggcgtccgtgcgacaggcacgcagcctactaggtgtggcggcgaccctggccccgggttcccgtggctaccgggcgcggccgcccccgcgccgcaggccgggaccccggtggccagaccccgaggacctcctgaccccgcggtggcagctgggaccgcgctacgcggctaagcagttcgcgcgttacggcgccgcctccggggtggtccccggttcgttatggccgtcgccggagcagctgcgggagctggaggccgaagaacgcgaatggtacccgagcctggcgaccatgcaggagtcgctgcgggtgaagcagctggccgaagagcagaagcgtcgggagagggagcagcacatcgcagagtgcatggccaagatgccacagatgattgtgaactggcagcagcagcagcgggagaactgggagaaggcccaggctgacaaggagaggagggcccgactgcaggctgaggcccaggagctcctgggctaccaggtggacccaaggagtgcccgcttccaggagctgctccaggacctagagaagaaggagcgcaagcgcctcaaggaggaaaaacagaaacggaagaaggaggcgcgagctgctgcattggctgcagctgtggctcaagacccagcagcctctggggcacccagctcctgaggctttgtcccttcccaataaagcctgctacctggcagtacccctgaagaacanagngaagcccacacaatacacacacatcagcaacaaagagcgcgactttctttcttatttacaacacaaaacggcgcgcttttatataaagaagagctccaacaaan

SEQ ID NO: 278273 - DNA, 984 bp, Homo sapiens
accgggcatggacagcccggcgggcctgtgaggaccccgcacagccaagatggcggcgtccgtgcgacaggcacgcagcctactaggtgtggcggcgaccctggccccgggttcccgtggctaccgggcgcggccgcccccgcgccgcaggccgggaccccggtggccagaccccgaggacctcctgaccccgcggtggcagctgggaccgcgctacgcggctaagcagttcgcgcgttacggcgccgcctccggggtggtccccggttcgttatggccgtcgccggagcagctgcgggagctggaggccgaagaacgcgaatggtacccgagcctggcgaccatgcaggagtcgctgcgggtgaagcagctggccgaagagcagaagcgtcgggagagggagcagcacatcgcagagtgcatggccaagatgccacagatgattgtgaactggcagcagcagcagcgggagaactgggagaaggcccaggctgacaaggagaggagggcccgactgcaggctgaggcccaggagctcctgggctaccaggtggacccaaggagtgcccgcttccaggagctgctccaggacctagagaagaaggagcgcaagcgcctcaaggaggaaaaacagaaacggaagaaggaggcgcgagctgctgcattggctgcagctgtggctcaagacccagcagcctctggggcacccagctcctgaggctttgtcccttcccaataaagcctgctacctggcagtacccctgaagaaaaaaaaaaaaaaaaataaaaaaaaaaaaaaaaaaaagagagaatgagaagagacagaaaaaaaaaatgcggggggatattttatgggggggaaaaaagaggcaaaaaagggagacggacaaggtgttgagcacaccggttttgagcagaggggaaacggagggcccaaaagggaggcaataaacgaaggcgggacccatcgaggatgaggaagaa

SEQ ID NO: 278274 - DNA, 629 bp, Homo sapiens
cgccttctgtcttggcggtaccctttgtgtaaccccgaggacctcctgaccccgcggtggcagctgggaccgcgctacgcggctaagcagttcgcgcgttacggcgccgcctccggggtggtccccggttcgttatggccgtcgccggagcagctgcgggagctggaggccgaagaacgcgaatggtacccgagcctggcgaccatgcaggagtcgctgcgggtgaagcagctggccgaagagcagaagcgtcgggagagggagcagcacatcgcagagtgcatggccaagatgccacagatgattgtgaactggcagcagcagcagcgggagaactgggagaaggcccaggctgacaaggagaggagggcccgactgcaggctgaggcccaggagctcctgggctaccaggtggacccaaggagtgcccgcttccaggagctgctccaggacctagagaagaaggagcgcaagcgcctcaaggaggaaaaacagaaacggaagaaggaggcgcgagctgctgcattggctgcagctgtggctcaagacccagcagcctctggggcacccagctcctgaggctttgtcccttcccaataaagcctgctacctggcagtacccctgaaga

SEQ ID NO: 278275 - DNA, 653 bp, Homo sapiens
  misc_feature (21)..(21): n is a, c, g, or t
  misc_feature (24)..(25): n is a, c, g, or t
agaactaggctagtagagccnggnntaatcggcgaggggcgtccgtgcgacaggcacgcagcctactaggtgtggcggcgaccctggccccgggttcccgtggctaccgggcgcggccgcccccgcgccgcaggccgggaccccggtggccagaccccgaggacctcctgaccccgcggtggcagctgggaccgcgctacgcggctaagcagttcgcgcgttacggcgccgcctccggggtggtccccggttcgttatggccgtcgccggagcagctgcgggagggagcagcacatcgcagagtgcatggccaagatgccacagatgattgtgaactggcagcagcagcagcgggagaactgggagaaggcccaggctgacaaggagaggagggcccgactgcaggctgaggcccaggagctcctgggctaccaggtggacccaaggagtgcccgcttccaggagctgctccaggacctagagaagaaggagcgcaagcgcctcaaggaggaaaaacagaaacggaagaaggaggcgcgagctgctgcattggctgcagctgtggctcaagacccagcagcctctggggcacccagctcctgaggctttgtcccttcccaataaagcctgctacctggcagtacccctgaaga

SEQ ID NO: 278276 - DNA, 702 bp, Homo sapiens
ggcctagcctcccagcctacatctttctcctgtgctggatgctccttgccctcgaacatcgaactccaagttcttcagttctgggactctgactggctctccctgtcagcttgcagacagcctattgtgggaccttgtgatcatatccttccagaggagataccctggtctctgaagtggttttgtatttccactgaaatatacaagtctggatgtctcctaccattgagccacttttcatcatcctgttcttcatcgtcgattggctcctcggtttccagtggagttgggataaagaagtgtggcctcagggggggcttgctgacgtgagacttaagtccaaacttgcgcttcagcaggtggaactgctctttgacgtagtggtaggggacagtcttcttcaccgtcacagtcatgtttccaagcttcctgtgctctggaagagaaccggggtcgcacatgagccatcatttgcagtagcttagaagggatcccggcgaggacccacattacctgtacaactctggtagcacctaaggaagcaactgcatatccaagtattagaagagaagaagggttcctgacaatatttggaaacacttaccaactctaggtgttaatgtcaacatgagttgacgaagcacaagctatcaaatttcctttcatcagatgtgaaccatgcgattggaccaaattcaattg

SEQ ID NO: 278277 - DNA, 835 bp, Homo sapiens
tctcgagcgaagagctactgcacttacccaggcttaggaagcgggtgtttaagccatgggttagagggctcgtgagcacgcccgatcctttccctgaggctatgaaacggtggctccacggactcctctcggccgactgacctttcgccgccctgccccagcagccggcgggtttcttcagtggagccgggctctggtctccgcagcccagtagcccgctagcccggccccctcccgctagtcgtaaagtgcagtaaaggcaccagcattttgcggcaccgtagtctctcttctcctcaagtttgaaatgctttatctcatcgggttgggcctgggagatgccaaggacatcacagtcaagggcctggaagttgttagacgctgcagtcgagtgtatctggaagcctacacctcagtcctaactgtagggaaggaagccttgggatagagaagttaacaaacttgcctaagttcatgcagatagtgaatgatagagccaggagatgaaccaaagcagtcctgagttgaagtctgccactctttttattattattattatttattatgtttttttattttgagacggagtcttgctatgttgcctaggctggaatgcagtggtgcgatctcggccccctgcaacctctgcctctcgggttcaagcaattcttctgtcacagccttctgagtagctgggattacaggcgtgtgccattgcgcccggctaatttttgtatttttagtaggatgagatttcaccatgttggccaggctggtctcgaactcctgacctcaggtgatccacctgcctcggcctccaaagtgctgtgattac

SEQ ID NO: 278278 - DNA, 670 bp, Homo sapiens
agtgggcaagtaaaggtccctttcttaagtagctgccaaggctgctttaggagtgttacagtagcaactcagcattttgaagggcatgtttagtcttgcattttcttgctaaaaagctcagatgaaagccttatgcaggtgtgtggaagaatttgaagaaaggcagtgctcctgcctctttaattgacatgaactcaggaaatatagctttactgtcttaaaagtgttgtttgctttaatccaatctaatcttttctcactacagggccacaacacacagtgatcttgttctaagagcaacaaagctgggaattccttatagagttattcacaatgcctccataatgaatgctgtaggctgctgtggtttacaggtaatgcaacaaaggaggtttttcagtggaattaaataaaaatgttttatttttccacaaattgaaaatacatttaattgtattttatgaatcataaaacatactactatttgatactaggctgcttagtatatacatagactgaattttttaacactaatttttttatgctaggttttcccccttattggaatcgaatgtttagatttagctagaaaatgattttaaccttaaatccaacttgtacttacataaaaaggaaaatataaactaatccaaatgacatactcagcatt

SEQ ID NO: 278279 - DNA, 2503 bp, Homo sapiens
tctcgagcgaagagctactgcacttacccaggcttaggaagcgggtgtttaagccatgggttagagggctcgtgagcacgcccgatcctttccctgaggctatgaaacggtggctccacggactcctctcggccgactgacctttcgccgccctgccccagcagccggcgggtttcttcagtggagccgggctctggtctccgcagcccagtagcccgctagcccggccccctcccgctagtcgtaaagtgcagtaaaggcaccagcattttgcggcaccgtaggtgaggccggcggcgtgggccttttctctgcacggagccggcgcttttgcagttgcttctgcggaaaggtggtagttaagaatttgtaaaggccagagaactacctacgattctctcagcggtctctcttctcctcaagtttgaaatgctttatctcatcgggttgggcctgggagatgccaaggacatcacagtcaagggcctggaagttgttagacgctgcagtcgagtgtatctggaagcctacacctcagtcctaactgtagggaaggaagccttggaagagttttatggaagaaaattggttgttgctgatagagaagaagtggaacaagaagcagataatattttaaaggatgctgatatcagtgatgttgcattccttgtggttggtgatccatttggggccacaacacacagtgatcttgttctaagagcaacaaagctgggaattccttatagagttattcacaatgcctccataatgaatgctgtaggctgctgtggtttacagttatataagtttggagagacagtttctattgttttttggacagacacttggagaccagaaagcttctttgacaaagtgaagaagaacagacaaaatggcatgcacacattatgtttactagacatcaaagtaaaggagcagtctttggaaaatctaatcaagggaaggaagatctatgaacctccacggtatatgagtgtaaaccaagcagcccagcagcttctggagattgttcaaaatcaaagaatacgaggagaagaaccagcagttaccgaggagacactttgtgttggcttagccagggttggagccgacgaccagaaaattgcagcaggcactttaaggcaaatgtgcactgtggacttgggagaaccattgcattccttgatcatcacaggaggcagcatacatccaatggagatggagatgctaagtctgttttccataccagaaaatagctcagaatctcaaagcatcaatggactttgaacatagatatttaccattgtctgatgtaaatttcagccatatatggattgatatggtttggatgtatccccacccaagtctcatcttgaattttaatcctcataattcccaggtgttgtggtaggtaattgaatcatgggggcagtttccctcatgctattctcatgatagtgagctttcatgagatctgatggttttataagtgcctggcatttcccctactggctctcattctcactcttgccgccctgtgaagaggtgccttccaccgtgattgttaagtttcctgaggccttcccagccatgtggaactgtgagtcgaaaattaaacctcttttataattaaaaaaaaaaaaaaaaaatgccttaaagaaaataataagagaagggtgtgttctcttccaagtaatgagccgatcaaggggaagcaacccaaggctagcaggctcttttcaattcccagctctgccactcttagcatggcagagagttggcctcattatgccagtatggctgccacagtgtcagacatcacattccaggcagtggaaaggagaaagaaccaaagggcatccctttctcttgaagcagtccctgtgaggggggattatctggaagccccaacccaatttctgcttccaaccattatccatagaaacaactggaagttgagaagtgcagtcttttaggtgggcacctggctgccctgtatgaaaccagaattaggttggtcagcaggaaaacaagaaaacacttactgtgttgactgaggtttttgacgcatcgctttattgtcaaattaaacaactctatctcattctgcactgaaacacgtactaccattgcctataattggaaaatgatcctcagaggcacagaagatgccctgatggaaagtttgccccttgggcaaagagacagccatgggaaccttcagacctcagcatggaagcttccaagatccagaggaagaggcaacagcactgagagtcataggtagaagaatcatcacagccctgctaaccaggcagctgatgcccctctcccctggctccctgtgtccaaatcctacaggggcatctgttggctgaactcaacctgaagccaaagagaagatgagtggagagaggcaacatttatagagctcaggtttctagggctggagagggatctggagggacacacaggagacacctggcataaccaaaaaatgatt

SEQ ID NO: 278280 - DNA, 1480 bp, Homo sapiens
tctcgagcgaagagctactgcacttacccaggcttaggaagcgggtgtttaagccatgggttagagggctcgtgagcacgcccgatcctttccctgaggctatgaaacggtggctccacggactcctctcggccgactgacctttcgccgccctgccccagcagccggcgggtttcttcagtggagccgggctctggtctccgcagcccagtagcccgctagcccggccccctcccgctagtcgtaaagtgcagtaaaggcaccagcattttgcggcaccgtaggtgaggccggcggcgtgggccttttctctgcacggagccggcgcttttgcagttgcttctgcggaaaggtggtagttaagaatttgtaaaggccagagaactacctacgattctctcagcggtctctcttctcctcaagtttgaaatgctttatctcatcgggttgggcctgggagatgccaaggacatcacagtcaagggcctggaagttgttagacgctgcagtcgagtgtatctggaagcctacacctcagtcctaactgtagggaaggaagccttggaagagttttatggaagaaaattggttgttgctgatagagaagaagtggaacaagaagcagataatattttaaaggatgctgatatcagtgatgttgcattccttgtggttggtgatccatttggacacttggagaccagaaagcttctttgacaaagtgaagaagaacagacaaaatggcatgcacacattatgtttactagacatcaaagtaaaggagcagtctttggaaaatctaatcaagggaaggaagatctatgaacctccacggtatatgagtgtaaaccaagcagcccagcagcttctggagattgttcaaaatcaaagaatacgaggagaagaaccagcagttaccgaggagacactttgtgttggcttagccagggttggagccgacgaccagaaaattgcagcaggcactttaaggcaaatgtgcactgtggacttgggagaaccattgcattccttgatcatcacaggaggcagcatacatccaatggagatggagatgctaagtctgttttccataccagaaaatagctcagaatctcaaagcatcaatggactttgaacatagatatttaccattgtctgatgtaaatttcagccatatatggattgatatggtttggatgtatccccacccaagtctcatcttgaattttaatcctcataattcccaggtgttgtggtaggtaattgaatcatgggggcagtttccctcatgctattctcatgatagtgagctttcatgagatctgatggttttataagtgcctggcatttcccctactggctctcattctcactcttgccgccctgtgaagaggtgccttccaccgtgattgttaagtttcctgaggccttcccagccatgtggaactgtgagtcgaaaattaaacctcttttataatta

SEQ ID NO: 278281 - DNA, 1650 bp, Homo sapiens
tctcgagcgaagagctactgcacttacccaggcttaggaagcgggtgtttaagccatgggttagagggctcgtgagcacgcccgatcctttccctgaggctatgaaacggtggctccacggactcctctcggccgactgacctttcgccgccctgccccagcagccggcgggtttcttcagtggagccgggctctggtctccgcagcccagtagcccgctagcccggccccctcccgctagtcgtaaagtgcagtaaaggcaccagcattttgcggcaccgtaggtgaggccggcggcgtgggccttttctctgcacggagccggcgcttttgcagttgcttctgcggaaaggtggtagttaagaatttgtaaaggccagagaactacctacgattctctcagcgggtaattggctgctcctagtctctcttctcctcaagtttgaaatgctttatctcatcgggttgggcctgggagatgccaaggacatcacagtcaagggcctggaagttgttagacgctgcagtcgagtgtatctggaagcctacacctcagtcctaactgtagggaaggaagccttggaagagttttatggaagaaaattggttgttgctgatagagaagaagtggaacaagaagcagataatattttaaaggatgctgatatcagtgatgttgcattccttgtggttggtgatccatttggggccacaacacacagtgatcttgttctaagagcaacaaagctgggaattccttatagagttattcacaatgcctccataatgaatgctgtaggctgctgtggtttacagttatataagtttggagagacagtttctattgttttttggacagacacttggagaccagaaagcttctttgacaaagtgaagaagaacagacaaaatggcatgcacacattatgtttactagacatcaaagtaaaggagcagtctttggaaaatctaatcaagggaaggaagatctatgaacctccacggtatatgagtgtaaaccaagcagcccagcagcttctggagattgttcaaaatcaaagaatacgaggagaagaaccagcagttaccgaggagacactttgtgttggcttagccagggttggagccgacgaccagaaaattgcagcaggcactttaaggcaaatgtgcactgtggacttgggagaaccattgcattccttgatcatcacaggaggcagcatacatccaatggagatggagatgctaagtctgttttccataccagaaaatagctcagaatctcaaagcatcaatggactttgaacatagatatttaccattgtctgatgtaaatttcagccatatatggattgatatggtttggatgtatccccacccaagtctcatcttgaattttaatcctcataattcccaggtgttgtggtaggtaattgaatcatgggggcagtttccctcatgctattctcatgatagtgagctttcatgagatctgatggttttataagtgcctggcatttcccctactggctctcattctcactcttgccgccctgtgaagaggtgccttccaccgtgattgttaagtttcctgaggccttcccagccatgtggaactgtgagtcgaaaattaaacctcttttataatta

SEQ ID NO: 278282 - DNA, 1474 bp, Homo sapiens
tctcgagcgaagagctactgcacttacccaggcttaggaagcgggtgtttaagccatgggttagagggctcgtgagcacgcccgatcctttccctgaggctatgaaacggtggctccacggactcctctcggccgactgacctttcgccgccctgccccagcagccggcgggtttcttcagtggagccgggctctggtctccgcagcccagtagcccgctagcccggccccctcccgctagtcgtaaagtgcagtaaaggcaccagcattttgcggcaccgtaggtgaggccggcggcgtgggccttttctctgcacggagccggcgcttttgcagttgcttctgcggaaaggtggtagttaagaatttgtaaaggccagagaactacctacgattctctcagcgggaagagttttatggaagaaaattggttgttgctgatagagaagaagtggaacaagaagcagataatattttaaaggatgctgatatcagtgatgttgcattccttgtggttggtgatccatttggggccacaacacacagtgatcttgttctaagagcaacaaagctgggaattccttatagagttattcacaatgcctccataatgaatgctgtaggctgctgtggtttacagttatataagtttggagagacagtttctattgttttttggacagacacttggagaccagaaagcttctttgacaaagtgaagaagaacagacaaaatggcatgcacacattatgtttactagacatcaaagtaaaggagcagtctttggaaaatctaatcaagggaaggaagatctatgaacctccacggtatatgagtgtaaaccaagcagcccagcagcttctggagattgttcaaaatcaaagaatacgaggagaagaaccagcagttaccgaggagacactttgtgttggcttagccagggttggagccgacgaccagaaaattgcagcaggcactttaaggcaaatgtgcactgtggacttgggagaaccattgcattccttgatcatcacaggaggcagcatacatccaatggagatggagatgctaagtctgttttccataccagaaaatagctcagaatctcaaagcatcaatggactttgaacatagatatttaccattgtctgatgtaaatttcagccatatatggattgatatggtttggatgtatccccacccaagtctcatcttgaattttaatcctcataattcccaggtgttgtggtaggtaattgaatcatgggggcagtttccctcatgctattctcatgatagtgagctttcatgagatctgatggttttataagtgcctggcatttcccctactggctctcattctcactcttgccgccctgtgaagaggtgccttccaccgtgattgttaagtttcctgaggccttcccagccatgtggaactgtgagtcgaaaattaaacctcttttataatta

SEQ ID NO: 278283 - DNA, 1528 bp, Homo sapiens
tctcgagcgaagagctactgcacttacccaggcttaggaagcgggtgtttaagccatgggttagagggctcgtgagcacgcccgatcctttccctgaggctatgaaacggtggctccacggactcctctcggccgactgacctttcgccgccctgccccagcagccggcgggtttcttcagtggagccgggctctggtctccgcagcccagtagcccgctagcccggccccctcccgctagtcgtaaagtgcagtaaaggcaccagcattttgcggcaccgtaggtgaggccggcggcgtgggccttttctctgcacggagccggcgcttttgcagttgcttctgcggaaaggtggtagttaagaatttgtaaaggccagagaactacctacgattctctcagcggtctctcttctcctcaagtttgaaatgctttatctcatcgggttgggcctgggagatgccaaggacatcacagtcaagggcctggaagttgttagacgctgcagtcgagtgtatctggaagcctacacctcagtcctaactgtagggaaggaagccttggaagagttttatggaagaaaattggttgttgctgatagagaagaagtggaacaagaagcagataatattttaaaggatgctgatatcagtgatgttgcattccttgtggttggtgatccatttggggccacaacacacagtgatcttgttctaagagcaacaaagctgggaattccttatagagttattcacaatgcctccataatgaatgctgtaggctgctgtggtttacagttatataagtttggagagacagtttctattgttttttggacagacacttggagaccagaaagcttctttgacaaagtgaagaagaacagacaaaatggcatgcacacattatgtttactagacatcaaagtaaaggagcagtctttggaaaatctaatcaacagttaccgaggagacactttgtgttggcttagccagggttggagccgacgaccagaaaattgcagcaggcactttaaggcaaatgtgcactgtggacttgggagaaccattgcattccttgatcatcacaggaggcagcatacatccaatggagatggagatgctaagtctgttttccataccagaaaatagctcagaatctcaaagcatcaatggactttgaacatagatatttaccattgtctgatgtaaatttcagccatatatggattgatatggtttggatgtatccccacccaagtctcatcttgaattttaatcctcataattcccaggtgttgtggtaggtaattgaatcatgggggcagtttccctcatgctattctcatgatagtgagctttcatgagatctgatggttttataagtgcctggcatttcccctactggctctcattctcactcttgccgccctgtgaagaggtgccttccaccgtgattgttaagtttcctgaggccttcccagccatgtggaactgtgagtcgaaaattaaacctcttttataatta

SEQ ID NO: 278284 - DNA, 1498 bp, Homo sapiens
tctcgagcgaagagctactgcacttacccaggcttaggaagcgggtgtttaagccatgggttagagggctcgtgagcacgcccgatcctttccctgaggctatgaaacggtggctccacggactcctctcggccgactgacctttcgccgccctgccccagcagccggcgggtttcttcagtggagccgggctctggtctccgcagcccagtagcccgctagcccggccccctcccgctagtcgtaaagtgcagtaaaggcaccagcattttgcggcaccgtaggtgaggccggcggcgtgggccttttctctgcacggagccggcgcttttgcagttgcttctgcggaaaggtggtagttaagaatttgtaaaggccagagaactacctacgattctctcagcgggtaattggctgctcctagtctctcttctcctcaagtttgaaatgctttatctcatcgggttgggcctgggagatgccaaggacatcacagtcaagggcctggaagttgttagacgctgcagtcgagtgtatctggaagcctacacctcagtcctaactgtagggaaggaagccttggaagagttttatggaagaaaattggttgttgctgatagagaagaagtggaacaagaagcagataatattttaaaggatgctgatatcagtgatgttgcattccttgtggttggtgatccatttggacacttggagaccagaaagcttctttgacaaagtgaagaagaacagacaaaatggcatgcacacattatgtttactagacatcaaagtaaaggagcagtctttggaaaatctaatcaagggaaggaagatctatgaacctccacggtatatgagtgtaaaccaagcagcccagcagcttctggagattgttcaaaatcaaagaatacgaggagaagaaccagcagttaccgaggagacactttgtgttggcttagccagggttggagccgacgaccagaaaattgcagcaggcactttaaggcaaatgtgcactgtggacttgggagaaccattgcattccttgatcatcacaggaggcagcatacatccaatggagatggagatgctaagtctgttttccataccagaaaatagctcagaatctcaaagcatcaatggactttgaacatagatatttaccattgtctgatgtaaatttcagccatatatggattgatatggtttggatgtatccccacccaagtctcatcttgaattttaatcctcataattcccaggtgttgtggtaggtaattgaatcatgggggcagtttccctcatgctattctcatgatagtgagctttcatgagatctgatggttttataagtgcctggcatttcccctactggctctcattctcactcttgccgccctgtgaagaggtgccttccaccgtgattgttaagtttcctgaggccttcccagccatgtggaactgtgagtcgaaaattaaacctcttttataatta

SEQ ID NO: 278285 - DNA, 932 bp, Homo sapiens
atgacagcagcaaagagatgcgcagagtaaacgggggaaatccctttatgaaaccatcagatcttgtgagaactcactatcacgagaacagcatggagttatataagtttggagagacagtttctattgttttttggacagacacttggagaccagaaagcttctttgacaaagtgaagaagaacagacaaaatggcatgcacacattatgtttactagacatcaaagtaaaggagcagtctttggaaaatctaatcaagggaaggaagatctatgaacctccacggtatatgagtgtaaaccaagcagcccagcagcttctggagattgttcaaaatcaaagaatacgaggagaagaaccagcagttaccgaggagacactttgtgttggcttagccagggttggagccgacgaccagaaaattgcagcaggcactttaaggcaaatgtgcactgtggacttgggagaaccattgcattccttgatcatcacaggaggcagcatacatccaatggagatggagatgctaagtctgttttccataccagaaaatagctcagaatctcaaagcatcaatggactttgaacatagatatttaccattgtctgatgtaaatttcagccatatatggattgatatggtttggatgtatccccacccaagtctcatcttgaattttaatcctcataattcccaggtgttgtggtaggtaattgaatcatgggggcagtttccctcatgctattctcatgatagtgagctttcatgagatctgatggttttataagtgcctggcatttcccctactggctctcattctcactcttgccgccctgtgaagaggtgccttccaccgtgattgttaagtttcctgaggccttcccagccatgtggaactgtgagtcgaaaattaaacctcttttataatta

SEQ ID NO: 278286 - DNA, 761 bp, Homo sapiens
tcgcggggattagattttccaaagactgctcctttactttgatgtctagtaaacataatgtgtgcatgccattttgtctgttcttcttcactttgtcaaagaagctttctggtctccaagtgtctgtaaaccaagcagcccagcagcttctggagattgttcaaaatcaaagaatacgaggagaagaaccagcagttaccgaggagacactttgtgttggcttagccagggttggagccgacgaccagaaaattgcagcaggcactttaaggcaaatgtgcactgtggacttgggagaaccattgcattccttgatcatcacaggaggcagcatacatccaatggagatggagatgctaagtctgttttccataccagaaaatagctcagaatctcaaagcatcaatggactttgaacatagatatttaccattgtctgatgtaaatttcagccatatatggattgatatggtttggatgtatccccacccaagtctcatcttgaattttaatcctcataattcccaggtgttgtggtaggtaattgaatcatgggggcagtttccctcatgctattctcatgatagtgagctttcatgagatctgatggttttataagtgcctggcatttcccctactggctctcattctcactcttgccgccctgtgaagaggtgccttccaccgtgattgttaagtttcctgaggccttcccagccatgtggaactgtgagtcgaaaattaaacctcttttataatta

SEQ ID NO: 278287 - DNA, 1159 bp, Homo sapiens
tctcgagcgaagagctactgcacttacccaggcttaggaagcgggtgtttaagccatgggttagagggctcgtgagcacgcccgatcctttccctgaggctatgaaacggtggctccacggactcctctcggccgactgacctttcgccgccctgccccagcagccggcgggtttcttcagtggagccgggctctggtctccgcagcccagtagcccgctagcccggccccctcccgctagtcgtaaagtgcagtaaaggcaccagcattttgcggcaccgtaggtgaggccggcggcgtgggccttttctctgcacggagccggcgcttttgcagttgcttctgcggaaaggtggtagttaagaatttgtaaaggccagagaactacctacgattctctcagcggtctctcttctcctcaagtttgaaatgctttatctcatcgggttgggcctgggagatgccaaggacatcacagtcaagggcctggaagttgttagacgctgcagtcgagtgtatctggaagcctacacctcagtcctaactgtagggaaggaagccttggaagagttttatggaagaaaattggttgttgctgatagagaagaagtggaacaagaagcagataatattttaaaggatgctgatatcagtgatgttgcattccttgtggttggtgatccatttggggccacaacacacagtgatcttgttctaagagcaacaaagctgggaattccttatagagttattcacaatgcctccataatgaatgctgtaggctgctgtggtttacagttatataagtttggagagacagtttctattgttttttggacagacacttggagaccagaaagcttctttgacaaagtgaagaagaacagacaaaatggcatgcacacattatgtttactagacatcaaagtaaaggagcagtctttggaaaatctaatcaagggaaggaagatctatgaacctccacggtatatgagtgtaaaccaagcagcccagcagcttctggagattgttcaaaatcaaagaatacgaggagaagaaccagcagttaccgaggagacactttgtgttggcttagccagggttggagccgacgaccaaattgcgggggcttaggaggtgcgtgggctgggaactctgt

SEQ ID NO: 278288 - DNA, 1177 bp, Homo sapiens
tctcgagcgaagagctactgcacttacccaggcttaggaagcgggtgtttaagccatgggttagagggctcgtgagcacgcccgatcctttccctgaggctatgaaacggtggctccacggactcctctcggccgactgacctttcgccgccctgccccagcagccggcgggtttcttcagtggagccgggctctggtctccgcagcccagtagcccgctagcccggccccctcccgctagtcgtaaagtgcagtaaaggcaccagcattttgcggcaccgtaggtgaggccggcggcgtgggccttttctctgcacggagccggcgcttttgcagttgcttctgcggaaaggtggtagttaagaatttgtaaaggccagagaactacctacgattctctcagcgggtaattggctgctcctagtctctcttctcctcaagtttgaaatgctttatctcatcgggttgggcctgggagatgccaaggacatcacagtcaagggcctggaagttgttagacgctgcagtcgagtgtatctggaagcctacacctcagtcctaactgtagggaaggaagccttggaagagttttatggaagaaaattggttgttgctgatagagaagaagtggaacaagaagcagataatattttaaaggatgctgatatcagtgatgttgcattccttgtggttggtgatccatttggggccacaacacacagtgatcttgttctaagagcaacaaagctgggaattccttatagagttattcacaatgcctccataatgaatgctgtaggctgctgtggtttacagttatataagtttggagagacagtttctattgttttttggacagacacttggagaccagaaagcttctttgacaaagtgaagaagaacagacaaaatggcatgcacacattatgtttactagacatcaaagtaaaggagcagtctttggaaaatctaatcaagggaaggaagatctatgaacctccacggtatatgagtgtaaaccaagcagcccagcagcttctggagattgttcaaaatcaaagaatacgaggagaagaaccagcagttaccgaggagacactttgtgttggcttagccagggttggagccgacgaccaaattgcgggggcttaggaggtgcgtgggctgggaactctgt

SEQ ID NO: 278289 - DNA, 897 bp, Homo sapiens
tctcgagcgaagagctactgcacttacccaggcttaggaagcgggtgtttaagccatgggttagagggctcgtgagcacgcccgatcctttccctgaggctatgaaacggtggctccacggactcctctcggccgactgacctttcgccgccctgccccagcagccggcgggtttcttcagtggagccgggctctggtctccgcagcccagtagcccgctagcccggccccctcccgctagtcgtaaagtgcagtaaaggcaccagcattttgcggcaccgtaggtgaggccggcggcgtgggccttttctctgcacggagccggcgcttttgcagttgcttctgcggaaaggtggtagttaagaatttgtaaaggccagagaactacctacgattctctcagcggtctctcttctcctcaagtttgaaatgctttatctcatcgggttgggcctgggagatgccaaggacatcacagtcaagggcctggaagttgttagacgctgcagtcgagtgtatctggaagcctacacctcagtcctaactgtagggaaggaagccttggaagagttttatggaagaaaattggttgttgctgatagagaagaagtggaacaagaagcagataatattttaaaggatgctgatatcagtgatgttgcattccttgtggttggtgatccatttgggtaagtcaaggcagatattttgagtttttaactcatttacttttttttaatcagtaagaattattctattgcatttaacacttttacctgccaggtcctgataaggaactctggttacttaagcgctatctaaaatgtcatagtttaaactttcatgatctttgagattagtgaagaaaagctagttggtaaatatatcatcatatgt

SEQ ID NO: 278290 - DNA, 781 bp, Homo sapiens
accagcattttgcggcaccgtaggtgaggccggcggcgtgggccttttctctgcacggagccggcgcttttgcagttgcttctgcggaaaggtggtagttaagaatttgtaaaggccagagaactacctacgattctctcagcgggtaattggctgctcctaggtttgtgtaacaagaggcaaaactggtagggttgtttaaaacctcttatcccagttcttaagcgtgacataaggttcccaaacccctccttgtgacttgcctcttctcttgtgctactttggttgtcatcgtgttcatcactagattttagatgtcctcggtgttactgacggtttttctgtccacttcgtcttgcagtctctcttctcctcaagtttgaaatgctttatctcatcgggttgggcctgggagatgccaaggacatcacagtcaagggcctggaagttgttagacgctgcagtcgagtgtatctggaagcctacacctcagtcctaactgtagggaaggaagccttggtaggtgctgagcgttccccagcctcctgggaagaaagctatctaacatctgattttcatacactaagctgaacagaattttcaggtctgcttgtttaaaccctttgaaacgcatcccttgttcattaatgatctgaggagcagaagaatggaaattttacaccaaccaagtgacttggaaaatgaaagggtgctttgtcctattttacaagtctaattttgtggctttctccagtaaataggaaagctattttatactcct

SEQ ID NO: 278291 - DNA, 381 bp, Homo sapiens
aatgtagactgtggtacttgagtatacctgggagagctaattgcattaataacatattatgtagtttcatggctaagaacagtggcatctagttttctgcctataggggaaggaagatctatgaacctccacggtatatgagtgtaaaccaagcagcccagcagcttctggagattgttcaaaatcaaagaatacgaggagaagaaccaggtactcaagacactagaagggctctcatattattcctctgttactacatttagatgtgtatatgacttaatatctcataccactatggaagcaagagtcagtatttttgtattgtactatttcttgtcatttttgtccaactttaacttaaatcccataggcttcaagttg

SEQ ID NO: 278292 - DNA, 1632 bp, Homo sapiens
tctcgagcgaagagctactgcacttacccaggcttaggaagcgggtgtttaagccatgggttagagggctcgtgagcacgcccgatcctttccctgaggctatgaaacggtggctccacggactcctctcggccgactgacctttcgccgccctgccccagcagccggcgggtttcttcagtggagccgggctctggtctccgcagcccagtagcccgctagcccggccccctcccgctagtcgtaaagtgcagtaaaggcaccagcattttgcggcaccgtaggtgaggccggcggcgtgggccttttctctgcacggagccggcgcttttgcagttgcttctgcggaaaggtggtagttaagaatttgtaaaggccagagaactacctacgattctctcagcggtctctcttctcctcaagtttgaaatgctttatctcatcgggttgggcctgggagatgccaaggacatcacagtcaagggcctggaagttgttagacgctgcagtcgagtgtatctggaagcctacacctcagtcctaactgtagggaaggaagccttggaagagttttatggaagaaaattggttgttgctgatagagaagaagtggaacaagaagcagataatattttaaaggatgctgatatcagtgatgttgcattccttgtggttggtgatccatttggggccacaacacacagtgatcttgttctaagagcaacaaagctgggaattccttatagagttattcacaatgcctccataatgaatgctgtaggctgctgtggtttacagttatataagtttggagagacagtttctattgttttttggacagacacttggagaccagaaagcttctttgacaaagtgaagaagaacagacaaaatggcatgcacacattatgtttactagacatcaaagtaaaggagcagtctttggaaaatctaatcaagggaaggaagatctatgaacctccacggtatatgagtgtaaaccaagcagcccagcagcttctggagattgttcaaaatcaaagaatacgaggagaagaaccagcagttaccgaggagacactttgtgttggcttagccagggttggagccgacgaccagaaaattgcagcaggcactttaaggcaaatgtgcactgtggacttgggagaaccattgcattccttgatcatcacaggaggcagcatacatccaatggagatggagatgctaagtctgttttccataccagaaaatagctcagaatctcaaagcatcaatggactttgaacatagatatttaccattgtctgatgtaaatttcagccatatatggattgatatggtttggatgtatccccacccaagtctcatcttgaattttaatcctcataattcccaggtgttgtggtaggtaattgaatcatgggggcagtttccctcatgctattctcatgatagtgagctttcatgagatctgatggttttataagtgcctggcatttcccctactggctctcattctcactcttgccgccctgtgaagaggtgccttccaccgtgattgttaagtttcctgaggccttcccagccatgtggaactgtgagtcgaaaattaaacctcttttataatta

SEQ ID NO: 278293 - DNA, 2077 bp, Homo sapiens
tctcgagcgaagagctactgcacttacccaggcttaggaagcgggtgtttaagccatgggttagagggctcgtgagcacgcccgatcctttccctgaggctatgaaacggtggctccacggactcctctcggccgactgacctttcgccgccctgccccagcagccggcgggtttcttcagtggagccgggctctggtctccgcagcccagtagcccgctagcccggccccctcccgctagtcgtaaagtgcagtaaaggcaccagcattttgcggcaccgtaggtgaggccggcggcgtgggccttttctctgcacggagccggcgcttttgcagttgcttctgcggaaaggtggtagttaagaatttgtaaaggccagagaactacctacgattctctcagcggtctctcttctcctcaagtttgaaatgctttatctcatcgggttgggcctgggagatgccaaggacatcacagtcaagggcctggaagttgttagacgctgcagtcgagtgtatctggaagcctacacctcagtcctaactgtagggaaggaagccttggaagagttttatggaagaaaattggttgttgctgatagagaagaagtggaacaagaagcagataatattttaaaggatgctgatatcagtgatgttgcattccttgtggttggtgatccatttggggccacaacacacagtgatcttgttctaagagcaacaaagctgggaattccttatagagttattcacaatgcctccataatgaatgctgtaggctgctgtggtttacagttatataagtttggagagacagtttctattgttttttggacagacacttggagaccagaaagcttctttgacaaagtgaagaagaacagacaaaatggcatgcacacattatgtttactagacatcaaagtaaaggagcagtctttggaaaatctaatcaagggaaggaagatctatgaacctccacggtatatgagtgtaaaccaagcagcccagcagcttctggagattgttcaaaatcaaagaatacgaggagaagaaccagcagttaccgaggagacactttgtgttggcttagccagggttggagccgacgaccagaaaattgcagcaggcactttaaggcaaatgtgcactgtggacttgggagaaccattgcattccttgatcatcacaggaggcagcatacatccaatggagatggagatgctaagtctgttttccataccagaaaatagctcagaatctcaaagcatcaatggactttgaacatagatatttaccattgtctgatgtaaatttcagccatatatggattgatatggtttggatgtatccccacccaagtctcatcttgaattttaatcctcataattcccaggtgttgtggtaggtaattgaatcatgggggcagtttccctcatgctattctcatgatagtgagctttcatgagatctgatggttttataagtgcctggcatttcccctactggctctcattctcactcttgccgccctgtgaagaggtgccttccaccgtgattgttaagtttcctgaggccttcccagccatgtggaactgtgagtcgaaaattaaacctcttttataattacccagtctcgggtatttcttcatagcagtgtgagaatggattaatacctggatgcatgcatgtttgtgtaacaaacaggtcttttggcttatctagtaagtataaaacaagtgaccaaaaagaagttgactcaacaatgcttggtttcttgtggcagtgagttttttccctatgatatcatcagttgttgctgctattttggcaaattttcaggatgtacacataaagcagaccaggctggaaagcttgtggatagacatccactgacagaatcatttaagagcagtttttatttatgaaaccaatttatacaaggtggttgttaacagaatataacttagaggtaactggaatttgaatcacttgaatctgttttaaagggtaaaaaatgttatgagtgccaagaaaagcaaataaaagattagtaaatgttcacaaaatatgt

SEQ ID NO: 278294 - DNA, 1517 bp, Homo sapiens
tctcgagcgaagagctactgcacttacccaggcttaggaagcgggtgtttaagccatgggttagagggctcgtgagcacgcccgatcctttccctgaggctatgaaacggtggctccacggactcctctcggccgactgacctttcgccgccctgccccagcagccggcgggtttcttcagtggagccgggctctggtctccgcagcccagtagcccgctagcccggccccctcccgctagtcgtaaagtgcagtaaaggcaccagcattttgcggcaccgtaggtgaggccggcggcgtgggccttttctctgcacggagccggcgcttttgcagttgcttctgcggaaaggtggtagttaagaatttgtaaaggccagagaactacctacgattctctcagcgggtaattggctgctcctaggtttgtgtaacaagaggcaaaactggaagagttttatggaagaaaattggttgttgctgatagagaagaagtggaacaagaagcagataatattttaaaggatgctgatatcagtgatgttgcattccttgtggttggtgatccatttggggccacaacacacagtgatcttgttctaagagcaacaaagctgggaattccttatagagttattcacaatgcctccataatgaatgctgtaggctgctgtggtttacagttatataagtttggagagacagtttctattgttttttggacagacacttggagaccagaaagcttctttgacaaagtgaagaagaacagacaaaatggcatgcacacattatgtttactagacatcaaagtaaaggagcagtctttggaaaatctaatcaagggaaggaagatctatgaacctccacggtatatgagtgtaaaccaagcagcccagcagcttctggagattgttcaaaatcaaagaatacgaggagaagaaccagcagttaccgaggagacactttgtgttggcttagccagggttggagccgacgaccagaaaattgcagcaggcactttaaggcaaatgtgcactgtggacttgggagaaccattgcattccttgatcatcacaggaggcagcatacatccaatggagatggagatgctaagtctgttttccataccagaaaatagctcagaatctcaaagcatcaatggactttgaacatagatatttaccattgtctgatgtaaatttcagccatatatggattgatatggtttggatgtatccccacccaagtctcatcttgaattttaatcctcataattcccaggtgttgtggtaggtaattgaatcatgggggcagtttccctcatgctattctcatgatagtgagctttcatgagatctgatggttttataagtgcctggcatttcccctactggctctcattctcactcttgccgccctgtgaagaggtgccttccaccgtgattgttaagtttcctgaggccttcccagccatgtggaactgtgagtcgaaaattaaacctcttttataatta

SEQ ID NO: 278295 - DNA, 1492 bp, Homo sapiens
tctcgagcgaagagctactgcacttacccaggcttaggaagcgggtgtttaagccatgggttagagggctcgtgagcacgcccgatcctttccctgaggctatgaaacggtggctccacggactcctctcggccgactgacctttcgccgccctgccccagcagccggcgggtttcttcagtggagccgggctctggtctccgcagcccagtagcccgctagcccggccccctcccgctagtcgtaaagtgcagtaaaggcaccagcattttgcggcaccgtaggtgaggccggcggcgtgggccttttctctgcacggagccggcgcttttgcagttgcttctgcggaaaggtggtagttaagaatttgtaaaggccagagaactacctacgattctctcagcgggtaattggctgctcctaggaagagttttatggaagaaaattggttgttgctgatagagaagaagtggaacaagaagcagataatattttaaaggatgctgatatcagtgatgttgcattccttgtggttggtgatccatttggggccacaacacacagtgatcttgttctaagagcaacaaagctgggaattccttatagagttattcacaatgcctccataatgaatgctgtaggctgctgtggtttacagttatataagtttggagagacagtttctattgttttttggacagacacttggagaccagaaagcttctttgacaaagtgaagaagaacagacaaaatggcatgcacacattatgtttactagacatcaaagtaaaggagcagtctttggaaaatctaatcaagggaaggaagatctatgaacctccacggtatatgagtgtaaaccaagcagcccagcagcttctggagattgttcaaaatcaaagaatacgaggagaagaaccagcagttaccgaggagacactttgtgttggcttagccagggttggagccgacgaccagaaaattgcagcaggcactttaaggcaaatgtgcactgtggacttgggagaaccattgcattccttgatcatcacaggaggcagcatacatccaatggagatggagatgctaagtctgttttccataccagaaaatagctcagaatctcaaagcatcaatggactttgaacatagatatttaccattgtctgatgtaaatttcagccatatatggattgatatggtttggatgtatccccacccaagtctcatcttgaattttaatcctcataattcccaggtgttgtggtaggtaattgaatcatgggggcagtttccctcatgctattctcatgatagtgagctttcatgagatctgatggttttataagtgcctggcatttcccctactggctctcattctcactcttgccgccctgtgaagaggtgccttccaccgtgattgttaagtttcctgaggccttcccagccatgtggaactgtgagtcgaaaattaaacctcttttataatta

SEQ ID NO: 278296 - DNA, 1554 bp, Homo sapiens
tctcgagcgaagagctactgcacttacccaggcttaggaagcgggtgtttaagccatgggttagagggctcgtgagcacgcccgatcctttccctgaggctatgaaacggtggctccacggactcctctcggccgactgacctttcgccgccctgccccagcagccggcgggtttcttcagtggagccgggctctggtctccgcagcccagtagcccgctagcccggccccctcccgctagtcgtaaagtgcagtaaaggcaccagcattttgcggcaccgtaggtgaggccggcggcgtgggccttttctctgcacggagccggcgcttttgcagttgcttctgcggaaaggtggtagttaagaatttgtaaaggccagagaactacctacgattctctcagcggtctctcttctcctcaagtttgaaatgctttatctcatcgggttgggcctgggagatgccaaggacatcacagtcaagggcctggaagttgttagacgctgcagtcgagtgtatctggaagcctacacctcagtcctaactgtagggaaggaagccttggaagagttttatggaagaaaattggttgttgctgatagagaagaagtggaacaagaagcagataatattttaaaggatgctgatatcagtgatgttgcattccttgtggttggtgatccatttggggccacaacacacagtgatcttgttctaagagcaacaaagctgggaattccttatagagttattcacaatgcctccataatgaatgctgtaggctgctgtggtttacagttatataagtttggagagacagtttctattgttttttggacagacacttggagaccagaaagcttctttgacaaagtgaagaagggaaggaagatctatgaacctccacggtatatgagtgtaaaccaagcagcccagcagcttctggagattgttcaaaatcaaagaatacgaggagaagaaccagcagttaccgaggagacactttgtgttggcttagccagggttggagccgacgaccagaaaattgcagcaggcactttaaggcaaatgtgcactgtggacttgggagaaccattgcattccttgatcatcacaggaggcagcatacatccaatggagatggagatgctaagtctgttttccataccagaaaatagctcagaatctcaaagcatcaatggactttgaacatagatatttaccattgtctgatgtaaatttcagccatatatggattgatatggtttggatgtatccccacccaagtctcatcttgaattttaatcctcataattcccaggtgttgtggtaggtaattgaatcatgggggcagtttccctcatgctattctcatgatagtgagctttcatgagatctgatggttttataagtgcctggcatttcccctactggctctcattctcactcttgccgccctgtgaagaggtgccttccaccgtgattgttaagtttcctgaggccttcccagccatgtggaactgtgagtcgaaaattaaacctcttttataatta

SEQ ID NO: 278297 - DNA, 1488 bp, Homo sapiens
tctcgagcgaagagctactgcacttacccaggcttaggaagcgggtgtttaagccatgggttagagggctcgtgagcacgcccgatcctttccctgaggctatgaaacggtggctccacggactcctctcggccgactgacctttcgccgccctgccccagcagccggcgggtttcttcagtggagccgggctctggtctccgcagcccagtagcccgctagcccggccccctcccgctagtcgtaaagtgcagtaaaggcaccagcattttgcggcaccgtaggtgaggccggcggcgtgggccttttctctgcacggagccggcgcttttgcagttgcttctgcggaaaggtggtagttaagaatttgtaaaggccagagaactacctacgattctctcagcggtctctcttctcctcaagtttgaaatgctttatctcatcgggttgggcctgggagatgccaaggacatcacagtcaagggcctggaagttgttagacgctgcagtcgagtgtatctggaagcctacacctcagtcctaactgtagggaaggaagccttggaagagttttatggaagaaaattggttgttgctgatagagaagaagtggaacaagaagcagataatattttaaaggatgctgatatcagtgatgttgcattccttgtggttggtgatccatttggggccacaacacacagtgatcttgttctaagagcaacaaagctgggaattccttatagagttattcacaatgcctccataatgaatgctgtaggctgctgtggtttacagttatataagtttggagagacagtttctattgttttttggacagacacttggagaccagaaagcttctttgacaaagtgaagaagaacagacaaaatggcatgcacacattatgtttactagcagttaccgaggagacactttgtgttggcttagccagggttggagccgacgaccagaaaattgcagcaggcactttaaggcaaatgtgcactgtggacttgggagaaccattgcattccttgatcatcacaggaggcagcatacatccaatggagatggagatgctaagtctgttttccataccagaaaatagctcagaatctcaaagcatcaatggactttgaacatagatatttaccattgtctgatgtaaatttcagccatatatggattgatatggtttggatgtatccccacccaagtctcatcttgaattttaatcctcataattcccaggtgttgtggtaggtaattgaatcatgggggcagtttccctcatgctattctcatgatagtgagctttcatgagatctgatggttttataagtgcctggcatttcccctactggctctcattctcactcttgccgccctgtgaagaggtgccttccaccgtgattgttaagtttcctgaggccttcccagccatgtggaactgtgagtcgaaaattaaacctcttttataatta

SEQ ID NO: 278298 - DNA, 1322 bp, Homo sapiens
tctcgagcgaagagctactgcacttacccaggcttaggaagcgggtgtttaagccatgggttagagggctcgtgagcacgcccgatcctttccctgaggctatgaaacggtggctccacggactcctctcggccgactgacctttcgccgccctgccccagcagccggcgggtttcttcagtggagccgggctctggtctccgcagcccagtagcccgctagcccggccccctcccgctagtcgtaaagtgcagtaaaggcaccagcattttgcggcaccgtaggtgaggccggcggcgtgggccttttctctgcacggagccggcgcttttgcagttgcttctgcggaaaggtggtagttaagaatttgtaaaggccagagaactacctacgattctctcagcgggaagagttttatggaagaaaattggttgttgctgatagagaagaagtggaacaagaagcagataatattttaaaggatgctgatatcagtgatgttgcattccttgtggttggtgatccatttggacacttggagaccagaaagcttctttgacaaagtgaagaagaacagacaaaatggcatgcacacattatgtttactagacatcaaagtaaaggagcagtctttggaaaatctaatcaagggaaggaagatctatgaacctccacggtatatgagtgtaaaccaagcagcccagcagcttctggagattgttcaaaatcaaagaatacgaggagaagaaccagcagttaccgaggagacactttgtgttggcttagccagggttggagccgacgaccagaaaattgcagcaggcactttaaggcaaatgtgcactgtggacttgggagaaccattgcattccttgatcatcacaggaggcagcatacatccaatggagatggagatgctaagtctgttttccataccagaaaatagctcagaatctcaaagcatcaatggactttgaacatagatatttaccattgtctgatgtaaatttcagccatatatggattgatatggtttggatgtatccccacccaagtctcatcttgaattttaatcctcataattcccaggtgttgtggtaggtaattgaatcatgggggcagtttccctcatgctattctcatgatagtgagctttcatgagatctgatggttttataagtgcctggcatttcccctactggctctcattctcactcttgccgccctgtgaagaggtgccttccaccgtgattgttaagtttcctgaggccttcccagccatgtggaactgtgagtcgaaaattaaacctcttttataatta

SEQ ID NO: 278299 - DNA, 1419 bp, Homo sapiens
tctcgagcgaagagctactgcacttacccaggcttaggaagcgggtgtttaagccatgggttagagggctcgtgagcacgcccgatcctttccctgaggctatgaaacggtggctccacggactcctctcggccgactgacctttcgccgccctgccccagcagccggcgggtttcttcagtggagccgggctctggtctccgcagcccagtagcccgctagcccggccccctcccgctagtcgtaaagtgcagtaaaggcaccagcattttgcggcaccgtaggtgaggccggcggcgtgggccttttctctgcacggagccggcgcttttgcagttgcttctgcggaaaggtggtagttaagaatttgtaaaggccagagaactacctacgattctctcagcgggaagagttttatggaagaaaattggttgttgctgatagagaagaagtggaacaagaagcagataatattttaaaggatgctgatatcagtgatgttgcattccttgtggttggtgatccatttggggccacaacacacagtgatcttgttctaagagcaacaaagctgggaattccttatagagttattcacaatgcctccataatgaatgctgtaggctgctgtggtttacagttatataagtttggagagacagtttctattgttttttggacagacacttggagaccagaaagcttctttgacaaagtgaagaagaacagacaaaatggcatgcacacattatgtttactagacatcaaagtaaaggagcagtctttggaaaatctaatcaagggaaggaagatctatgaacctccacggtatatgagtgtaaaccaagcagcccagcagcttctggagattgttcaaaatcaaagaatacgaggagaagaaccagcagttaccgaggagacactttgtgttggcttagccagggttggagccgacgaccattgcattccttgatcatcacaggaggcagcatacatccaatggagatggagatgctaagtctgttttccataccagaaaatagctcagaatctcaaagcatcaatggactttgaacatagatatttaccattgtctgatgtaaatttcagccatatatggattgatatggtttggatgtatccccacccaagtctcatcttgaattttaatcctcataattcccaggtgttgtggtaggtaattgaatcatgggggcagtttccctcatgctattctcatgatagtgagctttcatgagatctgatggttttataagtgcctggcatttcccctactggctctcattctcactcttgccgccctgtgaagaggtgccttccaccgtgattgttaagtttcctgaggccttcccagccatgtggaactgtgagtcgaaaattaaacctcttttataatta

SEQ ID NO: 278300 - DNA, 912 bp, Homo sapiens
tctcgagcgaagagctactgcacttacccaggcttaggaagcgggtgtttaagccatgggttagagggctcgtgagcacgcccgatcctttccctgaggctatgaaacggtggctccacggactcctctcggccgactgacctttcgccgccctgccccagcagccggcgggtttcttcagtggagccgggctctggtctccgcagcccagtagcccgctagcccggccccctcccgctagtcgtaaagtgcagtaaaggcaccagcattttgcggcaccgtaggtgaggccggcggcgtgggccttttctctgcacggagccggcgcttttgcagttgcttctgcggaaaggtggtagttaagaatttgtaaaggccagagaactacctacgattctctcagcggtctctcttctcctcaagtttgaaatgctttatctcatcgggttgggcctgggagatgccaaggacatcacagtcaagggcctggaagttgttagacgctgcagtcgagtgtatctggaagcctacacctcagtcctaactgtagggaaggaagccttggaagagttttatggaagaaaattggttgttgctgatagagaagaagtggaacaagaagcagataatattttaaaggatgctgatatcagtgatgttgcattccttgtggttggtgatccatttggggccacaacacacagtgatcttgttctaagagcaacaaagctgggaattccttatagagttattcacaatgcctccataatgaatgctgtaggctgctgtggtttacagttatataagttagtgctcacagattgcctctctttttgtttgatttctccctcctcaaatctgtaatttatttctgaactcctttccattagcaagcagataaaatggttacac

SEQ ID NO: 278301 - DNA, 799 bp, Homo sapiens
ctggtccaggcacagccttgccacagtccagagaaggccacctctaatggggcctgcaggcattgtggccacaggaggaaagggccggggggcccctctccccactcctggggcagctcccttgcccttccccagcctcaggcactctcatcatctccgttggcctcttctgggggctcttggggttcatctccagggtggaaaacttggagggcccctcctggcagagtcaaggatggggtcagcgagaccccatcccctcagccctcaacctttgtttcacccagagcccctctgaatcctgggagctggctctttccactccccgagggggccctcaggcccaccctggctgtcccagcatggcccccgcggcttctgcgctgcacccttcccgtccctccctgctcctcatggtcactagtgcctgcttatccactgggtcatcccctcggccagggcccctcctgccctggaagcccagcaagcgcccactcgtagctcctcagcgggtcctcgccggcctgtgccaggtgcaggggccagtgggaggacaacaggagccacgcaggccatcagcgcaagagcaaacgcacatggcaacgttggtccgctcagccactggttctgtggtggaacggtggatgtctgcactgtgacatcagctgagtacgagaactgccggttgcgggttataaacaagatgatgcccttgcggtaggccatgtgggcggtgaagttcaaggccagctggaggtgcgtggctgtctgttccaggtcgatgatgtcgtggtccagg

SEQ ID NO: 278302 - DNA, 1271 bp, Homo sapiens
aaattcctgactctcagaaacttgtgcataggaagaatctggggaccttgtggaaagtgcagctcccagacacctgcctcaactgactctgtggatgtggagcgggccctgccactccccatttttaacctactggggagagaacgggaggcaaaactacaaacctgaaaataaagtggctaagtggcttctcaaactctttccaagtctctaaacaccgctgagtctggattgtcactgtgctctacagaggaaacgaagaccaagaattaagcagctcgattttccagtgcagactgtttgacctttgtgactagtaaaccactccttttattaaggccaaatctgcaaaatctgtcttaaagaaaatggtcagtctttcctttcttctaaacatctctgattttttcatcttgtttcctgactattcacagacagcaacaataacagattctggaaagaaggatttgtagtatacaccacttgcctcactgctttatccaccaacggaccctttatctgggaccaaagattctgagctgaaagggccctcagagcagccaaggcatgcatgagaagagaagggctatgaagtggaagctgagggagcgtggactgcaggcttgggagagggagcatggtgtcctgcagagccacatgctggcagaactgggtctacagacacattttattcagtccctaaaccacagaaagtgaggacttctaatatgtggtaccagagtgtgcagcaaagaaccttctgcaaagagctttggctgcagatgttcaagatttgccatggactccagaactctcaaatcacttggaaatttgtctatgcagcattatctggtgtcatgcctgagatattgaaggaaaagccccagcctttcaggggtttctgagaagaatatgccccttttctgtattcataactgtatcttctttctctgggcagtattgagagtgggtaaaagaacatggacttgaagtcagagagtcccagcttctagccctagctatgtgaccaagggcaagttgtttccctctctgagcctgttttcatacttgagaaataggaaatagggatgttgtgaatattaaatgagatcgttcttggaaagaatattagcaaggtacctggcgcacggtcagtgctccacagagtctgaggaggtgatgtatttgccaagagacaatgccaaagaagggaggaatgcaattaggcatgtctttctaagccagtaaagggcctctttggatctttgtat

SEQ ID NO: 278303 - DNA, 436 bp, Homo sapiens
aatggaaccatctatggcggccaggtctttttcaggttcccttagcgccagaagcggttggtacagtctggtgctcctggaggacgccctgtgccttaaagcagctgtaaccaaggcctctcaagaggcggctacggatcctagcggatcgacacgccacacagcctcgtccccagcagtaggtggaggccctgggggtgcctaacaagcctcagaacaccaagaaatccgcgtggttgtgcaggtctttgctgttcagtagcattccacaaatagtgtgtccaaaacgcatctgtagatgtaacttgagtgaatgaatgaatgattcgagttgctccttctacccaataaagtagataagattttatctttctcatctttccaaggcccctttatagttgggaaaagtgagtatttggaaagatgacttgtccaa

SEQ ID NO: 278304 - DNA, 404 bp, Homo sapiens
ccagggcaccttcaccctgctcagcttgtggctccaacattctagaagccgaggcctctgccatccctgccctttcccatggatattccatttcaattagacaacccagcctggccggaatccccctgcgttccttcttttcctttgtgtatttttgagacggggtgttgctccgtcacccaggctggagtgtagtgggatcctggcccactgcagcctcaaattcctgggctgaggcaatcctgccgcctcagcctcctgagtagctggggttacaagagcaagccaccacacccagctaattttgaaaaatattttttgtagaggagaggtcttgctttgttgtccaggttggtctcaaactccagggctcaagggatcctttcccgttggcctcccaaggc

SEQ ID NO: 278305 - DNA, 348 bp, Homo sapiens
ccagggcaccttcaccctgctcagcttgtggctccaacattctagaagccgaggcctctgccatccctgccctttcccatggatattccatttcaattagacaacccagcctggccggaatccccctgcgttccttcttttcctttgtgtatttttgagacggggtgttgctccgtcacccaggctggagtgtagtgggatcctggcccactgcagcctcaaattcctgggctgaggcagaagaattgcttgaacccaggaggtggaggttacagtgagccgagatcctgccactgtactccagcctgggcgacagatcacgactccatctcaaaataaataaataaa

SEQ ID NO: 278306 - DNA, 523 bp, Homo sapiens
ccatccgggtcctggcgcggtgctctcccggcagcgacgggcgcgagggccggggcattcccacggccgcgacggccctctccgcgagcgcgaggatgtacatgaagcatggcaccaacagctgctcctgtgaggcctcaagaagcttacaatcgtggcagaagctgaagggggagccagcgtgtggcatggcaagggaaggagcaagagagagagggaggagctgccaggctcttttgaacaaccagatctcacgtgaactcacagattgaaattcactcattactgtgaggacacaccaagccatttatgagggatgcacccctatgacccaaacacctcctactaggcccacctccaacatcagaggtcacatgaaacgagatgtataggggacaaaacagtcaaaccatatcagtcccaccagcaagaaggctctcactggatgtggtcccttgatcttggacttctcagcctctgtaactgtaaaaaataaattttgtttcttataaattatccggtt

SEQ ID NO: 278307 - DNA, 1184 bp, Homo sapiens
ggggctcctgttcccctaacccactgaattcagccttccagaggccgaggtggctccaccacagcttctgtccggtggtgaccagcactgatctccggagccaagggaggacccgggacacctgggagccgggaaatgttttccatggctccgagacaatgacaccgcttcagtgtgaactctcatgaattgagtctagatccccagtgctgtccgtctcacctgtcctcctctacacatatctgggatatgtcacggcttggtggtctttgaagatgtgactctgaacttcatccagaaggagtaggctttgctggatttttccgtgaagaatctgtagagatgtgatgagggaagccatcagcacctggcttctatagctgcagcccaagaggccaactggaacgttaacatcagacactaatccagctgactggacacaattgggaaaactggttattttaccaaggctttaactggaatggtgtgccttcctttaaggaatcaaatttgacttatggagccaataaagcccttggaaagctggcctcagatttcatgtacagtccctgtacagggtttccgatctgtgagattttttaaactgacaggatcatggccatttcacagacaactacccaaaaatatctacagacggcactgctcctaccaacccgataccagagaactctctgtcccctcgtcagcaggaagtagccagaaagaacatgccgcccctcgtcctttttataactatgaggtctggattgacagagcagaagcatcaccattgtggataagcgcctcattttaaaattcaccttaatcaaaaactgcctaaatccaaagggcatcagcctaatggctaaggtcagcatgatcacaaaccacaaataacatctccaaccaaaaacattccagacacctcccacagagaaatgctagcctcgggataacccctctcctgccggaaagatgtcacccccaagataaccacccctccgcccagaacattccaaccctgccacaaacttctcccccacacagaaacattccaagcttgtaataagctccctcaccctaaaaccaacgtacattcttagtctgcaaggaaaagtgctcctgactgaccagccagaatcctctctcaggtcttttctataataaacctgtctttgactgtc

SEQ ID NO: 278308 - DNA, 806 bp, Homo sapiens
ggggctcctgttcccctaacccactgaattcagccttccagaggccgaggtggctccaccacagcttctgtccggtggtgaccagcactgatctccggagccaagggaggacccgggacacctgggagccgggaaatgttttccatggctccgagacaatgacaccgcttcagtgtgaactctcatgaattgagtctagatccccagtgctgtccgtctcacctgtcctcctctacacatatctgggatatgtcacggcttggtggtctttgaagatgtgactctgaacttcatccagaaggagtaggctttgctggatttttccgtgaagaatctgtagagatgtgatgagggaagccatcagcacctggcttctatagctgcagcccaagaggccaactggaacgttaacatcagacactaatccagctgactggacacaattgggaaaactggttattttaccaaggctttaactggaatggtgtgccttcctttaaggaatcaaatttgacttatggagccaataaagcccttggaaagctggcctcagatttcatgtacagtccctgtacagggtttccgatctgtggtaagtaaagaatgtcactttctgacaggccaggagtcccaagttatcttagaacctcaagaagagaggatttctcccaactcataggtattcagtggtacaaatctatggctggccttgcctttaaaaaggtcttatctcacattccttctacaaaacaaagttccatcaaagccaatttaaaggacctaagtaacaaataattattcttgct

SEQ ID NO: 278309 - DNA, 1146 bp, Homo sapiens
ggggctcctgttcccctaacccactgaattcagccttccagaggccgaggtggctccaccacagcttctgtccggtggtgaccagcactgatctccggagccaagggaggacccgggacacctgggagccgggaaatgttttccatggctccgagacaatgacaccgcttcagtgtgaactctcatgaattgagtctagatccccagtgctgtccgtctcacctgtcctcctctacacatatctgggatatgtcacggcttggtggtctttgaagatgtgactctgaacttcatccagaaggagtaggctttgctggatttttccgtgaagaatctgtagagatgtgatgagggaagccatcagcacctggcttctatagctgcagcccaagaggccaactggaacgttaacatcagacactaatccagctgactggacacaattgggaaaactggttattttaccaaggctttaactggaatggtgtgccttcctttaaggaatcaaatttgacttatggagccaataaagcccttggaaagctggcctcagatttcatgtacagtccctgtacagggtttccgatctgtgacaactacccaaaaatatctacagacggcactgctcctaccaacccgataccagagaactctctgtcccctcgtcagcaggaagtagccagaaagaacatgccgcccctcgtcctttttataactatgaggtctggattgacagagcagaagcatcaccattgtggataagcgcctcattttaaaattcaccttaatcaaaaactgcctaaatccaaagggcatcagcctaatggctaaggtcagcatgatcacaaaccacaaataacatctccaaccaaaaacattccagacacctcccacagagaaatgctagcctcgggataacccctctcctgccggaaagatgtcacccccaagataaccacccctccgcccagaacattccaaccctgccacaaacttctcccccacacagaaacattccaagcttgtaataagctccctcaccctaaaaccaacgtacattcttagtctgcaaggaaaagtgctcctgactgaccagccagaatcctctctcaggtcttttctataataaacctgtctttgactgtc

SEQ ID NO: 278310 - DNA, 2529 bp, Homo sapiens
cggggccgggcctcggagccgggactcgcgggcggcgggcgggggcgtcgctgcgcggctggccggtgaggccgcggcatggggcgagtgcagctcttcgagatcagcctgagccacggccgcgtcgtctacagccccggggagccgttggctgggaccgtgcgcgtgcgcctgggggcaccgctgccgttccgagccatccgggtgacctgcataggttcctgcggggtctccaacaaggctaatgacacagcgtgggtagtggaggagggttacttcaacagttccctgtcgctggcagacaaggggagcctgcccgctggagagcacagcttccccttccagttcctgcttcctgccactgcacccacgtcctttgagggtcctttcgggaagatcgtgcaccaggtgagggccgccatccacacgccacggttttccaaggatcacaagtgcagcctcgtgttctatatcttgagccccttgaacctgaacagcatcccagacattgagcaacccaacgtggcctctgccaccaagaagttctcctacaagctggtgaagacgggcagcgtggtcctcacagccagcactgatctccgcggctatgtggtggggcaggcactgcagctgcatgccgacgttgagaaccagtcaggcaaggacaccagccctgtggtggccagtctgctgcagaaagtgtcctataaggccaagcgctggatccacgacgtacggaccattgcggaggtggagggtgcgggcgtcaaggcctggcggcgggcgcagtggcacgagcagatcctggtgcctgccttgccccagtcggccctgccgggctgcagcctcatccacatcgactactacttacaggtctctctgaaggcgccggaagctactgtgaccctcccggtcttcattggcaatattgctgtgaaccatgccccagtgagcccccggccaggcctggggctgcctcctggggccccacccctggtggtgccttccgcaccaccccaggaggaggctgaggctgaggctgcggctggcggcccccacttcttggaccccgtcttcctctccaccaagagccattcgcagcggcagcccctgctggccaccttgagttctgtgcctggtgcgccggagccctgccctcaggatggcagccctgcctcacacccgctgcaccctcccttgtgcatttcaacaggtgccactgtcccctactttgcagagggctccggggggccagtgcccactaccagcaccttgattcttcctccagagtacagttcttggggctacccctatggtgagtcgacagccagggcttggcagggaggggacgccaagagccccacgcagaccctgctttcttcccgcagaggccccaccgtcttatgagcagagctgcggcggcgtggaacccagcctgacccctgagagctgaccccgtgctgccttctccaggcaggcctggcctctgccctgggactggggcgcccagggcctcgtgccttctctcttggcctagcctggcccactcaggacctgcccagcctctgccagctcctctggcatccgccctcttctccctggggctggggtgggggtggcagggagctgggacctggagagacaactcctgtaaataaaacactttatttgtagagctgggcctcaccggcctcgccttgggcaccctccagcctctggcagggcctgaccctgaccccatcctgggctctgctcatgccagggcagaccctgctcctcaggtgccccctactaccctgggggcgcgctcaggctaccatgcctgggcggagccgcggggctggctccctttaacagaggacgggggctggcgctgggccttccagagccgcctaaggacacgtccttggagcccggctcatgaaatggggcctcacgcaaccttggtgtttggttaaatttgtgccttggctcctgttgcgtttaggcacccaggttcccaagcggtgtggtgtggacctcccctgctgagaaacccgctggcgcgtggaggggcttgcccaggtccctccgacaggagaccctgctccctgggccttggcccctgctagcaccactgccaggcctggctctgagggacgctgcttctcccctgcccacgtctccaaggcctgaaaggcagggttctgtggaacagcatttctcaaaggggcatcctgcagacgttccagccccaggggaggccccgtgatgctggctggcctgcctggagggtgcttccagaaacaacggagatggtggtgaagaaggctctgggttcaaattccagttctcctttagggcgaaggggtgactgtggctaggtttgtcagttaccttatctataaaatgcacaggaccaggccgggcacggtggctccctcctgtaatcccagtactttgggaggctgaggcaggtggattgcttgaggtcaggagttccagatcagcctgggcaacatagtgaaactccatctgtacaaaaaaaaa

SEQ ID NO: 278311 - DNA, 2456 bp, Homo sapiens
cggggccgggcctcggagccgggactcgcgggcggcgggcgggggcgtcgctgcgcggctggccggtgaggccgcggcatggggcgagtgcagctcttcgagatcagcctgagccacggccgcgtcgtctacagccccggggagccgttggctgggaccgtgcgcgtgcgcctgggggcaccgctgccgttccgagccatccgggtgacctgcataggttcctgcggggtctccaacaaggctaatgacacagcgtgggtagtggaggagggttacttcaacagttccctgtcgctggcagacaaggggagcctgcccgctggagagcacagcttccccttccagttcctgcttcctgccactgcacccacgtcctttgagggtcctttcgggaagatcgtgcaccaggtgagggccgccatccacacgccacggttttccaaggatcacaagtgcagcctcgtgttctatatcttgagccccttgaacctgaacagcatcccagacattgagcaacccaacgtggcctctgccaccaagaagttctcctacaagctggtgaagacgggcagcgtggtcctcacagccagcactgatctccgcggctatgtggtggggcaggcactgcagctgcatgccgacgttgagaaccagtcaggcaaggacaccagccctgtggtggccagtctgctgcagaaagtgtcctataaggccaagcgctggatccacgacgtacggaccattgcggaggtggagggtgcgggcgtcaaggcctggcggcgggcgcagtggcacgagcagatcctggtgcctgccttgccccagtcggccctgccgggctgcagcctcatccacatcgactactacttacaggtctctctgaaggcgccggaagctactgtgaccctcccggtcttcattggcaatattgctgtgaaccatgccccagtgagcccccggccaggcctggggctgcctcctggggccccacccctggtggtgccttccgcaccaccccaggaggaggctgaggctgaggctgcggctggcggcccccacttcttggaccccgtcttcctctccaccaagagccattcgcagcggcagcccctgctggccaccttgagttctgtgcctggtgcgccggagccctgccctcaggatggcagccctgcctcacacccgctgcaccctcccttgtgcatttcaacaggtgccactgtcccctactttgcagagggctccggggggccagtgcccactaccagcaccttgattcttcctccagagtacagttcttggggctacccctatgaggccccaccgtcttatgagcagagctgcggcggcgtggaacccagcctgacccctgagagctgaccccgtgctgccttctccaggcaggcctggcctctgccctgggactggggcgcccagggcctcgtgccttctctcttggcctagcctggcccactcaggacctgcccagcctctgccagctcctctggcatccgccctcttctccctggggctggggtgggggtggcagggagctgggacctggagagacaactcctgtaaataaaacactttatttgtagagctgggcctcaccggcctcgccttgggcaccctccagcctctggcagggcctgaccctgaccccatcctgggctctgctcatgccagggcagaccctgctcctcaggtgccccctactaccctgggggcgcgctcaggctaccatgcctgggcggagccgcggggctggctccctttaacagaggacgggggctggcgctgggccttccagagccgcctaaggacacgtccttggagcccggctcatgaaatggggcctcacgcaaccttggtgtttggttaaatttgtgccttggctcctgttgcgtttaggcacccaggttcccaagcggtgtggtgtggacctcccctgctgagaaacccgctggcgcgtggaggggcttgcccaggtccctccgacaggagaccctgctccctgggccttggcccctgctagcaccactgccaggcctggctctgagggacgctgcttctcccctgcccacgtctccaaggcctgaaaggcagggttctgtggaacagcatttctcaaaggggcatcctgcagacgttccagccccaggggaggccccgtgatgctggctggcctgcctggagggtgcttccagaaacaacggagatggtggtgaagaaggctctgggttcaaattccagttctcctttagggcgaaggggtgactgtggctaggtttgtcagttaccttatctataaaatgcacaggaccaggccgggcacggtggctccctcctgtaatcccagtactttgggaggctgaggcaggtggattgcttgaggtcaggagttccagatcagcctgggcaacatagtgaaactccatctgtacaaaaaaaaa

SEQ ID NO: 278312 - DNA, 2252 bp, Homo sapiens
cggggccgggcctcggagccgggactcgcgggcggcgggcgggggcgtcgctgcgcggctggccggtgaggccgcggcatggggcgagtgcagctcttcgagatcagcctgagccacggccgcgtcgtctacagccccggggagccgttggctgggaccgtgcgcgtgcgcctgggggcaccgctgccgttccgagccatccgggtgacctgcataggttcctgcggggtctccaacaaggctaatgacacagcgtgggtagtggaggagggttacttcaacagttccctgtcgctggcagacaaggggagcctgcccgctggagagcacagcttccccttccagttcctgcttcctgccactgcacccacgtcctttgagggtcctttcgggaagatcgtgcaccaggtgagggccgccatccacacgccacggttttccaaggatcacaagtgcagcctcgtgttctatatcttgagccccttgaacctgaacagcatcccagacattgagcaacccaacgtggcctctgccaccaagaagttctcctacaagctggtgaagacgggcagcgtggtcctcacagccagcactgatctccgcggctatgtggtggggcaggcactgcagctgcatgccgacgttgagaaccagtcaggcaaggacaccagccctgtggtggccagtctgctgcagaaagtgtcctataaggccaagcgctggatccacgacgtacggaccattgcggaggtggagggtgcgggcgtcaaggcctggcggcgggcgcagtggcacgagcagatcctggtgcctgccttgccccagtcggccctgccgggctgcagcctcatccacatcgactactacttacaggtctctctgaaggcgccggaagctactgtgaccctcccggtcttcattggcaatattgctgtgaaccatgccccagtgagcccccggccaggcctggggctgcctcctggggccccacccctggtggtgccttccgcaccaccccaggaggaggctgaggctgaggctgcggctggcggcccccacttcttggaccccgtcttcctctccaccaagagccattcgcagcggcagcccctgctggccaccttgagttctgtgcctggtgcgccggagccctgccctcaggatggcagccctgcctcacacccgctgcaccctcccttgtgcatttcaacaggtgccactgtcccctactttgcagagggctccggggggccagtgcccactaccagcaccttgattcttcctccagagtacagttcttggggctacccctatggtgagtcgacagccagggcttggcagggagggagctgggacctggagagacaactcctgtaaataaaacactttatttgtagagctgggcctcaccggcctcgccttgggcaccctccagcctctggcagggcctgaccctgaccccatcctgggctctgctcatgccagggcagaccctgctcctcaggtgccccctactaccctgggggcgcgctcaggctaccatgcctgggcggagccgcggggctggctccctttaacagaggacgggggctggcgctgggccttccagagccgcctaaggacacgtccttggagcccggctcatgaaatggggcctcacgcaaccttggtgtttggttaaatttgtgccttggctcctgttgcgtttaggcacccaggttcccaagcggtgtggtgtggacctcccctgctgagaaacccgctggcgcgtggaggggcttgcccaggtccctccgacaggagaccctgctccctgggccttggcccctgctagcaccactgccaggcctggctctgagggacgctgcttctcccctgcccacgtctccaaggcctgaaaggcagggttctgtggaacagcatttctcaaaggggcatcctgcagacgttccagccccaggggaggccccgtgatgctggctggcctgcctggagggtgcttccagaaacaacggagatggtggtgaagaaggctctgggttcaaattccagttctcctttagggcgaaggggtgactgtggctaggtttgtcagttaccttatctataaaatgcacaggaccaggccgggcacggtggctccctcctgtaatcccagtactttgggaggctgaggcaggtggattgcttgaggtcaggagttccagatcagcctgggcaacatagtgaaactccatctgtacaaaaaaaaa

SEQ ID NO: 278313 - DNA, 2111 bp, Homo sapiens
cggggccgggcctcggagccgggactcgcgggcggcgggcgggggcgtcgctgcgcggctggccggtgaggccgcggcatggggcgagtgcagctcttcgagatcagcctgagccacggccgcgtcgtctacagccccggggagccgttggctgggaccgtgcgcgtgcgcctgggggcaccgctgccgttccgagccatccgggtgacctgcataggttcctgcggggtctccaacaaggctaatgacacagcgtgggtagtggaggagggttacttcaacagttccctgtcgctggcagacaaggggagcctgcccgctggagagcacagcttccccttccagttcctgcttcctgccactgcacccacgtcctttgagggtcctttcgggaagatcgtgcaccaggtgagggccgccatccacacgccacggttttccaaggatcacaagtgcagcctcgtgttctatatcttgagccccttgaacctgaacagcatcccagacattgagcaacccaacgtggcctctgccaccaagaagttctcctacaagctggtgaagacgggcagcgtggtcctcacagccagcactgatctccgcggctatgtggtggggcaggcactgcagctgcatgccgacgttgagaaccagtcaggcaaggacaccagccctgtggtggccagtctgctgcagaaagtgtcctataaggccaagcgctggatccacgacgtacggaccattgcggaggtggagggtgcgggcgtcaaggcctggcggcgggcgcagtggcacgagcagatcctggtgcctgccttgccccagtcggccctgccgggctgcagcctcatccacatcgactactacttacaggtctctctgaaggcgccggaagctactgtgaccctcccggtcttcattggcaatattgctgtgaaccatgccccagtgagcccccggccaggcctggggctgcctcctggggccccacccctggtggtgccttccgcaccaccccaggaggaggctgaggctgaggctgcggctggcggcccccacttcttggaccccgtcttcctctccaccaagagccattcgcagcggcagcccctgctggccaccttgagttctgtgcctggtgcgccggagccctgccctcaggatggcagccctgcctcacacccgctgcaccctcccttgtgcatttcaacaggtgccactgtcccctactttgcagagggctccggggggccagtgcccactaccagcaccttgattcttcctccagagtacagttcttggggctacccctatggtgagtcgacagccagggcttggcagggaggggacgccaagagccccacgcagaccctgctttcttcccgcagaggccccaccgtcttatgagcagagctgcggcggcgtggaacccagcctgacccctgagagctgaccccgtgctgccttctccaggcaggcctggcctctgccctgggactggggcgcccagggcctcgtgccttctctcttggcctagcctggcccactcaggacctgcccagcctctgccagctcctctggcatccgccctcttctccctggggctggggtgggggtggcagggagctgggacctggagagacaactcctgtaaataaaacactttatttgtagagctgggcctcaccggcctcgccttgggcaccctccagcctctggcagggcctgaccctgaccccatcctgggctctgctcatgccagggcagaccctgctcctcaggtgccccctactaccctgggggcgcgctcaggctaccatgcctgggcggagccgcggggtggcctgcctggagggtgcttccagaaacaacggagatggtggtgaagaaggctctgggttcaaattccagttctcctttagggcgaaggggtgactgtggctaggtttgtcagttaccttatctataaaatgcacaggaccaggccgggcacggtggctccctcctgtaatcccagtactttgggaggctgaggcaggtggattgcttgaggtcaggagttccagatcagcctgggcaacatagtgaaactccatctgtacaaaaaaaaa

SEQ ID NO: 278314 - DNA, 2302 bp, Homo sapiens
cggggccgggcctcggagccgggactcgcgggcggcgggcgggggcgtcgctgcgcggctggccggtgaggccgcggcatggggcgagtgcagctcttcgagatcagcctgagccacggccgcgtcgtctacagccccggggagccgttggctgggaccgtgcgcgtgcgcctgggggcaccgctgccgttccgagccatccgggtgacctgcataggttcctgcggggtctccaacaaggctaatgacacagcgtgggtagtggaggagggttacttcaacagttccctgtcgctggcagacaaggggagcctgcccgctggagagcacagcttccccttccagttcctgcttcctgccactgcacccacgtcctttgagggtcctttcgggaagatcgtgcaccaggtgagggccgccatccacacgccacggttttccaaggatcacaagtgcagcctcgtgttctatatcttgagccccttgaacctgaacagcatcccagacattgagcaacccaacgtggcctctgccaccaagaagttctcctacaagctggtgaagacgggcagcgtggtcctcacagccagcactgatctccgcggctatgtggtggggcaggcactgcagctgcatgccgacgttgagaaccagtcaggcaaggacaccagccctgtggtggccagtctgctgcagaaagtgtcctataaggccaagcgctggatccacgacgtacggaccattgcggaggtggagggtgcgggcgtcaaggcctggcggcgggcgcagtggcacgagcagatcctggtgcctgccttgccccagtcggccctgccgggctgcagcctcatccacatcgactactacttacaggtctctctgaaggcgccggaagctactgtgaccctcccggtcttcattggcaatattgctgtgaaccatgccccagtgagcccccggccaggcctggggctgcctcctggggccccacccctggtggtgccttccgcaccaccccaggaggaggctgaggctgaggctgcggctggcggcccccacttcttggaccccgtcttcctctccaccaagagccattcgcagcggcagcccctgctggccaccttgagttctgtgcctggtgcgccggagccctgccctcaggatggcagccctgcctcacacccgctgcaccctcccttgtgcatttcaacaggtgccactgtcccctactttgcagagggctccggggggccagtgcccactaccagcaccttgattcttcctccagagtacagttcttggggctacccctatggtgagtcgacagccagggcttggcagggaggggacgccaagagccccacgcagaccctgctttcttcccgcagaggccccaccgtcttatgagcagagctgcggcggcgtggaacccagcctgacccctgagagctgaccccgtgctgccttctccaggcaggcctggcctctgccctgggactggggcgcccagggcctcgtgccttctctcttggcctagcctggcccactcaggacctgcccagcctctgccagctcctctggcatccgccctcttctccctggggctggggtgggggtggcagggagctgggacctggagagacaactcctgtaaataaaacactttatttgtagaaaaaaaaaaaaagaaaaaaaaaaaataaaaaaaaaaaaaaaaaaaaaaaaaaaaaagaggggggggggcgcccccaaaaaaaccccccggggggcgccccattccgcgcccccccccttttttgtgtaacacagggggcgccccccaaatgagggaggccactgtattataaatagagcgacagcacgagcggggccgcgcgggtttaaacaacaacgcgtcgcggcatgcgctgggaaaacaacgtgcgactcaccgtgaagaaacctcgtgtgaggagaaagacagcaccaccctaaatcatcgcggggggcgaggcagaccacacatatagagtgtggcgacgacacagacaacttaccacctctacaacagcgagagcattatatacagcgcgcgctctctcaagggggggagacaatatcatatcaaaaaaagcttgttacgaaagggggtagctatactacgcggggtcggtagacacacctaatacgcgcggtcgataaatataggggcacgcagcgtcggtagggaaacaaagtttgtggcgcacaccacagcgggagcagtagatagaactttattggaacaagaacatatcttttatactaaccaccgagaggcgcg

SEQ ID NO: 278315 - DNA, 3876 bp, Homo sapiens
cctgctgctctgggtggcaggcagaaggcctgggccacaggtggggcctgctggggagaccacaggtgaggcaggtatggctgaccctgggcgctcggcacaccggtactcctcctgcctggctgctccctcagcaggtgtcagagtctgagtcaccttttcctcacgtgacccccaccaggaccaggcagggaggtggccatctttggccctgactcagccctgcagggagaagaggggctggaggtgcaggtggcctgccactgtctcccccaacccctgcccacctgggtcttgtgctgtgtgtacttctgctgcgtctgtcctcccttgtgaccagcttctgctggacctgattgtccagccatgatcttctgatcatcatggtttctggacacacatctgttggactaaggaatttgtgttcctggccacagaacagtgccacctctgcctcaagcagttcctggtctgggcactcccccagggaggccggagaggactgagccgtctcctgatgcagaaagtcagccccgctgggcagtgctcgcccaggaagtagggccccacccaacggtgtgctgactgtggaacactgtgtctgcctaggcgggtctggccacattcctgcagcatgatggttggcagttagcttcctggagtgtggacgggtccttccctgcctgactgacttgtccacagggcagcaagaagatgcgccccttggtgtgtcccgagtgtctcctgtaggcagctgagctttcgcaggtctggctgggagccaaggttaccaatctggggggtaacccagccatcatctggatgagcgttggggtctttctgctctggattgcagggcagacgtcgttttgtgctggtcaggcccctcgcctgcctgattcccttggagccccccaagacaggagatgggcagatgtcctctgaagtggcatgggctgcttgctcactggccttcccaggaccctgcccaggtggtgctgcttggccccaggtcgaattcctgtgctggcagcaagcaggggcctgggccgtcggctggctggggctcatgcagccatcccctttgcagccatccgggtgacctgcataggttcctgcggggtctccaacaaggctaatgacacagcgtgggtagtggaggagggttacttcaacagttccctgtcgctggcagacaagggtaagtttgggagccagttcccgagtggtgacccctgggggcagcccttggagtggggcctgtctgtcctgtcctccccctttcctagatctgcctcttggatctggcactggcccatcttgtcccagggttgtgggccctgatggctttctcataggcgctgggtggctgaaggggccacctcccccttgtgctggatttgggtgggctctgacccctggcacagctgtttcacccttgccccattcccaaaccactctcctgttcaagccaagctcttatcctcagtccttcacccaagccacagccctgtgctgctgtggcgctggtgactgagacagggagacccagtgtgagctggtcagctgcagtgcccactcttatcctggccctgtggccacctcaggccacctcagggggggactgccccccacctccctcctgtctctgcagggagcctgcccgctggagagcacagcttccccttccagttcctgcttcctgccactgcacccacgtcctttgagggtcctttcgggaagatcgtgcaccaggtgagggccgccatccacacgccacggttttccaaggatcacaagtgcagcctcgtgttctatatcttgagccccttgaacctgaacagcatcccagacattgagcaacccaacgtggcctctgccaccaagaagttctcctacaagctggtgaagacgggcagcgtggtcctcacagccagcactgatctccgcggctatgtggtggggcaggcactgcagctgcatgccgacgttgagaaccagtcaggcaaggacaccagccctgtggtggccagtctgctgcagaaagtgtcctataaggccaagcgctggatccacgacgtacggaccattgcggaggtggagggtgcgggcgtcaaggcctggcggcgggcgcagtggcacgagcagatcctggtgcctgccttgccccagtcggccctgccgggctgcagcctcatccacatcgactactacttacaggtctctctgaaggcgccggaagctactgtgaccctcccggtcttcattggcaatattgctgtgaaccatgccccagtgagcccccggccaggcctggggctgcctcctggggccccacccctggtggtgccttccgcaccaccccaggaggaggctgaggctgaggctgcggctggcggcccccacttcttggaccccgtcttcctctccaccaagagccattcgcagcggcagcccctgctggccaccttgagttctgtgcctggtgcgccggagccctgccctcaggatggcagccctgcctcacacccgctgcaccctcccttgtgcatttcaacaggtgccactgtcccctactttgcagagggctccggggggccagtgcccactaccagcaccttgattcttcctccagagtacagttcttggggctacccctatggtgagtcgacagccagggcttggcagggaggggacgccaagagccccacgcagaccctgctttcttcccgcagaggccccaccgtcttatgagcagagctgcggcggcgtggaacccagcctgacccctgagagctgaccccgtgctgccttctccaggcaggcctggcctctgccctgggactggggcgcccagggcctcgtgccttctctcttggcctagcctggcccactcaggacctgcccagcctctgccagctcctctggcatccgccctcttctccctggggctggggtgggggtggcagggagctgggacctggagagacaactcctgtaaataaaacactttatttgtagagctgggcctcaccggcctcgccttgggcaccctccagcctctggcagggcctgaccctgaccccatcctgggctctgctcatgccagggcagaccctgctcctcaggtgccccctactaccctgggggcgcgctcaggctaccatgcctgggcggagccgcggggctggctccctttaacagaggacgggggctggcgctgggccttccagagccgcctaaggacacgtccttggagcccggctcatgaaatggggcctcacgcaaccttggtgtttggttaaatttgtgccttggctcctgttgcgtttaggcacccaggttcccaagcggtgtggtgtggacctcccctgctgagaaacccgctggcgcgtggaggggcttgcccaggtccctccgacaggagaccctgctccctgggccttggcccctgctagcaccactgccaggcctggctctgagggacgctgcttctcccctgcccacgtctccaaggcctgaaaggcagggttctgtggaacagcatttctcaaaggggcatcctgcagacgttccagccccaggggaggccccgtgatgctggctggcctgcctggagggtgcttccagaaacaacggagatggtggtgaagaaggctctgggttcaaattccagttctcctttagggcgaaggggtgactgtggctaggtttgtcagttaccttatctataaaatgcacaggaccaggccgggcacggtggctccctcctgtaatcccagtactttgggaggctgaggcaggtggattgcttgaggtcaggagttccagatcagcctgggcaacatagtgaaactccatctgtacaaaaaaaaa

SEQ ID NO: 278316 - DNA, 2951 bp, Homo sapiens
gcaggctgtactggctcccaagttccttatgagtgtgaggccgcggcatggggcgagtgcagctcttcgagatcagcctgagccacggccgcgtcgtctacagccccggggagccgttggctgggaccgtgcgcgtgcgcctgggggcaccgctgccgttccgagccatccgggtgacctgcataggttcctgcggggtctccaacaaggctaatgacacagcgtgggtagtggaggagggttacttcaacagttccctgtcgctggcagacaagggtaagtttgggagccagttcccgagtggtgacccctgggggcagcccttggagtggggcctgtctgtcctgtcctccccctttcctagatctgcctcttggatctggcactggcccatcttgtcccagggttgtgggccctgatggctttctcataggcgctgggtggctgaaggggccacctcccccttgtgctggatttgggtgggctctgacccctggcacagctgtttcacccttgccccattcccaaaccactctcctgttcaagccaagctcttatcctcagtccttcacccaagccacagccctgtgctgctgtggcgctggtgactgagacagggagacccagtgtgagctggtcagctgcagtgcccactcttatcctggccctgtggccacctcaggccacctcagggggggactgccccccacctccctcctgtctctgcagggagcctgcccgctggagagcacagcttccccttccagttcctgcttcctgccactgcacccacgtcctttgagggtcctttcgggaagatcgtgcaccaggtgagggccgccatccacacgccacggttttccaaggatcacaagtgcagcctcgtgttctatatcttgagccccttgaacctgaacagcatcccagacattgagcaacccaacgtggcctctgccaccaagaagttctcctacaagctggtgaagacgggcagcgtggtcctcacagccagcactgatctccgcggctatgtggtggggcaggcactgcagctgcatgccgacgttgagaaccagtcaggcaaggacaccagccctgtggtggccagtctgctgcagaaagtgtcctataaggccaagcgctggatccacgacgtacggaccattgcggaggtggagggtgcgggcgtcaaggcctggcggcgggcgcagtggcacgagcagatcctggtgcctgccttgccccagtcggccctgccgggctgcagcctcatccacatcgactactacttacaggtctctctgaaggcgccggaagctactgtgaccctcccggtcttcattggcaatattgctgtgaaccatgccccagtgagcccccggccaggcctggggctgcctcctggggccccacccctggtggtgccttccgcaccaccccaggaggaggctgaggctgaggctgcggctggcggcccccacttcttggaccccgtcttcctctccaccaagagccattcgcagcggcagcccctgctggccaccttgagttctgtgcctggtgcgccggagccctgccctcaggatggcagccctgcctcacacccgctgcaccctcccttgtgcatttcaacaggtgccactgtcccctactttgcagagggctccggggggccagtgcccactaccagcaccttgattcttcctccagagtacagttcttggggctacccctatggtgagtcgacagccagggcttggcagggaggggacgccaagagccccacgcagaccctgctttcttcccgcagaggccccaccgtcttatgagcagagctgcggcggcgtggaacccagcctgacccctgagagctgaccccgtgctgccttctccaggcaggcctggcctctgccctgggactggggcgcccagggcctcgtgccttctctcttggcctagcctggcccactcaggacctgcccagcctctgccagctcctctggcatccgccctcttctccctggggctggggtgggggtggcagggagctgggacctggagagacaactcctgtaaataaaacactttatttgtagagctgggcctcaccggcctcgccttgggcaccctccagcctctggcagggcctgaccctgaccccatcctgggctctgctcatgccagggcagaccctgctcctcaggtgccccctactaccctgggggcgcgctcaggctaccatgcctgggcggagccgcggggctggctccctttaacagaggacgggggctggcgctgggccttccagagccgcctaaggacacgtccttggagcccggctcatgaaatggggcctcacgcaaccttggtgtttggttaaatttgtgccttggctcctgttgcgtttaggcacccaggttcccaagcggtgtggtgtggacctcccctgctgagaaacccgctggcgcgtggaggggcttgcccaggtccctccgacaggagaccctgctccctgggccttggcccctgctagcaccactgccaggcctggctctgagggacgctgcttctcccctgcccacgtctccaaggcctgaaaggcagggttctgtggaacagcatttctcaaaggggcatcctgcagacgttccagccccaggggaggccccgtgatgctggctggcctgcctggagggtgcttccagaaacaacggagatggtggtgaagaaggctctgggttcaaattccagttctcctttagggcgaaggggtgactgtggctaggtttgtcagttaccttatctataaaatgcacaggaccaggccgggcacggtggctccctcctgtaatcccagtactttgggaggctgaggcaggtggattgcttgaggtcaggagttccagatcagcctgggcaacatagtgaaactccatctgtacaaaaaaaaa

SEQ ID NO: 278317 - DNA, 4138 bp, Homo sapiens
cctgctgctctgggtggcaggcagaaggcctgggccacaggtggggcctgctggggagaccacaggtgaggcaggtatggctgaccctgggcgctcggcacaccggtactcctcctgcctggctgctccctcagcaggtgtcagagtctgagtcaccttttcctcacgtgacccccaccaggaccaggcagggaggtggccatctttggccctgactcagccctgcagggagaagaggggctggaggtgcaggtggcctgccactgtctcccccaacccctgcccacctgggtcttgtgctgtgtgtacttctgctgcgtctgtcctcccttgtgaccagcttctgctggacctgattgtccagccatgatcttctgatcatcatggtttctggacacacatctgttggactaaggaatttgtgttcctggccacagaacagtgccacctctgcctcaagcagttcctggtctgggcactcccccagggaggccggagaggactgagccgtctcctgatgcagaaagtcagccccgctgggcagtgctcgcccaggaagtagggccccacccaacggtgtgctgactgtggaacactgtgtctgcctaggcgggtctggccacattcctgcagcatgatggttggcagttagcttcctggagtgtggacgggtccttccctgcctgactgacttgtccacagggcagcaagaagatgcgccccttggtgtgtcccgagtgtctcctgtaggcagctgagctttcgcaggtctggctgggagccaaggttaccaatctggggggtaacccagccatcatctggatgagcgttggggtctttctgctctggattgcagggcagacgtcgttttgtgctggtcaggcccctcgcctgcctgattcccttggagccccccaagacaggagatgggcagatgtcctctgaagtggcatgggctgcttgctcactggccttcccaggaccctgcccaggtggtgctgcttggccccaggtcgaattcctgtgctggcagcaagcaggggcctgggccgtcggctggctggggctcatgcagccatcccctttgcagccatccgggtgacctgcataggttcctgcggggtctccaacaaggctaatgacacagcgtgggtagtggaggagggttacttcaacagttccctgtcgctggcagacaagggtaagtttgggagccagttcccgagtggtgacccctgggggcagcccttggagtggggcctgtctgtcctgtcctccccctttcctagatctgcctcttggatctggcactggcccatcttgtcccagggttgtgggccctgatggctttctcataggcgctgggtggctgaaggggccacctcccccttgtgctggatttgggtgggctctgacccctggcacagctgtttcacccttgccccattcccaaaccactctcctgttcaagccaagctcttatcctcagtccttcacccaagccacagccctgtgctgctgtggcgctggtgactgagacagggagacccagtgtgagctggtcagctgcagtgcccactcttatcctggccctgtggccacctcaggccacctcagggggggactgccccccacctccctcctgtctctgcagggagcctgcccgctggagagcacagcttccccttccagttcctgcttcctgccactgcacccacgtcctttgagggtcctttcgggaagatcgtgcaccaggtgagggccgccatccacacgccacggttttccaaggatcacaagtgcagcctcgtgttctatatcttgagccccttgaacctgaacagcatcccagacattgaggtgaggatggcacagtgacctccttggtgggtccccaccctcatggaggctggggaagagctgggcaggcactgcttcatcccagcgtcctgtccccagctgaggtgaggggggccagggtctggaggcagtggcctctttgccctgagctgactgctgatgtccaggggcagggcgtggcagggctgaggggcctgtcccaatgccacagggatccagcctgcgcacacctgctaagcccctccctggccctccccccaagcaacccaacgtggcctctgccaccaagaagttctcctacaagctggtgaagacgggcagcgtggtcctcacagccagcactgatctccgcggctatgtggtggggcaggcactgcagctgcatgccgacgttgagaaccagtcaggcaaggacaccagccctgtggtggccagtctgctgcagaaagtgtcctataaggccaagcgctggatccacgacgtacggaccattgcggaggtggagggtgcgggcgtcaaggcctggcggcgggcgcagtggcacgagcagatcctggtgcctgccttgccccagtcggccctgccgggctgcagcctcatccacatcgactactacttacaggtctctctgaaggcgccggaagctactgtgaccctcccggtcttcattggcaatattgctgtgaaccatgccccagtgagcccccggccaggcctggggctgcctcctggggccccacccctggtggtgccttccgcaccaccccaggaggaggctgaggctgaggctgcggctggcggcccccacttcttggaccccgtcttcctctccaccaagagccattcgcagcggcagcccctgctggccaccttgagttctgtgcctggtgcgccggagccctgccctcaggatggcagccctgcctcacacccgctgcaccctcccttgtgcatttcaacaggtgccactgtcccctactttgcagagggctccggggggccagtgcccactaccagcaccttgattcttcctccagagtacagttcttggggctacccctatggtgagtcgacagccagggcttggcagggaggggacgccaagagccccacgcagaccctgctttcttcccgcagaggccccaccgtcttatgagcagagctgcggcggcgtggaacccagcctgacccctgagagctgaccccgtgctgccttctccaggcaggcctggcctctgccctgggactggggcgcccagggcctcgtgccttctctcttggcctagcctggcccactcaggacctgcccagcctctgccagctcctctggcatccgccctcttctccctggggctggggtgggggtggcagggagctgggacctggagagacaactcctgtaaataaaacactttatttgtagagctgggcctcaccggcctcgccttgggcaccctccagcctctggcagggcctgaccctgaccccatcctgggctctgctcatgccagggcagaccctgctcctcaggtgccccctactaccctgggggcgcgctcaggctaccatgcctgggcggagccgcggggctggctccctttaacagaggacgggggctggcgctgggccttccagagccgcctaaggacacgtccttggagcccggctcatgaaatggggcctcacgcaaccttggtgtttggttaaatttgtgccttggctcctgttgcgtttaggcacccaggttcccaagcggtgtggtgtggacctcccctgctgagaaacccgctggcgcgtggaggggcttgcccaggtccctccgacaggagaccctgctccctgggccttggcccctgctagcaccactgccaggcctggctctgagggacgctgcttctcccctgcccacgtctccaaggcctgaaaggcagggttctgtggaacagcatttctcaaaggggcatcctgcagacgttccagccccaggggaggccccgtgatgctggctggcctgcctggagggtgcttccagaaacaacggagatggtggtgaagaaggctctgggttcaaattccagttctcctttagggcgaaggggtgactgtggctaggtttgtcagttaccttatctataaaatgcacaggaccaggccgggcacggtggctccctcctgtaatcccagtactttgggaggctgaggcaggtggattgcttgaggtcaggagttccagatcagcctgggcaacatagtgaaactccatctgtacaaaaaaaaa

SEQ ID NO: 278318 - DNA, 2951 bp, Homo sapiens
cctgctgctctgggtggcaggcagaaggcctgggccacaggtggggcctgctggggagaccacaggtgaggcaggtatggctgaccctgggcgctcggcacaccggtactcctcctgcctggctgctccctcagcaggtgtcagagtctgagtcaccttttcctcacgtgacccccaccaggaccaggcagggaggtggccatctttggccctgactcagccctgcagggagaagaggggctggaggtgcaggtggcctgccactgtctcccccaacccctgcccacctgggtcttgtgctgtgtgtacttctgctgcgtctgtcctcccttgtgaccagcttctgctggacctgattgtccagccatgatcttctgatcatcatggtttctggacacacatctgttggactaaggaatttgtgttcctggccacagaacagtgccacctctgcctcaagcagttcctggtctgggcactcccccagggaggccggagaggactgagccgtctcctgatgcagaaagtcagccccgctgggcagtgctcgcccaggaagtagggccccacccaacggtgtgctgactgtggaacactgtgtctgcctaggcgggtctggccacattcctgcagcatgatggttggcagttagcttcctggagtgtggacgggtccttccctgcctgactgacttgtccacagggcagcaagaagatgcgccccttgccatccgggtgacctgcataggttcctgcggggtctccaacaaggctaatgacacagcgtgggtagtggaggagggttacttcaacagttccctgtcgctggcagacaaggggagcctgcccgctggagagcacagcttccccttccagttcctgcttcctgccactgcacccacgtcctttgagggtcctttcgggaagatcgtgcaccaggtgagggccgccatccacacgccacggttttccaaggatcacaagtgcagcctcgtgttctatatcttgagccccttgaacctgaacagcatcccagacattgaggcactgcagctgcatgccgacgttgagaaccagtcaggcaaggacaccagccctgtggtggccagtctgctgcagaaagtgtcctataaggccaagcgctggatccacgacgtacggaccattgcggaggtggagggtgcgggcgtcaaggcctggcggcgggcgcagtggcacgagcagatcctggtgcctgccttgccccagtcggccctgccgggctgcagcctcatccacatcgactactacttacaggtctctctgaaggcgccggaagctactgtgaccctcccggtcttcattggcaatattgctgtgaaccatgccccagtgagcccccggccaggcctggggctgcctcctggggccccacccctggtggtgccttccgcaccaccccaggaggaggctgaggctgaggctgcggctggcggcccccacttcttggaccccgtcttcctctccaccaagagccattcgcagcggcagcccctgctggccaccttgagttctgtgcctggtgcgccggagccctgccctcaggatggcagccctgcctcacacccgctgcaccctcccttgtgcatttcaacaggtgccactgtcccctactttgcagagggctccggggggccagtgcccactaccagcaccttgattcttcctccagagtacagttcttggggctacccctatggtgagtcgacagccagggcttggcagggaggggacgccaagagccccacgcagaccctgctttcttcccgcagaggccccaccgtcttatgagcagagctgcggcggcgtggaacccagcctgacccctgagagctgaccccgtgctgccttctccaggcaggcctggcctctgccctgggactggggcgcccagggcctcgtgccttctctcttggcctagcctggcccactcaggacctgcccagcctctgccagctcctctggcatccgccctcttctccctggggctggggtgggggtggcagggagctgggacctggagagacaactcctgtaaataaaacactttatttgtagagctgggcctcaccggcctcgccttgggcaccctccagcctctggcagggcctgaccctgaccccatcctgggctctgctcatgccagggcagaccctgctcctcaggtgccccctactaccctgggggcgcgctcaggctaccatgcctgggcggagccgcggggctggctccctttaacagaggacgggggctggcgctgggccttccagagccgcctaaggacacgtccttggagcccggctcatgaaatggggcctcacgcaaccttggtgtttggttaaatttgtgccttggctcctgttgcgtttaggcacccaggttcccaagcggtgtggtgtggacctcccctgctgagaaacccgctggcgcgtggaggggcttgcccaggtccctccgacaggagaccctgctccctgggccttggcccctgctagcaccactgccaggcctggctctgagggacgctgcttctcccctgcccacgtctccaaggcctgaaaggcagggttctgtggaacagcatttctcaaaggggcatcctgcagacgttccagccccaggggaggccccgtgatgctggctggcctgcctggagggtgcttccagaaacaacggagatggtggtgaagaaggctctgggttcaaattccagttctcctttagggcgaaggggtgactgtggctaggtttgtcagttaccttatctataaaatgcacaggaccaggccgggcacggtggctccctcctgtaatcccagtactttgggaggctgaggcaggtggattgcttgaggtcaggagttccagatcagcctgggcaacatagtgaaactccatctgtacaaaaaaaaa

SEQ ID NO: 278319 - DNA, 2760 bp, Homo sapiens
gcaggctgtactggctcccaagttccttatgagtgtgaggccgcggcatggggcgagtgcagctcttcgagatcagcctgagccacggccgcgtcgtctacagccccggggagccgttggctgggaccgtgcgcgtgcgcctgggggcaccgctgccgttccgagccatccgggtgacctgcataggttcctgcggggtctccaacaaggctaatgacacagcgtgggtagtggaggagggttacttcaacagttccctgtcgctggcagacaaggggagcctgcccgctggagagcacagcttccccttccagttcctgcttcctgccactgcacccacgtcctttgagggtcctttcgggaagatcgtgcaccaggtgagggccgccatccacacgccacggttttccaaggatcacaagtgcagcctcgtgttctatatcttgagccccttgaacctgaacagcatcccagacattgaggtgaggatggcacagtgacctccttggtgggtccccaccctcatggaggctggggaagagctgggcaggcactgcttcatcccagcgtcctgtccccagctgaggtgaggggggccagggtctggaggcagtggcctctttgccctgagctgactgctgatgtccaggggcagggcgtggcagggctgaggggcctgtcccaatgccacagggatccagcctgcgcacacctgctaagcccctccctggccctccccccaagcaacccaacgtggcctctgccaccaagaagttctcctacaagctggtgaagacgggcagcgtggtcctcacagccagcactgatctccgcggctatgtggtggggcaggcactgcagctgcatgccgacgttgagaaccagtcaggcaaggacaccagccctgtggtggccagtctgctgcagaaagtgtcctataaggccaagcgctggatccacgacgtacggaccattgcggaggtggagggtgcgggcgtcaaggcctggcggcgggcgcagtggcacgagcagatcctggtgcctgccttgccccagtcggccctgccgggctgcagcctcatccacatcgactactacttacaggtctctctgaaggcgccggaagctactgtgaccctcccggtcttcattggcaatattgctgtgaaccatgccccagtgagcccccggccaggcctggggctgcctcctggggccccacccctggtggtgccttccgcaccaccccaggaggaggctgaggctgaggctgcggctggcggcccccacttcttggaccccgtcttcctctccaccaagagccattcgcagcggcagcccctgctggccaccttgagttctgtgcctggtgcgccggagccctgccctcaggatggcagccctgcctcacacccgctgcaccctcccttgtgcatttcaacaggtgccactgtcccctactttgcagagggctccggggggccagtgcccactaccagcaccttgattcttcctccagagtacagttcttggggctacccctatggtgagtcgacagccagggcttggcagggaggggacgccaagagccccacgcagaccctgctttcttcccgcagaggccccaccgtcttatgagcagagctgcggcggcgtggaacccagcctgacccctgagagctgaccccgtgctgccttctccaggcaggcctggcctctgccctgggactggggcgcccagggcctcgtgccttctctcttggcctagcctggcccactcaggacctgcccagcctctgccagctcctctggcatccgccctcttctccctggggctggggtgggggtggcagggagctgggacctggagagacaactcctgtaaataaaacactttatttgtagagctgggcctcaccggcctcgccttgggcaccctccagcctctggcagggcctgaccctgaccccatcctgggctctgctcatgccagggcagaccctgctcctcaggtgccccctactaccctgggggcgcgctcaggctaccatgcctgggcggagccgcggggctggctccctttaacagaggacgggggctggcgctgggccttccagagccgcctaaggacacgtccttggagcccggctcatgaaatggggcctcacgcaaccttggtgtttggttaaatttgtgccttggctcctgttgcgtttaggcacccaggttcccaagcggtgtggtgtggacctcccctgctgagaaacccgctggcgcgtggaggggcttgcccaggtccctccgacaggagaccctgctccctgggccttggcccctgctagcaccactgccaggcctggctctgagggacgctgcttctcccctgcccacgtctccaaggcctgaaaggcagggttctgtggaacagcatttctcaaaggggcatcctgcagacgttccagccccaggggaggccccgtgatgctggctggcctgcctggagggtgcttccagaaacaacggagatggtggtgaagaaggctctgggttcaaattccagttctcctttagggcgaaggggtgactgtggctaggtttgtcagttaccttatctataaaatgcacaggaccaggccgggcacggtggctccctcctgtaatcccagtactttgggaggctgaggcaggtggattgcttgaggtcaggagttccagatcagcctgggcaacatagtgaaactccatctgtacaaaaaaaaa

SEQ ID NO: 278320 - DNA, 2549 bp, Homo sapiens
gcaggctgtactggctcccaagttccttatgagtgtgaggccgcggcatggggcgagtgcagctcttcgagatcagcctgagccacggccgcgtcgtctacagccccggggagccgttggctgggaccgtgcgcgtgcgcctgggggcaccgctgccgttccgagccatccgggtgacctgcataggttcctgcggggtctccaacaaggctaatgacacagcgtgggtagtggaggagggttacttcaacagttccctgtcgctggcagacaaggggagcctgcccgctggagagcacagcttccccttccagttcctgcttcctgccactgcacccacgtcctttgagggtcctttcgggaagatcgtgcaccaggtgagggccgccatccacacgccacggttttccaaggatcacaagtgcagcctcgtgttctatatcttgagccccttgaacctgaacagcatcccagacattgagggatccagcctgcgcacacctgctaagcccctccctggccctccccccaagcaacccaacgtggcctctgccaccaagaagttctcctacaagctggtgaagacgggcagcgtggtcctcacagccagcactgatctccgcggctatgtggtggggcaggcactgcagctgcatgccgacgttgagaaccagtcaggcaaggacaccagccctgtggtggccagtctgctgcagaaagtgtcctataaggccaagcgctggatccacgacgtacggaccattgcggaggtggagggtgcgggcgtcaaggcctggcggcgggcgcagtggcacgagcagatcctggtgcctgccttgccccagtcggccctgccgggctgcagcctcatccacatcgactactacttacaggtctctctgaaggcgccggaagctactgtgaccctcccggtcttcattggcaatattgctgtgaaccatgccccagtgagcccccggccaggcctggggctgcctcctggggccccacccctggtggtgccttccgcaccaccccaggaggaggctgaggctgaggctgcggctggcggcccccacttcttggaccccgtcttcctctccaccaagagccattcgcagcggcagcccctgctggccaccttgagttctgtgcctggtgcgccggagccctgccctcaggatggcagccctgcctcacacccgctgcaccctcccttgtgcatttcaacaggtgccactgtcccctactttgcagagggctccggggggccagtgcccactaccagcaccttgattcttcctccagagtacagttcttggggctacccctatggtgagtcgacagccagggcttggcagggaggggacgccaagagccccacgcagaccctgctttcttcccgcagaggccccaccgtcttatgagcagagctgcggcggcgtggaacccagcctgacccctgagagctgaccccgtgctgccttctccaggcaggcctggcctctgccctgggactggggcgcccagggcctcgtgccttctctcttggcctagcctggcccactcaggacctgcccagcctctgccagctcctctggcatccgccctcttctccctggggctggggtgggggtggcagggagctgggacctggagagacaactcctgtaaataaaacactttatttgtagagctgggcctcaccggcctcgccttgggcaccctccagcctctggcagggcctgaccctgaccccatcctgggctctgctcatgccagggcagaccctgctcctcaggtgccccctactaccctgggggcgcgctcaggctaccatgcctgggcggagccgcggggctggctccctttaacagaggacgggggctggcgctgggccttccagagccgcctaaggacacgtccttggagcccggctcatgaaatggggcctcacgcaaccttggtgtttggttaaatttgtgccttggctcctgttgcgtttaggcacccaggttcccaagcggtgtggtgtggacctcccctgctgagaaacccgctggcgcgtggaggggcttgcccaggtccctccgacaggagaccctgctccctgggccttggcccctgctagcaccactgccaggcctggctctgagggacgctgcttctcccctgcccacgtctccaaggcctgaaaggcagggttctgtggaacagcatttctcaaaggggcatcctgcagacgttccagccccaggggaggccccgtgatgctggctggcctgcctggagggtgcttccagaaacaacggagatggtggtgaagaaggctctgggttcaaattccagttctcctttagggcgaaggggtgactgtggctaggtttgtcagttaccttatctataaaatgcacaggaccaggccgggcacggtggctccctcctgtaatcccagtactttgggaggctgaggcaggtggattgcttgaggtcaggagttccagatcagcctgggcaacatagtgaaactccatctgtacaaaaaaaaa

SEQ ID NO: 278321 - DNA, 2736 bp, Homo sapiens
cctgctgctctgggtggcaggcagaaggcctgggccacaggtggggcctgctggggagaccacaggtgaggcaggtatggctgaccctgggcgctcggcacaccggtactcctcctgcctggctgctccctcagcaggtgtcagagtctgagtcaccttttcctcacgtgacccccaccaggaccaggcagggaggtggccatctttggccctgactcagccctgcagggagaagaggggctggaggtgcaggtggcctgccactgtctcccccaacccctgcccacctgggtcttgtgctgtgtgtacttctgctgcgtctgtcctcccttgtgaccagcttctgctggacctgattgtccagccatgatcttctgatcatcatggtttctggacacacatctgttggactaaggaatttgtgttcctggccacagaacagtgccacctctgcctcaagcagttcctggtctgggcactcccccagggaggccggagaggactgagccgtctcctgatgcagaaagtcagccccgctgggcagtgctcgcccaggaagtagggccccacccaacggtgtgctgactgtggaacactgtgtctgcctaggcgggtctggccacattcctgcagcatgatggttggcagttagcttcctggagtgtggacgggtccttccctgcctgactgacttgtccacagggcagcaagaagatgcgccccttggtgtgtcccgagtgtctcctgtaggcagctgagctttcgcaggtctggctgggagccaaggttaccaatctggggggtaacccagccatcatctggatgagcgttggggtctttctgctctggattgcagggcagacgtcgttttgtgctggtcaggcccctcgcctgcctgattcccttggagccccccaagacaggagatgggcagatgtcctctgaagtggcatgggctgcttgctcactggccttcccaggaccctgcccaggtggtgctgcttggccccaggtcgaattcctgtgctggcagcaagcaggggcctgggccgtcggctggctggggctcatgcagccatcccctttgcagccatccgggtgacctgcataggttcctgcggggtctccaacaaggctaatgacacagcgtgggtagtggaggagggttacttcaacagttccctgtcgctggcagacaagggtaagtttgggagccagttcccgagtggtgacccctgggggcagcccttggagtggggcctgtctgtcctgtcctccccctttcctagatctgcctcttggatctggcactggcccatcttgtcccagggttgtgggccctgatggctttctcataggcgctgggtggctgaaggggccacctcccccttgtgctggatttgggtgggctctgacccctggcacagctgtttcacccttgccccattcccaaaccactctcctgttcaagccaagctcttatcctcagtccttcacccaagccacagccctgtgctgctgtggcgctggtgactgagacagggagacccagtgtgagctggtcagctgcagtgcccactcttatcctggccctgtggccacctcaggccacctcagggggggactgccccccacctccctcctgtctctgcagggagcctgcccgctggagagcacagcttccccttccagttcctgcttcctgtggggcgcccagggcctcgtgccttctctcttggcctagcctggcccactcaggacctgcccagcctctgccagctcctctggcatccgccctcttctccctggggctggggtgggggtggcagggagctgggacctggagagacaactcctgtaaataaaacactttatttgtagagctgggcctcaccggcctcgccttgggcaccctccagcctctggcagggcctgaccctgaccccatcctgggctctgctcatgccagggcagaccctgctcctcaggtgccccctactaccctgggggcgcgctcaggctaccatgcctgggcggagccgcggggctggctccctttaacagaggacgggggctggcgctgggccttccagagccgcctaaggacacgtccttggagcccggctcatgaaatggggcctcacgcaaccttggtgtttggttaaatttgtgccttggctcctgttgcgtttaggcacccaggttcccaagcggtgtggtgtggacctcccctgctgagaaacccgctggcgcgtggaggggcttgcccaggtccctccgacaggagaccctgctccctgggccttggcccctgctagcaccactgccaggcctggctctgagggacgctgcttctcccctgcccacgtctccaaggcctgaaaggcagggttctgtggaacagcatttctcaaaggggcatcctgcagacgttccagccccaggggaggccccgtgatgctggctggcctgcctggagggtgcttccagaaacaacggagatggtggtgaagaaggctctgggttcaaattccagttctcctttagggcgaaggggtgactgtggctaggtttgtcagttaccttatctataaaatgcacaggaccaggccgggcacggtggctccctcctgtaatcccagtactttgggaggctgaggcaggtggattgcttgaggtcaggagttccagatcagcctgggcaacatagtgaaactccatctgtacaaaaaaaaa

SEQ ID NO: 278322 - DNA, 2223 bp, Homo sapiens
cggggccgggcctcggagccgggactcgcgggcggcgggcgggggcgtcgctgcgcggctggccggtgaggccgcggcatggggcgagtgcagctcttcgagatcagcctgagccacggccgcgtcgtctacagccccggggagccgttggctgggaccgtgcgcgtgcgcctgggggcaccgctgccgttccgagccatccgggtgacctgcataggttcctgcggggtctccaacaaggctaatgacacagcgtgggtagtggaggagggttacttcaacagttccctgtcgctggcagacaaggggagcctgcccgctggagagcacagcttccccttccagttcctgcttcctgccactgcacccacgtcctttgagggtcctttcgggaagatcgtgcaccaggtgagggccgccatccacacgccacggttttccaaggatcacaagtgcagcctcgtgttctatatcttgagccccttgaacctgaacagcatcccagacattgagcaacccaacgtggcctctgccaccaagaagttctcctacaagctggtgaagacgggcagcgtggtcctcacagccagcactgatctccgcggctatgtggtggggcaggcactgcagctgcatgccgacgttgagaaccagtcaggcaaggacaccagccctgtggtggccagtctgctgcagaaagtgtcctataaggccaagcgctggatccacgacgtacggaccattgcggaggtggagggtgcgggcgtcaaggcctggcggcgggcgcagtggcacgagcagatcctggtgcctgccttgccccagtcggccctgccgggctgcagcctcatccacatcgactactacttacaggtctctctgaaggcgccggaagctactgtgaccctcccggtcttcattggcaatattgctgtgaaccatgccccagtgagcccccggccaggcctggggctgcctcctggggccccacccctggtggtgccttccgcaccaccccaggaggaggctgaggctgaggctgcggctggcggcccccacttcttggaccccgtcttcctctccaccaagagccattcgcagcggcagcccctgctggccaccttgagttctgtgcctggtgcgccggagccctgccctcaggatggcagccctgcctcacacccgctgcaccctcccttgtgcatttcaacaggtgccactgtcccctactttgcagagggctccggggggccagtgcccactaccagcaccttgattcttccctcttctccctggggctggggtgggggtggcagggagctgggacctggagagacaactcctgtaaataaaacactttatttgtagagctgggcctcaccggcctcgccttgggcaccctccagcctctggcagggcctgaccctgaccccatcctgggctctgctcatgccagggcagaccctgctcctcaggtgccccctactaccctgggggcgcgctcaggctaccatgcctgggcggagccgcggggctggctccctttaacagaggacgggggctggcgctgggccttccagagccgcctaaggacacgtccttggagcccggctcatgaaatggggcctcacgcaaccttggtgtttggttaaatttgtgccttggctcctgttgcgtttaggcacccaggttcccaagcggtgtggtgtggacctcccctgctgagaaacccgctggcgcgtggaggggcttgcccaggtccctccgacaggagaccctgctccctgggccttggcccctgctagcaccactgccaggcctggctctgagggacgctgcttctcccctgcccacgtctccaaggcctgaaaggcagggttctgtggaacagcatttctcaaaggggcatcctgcagacgttccagccccaggggaggccccgtgatgctggctggcctgcctggagggtgcttccagaaacaacggagatggtggtgaagaaggctctgggttcaaattccagttctcctttagggcgaaggggtgactgtggctaggtttgtcagttaccttatctataaaatgcacaggaccaggccgggcacggtggctccctcctgtaatcccagtactttgggaggctgaggcaggtggattgcttgaggtcaggagttccagatcagcctgggcaacatagtgaaactccatctgtacaaaaaaaaa

SEQ ID NO: 278323 - DNA, 3685 bp, Homo sapiens
cctgctgctctgggtggcaggcagaaggcctgggccacaggtggggcctgctggggagaccacaggtgaggcaggtatggctgaccctgggcgctcggcacaccggtactcctcctgcctggctgctccctcagcaggtgtcagagtctgagtcaccttttcctcacgtgacccccaccaggaccaggcagggaggtggccatctttggccctgactcagccctgcagggagaagaggggctggaggtgcaggtggcctgccactgtctcccccaacccctgcccacctgggtcttgtgctgtgtgtacttctgctgcgtctgtcctcccttgtgaccagcttctgctggacctgattgtccagccatgatcttctgatcatcatggtttctggacacacatctgttggactaaggaatttgtgttcctggccacagaacagtgccacctctgcctcaagcagttcctggtctgggcactcccccagggaggccggagaggactgagccgtctcctgatgcagaaagtcagccccgctgggcagtgctcgcccaggaagtagggccccacccaacggtgtgctgactgtggaacactgtgtctgcctaggcgggtctggccacattcctgcagcatgatggttggcagttagcttcctggagtgtggacgggtccttccctgcctgactgacttgtccacagggcagcaagaagatgcgccccttggtgtgtcccgagtgtctcctgtaggcagctgagctttcgcaggtctggctgggagccaaggttaccaatctggggggtaacccagccatcatctggatgagcgttggggtctttctgctctggattgcagggcagacgtcgttttgtgctggtcaggcccctcgcctgcctgattcccttggagccccccaagacaggagatgggcagatgtcctctgaagtggcatgggctgcttgctcactggccttcccaggaccctgcccaggtggtgctgcttggccccaggtcgaattcctgtgctggcagcaagcaggggcctgggccgtcggctggctggggctcatgcagccatcccctttgcagccatccgggtgacctgcataggttcctgcggggtctccaacaaggctaatgacacagcgtgggtagtggaggagggttacttcaacagttccctgtcgctggcagacaaggggagcctgcccgctggagagcacagcttccccttccagttcctgcttcctgccactgcacccacgtcctttgagggtcctttcgggaagatcgtgcaccaggtgagggccgccatccacacgccacggttttccaaggatcacaagtgcagcctcgtgttctatatcttgagccccttgaacctgaacagcatcccagacattgaggtgaggatggcacagtgacctccttggtgggtccccaccctcatggaggctggggaagagctgggcaggcactgcttcatcccagcgtcctgtccccagctgaggtgaggggggccagggtctggaggcagtggcctctttgccctgagctgactgctgatgtccaggggcagggcgtggcagggctgaggggcctgtcccaatgccacagggatccagcctgcgcacacctgctaagcccctccctggccctccccccaagcaacccaacgtggcctctgccaccaagaagttctcctacaagctggtgaagacgggcagcgtggtcctcacagccagcactgatctccgcggctatgtggtggggcaggcactgcagctgcatgccgacgttgagaaccagtcaggcaaggacaccagccctgtggtggccagtctgctgcagaaagtgtcctataaggccaagcgctggatccacgacgtacggaccattgcggaggtggagggtgcgggcgtcaaggcctggcggcgggcgcagtggcacgagcagatcctggtgcctgccttgccccagtcggccctgccgggctgcagcctcatccacatcgactactacttacaggtctctctgaaggcgccggaagctactgtgaccctcccggtcttcattggcaatattgctgtgaaccatgccccagtgagcccccggccaggcctggggctgcctcctggggccccacccctggtggtgccttccgcaccaccccaggaggaggctgaggctgaggctgcggctggcggcccccacttcttggaccccgtcttcctctccaccaagagccattcgcagcggcagcccctgctggccaccttgagttctgtgcctggtgcgccggagccctgccctcaggatggcagccctgcctcacacccgctgcaccctcccttgtgcatttcaacaggtgccactgtcccctactttgcagagggctccggggggccagtgcccactaccagcaccttgattcttcctccagagtacagttcttggggctacccctatggtgagtcgacagccagggcttggcagggaggggacgccaagagccccacgcagaccctgctttcttcccgcagaggccccaccgtcttatgagcagagctgcggcggcgtggaacccagcctgacccctgagagctgaccccgtgctgccttctccaggcaggcctggcctctgccctgggactggggcgcccagggcctcgtgccttctctcttggcctagcctggcccactcaggacctgcccagcctctgccagctcctctggcatccgccctcttctccctggggctggggtgggggtggcagggagctgggacctggagagacaactcctgtaaataaaacactttatttgtagagctgggcctcaccggcctcgccttgggcaccctccagcctctggcagggcctgaccctgaccccatcctgggctctgctcatgccagggcagaccctgctcctcaggtgccccctactaccctgggggcgcgctcaggctaccatgcctgggcggagccgcggggctggctccctttaacagaggacgggggctggcgctgggccttccagagccgcctaaggacacgtccttggagcccggctcatgaaatggggcctcacgcaaccttggtgtttggttaaatttgtgccttggctcctgttgcgtttaggcacccaggttcccaagcggtgtggtgtggacctcccctgctgagaaacccgctggcgcgtggaggggcttgcccaggtccctccgacaggagaccctgctccctgggccttggcccctgctagcaccactgccaggcctggctctgagggacgctgcttctcccctgcccacgtctccaaggcctgaaaggcagggttctgtggaacagcatttctcaaaggggcatcctgcagacgttccagccccaggggaggccccgtgatgctggctggcctgcctggagggtgcttccagaaacaacggagatggtggtgaagaaggctctgggttcaaattccagttctcctttagggcgaaggggtgactgtggctaggtttgtcagttaccttatctataaaatgcacaggaccaggccgggcacggtggctccctcctgtaatcccagtactttgggaggctgaggcaggtggattgcttgaggtcaggagttccagatcagcctgggcaacatagtgaaactccatctgtacaaaaaaaaa

SEQ ID NO: 278324 - DNA, 3325 bp, Homo sapiens
cctgctgctctgggtggcaggcagaaggcctgggccacaggtggggcctgctggggagaccacaggtgaggcaggtatggctgaccctgggcgctcggcacaccggtactcctcctgcctggctgctccctcagcaggtgtcagagtctgagtcaccttttcctcacgtgacccccaccaggaccaggcagggaggtggccatctttggccctgactcagccctgcagggagaagaggggctggaggtgcaggtggcctgccactgtctcccccaacccctgcccacctgggtcttgtgctgtgtgtacttctgctgcgtctgtcctcccttgtgaccagcttctgctggacctgattgtccagccatgatcttctgatcatcatggtttctggacacacatctgttggactaaggaatttgtgttcctggccacagaacagtgccacctctgcctcaagcagttcctggtctgggcactcccccagggaggccggagaggactgagccgtctcctgatgcagaaagtcagccccgctgggcagtgctcgcccaggaagtagggccccacccaacggtgtgctgactgtggaacactgtgtctgcctaggcgggtctggccacattcctgcagcatgatggttggcagttagcttcctggagtgtggacgggtccttccctgcctgactgacttgtccacagggcagcaagaagatgcgccccttggtgtgtcccgagtgtctcctgtaggcagctgagctttcgcaggtctggctgggagccaaggttaccaatctggggggtaacccagccatcatctggatgagcgttggggtctttctgctctggattgcagggcagacgtcgttttgtgctggtcaggcccctcgcctgcctgattcccttggagccccccaagacaggagatgggcagatgtcctctgaagtggcatgggctgcttgctcactggccttcccaggaccctgcccagccatccgggtgacctgcataggttcctgcggggtctccaacaaggctaatgacacagcgtgggtagtggaggagggttacttcaacagttccctgtcgctggcagacaaggggagcctgcccgctggagagcacagcttccccttccagttcctgcttcctgccactgcacccacgtcctttgagggtcctttcgggaagatcgtgcaccaggtgagggccgccatccacacgccacggttttccaaggatcacaagtgcagcctcgtgttctatatcttgagccccttgaacctgaacagcatcccagacattgagcaacccaacgtggcctctgccaccaagaagttctcctacaagctggtgaagacgggcagcgtggtcctcacagccagcactgatctccgcggctatgtggtggggcaggcactgcagctgcatgccgacgttgagaaccagtcaggcaaggacaccagccctgtggtggccagtctgctgcagaaagtgtcctataaggccaagcgctggatccacgacgtacggaccattgcggaggtggagggtgcgggcgtcaaggcctggcggcgggcgcagtggcacgagcagatcctggtgcctgccttgccccagtcggccctgccgggctgcagcctcatccacatcgactactacttacaggtctctctgaaggcgccggaagctactgtgaccctcccggtcttcattggcaatattgctgtgaaccatgccccagtgagcccccggccaggcctggggctgcctcctggggccccacccctggtggtgccttccgcaccaccccaggaggaggctgaggctgaggctgcggctggcggcccccacttcttggaccccgtcttcctctccaccaagagccattcgcagcggcagcccctgctggccaccttgagttctgtgcctggtgcgccggagccctgccctcaggatggcagccctgcctcacacccgctgcaccctcccttgtgcatttcaacaggtgccactgtcccctactttgcagagggctccggggggccagtgcccactaccagcaccttgattcttcctccagagtacagttcttggggctacccctatggtgagtcgacagccagggcttggcagggaggggacgccaagagccccacgcagaccctgctttcttcccgcagaggccccaccgtcttatgagcagagctgcggcggcgtggaacccagcctgacccctgagagctgaccccgtgctgccttctccaggcaggcctggcctctgccctgggactggggcgcccagggcctcgtgccttctctcttggcctagcctggcccactcaggacctgcccagcctctgccagctcctctggcatccgccctcttctccctggggctggggtgggggtggcagggagctgggacctggagagacaactcctgtaaataaaacactttatttgtagagctgggcctcaccggcctcgccttgggcaccctccagcctctggcagggcctgaccctgaccccatcctgggctctgctcatgccagggcagaccctgctcctcaggtgccccctactaccctgggggcgcgctcaggctaccatgcctgggcggagccgcggggctggctccctttaacagaggacgggggctggcgctgggccttccagagccgcctaaggacacgtccttggagcccggctcatgaaatggggcctcacgcaaccttggtgtttggttaaatttgtgccttggctcctgttgcgtttaggcacccaggttcccaagcggtgtggtgtggacctcccctgctgagaaacccgctggcgcgtggaggggcttgcccaggtccctccgacaggagaccctgctccctgggccttggcccctgctagcaccactgccaggcctggctctgagggacgctgcttctcccctgcccacgtctccaaggcctgaaaggcagggttctgtggaacagcatttctcaaaggggcatcctgcagacgttccagccccaggggaggccccgtgatgctggctggcctgcctggagggtgcttccagaaacaacggagatggtggtgaagaaggctctgggttcaaattccagttctcctttagggcgaaggggtgactgtggctaggtttgtcagttaccttatctataaaatgcacaggaccaggccgggcacggtggctccctcctgtaatcccagtactttgggaggctgaggcaggtggattgcttgaggtcaggagttccagatcagcctgggcaacatagtgaaactccatctgtacaaaaaaaaa

SEQ ID NO: 278325 - DNA, 2576 bp, Homo sapiens
cggggccgggcctcggagccgggactcgcgggcggcgggcgggggcgtcgctgcgcggctggccggtgaggccgcggcatggggcgagtgcagctcttcgagatcagcctgagccacggccgcgtcgtctacagccccggggagccgttggctgggaccgtgcgcgtgcgcctgggggcaccgctgccgttccgagccatccgggtgacctgcataggttcctgcggggtctccaacaaggctaatgacacagcgtgggtagtggaggagggttacttcaacagttccctgtcgctggcagacaagggccacctcagggggggactgccccccacctccctcctgtctctgcagggagcctgcccgctggagagcacagcttccccttccagttcctgcttcctgccactgcacccacgtcctttgagggtcctttcgggaagatcgtgcaccaggtgagggccgccatccacacgccacggttttccaaggatcacaagtgcagcctcgtgttctatatcttgagccccttgaacctgaacagcatcccagacattgagcaacccaacgtggcctctgccaccaagaagttctcctacaagctggtgaagacgggcagcgtggtcctcacagccagcactgatctccgcggctatgtggtggggcaggcactgcagctgcatgccgacgttgagaaccagtcaggcaaggacaccagccctgtggtggccagtctgctgcagaaagtgtcctataaggccaagcgctggatccacgacgtacggaccattgcggaggtggagggtgcgggcgtcaaggcctggcggcgggcgcagtggcacgagcagatcctggtgcctgccttgccccagtcggccctgccgggctgcagcctcatccacatcgactactacttacaggtctctctgaaggcgccggaagctactgtgaccctcccggtcttcattggcaatattgctgtgaaccatgccccagtgagcccccggccaggcctggggctgcctcctggggccccacccctggtggtgccttccgcaccaccccaggaggaggctgaggctgaggctgcggctggcggcccccacttcttggaccccgtcttcctctccaccaagagccattcgcagcggcagcccctgctggccaccttgagttctgtgcctggtgcgccggagccctgccctcaggatggcagccctgcctcacacccgctgcaccctcccttgtgcatttcaacaggtgccactgtcccctactttgcagagggctccggggggccagtgcccactaccagcaccttgattcttcctccagagtacagttcttggggctacccctatggtgagtcgacagccagggcttggcagggaggggacgccaagagccccacgcagaccctgctttcttcccgcagaggccccaccgtcttatgagcagagctgcggcggcgtggaacccagcctgacccctgagagctgaccccgtgctgccttctccaggcaggcctggcctctgccctgggactggggcgcccagggcctcgtgccttctctcttggcctagcctggcccactcaggacctgcccagcctctgccagctcctctggcatccgccctcttctccctggggctggggtgggggtggcagggagctgggacctggagagacaactcctgtaaataaaacactttatttgtagagctgggcctcaccggcctcgccttgggcaccctccagcctctggcagggcctgaccctgaccccatcctgggctctgctcatgccagggcagaccctgctcctcaggtgccccctactaccctgggggcgcgctcaggctaccatgcctgggcggagccgcggggctggctccctttaacagaggacgggggctggcgctgggccttccagagccgcctaaggacacgtccttggagcccggctcatgaaatggggcctcacgcaaccttggtgtttggttaaatttgtgccttggctcctgttgcgtttaggcacccaggttcccaagcggtgtggtgtggacctcccctgctgagaaacccgctggcgcgtggaggggcttgcccaggtccctccgacaggagaccctgctccctgggccttggcccctgctagcaccactgccaggcctggctctgagggacgctgcttctcccctgcccacgtctccaaggcctgaaaggcagggttctgtggaacagcatttctcaaaggggcatcctgcagacgttccagccccaggggaggccccgtgatgctggctggcctgcctggagggtgcttccagaaacaacggagatggtggtgaagaaggctctgggttcaaattccagttctcctttagggcgaaggggtgactgtggctaggtttgtcagttaccttatctataaaatgcacaggaccaggccgggcacggtggctccctcctgtaatcccagtactttgggaggctgaggcaggtggattgcttgaggtcaggagttccagatcagcctgggcaacatagtgaaactccatctgtacaaaaaaaaa

SEQ ID NO: 278326 - DNA, 2447 bp, Homo sapiens
gcaggctgtactggctcccaagttccttatgagtgtgaggccgcggcatggggcgagtgcagctcttcgagatcagcctgagccacggccgcgtcgtctacagccccggggagccgttggctgggaccgtgcgcgtgcgcctgggggcaccgctgccgttccgagccatccgggtgacctgcataggttcctgcggggtctccaacaaggctaatgacacagcgtgggtagtggaggagggttacttcaacagttccctgtcgctggcagacaaggccactgcacccacgtcctttgagggtcctttcgggaagatcgtgcaccaggtgagggccgccatccacacgccacggttttccaaggatcacaagtgcagcctcgtgttctatatcttgagccccttgaacctgaacagcatcccagacattgagcaacccaacgtggcctctgccaccaagaagttctcctacaagctggtgaagacgggcagcgtggtcctcacagccagcactgatctccgcggctatgtggtggggcaggcactgcagctgcatgccgacgttgagaaccagtcaggcaaggacaccagccctgtggtggccagtctgctgcagaaagtgtcctataaggccaagcgctggatccacgacgtacggaccattgcggaggtggagggtgcgggcgtcaaggcctggcggcgggcgcagtggcacgagcagatcctggtgcctgccttgccccagtcggccctgccgggctgcagcctcatccacatcgactactacttacaggtctctctgaaggcgccggaagctactgtgaccctcccggtcttcattggcaatattgctgtgaaccatgccccagtgagcccccggccaggcctggggctgcctcctggggccccacccctggtggtgccttccgcaccaccccaggaggaggctgaggctgaggctgcggctggcggcccccacttcttggaccccgtcttcctctccaccaagagccattcgcagcggcagcccctgctggccaccttgagttctgtgcctggtgcgccggagccctgccctcaggatggcagccctgcctcacacccgctgcaccctcccttgtgcatttcaacaggtgccactgtcccctactttgcagagggctccggggggccagtgcccactaccagcaccttgattcttcctccagagtacagttcttggggctacccctatggtgagtcgacagccagggcttggcagggaggggacgccaagagccccacgcagaccctgctttcttcccgcagaggccccaccgtcttatgagcagagctgcggcggcgtggaacccagcctgacccctgagagctgaccccgtgctgccttctccaggcaggcctggcctctgccctgggactggggcgcccagggcctcgtgccttctctcttggcctagcctggcccactcaggacctgcccagcctctgccagctcctctggcatccgccctcttctccctggggctggggtgggggtggcagggagctgggacctggagagacaactcctgtaaataaaacactttatttgtagagctgggcctcaccggcctcgccttgggcaccctccagcctctggcagggcctgaccctgaccccatcctgggctctgctcatgccagggcagaccctgctcctcaggtgccccctactaccctgggggcgcgctcaggctaccatgcctgggcggagccgcggggctggctccctttaacagaggacgggggctggcgctgggccttccagagccgcctaaggacacgtccttggagcccggctcatgaaatggggcctcacgcaaccttggtgtttggttaaatttgtgccttggctcctgttgcgtttaggcacccaggttcccaagcggtgtggtgtggacctcccctgctgagaaacccgctggcgcgtggaggggcttgcccaggtccctccgacaggagaccctgctccctgggccttggcccctgctagcaccactgccaggcctggctctgagggacgctgcttctcccctgcccacgtctccaaggcctgaaaggcagggttctgtggaacagcatttctcaaaggggcatcctgcagacgttccagccccaggggaggccccgtgatgctggctggcctgcctggagggtgcttccagaaacaacggagatggtggtgaagaaggctctgggttcaaattccagttctcctttagggcgaaggggtgactgtggctaggtttgtcagttaccttatctataaaatgcacaggaccaggccgggcacggtggctccctcctgtaatcccagtactttgggaggctgaggcaggtggattgcttgaggtcaggagttccagatcagcctgggcaacatagtgaaactccatctgtacaaaaaaaaa

SEQ ID NO: 278327 - DNA, 2838 bp, Homo sapiens
cggggccgggcctcggagccgggactcgcgggcggcgggcgggggcgtcgctgcgcggctggccggtgaggccgcggcatggggcgagtgcagctcttcgagatcagcctgagccacggccgcgtcgtctacagccccggggagccgttggctgggaccgtgcgcgtgcgcctgggggcaccgctgccgttccgagccatccgggtgacctgcataggttcctgcggggtctccaacaaggctaatgacacagcgtgggtagtggaggagggttacttcaacagttccctgtcgctggcagacaagggccacctcagggggggactgccccccacctccctcctgtctctgcagggagcctgcccgctggagagcacagcttccccttccagttcctgcttcctgccactgcacccacgtcctttgagggtcctttcgggaagatcgtgcaccaggtgagggccgccatccacacgccacggttttccaaggatcacaagtgcagcctcgtgttctatatcttgagccccttgaacctgaacagcatcccagacattgaggtgaggatggcacagtgacctccttggtgggtccccaccctcatggaggctggggaagagctgggcaggcactgcttcatcccagcgtcctgtccccagctgaggtgaggggggccagggtctggaggcagtggcctctttgccctgagctgactgctgatgtccaggggcagggcgtggcagggctgaggggcctgtcccaatgccacagggatccagcctgcgcacacctgctaagcccctccctggccctccccccaagcaacccaacgtggcctctgccaccaagaagttctcctacaagctggtgaagacgggcagcgtggtcctcacagccagcactgatctccgcggctatgtggtggggcaggcactgcagctgcatgccgacgttgagaaccagtcaggcaaggacaccagccctgtggtggccagtctgctgcagaaagtgtcctataaggccaagcgctggatccacgacgtacggaccattgcggaggtggagggtgcgggcgtcaaggcctggcggcgggcgcagtggcacgagcagatcctggtgcctgccttgccccagtcggccctgccgggctgcagcctcatccacatcgactactacttacaggtctctctgaaggcgccggaagctactgtgaccctcccggtcttcattggcaatattgctgtgaaccatgccccagtgagcccccggccaggcctggggctgcctcctggggccccacccctggtggtgccttccgcaccaccccaggaggaggctgaggctgaggctgcggctggcggcccccacttcttggaccccgtcttcctctccaccaagagccattcgcagcggcagcccctgctggccaccttgagttctgtgcctggtgcgccggagccctgccctcaggatggcagccctgcctcacacccgctgcaccctcccttgtgcatttcaacaggtgccactgtcccctactttgcagagggctccggggggccagtgcccactaccagcaccttgattcttcctccagagtacagttcttggggctacccctatggtgagtcgacagccagggcttggcagggaggggacgccaagagccccacgcagaccctgctttcttcccgcagaggccccaccgtcttatgagcagagctgcggcggcgtggaacccagcctgacccctgagagctgaccccgtgctgccttctccaggcaggcctggcctctgccctgggactggggcgcccagggcctcgtgccttctctcttggcctagcctggcccactcaggacctgcccagcctctgccagctcctctggcatccgccctcttctccctggggctggggtgggggtggcagggagctgggacctggagagacaactcctgtaaataaaacactttatttgtagagctgggcctcaccggcctcgccttgggcaccctccagcctctggcagggcctgaccctgaccccatcctgggctctgctcatgccagggcagaccctgctcctcaggtgccccctactaccctgggggcgcgctcaggctaccatgcctgggcggagccgcggggctggctccctttaacagaggacgggggctggcgctgggccttccagagccgcctaaggacacgtccttggagcccggctcatgaaatggggcctcacgcaaccttggtgtttggttaaatttgtgccttggctcctgttgcgtttaggcacccaggttcccaagcggtgtggtgtggacctcccctgctgagaaacccgctggcgcgtggaggggcttgcccaggtccctccgacaggagaccctgctccctgggccttggcccctgctagcaccactgccaggcctggctctgagggacgctgcttctcccctgcccacgtctccaaggcctgaaaggcagggttctgtggaacagcatttctcaaaggggcatcctgcagacgttccagccccaggggaggccccgtgatgctggctggcctgcctggagggtgcttccagaaacaacggagatggtggtgaagaaggctctgggttcaaattccagttctcctttagggcgaaggggtgactgtggctaggtttgtcagttaccttatctataaaatgcacaggaccaggccgggcacggtggctccctcctgtaatcccagtactttgggaggctgaggcaggtggattgcttgaggtcaggagttccagatcagcctgggcaacatagtgaaactccatctgtacaaaaaaaaa

SEQ ID NO: 278328 - DNA, 1458 bp, Homo sapiens
tcttgcgtttcgcccctctcagtcgatcaattctactgtctgcttccgcgctcttgctgtcttctgctcgactccccggccccgcgcggcggggccgtctcgccctcgtgtctctttttcttccgcctcctttcgtcttctgtctgcccctctacctccttatgtttccgtctcctccgcgtcccctgagcttcctctgctatagttctgtcttgtcccgctcgtggctgccgcctctattatcatcctcagctctctcgtcgtcgtggctctcgccctgtgccgccgttctcttcgtctttcgtgtccctgtcgcttcttcgctcctccctctcctgcttccttctcccgtcctccctgtctcgtttggtccctccctccgccgcgcctggctggctggcgtcgcctccctctcgttccttctcctgcggctcttgtccttctctctctcctgcctctctctttcgttgtctctttgctttttgtttgttttttttattctttttttcttttttccttttttcgtttttttgtttttttttttttttttttttttttttttttttttttttttttcctgtaaataaaacactttatttgtagagctgggcctcaccggcctcgccttgggcaccctccagcctctggcagggcctgaccctgaccccatcctgggctctgctcatgccagggcagaccctgctcctcaggtgccccctactaccctgggggcgcgctcaggctaccatgcctgggcggagccgcggggctggctccctttaacagaggacgggggctggcgctgggccttccagagccgcctaaggacacgtccttggagcccggctcatgaaatggggcctcacgcaaccttggtgtttggttaaatttgtgccttggctcctgttgcgtttaggcacccaggttcccaagcggtgtggtgtggacctcccctgctgagaaacccgctggcgcgtggaggggcttgcccaggtccctccgacaggagaccctgctccctgggccttggcccctgctagcaccactgccaggcctggctctgagggacgctgcttctcccctgcccacgtctccaaggcctgaaaggcagggttctgtggaacagcatttctcaaaggggcatcctgcagacgttccagccccaggggaggccccgtgatgctggctggcctgcctggagggtgcttccagaaacaacggagatggtggtgaagaaggctctgggttcaaattccagttctcctttagggcgaaggggtgactgtggctaggtttgtcagttaccttatctataaaatgcacaggaccaggccgggcacggtggctccctcctgtaatcccagtactttgggaggctgaggcaggtggattgcttgaggtcaggagttccagatcagcctgggcaacatagtgaaactccatctgtacaaaaaaaaa

SEQ ID NO: 278329 - DNA, 898 bp, Homo sapiens
cggggccgggcctcggagccgggactcgcgggcggcgggcgggggcgtcgctgcgcggctggccggtgaggccgcggcatggggcgagtgcagctcttcgagatcagcctgagccacggccgcgtcgtctacagccccggggagccgttggctgggaccgtgcgcgtgcgcctgggggcaccgctgccgttccgagccatccgggtgacctgcataggttcctgcggggtctccaacaaggctaatgacacagcgtgggtagtggaggagggttacttcaacagttccctgtcgctggcagacaaggggagcctgcccgctggagagcacagcttccccttccagttcctgcttcctgccactgcacccacgtcctttgagggtcctttcgggaagatcgtgcaccaggtgagggccgccatccacacgccacggttttccaaggatcacaagtgcagcctcgtgttctatatcttgagccccttgaacctgaacagcatcccagacattgagcaacccaacgtggcctctgccaccaagaagttctcctacaagctggtgaagacgggcagcgtggtcctcacagccagcactgatctccgcggctatgtggtggggcaggcactgcagctgcatgccgacgttgagaaccagtcaggcaaggacaccagccctgtggtggccagtctgctgcagaaagtgtcctataaggccaagcgctggatccacgacgtacggaccattgcggaggtggagggtgcgggcgtcaaggcctggcggcgggcgcagtggcacgagcagatcctggtgcctgccttgccccagtcggccctgccgggctgcagcctcatccacatcgactactacttacagtcccaggttagcattttcaatgact

SEQ ID NO: 278330 - DNA, 917 bp, Homo sapiens
acatacatcgggtgtgagcacggaatagctgggcggcggctggtccacagacactgggagacagaaggggccggtccccaggcgcccgtgctgcagcagtgggatccactggggagaggctggagaccaccggtgtgaaggcctcgcgggtaaattcactgcagctggacttgccaaagatgacctgggagagtggattcatgagggacccatgggggatgccctaccccccttccctggggcacagccactgaccggcagagcctggctggggtcctcgcctgtcatgtactgcactcgcacggcaaggttgcgcacggagccctggcggctgctgaagttgaggctgtgcagatggaggaggatattctgcagctgcaggcagaggccacagctgaggtgctgggggaggtggcccaggcacagaaggtgctacgggacagcgtgcagcggctagaagtccagctgaggagcgcctggctgggccctgcctaccgagaatttgaggtcttaaaggctcacgctgacaagcagagccacatcctatgggccctcacaggccacgtgcagcggcagaggcgggagatggtggcacagcagcatcggctgcgacagatccaggagagactccacacagcggcgctcccagcctgaatctgcctggatggaactgaggaccaatcatgctgcaaggaacacttccacgccccgtgaggcccctgtgcagggaggagctgcctgttcactgggatcagccagggcgccgggccccacttctgagcacagagcagagacagacgcaggcggggacaaaggcagaggatgtagccccattggggaggggtggaggaaggacatgtaccctttcatgcctacacacccctcattaaagcagagtcgtggcatctcaaaaaaaa

SEQ ID NO: 278331 - DNA, 701 bp, Homo sapiens
gtcatgccagtgcctgctctgtgcctgctgtgggccctggcaatggtgacccggcctgcctcagcggcccccatgggcggcccagaactggcacagcatgaggagctgaccctgctcttccatgggaccctgcagctgggccaggccctcaacggtgtgtacaggaccacggagggacggctgacaaaggccaggaacagcctgggtctctatggccgcacaatagaactcctggggcaggaggtcagccggggccgggatgcagcccaggaacttcgggcaagcctgttggagactcaggctcacgctgacaagcagagccacatcctatgggccctcacaggccacgtgcagcggcagaggcgggagatggtggcacagcagcatcggctgcgacagatccaggagagactccacacagcggcgctcccagcctgaatctgcctggatggaactgaggaccaatcatgctgcaaggaacacttccacgccccgtgaggcccctgtgcagggaggagctgcctgttcactgggatcagccagggcgccgggccccacttctgagcacagagcagagacagacgcaggcggggacaaaggcagaggatgtagccccattggggaggggtggaggaaggacatgtaccctttcatgcctacacacccctcattaaagcagagtcgtggcatctcaaaaaaaa

SEQ ID NO: 278332 - DNA, 863 bp, Homo sapiens
gtcatgccagtgcctgctctgtgcctgctgtgggccctggcaatggtgacccggcctgcctcagcggcccccatgggcggcccagaactggcacagcatgaggagctgaccctgctcttccatgggaccctgcagctgggccaggccctcaacggtgtgtacaggaccacggagggacggctgacaaaggccaggaacagcctgggtctctatggccgcacaatagaactcctggggcaggaggtcagccggggccgggatgcagcccaggaacttcgggcaagcctgttggagactcagatggaggaggatattctgcagctgcaggcagaggccacagctgaggtgctgggggaggtggcccaggcacagaaggtgctacgggacagcgtgcagcggctagaagtccagctgaggagcgcctggctgggccctgcctaccgagaatttgaggtcttaaaggctcacgctgacaagcagagccacatcctatgggccctcacaggccacgtgcagcggcagaggcgggagatggtggcacagcagcatcggctgcgacagatccaggagagactccacacagcggcgctcccagcctgaatctgcctggatggaactgaggaccaatcatgctgcaaggaacacttccacgccccgtgaggcccctgtgcagggaggagctgcctgttcactgggatcagccagggcgccgggccccacttctgagcacagagcagagacagacgcaggcggggacaaaggcagaggatgtagccccattggggaggggtggaggaaggacatgtaccctttcatgcctacacacccctcattaaagcagagtcgtggcatctcaaaaaaaa

SEQ ID NO: 278333 - DNA, 867 bp, Homo sapiens
gccttaggtagacctcttacagctcacaagaaatgcagtttatgaggaaagaccatgaatcggggggcggcccggggagggtattaccaaacagatcagcatcaggaacatcattcccagagagaaatttggccaattgtcagttcaagtacacatctctccctccttttacagcatattgcaatagattatagccatgcgaaataatccataaacttagctaattccaccaaacagataggaaagaaggtagagtcctacaagagcctagtcagaataagaactacagtaattttgccaaaaccctgttaagttcttgaataattctggtcaaaatggatttcaatctgagttaactcacagtcaacaatttggctgtttttcttgcttctcactctactgccttactctcttccacagtgttaagtagccatttaaatgggtttgttctgctgcaggtggctgagcctgggatttccaacttgggagactacacagtggactctataatgattagtggcagcatccaatgtctcttccaagtctaaaatttgtgagtttcaaagttgactctccccaaacctggcctttgctgcctcagattctgtcactctagcaaggcagagagagcaaaaggggcaagacaaacctcatcaacagcacagaaatcccagaatcacacactctctggtccagccaagccaagtgtttttttttttgttgttgttgttgttttttaaatcaccctccattactcaacattctcgttcccagatgaattttaaactggagttgcaccaactgtgagacagcctcaaccccaatgttaaatactaccagttatatatatatatatatatatatata

SEQ ID NO: 278334 - DNA, 536 bp, Homo sapiens
tagtcagaatccactactctaccactaatgtctcttccatccggctctgcagcacctgagcaaaagacctctgcagctgagtccaaagagcattcccatgtgaaccgagcaaccaagtatcatcggagtggctgagcctgggatttccaacttgggagactacacagtggactctataatgattagtggcagcatccaatgtctcttccaagtctaaaatttgtgagtttcaaagttgactctccccaaacctggcctttgctgcctcagattctgtcactctagcaaggcagagagagcaaaaggggcaagacaaacctcatcaacagcacagaaatcccagaatcacacactctctggtccagccaagccaagtgtttttttttttgttgttgttgttgttttttaaatcaccctccattactcaacattctcgttcccagatgaattttaaactggagttgcaccaactgtgagacagcctcaaccccaatgttaaatactaccagttatatatatatatatatatatatata

SEQ ID NO: 278335 - DNA, 1315 bp, Homo sapiens
cgcgctatgcatgctaggattagtagttcctccgtccctcatggcgcggggtcagggcggagctcaggttgactctgcagcagagaactacaattcccatggggccgcgcggcagaaagaaaggggcgggacgggagggggcgcgtcgcgcttgcgcaggtcccggggccggagggaggcggaggcgtagcggtccaactgctgaagtccccatgtgacagtgagcggggtccccgctccaggagacgctcgagtctgcgtcccggccctcagcactgtccactgtttcggtgccagcagagaccagcaggcccgggacagttggtgtttggccgtgccgctgtctaacttggtgtgcagagtgaattgccgctgccggagcggagagaggcggagcggccaggagagaggggatttctgtcagcgccggcctcgggagctcggagacatgaacggcttcacgcctgacgagatgagccgcggcggggatgcggccgccgcagtggccgcagtggtcgctgccgcggccgccgccgcctcggcggggaacgggaccggcgcgggcaccggggctgaggtgccgggcgcgggggcggtctcagcggctgggcccccgggggcggccgggccgggccccgggcaactgtgctgcctgcgggaggatggtgagcggtgcggccgggcggcaggcaacgccagcttcagcaagaggatccagaagagcatctcccagaagaaggtgaagatcgagctggataagagcgcaaggcatctttacatatgtgattatcataaaaacttaattcagagtgttcgaaacagaagaaagagaaaagggagtgatgatgatggaggtgattcacctgttcaagatattgataccccagaggttgatttataccaattacaagtaaatacacttaggagatacaaaagacacttcaagctaccaaccagaccaggacttaataaagcacaacttgttgagatagttggttgccactttaggtctattccagtgaatgaaaaagacaccttaacatatttcatctactcagtgaagaatgacaagaacaaatcagatctcaaggttgatagtggtgttcactaggagacgtggaattgagactaataacttggatgttaacactgtttactgttttttcacatgtagaaatgttctttgtgtattttttctacagaggattttctctgattttattttctttgtttctgactctaataattagttggaaactcatataaaatgagctttcctaaattaaatctattttaaataaaggttattactatt

SEQ ID NO: 278336 - DNA, 458 bp, Homo sapiens
aatataatttttaaaggaaatagcccttatcacatagcactttttcttttgatgaaaccgtattttttacgtagtttatgaaacctgttatatctaaaatttaatttccttaatttttcttttctttgtagatagttggttgccactttaggtctattccagtgaatgaaaaagacaccttaacatatttcatctactcagtgaagaatgacaagaacaaatcagatctcaaggttgatagtggtgttcactaggagacgtggaattgagactaataacttggatgttaacactgtttactgttttttcacatgtagaaatgttctttgtgtattttttctacagaggattttctctgattttattttctttgtttctgactctaataattagttggaaactcatataaaatgagctttcctaaattaaatctattttaaataaaggttattactatt

SEQ ID NO: 278337 - DNA, 381 bp, Homo sapiens
ttttttttgattttggaagtaaatttttattgtgctgaagttaaaatgtttgttattatacatatcaatgataaattttcaacaaattgtatgaactcatttatacatgttaattttttctaggttgatttataccaattacaagtaaatacacttaggagatacaaaagacacttcaagctaccaaccagaccaggacttaataaagcacaacttgttgaggtatatatgagttttaaactatttgaactatctgcacaaccgagaggttattaagtgctaatggaagttttaatgtagtgtatgtaacagtacattttaattagaaagaacaaagttaaaaaatctgttgtggaagaatctagttgtgtagaaatgttt

SEQ ID NO: 278338 - DNA, 1551 bp, Homo sapiens
cgcgctatgcatgctaggattagtagttcctccgtccctcatggcgcggggtcagggcggagctcaggttgactctgcagcagagaactacaattcccatggggccgcgcggcagaaagaaaggggcgggacgggagggggcgcgtcgcgcttgcgcaggtcccggggccggagggaggcggaggcgtagcggtccaactgctgaagtccccatgtgacagtgagcggggtccccgctccaggagacgctcgagtctgcgtcccggccctcagcactgtccactgtttcggtgccagcagagaccagcaggcccgggacagttggtgtttggccgtgccgctgtctaacttggtgtgcagagtgaattgccgctgccggagcggagagaggcggagcggccaggagagaggggatttctgtcagcgccggcctcgggagctcggagacatgaacggcttcacgcctgacgagatgagccgcggcggggatgcggccgccgcagtggccgcagtggtcgctgccgcggccgccgccgcctcggcggggaacgggaccggcgcgggcaccggggctgaggtgccgggcgcgggggcggtctcagcggctgggcccccgggggcggccgggccgggccccgggcaactgtgctgcctgcgggaggatggtgagcggtgcggccgggcggcaggcaacgccagcttcagcaagaggatccagaagagcatctcccagaagaaggtgaagatcgagctggataagagcgcaaggcatctttacatatgtgattatcataaaaacttaattcagagtgttcgaaacagaagaaagagaaaagggagtgatgatgatggaggtgattcacctgttcaagatattgataccccagaggttgatttataccaattacaagtaaatacacttaggagatacaaaagacacttcaagctaccaaccagaccaggacttaataaagcacaacttgttgagatagttggttgccactttaggtctattccagtgaatgaaaaagacaccttaacatatttcatctactcagtgaagaatgacaagaacaaatcagatctcaaggttgatagtggtgttcactaggagacgtggaattgagactaataacttggatgttaacactgtttactgttttttcacatgtagaaatgttctttgtgtattttttctacagaggattttctctgattttattttctttgtttctgactctaataattagttggaaactcatataaaatgagctttcctaaattaaatctattttaaataaaggttattactattatagttgcttcagtgtatttattttgtgaaacttgatttttcttttaaactgactaagagatcagtattgagattttaatgtaaagtccttcattttgtaatccttttttttttttttttttaaacttccaagaaattaacagggtaaggagaagtaacaaatgtagcacatttgcattctctgggacaatctgacttggaagtgaagataatctaaatagcattattttttaaag

SEQ ID NO: 278339 - DNA, 836 bp, Homo sapiens
aaataaaaataagaaatcaataggtatcgagacaaaaaaaaaagtttagcaaggcatctttacatatgtgattatcataaaaacttaattcagagtgttcgaaacagaagaaagagaaaagggagtgatgatgatggaggtgattcacctgttcaagatattgataccccagaggttgatttataccaattacaagtaaatacacttaggagatacaaaagacacttcaagctaccaaccagaccaggacttaataaagcacaacttgttgagatagttggttgccactttaggtctattccagtgaatgaaaaagacaccttaacatatttcatctactcagtgaagaatgacaagaacaaatcagatctcaaggttgatagtggtgttcactaggagacgtggaattgagactaataacttggatgttaacactgtttactgttttttcacatgtagaaatgttctttgtgtattttttctacagaggattttctctgattttattttctttgtttctgactctaataattagttggaaactcatataaaatgagctttcctaaattaaatctattttaaataaaggttattactattatagttgcttcagtgtatttattttgtgaaacttgatttttcttttaaactgactaagagatcagtattgagattttaatgtaaagtccttcattttgtaatccttttttttttttttttttaaacttccaagaaattaacagggtaaggagaagtaacaaatgtagcacatttgcattctctgggacaatctgacttggaagtgaagataatctaaatagcattattttttaaag

SEQ ID NO: 278340 - DNA, 549 bp, Homo sapiens
ttttttttgattttggaagtaaatttttattgtgctgaagttaaaatgtttgttattatacatatcaatgataaattttcaacaaattgtatgaactcatttatacatgttaattttttctaggttgatttataccaattacaagtaaatacacttaggagatacaaaagacacttcaagctaccaaccagaccaggacttaataaagcacaacttgttgagatagttggttgccactttaggtctattccagtgaatgaaaaagacaccttaacatatttcatctactcagtgaagaatgacaagaacaaatcagatctcaaggttgatagtggtgttcactaggagacgtggaattgagactaataacttggatgttaacactgtttactgttttttcacatgtagaaatgttctttgtgtattttttctacagaggattttctctgattttattttctttgtttctgactctaataattagttggaaactcatataaaatgagctttcctaaattaaatctattttaaataaaggttattactatt

SEQ ID NO: 278341 - DNA, 514 bp, Homo sapiens
tccattggccaacgctctgggaagaaagagaaaagggagtgatgatgatggaggtgattcacctgttcaagatattgataccccagaggttgatttataccaattacaagtaaatacacttaggagatacaaaagacacttcaagctaccaaccagaccaggacttaataaagcacaacttgttgagatagttggttgccactttaggtctattccagtgaatgaaaaagacaccttaacatatttcatctactcagtgaagaatgacaagaacaaatcagatctcaaggttgatagtggtgttcactaggagacgtggaattgagactaataacttggatgttaacactgtttactgttttttcacatgtagaaatgttctttgtgtattttttctacagaggattttctctgattttattttctttgtttctgactctaataattagttggaaactcatataaaatgagctttcctaaattaaatctattttaaataaaggttattactatt

SEQ ID NO: 278342 - DNA, 1463 bp, Homo sapiens
tcaggaaatgcgctttctgctccccgcgcccggtagagctaatgcagggaagtttctgggaacattcgaccagcgtttgtattggagtcgaggaacttctctgaaaaccaattctacgatattccagcagctaaacacagcccgaattccctagaaacagagagagcgagagaaaacactgtaaaccccaatcacacgctcctgttttcccgagaccagcaggcccgggacagttggtgtttggccgtgccgctgtctaacttggtgtgcagagtgaattgccgctgccggagcggagagaggcggagcggccaggagagaggggatttctgtcagcgccggcctcgggagctcggagacatgaacggcttcacgcctgacgagatgagccgcggcggggatgcggccgccgcagtggccgcagtggtcgctgccgcggccgccgccgcctcggcggggaacgggaccggcgcgggcaccggggctgaggtgccgggcgcgggggcggtctcagcggctgggcccccgggggcggccgggccgggccccgggcaactgtgctgcctgcgggaggatggtgagcggtgcggccgggcggcaggcaacgccagcttcagcaagaggatccagaagagcatctcccagaagaaggtgaagatcgagctggataagagcgcaaggcatctttacatatgtgattatcataaaaacttaattcagagtgttcgaaacagaagaaagagaaaagggagtgatgatgatggaggtgattcacctgttcaagatattgataccccagaggttgatttataccaattacaagtaaatacacttaggagatacaaaagacacttcaagctaccaaccagaccaggacttaataaagcacaacttgttgagatagttggttgccactttaggtctattccagtgaatgaaaaagacaccttaacatatttcatctactcagtgaagaatgacaagaacaaatcagatctcaaggttgatagtggtgttcactaggagacgtggaattgagactaataacttggatgttaacactgtttactgttttttcacatgtagaaatgttctttgtgtattttttctacagaggattttctctgattttattttctttgtttctgactctaataattagttggaaactcatataaaatgagctttcctaaattaaatctattttaaataaaggttattactattatagttgcttcagtgtatttattttgtgaaacttgatttttcttttaaactgactaagagatcagtattgagattttaatgtaaagtccttcattttgtaatccttttttttttttttttttaaacttccaagaaattaacagggtaaggagaagtaacaaatgtagcacatttgcattctctgggacaatctgacttggaagtgaagataatctaaatagcattattttttaaag

SEQ ID NO: 278343 - DNA, 750 bp, Homo sapiens
tccattggccaacgctctgggaagaaagagaaaagggagtgatgatgatggaggtgattcacctgttcaagatattgataccccagaggttgatttataccaattacaagtaaatacacttaggagatacaaaagacacttcaagctaccaaccagaccaggacttaataaagcacaacttgttgagatagttggttgccactttaggtctattccagtgaatgaaaaagacaccttaacatatttcatctactcagtgaagaatgacaagaacaaatcagatctcaaggttgatagtggtgttcactaggagacgtggaattgagactaataacttggatgttaacactgtttactgttttttcacatgtagaaatgttctttgtgtattttttctacagaggattttctctgattttattttctttgtttctgactctaataattagttggaaactcatataaaatgagctttcctaaattaaatctattttaaataaaggttattactattatagttgcttcagtgtatttattttgtgaaacttgatttttcttttaaactgactaagagatcagtattgagattttaatgtaaagtccttcattttgtaatccttttttttttttttttttaaacttccaagaaattaacagggtaaggagaagtaacaaatgtagcacatttgcattctctgggacaatctgacttggaagtgaagataatctaaatagcattattttttaaag

SEQ ID NO: 278344 - DNA, 1109 bp, Homo sapiens
cattctctcggcggcatctggggttccaggcgggcagcagctgcaggctgaccttgcagcttggcggaatggactggcctcacaacctgctgtttcttcttaccatttccatcttcctggggctgggccagcccaggagccccaaaagcaagaggaaggggcaagggcggcctgggcccctggcccctggccctcaccaggtgccactggacctggtgtcacggatgaaaccgtatgcccgcatggaggagtatgagaggaacatcgaggagatggtggcccagctgaggaacagctcagagctggcccagagaaagtgtgaggtcaacttgcagctgtggatgtccaacaagaggagcctgtctccctggggctacagcatcaaccacgaccccagccgtatccccgtggacctgccggaggcacggtgcctgtgtctgggctgtgtgaaccccttcaccatgcaggaggaccgcagcatggtgagcgtgccggtgttcagccaggttcctgtgcgccgccgcctctgcccgccaccgccccgcacagggccttgccgccagcgcgcagtcatggagaccatcgctgtgggctgcacctgcatcttctgaatcacctggcccagaagccaggccagcagcccgagaccatcctccttgcacctttgtgccaagaaaggcctatgaaaaagtggatactggttaaaattaccccaggaagcttcggctgggttccagacacatggaaaacagacttcctgtgccagcgcatgctgatcccttcagcagccgcttctccacccttggggctgctctccagcacctggcagtgtccagagcggataggggcgccgtgtttggtgaatgagtgcacagacgcctctagggggagcccaagatctgcctcctgcctccctctattatgccttcataggtgggtcagaacaaagaattccttatcaacctcccgggtcccccactgccaatcacccacctccattctaccctctacagctgccccttatcccccaaagtcctgaaattttgcttgggtcacctgctccaggaggcagagttcccatgaagggtattaaacgtctactacactgc

SEQ ID NO: 278345 - DNA, 722 bp, Homo sapiens
cattctctcggcggcatctggggttccaggcgggcagcagctgcaggctgaccttgcagcttggcggaatggactggcctcacaacctgctgtttcttcttaccatttccatcttcctggggctgggccagcccaggagccccaaaagcaagaggaaggggcaagggcggcctgggcccctggcccctggccctcaccaggtgccactggacctggtgtcacggatgaaaccgtatgcccgcatggaggagtatgagaggaacatcgaggagatggtggcccagctgaggaacagctcagagctggcccagagaaagtgtgaggtcaacttgcagctgtggatgtccaacaagaggagcctgtctccctggggctacagcatcaaccacgaccccagccgtatccccgtggacctgccggaggcacggtgcctgtgtctgggctgtgtgaaccccttcaccatgcaggaggaccgcagcatggtgagcgtgccggtgttcagccaggttcctgtgcgccgccgcctctgcccgccaccgccccgcacagggccttgccgccagcgcgcagtcatggagaccatcgctgtgggctgcacctgcatcttctgaatcacctggcccagaagccaggccagcagcccgagaccatcctccttgcacctttgtgccaagaaaggcctatgaaaagtaaacactgacttttgaaagcaaaaaaaaaag

SEQ ID NO: 278346 - DNA, 352 bp, Homo sapiens
gattgtaagtgactttatattatttaacctcagtattggatggttttgggttcaaagattgtcccatgttttgtggcagtattctttttaatgaattgttcctgtgcaattcagaaaatgttgcttgtagtcctggatttatttcttattagactgggactttgagagagtcagtatacccttgtgtgcctcattttcttatccatataatgaaggggtcagtgacctgtggaaatacctcaaagatcatctcacattctctctaggatgcatgagccaccatgcctggcctaatttttattttttgtagggacagagtcttgctatgttgcctagactggccttgaactca

SEQ ID NO: 278347 - DNA, 448 bp, Homo sapiens
taccagttttccacagagaattccacatgtctccactccccgggcagtgttggcactggctaactggagaaactgtgggcacagccgcccaggcaccaccacatggcgcaatccatcgattgtgggaactgtaaaggagaaaggagaatagtctgcgaccactgagccctgcctcctcaagcagacctcacagccagcagccctggaggagcaacattaagccactgggattcccccaacttcaggcagatctggtactcagatgcagagactactacttttatcttgaagtcagtctgtgctgctctgaagcttttagatgggcaacaatgaaagtgaagacccacctttactgtgtctttcttttcaggaatgacagcagatttgtaatctcgatgttttggtagtttctcaataaagagcctaaggaaacagttcaaaatgatta

SEQ ID NO: 278348 - DNA, 484 bp, Homo sapiens
taccagttttccacagagaattccacatgtctccactccccgggcagtgttggcactggctaactggagaaactgtgggcacagccgcccaggcaccaccacatggcgcaatccatcgattgtgggaactgtaaaggagaaaggagaatagtctgcgaccactgagccctgcctcctcaagcagacctcacagccagcagccctggaggagcaacattaagccactgggattcccccaacttcaggcagtgagtagggatctcattctaatggcaccaaaaaaagggctgtaaagtgtcttctccaatcttgggccacagctgtaaggagcacattacttcaagaagagaaaatagtaggctttaattattcaagttaagaaaagggcaaactactaccttaagaaaagttttcttaaaaataaccttaagaatgtaattggattgtttgtaactcaaaggataaatacttgaggggatggaaa

SEQ ID NO: 278349 - DNA, 326 bp, Homo sapiens
cttgccgggcttcttgtcgtcgcggggcaccttgacgaagcactcgttgagcgagaggttgtggcggatgctgttctgccagccctgcttgttctcccggtagaaggggaagcggtccatgatgaactggtagatgccgttcaaggtttccttgcacccttcctggctgttcatcggctgcgtattcgattctcagcaaaaggatgttgagacaacccaccaggcctcttcgcttcggcctcttcgcttcggggaggcgactagaaggcaatggggcgtgccacttatttccaataaaagaacagaagacgaaaatgtagatgcat

SEQ ID NO: 278350 - DNA, 697 bp, Homo sapiens
agtaaaggaagcctggaatgctggaagatctacaaacaatattatctgaacaacagttacagctgtgattaaagtacaaagagaaaaaaaacagtagatttaacagtaaactaggtggaggaagggatagaagctaaacagcatttcactgtagtaggaaaaacactgacttgagagttaataagtgttcaagtattttattgtaattctttaattgtttgttaaacctaaacatagtttgatagtgtttttttgctgctgattatatatcctgatatcagctggtttatattccttaaattagggaaaaatgttcaattttttcaaatggtttttcaaagtttctacttgttcaaatcaagtagaactaattaattctctatccaaagattttagacatgcctccagacccaaatactctgatgagaaaaagacagcttctctgtttttggaactcaaactttcagcaacatgctttcaatattaacatataatagactactgttatatgacactaaatgtaaaatctaagtgaatatactttattggacatacttttttgataactttcataacaagttagcatgaacacaaataatatctcactttattatagaacacaacataatcttttacattctatttaaggtccttcctacaccctactgcataatcatccacaaatataactttatcc

SEQ ID NO: 278351 - DNA, 439 bp, Homo sapiens
atttaaaagtaataaagacaaactacagttacttgggtgagttggctccccaggcttttgagatacctgccttttgtccagcactgcatcgtcctcgcatatccaaggctgtgtctcccttcagcatcaccactcggcttttagcagactgaagccatggtttttagttttgtctctagtgatgagcagaaaagagggatgaggaagaggctttactggtccaaccagaaagagaagctaagaacccatgactggattctctcccttggacaccccacagaccaatatctcaccttccaggagaagacccttccagctcttgcttctttaaacctattaacttagttttctttagctagactcccaaacatcagcttttacaattcagcctatggttcaatcactatggcaagataaacatttgtttaggtgtgaaaca

SEQ ID NO: 278352 - DNA, 649 bp, Homo sapiens
cttaatgagactccttactatactggaatattcattctagcttaagctagaatctggtttgcaatactattatgtcattgattctgaaacatcttatggttataattgcattttttcattcctgctggcacataaaatagtggtatgtcttataactgatgagacagtgaccttattctgataaggagtgccatgaaaactctaacgggtcttcagcttcttgttctacatttagcctatcctgtgagaatgcttcaggcccttcttttaaaagtctacataatgttgcaggaaatgttggttagcttcaggagagtgtaataatagtagctgagcctgattcattttatatagcagcaaagagcttcccaccattcaggtgtagccttgggtgcttccactgcactgatgtttgtttctctctttcagttacttgggtgagttggctccccaggcttttgagatacctgccttttgtccagcactgcatcgtcctcgcatatccaaggctgtgtctcccttcagcatcaccactcggtagttataattccgccttttatcagaagctgatacattttcatcggcatcagaccgtatttctatgtattcaatatctgacacaggaagaagaatattttagaggaaccta

SEQ ID NO: 278353 - DNA, 394 bp, Homo sapiens
gcctcttcgctttgctctggccccgaagcgctgggattgggacctcccttcctcccgaccagctcatcctgggaaagctggggttgctttttcgggtttctctggactctgggtctccgttggcaaagacatgatgcccagtcaggaggagtaaggcctgagagagttgtttttttacttgggtgagttggctccccaggcttttgagatacctgccttttgtccagcactgcatcgtcctcgcatatccaaggctgtgtctcccttcagcatcaccactcggtagttataattccgccttttatcagaagctgatacattttcatcggcatcagaccgtatttctatgtattcaatatctgacacaggaagaagaatattttagaggaaccta

SEQ ID NO: 278354 - DNA, 1697 bp, Homo sapiens
cttaatgagactccttactatactggaatattcattctagcttaagctagaatctggtttgcaatactattatgtcattgattctgaaacatcttatggttataattgcattttttcattcctgctggcacataaaatagtggtatgtcttataactgatgagacagtgaccttattctgataaggagtgccatgaaaactctaacgggtcttcagcttcttgttctacatttagcctatcctgtgagaatgcttcaggcccttcttttaaaagtctacataatgttgcaggaaatgttggttagcttcaggagagtgtaataatagtagctgagcctgattcattttatatagcagcaaagagcttcccaccattcaggtgtagccttgggtgcttccactgcactgatgtttgtttctctctttcagttacttgggtgagttggctccccaggcttttgagatacctgccttttgtccagcactgcatcgtcctcgcatatccaaggctgtgtctcccttcagcatcaccactcggcttttagcagactgaagccatggtttttagttttgtctctagtgatgagcagaaaagagggatgaggaagaggctttactggtccaaccagaaagagaagctaagaacccatgactggattctctcccttggacaccccacagaccaatatctcaccttccaggagaagacccttccagctcttgcttctttaaacctattaacttagttttctttagctagactcccaaacatcagcttttacaattcagcctatggttcaatcactatggcaagataaacatttgtttaggtgtgaaacaccactggctatctttgggttttgtaatctaccctcttgaggttgcaggagctactgtgaaaccttactgcatccatggtcatgatagagatggtgactctaaggtgagccctgaataaagccctcatctgaagctcccctcgaatgcagggacccaggctctgaagagcctcacagaaagctggctaccttggatgcaaaactgtaaaggttacgtgtttacaatgagtcttaaaagaagcatgacctggccaggtgcgtggctcatgcttgtaatcccagcactttgggaggccaaggcaggtggatcacaaggtcaagagatcaagaccatcctggccaacatggtgaaaccccgtctctactaaaaatacaaaaaattagcccgggtgtggtggcaggcgcctgtaatcccagctacttgggaggccgaggcagaaaattgcttgaacccgggaggtggagatggcagtgagctgagatcgcaccattgggagtccagcctgggcaaaaagagcgaaactctgtctcaaaaaaaaaaaaaaaagtattacctaatatgcaaccttccacatctggggaaaaatgagagtagaacattttgggcatggggtagaacaccatatcttgagtgatatattctaacatcatttaaattggtatattgtattagtatggggtaatacattccaaatgatggataatttcccccttttcatctatgtgtctctgaccactgccaatgcttatacttagtgatgtttttagatgattactaataacagatggtaatcagcttttcttgaaaatgcactgctgacttcctgtgttaccttaaatagacagctgaacgcaaca

SEQ ID NO: 278355 - DNA, 414 bp, Homo sapiens
accccgcgggcccggccgagcggcagcccctgccctggagggtggtctccagggaccaaggcgtggcgggcggtgcggagaggcgcggcacagatggctacatcagaggaatttctccacatattcagaacgtcctaaaagctccacaaaatcttcatcatgagtgattaccagaagctggaagttacgctgctttacttgggtgagttggctccccaggcttttgagatacctgccttttgtccagcactgcatcgtcctcgcatatccaaggctgtgtctcccttcagcatcaccactcggtagttataattccgccttttatcagaagctgatacattttcatcggcatcagaccgtatttctatgtattcaatatctgacacaggaagaagaatattttagaggaaccta

SEQ ID NO: 278356 - DNA, 899 bp, Homo sapiens
  misc_feature (1)..(3): n is a, c, g, or t
  misc_feature (5)..(6): n is a, c, g, or t
  misc_feature (17)..(17): n is a, c, g, or t
  misc_feature (24)..(24): n is a, c, g, or t
  misc_feature (26)..(27): n is a, c, g, or t
  misc_feature (54)..(54): n is a, c, g, or t
  misc_feature (70)..(70): n is a, c, g, or t
  misc_feature (85)..(85): n is a, c, g, or t
  misc_feature (97)..(97): n is a, c, g, or t
nnncnncactgcctgcnctgctgnannacccgcacatcaatgccatgtttcttnaggtactccacagttnatgaaggcacctggnaaggtggaaaanagatgagtaagtagggggaaaggccccccaggggttcctttactgccatgaggcaggtgtactctacagaattagacagtgacaatcgtcacttcacgatcactcagtgtatcaccagtccaaaatttggcagtgagccccaatgagtcaaaaaggcctctttgtcagaggtatcataatacccatgcataaagctcaagtgaaatggaaatgaaagaacatgggatttgcagttagccttggatttacatccttactagcactgtaaccttgggtaagtaaattaaattctctgagtctttgttttcatgtctgtaaattagggacattaacacctagggttggtatgacaactaactgagctaagggtatgtgaaacatctaccttggtgtgcaaactccataaatgttaaatgtttgagttagtctaaactgagtctaaatttcttctttgccgcatactagctaagaaatgttaggctagctctttaaagtctcccagccccaatttcttcccttgtaaaataggtataatagtacttacatcacagggttggtgtgaggatgaaattgactcatgtatgtacactgcagctcaaatgtcttctcacaaaggcctttcttgcccaccccctactagcccagcataagtcaccattttcctcactgcgtttattattatctgaagttgtctagttttttattatccatgaggggcatgaaccttgtttgtcttgtttatcgcaccgtcaccagtttctagaatagtgccttacccatagaaaatgcttaataaatatct

SEQ ID NO: 278357 - DNA, 488 bp, Homo sapiens
ctcagcttcggcattccagcctggaacaatcctcccagacctggaggtccgccccctccaaaacttccaccgcctccgccaccacctcctccgccaaatccgccgcctccaccaaagccaccaccaccgcctccagcaccagctcctttaggttctgtagaagaagagacacccgacagactatgccccctggtctggcccagaaatggactggagaagctaaaaaagacactgctggacttgtcacagccgccgggaaacaagaattaagacagtttggaagagtcccattcaaagtgggcggtctagaaaatgaaaattttaaattccacagcagcaacagcagctctcatgtatggagaatctgctggatccagggctctatccttgcgtggtctctgactcctaagacagcggaagccagcatcgctgtgctcatttgatagactcagagaaattaaatcactccctaaaacaccctgaagcaa

SEQ ID NO: 278358 - DNA, 538 bp, Homo sapiens
tgcactgtcagcttgtccacttttgaggtgttggcacttggactgatccaccactggcttcctcgctccccagcttgcagacggcctattgtgggacttcaccttgtgatcagaggccagtttgctattcttagttccagcggaagtggatctgacgtgggcgatcagcaccttcctttaccaatggcttatggaactcacgtccagcacgagagtggatatttgcccaacaaaactcacagtaatactgcagaatatgtacagacaaaaacaagtatgctaatgaaatttcttcaaatactataaacaattagtgaagactgctactataggctgctgctgtatttttaagaggctcaacttcaaatacttcaaccttttatggaaagatggaaacacacaacaaactatgtagatcttgatacaagtctccatcaagttgattcattttcaaaagtaaattacatcctaatctcaaacctgtggcaagacaagtcaaatcatcaaagaatggtaaatccatcaaaacgctaataat

SEQ ID NO: 278359 - DNA, 2932 bp, Homo sapiens
gttatgaataaagcaagggcagaaaaaaacatgtaggggagagaatgaggaactaggtccaggagatgctgaaactgaataataaagacgtcatatcacaccccttggggtatccatctgagagcttgctttccattgccagcatgctggacagcagtgacagctccagtcagccccactggagcaacgagctcatagcggaacagctacagcagcaagtctctcagctgcaggatcagctggatgctgagctggaggacaagagaaaagttttacttgagctgtccagggagaaagcccaaaatgaggatctgaagcttgaagtcaccaacatacttcagaagcataaacaggaagtagagctcctccaaaatgcagccacaatttcccaacctcctgacaggcaatctgaaccagccactcacccagctgtattgcaagagaacactcagatcgagccaagtgaacccaaaaaccaagaagaaaagaaactgtcccaggtgctaaatgagttgcaagtatcacacgcagagaccacattggaactagaaaagaccagggacatgcttattctgcagcgcaaaatcaacgtgtgttatcaggtgcaaggaaagatggtacaggaaggggatggataacaggaacgtgggaaccactcacaggactgggaatgaagcaagacctaagtttccagggctgataccaggaggaactggaggcaatgatgacaaaagctgacaatgataatagagatcacaaagaaaagctggagaggttgactcgactactagacctcaagaataaccgtatcaagcagctggaaggtattttaagaagccatgaccttccaacatctgggtgagaatctttttgaactgcacatccaccaggccttcctgacatctgccgccctagctcaggctggagatacccaacctaccactttctgcacctattccttctatgactttgaaacccactgtaccccattatctgtggggccacagcccctctatgacttcacctcccagtatgtgatggagacagattcgcttttcttacactaccttcaagaggcttcagcccggcttgacatacaccaggccatggccagtgaacacagcactcttgctgcaggatggatttgctttgacagggtgctagagactgtggagaaagtccatggcttggccacactgattggagctggtggagaagagttcggggttctagagtactggatgaggctgcgtttccccataaaacccagcctacaggcgtgcaataaacgaaagaaagcccaggtctacctgtcaaccgatgtgcttggaggccggaaggcccaggaagaggagttcagatcggagtcttgggaacctcagaacgagctgtggattgaaatcaccaagtgctgtggcctccggagtcgatggctgggaactcaacccagtccatatgctgtgtaccgcttcttcaccttttctgaccatgacactgccatcattccagccagtaacaacccctactttagagaccaggctcgattcccagtgcttgtgacctctgacctggaccattatctgagacgggaggccttgtctatacatgtttttgatgatgaagacttagagcctggctcgtatcttggccgagcccgagtgcctttactgcctcttgcaaaaaatgaatctatcaaaggtgattttaacctcactgaccctgcagagaaacccaacggatctattcaagtgcaactggattggaagtttccctacataccccctgagagcttcctgaaaccagaagctcagactaaggggaaggataccaaggacagttcaaagatctcatctgaagaggaaaaggcttcatttccttcccaggatcagatggcatctcctgaggttcccattgaagctggccagtatcgatctaagagaaaacctcctcatgggggagaaagaaaggagaaggagcaccaggttgtgagctactcaagaagaaaacatggcaaaagaataggtgttcaaggaaagaatagaatggagtatcttagccttaacatcttaaatggaaatacaccagagcaggtgaattacactgagtggaagttctcagagactaacagcttcataggtgatggctttaaaaatcagcacgaggaagaggaaatgacattatcccattcagcactgaaacagaaggaacctctacatcctgtaaatgacaaagaatcctctgaacaaggttctgaagtcagtgaagcacaaactaccgacagtgatgatgtcatagtgccacccatgtctcagaaatatcctaaggcagattcagagaagatgtgcattgaaattgtctccctggccttctacccagaggcagaagtgatgtctgatgagaacataaaacaggtgtatgtggagtacaaattctacgacctacccttgtcggagacagagactccagtgtccctaaggaagcctagggcaggagaagaaatccactttcactttagcaaggtaatagacctggacccacaggagcagcaaggccgaaggcggtttctgttcgacatgctgaatggacaagatcctgatcaaggacatttaaagtttacagtggtaagtgatcctctggatgaagaaaagaaagaatgtgaagaagtgggatatgcatatcttcaactgtggcagatcctggagtcaggaagagatattctagagcaagagctagacattgttagccctgaagatctggctaccccaataggaaggctgaaggtttcccttcaagcagctgctgtcctccatgctatttacaaggagatgactgaagatttgttttcatgaaggaacaagtgctattccaatctaaaagtctctgagggaaccatagtaaaaagtctcttataaagttagcttgctataacatg

SEQ ID NO: 278360 - DNA, 2801 bp, Homo sapiens
gttatgaataaagcaagggcagaaaaaaacatgtaggggagagaatgaggaactaggtccaggagatgctgaaactgaataataaagacgtcatatcacaccccttggggtatccatctgagagcttgctttccattgccagcatgctggacagcagtgacagctccagtcagccccactggagcaacgagctcatagcggaacagctacagcagcaagtctctcagctgcaggatcagctggatgctgagctggaggacaagagaaaagttttacttgagctgtccagggagaaagcccaaaatgaggatctgaagcttgaagtcaccaacatacttcagaagcataaacaggaagtagagctcctccaaaatgcagccacaatttcccaacctcctgacaggcaatctgaaccagccactcacccagctgtattgcaagagaacactcagatcgagccaagtgaacccaaaaaccaagaagaaaagaaactgtcccaggtgctaaatgagttgcaagtatcacacgcagagaccacattggaactagaaaagaccagggacatgcttattctgcagcgcaaaatcaacgtgtgttatcaggaggaactggaggcaatgatgacaaaagctgacaatgataatagagatcacaaagaaaagctggagaggttgactcgactactagacctcaagaataaccgtatcaagcagctggaagaaagagctccctaccctttaacggataggcagctttctttcccctctagaacagctcaaagatgttgcttatggcacccgaccgttgtcgttatgtttggaaacactgccagcccatggagatgaggataaagtggatatttctctgctgcatcagcccctctatgacttcacctcccagtatgtgatggagacagattcgcttttcttacactaccttcaagaggcttcagcccggcttgacatacaccaggccatggccagtgaacacagcactcttgctgcaggatggatttgctttgacagggtgctagagactgtggagaaagtccatggcttggccacactgattggagctggtggagaagagttcggggttctagagtactggatgaggctgcgtttccccataaaacccagcctacaggcgtgcaataaacgaaagaaagcccaggtctacctgtcaaccgatgtgcttggaggccggaaggcccaggaagaggagttcagatcggagtcttgggaacctcagaacgagctgtggattgaaatcaccaagtgctgtggcctccggagtcgatggctgggaactcaacccagtccatatgctgtgtaccgcttcttcaccttttctgaccatgacactgccatcattccagccagtaacaacccctactttagagaccaggctcgattcccagtgcttgtgacctctgacctggaccattatctgagacgggaggccttgtctatacatgtttttgatgatgaagacttagagcctggctcgtatcttggccgagcccgagtgcctttactgcctcttgcaaaaaatgaatctatcaaaggtgattttaacctcactgaccctgcagagaaacccaacggatctattcaagtgcaactggattggaagtttccctacataccccctgagagcttcctgaaaccagaagctcagactaaggggaaggataccaaggacagttcaaagatctcatctgaagaggaaaaggcttcatttccttcccaggatcagatggcatctcctgaggttcccattgaagctggccagtatcgatctaagagaaaacctcctcatgggggagaaagaaaggagaaggagcaccaggttgtgagctactcaagaagaaaacatggcaaaagaataggtgttcaaggaaagaatagaatggagtatcttagccttaacatcttaaatggaaatacaccagagcaggtgaattacactgagtggaagttctcagagactaacagcttcataggtgatggctttaaaaatcagcacgaggaagaggaaatgacattatcccattcagcactgaaacagaaggaacctctacatcctgtaaatgacaaagaatcctctgaacaaggttctgaagtcagtgaagcacaaactaccgacagtgatgatgtcatagtgccacccatgtctcagaaatatcctaaggcagattcagagaagatgtgcattgaaattgtctccctggccttctacccagaggcagaagtgatgtctgatgagaacataaaacaggtgtatgtggagtacaaattctacgacctacccttgtcggagacagagactccagtgtccctaaggaagcctagggcaggagaagaaatccactttcactttagcaaggtaatagacctggacccacaggagcagcaaggccgaaggcggtttctgttcgacatgctgaatggacaagatcctgatcaaggacatttaaagtttacagtggtaagtgatcctctggatgaagaaaagaaagaatgtgaagaagtgggatatgcatatcttcaactgtggcagatcctggagtcaggaagagatattctagagcaagagctagacattgttagccctgaagatctggctaccccaataggaaggctgaaggtttcccttcaagcagctgctgtcctccatgctatttacaaggagatgactgaagatttgttttcatgaaggaacaagtgctattccaatctaaaagtctctgagggaaccatagtaaaaagtctcttataaagttagcttgctataacatg

SEQ ID NO: 278361 - DNA, 2935 bp, Homo sapiens
gttatgaataaagcaagggcagaaaaaaacatgtaggggagagaatgaggaactaggtccaggagatgctgaaactgaataataaagacgtcatatcacaccccttggggtatccatctgagagcttgctttccattgccagcatgctggacagcagtgacagctccagtcagccccactggagcaacgagctcatagcggaacagctacagcagcaagtctctcagctgcaggatcagctggatgctgagctggaggacaagagaaaagttttacttgagctgtccagggagaaagcccaaaatgaggatctgaagcttgaagtcaccaacatacttcagaagcataaacaggaagtagagctcctccaaaatgcagccacaatttcccaacctcctgacaggcaatctgaaccagccactcacccagctgtattgcaagagaacactcagatcgagccaagtgaacccaaaaaccaagaagaaaagaaactgtcccaggtgctaaatgagttgcaagtatcacacgcagagaccacattggaactagaaaagaccagggacatgcttattctgcagcgcaaaatcaacgtgtgttatcaggaggaactggaggcaatgatgacaaaagctgacaatgataatagagatcacaaagaaaagctggagaggttgactcgactactagacctcaagaataaccgtatcaagcagctggaaggtattttaagaagccatgaccttccaacatctgaacagctcaaagatgttgcttatggcacccgaccgttgtcgttatgtttggaaacactgccagcccatggagatgaggataaagtggatatttctctgctgcatcagggtgagaatctttttgaactgcacatccaccaggccttcctgacatctgccgccctagctcaggctggagatacccaacctaccactttctgcacctattccttctatgactttgaaacccactgtaccccattatctgtggggccacagcccctctatgacttcacctcccagtatgtgatggagacagattcgcttttcttacactaccttcaagaggcttcagcccggcttgacatacaccaggccatggccagtgaacacagcactcttgctgcaggatggatttgctttgacagggtgctagagactgtggagaaagtccatggcttggccacactgattggagctggtggagaagagttcggggttctagagtactggatgaggctgcgtttccccataaaacccagcctacaggcgtgcaataaacgaaagaaagcccaggtctacctgtcaaccgatgtgcttggaggccggaaggcccaggaagaggagttcagatcggagtcttgggaacctcagaacgagctgtggattgaaatcaccaagtgctgtggcctccggagtcgatggctgggaactcaacccagtccatatgctgtgtaccgcttcttcaccttttctgaccatgacactgccatcattccagccagtaacaacccctactttagagaccaggctcgattcccagtgcttgtgacctctgacctggaccattatctgagacgggaggccttgtctatacatgtttttgatgatgaagacttagagcctggctcgtatcttggccgagcccgagtgcctttactgcctcttgcaaaaaatgaatctatcaaaggtgattttaacctcactgaccctgcagagaaacccaacggatctattcaagtgcaactggattggaagtttccctacataccccctgagagcttcctgaaaccagaagctcagactaaggggaaggataccaaggacagttcaaagatctcatctgaagaggaaaaggcttcatttccttcccaggatcagatggcatctcctgaggttcccattgaagctggccagtatcgatctaagagaaaacctcctcatgggggagaaagaaaggagaaggagcaccaggttgtgagctactcaagaagaaaacatggcaaaagaataggtgttcaaggaaagaatagaatggagtatcttagccttaacatcttaaatggaaatacaccagagcaggtgaattacactgagtggaagttctcagagactaacagcttcataggtgatggctttaaaaatcagcacgaggaagaggaaatgacattatcccattcagcactgaaacagaaggaacctctacatcctgtaaatgacaaagaatcctctgaacaaggttctgaagtcagtgaagcacaaactaccgacagtgatgatgtcatagtgccacccatgtctcagaaatatcctaaggcagattcagagaagatgtgcattgaaattgtctccctggccttctacccagaggcagaagtgatgtctgatgagaacataaaacaggtgtatgtggagtacaaattctacgacctacccttgtcggagacagagactccagtgtccctaaggaagcctagggcaggagaagaaatccactttcactttagcaaggtaatagacctggacccacaggagcagcaaggccgaaggcggtttctgttcgacatgctgaatggacaagatcctgatcaaggacatttaaagtttacagtggtaagtgatcctctggatgaagaaaagaaagaatgtgaagaagtgggatatgcatatcttcaactgtggcagatcctggagtcaggaagagatattctagagcaagagctagacattgttagccctgaagatctggctaccccaataggaaggctgaaggtttcccttcaagcagctgctgtcctccatgctatttacaaggagatgactgaagatttgttttcatgaaggaacaagtgctattccaatctaaaagtctctgagggaaccatagtaaaaagtctcttataaagttagcttgctataacatg

SEQ ID NO: 278362 - DNA, 3117 bp, Homo sapiens
gttatgaataaagcaagggcagaaaaaaacatgtaggggagagaatgaggaactaggtccaggagatgctgaaactgaataataaagacgtcatatcacaccccttggggtatccatctgagagcttgctttccattgccagcatgctggacagcagtgacagctccagtcagccccactggagcaacgagctcatagcggaacagctacagcagcaagtctctcagctgcaggatcagctggatgctgagctggaggacaagagaaaagttttacttgagctgtccagggagaaagcccaaaatgaggatctgaagcttgaagtcaccaacatacttcagaagcataaacaggaagtagagctcctccaaaatgcagccacaatttcccaacctcctgacaggcaatctgaaccagccactcacccagctgtattgcaagagaacactcagatcgagccaagtgaacccaaaaaccaagaagaaaagaaactgtcccaggtgctaaatgagttgcaagtatcacacgcagagaccacattggaactagaaaagaccagggacatgcttattctgcagcgcaaaatcaacgtgtgttatcaggaggaactggaggcaatgatgacaaaagctgacaatgataatagagatcacaaagaaaagctggagaggttgactcgactactagacctcaagaataaccgtatcaagcagctggaaggtattttaagaagccatgaccttccaacatctgaacagctcaaagatgttgcttatggcacccgaccgttgtcgttatgtttggaaacactgccagcccatggagatgaggataaagtggatatttctctgctgcatcagggtgagaatctttttgaactgcacatccaccaggccttcctgacatctgccgccctagctcaggctggagatacccaacctaccactttctgcacctattccttctatgactttgaaacccactgtaccccattatctgtggggccacagcccctctatgacttcacctcccagtatgtgatggagacagattcgcttttcttacactaccttcaagaggcttcagcccggcttgacatacaccaggccatggccagtgaacacagcactcttgctgcaggatggatttgctttgacagggtgctagagactgtggagaaagtccatggcttggccacactgattggagctggtggagaagagttcggggttctagagtactggatgaggctgcgtttccccataaaacccagcctacaggcgtgcaataaacgaaagaaagcccaggtctacctgtcaaccgatgtgcttggaggccggaaggcccaggaagaggagttcagatcggagtcttgggaacctcagaacgagctgtggattgaaatcaccaagtgctgtggcctccggagtcgatggctgggaactcaacccagtccatatgctgtgtaccgcttcttcaccttttctgaccatgacactgccatcattccagccagtaacaacccctactttagagaccaggctcgattcccagtgcttgtgacctctgacctggaccattatctgagacgggaggccttgtctatacatgtttttgatgatgaagacttagagcctggctcgtatcttggccgagcccgagtgcctttactgcctcttgcaaaaaatgaatctatcaaaggtgattttaacctcactgaccctgcagagaaacccaacggatctattcaagtgcaactggattggaagtttccctacataccccctgagagcttcctgaaaccagaagctcagactaaggggaaggataccaaggacagttcaaagatctcatctgaagaggaaaaggcttcatttccttcccaggatcagatggcatctcctgaggttcccattgaagctggccagtatcgatctaagagaaaacctcctcatgggggagaaagaaaggagaaggagcaccaggttgtgagctactcaagaagaaaacatggcaaaagaataggtgttcaaggaaagaatagaatggagtatcttagccttaacatcttaaatggaaatacaccagagcaggtgaattacactgagtggaagttctcagagactaacagcttcataggtgatggctttaaaaatcagcacgaggaagaggaaatgacattatcccattcagcactgaaacagaaggaacctctacatcctgtaaatgacaaagaatcctctgaacaaggttctgaagtcagtgaagcacaaactaccgacagtgatgatgtcatagtgccacccatgtctcagaaatatcctaaggcagattcagagaagatgtgcattgaaattgtctccctggccttctacccagaggcagaagtgatgtctgatgagaacataaaacaggtgtatgtggagtacaaattctacgacctacccttgtcggagacagagactccagtgtccctaaggaagcctagggcaggagaagaaatccactttcactttagcaaggtaatagacctggacccacaggagcagcaaggccgaaggcggtttctgttcgacatgctgaatggacaagatcctgatcaaggacatttaaagtttacagtggtaagtgatcctctggatgaagaaaagaaagaatgtgaagaagtgggatatgcatatcttcaactgtggcagatcctggagtcaggaagagatattctagagcaagagctagacattgttagccctgaagatctggctaccccaataggaaggctgaaggtttcccttcaagcagctgctgtcctccatgctatttacaaggagatgactgaagatttgttttcatgaaggaacaagtgctattccaatctaaaagtctctgagggaaccatagtaaaaagtctcttataaagttagcttgctataacatgaatttggtttactgtgatgtctagtgtctctcaatctaatgatgaaagtttagaatgatgaaagtttcatttgtaaaactagctagctaaaggcatttttctccagtaccttagcactttaccaggcaggaagcaggcttgctttcaagaactgaaaatgaacggtcacaggtgaatttaca

SEQ ID NO: 278363 - DNA, 1045 bp, Homo sapiens
  misc_feature (1)..(1): n is a, c, g, or t
ncatgcatacagcccagtctaacgtacaggatcaaaaagagaccttatttcggctggcaattaccttacccgcttgttcattatctgactcctgcactcctcccaagtgttcaatgttaaccagatggcaaagttaaccagacagaggaaatccacataattactctagatgaagccccctaactgcggattagaaggaaaagagatgaagggtgctgcactaataataacaaccattttcaaccaaggcaggattctgggcctagaatcttcagtgacaaattaccaggagaggaggagggaaatgaagagctggaggcctagggagatggtgtgaggagaggagactgtgcctttccacttcttaataattaatgttctcctgctgctctgagtctgcatcaccagtgattcagtttgagtcagacatccaacaacaactgagcaaaagaatcatctcagatccaagcaatggtgacgcgcagatagaagagactgaggccaacgaccaaagcaaaggacagcagaactgactgacacagctcagaaaatatccaaagctctgtatgctctggaaaggaagacaagaaatgctaaagactctggatattgctctgtttctataaggtcccacccatataccatctcttcttttggatttcctttggcagggttcccttgtatggaagttctcaggagaacaacactctcagagtcccactgtctcaaagaattcttaatggacagctatacttggccccaaggtttcaacctcacactgaagaaagtgacataagaaaacacaagtcccagtgctatcaggggctatctggaaaagctgcttaaacagcaagtgaaagaaggctctcccctaccccgttctagactcaccctgaagttatttgaaggatccttgagactcttttggattgctgcttggagaacattcctgtaacttgtccctgctccttgaactataaaagcagaagggaggtactgagttaaaacttacaaattattatcaaataaatcttcaatagtggtt

SEQ ID NO: 278364 - DNA, 782 bp, Homo sapiens
tctgtcaaaaaaaaaaaaaaaaaaaaaagaaagaaaagaaaatagaatattcctagcaaattagttctaagtagaacaaaaaaaatttaatggagagaatagtacctatattatggtattattcatgaggattaagcaagaatccgtgtaaagcaattagcaaagtacctggcacgtagtagatttttaataaattatatactctgagcacagctatgcctaggttagtcctatcatgttcttgtttctttctttcagagaccttatttcggctggcaattaccttacccgcttgttcattatctgactcctgcactcctcccaagtgttcaatgttaaccagatggcaaagttaaccagacagaggaaatccacataattactctagatgaagccccctaactgcggattagaaggaaaagagatgaagggtgctgcactaataataacaaccattttcaaccaaggcaggattctgggcctagaatcttcagtgacaaattaccaggagaggaggagggaaatgaagagctggaggcctagggagatggtgtgaggagaggagactgtgcctttccacttcttaataattaatgttctcctgctgctctgagtctgcatgtaagtggatttgtgacctctcagctgatgaaaaccatagcacaagaagagtaaaagtgtgctgccttgtttcttacttgctaattagccacctgagcccaggggggtttataagtggcctcaagcccaattactgattttgttcccagaggcagagaagg

SEQ ID NO: 278365 - DNA, 1006 bp, Homo sapiens
ccatgctggcaatacacagggagacttcacttgcctagggcagggtatgcagtctacttgagtacagtggccacacagtggctatcaagactgggctatatatctactagtttgctgcatggcatgtacataggagaggcggagatcggattagtagtattactgcttcagcggtgctgcactaataataacaaccattttcaaccaaggcaggattctgggcctagaatcttcagtgacaaattaccaggagaggaggagggaaatgaagagctggaggcctagggagatggtgtgaggagaggagactgtgcctttccacttcttaataattaatgttctcctgctgctctgagtctgcatcaccagtgattcagtttgagtcagacatccaacaacaactgagcaaaagaatcatctcagatccaagcaatggtgacgcgcagatagaagagactgaggccaacgaccaaagcaaaggacagcagaactgactgacacagctcagaaaatatccaaagctctgtatgctctggaaaggaagacaagaaatgctaaagactctggatattgctctgtttctataaggtcccacccatataccatctcttcttttggatttcctttggcagggttcccttgtatggaagttctcaggagaacaacactctcagagtcccactgtctcaaagaattcttaatggacagctatacttggccccaaggtttcaacctcacactgaagaaagtgacataagaaaacacaagtcccagtgctatcaggggctatctggaaaagctgcttaaacagcaagtgaaagaaggctctcccctaccccgttctagactcaccctgaagttatttgaaggatccttgagactcttttggattgctgcttggagaacattcctgtaacttgtccctgctccttgaactataaaagcagaagggaggtactgagttaaaacttacaaattattatcaaataaatcttcaatagtggtt

SEQ ID NO: 278366 - DNA, 271 bp, Homo sapiens
ttcctgaatggatttcttcactggttcttctgggggatgagagagagaaaccatttacaaagctgaaggagagctaagtccacccctacactggctgagtttctttgtataacaactgttctcccttcctattttcttcaattatctcttctttccccagctatacttggccccaaggtttcaacctcacactgaagaaagtgacataagaaaacacaagtcccagtgctatcaggggctatctggaaaagctgcttaaacagcaagtgaa

SEQ ID NO: 278367 - DNA, 339 bp, Homo sapiens
gctaaataattaaacagaatgtcattccacttatctaggctcttctcattctcttttgatgcagcaccagtgattcagtttgagtcagacatccaacaacaactgagcaaaagaatcatctcagatccaagcaatggtgacgcgcagatagaagagactgaggccaacgaccaaagcaaaggacagcagaactgactgacacagctcagaaaatatccaaagctctgtaagtgaacacacatttattatgtctttaatgttcccaggaaagcttttgtcgtctatctaggtgaaatgatggggcatgtgataatatgtgaagccagaatgccttccatt

SEQ ID NO: 278368 - DNA, 2554 bp, Homo sapiens
gggggcgggcggcggcgaggcggcctgcagggagcagccgcgagccggccgggcgcgccgagcccgagccccagccggagcggggcgggggagggaggagccagagcggccgccgcctctgccggaggagccgcggggccgccacactcgccccccgccccccccgcgctcactcgcactcacacccgggcgcaggaggcgggcggcccgggccccaccggccccccatggacgcccccagcacggggcgctgagacccccgcgtcgctgcccagcccggtccggcgcgccacgccgagggatctctggacaggacaagactccgaagctactcccccagcacacagcccgggacccacaaacccagcttgcccccagccctcccacctgccactccctggcccctcccaccgcccgccccccttggggcgcagggcatggtgtgaaaggccaagtgctgaggcgggtatcatgggtgctgtgccctagggcctgggtggcagggggtgggtggcctgtgggtgtgccgggggggccagtgtgcccaccccagtctcttggcgtgctggagggcatcctggatggaattgaagtgaatggaacagaagccaagcaaggtggagtgtgggtcagacccagaggagaacagtgccaggtcaccagatggaaagcgaaaaagaaagaacggccaatgttccctgaaaaccagcatgtcagggtatatccctagttacctggacaaagacgagcagtgtgtcgtgtgtggggacaaggcaactggttatcactaccgctgtatcacttgtgagggctgcaagggcttctttcgccgcacaatccagaagaacctccatcccacctattcctgcaaatatgacagctgctgtgtcattgacaagatcacccgcaatcagtgccagctgtgccgcttcaagaagtgcatcgccgtgggcatggccatggacttggttctagatgactcgaagcgggtggccaagcgtaagctgattgagcagaaccgggagcggcggcggaaggaggagatgatccgatcactgcagcagcgaccagagcccactcctgaagagtgggatctgatccacattgccacagaggcccatcgcagcaccaatgcccagggcagccattggaaacagaggcggaaattcctgcccgatgacattggccagtcacccattgtctccatgccggacggagacaaggtggacctggaagccttcagcgagtttaccaagatcatcaccccggccatcacccgtgtggtggactttgccaaaaaactgcccatgttctccgagctgccttgcgaagaccagatcatcctcctgaaggggtgctgcatggagatcatgtccctgcgggcggctgtccgctacgaccctgagagcgacaccctgacgctgagtggggagatggctgtcaagcgggagcagctcaagaatggcggcctgggcgtagtctccgacgccatctttgaactgggcaagtcactctctgcctttaacctggatgacacggaagtggctctgctgcaggctgtgctgctaatgtcaacagaccgctcgggcctgctgtgtgtggacaagatcgagaagagtcaggaggcgtacctgctggcgttcgagcactacgtcaaccaccgcaaacacaacattccgcacttctggcccaagctgctgatgaaggagagagaagtgcagagttcgattctgtacaagggggcagcggcagaaggccggccgggcgggtcactgggcgtccacccggaaggacagcagcttctcggaatgcatgttgttcagggtccgcaggtccggcagcttgagcagcagcttggtgaagcgggaagtctccaagggccggttcttcagcaccagagcccgaagagcccgcagcagcgtctcctggagctgctccaccgaagcggaattctccatgcccgagcggtctgtggggaagacgacagcagtgaggcggactccccgagctcctctgaggaggaaccggaggtctgcgaggacctggcaggcaatgcagcctctccctgaagccccccagaaggccgatggggaaggagaaggagtgccataccttctcccaggcctctgccccaagagcaggaggtgcctgaaagctgggagcgtgggctcagcagggctggtcacctcccatcccgtaagaccaccttcccttcctcagcaggccaaacatggccagactcccttgctttttgctgtgtagttccctctgcctgggatgcccttccccctttctctgcctggcaacatcttacttgtcctttgaggccccaactcaagtgtcacctccttccccagctcccccaggcagaaatagttgtctgtgcttccttggttcatgcttctactgtgacacttatctcactgttttataattagtcgggcatgagtctgtttcccaagctagactgtgtctgaatcatgtctgtatccccagtgcccggtgcagggcctggcatagagtaggtactccataaaaggtgtgttgaattgaa

SEQ ID NO: 278369 - DNA, 410 bp, Homo sapiens
tgaggatccgtggggaaatctggtgccatgcgttagaccttgtgcctctctgttcacagtggttctagatgactcgaagcgggtggccaagcgtaagctgattgagcagaaccgggagcggcggcggaaggaggagatgatccgatcactgcagcagcgaccagagcccactcctgaagagtgggatctgatccacattgccacagaggcccatcgcagcaccaatgcccagggcagccattggaaacagaggcggaaattcctggtaaggagaaagggggcatggggagagcagtagccaggtggcagggagaagagagtgagctcggagtcttgcctcctccaggaagtcttcttagtgtaatccaacccaaaatacatactcttcacacttttgctgtccagatttt

SEQ ID NO: 278370 - DNA, 2617 bp, Homo sapiens
attcggcacgaggcctgcgctttgcactattggggcaaaaatgtcttaagcagtggggaacctgccaccccaccctgaccctcagcctgccacagccccctacacacacacacacacacacacacacacacacacacacacggacatgcacacacggacatgggaaggcaatgctatgctgcccgtcagggcactgtccttccccaatcgttcaggtgttccaacaggggtggagggcctggaggagcacccgctgtcacctgtgcatgtgcctgtcccaccggccccccatggacgcccccagcacggggcgctgagacccccgcgtcgctgcccagcccggtccggcgcgccacgccgagggatctctggacaggacaagactccgaagctactcccccagcacacagcccgggacccacaaacccagcttgcccccagccctcccacctgccactccctggcccctcccaccgcccgccccccttggggcgcagggcatggtgtgaaaggccaagtgctgaggcgggtatcatgggtgctgtgccctagggcctgggtggcagggggtgggtggcctgtgggtgtgccgggggggccagtgtgcccaccccagtctcttggcgtgctggagggcatcctggatggaattgaagtgaatggaacagaagccaagcaaggtggagtgtgggtcagacccagaggagaacagtgccaggtcaccagatggaaagcgaaaaagaaagaacggccaatgttccctgaaaaccagcatgtcagggtatatccctagttacctggacaaagacgagcagtgtgtcgtgtgtggggacaaggcaactggttatcactaccgctgtatcacttgtgagggctgcaagggcttctttcgccgcacaatccagaagaacctccatcccacctattcctgcaaatatgacagctgctgtgtcattgacaagatcacccgcaatcagtgccagctgtgccgcttcaagaagtgcatcgccgtgggcatggccatggacttggttctagatgactcgaagcgggtggccaagcgtaagctgattgagcagaaccgggagcggcggcggaaggaggagatgatccgatcactgcagcagcgaccagagcccactcctgaagagtgggatctgatccacattgccacagaggcccatcgcagcaccaatgcccagggcagccattggaaacagaggcggaaattcctgcccgatgacattggccagtcacccattgtctccatgccggacggagacaaggtggacctggaagccttcagcgagtttaccaagatcatcaccccggccatcacccgtgtggtggactttgccaaaaaactgcccatgttctccgagctgccttgcgaagaccagatcatcctcctgaaggggtgctgcatggagatcatgtccctgcgggcggctgtccgctacgaccctgagagcgacaccctgacgctgagtggggagatggctgtcaagcgggagcagctcaagaatggcggcctgggcgtagtctccgacgccatctttgaactgggcaagtcactctctgcctttaacctggatgacacggaagtggctctgctgcaggctgtgctgctaatgtcaacagaccgctcgggcctgctgtgtgtggacaagatcgagaagagtcaggaggcgtacctgctggcgttcgagcactacgtcaaccaccgcaaacacaacattccgcacttctggcccaagctgctgatgaaggagagagaagtgcagagttcgattctgtacaagggggcagcggcagaaggccggccgggcgggtcactgggcgtccacccggaaggacagcagcttctcggaatgcatgttgttcagggtccgcaggtccggcagcttgagcagcagcttggtgaagcgggaagtctccaagggccggttcttcagcaccagagcccgaagagcccgcagcagcgtctcctggagctgctccaccgaagcggaattctccatgcccgagcggtctgtggggaagacgacagcagtgaggcggactccccgagctcctctgaggaggaaccggaggtctgcgaggacctggcaggcaatgcagcctctccctgaagccccccagaaggccgatggggaaggagaaggagtgccataccttctcccaggcctctgccccaagagcaggaggtgcctgaaagctgggagcgtgggctcagcagggctggtcacctcccatcccgtaagaccaccttcccttcctcagcaggccaaacatggccagactcccttgctttttgctgtgtagttccctctgcctgggatgcccttccccctttctctgcctggcaacatcttacttgtcctttgaggccccaactcaagtgtcacctccttccccagctcccccaggcagaaatagttgtctgtgcttccttggttcatgcttctactgtgacacttatctcactgttttataattagtcgggcatgagtctgtttcccaagctagactgtgtctgaatcatgtctgtatccccagtgcccggtgcagggcctggcatagagtaggtactccataaaaggtgtgttgaattgaa

SEQ ID NO: 278371 - DNA, 2416 bp, Homo sapiens
gcccagccctcgcagctgaagcttgaggaagctctgcccccgacagcagtggcgatttgtcaaggtcacacagtgagttaccggcggagaagggacccgaactcccaaacaaactacacctgcaagcgtttggtgtttagactttctccccgatgtataagggatctctggacaggacaagactccgaagctactcccccagcacacagcccgggacccacaaacccagcttgcccccagccctcccacctgccactccctggcccctcccaccgcccgccccccttggggcgcagggcatggtgtgaaaggccaagtgctgaggcgggtatcatgggtgctgtgccctagggcctgggtggcagggggtgggtggcctgtgggtgtgccgggggggccagtgtgcccaccccagtctcttggcgtgctggagggcatcctggatggaattgaagtgaatggaacagaagccaagcaaggtggagtgtgggtcagacccagaggagaacagtgccaggtcaccagatggaaagcgaaaaagaaagaacggccaatgttccctgaaaaccagcatgtcagggtatatccctagttacctggacaaagacgagcagtgtgtcgtgtgtggggacaaggcaactggttatcactaccgctgtatcacttgtgagggctgcaagggcttctttcgccgcacaatccagaagaacctccatcccacctattcctgcaaatatgacagctgctgtgtcattgacaagatcacccgcaatcagtgccagctgtgccgcttcaagaagtgcatcgccgtgggcatggccatggacttggttctagatgactcgaagcgggtggccaagcgtaagctgattgagcagaaccgggagcggcggcggaaggaggagatgatccgatcactgcagcagcgaccagagcccactcctgaagagtgggatctgatccacattgccacagaggcccatcgcagcaccaatgcccagggcagccattggaaacagaggcggaaattcctgcccgatgacattggccagtcacccattgtctccatgccggacggagacaaggtggacctggaagccttcagcgagtttaccaagatcatcaccccggccatcacccgtgtggtggactttgccaaaaaactgcccatgttctccgagctgccttgcgaagaccagatcatcctcctgaaggggtgctgcatggagatcatgtccctgcgggcggctgtccgctacgaccctgagagcgacaccctgacgctgagtggggagatggctgtcaagcgggagcagctcaagaatggcggcctgggcgtagtctccgacgccatctttgaactgggcaagtcactctctgcctttaacctggatgacacggaagtggctctgctgcaggctgtgctgctaatgtcaacagaccgctcgggcctgctgtgtgtggacaagatcgagaagagtcaggaggcgtacctgctggcgttcgagcactacgtcaaccaccgcaaacacaacattccgcacttctggcccaagctgctgatgaaggagagagaagtgcagagttcgattctgtacaagggggcagcggcagaaggccggccgggcgggtcactgggcgtccacccggaaggacagcagcttctcggaatgcatgttgttcagggtccgcaggtccggcagcttgagcagcagcttggtgaagcgggaagtctccaagggccggttcttcagcaccagagcccgaagagcccgcagcagcgtctcctggagctgctccaccgaagcggaattctccatgcccgagcggtctgtggggaagacgacagcagtgaggcggactccccgagctcctctgaggaggaaccggaggtctgcgaggacctggcaggcaatgcagcctctccctgaagccccccagaaggccgatggggaaggagaaggagtgccataccttctcccaggcctctgccccaagagcaggaggtgcctgaaagctgggagcgtgggctcagcagggctggtcacctcccatcccgtaagaccaccttcccttcctcagcaggccaaacatggccagactcccttgctttttgctgtgtagttccctctgcctgggatgcccttccccctttctctgcctggcaacatcttacttgtcctttgaggccccaactcaagtgtcacctccttccccagctcccccaggcagaaatagttgtctgtgcttccttggttcatgcttctactgtgacacttatctcactgttttataattagtcgggcatgagtctgtttcccaagctagactgtgtctgaatcatgtctgtatccccagtgcccggtgcagggcctggcatagagtaggtactccataaaaggtgtgttgaattgaa

SEQ ID NO: 278372 - DNA, 2437 bp, Homo sapiens
gggggcgggcggcggcgaggcggcctgcagggagcagccgcgagccggccgggcgcgccgagcccgagccccagccggagcggggcgggggagggaggagccagagcggccgccgcctctgccggaggagccgcggggccgccacactcgccccccgccccccccgcgctcactcgcactcacacccgggcgcaggaggcgggcggcccgggccccaccggccccccatggacgcccccagcacggggcgctgagacccccgcgtcgctgcccagcccggtccggcgcgccacgccgagggatctctggacaggacaagactccgaagctactcccccagcacacagcccgggacccacaaacccagcttgcccccagccctcccacctgccactccctggcccctcccaccgcccgccccccttggggcgcagggcatggtgtgaaaggccaagtgctgaggcgggtatcatgggtgctgtgccctagggcctgggtggcagggggtgggtggcctgtgggtgtgccgggggggccagtgtgcccaccccagtctcttggcgtgctggagggcatcctggatggaattgaagtgaatggaacagaagccaagcaaggtggagtgtgggtcagacccagaggagaacagtgccaggtcaccagatggaaagcgaaaaagaaagaacggccaatgttccctgaaaaccagcatgtcagggtatatccctagttacctggacaaagacgagcagtgtgtcgtgtgtggggacaaggcaactggttatcactaccgctgtatcacttgtgagggctgcaagggcttctttcgccgcacaatccagaagaacctccatcccacctattcctgcaaatatgacagctgctgtgtcattgacaagatcacccgcaatcagtgccagctgtgccgcttcaagaagtgcatcgccgtgggcatggccatggacttggttctagatgactcgaagcgggtggccaagcgtaagctgattgagcagaaccgggagcggcggcggaaggaggagatgatccgatcactgcagcagcgaccagagcccactcctgaagagtgggatctgatccacattgccacagaggcccatcgcagcaccaatgcccagggcagccattggaaacagaggcggaaattcctgcccgatgacattggccagtcacccattgtctccatgccggacggagacaaggtggacctggaagccttcagcgagtttaccaagatcatcaccccggccatcacccgtgtggtggactttgccaaaaaactgcccatgttctccgagctgccttgcgaagaccagatcatcctcctgaaggggtgctgcatggagatcatgtccctgcgggcggctgtccgctacgaccctgagagcgacaccctgacgctgagtggggagatggctgtcaagcgggagcagctcaagaatggcggcctgggcgtagtctccgacgccatctttgaactgggcaagtcactctctgcctttaacctggatgacacggaagtggctctgctgcaggctgtgctgctaatgtcaacagaccgctcgggcctgctgtgtgtggacaagatcgagaagagtcaggaggcgtacctgctggcgttcgagcactacgtcaaccaccgcaaacacaacattccgcacttctggcccaagctgctgatgaagggtccgcaggtccggcagcttgagcagcagcttggtgaagcgggaagtctccaagggccggttcttcagcaccagagcccgaagagcccgcagcagcgtctcctggagctgctccaccgaagcggaattctccatgcccgagcggtctgtggggaagacgacagcagtgaggcggactccccgagctcctctgaggaggaaccggaggtctgcgaggacctggcaggcaatgcagcctctccctgaagccccccagaaggccgatggggaaggagaaggagtgccataccttctcccaggcctctgccccaagagcaggaggtgcctgaaagctgggagcgtgggctcagcagggctggtcacctcccatcccgtaagaccaccttcccttcctcagcaggccaaacatggccagactcccttgctttttgctgtgtagttccctctgcctgggatgcccttccccctttctctgcctggcaacatcttacttgtcctttgaggccccaactcaagtgtcacctccttccccagctcccccaggcagaaatagttgtctgtgcttccttggttcatgcttctactgtgacacttatctcactgttttataattagtcgggcatgagtctgtttcccaagctagactgtgtctgaatcatgtctgtatccccagtgcccggtgcagggcctggcatagagtaggtactccataaaaggtgtgttgaattgaa

SEQ ID NO: 278373 - DNA, 1619 bp, Homo sapiens
ggacgcgtgggcgtgggcatggccatggacttggttctagatgactcgaagcgggtggccaagcgtaagctgattgagcagaaccgggagcggcggcggaaggaggagatgatccgatcactgcagcagcgaccagagcccactcctgaagagtgggatctgatccacattgccacagaggcccatcgcagcaccaatgcccagggcagccattggaaacagaggcggaaattcctgcccgatgacattggccagtcacccattgtctccatgccggacggagacaaggtggacctggaagccttcagcgagtttaccaagatcatcaccccggccatcacccgtgtggtggactttgccaaaaaactgcccatgttctccgagctgccttgcgaagaccagatcatcctcctgaaggggtgctgcatggagatcatgtccctgcgggcggctgtccgctacgaccctgagagcgacaccctgacgctgagtggggagatggctgtcaagcgggagcagctcaagaatggcggcctgggcgtagtctccgacgccatctttgaactgggcaagtcactctctgcctttaacctggatgacacggaagtggctctgctgcaggctgtgctgctaatgtcaacagaccgctcgggcctgctgtgtgtggacaagatcgagaagagtcaggaggcgtacctgctggcgttcgagcactacgtcaaccaccgcaaacacaacattccgcacttctggcccaagctgctgatgaaggagagagaagtgcagagttcgattctgtacaagggggcagcggcagaaggccggccgggcgggtcactgggcgtccacccggaaggacagcagcttctcggaatgcatgttgttcagggtccgcaggtccggcagcttgagcagcagcttggtgaagcgggaagtctccaagggccggttcttcagcaccagagcccgaagagcccgcagcagcgtctcctggagctgctccaccgaagcggaattctccatgcccgagcggtctgtggggaagacgacagcagtgaggcggactccccgagctcctctgaggaggaaccggaggtctgcgaggacctggcaggcaatgcagcctctccctgaagccccccagaaggccgatggggaaggagaaggagtgccataccttctcccaggcctctgccccaagagcaggaggtgcctgaaagctgggagcgtgggctcagcagggctggtcacctcccatcccgtaagaccaccttcccttcctcagcaggccaaacatggccagactcccttgctttttgctgtgtagttccctctgcctgggatgcccttccccctttctctgcctggcaacatcttacttgtcctttgaggccccaactcaagtgtcacctccttccccagctcccccaggcagaaatagttgtctgtgcttccttggttcatgcttctactgtgacacttatctcactgttttataattagtcgggcatgagtctgtttcccaagctagactgtgtctgaatcatgtctgtatccccagtgcccggtgcagggcctggcatagagtaggtactccataaaaggtgtgttgaattgaa

SEQ ID NO: 278374 - DNA, 2406 bp, Homo sapiens
gggggcgggcggcggcgaggcggcctgcagggagcagccgcgagccggccgggcgcgccgagcccgagccccagccggagcggggcgggggagggaggagccagagcggccgccgcctctgccggaggagccgcggggccgccacactcgccccccgccccccccgcgctcactcgcactcacacccgggcgcaggaggcgggcggcccgggccccaccggccccccatggacgcccccagcacggggcgctgagacccccgcgtcgctgcccagcccggtccggcgcgccacgccgagggatctctggacaggacaagactccgaagctactcccccagcacacagcccgggacccacaaacccagcttgcccccagccctcccacctgccactccctggcccctcccaccgcccgccccccttggggcgcagggcatggtgtgaaaggccaagtgctgaggcgggtatcatgggtgctgtgccctagggcctgggtggcagggggtgggtggcctgtgggtgtgccgggggggccagtgtgcccaccccagtctcttggcgtgctggagggcatcctggatggaattgaagtgaatggaacagaagccaagcaaggtggagtgtgggtcagacccagaggagaacagtgccaggtcaccagatggaaagcgaaaaagaaagaacggccaatgttccctgaaaaccagcatgtcagggtatatccctagttacctggacaaagacgagcagtgtgtcgtgtgtggggacaaggcaactggttatcactaccgctgtatcacttgtgagggctgcaagggcttctttcgccgcacaatccagaagaacctccatcccacctattcctgcaaatatgacagctgctgtgtcattgacaagatcacccgcaatcagtgccagctgtgccgcttcaagaagtgcatcgccgtgggcatggccatggacttggttctagatgactcgaagcgggtggccaagcgtaagctgattgagcagaaccgggagcggcggcggaaggaggagatgatccgatcactgcagcagcgaccagagcccactcctgaagagtgggatctgatccacattgccacagaggcccatcgcagcaccaatgcccagggcagccattggaaacagaggcggaaattcctgcccgatgacattggccagtcacccattgtctccatgccggacggagacaaggtggacctggaagccttcagcgagtttaccaagatcatcaccccggccatcacccgtgtggtggactttgccaaaaaactgcccatgttctccgagctgccttgcgaagaccagatcatcctcctgaaggggtgctgcatggagatcatgtccctgcgggcggctgtccgctacgaccctgagagcgacaccctgacgctgagtggggagatggctgtcaagcgggagcagctcaagaatggcggcctgggcgtagtctccgacgccatctttgaactgggcaagtcactctctgcctttaacctggatgacacggaagtggctctgctgcaggctgtgctgctaatgtcaacagaccgctcgggcctgctgtgtgtggacaagatcgagaagagtcaggaggcgtacctgctggcgttcgagcactacgtcaaccaccgcaaacacaacattccgcacttctggcccaagctgctgatgaaggtgactgacctccgcatgatcggggcctgccacgccagccgcttcctccacatgaaagtcgagtgccccaccgaactcttccccccactcttcctcgaggtctttgaggatcaggaagtctaaagcctcaggcggccagagggtgtgcggagctggtggggaggagcctggagagaaggggcagagctgggggctgagggagacccccccacaccccttctctccttcctctcgtccttggatagattcagctcccacacacacacccgcactgcccaggtccctcctcagacctccagccctgggacagggcaaacaactgaacttgctatggaaaggacagtgtgggaggctgggggagctgtgtcctgcagttcccaggaccccatcctctcagaaggtaggggaagggcgggaggattgagaagggacaagccaccttgaccgtaggggaaggaggaatgtgggctgggggaagatgccctcaactcaccccctacacacacatgagagagagcccccacccagttccttggcctaggtctcccctccaggctgagggcctctctacttccccagatgcctgggtgcaaagaacggcttggcttggctcctcctctggaggttaaaatttatagtcattctaactgcactttggaaaccaagcaaggggagaagtgcgcctgatgcgggagcctct

SEQ ID NO: 278375 - DNA, 1774 bp, Homo sapiens
gggggcgggcggcggcgaggcggcctgcagggagcagccgcgagccggccgggcgcgccgagcccgagccccagccggagcggggcgggggagggaggagccagagcggccgccgcctctgccggaggagccgcggggccgccacactcgccccccgccccccccgcgctcactcgcactcacacccgggcgcaggaggcgggcggcccgggccccaccggccccccatggacgcccccagcacggggcgctgagacccccgcgtcgctgcccagcccggtccggcgcgccacgccgagggatctctggacaggacaagactccgaagctactcccccagcacacagcccgggacccacaaacccagcttgcccccagccctcccacctgccactccctggcccctcccaccgcccgccccccttggggcgcagggcatggtgtgaaaggccaagtgctgaggcgggtatcatgggtgctgtgccctagggcctgggtggcagggggtgggtggcctgtgggtgtgccgggggggccagtgtgcccaccccagtctcttggcgtgctggagggcatcctggatggaattgaagtgaatggaacagaagccaagcaaggtggagtgtgggtcagacccagaggagaacagtgccaggtcaccagatggaaagcgaaaaagaaagaacggccaatgttccctgaaaaccagcatgtcagggtatatccctagttacctggacaaagacgagcagtgtgtcgtgtgtggggacaaggcaactggttatcactaccgctgtatcacttgtgagggctgcaagggcttctttcgccgcacaatccagaagaacctccatcccacctattcctgcaaatatgacagctgctgtgtcattgacaagatcacccgcaatcagtgccagctgtgccgcttcaagaagtgcatcgccgtgggcatggccatggacttggttctagatgactcgaagcgggtggccaagcgtaagctgattgagcagaaccgggagcggcggcggaaggaggagatgatccgatcactgcagcagcgaccagagcccactcctgaagagtgggatctgatccacattgccacagaggcccatcgcagcaccaatgcccagggcagccattggaaacagaggcggaaattcctgcccgatgacattggccagtcacccattgtctccatgccggacggagacaaggtggacctggaagccttcagcgagtttaccaagatcatcaccccggccatcacccgtgtggtggactttgccaaaaaactgcccatgttctccgagctgccttgcgaagaccagatcatcctcctgaaggggtgctgcatggagatcatgtccctgcgggcggctgtccgctacgaccctgagagcgacaccctgacgctgagtggggagatggctgtcaagcgggagcagctcaagaatggcggcctgggcgtagtctccgacgccatctttgaactgggcaagtcactctctgcctggcaacatcttacttgtcctttgaggccccaactcaagtgtcacctccttccccagctcccccaggcagaaatagttgtctgtgcttccttggttcatgcttctactgtgacacttatctcactgttttataattagtcgggcatgagtctgtttcccaagctagactgtgtctgaatcatgtctgtatccccagtgcccggtgcagggcctggcatagagtaggtactccataaaaggtgtgttgaattgaa

SEQ ID NO: 278376 - DNA, 1687 bp, Homo sapiens
gggggcgggcggcggcgaggcggcctgcagggagcagccgcgagccggccgggcgcgccgagcccgagccccagccggagcggggcgggggagggaggagccagagcggccgccgcctctgccggaggagccgcggggccgccacactcgccccccgccccccccgcgctcactcgcactcacacccgggcgcaggaggcgggcggcccgggccccaccggccccccatggacgcccccagcacggggcgctgagacccccgcgtcgctgcccagcccggtccggcgcgccacgccgagggatctctggacaggacaagactccgaagctactcccccagcacacagcccgggacccacaaacccagcttgcccccagccctcccacctgccactccctggcccctcccaccgcccgccccccttggggcgcagggcatggtgtgaaaggccaagtgctgaggcgggtatcatgggtgctgtgccctagggcctgggtggcagggggtgggtggcctgtgggtgtgccgggggggccagtgtgcccaccccagtctcttggcgtgctggagggcatcctggatggaattgaagtgaatggaacagaagccaagcaaggtggagtgtgggtcagacccagaggagaacagtgccaggtcaccagatggaaagcgaaaaagaaagaacggccaatgttccctgaaaaccagcatgtcagggtatatccctagttacctggacaaagacgagcagtgtgtcgtgtgtggggacaaggcaactggttatcactaccgctgtatcacttgtgagggctgcaagggcttctttcgccgcacaatccagaagaacctccatcccacctattcctgcaaatatgacagctgctgtgtcattgacaagatcacccgcaatcagtgccagctgtgccgcttcaagaagtgcatcgccgtgggcatggccatggacttggttctagatgactcgaagcgggtggccaagcgtaagctgattgagcagaaccgggagcggcggcggaaggaggagatgatccgatcactgcagcagcgaccagagcccactcctgaagagtgggatctgatccacattgccacagaggcccatcgcagcaccaatgcccagggcagccattggaaacagaggcggaaattcctgcccgatgacattggccagtcacccattgtctccatgccggacggagacaaggtggacctggaagccttcagcgagtttaccaagatcatcaccccggccatcacccgtgtggtggactttgccaaaaaactgcccatgttctccgagctcccatcccgtaagaccaccttcccttcctcagcaggccaaacatggccagactcccttgctttttgctgtgtagttccctctgcctgggatgcccttccccctttctctgcctggcaacatcttacttgtcctttgaggccccaactcaagtgtcacctccttccccagctcccccaggcagaaatagttgtctgtgcttccttggttcatgcttctactgtgacacttatctcactgttttataattagtcgggcatgagtctgtttcccaagctagactgtgtctgaatcatgtctgtatccccagtgcccggtgcagggcctggcatagagtaggtactccataaaaggtgtgttgaattgaa

SEQ ID NO: 278377 - DNA, 1160 bp, Homo sapiens
  misc_feature (1122)..(1122): n is a, c, g, or t
gggggcgggcggcggcgaggcggcctgcagggagcagccgcgagccggccgggcgcgccgagcccgagccccagccggagcggggcgggggagggaggagccagagcggccgccgcctctgccggaggagccgcggggccgccacactcgccccccgccccccccgcgctcactcgcactcacacccgggcgcaggaggcgggcggcccgggccccaccggccccccatggacgcccccagcacggggcgctgagacccccgcgtcgctgcccagcccggtccggcgcgccacgccgagggatctctggacaggacaagactccgaagctactcccccagcacacagcccgggacccacaaacccagcttgcccccagccctcccacctgccactccctggcccctcccaccgcccgccccccttggggcgcagggcatggtgtgaaaggccaagtgctgaggcgggtatcatgggtgctgtgccctagggcctgggtggcagggggtgggtggcctgtgggtgtgccgggggggccagtgtgcccaccccagtctcttggcgtgctggagggcatcctggatggaattgaagtgaatggaacagaagccaagcaaggtggagtgtgggtcagacccagaggagaacagtgccaggtcaccagatggaaagcgaaaaagaaagaacggccaatgttccctgaaaaccagcatgtcagggtatatccctagttacctggacaaagacgagcagtgtgtcgtgtgtggggacaaggcaactggttatcactaccgctgtatcacttgtgagggctgcaagggcttctttcgccgcacaatccagaagaacctccatcccacctattcctgcaaatatgacagctgctgtgtcattgacaagatcacccgcaatcagtgccagctgtgccgcttcaagaagtgcatcgccgtgggcatggccatggacttggttctagatgactcgaagcgggtggccaagcgtaagctgattgagcagaaccgggagcggcggcggaaggaggagatgatccgatcactgcagcagcgaccagagcccactcctgaagagtgggatctgataaaaattgaaaaagaggaaaatngaagaaaaaatgaaaagggaagaaattggaaaaagagg

SEQ ID NO: 278378 - DNA, 557 bp, Homo sapiens
agagagcgagcgatagagagagatgatattaagttattaactgaggctgaccagaggggaggaccccccctttaccaccccatgcactttgcgagctgccccttcttcccccacatcagagagaaatgcccccacaccagagccccaagggtagggctgccgatcagagctgtgagttaacacaacagggtcctggccaccccccttgccataccccgccctctgtgcccctttggcaccccccaaccctagtatgtcctctgctttctgccactcgtgcccgctgagttccatctacctctcatgctggatgccagctggcccctcaccagcctgccctgctgcccacacagctcccctttaagtgcccagccctaggggcctctccccatccacctcctccttccacaccttggcacccacccaggaaaaaactgtggctccaactcctaccctccttatatcctgcagtattagctagaaaccggatgctgctgcattggttgggtcgggggtaggagggctgtgcgtgagcgtctcccagaaccctccacccc

SEQ ID NO: 278379 - DNA, 3040 bp, Homo sapiens
attcggcacgaggcctgcgctttgcactattggggcaaaaatgtcttaagcagtggggaacctgccaccccaccctgaccctcagcctgccacagccccctacacacacacacacacacacacacacacacacacacacacggacatgcacacacggacatgggaaggcaatgctatgctgcccgtcagggcactgtccttccccaatcgttcaggtgttccaacaggggtggagggcctggaggagcacccgctgtcacctgtgcatgtgcctgtcccaccggccccccatggacgcccccagcacggggcgctgagacccccgcgtcgctgcccagcccggtccggcgcgccacgccgagggatctctggacaggacaagactccgaagctactcccccagcacacagcccgggacccacaaacccagcttgcccccagccctcccacctgccactccctggcccctcccaccgcccgccccccttggggcgcagggcatggtgtgaaaggccaagtgctgaggcgggtatcatgggtgctgtgccctagggcctgggtggcagggggtgggtggcctgtgggtgtgccgggggggccagtgtgcccaccccagtctcttggcgtgctggagggcatcctggatggaattgaagtgaatggaacagaagccaagcaaggtggagtgtgggtcagacccagaggagaacagtgccaggtcaccagatggaaagcgaaaaagaaagaacggccaatgttccctgaaaaccagcatgtcagggtatatccctagttacctggacaaagacgagcagtgtgtcgtgtgtggggacaaggcaactggttatcactaccgctgtatcacttgtgagggctgcaagggcttctttcgccgcacaatccagaagaacctccatcccacctattcctgcaaatatgacagctgctgtgtcattgacaagatcacccgcaatcagtgccagctgtgccgcttcaagaagtgcatcgccgtgggcatggccatggacttggttctagatgactcgaagcgggtggccaagcgtaagctgattgagcagaaccgggagcggcggcggaaggaggagatgatccgatcactgcagcagcgaccagagcccactcctgaagagtgggatctgatccacattgccacagaggcccatcgcagcaccaatgcccagggcagccattggaaacagaggcggaaattcctgcccgatgacattggccagtcacccattgtctccatgccggacggagacaaggtggacctggaagccttcagcgagtttaccaagatcatcaccccggccatcacccgtgtggtggactttgccaaaaaactgcccatgttctccgagctgccttgcgaagaccagatcatcctcctgaaggggtgctgcatggagatcatgtccctgcgggcggctgtccgctacgaccctgagagcgacaccctgacgctgagtggggagatggctgtcaagcgggagcagctcaagaatggcggcctgggcgtagtctccgacgccatctttgaactgggcaagtcactctctgcctttaacctggatgacacggaagtggctctgctgcaggctgtgctgctaatgtcaacagaccgctcgggcctgctgtgtgtggacaagatcgagaagagtcaggaggcgtacctgctggcgttcgagcactacgtcaaccaccgcaaacacaacattccgcacttctggcccaagctgctgatgaaggtgactgacctccgcatgatcggggcctgccacgccagccgcttcctccacatgaaagtcgagtgccccaccgaactcttccccccactcttcctcgaggtctttgaggatcaggaagtctaaagcctcaggcggccagagggtgtgcggagctggtggggaggagcctggagagaaggggcagagctgggggctgagggagacccccccacaccccttctctccttcctctcgtccttggatagattcagctcccacacacacacccgcactgcccaggtccctcctcagacctccagccctgggacagggcaaacaactgaacttgctatggaaaggacagtgtgggaggctgggggagctgtgtcctgcagttcccaggaccccatcctctcagaaggtaggggaagggcgggaggattgagaagggacaagccaccttgaccgtaggggaaggaggaatgtgggctgggggaagatgccctcaactcaccccctacacacacatgagagagagcccccacccagttccttggcctaggtctcccctccaggctgagggcctctctacttccccagatgcctgggtgcaaagaacggcttggcttggctcctcctctggaggttaaaatttatagtcattctaactgcatttgcgagctgccccttcttcccccacatcagagagaaatgcccccacaccagagccccaagggtagggctgccgatcagagctgtgagttaacacaacagggtcctggccaccccccttgccataccccgccctctgtgcccctttggcaccccccaaccctagtatgtcctctgctttctgccactcgtgcccgctgagttccatctacctctcatgctggatgccagctggcccctcaccagcctgccctgctgcccacacagctcccctttaagtgcccagccctaggggcctctccccatccacctcctccttccacaccttggcacccacccaggaaaaaactagacagagagaaaaatacaaaaaagagagagcgagcgatagagagagatgatattaagttattaactgaggctgaccagaggggaggaccccccctttaccaccccatgcactttgcgagctgccccttcttcccctcgagtttttttttttttttttttggagtcaaattttcaactgtgcatttattggcctgggcttagacatattaaaaagcaacacttactgagaacataacataaccagacatttctgccaggtgctgttaggt

SEQ ID NO: 278380 - DNA, 2659 bp, Homo sapiens
gggggcgggcggcggcgaggcggcctgcagggagcagccgcgagccggccgggcgcgccgagcccgagccccagccggagcggggcgggggagggaggagccagagcggccgccgcctctgccggaggagccgcggggccgccacactcgccccccgccccccccgcgctcactcgcactcacacccgggcgcaggaggcgggcggcccgggccccaccggccccccatggacgcccccagcacggggcgctgagacccccgcgtcgctgcccagcccggtccggcgcgccacgccgagggatctctggacaggacaagactccgaagctactcccccagcacacagcccgggacccacaaacccagcttgcccccagccctcccacctgccactccctggcccctcccaccgcccgccccccttggggcgcagggcatggtgtgaaaggccaagtgctgaggcgggtatcatgggtgctgtgccctagggcctgggtggcagggggtgggtggcctgtgggtgtgccgggggggccagtgtgcccaccccagtctcttggcgtgctggagggcatcctggatggaattgaagtgaatggaacagaagccaagcaaggtggagtgtgggtcagacccagaggagaacagtgccaggtcaccagatggaaagcgaaaaagaaagaacggccaatgttccctgaaaaccagcatgtcagggtatatccctagttacctggacaaagacgagcagtgtgtcgtgtgtggggacaaggcaactggttatcactaccgctgtatcacttgtgagggctgcaagggcttctttcgccgcacaatccagaagaacctccatcccacctattcctgcaaatatgacagctgctgtgtcattgacaagatcacccgcaatcagtgccagctgtgccgcttcaagaagtgcatcgccgtgggcatggccatggacttggttctagatgactcgaagcgggtggccaagcgtaagctgattgagcagaaccgggagcggcggcggaaggaggagatgatccgatcactgcagcagcgaccagagcccactcctgaagagtgggatctgatccacattgccacagaggcccatcgcagcaccaatgcccagggcagccattggaaacagaggcggaaattcctgcccgatgacattggccagtcacccattgtctccatgccggacggagacaaggtggacctggaagccttcagcgagtttaccaagatcatcaccccggccatcacccgtgtggtggactttgccaaaaaactgcccatgttctccgagctgccttgcgaagaccagatcatcctcctgaaggggtgctgcatggagatcatgtccctgcgggcggctgtccgctacgaccctgagagcgacaccctgacgctgagtggggagatggctgtcaagcgggagcagctcaagaatggcggcctgggcgtagtctccgacgccatctttgaactgggcaagtcactctctgcctttaacctggatgacacggaagtggctctgctgcaggctgtgctgctaatgtcaacagaccgctcgggcctgctgtgtgtggacaagatcgagaagagtcaggaggcgtacctgctggcgttcgagcactacgtcaaccaccgcaaacacaacattccgcacttctggcccaagctgctgatgaaggagagagaagtgcagagttcgattctgtacaagggggcagcggcagaaggccggccgggcgggtcactgggcgtccacccggaaggacagcagcttctcggaatgcatgttgttcagggtccgcaggtccggcagcttgagcagcagcttggtgaagcgggaagtctccaagggccggttcttcagcaccagagcccgaagagcccgcagcagcgtctcctggagctgctccaccgaagcggaattctccatgcccgagcggtctgtggggaagacgacagcagtgaggcggactccccgagctcctctgaggaggaaccggaggtctgcgaggacctggcaggcaatgcagcctctccctgaagccccccagaaggccgatggggaaggagaaggagtgccataccttctcccaggcctctgccccaagagcaggaggtgcctgaaagctgggagcgtgggctcagcagggctggtcacctcccatcccgtaagaccaccttcccttcctcagcaggccaaacatggccagactcccttgctttttgctgtgtagttccctctgcctgggatgcccttccccctttctctgcctggcaacatcttacttgtcctttgaggccccaactcaagtgtcacctccttccccagctcccccaggcagaaatagttgtctgtgcttccttggttcatgcttctactgtgacacttatctcactgttttataattagtcgggcatgagtctgtttcccaagctagactgtgtctgaatcatgtctgtatccccagtgcccggtgcagggcctggcatagagtaggtactccataaaaggtgtgttgaattgaaaaaaaaaaaaacacaggggggcggttaaaataccgggggccaaggtaggatacgttttggcaaggggcccaagggagcgaaaaagagaggggcgtaaaggggtga

SEQ ID NO: 278381 - DNA, 2378 bp, Homo sapiens
cacgtccccaaccccaccaaacccagccagggctcctctggacctggatgtggaacagtaattcatgtgttccctggggggagcctcctagagggcttgggatggacttgtctgggggtgagaaaggtaatgtgggatgtgcccagcttttgagggtggattaggtcaggacggcctcttccctcttcccctaataccctcatctgaggccctaccagaatcagggcctgagctgaaggactgaggggctgtattatccccagtgagcagctgacgtttatttttccctctccaccatcctctgccttgtagatagatcaagaagaaagccctgaatgggcagtcagaagaactgagattcttcatactcttagggcagagatggacaggttcacctcgtgtctctctaggattctaccagggaggctgggctaggagaggggtcagaaacaaaaagttgagggatggggaaaagtgtgagagcctctctgctgggactccaagccatgcctgccttcctccatcctttccttcctcccagggtatatccctagttacctggacaaagacgagcagtgtgtcgtgtgtggggacaaggcaactggttatcactaccgctgtatcacttgtgagggctgcaagggcttctttcgccgcacaatccagaagaacctccatcccacctattcctgcaaatatgacagctgctgtgtcattgacaagatcacccgcaatcagtgccagctgtgccgcttcaagaagtgcatcgccgtgggcatggccatggacttggttctagatgactcgaagcgggtggccaagcgtaagctgattgagcagaaccgggagcggcggcggaaggaggagatgatccgatcactgcagcagcgaccagagcccactcctgaagagtgggatctgatccacattgccacagaggcccatcgcagcaccaatgcccagggcagccattggaaacagaggcggaaattcctgcccgatgacattggccagtcacccattgtctccatgccggacggagacaaggtggacctggaagccttcagcgagtttaccaagatcatcaccccggccatcacccgtgtggtggactttgccaaaaaactgcccatgttctccgagctgccttgcgaagaccagatcatcctcctgaaggggtgctgcatggagatcatgtccctgcgggcggctgtccgctacgaccctgagagcgacaccctgacgctgagtggggagatggctgtcaagcgggagcagctcaagaatggcggcctgggcgtagtctccgacgccatctttgaactgggcaagtcactctctgcctttaacctggatgacacggaagtggctctgctgcaggctgtgctgctaatgtcaacagaccgctcgggcctgctgtgtgtggacaagatcgagaagagtcaggaggcgtacctgctggcgttcgagcactacgtcaaccaccgcaaacacaacattccgcacttctggcccaagctgctgatgaaggagagagaagtgcagagttcgattctgtacaagggggcagcggcagaaggccggccgggcgggtcactgggcgtccacccggaaggacagcagcttctcggaatgcatgttgttcagggtccgcaggtccggcagcttgagcagcagcttggtgaagcgggaagtctccaagggccggttcttcagcaccagagcccgaagagcccgcagcagcgtctcctggagctgctccaccgaagcggaattctccatgcccgagcggtctgtggggaagacgacagcagtgaggcggactccccgagctcctctgaggaggaaccggaggtctgcgaggacctggcaggcaatgcagcctctccctgaagccccccagaaggccgatggggaaggagaaggagtgccataccttctcccaggcctctgccccaagagcaggaggtgcctgaaagctgggagcgtgggctcagcagggctggtcacctcccatcccgtaagaccaccttcccttcctcagcaggccaaacatggccagactcccttgctttttgctgtgtagttccctctgcctgggatgcccttccccctttctctgcctggcaacatcttacttgtcctttgaggccccaactcaagtgtcacctccttccccagctcccccaggcagaaatagttgtctgtgcttccttggttcatgcttctactgtgacacttatctcactgttttataattagtcgggcatgagtctgtttcccaagctagactgtgtctgaatcatgtctgtatccccagtgcccggtgcagggcctggcatagagtaggtactccataaaaggtgtgttgaattgaa

SEQ ID NO: 278382 - DNA, 3132 bp, Homo sapiens
gggggcgggcggcggcgaggcggcctgcagggagcagccgcgagccggccgggcgcgccgagcccgagccccagccggagcggggcgggggagggaggagccagagcggccgccgcctctgccggaggagccgcggggccgccacactcgccccccgccccccccgcgctcactcgcactcacacccgggcgcaggaggcgggcggcccgggccccaccggccccccatggacgcccccagcacggggcgctgagacccccgcgtcgctgcccagcccggtccggcgcgccacgccgagggatctctggacaggacaagactccgaagctactcccccagcacacagcccgggacccacaaacccagcttgcccccagccctcccacctgccactccctggcccctcccaccgcccgccccccttggggcgcagggcatggtgtgaaaggccaagtgctgaggcgggtatcatgggtgctgtgccctagggcctgggtggcagggggtgggtggcctgtgggtgtgccgggggggccagtgtgcccaccccagtctcttggcgtgctggagggcatcctggatggaattgaagtgaatggaacagaagccaagcaaggtggagtgtgggtcagacccagaggagaacagtgccaggtcaccagatggaaagcgaaaaagaaagaacggccaatgttccctgaaaaccagcatgtcagggtatatccctagttacctggacaaagacgagcagtgtgtcgtgtgtggggacaaggcaactggttatcactaccgctgtatcacttgtgagggctgcaagggcttctttcgccgcacaatccagaagaacctccatcccacctattcctgcaaatatgacagctgctgtgtcattgacaagatcacccgcaatcagtgccagctgtgccgcttcaagaagtgcatcgccgtgggcatggccatggacttggttctagatgactcgaagcgggtggccaagcgtaagctgattgagcagaaccgggagcggcggcggaaggaggagatgatccgatcactgcagcagcgaccagagcccactcctgaagagtgggatctgatccacattgccacagaggcccatcgcagcaccaatgcccagggcagccattggaaacagaggcggaaattcctgcccgatgacattggccagtcacccattgtctccatgccggacggagacaaggtggacctggaagccttcagcgagtttaccaagatcatcaccccggccatcacccgtgtggtggactttgccaaaaaactgcccatgttctccgagctgccttgcgaagaccagatcatcctcctgaaggggtgctgcatggagatcatgtccctgcgggcggctgtccgctacgaccctgagagcgacaccctgacgctgagtggggagatggctgtcaagcgggagcagctcaagaatggcggcctgggcgtagtctccgacgccatctttgaactgggcaagtcactctctgcctttaacctggatgacacggaagtggctctgctgcaggctgtgctgctaatgtcaacagaccgctcgggcctgctgtgtgtggacaagatcgagaagagtcaggaggcgtacctgctggcgttcgagcactacgtcaaccaccgcaaacacaacattccgcacttctggcccaagctgctgatgaaggtgactgacctccgcatgatcggggcctgccacgccagccgcttcctccacatgaaagtcgagtgccccaccgaactcttccccccactcttcctcgaggtctttgaggatcaggaagtctaaagcctcaggcggccagagggtgtgcggagctggtggggaggagcctggagagaaggggcagagctgggggctgagggagacccccccacaccccttctctccttcctctcgtccttggatagattcagctcccacacacacacccgcactgcccaggtccctcctcagacctccagccctgggacagggcaaacaactgaacttgctatggaaaggacagtgtgggaggctgggggagctgtgtcctgcagttcccaggaccccatcctctcagaaggtaggggaagggcgggaggattgagaagggacaagccaccttgaccgtaggggaaggaggaatgtgggctgggggaagatgccctcaactcaccccctacacacacatgagagagagcccccacccagttccttggcctaggtctcccctccaggctgagggcctctctacttccccagatgcctgggtgcaaagaacggcttggcttggctcctcctctggaggttaaaatttatagtcattctaactgcactttggaaaccaagcaaggggagaagacaaatgaagaaaaactagacagagagaaaaatacaaaaaagagagagcgagcgatagagagagatgatattaagttattaactgaggctgaccagaggggaggaccccccctttaccaccccatgcactttgcgagctgccccttcttcccccacatcagagagaaatgcccccacaccagagccccaagggtagggctgccgatcagagctgtgagttaacacaacagggtcctggccaccccccttgccataccccgccctctgtgcccctttggcaccccccaaccctagtatgtcctctgctttctgccactcgtgcccgctgagttccatctacctctcatgctggatgccagctggcccctcaccagcctgccctgctgcccacacagctcccctttaagtgcccagccctaggggcctctccccatccacctcctccttccacaccttggcacccacccaggaaaaaactagacagagagaaaaatacaaaaaagagagagcgagcgatagagagagatgatattaagttattaactgaggctgaccagaggggaggaccccccctttaccaccccatgcactttgcgagctgccccttcttcccctcgagtttttttttttttttttttggagtcaaattttcaactgtgcatttattggcctgggcttagacatattaaaaagcaacacttactgagaacataacataaccagacatttctgccaggtgctgttaggt

SEQ ID NO: 278383 - DNA, 2411 bp, Homo sapiens
gggggcgggcggcggcgaggcggcctgcagggagcagccgcgagccggccgggcgcgccgagcccgagccccagccggagcggggcgggggagggaggagccagagcggccgccgcctctgccggaggagccgcggggccgccacactcgccccccgccccccccgcgctcactcgcactcacacccgggcgcaggaggcgggcggcccgggccccaccggccccccatggacgcccccagcacggggcgctgagacccccgcgtcgctgcccagcccggtccggcgcgccacgccgagggatctctggacaggacaagactccgaagctactcccccagcacacagcccgggacccacaaacccagcttgcccccagccctcccacctgccactccctggcccctcccaccgcccgccccccttggggcgcagggcatggtgtgaaaggccaagtgctgaggcgggtatcatgggtgctgtgccctagggcctgggtggcagggggtgggtggcctgtgggtgtgccgggggggccagtgtgcccaccccagtctcttggcgtgctggagggcatcctggatggaattgaagtgaatggaacagaagccaagcaaggtggagtgtgggtcagacccagaggagaacagtgccaggtcaccagatggaaagcgaaaaagaaagaacggccaatgttccctgaaaaccagcatgtcagggtatatccctagttacctggacaaagacgagcagtgtgtcgtgtgtggggacaaggcaactggttatcactaccgctgtatcacttgtgagggctgcaagggcttctttcgccgcacaatccagaagaacctccatcccacctattcctgcaaatatgacagctgctgtgtcattgacaagatcacccgcaatcagtgccagctgtgccgcttcaagaagtgcatcgccgtgggcatggccatggacttggttctagatgactcgaagcgggtggccaagcgtaagctgattgagcagaaccgggagcggcggcggaaggaggagatgatccgatcactgcagcagcgaccagagcccactcctgaagagtgggatctgatccacattgccacagaggcccatcgcagcaccaatgcccagggcagccattggaaacagaggcggaaattcctgcccgatgacattggccagtcacccattgtctccatgccggacggagacaaggtggacctggaagccttcagcgagtttaccaagatcatcaccccggccatcacccgtgtggtggactttgccaaaaaactgcccatgttctccgagctgccttgcgaagaccagatcatcctcctgaaggggtgctgcatggagatcatgtccctgcgggcggctgtccgctacgaccctgagagcgacaccctgacgctgagtggggagatggctgtcaagcgggagcagctcaagaatggcggcctgggcgtagtctccgacgccatctttgaactgggcaagtcactctctgcctttaacctggatgacacggaagtggctctgctgcaggctgtgctgctaatgtcaacagaccgctcgggcctgctgtgtgtggacaagatcgagaagagtcaggaggcgtacctgctggcgttcgagcactacgtcaaccaccgcaaacacaacattccgcacttctggcccaagctgctgatgaaggtgactgacctccgcatgatcggggcctgccacgccagccgcttcctccacatgaaagtcgagtgccccaccgaactcttccccccactcttcctcgaggtctttgaggatcaggaagtctaaagcctcaggcggccagagggtgtgcggagctggtggggaggagcctggagagaaggggcagagctgggggctgagggagacccccccacaccccttctctccttcctctcgtccttggatagattcagctcccacacacacacccgcactgcccaggtccctcctcagacctccagccctgggacagggcaaacaactgaacttgctatggaaaggacagtgtgggaggctgggggagctgtgtcctgcagttcccaggaccccatcctctcagaaggtaggggaagggcgggaggattgagaagggacaagccaccttgaccgtaggggaaggaggaatgtgggctgggggaagatgccctcaactcaccccctacacacacatgagagagagcccccacccagttccttggcctaggtctcccctccaggctgagggcctctctacttccccagatgcctgggtgcaaagaacggcttggcttggctcctcctctggaggttaaaatttatagtcattctaactgcactttggaaaccaagcaaggggagaagacaaatgaagaaaaactagacagagag

SEQ ID NO: 278384 - DNA, 1688 bp, Homo sapiens
gggggcgggcggcggcgaggcggcctgcagggagcagccgcgagccggccgggcgcgccgagcccgagccccagccggagcggggcgggggagggaggagccagagcggccgccgcctctgccggaggagccgcggggccgccacactcgccccccgccccccccgcgctcactcgcactcacacccgggcgcaggaggcgggcggcccgggccccaccggccccccatggacgcccccagcacggggcgctgagacccccgcgtcgctgcccagcccggtccggcgcgccacgccgagggatctctggacaggacaagactccgaagctactcccccagcacacagcccgggacccacaaacccagcttgcccccagccctcccacctgccactccctggcccctcccaccgcccgccccccttggggcgcagggcatggtgtgaaaggccaagtgctgaggcgggtatcatgggtgctgtgccctagggcctgggtggcagggggtgggtggcctgtgggtgtgccgggggggccagtgtgcccaccccagtctcttggcgtgctggagggcatcctggatggaattgaagtgaatggaacagaagccaagcaaggtggagtgtgggtcagacccagaggagaacagtgccaggtcaccagatggaaagcgaaaaagaaagaacggccaatgttccctgaaaaccagcatgtcagggtatatccctagttacctggacaaagacgagcagtgtgtcgtgtgtggggacaaggcaactggttatcactaccgctgtatcacttgtgagggctgcaagggcttctttcgccgcacaatccagaagaacctccatcccacctattcctgcaaatatgacagctgctgtgtcattgacaagatcacccgcaatcagtgccagctgtgccgcttcaagaagtgcatcgccgtgggcatggccatggacttggttctagatgactcgaagcgggtggccaagcgtaagctgattgagcagaaccgggagcggcggcggaaggaggagatgatccgatcactgcagcagcgaccagagcccactcctgaagagtgggatctgatccacattgccacagaggcccatcgcagcaccaatgcccagggcagccattggaaacagaggcggaaattcctgcccgatgacattggccagtcacccattgtctccatgccggacggagacaaggtggacctggaagccttcagcgagtttaccaagatcatcaccccggccatcacccgtgtggtggactttgccaaaaaactgcccatgttctccgagctgccttgcgaagaccagatcatcctcctgaaggggtgctgcatggagatcatgtccctgcgggcggctgtccgctacgaccctgagagcgacaccctgacgctgagtggggagatggctgtcaagcgggagcagctcaagaatggcggcctgggcgtagtctccgacgccatctttgaactgggcaagtcactctctgcctttaacctggatgacacggaagtggctctgctgcaggctgtgctgctaatgtcaacagaccgctcgggcctgctgtgtgtggacaagatcgagaagagtcaggaggcgtacctgctggcgttcgagcactacgtcaaccgcagtcacccgtcgggatcctcgagagca

SEQ ID NO: 278385 - DNA, 1651 bp, Homo sapiens
gggggcgggcggcggcgaggcggcctgcagggagcagccgcgagccggccgggcgcgccgagcccgagccccagccggagcggggcgggggagggaggagccagagcggccgccgcctctgccggaggagccgcggggccgccacactcgccccccgccccccccgcgctcactcgcactcacacccgggcgcaggaggcgggcggcccgggccccaccggccccccatggacgcccccagcacggggcgctgagacccccgcgtcgctgcccagcccggtccggcgcgccacgccgagggatctctggacaggacaagactccgaagctactcccccagcacacagcccgggacccacaaacccagcttgcccccagccctcccacctgccactccctggcccctcccaccgcccgccccccttggggcgcagggcatggtgtgaaaggccaagtgctgaggcgggtatcatgggtgctgtgccctagggcctgggtggcagggggtgggtggcctgtgggtgtgccgggggggccagtgtgcccaccccagtctcttggcgtgctggagggcatcctggatggaattgaagtgaatggaacagaagccaagcaaggtggagtgtgggtcagacccagaggagaacagtgccaggtcaccagatggaaagcgaaaaagaaagaacggccaatgttccctgaaaaccagcatgtcagggtatatccctagttacctggacaaagacgagcagtgtgtcgtgtgtggggacaaggcaactggttatcactaccgctgtatcacttgtgagggctgcaagggcttctttcgccgcacaatccagaagaacctccatcccacctattcctgcaaatatgacagctgctgtgtcattgacaagatcacccgcaatcagtgccagctgtgccgcttcaagaagtgcatcgccgtgggcatggccatggacttggttctagatgactcgaagcgggtggccaagcgtaagctgattgagcagaaccgggagcggcggcggaaggaggagatgatccgatcactgcagcagcgaccagagcccactcctgaagagtgggatctgatccacattgccacagaggcccatcgcagcaccaatgcccagggcagccattggaaacagaggcggaaattcctgcccgatgacattggccagtcacccattgtctccatgccggacggagacaaggtggacctggaagccttcagcgagtttaccaagatcatcaccccggccatcacccgtgtggtggactttgccaaaaaactgcccatgttctccgaggtgagtggcagaagtggggagagatgtgatgctgtgctggagggaaacctgctcccccggtcacccagtacaggctcatctgaggttctctggacaaggagcaattcctgtaggtcaacatacacagataacatacacagacacacacacacacatgcatacacatacacccagcacacaggcacacatgcagacacatacacggacacacacacacacctagcatacagatacgtacacagacacacatacacacacacatacacccagcacacagacacacacatctcatttctctagtgtcttttgcctttaaaaaaaactaaacagat

SEQ ID NO: 278386 - DNA, 1362 bp, Homo sapiens
ttttgtttgtttgttttttgagacagggtcccattctgtcacccaggctggagtgcagtggcagtcacagctcattgcagccttgacctcctgggctcaagcaatcctcccacctcagcctcttcagcctcagccttcccggtagctgagaccacagcctcggctaagtttttaattttttgtaaagatggggtctcaccatgttgcccaggctggtcttggactgctagtctcaagcgatcctcccaccttggcctcccagagtgctgtgctggcattacaggtttgatttttgtgtatggtgtaagaaaagagtccgatttcaatcttttgcacatggatatccagcttttccaacaccatgtattgaagagactaccttttcccttttgtggattcttggcaaccttgttgaagggccttcctttgcttcacctcatggctcacatacaagtgacctgagtcactccatcttcctgatcaaactgtccgtcgtctaattcccggaggacgttgtcactgctgctgaacccagagaagctgttgtgctgtgccagccttccctcctttgtccagcattcccgggagggagaaaggcggcactcctcaggcaggtgtctgctctctgcaggttgtgacgaggttgtgtctaatccgatgcttctactagtggctatattcttgtcttcaccttttatgtggcggctggctttcttctgaaacacaagacattggtgaccaggagagttaaaaagatgggtgtttcctgtccctctggtctagcacatgctgcctttctgcctccaggaatgtccttttgcccagctcttcaaaatcctgctcatcttcaacgaccagctcagagctacctccacattcccctctccacccaaatacaaatgaactcccttctccctgttttgtaactctttgtaggttcctggcacatcattcttgttgatgggtatgttatgtacacatctcggccctcagtgacatctctaaggaaggaaatttgttgaaatcatactttgggagaacaaagcaaggtataaatactaatatgtttttcttcttagtgttagttcagatctatacagcagaaaaggtgctttgatggccaccttacacccatgtcatgtagacacaggctgcacagaagagtcacagtgatatggtttggctgtgtccccacccaaatctcatcttgaattgtaactcccatatttcccatgtgttgtgggaggggcccagtgggaggtagtcaaatcatgggggtgggtcttatcccatgaataagtatcatgagatctgatggttttataaaggggagttcccttgcacatgctctctcttgcctgc

SEQ ID NO: 278387 - DNA, 881 bp, Homo sapiens
  misc_feature (843)..(843): n is a, c, g, or t
  misc_feature (851)..(851): n is a, c, g, or t
  misc_feature (860)..(860): n is a, c, g, or t
agcggagtccgcggtcctcacccgcgccgggcggtagtagtagctgtgctctttggggtccaggcgccgcggcgggatgtagctgaaggcggactgcgccgagacgggcggcggcctgggcttgccccgcagcgtggacgcggtggtctcctcctcgtcgtcctccatgccgccaccgtccagcgcccccgccttggccgcggtccgtcccgcccgcccaggggcccagtcggagtctgcaggcctcaggttgctcagcgccagcgtctagcccgcgtctgtgttcggtcgttgcctggaaaccgccgcctggcgacccggagctgccctgcagcattcccgctccagggtggagcgaccctcccctcctccctcccggcccctcgactacacctggggtctctccttccttcctcctcgggaggagcccgactgggagacgccgcggggactacccatttccagcccgctcacctttcccatgcagcagcccctgcttcactcactgattcactccttcgcgagaccattagtgactgagcacctagcgcatggtgtgtcaggagctggagattgagccttgaacggagcaggccttgtccacaggaagcttacagtctggagaagacacatgaaagacgcgaagaagccaaatgacttgccgaggctccagggcagcgctgtccaatagaaacatgatgagagccacgtgtgtcgtttcttatttgactcagaggaactgactgcttccgttttcccagaattctatcaaatatctttcaagtgtccacatgtacccaagcgacgcacattcctcacataggaggaaggcaaggaaaggtnggcagagntcctttcantcccagactgttgaaggaagg

SEQ ID NO: 278388 - DNA, 916 bp, Homo sapiens
agcggagtccgcggtcctcacccgcgccgggcggtagtagtagctgtgctctttggggtccaggcgccgcggcgggatgtagctgaaggcggactgcgccgagacgggcggcggcctgggcttgccccgcagcgtggacgcggtggtctcctcctcgtcgtcctccatgccgccaccgtccagcgcccccgccttggccgcggtccgtcccgcccgcccaggggcccagtcggagtctgcaggcctcaggttgctcagcgccagcgtctagcccgcgtctgtgttcggtcgttgcctggaaaccgccgcctggcgacccggagctgccctgcagcattcccgctccagggtggagcgaccctcccctcctccctcccggcccctcgactacacctggggtctctccttccttcctcctcgggaggagcccgactgggagacgccgcggggactacccatttccagcccgctcacctttcccatgcagcagcccctgcttcactcactgattcactccttcgcgagaccattagtgactgagcacctagcgcatggtgtgtcaggagctggagattgagccttgaacggagcaggccttgtccacaggaagcttacagtctggagaagacacatgaaagacgcgaagaagccaaatgacttgccgaggctccagggcagcgctgtccaatagaaacatgatgagagccacgtgtgtcgtttcttatttgactcagaggaactgactgcttccgttttcccagaattctatcaaatatctttcaagtgtccacatgtacccaagcgacgcacattcctcacataggaggaaggcaaggaaagaatcatatctatttttttcaccttcttgagaaaaagataccgctgcttattagcctcaacgagtcttgtaatgtga

SEQ ID NO: 278389 - DNA, 1167 bp, Homo sapiens
agcggagtccgcggtcctcacccgcgccgggcggtagtagtagctgtgctctttggggtccaggcgccgcggcgggatgtagctgaaggcggactgcgccgagacgggcggcggcctgggcttgccccgcagcgtggacgcggtggtctcctcctcgtcgtcctccatgccgccaccgtccagcgcccccgccttggccgcggtccgtcccgcccgcccaggggcccagtcggagtctgcaggcctcaggttgctcagcgccagcgtctagcccgcgtctgtgttcggtcgttgcctggaaaccgccgcctggcgacccggagctgccctgcagcattcccgctccagggtggagcgaccctcccctcctccctcccggcccctcgactacacctggggtctctccttccttcctcctcgggaggagcccgactgggagacgccgcggggactacccatttccagcccgctcacctttcccatgcagcagcccctgcttcactcactgattcactccttcgcgagaccattagtgactgagcacctagcgcatggtgtgtcaggagctggagattgagccttgaacggagcaggccttgtccacaggaagcttacagtctggagaagacacatgaaagacgcgaagaagccaaatgacttgccgaggctccagggcagcgctgtccaatagaaacatgatgagagccacgtgtgtcgtttcttatttgactcagaggaactgactgcttccgttttcccagaattctatcaaatatctttcaagtgtccacatgtacccaagcgacgcacattcctcacataggaggaaggcaaggaaaggtaaagaagactgcctgtgttgttcaggcagaactgtcaccacactcttccacagctcctgcctgcctgccatctacacacacactcacaacacacactcagagaggatccactctctcctccagagatcctctagtttcaactgctgcagcccaaagtcctgaactttgctgccccctattgataggcccaaagactatcactgttgctgcaggggttgtgctagcaagtaaaacaattttttttcattcatttttcttgctttgctttacttttgaaaacaaatatagaaaggttatgcaattattaaaaatattatcaaatata

SEQ ID NO: 278390 - DNA, 685 bp, Homo sapiens
attcccgctccagggtggagcgaccctcccctcctccctcccggcccctcgactacacctggggtctctccttccttcctcctcgggaggagcccgactgggagacgccgcggggactacccatttccagcccgctcacctttcccatgcagcagcccctgcttcactcactgattcactccttcgcgagaccattagtgactgagcacctagcgcatggtgtgtcaggagctggagattgagccttgaacggagcaggccttgtccacaggaagcttacagtctggagaagacacatgaaagacgcgaagaagccaaatgacttgccgaggctccagggcagcgctgtccaatagaaacatgatgagagccacgtgtgtcgtttcttatttgactcagtaagtccaaaacgttatcatttcaacaaatggcactagctgcctttcaagctctcggtggccacgtgtggctagcagttacagtattggccagtgcaggtgtaaggctgcatgaatttacagaatctggcagaactcagctgctgtggacagggctcttgcaatcctttgccagtgtgtttacgttggcccttgatctgaatgctgggtcaatacctgcgttccgtttgttgaaaatgtgttaagctgtatactcgtgattggtgggtgtacagccaagaaaagtt

SEQ ID NO: 278391 - DNA, 652 bp, Homo sapiens
attgatcgaaatgcagaaaattggtgttattatgaaggcttggaaaaagctctacaaattagcactttagaagagaggcttcaaatttatgaagaaattagtaagcagcaccccaaagcaattacacccagaagattacctttgactcttgtcccaggtttctataatccaggaacttgttactaattatgaagcctctcttaaaacgtgtgacttttttagcccatatgagaatggggagaaggaacccccgacaacactactctgggttcagtatttcctggcacagcactttgataaacttggacagtattctttggctttggattatattaatgctgcaattgctagtactccaactctaatagaattattctatatgaaagcaaaaatttacaaggtaaaatctgaatcctgttttttgagtagttgaagaattcagctactttaagaatccttggagttttttctttgtggaaacaagttctagggcaccctgataatctttttctaataatcctgtgtagtttcatgttatattaattgtataatcaatgtgtaattagatgtgtaatcatttgagctcttagtaaatgtgaactgtaattttgatttctaaataaatttgacagaaatggtgacagaaaaaaaa

SEQ ID NO: 278392 - DNA, 3164 bp, Homo sapiens
attgatcgaaatgcagaaaattggtgttattatgaaggcttggaaaaagctctacaaattagcactttagaagagaggcttcaaatttatgaagaaattagtaagcagcaccccaaagcaattacacccagaagattacctttgactcttgtcccaggtttctataatccaggaacttgttactaattatgaagcctctcttaaaacgtgtgacttttttagcccatatgagaatggggagaaggaacccccgacaacactactctgggttcagtatttcctggcacagcactttgataaacttggacagtattctttggctttggattatattaatgctgcaattgctagtactccaactctaatagaattattctatatgaaagcaaaaatttacaagcatataggtaatctcaaagaagctgcaaagtggatggatgaagcacagtctttggacacagctgatagattcatcaattccaaatgtgcaaaatacatgcttcgagcaaatatgataaaagaagcagaggaaatgtgctccaagttcacaagggaaggaacatctgccatggaaaatctaaatgaaatgcagtgtatgtggtttcagacagaatgcatttcagcttatcagcgtctggggagatacggggatgccttgaaaaaatgtcatgaagtagaaaggcatttttttgagataactgatgaccaattcgacttccatacatactgcatgagaaagatgacccttcgtgcctatgttgaccttttgagattagaagatatactcagaagacatgccttttatttcaaggctgctagatcagcgattgaaatatacttgaaattgtatgataatcccttaaccaatgaaagcaaacaacaagaaataaactcagaaaacttgtcagccaaagaattgaagaaaatgcttagcaagcagagaagagctcagaaaaaggctaaactagaagaagaaagaaagcatgcagaaagagaacgtcaacagaaaaatcaaaagaaaaaaagagatgaagaagaagaagaagccagtggccttaaggaagaacttatacctgaaaaattagaaagggtagaaaatccattagaggaagccgttaagttccttatacctcttaagaaccttgttgctgataacattgacactcatctgttagcatttgaaatatattttagaaaaggaaagtttctgttaatgctgcagtctgtcaaacgaggttttgccattaacagtaataacccatggttacatgaatgtttaattagattttctaaatctgtgtctaatcatagtaatcttccagacattgtgagcaaagttctatctcaagaaatgcagaaaatatttgtcaaaaaggatttggaaagttttaatgaggattttctgaaacgtaacgctacctctcttcagcatctactttcaggtgctaaaatgatgtattttctggacaagtcaaggcaggagaaagcaattgctatagccactagactagatgaaactataaaagataaagatgtaaagacattaataaaggtttctgaagcactgcttgatggcagctttgggaactgtagttcccaatatgaagaatataggatggccagtcataacctgcttccttttacatctgccttcttgcctgctgtgaatgaagtcgacaatcctaatgtggcactgaaccatacagctaattatgatgtcttggcaaatgaaatttgaaatcttctagaaagtagactcctatagactcaaagctgaattgagatcagggtttcttttccaggttgcattttaatatacgtatgaaatgaaatatttggttaggatttttaaatggcatattctgtaagcttattttgttctttacccggcctgccaatttacataaccatctgttaaaattacctgtttattcttacacagttttgtggtagctccgattgcttctgtataattataatttcttactaagctaagttgtatacaaccccactgtattattttctttagattctgatttcaggatctgtgctttgattccttgtctgttttatcgtatatttgcttgctttttaattaaagcacatcagttttaaagtgttaactatatgttaacaatatggaggctgggcgtggtggctcacacctgtaatcccagcactttgggaggcccagactggcggatcacctgaggtcaggagatcgagatcagcctggccaacatggtgaaaccccttctctactgaaaatacaaaaattagccagacgtgatggcacatacctgtaatccaagctgcccaggagctgaggccggagaatcgcttgaacctgggaggtggaggttgcagtgagccgagatcatgccactgcactccagcctgggcaacagagcaagactccatctcgaaaaaaaggaattcctcttggcagatattgaagtttatttgaaaatttaattcgtccttttttcattgtaatatttcatggtttactatttccttttagtattcatgaaaatggtattttctggttgaataagggtgctctagttttatgtagatgatttcagaatgtgaaggctggtttgcctgtcagtcatggaaattcactggtaaaattgttgcatatttctctctcccagtcttaaaagcccacaggcaagaattaatgctttcttaactaagttactttgagtattaacaagtagcttatactgaggtgtgcttcaagggagcattatagggcagaaaacaaattaaaatgaaatgttgttgttatagccatgcattgaccattaaatgcattttaatatctcggcaaaatgagatttgaaactcattagtttaactcttaaaacatagtgttgttaaacagtattttttgggggcgggtggatagctttttgttctatcttgtacagaaaacagtaatggaatcactcatgttcagaaccttgtaaatatgtctgtaatattaatgcttccctttattaagacaaatatacattcaaaaagggagattttatttagacacacattttcttttcaccctaatctatttagattcatacttattgagacgggaaaaactcgctgtaaaataatgccaacctagataatgctataataaattattttgtacacag

SEQ ID NO: 278393 - DNA, 3086 bp, Homo sapiens
attgatcgaaatgcagaaaattggtgttattatgaaggcttggaaaaagctctacaaattagcactttagaagagaggcttcaaatttatgaagaaattagtaagcagcaccccaaagcaattacacccagaagattacctttgactcttgtcccaggtttctataatccaggaacttgttactaattatgaagcctctcttaaaacgtgtgacttttttagcccatatgagaatggggagaaggaacccccgacaacactactctgggttcagtatttcctggcacagcactttgataaacttggacagtattctttggctttggattatattaatgctgcaattgctagtactccaactctaatagaattattctatatgaaagcaaaaatttacaagcatataggtaatctcaaagaagctgcaaagtggatggatgaagcacagtctttggacacagctgatagattcatcaattccaaatgtgcaaaatacatgcttcgagcaaatatgataaaagaagcagaggaaatgtgctccaagttcacaagggaaggaacatctgccatggaaaatctaaatgaaatgcagtgtatgtggtttcagacagaatgcatttcagcttatcagcgtctggggagatacggggatgccttgaaaaaatgtcatgaagtagaaaggcatttttttgagataactgatgaccaattcgacttccatacatactgcatgagaaagatgacccttcgtgcctatgttgaccttttgagattagaagatatactcagaagacatgccttttatttcaaggctgctagatcagcgattgaaatatacttgaaattgtatgataatcccttaaccaatgaaagcaaacaacaagaaataaactcagaaaacttgtcagccaaagaattgaagaaaatgcttagcaagcagagaagagctcagaaaaaggctaaactagaagaagaaagaaagcatgcagaaagagaacgtcaacagaaaaatcaaaagaaaaaaagagatgaagaagaagaagaagccagtggccttaaggaagaacttatacctgaaaaattagaaagggtagaaaatccattagaggaagccgttaagttccttatacctcttaagaaccttgttgctgataacattgacactcatctgttagcatttgaaatatattttagaaaaggaaagtttctgttaatgctgcagtctgtcaaacgaggttttgccattaacagtaataacccatggttacatgaatgtttaattagattttctaaatctgacattgtgagcaaagttctatctcaagaaatgcagaaaatatttgtcaaaaaggatttggaaagttttaatgaggattttctgaaacgtaacgctacctctcttcagcatctactttcaggtgctactagactagatgaaactataaaagataaagatgtaaagacattaataaaggtttctgaagcactgcttgatggcagctttgggaactgtagttcccaatatgaagaatataggatggccagtcataacctgcttccttttacatctgccttcttgcctgctgtgaatgaagtcgacaatcctaatgtggcactgaaccatacagctaattatgatgtcttggcaaatgaaatttgaaatcttctagaaagtagactcctatagactcaaagctgaattgagatcagggtttcttttccaggttgcattttaatatacgtatgaaatgaaatatttggttaggatttttaaatggcatattctgtaagcttattttgttctttacccggcctgccaatttacataaccatctgttaaaattacctgtttattcttacacagttttgtggtagctccgattgcttctgtataattataatttcttactaagctaagttgtatacaaccccactgtattattttctttagattctgatttcaggatctgtgctttgattccttgtctgttttatcgtatatttgcttgctttttaattaaagcacatcagttttaaagtgttaactatatgttaacaatatggaggctgggcgtggtggctcacacctgtaatcccagcactttgggaggcccagactggcggatcacctgaggtcaggagatcgagatcagcctggccaacatggtgaaaccccttctctactgaaaatacaaaaattagccagacgtgatggcacatacctgtaatccaagctgcccaggagctgaggccggagaatcgcttgaacctgggaggtggaggttgcagtgagccgagatcatgccactgcactccagcctgggcaacagagcaagactccatctcgaaaaaaaggaattcctcttggcagatattgaagtttatttgaaaatttaattcgtccttttttcattgtaatatttcatggtttactatttccttttagtattcatgaaaatggtattttctggttgaataagggtgctctagttttatgtagatgatttcagaatgtgaaggctggtttgcctgtcagtcatggaaattcactggtaaaattgttgcatatttctctctcccagtcttaaaagcccacaggcaagaattaatgctttcttaactaagttactttgagtattaacaagtagcttatactgaggtgtgcttcaagggagcattatagggcagaaaacaaattaaaatgaaatgttgttgttatagccatgcattgaccattaaatgcattttaatatctcggcaaaatgagatttgaaactcattagtttaactcttaaaacatagtgttgttaaacagtattttttgggggcgggtggatagctttttgttctatcttgtacagaaaacagtaatggaatcactcatgttcagaaccttgtaaatatgtctgtaatattaatgcttccctttattaagacaaatatacattcaaaaagggagattttatttagacacacattttcttttcaccctaatctatttagattcatacttattgagacgggaaaaactcgctgtaaaataatgccaacctagataatgctataataaattattttgtacacag

SEQ ID NO: 278394 - DNA, 534 bp, Homo sapiens
gtatttcattaaaactaaaatattaatatatactaactttcaggtttaaaaaataacctgatcttttgacttatatagaagttgagtatcatcacaaaacatgatttgtagggaatgggcatggtttgtaggaagagaaagttcaagttgaatgccaaaaataattcatatcctttatagtgtaaaacattggagagggcagctaagtgaaaattgtgactgtttaaattgttttttgggctttttacaattttttttttctaaaggtagacattattgacataaatgtaaaggttaattttgtgatttttgtttttaagcatttttttgagataactgatgaccaattcgacttccatacatactgcatgagaaagatgacccttcgtgcctatgttgaccttttgagattagaagatatactcagaagacatgccttttatttcaaggctgctagatcagcgattgaaatatacttgaaattgtatgataatcccttaaccaatgaaagcaaacaacaagaaataaactcag

SEQ ID NO: 278395 - DNA, 3110 bp, Homo sapiens
attgatcgaaatgcagaaaattggtgttattatgaaggcttggaaaaagctctacaaattagcactttagaagagaggcttcaaatttatgaagaaattagtaagcagcaccccaaagcaattacacccagaagattacctttgactcttgtcccaggtttctataatccaggaacttgttactaattatgaagcctctcttaaaacgtgtgacttttttagcccatatgagaatggggagaaggaacccccgacaacactactctgggttcagtatttcctggcacagcactttgataaacttggacagtattctttggctttggattatattaatgctgcaattgctagtactccaactctaatagaattattctatatgaaagcaaaaatttacaagcatataggtaatctcaaagaagctgcaaagtggatggatgaagcacagtctttggacacagctgatagattcatcaattccaaatgtgcaaaatacatgcttcgagcaaatatgataaaagaagcagaggaaatgtgctccaagttcacaagggaaggaacatctgccatggaaaatctaaatgaaatgcagtgtatgtggtttcagacagaatgcatttcagcttatcagcgtctggggagatacggggatgccttgaaaaaatgtcatgaagtagaaaggcatttttttgagataactgatgaccaattcgacttccatacatactgcatgagaaagatgacccttcgtgcctatgttgaccttttgagattagaagatatactcagaagacatgccttttatttcaaggctgctagatcagcgattgaaatatacttgaaattgtatgataatcccttaaccaatgaaagcaaacaacaagaaataaactcagaaaacttgtcagccaaagaattgaagaaaatgcttagcaagcagagaagagctcagaaaaaggctaaactagaagaagaaagaaagcatgcagaaagagaacgtcaacagaaaaatcaaaagaaaaaaagagatgaagaagaagaagaagccagtggccttaaggaagaacttatacctgaaaaattagaaagggtagaaaatccattagaggaagccgttaagttccttatacctcttaagaaccttgttgctgataacattgacactcatctgttagcatttgaaatatattttagaaaaggaaagtttctgttaatgctgcagtctgtcaaacgaggttttgccattaacagtaataacccatggttacatgaatgtttaattagattttctaaatctgtgtctaatcatagtaatcttccagacattgtgagcaaagttctatctcaagaaatgcagaaaatatttgtcaaaaaggatttggaaagttttaatgaggattttctgaaacgtaacgctacctctcttcagcatctactttcaggtgctactagactagatgaaactataaaagataaagatgtaaagacattaataaaggtttctgaagcactgcttgatggcagctttgggaactgtagttcccaatatgaagaatataggatggccagtcataacctgcttccttttacatctgccttcttgcctgctgtgaatgaagtcgacaatcctaatgtggcactgaaccatacagctaattatgatgtcttggcaaatgaaatttgaaatcttctagaaagtagactcctatagactcaaagctgaattgagatcagggtttcttttccaggttgcattttaatatacgtatgaaatgaaatatttggttaggatttttaaatggcatattctgtaagcttattttgttctttacccggcctgccaatttacataaccatctgttaaaattacctgtttattcttacacagttttgtggtagctccgattgcttctgtataattataatttcttactaagctaagttgtatacaaccccactgtattattttctttagattctgatttcaggatctgtgctttgattccttgtctgttttatcgtatatttgcttgctttttaattaaagcacatcagttttaaagtgttaactatatgttaacaatatggaggctgggcgtggtggctcacacctgtaatcccagcactttgggaggcccagactggcggatcacctgaggtcaggagatcgagatcagcctggccaacatggtgaaaccccttctctactgaaaatacaaaaattagccagacgtgatggcacatacctgtaatccaagctgcccaggagctgaggccggagaatcgcttgaacctgggaggtggaggttgcagtgagccgagatcatgccactgcactccagcctgggcaacagagcaagactccatctcgaaaaaaaggaattcctcttggcagatattgaagtttatttgaaaatttaattcgtccttttttcattgtaatatttcatggtttactatttccttttagtattcatgaaaatggtattttctggttgaataagggtgctctagttttatgtagatgatttcagaatgtgaaggctggtttgcctgtcagtcatggaaattcactggtaaaattgttgcatatttctctctcccagtcttaaaagcccacaggcaagaattaatgctttcttaactaagttactttgagtattaacaagtagcttatactgaggtgtgcttcaagggagcattatagggcagaaaacaaattaaaatgaaatgttgttgttatagccatgcattgaccattaaatgcattttaatatctcggcaaaatgagatttgaaactcattagtttaactcttaaaacatagtgttgttaaacagtattttttgggggcgggtggatagctttttgttctatcttgtacagaaaacagtaatggaatcactcatgttcagaaccttgtaaatatgtctgtaatattaatgcttccctttattaagacaaatatacattcaaaaagggagattttatttagacacacattttcttttcaccctaatctatttagattcatacttattgagacgggaaaaactcgctgtaaaataatgccaacctagataatgctataataaattattttgtacacag

SEQ ID NO: 278396 - DNA, 256 bp, Homo sapiens
tacatcgagctcggtcctggggaacctatcggagtaacaatacaaatggattttgggagtgactcaagaagtgaagaatgcacaagaatggatcacaagatggaatttagcaaaccctagccttgcttgttaaattttttttttttttttttaagaatatctgtaatggtactgactttgcttgctttgaagtagctcttttttttttttttttttttttgggaaaacgtcgttttataaactctctcgtaggtgt

SEQ ID NO: 278397 - DNA, 577 bp, Homo sapiens
  misc_feature (121)..(121): n is a, c, g, or t
ttttttgggcaaggaaaagaaacccaaaattccaaacccttgggaaaacggggccaaaaaaatttttttaacccccaattttaaaactgcccccaaagggaaaaacccactcccccccccnaaaaaaaaaaaaaaaaaaaaaagcaaattaccagtgagtagtgtgttacttgggtttttaataggcatcttattaacatgttccaacttgagcccttaactttctccacctacccccttccacaaacctgttttcactgtcttctctgtcttagttaatgtcagctttgtctgtccagctgctcaggctaaaacttttctttcatataacacatcctatcagcagctcctgtttgtgggtaggcattttgcctttttttttttttttttttttaaactgctatatctctagcatgtagaacagtgcctggcagcacataataggtgcttaatataatatttgttgaaagaacaagtcagtgagtatttttaatgtgaggtgcaaagagaaaaaaaaaatgtatctttgaggtgtggagttttgaagaacttccattttctaagcatttgtgtaatg

SEQ ID NO: 278398 - DNA, 915 bp, Homo sapiens
cccatggagtatgggaaggcaggagctgccctcctgctggagggattctctttgacttggagcagatgtgtcaggcgaggactgtcttgctgtttggtgactcaagcctagaaagctagacaggaaatcagctgagaccatttgacagggatggggatcctgagtaagattcaaagacagattaatcatttgtccttgtcaagttgatgtggggtcagtgagaaatcttggaagggacctgttctcctgccagagcagctgtgaggttatggaggaagaaccccttggatatcgccaggatgatcctagctatcgttcttttcactctggtggatatggccaggatgccttgggtatggaccccatgatggaacatgagatgggtggccaccaccctggtgctgactatccagttgatgggctgccagatctggggcatgcccaggacctcatggatgggctgcctccaggtgacagcaatcagctggcctggtttgatactgacctgtaaatcatcctttaggaagtaggagtcaaagtgacccttgtctactgtgatgctgaattcatgactaagagactattggtgaacttatcctggctgtgattacagacgtcaagagggagtattccagcgacactaagaaaataatgcaagagaacgccagcgaagagtgcccaggcaacactgacagactagaaaaaaaatatcaggagatgaagctgacacagtgagagcagcccaggtgcttcttggtgcttgttattacagacacacacttcacacaggggaggattattttaattctgtggccttcagatctcataaatacaagtaaaaacaagcaggtaactatgataactttacttcagagagtttaaatttcaaaaataaacctatccatccagcccctt

SEQ ID NO: 278399 - DNA, 3446 bp, Homo sapiens
atagctgattgatgagttgacatgccatggatccagacagaaaagcggctgttagtcactggcagcaacagtcttacctggactctggaatccattctggtgccactaccacagctccttctctgagtggtaaaggcaatcctgaggaagaggatgtggatacctcccaagtcctgtatgagtgggaacagggattttctcagtccttcactcaagaacaagtagctgatattgatggacagtatgcaatgactcgagctcagagggtacgagctgctatgttccctgagacattagatgagggcatgcagatcccatctacacagtttgatgctgctcatcccactaatgtccagcgtttggctgaaccatcacagatgctgaaacatgcagttgtaaacttgattaactatcaagatgatgcagaacttgccacacgtgcaatccctgaactgacaaaactgctaaatgacgaggaccaggtggtggttaataaggctgcagttatggtccatcagctttctaaaaaggaagcttccagacacgctatcatgcgttctcctcagatggtgtctgctattgtacgtaccatgcagaatacaaatgatgtagaaacagctcgttgtaccgctgggaccttgcataacctttcccatcatcgtgagggcttactggccatctttaagtctggaggcattcctgccctggtgaaaatgcttggttcaccagtggattctgtgttgttttatgccattacaactctccacaaccttttattacatcaagaaggagctaaaatggcagtgcgtttagctggtgggctgcagaaaatggttgccttgctcaacaaaacaaatgttaaattcttggctattacgacagactgccttcaaattttagcttatggcaaccaagaaagcaagctcatcatactggctagtggtggaccccaagctttagtaaatataatgaggacctatacttacgaaaaactactgtggaccacaagcagagtgctgaaggtgctatctgtctgctctagtaataagccggctattgtagaagctggtggaatgcaagctttaggacttcacctgacagatccaagtcaacgtcttgttcagaactgtctttggactctcaggaatctttcagatgctgcaactaaacaggaagggatggaaggtctccttgggactcttgttcagcttctgggttcagatgatataaatgtggtcacctgtgcagctggaattctttctaacctcacttgcaataattataagaacaagatgatggtctgccaagtgggtggtatagaggctcttgtgcgtactgtccttcgggctggtgacagggaagacatcactgagcctgccatctgtgctcttcgtcatctgaccagccgacaccaagaagcagagatggcccagaatgcagttcgccttcactatggactaccagttgtggttaagctcttacacccaccatcccactggcctctgataaaggctactgttggattgattcgaaatcttgccctttgtcccgcaaatcatgcacctttgcgtgagcagggtgccattccacgactagttcagttgcttgttcgtgcacatcaggatacccagcgccgtacgtccatgggtgggacacagcagcaatttgtggagggggtccgcatggaagaaatagttgaaggttgtaccggagcccttcacatcctagctcgggatgttcacaaccgaattgttatcagaggactaaataccattccattgtttgtgcagctgctttattctcccattgaaaacatccaaagagtagctgcaggggtcctctgtgaacttgctcaggacaaggaagctgcagaagctattgaagctgagggagccacagctcctctgacagagttacttcactctaggaatgaaggtgtggcgacatatgcagctgctgttttgttccgaatgtctgaggacaagccacaagattacaagaaacggctttcagttgagctgaccagctctctcttcagaacagagccaatggcttggaatgagactgctgatcttggacttgatattggtgcccagggagaaccccttggatatcgccaggatgatcctagctatcgttcttttcactctggtggatatggccaggatgccttgggtatggaccccatgatggaacatgagatgggtggccaccaccctggtgctgactatccagttgatgggctgccagatctggggcatgcccaggacctcatggatgggctgcctccaggtgacagcaatcagctggcctggtttgatactgacctgtaaatcatcctttaggtaagaagttttaaaaagccagtttgggtaaaatacttttactctgcctacagaacttcagaaagacttggttggtagggtgggagtggtttaggctatttgtaaatctgccacaaaaacaggtatatactttgaaaggagatgtcttggaacattggaatgttctcagatttctggttgttatgtgatcatgtgtggaagttattaactttaatgttttttgccacagcttttgcaacttaatactcaaatgagtaacatttgctgttttaaacattaatagcagcctttctctctttatacagctgtattgtctgaacttgcattgtgattggcctgtagagttgctgagagggctcgaggggtgggctggtatctcagaaagtgcctgacacactaaccaagctgagtttcctatgggaacaattgaagtaaactttttgttctggtcctttttggtcgaggagtaacaatacaaatggattttgggagtgactcaagaagtgaagaatgcacaagaatggatcacaagatggaatttagcaaaccctagccttgcttgttaaattttttttttttttttttaagaatatctgtaatggtactgactttgcttgctttgaagtagctcttttttttttttttttttttttttttttttttgcagtaactgttttttaagtctctcgtagtgttaagttatagtgaatactgctacagcaatttctaatttttaagaattgagtaatggtgtagaacactaattaattcataatcactctaattaattgtaatctgaataaagtgtaacaattgtgtagcctttttgtataaaatagacaaatagaaaatggtccaattagtttcctttttaatatgcttaaaataagcaggtggatctatttcatgtttttgatcaaaaactatttgggatatgtatgggtagggtaaatcagtaagaggtgttatttggaaccttgttttggacagtttaccagttgccttttatcccaaagttgttgtaacctgctgtgatacgatgcttcaagagaaaatgcggttataaaaaatggttcagaattaaacttttaattcattcga

SEQ ID NO: 278400 - DNA, 3364 bp, Homo sapiens
atagctgattgatgagttgacatgccatggatccagacagaaaagcggctgttagtcactggcagcaacagtcttacctggactctggaatccattctggtgccactaccacagctccttctctgagtggtaaaggcaatcctgaggaagaggatgtggatacctcccaagtcctgtatgagtgggaacagggattttctcagtccttcactcaagaacaagtagctgatattgatggacagtatgcaatgactcgagctcagagggtacgagctgctatgttccctgagacattagatgagggcatgcagatcccatctacacagtttgatgctgctcatcccactaatgtccagcgtttggctgaaccatcacagatgctgaaacatgcagttgtaaacttgattaactatcaagatgatgcagaacttgccacacgtgcaatccctgaactgacaaaactgctaaatgacgaggaccaggtggtggttaataaggctgcagttatggtccatcagctttctaaaaaggaagcttccagacacgctatcatgcgttctcctcagatggtgtctgctattgtacgtaccatgcagaatacaaatgatgtagaaacagctcgttgtaccgctgggaccttgcataacctttcccatcatcgtgagggcttactggccatctttaagtctggaggcattcctgccctggtgaaaatgcttggttcaccagtggattctgtgttgttttatgccattacaactctccacaaccttttattacatcaagaaggagctaaaatggcagtgcgtttagctggtgggctgcagaaaatggttgccttgctcaacaaaacaaatgttaaattcttggctattacgacagactgccttcaaattttagcttatggcaaccaagaaagcaagctcatcatactggctagtggtggaccccaagctttagtaaatataatgaggacctatacttacgaaaaactactgtggaccacaagcagagtgctgaaggtgctatctgtctgctctagtaataagccggctattgtagaagctggtggaatgcaagctttaggacttcacctgacagatccaagtcaacgtcttgttcagaactgtctttggactctcaggaatctttcagatgctgcaactaaacaggaagggatggaaggtctccttgggactcttgttcagcttctgggttcagatgatataaatgtggtcacctgtgcagctggaattctttctaacctcacttgcaataattataagaacaagatgatggtctgccaagtgggtggtatagaggctcttgtgcgtactgtccttcgggctggtgacagggaagacatcactgagcctgccatctgtgctcttcgtcatctgaccagccgacaccaagaagcagagatggcccagaatgcagttcgccttcactatggactaccagttgtggttaagctcttacacccaccatcccactggcctctgataaaggctactgttggattgattcgaaatcttgccctttgtcccgcaaatcatgcacctttgcgtgagcagggtgccattccacgactagttcagttgcttgttcgtgcacatcaggatacccagcgccgtacgtccatgggtgggacacagcagcaatttgtggagggggtccgcatggaagaaatagttgaaggttgtaccggagcccttcacatcctagctcgggatgttcacaaccgaattgttatcagaggactaaataccattccattgtttgtgcagctgctttattctcccattgaaaacatccaaagagtagctgcaggggtcctctgtgaacttgctcaggacaaggaagctgcagaagctattgaagctgagggagccacagctcctctgacagagttacttcactctaggaatgaaggtgtggcgacatatgcagctgctgttttgttccgaatgtctgaggacaagccacaagattacaagaaacggctttcagttgagctgaccagctctctcttcagaacagagccaatggcttggaatgagactgctgatcttggacttgatattggtgcccagggagaaccccttggatatcgccaggatgatcctagctatcgttcttttcactctggtggatatggccaggatgccttgggtatggaccccatgatggaacatgagatgggtggccaccaccctggtgctgactatccagttgatgggctgccagatctggggcatgcccaggacctcatggatgggctgcctccaggtgacagcaatcagctggcctggtttgatactgacctgtaaatcatcctttaggtaagaagttttaaaaagccagtttgggtaaaatacttttactctgcctacagaacttcagaaagacttggttggtagggtgggagtggtttaggctatttgtaaatctgccacaaaaacaggtatatactttgaaaggagatgtcttggaacattggaatgttctcagatttctggttgttatgtgatcatgtgtggaagttattaactttaatgttttttgccacagcttttgcaacttaatactcaaatgagtaacatttgctgttttaaacattaatagcagcctttctctctttatacagctgtattgtctgaacttgcattgtgattggcctgtagagttgctgagagggctcgaggggtgggctggtatctcagaaagtgcctgacacactaaccaagctgagtttcctatgggaacaattgaagtaaactttttgttctggtcctttttggtcgaggagtaacaatacaaatggattttgggagtgactcaagaagtgaagaatgcacaagaatggatcacaagatggaatttagcaaaccctagccttgcttgttaaattttttttttttttgcagtaactgttttttaagtctctcgtagtgttaagttatagtgaatactgctacagcaatttctaatttttaagaattgagtaatggtgtagaacactaattaattcataatcactctaattaattgtaatctgaataaagtgtaacaattgtgtagcctttttgtataaaatagacaaatagaaaatggtccaattagtttcctttttaatatgcttaaaataagcaggtggatctatttcatgtttttgatcaaaaactatttgggatatgtatgggtagggtaaatcagtaagaggtgttatttggaaccttgttttggacagtttaccagttgccttttatcccaaagttgttgtaacctgctgtgatacgatgcttcaagagaaaatgcggttataaaaaatggttcagaattaaacttttaattcattcga

SEQ ID NO: 278401 - DNA, 4179 bp, Homo sapiens
atagctgattgatgagttgacatgccatggatccagacagaaaagcggctgttagtcactggcagcaacagtcttacctggactctggaatccattctggtgccactaccacagctccttctctgagtggtaaaggcaatcctgaggaagaggatgtggatacctcccaagtcctgtatgagtgggaacagggattttctcagtccttcactcaagaacaagtagctgatattgatggacagtatgcaatgactcgagctcagagggtacgagctgctatgttccctgagacattagatgagggcatgcagatcccatctacacagtttgatgctgctcatcccactaatgtccagcgtttggctgaaccatcacagatgctgaaacatgcagttgtaaacttgattaactatcaagatgatgcagaacttgccacacgtgcaatccctgaactgacaaaactgctaaatgacgaggaccaggtggtggttaataaggctgcagttatggtccatcagctttctaaaaaggaagcttccagacacgctatcatgcgttctcctcagatggtgtctgctattgtacgtaccatgcagaatacaaatgatgtagaaacagctcgttgtaccgctgggaccttgcataacctttcccatcatcgtgagggcttactggccatctttaagtctggaggcattcctgccctggtgaaaatgcttggttcaccagtggattctgtgttgttttatgccattacaactctccacaaccttttattacatcaagaaggagctaaaatggcagtgcgtttagctggtgggctgcagaaaatggttgccttgctcaacaaaacaaatgttaaattcttggctattacgacagactgccttcaaattttagcttatggcaaccaagaaagcaagctcatcatactggctagtggtggaccccaagctttagtaaatataatgaggacctatacttacgaaaaactactgtggaccacaagcagagtgctgaaggtgctatctgtctgctctagtaataagccggctattgtagaagctggtggaatgcaagctttaggacttcacctgacagatccaagtcaacgtcttgttcagaactgtctttggactctcaggaatctttcagatgctgcaactaaacaggaagggatggaaggtctccttgggactcttgttcagcttctgggttcagatgatataaatgtggtcacctgtgcagctggaattctttctaacctcacttgcaataattataagaacaagatgatggtctgccaagtgggtggtatagaggctcttgtgcgtactgtccttcgggctggtgacagggaagacatcactgagcctgccatctgtgctcttcgtcatctgaccagccgacaccaagaagcagagatggcccagaatgcagttcgccttcactatggactaccagttgtggttaagctcttacacccaccatcccactggcctctgataaaggctactgttggattgattcgaaatcttgccctttgtcccgcaaatcatgcacctttgcgtgagcagggtgccattccacgactagttcagttgcttgttcgtgcacatcaggatacccagcgccgtacgtccatgggtgggacacagcagcaatttgtggagggggtccgcatggaagaaatagttgaaggttgtaccggagcccttcacatcctagctcgggatgttcacaaccgaattgttatcagaggactaaataccattccattgtttgtgcagctgctttattctcccattgaaaacatccaaagagtagctgcaggggtcctctgtgaacttgctcaggacaaggaagctgcagaagctattgaagctgagggagccacagctcctctgacagagttacttcactctaggaatgaaggtgtggcgacatatgcagctgctgttttgttccgaatgtctgaggacaagccacaagattacaagaaacggctttcagttgagctgaccagctctctcttcagaacagagccaatggcttggaatgagactgctgatcttggacttgatattggtgcccagggagaaccccttggatatcgccaggatgatcctagctatcgttcttttcactctggtggatatggccaggatgccttgggtatggaccccatgatggaacatgagatgggtggccaccaccctggtgctgactatccagttgatgggctgccagatctggggcatgcccaggacctcatggatgggctgcctccaggtgacagcaatcagctggcctggtttgatactgacctgtaaatcatcctttaggtaagaagttttaaaaagccagtttgggtaaaatacttttactctgcctacagaacttcagaaagacttggttggtagggtgggagtggtttaggctatttgtaaatctgccacaaaaacaggtatatactttgaaaggagatgtcttggaacattggaatgttctcagatttctggttgttatgtgatcatgtgtggaagttattaactttaatgttttttgccacagcttttgcaacttaatactcaaatgagtaacatttgctgttttaaacattaatagcagcctttctctctttatacagctgtattgtctgaacttgcattgtgattggcctgtagagttgctgagagggctcgaggggtgggctggtatctcagaaagtgcctgacacactaaccaagctgagtttcctatgggaacaattgaagtaaactttttgttctggtcctttttggtcgaggagtaacaatacaaatggattttgggagtgactcaagaagtgaagaatgcacaagaatggatcacaagatggaatttagcaaaccctagccttgcttgttaaattttttttttttttttttaagaatatctgtaatggtactgactttgcttgctttgaagtagctcttttttttttttttttttttttttttttttttgcagtaactgttttttaagtctctcgtagtgttaagttatagtgaatactgctacagcaatttctaatttttaagaattgagtaatggtgtagaacactaattaattcataatcactctaattaattgtaatctgaataaagtgtaacaattgtgtagcctttttgtataaaatagacaaatagaaaatggtccaattagtttcctttttaatatgcttaaaataagcaggtggatctatttcatgtttttgatcaaaaactatttgggatatgtatgggtagggtaaatcagtaagaggtgttatttggaaccttgttttggacagtttaccagttgccttttatcccaaagttgttgtaacctgctgtgatacgatgcttcaagagaaaatgcggttataaaaaatggttcagaattaaacttttaattcattcgaaaaaaaaaaaaaaaaaaaaaaaaaaaaaaaaaaaaaaaaaaaaaaaaaaaaaaaaaaaaaaaaaaaaaaacaaaaaggacaggagaaaaaaaaaaaaaaaaacaaaaaaaaaaaaaaaaaaaaaaaaaaaaggggggggacagaaagaattaactaaccggggggagaggcgccaaattaataagcacccaccaccagtgtataaaaacaaacgcaggccgcataagagaagaatacatagtcaaaactaggaacagaacggggggggaagcccacaaaaccgaggtgatgactcgaaaaaaaatggcaacccgtgtgcctagttagagaaaacaacccccccgagggcatggtacgacaaacacaccgggaaacacacgacgcaaaaaaaagaagcgacgagcagagcagaaaaacaatatgggcgcgaggtagagagacgaataacaccccaatctatgggcgggagacagaaaatcagcctcggatggatatattctcacaacatcctccccgcccccttctcaacaacaggtcgcgaaacagacaagacaacgagaatgaagaaagataatatagagcaacccagcaagacagacaagaagacgaagagacaaaacaacgaaaacacgtaggcaggacaaaacgagaacgccgacagaacgatataggagcagaagagaaaaaagcagacagaacgaaccaaaacaaaagaaggcaacagacgcaacag

SEQ ID NO: 278402 - DNA, 2615 bp, Homo sapiens
  misc_feature (69)..(69): n is a, c, g, or t
cgtagtggtggctgagatatgttgcttgccacaacaatgtaatctggtatacgacagactgcttcaatntagttatggcacccagagagcagctcatcatactggctagtggtggaccccaagctttagtaaatataatgaggacctatacttacgaaaaactactgtggaccacaagcagagtgctgaaggtgctatctgtctgctctagtaataagccggctattgtagaagctggtggaatgcaagctttaggacttcacctgacagatccaagtcaacgtcttgttcagaactgtctttggactctcaggaatctttcagatgctgcaactaaacaggaagggatggaaggtctccttgggactcttgttcagcttctgggttcagatgatataaatgtggtcacctgtgcagctggaattctttctaacctcacttgcaataattataagaacaagatgatggtctgccaagtgggtggtatagaggctcttgtgcgtactgtccttcgggctggtgacagggaagacatcactgagcctgccatctgtgctcttcgtcatctgaccagccgacaccaagaagcagagatggcccagaatgcagttcgccttcactatggactaccagttgtggttaagctcttacacccaccatcccactggcctctgataaaggctactgttggattgattcgaaatcttgccctttgtcccgcaaatcatgcacctttgcgtgagcagggtgccattccacgactagttcagttgcttgttcgtgcacatcaggatacccagcgccgtacgtccatgggtgggacacagcagcaatttgtggagggggtccgcatggaagaaatagttgaaggttgtaccggagcccttcacatcctagctcgggatgttcacaaccgaattgttatcagaggactaaataccattccattgtttgtgcagctgctttattctcccattgaaaacatccaaagagtagctgcaggggtcctctgtgaacttgctcaggacaaggaagctgcagaagctattgaagctgagggagccacagctcctctgacagagttacttcactctaggaatgaaggtgtggcgacatatgcagctgctgttttgttccgaatgtctgaggacaagccacaagattacaagaaacggctttcagttgagctgaccagctctctcttcagaacagagccaatggcttggaatgagactgctgatcttggacttgatattggtgcccagggagaaccccttggatatcgccaggatgatcctagctatcgttcttttcactctggtggatatggccaggatgccttgggtatggaccccatgatggaacatgagatgggtggccaccaccctggtgctgactatccagttgatgggctgccagatctggggcatgcccaggacctcatggatgggctgcctccaggtgacagcaatcagctggcctggtttgatactgacctgtaaatcatcctttaggtaagaagttttaaaaagccagtttgggtaaaatacttttactctgcctacagaacttcagaaagacttggttggtagggtgggagtggtttaggctatttgtaaatctgccacaaaaacaggtatatactttgaaaggagatgtcttggaacattggaatgttctcagatttctggttgttatgtgatcatgtgtggaagttattaactttaatgttttttgccacagcttttgcaacttaatactcaaatgagtaacatttgctgttttaaacattaatagcagcctttctctctttatacagctgtattgtctgaacttgcattgtgattggcctgtagagttgctgagagggctcgaggggtgggctggtatctcagaaagtgcctgacacactaaccaagctgagtttcctatgggaacaattgaagtaaactttttgttctggtcctttttggtcgaggagtaacaatacaaatggattttgggagtgactcaagaagtgaagaatgcacaagaatggatcacaagatggaatttagcaaaccctagccttgcttgttaaattttttttttttttttttaagaatatctgtaatggtactgactttgcttgctttgaagtagctcttttttttttttttttttttttttttttttttgcagtaactgttttttaagtctctcgtagtgttaagttatagtgaatactgctacagcaatttctaatttttaagaattgagtaatggtgtagaacactaattaattcataatcactctaattaattgtaatctgaataaagtgtaacaattgtgtagcctttttgtataaaatagacaaatagaaaatggtccaattagtttcctttttaatatgcttaaaataagcaggtggatctatttcatgtttttgatcaaaaactatttgggatatgtatgggtagggtaaatcagtaagaggtgttatttggaaccttgttttggacagtttaccagttgccttttatcccaaagttgttgtaacctgctgtgatacgatgcttcaagagaaaatgcggttataaaaaatggttcagaattaaacttttaattcattcga

SEQ ID NO: 278403 - DNA, 3312 bp, Homo sapiens
atagctgattgatgagttgacatgccatggatccagacagaaaagcggctgttagtcactggcagcaacagtcttacctggactctggaatccattctggtgccactaccacagctccttctctgagtggtaaaggcaatcctgaggaagaggatgtggatacctcccaagtcctgtatgagtgggaacagggattttctcagtccttcactcaagaacaagtagctgatattgatggacagtatgcaatgactcgagctcagagggtacgagctgctatgttccctgagacattagatgagggcatgcagatcccatctacacagtttgatgctgctcatcccactaatgtccagcgtttggctgaaccatcacagatgctgaaacatgcagttgtaaacttgattaactatcaagatgatgcagaacttgccacacgtgcaatccctgaactgacaaaactgctaaatgacgaggaccaggtggtggttaataaggctgcagttatggtccatcagctttctaaaaaggaagcttccagacacgctatcatgcgttctcctcagatggtgtctgctattgtacgtaccatgcagaatacaaatgatgtagaaacagctcgttgtaccgctgggaccttgcataacctttcccatcatcgtgagggcttactggccatctttaagtctggaggcattcctgccctggtgaaaatgcttggttcaccagtggattctgtgttgttttatgccattacaactctccacaaccttttattacatcaagaaggagctaaaatggcagtgcgtttagctggtgggctgcagaaaatggttgccttgctcaacaaaacaaatgttaaattcttggctattacgacagactgccttcaaattttagcttatggcaaccaagaaagcaagctcatcatactggctagtggtggaccccaagctttagtaaatataatgaggacctatacttacgaaaaactactgtggaccacaagcagagtgctgaaggtgctatctgtctgctctagtaataagccggctattgtagaagctggtggaatgcaagctttaggacttcacctgacagatccaagtcaacgtcttgttcagaactgtctttggactctcaggaatctttcagatgctgcaactaaacaggaagggatggaaggtctccttgggactcttgttcagcttctgggttcagatgatataaatgtggtcacctgtgcagctggaattctttctaacctcacttgcaataattataagaacaagatgatggtctgccaagtgggtggtatagaggctcttgtgcgtactgtccttcgggctggtgacagggaagacatcactgagcctgccatctgtgctcttcgtcatctgaccagccgacaccaagaagcagagatggcccagaatgcagttcgccttcactatggactaccagttgtggttaagctcttacacccaccatcccactggcctctgataaaggctactgttggattgattcgaaatcttgccctttgtcccgcaaatcatgcacctttgcgtgagcagggtgccattccacgactagttcagttgcttgttcgtgcacatcaggatacccagcgccgtacgtccatgggtgggacacagcagcaatttgtggagggggtccgcatggaagaaatagttgaaggttgtaccggagcccttcacatcctagctcgggatgttcacaaccgaattgttatcagaggactaaataccattccattgtttgtgcagctgctttattctcccattgaaaacatccaaagagtagctgcaggggtcctctgtgaacttgctcaggacaaggaagctgcagaagctattgaagctgagggagccacagctcctctgacagagttacttcactctaggaatgaaggtgtggcgacatatgcagctgctgttttgttccgaatgtctgaggacaagccacaagattacaagaaacggctttcagttgagctgaccagctctctcttcagaacagagccaatggcttggaatgagactgctgatcttggacttgatattggtgcccagggagaaccccttggatatcgccaggatgatcctagctatcgttcttttcactctggtggatatggccaggatgccttgggtatggaccccatgatggaacatgagatgggtggccaccaccctggtgctgactatccagttgatgggctgccagatctggggcatgcccaggacctcatggatgggctgcctccaggtgacagcaatcagctggcctggtttgatactgacctgtaaatcatcctttaggtaagaagttttaaaaagccagtttgggtaaaatacttttactctgcctacagaacttcagaaagacttggttggtagggtgggagtggtttaggctatttgtaaatctgccacaaaaacaggtatatactttgaaaggagatgtcttggaacattggaatgttctcagatttctggttgttatgtgatcatgtgtggaagttattaactttaatgttttttgccacagcttttgcaacttaatactcaaatgagtaacatttgctgttttaaacattaatagcagcctttctctctttatacagctgtattgtctgaacttgcattgtgattggcctgtagagttgctgagagggctcgaggggtgggctggtatctcagaaagtgcctgacacactaaccaagctgagtttcctatgggaacaattgaagtaaactttttgttctggtcctttttggtcgaggagtaacaatacaaatggattttgggagtgactcaagaagtgaagaatgcacaagaatggatcacaagatggaatttagcaaaccctagccttgcttgttaaattttttttttttttttttaagaatatctgtaatggtactgactttgcttgctttgaagtagctcttttttttttttttttttttttttttttttttgcagtaactgttttttaagtctctcgtagtgttaagttatagtgaatactgctacagcaatttctaatttttaagaattgagtaatggtgtagaacactaattaattcataatcactctaattaattgtaatctgaataaagtgtaacaattgtgtagcctttttgtataaaatagacaaatagaaaatggtccaattagtttcctttttaatatgcttaaaataagcaggtggatctatttcatgtttttgatcaaaaactatttgggatatgtatggcccaggggatactctagaagttgac

SEQ ID NO: 278404 - DNA, 3077 bp, Homo sapiens
atagctgattgatgagttgacatgccatggatccagacagaaaagcggctgttagtcactggcagcaacagtcttacctggactctggaatccattctggtgccactaccacagctccttctctgagtggtaaaggcaatcctgaggaagaggatgtggatacctcccaagtcctgtatgagtgggaacagggattttctcagtccttcactcaagaacaagtagctgatattgatggacagtatgcaatgactcgagctcagagggtacgagctgctatgttccctgagacattagatgagggcatgcagatcccatctacacagtttgatgctgctcatcccactaatgtccagcgtttggctgaaccatcacagatgctgaaacatgcagttgtaaacttgattaactatcaagatgatgcagaacttgccacacgtgcaatccctgaactgacaaaactgctaaatgacgaggaccaggtggtggttaataaggctgcagttatggtccatcagctttctaaaaaggaagcttccagacacgctatcatgcgttctcctcagatggtgtctgctattgtacgtaccatgcagaatacaaatgatgtagaaacagctcgttgtaccgctgggaccttgcataacctttcccatcatcgtgagggcttactggccatctttaagtctggaggcattcctgccctggtgaaaatgcttggttcaccagtggattctgtgttgttttatgccattacaactctccacaaccttttattacatcaagaaggagctaaaatggcagtgcgtttagctggtgggctgcagaaaatggttgccttgctcaacaaaacaaatgttaaattcttggctattacgacagactgccttcaaattttagcttatggcaaccaagaaagcaagctcatcatactggctagtggtggaccccaagctttagtaaatataatgaggacctatacttacgaaaaactactgtggaccacaagcagagtgctgaaggtgctatctgtctgctctagtaataagccggctattgtagaagctggtggaatgcaagctttaggacttcacctgacagatccaagtcaacgtcttgttcagaactgtctttggactctcaggaatctttcagatgctgcaactaaacaggaagggatggaaggtctccttgggactcttgttcagcttctgggttcagatgatataaatgtggtcacctgtgcagctggaattctttctaacctcacttgcaataattataagaacaagatgatggtctgccaagtgggtggtatagaggctcttgtgcgtactgtccttcgggctggtgacagggaagacatcactgagcctgccatctgtgctcttcgtcatctgaccagccgacaccaagaagcagagatggcccagaatgcagttcgccttcactatggactaccagttgtggttaagctcttacacccaccatcccactggcctctgataaaggctactgttggattgattcgaaatcttgccctttgtcccgcaaatcatgcacctttgcgtgagcagggtgccattccacgactagttcagttgcttgttcgtgcacatcaggatacccagcgccgtacgtccatgggtgggacacagcagcaatttgtggagggggtccgcatggaagaaatagttgaaggttgtaccggagcccttcacatcctagctcgggatgttcacaaccgaattgttatcagaggactaaataccattccattgtttgtgcagctgctttattctcccattgaaaacatccaaagagtagctgcaggggtcctctgtgaacttgctcaggacaaggaagctgcagaagctattgaagctgagggagccacagctcctctgacagagttacttcactctaggaatgaaggtgtggcgacatatgcagctgctgttttgttccgaatgtctgaggacaagccacaagattacaagaaacggctttcagttgagctgaccagctctctcttcagaacagagccaatggcttggaatgagactgctgatcttggacttgatattggtgcccagggagaaccccttggatatcgccaggatgatcctagctatcgttcttttcactctggtggatatggccaggatgccttgggtatggaccccatgatggaacatgagatgggtggccaccaccctggtgctgactatccagttgatgggctgccagatctggggcatgcccaggacctcatggatgggctgcctccaggtgacagcaatcagctggcctggtttgatactgacctgtaaatcatcctttaggtaagaagttttaaaaagccagtttgggtaaaatacttttactctgcctacagaacttcagaaagacttggttggtagggtgggagtggtttaggctatttgtaaatctgccacaaaaacaggtatatactttgaaaggagatgtcttggaacattggaatgttctcagatttctggttgttatgtgatcatgtgtggaagttattaactttaatgttttttgccacagcttttgcaacttaatactcaaatgagtaacatttgctgttttaaacattaatagcagcctttctctctttatacagctgtattgtctgaacttgcattgtgattggcctgtagagttgctgagagggctcgaggggtgggctggtatctcagaaagtgcctgacacactaaccaagctgagtttcctatgggaacaattgaagtaaactttttgttctggtcctttttggtcgaggagtaacaatacaaatggattttgggagtgactcaagaagtgaagaatgcacaagaatggatcacaagatggaatttagcaaaccctagccttgcttgttaaattttttttttttttttttaagaatatctgtaatggtactgactttgcttgctttgaagtagctcttttttttttttttttttttttgggggttcctctagagttcaccctgtgcaggctttcacgctttggcatgtgcccgctcgtttttacaccgttcgttgac

SEQ ID NO: 278405 - DNA, 2153 bp, Homo sapiens
taagtgaagtgttctaggttttatgtccataaaatttccagattgtaatgactaataacatttcagaaaattagggaccataatagggttaccaacatttaattttatgaaaattccctacattttttggtcagtaagagaaacattgagacttgagaagagggaggagatttcacatttcacttttatgggtgcctagaggggagagctgacctgggctgccagaggcagggcatagacccccaaccaattctgggttttccaaatcttagatcagttagagctgcctctgaagaaagggtttatagctaaaaaatattatggaaatccagtgctccagagcattaaacaccccaagacataaaattcagagaatattatttactacagtgtgaatgcctcttgcactctgaattgggaatgtttgcaccacagtggggggcttgccatgttttagctttagatttaattaggttttgtttgtgttttctccttagctgctttattctcccattgaaaacatccaaagagtagctgcaggggtcctctgtgaacttgctcaggacaaggaagctgcagaagctattgaagctgagggagccacagctcctctgacagagttacttcactctaggaatgaaggtgtggcgacatatgcagctgctgttttgttccgaatgtctgaggacaagccacaagattacaagaaacggctttcagttgagctgaccagctctctcttcagaacagagccaatggcttggaatgagactgctgatcttggacttgatattggtgcccagggagaaccccttggatatcgccaggatgatcctagctatcgttcttttcactctggtggatatggccaggatgccttgggtatggaccccatgatggaacatgagatgggtggccaccaccctggtgctgactatccagttgatgggctgccagatctggggcatgcccaggacctcatggatgggctgcctccaggtgacagcaatcagctggcctggtttgatactgacctgtaaatcatcctttaggtaagaagttttaaaaagccagtttgggtaaaatacttttactctgcctacagaacttcagaaagacttggttggtagggtgggagtggtttaggctatttgtaaatctgccacaaaaacaggtatatactttgaaaggagatgtcttggaacattggaatgttctcagatttctggttgttatgtgatcatgtgtggaagttattaactttaatgttttttgccacagcttttgcaacttaatactcaaatgagtaacatttgctgttttaaacattaatagcagcctttctctctttatacagctgtattgtctgaacttgcattgtgattggcctgtagagttgctgagagggctcgaggggtgggctggtatctcagaaagtgcctgacacactaaccaagctgagtttcctatgggaacaattgaagtaaactttttgttctggtcctttttggtcgaggagtaacaatacaaatggattttgggagtgactcaagaagtgaagaatgcacaagaatggatcacaagatggaatttagcaaaccctagccttgcttgttaaattttttttttttttttttaagaatatctgtaatggtactgactttgcttgctttgaagtagctcttttttttttttttttttttttttttttttttgcagtaactgttttttaagtctctcgtagtgttaagttatagtgaatactgctacagcaatttctaatttttaagaattgagtaatggtgtagaacactaattaattcataatcactctaattaattgtaatctgaataaagtgtaacaattgtgtagcctttttgtataaaatagacaaatagaaaatggtccaattagtttcctttttaatatgcttaaaataagcaggtggatctatttcatgtttttgatcaaaaactatttgggatatgtatgggtagggtaaatcagtaagaggtgttatttggaaccttgttttggacagtttaccagttgccttttatcccaaagttgttgtaacctgctgtgatacgatgcttcaagagaaaatgcggttataaaaaatggttcagaattaaacttttaattcattcga

SEQ ID NO: 278406 - DNA, 1612 bp, Homo sapiens
ttacgaggatccccggaacagggacaaggaagctgcagaagctattgaagctgagggagccacagctcctctgacagagttacttcactctaggaatgaaggtgtggcgacatatgcagctgctgttttgttccgaatgtctgaggacaagccacaagattacaagaaacggctttcagttgagctgaccagctctctcttcagaacagagccaatggcttggaatgagactgctgatcttggacttgatattggtgcccagggagaaccccttggatatcgccaggatgatcctagctatcgttcttttcactctggtggatatggccaggatgccttgggtatggaccccatgatggaacatgagatgggtggccaccaccctggtgctgactatccagttgatgggctgccagatctggggcatgcccaggacctcatggatgggctgcctccaggtgacagcaatcagctggcctggtttgatactgacctgtaaatcatcctttaggtaagaagttttaaaaagccagtttgggtaaaatacttttactctgcctacagaacttcagaaagacttggttggtagggtgggagtggtttaggctatttgtaaatctgccacaaaaacaggtatatactttgaaaggagatgtcttggaacattggaatgttctcagatttctggttgttatgtgatcatgtgtggaagttattaactttaatgttttttgccacagcttttgcaacttaatactcaaatgagtaacatttgctgttttaaacattaatagcagcctttctctctttatacagctgtattgtctgaacttgcattgtgattggcctgtagagttgctgagagggctcgaggggtgggctggtatctcagaaagtgcctgacacactaaccaagctgagtttcctatgggaacaattgaagtaaactttttgttctggtcctttttggtcgaggagtaacaatacaaatggattttgggagtgactcaagaagtgaagaatgcacaagaatggatcacaagatggaatttagcaaaccctagccttgcttgttaaattttttttttttttttttaagaatatctgtaatggtactgactttgcttgctttgaagtagctcttttttttttttttttttttttttttttttttgcagtaactgttttttaagtctctcgtagtgttaagttatagtgaatactgctacagcaatttctaatttttaagaattgagtaatggtgtagaacactaattaattcataatcactctaattaattgtaatctgaataaagtgtaacaattgtgtagcctttttgtataaaatagacaaatagaaaatggtccaattagtttcctttttaatatgcttaaaataagcaggtggatctatttcatgtttttgatcaaaaactatttgggatatgtatgggtagggtaaatcagtaagaggtgttatttggaaccttgttttggacagtttaccagttgccttttatcccaaagttgttgtaacctgctgtgatacgatgcttcaagagaaaatgcggttataaaaaatggttcagaattaaacttttaattcattcga

SEQ ID NO: 278407 - DNA, 2636 bp, Homo sapiens
atagctgattgatgagttgacatgccatggatccagacagaaaagcggctgttagtcactggcagcaacagtcttacctggactctggaatccattctggtgccactaccacagctccttctctgagtggtaaaggcaatcctgaggaagaggatgtggatacctcccaagtcctgtatgagtgggaacagggattttctcagtccttcactcaagaacaagtagctgatattgatggacagtatgcaatgactcgagctcagagggtacgagctgctatgttccctgagacattagatgagggcatgcagatcccatctacacagtttgatgctgctcatcccactaatgtccagcgtttggctgaaccatcacagatgctgaaacatgcagttgtaaacttgattaactatcaagatgatgcagaacttgccacacgtgcaatccctgaactgacaaaactgctaaatgacgaggaccaggtggtggttaataaggctgcagttatggtccatcagctttctaaaaaggaagcttccagacacgctatcatgcgttctcctcagatggtgtctgctattgtacgtaccatgcagaatacaaatgatgtagaaacagctcgttgtaccgctgggaccttgcataacctttcccatcatcgtgagggcttactggccatctttaagtctggaggcattcctgccctggtgaaaatgcttggttcaccagtggattctgtgttgttttatgccattacaactctccacaaccttttattacatcaagaaggagctaaaatggcagtgcgtttagctggtgggctgcagaaaatggttgccttgctcaacaaaacaaatgttaaattcttggctattacgacagactgccttcaaattttagcttatggcaaccaagaaagcaagctcatcatactggctagtggtggaccccaagctttagtaaatataatgaggacctatacttacgaaaaactactgtggaccacaagcagagtgctgaaggtgctatctgtctgctctagtaataagccggctattgtagaagctggtggaatgcaagctttaggacttcacctgacagatccaagtcaacgtcttgttcagaactgtctttggactctcaggaatctttcagatgctgcaactaaacaggaagggatggaaggtctccttgggactcttgttcagcttctgggttcagatgatataaatgtggtcacctgtgcagctggaattctttctaacctcacttgcaataattataagaacaagatgatggtctgccaagtgggtggtatagaggctcttgtgcgtactgtccttcgggctggtgacagggaagacatcactgagcctgccatctgtgctcttcgtcatctgaccagccgacaccaagaagcagagatggcccagaatgcagttcgccttcactatggactaccagttgtggttaagctcttacacccaccatcccactggcctctgataaaggctactgttggattgattcgaaatcttgccctttgtcccgcaaatcatgcacctttgcgtgagcagggtgccattccacgactagttcagttgcttgttcgtgcacatcaggatacccagcgccgtacgtccatgggtgggacacagcagcaatttgtggagggggtccgcatggaagaaatagttgaaggttgtaccggagcccttcacatcctagctcgggatgttcacaaccgaattgttatcagaggactaaataccattccattgtttgtgcagctgctttattctcccattgaaaacatccaaagagtagctgcaggggtcctctgtgaacttgctcaggacaaggaagctgcagaagctattgaagctgagggagccacagctcctctgacagagttacttcactctaggaatgaaggtgtggcgacatatgcagctgctgttttgttccgaatgtctgaggacaagccacaagattacaagaaacggctttcagttgagctgaccagctctctcttcagaacagagccaatggcttggaatgagactgctgatcttggacttgatattggtgcccagggagaaccccttggatatcgccaggatgatcctagctatcgttcttttcactctggtggatatggccaggatgccttgggtatggaccccatgatggaacatgagatgggtggccaccaccctggtgctgactatccagttgatgggctgccagatctggggcatgcccaggacctcatggatgggctgcctccaggtgacagcaatcagctggcctggtttgatactgacctgtaaatcatcctttaggagtaacaatacaaatggattttgggagtgactcaagaagtgaagaatgcacaagaatggatcacaagatggaatttagcaaaccctagccttgcttgttaaattttttttttttttttttaagaatatctgtaatggtactgactttgcttgctttgaagtagctcttttttttttttttttttttttaaaaatggtctcgtgtcgcccaggtgtagacgcaaaaccaaacttctttgtgttctcactcataagggggagctaagctatgaggatccgtgtacaatttga

SEQ ID NO: 278408 - DNA, 2241 bp, Homo sapiens
taagtgaagtgttctaggttttatgtccataaaatttccagattgtaatgactaataacatttcagaaaattagggaccataatagggttaccaacatttaattttatgaaaattccctacattttttggtcagtaagagaaacattgagacttgagaagagggaggagatttcacatttcacttttatgggtgcctagaggggagagctgacctgggctgccagaggcagggcatagacccccaaccaattctgggttttccaaatcttagatcagttagagctgcctctgaagaaagggtttatagctaaaaaatattatggaaatccagtgctccagagcattaaacaccccaagacataaaattcagagaatattatttactacagtgtgaatgcctcttgcactctgaattgggaatgtttgcaccacagtggggggcttgccatgttttagctttagatttaattaggttttgtttgtgttttctccttagctgctttattctcccattgaaaacatccaaagagtagctgcaggggtcctctgtgaacttgctcaggacaaggaagctgcagaagctattgaagctgagggagccacagctcctctgacagagttacttcactctaggaatgaaggtgtgggtaagtaaaaaggaaccaaagcctttagcagatgtgtacattgaagtctcagtttttcctcaagggcctttttctccttgtctcttagcgacatatgcagctgctgttttgttccgaatgtctgaggacaagccacaagattacaagaaacggctttcagttgagctgaccagctctctcttcagaacagagccaatggcttggaatgagactgctgatcttggacttgatattggtgcccagggagaaccccttggatatcgccaggatgatcctagctatcgttcttttcactctggtggatatggccaggatgccttgggtatggaccccatgatggaacatgagatgggtggccaccaccctggtgctgactatccagttgatgggctgccagatctggggcatgcccaggacctcatggatgggctgcctccaggtgacagcaatcagctggcctggtttgatactgacctgtaaatcatcctttaggtaagaagttttaaaaagccagtttgggtaaaatacttttactctgcctacagaacttcagaaagacttggttggtagggtgggagtggtttaggctatttgtaaatctgccacaaaaacaggtatatactttgaaaggagatgtcttggaacattggaatgttctcagatttctggttgttatgtgatcatgtgtggaagttattaactttaatgttttttgccacagcttttgcaacttaatactcaaatgagtaacatttgctgttttaaacattaatagcagcctttctctctttatacagctgtattgtctgaacttgcattgtgattggcctgtagagttgctgagagggctcgaggggtgggctggtatctcagaaagtgcctgacacactaaccaagctgagtttcctatgggaacaattgaagtaaactttttgttctggtcctttttggtcgaggagtaacaatacaaatggattttgggagtgactcaagaagtgaagaatgcacaagaatggatcacaagatggaatttagcaaaccctagccttgcttgttaaattttttttttttttttttaagaatatctgtaatggtactgactttgcttgctttgaagtagctcttttttttttttttttttttttttttttttttgcagtaactgttttttaagtctctcgtagtgttaagttatagtgaatactgctacagcaatttctaatttttaagaattgagtaatggtgtagaacactaattaattcataatcactctaattaattgtaatctgaataaagtgtaacaattgtgtagcctttttgtataaaatagacaaatagaaaatggtccaattagtttcctttttaatatgcttaaaataagcaggtggatctatttcatgtttttgatcaaaaactatttgggatatgtatgggtagggtaaatcagtaagaggtgttatttggaaccttgttttggacagtttaccagttgccttttatcccaaagttgttgtaacctgctgtgatacgatgcttcaagagaaaatgcggttataaaaaatggttcagaattaaacttttaattcattcga

SEQ ID NO: 278409 - DNA, 1624 bp, Homo sapiens
cccatggagtatgggaaggcaggagctgccctcctgctggagggattctctttgacttggagcagatgtgtcaggcgaggactgtcttgctgtttggtgactcaagcctagaaagctagacaggaaatcagctgagaccatttgacagggatggggatcctgagtaagattcaaagacagattaatcatttgtccttgtcaagttgatgtggggtcagtgagaaatcttggaagggacctgttctcctgccagagcagctgtgaggttatggaggaagaaccccttggatatcgccaggatgatcctagctatcgttcttttcactctggtggatatggccaggatgccttgggtatggaccccatgatggaacatgagatgggtggccaccaccctggtgctgactatccagttgatgggctgccagatctggggcatgcccaggacctcatggatgggctgcctccaggtgacagcaatcagctggcctggtttgatactgacctgtaaatcatcctttaggtaagaagttttaaaaagccagtttgggtaaaatacttttactctgcctacagaacttcagaaagacttggttggtagggtgggagtggtttaggctatttgtaaatctgccacaaaaacaggtatatactttgaaaggagatgtcttggaacattggaatgttctcagatttctggttgttatgtgatcatgtgtggaagttattaactttaatgttttttgccacagcttttgcaacttaatactcaaatgagtaacatttgctgttttaaacattaatagcagcctttctctctttatacagctgtattgtctgaacttgcattgtgattggcctgtagagttgctgagagggctcgaggggtgggctggtatctcagaaagtgcctgacacactaaccaagctgagtttcctatgggaacaattgaagtaaactttttgttctggtcctttttggtcgaggagtaacaatacaaatggattttgggagtgactcaagaagtgaagaatgcacaagaatggatcacaagatggaatttagcaaaccctagccttgcttgttaaattttttttttttttttttaagaatatctgtaatggtactgactttgcttgctttgaagtagctcttttttttttttttttttttttttttttttttgcagtaactgttttttaagtctctcgtagtgttaagttatagtgaatactgctacagcaatttctaatttttaagaattgagtaatggtgtagaacactaattaattcataatcactctaattaattgtaatctgaataaagtgtaacaattgtgtagcctttttgtataaaatagacaaatagaaaatggtccaattagtttcctttttaatatgcttaaaataagcaggtggatctatttcatgtttttgatcaaaaactatttgggatatgtatgggtagggtaaatcagtaagaggtgttatttggaaccttgttttggacagtttaccagttgccttttatcccaaagttgttgtaacctgctgtgatacgatgcttcaagagaaaatgcggttataaaaaatggttcagaattaaacttttaattcattcga

SEQ ID NO: 278410 - DNA, 1196 bp, Homo sapiens
  misc_feature (1)..(1): n is a, c, g, or t
naccctccgctcttcacccactcatggatgggctgcctccaggtgacagcaatcagctggcctggtttgatactgacctgtaaatcatcctttaggtaagaagttttaaaaagccagtttgggtaaaatacttttactctgcctacagaacttcagaaagacttggttggtagggtgggagtggtttaggctatttgtaaatctgccacaaaaacaggtatatactttgaaaggagatgtcttggaacattggaatgttctcagatttctggttgttatgtgatcatgtgtggaagttattaactttaatgttttttgccacagcttttgcaacttaatactcaaatgagtaacatttgctgttttaaacattaatagcagcctttctctctttatacagctgtattgtctgaacttgcattgtgattggcctgtagagttgctgagagggctcgaggggtgggctggtatctcagaaagtgcctgacacactaaccaagctgagtttcctatgggaacaattgaagtaaactttttgttctggtcctttttggtcgaggagtaacaatacaaatggattttgggagtgactcaagaagtgaagaatgcacaagaatggatcacaagatggaatttagcaaaccctagccttgcttgttaaattttttttttttttttttaagaatatctgtaatggtactgactttgcttgctttgaagtagctcttttttttttttttttttttttttttttttttgcagtaactgttttttaagtctctcgtagtgttaagttatagtgaatactgctacagcaatttctaatttttaagaattgagtaatggtgtagaacactaattaattcataatcactctaattaattgtaatctgaataaagtgtaacaattgtgtagcctttttgtataaaatagacaaatagaaaatggtccaattagtttcctttttaatatgcttaaaataagcaggtggatctatttcatgtttttgatcaaaaactatttgggatatgtatgggtagggtaaatcagtaagaggtgttatttggaaccttgttttggacagtttaccagttgccttttatcccaaagttgttgtaacctgctgtgatacgatgcttcaagagaaaatgcggttataaaaaatggttcagaattaaacttttaattcattcga

SEQ ID NO: 278411 - DNA, 3253 bp, Homo sapiens
atagctgattgatgagttgacatgccatggatccagacagaaaagcggctgttagtcactggcagcaacagtcttacctggactctggaatccattctggtgccactaccacagctccttctctgagtggtaaaggcaatcctgaggaagaggatgtggatacctcccaagtcctgtatgagtgggaacagggattttctcagtccttcactcaagaacaagtagctgatattgatggacagtatgcaatgactcgagctcagagggtacgagctgctatgttccctgagacattagatgagggcatgcagatcccatctacacagtttgatgctgctcatcccactaatgtccagcgtttggctgaaccatcacagatgctgaaacatgcagttgtaaacttgattaactatcaagatgatgcagaacttgccacacgtgcaatccctgaactgacaaaactgctaaatgacgaggaccaggtggtggttaataaggctgcagttatggtccatcagctttctaaaaaggaagcttccagacacgctatcatgcgttctcctcagatggtgtctgctattgtacgtaccatgcagaatacaaatgatgtagaaacagctcgttgtaccgctgggaccttgcataacctttcccatcatcgtgagggcttactggccatctttaagtctggaggcattcctgccctggtgaaaatgcttggttcaccagtggattctgtgttgttttatgccattacaactctccacaaccttttattacatcaagaaggagctaaaatggcagtgcgtttagctggtgggctgcagaaaatggttgccttgctcaacaaaacaaatgttaaattcttggctattacgacagactgccttcaaattttagcttatggcaaccaagaaagcaagctcatcatactggctagtggtggaccccaagctttagtaaatataatgaggacctatacttacgaaaaactactgtggaccacaagcagagtgctgaaggtgctatctgtctgctctagtaataagccggctattgtagaagctggtggaatgcaagctttaggacttcacctgacagatccaagtcaacgtcttgttcagaactgtctttggactctcaggaatctttcagatgctgcaactaaacaggaagggatggaaggtctccttgggactcttgttcagcttctgggttcagatgatataaatgtggtcacctgtgcagctggaattctttctaacctcacttgcaataattataagaacaagatgatggtctgccaagtgggtggtatagaggctcttgtgcgtactgtccttcgggctggtgacagggaagacatcactgagcctgccatctgtgctcttcgtcatctgaccagccgacaccaagaagcagagatggcccagaatgcagttcgccttcactatggactaccagttgtggttaagctcttacacccaccatcccactggcctctgataaaggctactgttggattgattcgaaatcttgccctttgtcccgcaaatcatgcacctttgcgtgagcagggtgccattccacgactagttcagttgcttgttcgtgcacatcaggatacccagcgccgtacgtccatgggtgggacacagcagcaatttgtggagggggtccgcatggaagaaatagttgaaggttgtaccggagcccttcacatcctagctcgggatgttcacaaccgaattgttatcagaggactaaataccattccattgtttgtgcagctgctttattctcccattgaaaacatccaaagagtagctgcaggggtcctctgtgaacttgctcaggacaaggaagctgcagaagctattgaagctgagggagccacagctcctctgacagagttacttcactctaggaatgaaggtgtggcgacatatgcagctgctgttttgttccgaatgtctgaggacaagccacaagattacaagaaacggctttcagttgagctgaccagctctctcttcagaacagagccaatggcttggaatgaggtagggaaatgtgagcagttatttatctggtagtttcctagagcaggtatggcagcttgttctttcctctcaaaacacttagtacacattcatttgcattgatgtttccctggcttgagtatttcttctttatgctgtctagcaactgctctgaggaagaactataatacaagctttaaagagtctgttcagaatcattacaaataagttgtgttatttaaaattataattcataagggagaaagatgaaaaatgttaccagattaaagaagatttttcaaaaggatgtaaggaaagaggcagtgttaaacactgttaagaggacagtttatcagtattttttactaaactttaataaaacttttctatttgaatttctgctatgaatttttcttcagcatttgtcctcagtacaggtggttccttgaaacattgtttctaataaaactagaacatcctgatattttatccattctatagagatcattgatggtacacagacatacagtggattatgtttgttgagtgaatggaaagagagattgttaggtttacaacgatgcagctcttgagaccggagtttaagatcagcctgggcaacatagtgaaaccccatctttagctgggcatggagatggatgcctatagtcctagctactggggagacgggggcaggaggattgcttgaacccaggagttaacagactgcactcagtgacagagccagactccaacacaaaaaaaaaaaaaaaaaaagcaaattaccagtgagtagtgtgttacttgggtttttaataggcatcttattaacatgttccaacttgagcccttaactttctccacctacccccttccacaaacctgttttcactgtcttctctgtcttagttaatgtcagctttgtctgtccagctgctcaggctaaaacttttctttcatataacacatcctatcagcagctcctgtttgtgggtaggcattttgcctttttttttttttttttttttaaactgctatatctctagcatgtagaacagtgcctggcagcacataataggtgcttaatataatatttgttgaaagaacaagtcagtgagtatttttaatgtgaggtgcaaagagaaaaaaaaaatgtatctttgaggtgtggagttttgaagaacttccattttctaagcatttgtgtaatg

SEQ ID NO: 278412 - DNA, 2345 bp, Homo sapiens
atagctgattgatgagttgacatgccatggatccagacagaaaagcggctgttagtcactggcagcaacagtcttacctggactctggaatccattctggtgccactaccacagctccttctctgagtggtaaaggcaatcctgaggaagaggatgtggatacctcccaagtcctgtatgagtgggaacagggattttctcagtccttcactcaagaacaagtagctgatattgatggacagtatgcaatgactcgagctcagagggtacgagctgctatgttccctgagacattagatgagggcatgcagatcccatctacacagtttgatgctgctcatcccactaatgtccagcgtttggctgaaccatcacagatgctgaaacatgcagttgtaaacttgattaactatcaagatgatgcagaacttgccacacgtgcaatccctgaactgacaaaactgctaaatgacgaggaccaggtggtggttaataaggctgcagttatggtccatcagctttctaaaaaggaagcttccagacacgctatcatgcgttctcctcagatggtgtctgctattgtacgtaccatgcagaatacaaatgatgtagaaacagctcgttgtaccgctgggaccttgcataacctttcccatcatcgtgagggcttactggccatctttaagtctggaggcattcctgccctggtgaaaatgcttggttcaccagtggattctgtgttgttttatgccattacaactctccacaaccttttattacatcaagaaggagctaaaatggcagtgcgtttagctggtgggctgcagaaaatggttgccttgctcaacaaaacaaatgttaaattcttggctattacgacagactgccttcaaattttagcttatggcaaccaagaaagcaagctcatcatactggctagtggtggaccccaagctttagtaaatataatgaggacctatacttacgaaaaactactgtggaccacaagcagagtgctgaaggtgctatctgtctgctctagtaataagccggctattgtagaagctggtggaatgcaagctttaggacttcacctgacagatccaagtcaacgtcttgttcagaactgtctttggactctcaggaatctttcagatgctgcaactaaacaggaagggatggaaggtctccttgggactcttgttcagcttctgggttcagatgatataaatgtggtcacctgtgcagctggaattctttctaacctcacttgcaataattataagaacaagatgatggtctgccaagtgggtggtatagaggctcttgtgcgtactgtccttcgggctggtgacagggaagacatcactgagcctgccatctgtgctcttcgtcatctgaccagccgacaccaagaagcagagatggcccagaatgcagttcgccttcactatggactaccagttgtggttaagctcttacacccaccatcccactggcctctgataaaggctactgttggattgattcgaaatcttgccctttgtcccgcaaatcatgcacctttgcgtgagcagggtgccattccacgactagttcagttgcttgttcgtgcacatcaggatacccagcgccgtacgtccatgggtgggacacagcagcaatttgtggagggggtccgcatggaagaaatagttgaaggttgtaccggagcccttcacatcctagctcgggatgttcacaaccgaattgttatcagaggactaaataccattccattgtttgtgcagctgctttattctcccattgaaaacatccaaagagtagctgcaggggtcctctgtgaacttgctcaggacaaggaagctgcagaagctattgaagctgagggagccacagctcctctgacagagttacttcactctaggaatgaaggtgtggcgacatatgcagctgctgttttgttccgaatgtctgaggacaagccacaagattacaagaaacggctttcagttgagctgaccagctctctcttcagaacagagccaatggcttggaatgagactgctgatcttggacttgatattggtgcccagggagaaccccttggatatcgccaggatgatcctagctatcgttcttttcactctggtggatatggccaggatgccttgggtatggaccccatgatggaacatgagatgggtggccaccaccctggtgctgactatccagttgatgggctgccagatctggggcatgcccaggacctcatggatgggctgccttcaatagaagtcgggagtgctccaagctgatccgagctgttcctacccgtgtcagtt

SEQ ID NO: 278413 - DNA, 668 bp, Homo sapiens
tacatcgagctcggtcctggggaacctatcggagtaacaatacaaatggattttgggagtgactcaagaagtgaagaatgcacaagaatggatcacaagatggaatttagcaaaccctagccttgcttgttaaattttttttttttttttttaagaatatctgtaatggtactgactttgcttgctttgaagtagctcttttttttttttttttttttttttttttttttgcagtaactgttttttaagtctctcgtagtgttaagttatagtgaatactgctacagcaatttctaatttttaagaattgagtaatggtgtagaacactaattaattcataatcactctaattaattgtaatctgaataaagtgtaacaattgtgtagcctttttgtataaaatagacaaatagaaaatggtccaattagtttcctttttaatatgcttaaaataagcaggtggatctatttcatgtttttgatcaaaaactatttgggatatgtatgggtagggtaaatcagtaagaggtgttatttggaaccttgttttggacagtttaccagttgccttttatcccaaagttgttgtaacctgctgtgatacgatgcttcaagagaaaatgcggttataaaaaatggttcagaattaaacttttaattcattcga

SEQ ID NO: 278414 - DNA, 779 bp, Homo sapiens
tggctgtatctagagtaacctggtcatcctgctacaccgagggtgggctggtatctcagaaagtgcctgacacactaaccaagctgagtttcctatgggaacaattgaagtaaactttttgttctggtcctttttggtcgaggagtaacaatacaaatggattttgggagtgactcaagaagtgaagaatgcacaagaatggatcacaagatggaatttagcaaaccctagccttgcttgttaaattttttttttttttttttaagaatatctgtaatggtactgactttgcttgctttgaagtagctcttttttttttttttttttttttttttttttttgcagtaactgttttttaagtctctcgtagtgttaagttatagtgaatactgctacagcaatttctaatttttaagaattgagtaatggtgtagaacactaattaattcataatcactctaattaattgtaatctgaataaagtgtaacaattgtgtagcctttttgtataaaatagacaaatagaaaatggtccaattagtttcctttttaatatgcttaaaataagcaggtggatctatttcatgtttttgatcaaaaactatttgggatatgtatgggtagggtaaatcagtaagaggtgttatttggaaccttgttttggacagtttaccagttgccttttatcccaaagttgttgtaacctgctgtgatacgatgcttcaagagaaaatgcggttataaaaaatggttcagaattaaacttttaattcattcga

SEQ ID NO: 278415 - DNA, 1904 bp, Homo sapiens
atagctgattgatgagttgacatgccatggatccagacagaaaagcggctgttagtcactggcagcaacagtcttacctggactctggaatccattctggtgccactaccacagctccttctctgagtggtaaaggcaatcctgaggaagaggatgtggatacctcccaagtcctgtatgagtgggaacagggattttctcagtccttcactcaagaacaagtagctgatattgatggacagtatgcaatgactcgagctcagagggtacgagctgctatgttccctgagacattagatgagggcatgcagatcccatctacacagtttgatgctgctcatcccactaatgtccagcgtttggctgaaccatcacagatgctgaaacatgcagttgtaaacttgattaactatcaagatgatgcagaacttgccacacgtgcaatccctgaactgacaaaactgctaaatgacgaggaccaggtggtggttaataaggctgcagttatggtccatcagctttctaaaaaggaagcttccagacacgctatcatgcgttctcctcagatggtgtctgctattgtacgtaccatgcagaatacaaatgatgtagaaacagctcgttgtaccgctgggaccttgcataacctttcccatcatcgtgagggcttactggccatctttaagtctggaggcattcctgccctggtgaaaatgcttggttcaccagtggattctgtgttgttttatgccattacaactctccacaaccttttattacatcaagaaggagctaaaatggcagtgcgtttagctggtgggctgcagaaaatggttgccttgctcaacaaaacaaatgttaaattcttggctattacgacagactgccttcaaattttagcttatggcaaccaagaaagcaagctcatcatactggctagtggtggaccccaagctttagtaaatataatgaggacctatacttacgaaaaactactgtggaccacaagcagagtgctgaaggtgctatctgtctgctctagtaataagccggctattgtagaagctggtggaatgcaagctttaggacttcacctgacagatccaagtcaacgtcttgttcagaactgtctttggactctcaggaatctttcagatgctgcaactaaacaggaagggatggaaggtctccttgggactcttgttcagcttctgggttcagatgatataaatgtggtcacctgtgcagctggaattctttctaacctcacttgcaataattataagaacaagatgatggtctgccaagtgggtggtatagaggctcttgtgcgtactgtccttcgggctggtgacagggaagacatcactgagcctgccatctgtgctcttcgtcatctgaccagccgacaccaagaagcagagatggcccagaatgcagttcgccttcactatggactaccagttgtggttaagctcttacacccaccatcccactggcctctgataaaggctactgttggattgattcgaaatcttgccctttgtcccgcaaatcatgcacctttgcgtgagcagggtgccattccacgactagttcagttgcttgttcgtgcacatcaggatacccagcgccgtacgtccatgggtgggacacagcagcaatttgtggagggggtccgcatggaagaaatagttgaaggttgtaccggagcccttcacatcctagctcgggatgttcacaaccgaattgttatcagaggactaaataccattccattgtttgtgcagctgctttattctcccattgaaaacatccaaagagtagctgcaggggtcctctgtgaacttgctcacggaacccccagcttacacgcagctacccgatctaccgatccccgatta

SEQ ID NO: 278416 - DNA, 2747 bp, Homo sapiens
gagacaggctgttgttctgttgcacaggctggagtgcagtggtgcaatcatggctcattgtagcctcaacctcccagacattcacaacacttgagtacaccagaatagcaacaggtggcggccacaaaaattgttacactggtaaatacgtactatatttaattttacacagctatgatttaatactgtatctttacagctgtttacatttcttatgactgcaaatggtggaaccatgtggtttgagtgtgtatatgttttgataaattttaacttgttatcatagatttgtatatattttatggtagtaaatgatgaaatagactagtacctacatatattttatacattaatgacatacctttttcttaatttttttcactatttataggttatgcgatttttctgttttttcagtgttgcaaatctccaaacattttccgatatatttattttttaaaattcatgtataatgtcgccacccagttaaaacctatgttgttcaagggtcaactgtattattatagtcatcacgtttcacaattgatctttagaacttattctatccagctgaaactgtatcctctgaccaacaacctccaccccaccacacctaccccaccccctaatctacaatctagttctacgagatcaacttttttagattccacatataagtgagatcatgtggttatgtgcctttctgtgcctgccttattcacttagcctaatgtcctccaggttcatccacgttggcacaaacaagatttccttctttttgtggcagaataatattccattgtgtgtgtatatagatatatggagagactatgtatctatctatctatatatacatacactctagttgaagcaattctaaagttaagtcattgtccaaatatttatagacgtatttacaagttactatgccttactttacagcttttctaagtcatcaaacacacatttttatgaaactggaagaaactaataataataatttttaaaatagaaaatgatttcacaaactttacagaggagaatgccctgtttgttaaccatgtttcttttggcaggagggggtccgcatggaagaaatagttgaaggttgtaccggagcccttcacatcctagctcgggatgttcacaaccgaattgttatcagaggactaaataccattccattgtttgtgcagctgctttattctcccattgaaaacatccaaagagtagctgcaggggtcctctgtgaacttgctcaggacaaggaagctgcagaagctattgaagctgagggagccacagctcctctgacagagttacttcactctaggaatgaaggtgtgggtaagtaaaaaggaaccaaagcctttagcagatgtgtacattgaagtctcagtttttcctcaagggcctttttctccttgtctcttagcgacatatgcagctgctgttttgttccgaatgtctgaggacaagccacaagattacaagaaacggctttcagttgagctgaccagctctctcttcagaacagagccaatggcttggaatgaggtagggaaatgtgagcagttatttatctggtagtttcctagagcaggtatggcagcttgttctttcctctcaaaacacttagtacacattcatttgcattgatgtttccctggcttgagtatttcttctttatgctgtctagcaactgctctgaggaagaactataatacaagctttaaagagtctgttcagaatcattacaaataagttgtgttatttaaaattataattcataagggagaaagatgaaaaatgttaccagattaaagaagatttttcaaaaggatgtaaggaaagaggcagtgttaaacactgttaagaggacagtttatcagtattttttactaaactttaataaaacttttctatttgaatttctgctatgaatttttcttcagcatttgtcctcagtacaggtggttccttgaaacattgtttctaataaaactagaacatcctgatattttatccattctatagagatcattgatggtacacagacatacagtggattatgtttgttgagtgaatggaaagagagattgttaggtttacaacgatgcagctcttgagaccggagtttaagatcagcctgggcaacatagtgaaaccccatctttagctgggcatggagatggatgcctatagtcctagctactggggagacgggggcaggaggattgcttgaacccaggagttaacagactgcactcagtgacagagccagactccaacacaaaaaaaaaaaaaaaaaaagcaaattaccagtgagtagtgtgttacttgggtttttaataggcatcttattaacatgttccaacttgagcccttaactttctccacctacccccttccacaaacctgttttcactgtcttctctgtcttagttaatgtcagctttgtctgtccagctgctcaggctaaaacttttctttcatataacacatcctatcagcagctcctgtttgtgggtaggcattttgcctttttttttttttttttttttaaactgctatatctctagcatgtagaacagtgcctggcagcacataataggtgcttaatataatatttgttgaaagaacaagtcagtgagtatttttaatgtgaggtgcaaagagaaaaaaaaaatgtatctttgaggtgtggagttttgaagaacttccattttctaagcatttgtgtaatg

SEQ ID NO: 278417 - DNA, 1197 bp, Homo sapiens
  misc_feature (1179)..(1179): n is a, c, g, or t
atagctgattgatgagttgacatgccatggatccagacagaaaagcggctgttagtcactggcagcaacagtcttacctggactctggaatccattctggtgccactaccacagctccttctctgagtggtaaaggcaatcctgaggaagaggatgtggatacctcccaagtcctgtatgagtgggaacagggattttctcagtccttcactcaagaacaagtagctgatattgatggacagtatgcaatgactcgagctcagagggtacgagctgctatgttccctgagacattagatgagggcatgcagatcccatctacacagtttgatgctgctcatcccactaatgtccagcgtttggctgaaccatcacagatgctgaaacatgcagttgtaaacttgattaactatcaagatgatgcagaacttgccacacgtgcaatccctgaactgacaaaactgctaaatgacgaggaccaggtggtggttaataaggctgcagttatggtccatcagctttctaaaaaggaagcttccagacacgctatcatgcgttctcctcagatggtgtctgctattgtacgtaccatgcagaatacaaatgatgtagaaacagctcgttgtaccgctgggaccttgcataacctttcccatcatcgtgagggcttactggccatctttaagtctggaggcattcctgccctggtgaaaatgcttggttcaccagtggattctgtgttgttttatgccattacaactctccacaaccttttattacatcaagaaggagctaaaatggcagtgcgtttagctggtgggctgcagaaaatggttgccttgctcaacaaaacaaatgttaaattcttggctattacgacagactgccttcaaattttagcttatggcaaccaagaaagcaagctcatcatactggctagtggtggaccccaagctttagtaaatataatgaggacctatacttacgaaaaactactgtggaccacaagcagagtgctgaaggtgctatctgtctgctctagtaataagccggctattgtagaagctggtggaatgcaagctttaggacttcacctgacagatccaagtcaacgtcttgttcagaactgtctttggactctcaggaatctttcagatgctgcaactaaacagcctctgnagggtcctctagacgcca

SEQ ID NO: 278418 - DNA, 656 bp, Homo sapiens
atagctgattgatgagttgacatgccatggatccagacagaaaagcggctgttagtcactggcagcaacagtcttacctggactctggaatccattctggtgccactaccacagctccttctctgagtggtaaaggcaatcctgaggaagaggatgtggatacctcccaagtcctgtatgagtgggaacagggattttctcagtccttcactcaagaacaagtagctgatattgatggacagtatgcaatgactcgagctcagagggtacgagctgctatgttccctgagacattagatgagggcatgcagatcccatctacacagtttgatgctgctcatcccactaatgtccagcgtttggctgaaccatcacagatgctgaaacatgcagttgtaaacttgattaactatcaagatgatgcagaacttgccacacgtgcaatccctgaactgacaaaactgctaaatgacgaggaccagcattggtccgagagaaattagcaccgtagcggtgatcactatctgtatttttatcctcatccaactgtatcactttgtgcagcagcggagggaggattacgcccaacagcttgaaaatatagcgcattcagtgagaaagccgctttctcaggcggtgcttgatgtcaacctgaa

SEQ ID NO: 278419 - DNA, 379 bp, Homo sapiens
cacccgtttcatcaatagcgcaagtagctgatattgatggacagtatgcaatgactcgagctcagagggtacgagctgctatgttccctgagacattagatgagggcatgcagatcccatctacacagtttgatgctgctcatcccactaatgtccagcgtttggctgaaccatcacagatgctgaaacatgcagttgtaatggcaataaaacaacacacgaatccacgtggtgaaccaagcattttcaccagggcaggaatgcctccagacttaaagatggccgtaagccctcacgatgatgggaaaggttatgcaaggtcccagcggtacacgagctgtttctacatcatttgtattctgcgtgtacgacatatgac

SEQ ID NO: 278420 - DNA, 213 bp, Homo sapiens
cagaattaaacttttaattcattcgattgtgtcactctttctttttttcttgtcattaataaatggtttgtgagggtggtaagtaagtttatccaactcaactttatcctgaactttatcctgagatagatagatacatagtgaagtaatttgttgtagcgatagagagggccctacttctctagatgcaatttgccaagtttctttagcatt

SEQ ID NO: 278421 - DNA, 112 bp, Homo sapiens
gatagtgagtgttgaattaaccttttccagatattgatggacagtatgcaatgactcgagctcagagggtacgagctgctatgttccctgagacattagatgagggcatgca

SEQ ID NO: 278422 - DNA, 498 bp, Homo sapiens
tttttttttaaactgctatatctctagcatgtagaacagtgcctggcagcacataataggtgcttaatataatatttgttgaaagaacaagtcagtgagtatttttaatgtgaggtgcaaagagaaaaaaaaaatgtatctttgaggtgtggagttttgaagaacttccattttctaagcatttgtgtaatgttggagttacttgttccttttgtaatctgaaagtatgctttaaaaaaaattagtgtacttttgagaattttcattttgctttctattcttccttgctttgtgcatgtttatctagactgctgatcttggacttgatattggtgcccagggagaaccccttggatatcgccaggatggtatgtgtctcatatttctcgattaactccagatcaagctaaagttctaaaacttttatcagaagagccggtttgctcatctgggaaaccagtgttggcagaaaagtagtggcttcaattaaaagcagtt

SEQ ID NO: 278423 - DNA, 333 bp, Homo sapiens
cttcctgcttctgcccccaccatcccactggcctctgataaaggctactgttggattgattcgaaatcttgccctttgtcccgcaaatcatgcacctttgcgtgagcagggtgccattccacgactagttcagttgcttgttcgtgcacatcaggatacccagcgccgtacgtccatgggtgggacacagcagcaatttgtggagggggtccgcatggaagaaatagttgaaggttgtaccggagcccttcacatcctagctcgggatgttcacaaccggcagttcctatcacagattgcaatgaccatcacgcatcgactgtacagatgcct

SEQ ID NO: 278424 - DNA, 3248 bp, Homo sapiens
cacccgtttcatcaatagcgcaagtagctgatattgatggacagtatgcaatgactcgagctcagagggtacgagctgctatgttccctgagacattagatgagggcatgcagatcccatctacacagtttgatgctgctcatcccactaatgtccagcgtttggctgaaccatcacagatgctgaaacatgcagttgtaaacttgattaactatcaagatgatgcagaacttgccacacgtgcaatccctgaactgacaaaactgctaaatgacgaggaccaggtggtggttaataaggctgcagttatggtccatcagctttctaaaaaggaagcttccagacacgctatcatgcgttctcctcagatggtgtctgctattgtacgtaccatgcagaatacaaatgatgtagaaacagctcgttgtaccgctgggaccttgcataacctttcccatcatcgtgagggcttactggccatctttaagtctggaggcattcctgccctggtgaaaatgcttggttcaccagtggattctgtgttgttttatgccattacaactctccacaaccttttattacatcaagaaggagctaaaatggcagtgcgtttagctggtgggctgcagaaaatggttgccttgctcaacaaaacaaatgttaaattcttggctattacgacagactgccttcaaattttagcttatggcaaccaagaaagcaagctcatcatactggctagtggtggaccccaagctttagtaaatataatgaggacctatacttacgaaaaactactgtggaccacaagcagagtgctgaaggtgctatctgtctgctctagtaataagccggctattgtagaagctggtggaatgcaagctttaggacttcacctgacagatccaagtcaacgtcttgttcagaactgtctttggactctcaggaatctttcagatgctgcaactaaacaggaagggatggaaggtctccttgggactcttgttcagcttctgggttcagatgatataaatgtggtcacctgtgcagctggaattctttctaacctcacttgcaataattataagaacaagatgatggtctgccaagtgggtggtatagaggctcttgtgcgtactgtccttcgggctggtgacagggaagacatcactgagcctgccatctgtgctcttcgtcatctgaccagccgacaccaagaagcagagatggcccagaatgcagttcgccttcactatggactaccagttgtggttaagctcttacacccaccatcccactggcctctgataaaggctactgttggattgattcgaaatcttgccctttgtcccgcaaatcatgcacctttgcgtgagcagggtgccattccacgactagttcagttgcttgttcgtgcacatcaggatacccagcgccgtacgtccatgggtgggacacagcagcaatttgtggagggggtccgcatggaagaaatagttgaaggttgtaccggagcccttcacatcctagctcgggatgttcacaaccgaattgttatcagaggactaaataccattccattgtttgtgcagctgctttattctcccattgaaaacatccaaagagtagctgcaggggtcctctgtgaacttgctcaggacaaggaagctgcagaagctattgaagctgagggagccacagctcctctgacagagttacttcactctaggaatgaaggtgtggcgacatatgcagctgctgttttgttccgaatgtctgaggacaagccacaagattacaagaaacggctttcagttgagctgaccagctctctcttcagaacagagccaatggcttggaatgagactgctgatcttggacttgatattggtgcccagggagaaccccttggatatcgccaggatgatcctagctatcgttcttttcactctggtggatatggccaggatgccttgggtatggaccccatgatggaacatgagatgggtggccaccaccctggtgctgactatccagttgatgggctgccagatctggggcatgcccaggacctcatggatgggctgcctccaggtgacagcaatcagctggcctggtttgatactgacctgtaaatcatcctttaggtaagaagttttaaaaagccagtttgggtaaaatacttttactctgcctacagaacttcagaaagacttggttggtagggtgggagtggtttaggctatttgtaaatctgccacaaaaacaggtatatactttgaaaggagatgtcttggaacattggaatgttctcagatttctggttgttatgtgatcatgtgtggaagttattaactttaatgttttttgccacagcttttgcaacttaatactcaaatgagtaacatttgctgttttaaacattaatagcagcctttctctctttatacagctgtattgtctgaacttgcattgtgattggcctgtagagttgctgagagggctcgaggggtgggctggtatctcagaaagtgcctgacacactaaccaagctgagtttcctatgggaacaattgaagtaaactttttgttctggtcctttttggtcgaggagtaacaatacaaatggattttgggagtgactcaagaagtgaagaatgcacaagaatggatcacaagatggaatttagcaaaccctagccttgcttgttaaattttttttttttttttttaagaatatctgtaatggtactgactttgcttgctttgaagtagctcttttttttttttttttttttttttttttttttgcagtaactgttttttaagtctctcgtagtgttaagttatagtgaatactgctacagcaatttctaatttttaagaattgagtaatggtgtagaacactaattaattcataatcactctaattaattgtaatctgaataaagtgtaacaattgtgtagcctttttgtataaaatagacaaatagaaaatggtccaattagtttcctttttaatatgcttaaaataagcaggtggatctatttcatgtttttgatcaaaaactatttgggatatgtatgggtagggtaaatcagtaagaggtgttatttggaaccttgttttggacagtttaccagttgccttttatcccaaagttgttgtaacctgctgtgatacgatgcttcaagagaaaatgcggttataaaaaatggttcagaattaaacttttaattcattcga

SEQ ID NO: 278425 - DNA, 2982 bp, Homo sapiens
atagctgattgatgagttgacatgccatggatccagacagaaaagcggctgttagtcactggcagcaacagtcttacctggactctggaatccattctggtgccactaccacagctccttctctgagtggtaaaggcaatcctgaggaagaggatgtggatacctcccaagtcctgtatgagtgggaacagggattttctcagtccttcactcaagaacaagtagctgatattgatggacagtatgcaatgactcgagctcagagggtacgagctgctatgttccctgagacattagatgagggcatgcagatcccatctacacagtttgatgctgctcatcccactaatgtccagcgtttggctgaaccatcacagatgctgaaacatgcagttgtaaacttgattaactatcaagatgatgcagaacttgccacacgtgcaatccctgaactgacaaaactgctaaatgacgaggaccaggtggtggttaataaggctgcagttatggtccatcagctttctaaaaaggaagcttccagacacgctatcatgcgttctcctcagatggtgtctgctattgtacgtaccatgcagaatacaaatgatgtagaaacagctcgttgtaccgctgggaccttgcataacctttcccatcatcgtgagggcttactggccatctttaagtctggaggcattcctgccctggtgaaaatgcttggttcaccagtggattctgtgttgttttatgccattacaactctccacaaccttttattacatcaagaaggagctaaaatggcagtgcgtttagctggtgggctgcagaaaatggttgccttgctcaacaaaacaaatgttaaattcttggctattacgacagactgccttcaaattttagcttatggcaaccaagaaagcaagctcatcatactggctagtggtggaccccaagctttagtaaatataatgaggacctatacttacgaaaaactactgtggaccacaagcagagtgctgaaggtgctatctgtctgctctagtaataagccggctattgtagaagctggtggaatgcaagctttaggacttcacctgacagatccaagtcaacgtcttgttcagaactgtctttggactctcaggaatctttcagatgctgcaactaaacaggaagggatggaaggtctccttgggactcttgttcagcttctgggttcagatgatataaatgtggtcacctgtgcagctggaattctttctaacctcacttgcaataattataagaacaagatgatggtctgccaagtgggtggtatagaggctcttgtgcgtactgtccttcgggctggtgacagggaagacatcactgagcctgccatctgtgctcttcgtcatctgaccagccgacaccaagaagcagagatggcccagaatgcagttcgccttcactatggactaccagttgtggttaagctcttacacccaccatcccactggcctctgataaaggctactgttggattgattcgaaatcttgccctttgtcccgcaaatcatgcacctttgcgtgagcagggtgccattccacgactagttcagttgcttgttcgtgcacatcaggatacccagcgccgtacgtccatgggtgggacacagcagcaatttgtggagggggtccgcatggaagaaatagttgaaggttgtaccggagcccttcacatcctagctcgggatgttcacaaccgaattgttatcagaggactaaataccattccattgtttgtgcagctgctttattctcccattgaaaacatccaaagagtagctgcaggggtcctctgtgaacttgctcaggacaaggaagctgcagaagctattgaagctgagggagccacagctcctctgacagagttacttcactctaggaatgaaggtgtggcgacatatgcagctgctgttttgttccgaatgtctgaggacaagccacaagattacaagaaacggctttcagttgagctgaccagctctctcttcagaacagagccaatggcttggaatgagactgctgatcttggacttgatattggtgcccagggagaaccccttggatatcgccaggatgatcctagctatcgttcttttcactctggtggatatggccaggatgccttgggtatggaccccatgatggaacatgagatgggtggccaccaccctggtgctgactatccagttgatgggctgccagatctggggcatgcccaggacctcatggatgggctgcctccaggtgacagcaatcagctggcctggtttgatactgacctgtaaatcatcctttaggagtaacaatacaaatggattttgggagtgactcaagaagtgaagaatgcacaagaatggatcacaagatggaatttagcaaaccctagccttgcttgttaaattttttttttttttttttaagaatatctgtaatggtactgactttgcttgctttgaagtagctcttttttttttttttttttttttttttttttttgcagtaactgttttttaagtctctcgtagtgttaagttatagtgaatactgctacagcaatttctaatttttaagaattgagtaatggtgtagaacactaattaattcataatcactctaattaattgtaatctgaataaagtgtaacaattgtgtagcctttttgtataaaatagacaaatagaaaatggtccaattagtttcctttttaatatgcttaaaataagcaggtggatctatttcatgtttttgatcaaaaactatttgggatatgtatgggtagggtaaatcagtaagaggtgttatttggaaccttgttttggacagtttaccagttgccttttatcccaaagttgttgtaacctgctgtgatacgatgcttcaagagaaaatgcggttataaaaaatggttcagaattaaacttttaattcattcga

SEQ ID NO: 278426 - DNA, 3141 bp, Homo sapiens
atagctgattgatgagttgacatgccatggatccagacagaaaagcggctgttagtcactggcagcaacagtcttacctggactctggaatccattctggtgccactaccacagctccttctctgagtggtaaaggcaatcctgaggaagaggatgtggatacctcccaagtcctgtatgagtgggaacagggattttctcagtccttcactcaagaacaagtagctgatattgatggacagtatgcaatgactcgagctcagagggtacgagctgctatgttccctgagacattagatgagggcatgcagatcccatctacacagtttgatgctgctcatcccactaatgtccagcgtttggctgaaccatcacagatgctgaaacatgcagttgtaaacttgattaactatcaagatgatgcagaacttgccacacgtgcaatccctgaactgacaaaactgctaaatgacgaggaccaggtggtggttaataaggctgcagttatggtccatcagctttctaaaaaggaagcttccagacacgctatcatgcgttctcctcagatggtgtctgctattgtacgtaccatgcagaatacaaatgatgtagaaacagctcgttgtaccgctgggaccttgcataacctttcccatcatcgtgagggcttactggccatctttaagtctggaggcattcctgccctggtgaaaatgcttggttcaccagtggattctgtgttgttttatgccattacaactctccacaaccttttattacatcaagaaggagctaaaatggcagtgcgtttagctggtgggctgcagaaaatggttgccttgctcaacaaaacaaatgttaaattcttggctattacgacagactgccttcaaattttagcttatggcaaccaagaaagcaagctcatcatactggctagtggtggaccccaagctttagtaaatataatgaggacctatacttacgaaaaactactgtggaccacaagcagagtgctgaaggtgctatctgtctgctctagtaataagccggctattgtagaagctggtggaatgcaagctttaggacttcacctgacagatccaagtcaacgtcttgttcagaactgtctttggactctcaggaatctttcagatgctgcaactaaacaggaagggatggaaggtctccttgggactcttgttcagcttctgggttcagatgatataaatgtggtcacctgtgcagctggaattctttctaacctcacttgcaataattataagaacaagatgatggtctgccaagtgggtggtatagaggctcttgtgcgtactgtccttcgggctggtgacagggaagacatcactgagcctgccatctgtgctcttcgtcatctgaccagccgacaccaagaagcagagatggcccagaatgcagttcgccttcactatggactaccagttgtggttaagctcttacacccaccatcccactggcctctgataaaggctactgttggattgattcgaaatcttgccctttgtcccgcaaatcatgcacctttgcgtgagcagggtgccattccacgactagttcagttgcttgttcgtgcacatcaggatacccagcgccgtacgtccatgggtgggacacagcagcaatttgtggagggggtccgcatggaagaaatagttgaaggttgtaccggagcccttcacatcctagctcgggatgttcacaaccgaattgttatcagaggactaaataccattccattgtttgtgcagctgctttattctcccattgaaaacatccaaagagtagctgcaggggtcctctgtgaacttgctcaggacaaggaagctgcagaagctattgaagctgagggagccacagctcctctgacagagttacttcactctaggaatgaaggtgtggcgacatatgcagctgctgttttgttccgaatgtctgaggacaagccacaagattacaagaaacggctttcagttgagctgaccagctctctcttcagaacagagccaatggcttggaatgagactgctgatcttggacttgatattggtgcccagggagaaccccttggatatcgccaggatgatcctagctatcgttcttttcactctggtggatatggccaggatgccttgggtatggaccccatgatggaacatgagatgggtggccaccaccctggtgctgactatccagttgatgggctgccagatctggggcatgcccaggacctcatggatgggctgcctccaggtgacagcaatcagctggcctggtttgatactgacctgtaaatcatcctttagctgtattgtctgaacttgcattgtgattggcctgtagagttgctgagagggctcgaggggtgggctggtatctcagaaagtgcctgacacactaaccaagctgagtttcctatgggaacaattgaagtaaactttttgttctggtcctttttggtcgaggagtaacaatacaaatggattttgggagtgactcaagaagtgaagaatgcacaagaatggatcacaagatggaatttagcaaaccctagccttgcttgttaaattttttttttttttttttaagaatatctgtaatggtactgactttgcttgctttgaagtagctcttttttttttttttttttttttttttttttttgcagtaactgttttttaagtctctcgtagtgttaagttatagtgaatactgctacagcaatttctaatttttaagaattgagtaatggtgtagaacactaattaattcataatcactctaattaattgtaatctgaataaagtgtaacaattgtgtagcctttttgtataaaatagacaaatagaaaatggtccaattagtttcctttttaatatgcttaaaataagcaggtggatctatttcatgtttttgatcaaaaactatttgggatatgtatgggtagggtaaatcagtaagaggtgttatttggaaccttgttttggacagtttaccagttgccttttatcccaaagttgttgtaacctgctgtgatacgatgcttcaagagaaaatgcggttataaaaaatggttcagaattaaacttttaattcattcga

SEQ ID NO: 278427 - DNA, 3534 bp, Homo sapiens
atagctgattgatgagttgacatgccatggatccagacagaaaagcggctgttagtcactggcagcaacagtcttacctggactctggaatccattctggtgccactaccacagctccttctctgagtggtaaaggcaatcctgaggaagaggatgtggatacctcccaagtcctgtatgagtgggaacagggattttctcagtccttcactcaagaacaagtagctgatattgatggacagtatgcaatgactcgagctcagagggtacgagctgctatgttccctgagacattagatgagggcatgcagatcccatctacacagtttgatgctgctcatcccactaatgtccagcgtttggctgaaccatcacagatgctgaaacatgcagttgtaaacttgattaactatcaagatgatgcagaacttgccacacgtgcaatccctgaactgacaaaactgctaaatgacgaggaccaggtggtggttaataaggctgcagttatggtccatcagctttctaaaaaggaagcttccagacacgctatcatgcgttctcctcagatggtgtctgctattgtacgtaccatgcagaatacaaatgatgtagaaacagctcgttgtaccgctgggaccttgcataacctttcccatcatcgtgagggcttactggccatctttaagtctggaggcattcctgccctggtgaaaatgcttggttcaccagtggattctgtgttgttttatgccattacaactctccacaaccttttattacatcaagaaggagctaaaatggcagtgcgtttagctggtgggctgcagaaaatggttgccttgctcaacaaaacaaatgttaaattcttggctattacgacagactgccttcaaattttagcttatggcaaccaagaaagcaagctcatcatactggctagtggtggaccccaagctttagtaaatataatgaggacctatacttacgaaaaactactgtggaccacaagcagagtgctgaaggtgctatctgtctgctctagtaataagccggctattgtagaagctggtggaatgcaagctttaggacttcacctgacagatccaagtcaacgtcttgttcagaactgtctttggactctcaggaatctttcagatgctgcaactaaacaggaagggatggaaggtctccttgggactcttgttcagcttctgggttcagatgatataaatgtggtcacctgtgcagctggaattctttctaacctcacttgcaataattataagaacaagatgatggtctgccaagtgggtggtatagaggctcttgtgcgtactgtccttcgggctggtgacagggaagacatcactgagcctgccatctgtgctcttcgtcatctgaccagccgacaccaagaagcagagatggcccagaatgcagttcgccttcactatggactaccagttgtggttaagctcttacacccaccatcccactggcctctgataaaggctactgttggattgattcgaaatcttgccctttgtcccgcaaatcatgcacctttgcgtgagcagggtgccattccacgactagttcagttgcttgttcgtgcacatcaggatacccagcgccgtacgtccatgggtgggacacagcagcaatttgtggagggggtccgcatggaagaaatagttgaaggttgtaccggagcccttcacatcctagctcgggatgttcacaaccgaattgttatcagaggactaaataccattccattgtttgtgcagctgctttattctcccattgaaaacatccaaagagtagctgcaggggtcctctgtgaacttgctcaggacaaggaagctgcagaagctattgaagctgagggagccacagctcctctgacagagttacttcactctaggaatgaaggtgtgggtaagtaaaaaggaaccaaagcctttagcagatgtgtacattgaagtctcagtttttcctcaagggcctttttctccttgtctcttagcgacatatgcagctgctgttttgttccgaatgtctgaggacaagccacaagattacaagaaacggctttcagttgagctgaccagctctctcttcagaacagagccaatggcttggaatgagactgctgatcttggacttgatattggtgcccagggagaaccccttggatatcgccaggatgatcctagctatcgttcttttcactctggtggatatggccaggatgccttgggtatggaccccatgatggaacatgagatgggtggccaccaccctggtgctgactatccagttgatgggctgccagatctggggcatgcccaggacctcatggatgggctgcctccaggtgacagcaatcagctggcctggtttgatactgacctgtaaatcatcctttaggtaagaagttttaaaaagccagtttgggtaaaatacttttactctgcctacagaacttcagaaagacttggttggtagggtgggagtggtttaggctatttgtaaatctgccacaaaaacaggtatatactttgaaaggagatgtcttggaacattggaatgttctcagatttctggttgttatgtgatcatgtgtggaagttattaactttaatgttttttgccacagcttttgcaacttaatactcaaatgagtaacatttgctgttttaaacattaatagcagcctttctctctttatacagctgtattgtctgaacttgcattgtgattggcctgtagagttgctgagagggctcgaggggtgggctggtatctcagaaagtgcctgacacactaaccaagctgagtttcctatgggaacaattgaagtaaactttttgttctggtcctttttggtcgaggagtaacaatacaaatggattttgggagtgactcaagaagtgaagaatgcacaagaatggatcacaagatggaatttagcaaaccctagccttgcttgttaaattttttttttttttttttaagaatatctgtaatggtactgactttgcttgctttgaagtagctcttttttttttttttttttttttttttttttttgcagtaactgttttttaagtctctcgtagtgttaagttatagtgaatactgctacagcaatttctaatttttaagaattgagtaatggtgtagaacactaattaattcataatcactctaattaattgtaatctgaataaagtgtaacaattgtgtagcctttttgtataaaatagacaaatagaaaatggtccaattagtttcctttttaatatgcttaaaataagcaggtggatctatttcatgtttttgatcaaaaactatttgggatatgtatgggtagggtaaatcagtaagaggtgttatttggaaccttgttttggacagtttaccagttgccttttatcccaaagttgttgtaacctgctgtgatacgatgcttcaagagaaaatgcggttataaaaaatggttcagaattaaacttttaattcattcga

SEQ ID NO: 278428 - DNA, 3368 bp, Homo sapiens
atagctgattgatgagttgacatgccatggatccagacagaaaagcggctgttagtcactggcagcaacagtcttacctggactctggaatccattctggtgccactaccacagctccttctctgagtggtaaaggcaatcctgaggaagaggatgtggatacctcccaagtcctgtatgagtgggaacagggattttctcagtccttcactcaagaacaagtagctgatattgatggacagtatgcaatgactcgagctcagagggtacgagctgctatgttccctgagacattagatgagggcatgcagatcccatctacacagtttgatgctgctcatcccactaatgtccagcgtttggctgaaccatcacagatgctgaaacatgcagttgtaaacttgattaactatcaagatgatgcagaacttgccacacgtgcaatccctgaactgacaaaactgctaaatgacgaggaccaggtggtggttaataaggctgcagttatggtccatcagctttctaaaaaggaagcttccagacacgctatcatgcgttctcctcagatggtgtctgctattgtacgtaccatgcagaatacaaatgatgtagaaacagctcgttgtaccgctgggaccttgcataacctttcccatcatcgtgagggcttactggccatctttaagtctggaggcattcctgccctggtgaaaatgcttggttcaccagtggattctgtgttgttttatgccattacaactctccacaaccttttattacatcaagaaggagctaaaatggcagtgcgtttagctggtgggctgcagaaaatggttgccttgctcaacaaaacaaatgttaaattcttggctattacgacagactgccttcaaattttagcttatggcaaccaagaaagcaagctcatcatactggctagtggtggaccccaagctttagtaaatataatgaggacctatacttacgaaaaactactgtggaccacaagcagagtgctgaaggtgctatctgtctgctctagtaataagccggctattgtagaagctggtggaatgcaagctttaggacttcacctgacagatccaagtcaacgtcttgttcagaactgtctttggactctcaggaatctttcagatgctgcaactaaacaggaagggatggaaggtctccttgggactcttgttcagcttctgggttcagatgatataaatgtggtcacctgtgcagctggaattctttctaacctcacttgcaataattataagaacaagatgatggtctgccaagtgggtggtatagaggctcttgtgcgtactgtccttcgggctggtgacagggaagacatcactgagcctgccatctgtgctcttcgtcatctgaccagccgacaccaagaagcagagatggcccagaatgcagttcgccttcactatggactaccagttgtggttaagctcttacacccaccatcccactggcctctgataaaggctactgttggattgattcgaaatcttgccctttgtcccgcaaatcatgcacctttgcgtgagcagggtgccattccacgactagttcagttgcttgttcgtgcacatcaggatacccagcgccgtacgtccatgggtgggacacagcagcaatttgtggagggggtccgcatggaagaaatagttgaaggttgtaccggagcccttcacatcctagctcgggatgttcacaaccgaattgttatcagaggactaaataccattccattgtttgtgcagctgctttattctcccattgaaaacatccaaagagtagctgcaggggtcctctgtgaacttgctcaggacaaggaagctgcagaagctattgaagctgagggagccacagctcctctgacagagttacttcactctaggaatgaaggtgtggcgacatatgcagctgctgttttgttccgaatgtctgaggacaagccacaagattacaagaaacggctttcagttgagctgaccagctctctcttcagaacagagccaatggcttggaatgagactgctgatcttggacttgatattggtgcccagggagaaccccttggatatcgccaggatgatcctagctatcgttcttttcactctggtggatatggccaggatgccttgggtatggaccccatgatggaacatgagatgggtggccaccaccctggtgctgactatccagttgatgggctgccagatctggggcatgcccaggacctcatggatgggctgcctccaggtgacagcaatcagctggcctggtttgatactgacctgtaaatcatcctttaggtaagaagttttaaaaagccagtttgggtaaaatacttttactctgcctacagaacttcagaaagacttggttggtagggtgggagtggtttaggctatttgtaaatctgccacaaaaacaggtatatactttgaaaggagatgtcttggaacattggaatgttctcagatttctggttgttatgtgatcatgtgtggaagttattaactttaatgttttttgccacagcttttgcaacttaatactcaaatgagtaacatttgctgttttaaacattaatagcagcctttctctctttatacagctgtattgtctgaacttgcattgtgattggcctgtagagttgctgagagggctcgaggggtgggctggtatctcagaaagtgcctgacacactaaccaagctgagtttcctatgggaacaattgaagtaaactttttgttctggtcctttttggtcgaggagtaacaatacaaatggattttgggagtgactcaagaagtgaagaatgcacaagaatggatcacaagatggaatttagcaaaccctagccttgcttgttaaattttttttttttttttttaagaatatctgtaatggtactgactttgcttgctttgaagtagctcttttttttttttttttttttttttttttttttgcagtaactgttttttaagtctctcgtagtgttaagttatagtgaatactgctacagcaatttctaatttttaagaattgagtaatggtgtagaacactaattaattcataatcactctaattaattgtaatctgaataaagtgtaacaattgtgtagcctttttgtataaaatagacaaatagaaaatggtccaattagtttcctttttaatatgcttaaaataagcaggtggatctatttcatgtttttgatcaaaaactatttgggatatgtatggctctatcgagctacggttgtatcacgtaagacgcagttactagcttcatgctcagctcgactccagtgatcttaaccccgg

SEQ ID NO: 278429 - DNA, 1796 bp, Homo sapiens
cgactcttgggatcccctctgagggggtccgcatggaagaaatagttgaaggttgtaccggagcccttcacatcctagctcgggatgttcacaaccgaattgttatcagaggactaaataccattccattgtttgtgcagctgctttattctcccattgaaaacatccaaagagtagctgcaggggtcctctgtgaacttgctcaggacaaggaagctgcagaagctattgaagctgagggagccacagctcctctgacagagttacttcactctaggaatgaaggtgtggcgacatatgcagctgctgttttgttccgaatgtctgaggacaagccacaagattacaagaaacggctttcagttgagctgaccagctctctcttcagaacagagccaatggcttggaatgagactgctgatcttggacttgatattggtgcccagggagaaccccttggatatcgccaggatgatcctagctatcgttcttttcactctggtggatatggccaggatgccttgggtatggaccccatgatggaacatgagatgggtggccaccaccctggtgctgactatccagttgatgggctgccagatctggggcatgcccaggacctcatggatgggctgcctccaggtgacagcaatcagctggcctggtttgatactgacctgtaaatcatcctttaggtaagaagttttaaaaagccagtttgggtaaaatacttttactctgcctacagaacttcagaaagacttggttggtagggtgggagtggtttaggctatttgtaaatctgccacaaaaacaggtatatactttgaaaggagatgtcttggaacattggaatgttctcagatttctggttgttatgtgatcatgtgtggaagttattaactttaatgttttttgccacagcttttgcaacttaatactcaaatgagtaacatttgctgttttaaacattaatagcagcctttctctctttatacagctgtattgtctgaacttgcattgtgattggcctgtagagttgctgagagggctcgaggggtgggctggtatctcagaaagtgcctgacacactaaccaagctgagtttcctatgggaacaattgaagtaaactttttgttctggtcctttttggtcgaggagtaacaatacaaatggattttgggagtgactcaagaagtgaagaatgcacaagaatggatcacaagatggaatttagcaaaccctagccttgcttgttaaattttttttttttttttttaagaatatctgtaatggtactgactttgcttgctttgaagtagctcttttttttttttttttttttttttttttttttgcagtaactgttttttaagtctctcgtagtgttaagttatagtgaatactgctacagcaatttctaatttttaagaattgagtaatggtgtagaacactaattaattcataatcactctaattaattgtaatctgaataaagtgtaacaattgtgtagcctttttgtataaaatagacaaatagaaaatggtccaattagtttcctttttaatatgcttaaaataagcaggtggatctatttcatgtttttgatcaaaaactatttgggatatgtatgggtagggtaaatcagtaagaggtgttatttggaaccttgttttggacagtttaccagttgccttttatcccaaagttgttgtaacctgctgtgatacgatgcttcaagagaaaatgcggttataaaaaatggttcagaattaaacttttaattcattcga

SEQ ID NO: 278430 - DNA, 3364 bp, Homo sapiens
  misc_feature (3118)..(3118): n is a, c, g, or t
atagctgattgatgagttgacatgccatggatccagacagaaaagcggctgttagtcactggcagcaacagtcttacctggactctggaatccattctggtgccactaccacagctccttctctgagtggtaaaggcaatcctgaggaagaggatgtggatacctcccaagtcctgtatgagtgggaacagggattttctcagtccttcactcaagaacaagtagctgatattgatggacagtatgcaatgactcgagctcagagggtacgagctgctatgttccctgagacattagatgagggcatgcagatcccatctacacagtttgatgctgctcatcccactaatgtccagcgtttggctgaaccatcacagatgctgaaacatgcagttgtaaacttgattaactatcaagatgatgcagaacttgccacacgtgcaatccctgaactgacaaaactgctaaatgacgaggaccaggtggtggttaataaggctgcagttatggtccatcagctttctaaaaaggaagcttccagacacgctatcatgcgttctcctcagatggtgtctgctattgtacgtaccatgcagaatacaaatgatgtagaaacagctcgttgtaccgctgggaccttgcataacctttcccatcatcgtgagggcttactggccatctttaagtctggaggcattcctgccctggtgaaaatgcttggttcaccagtggattctgtgttgttttatgccattacaactctccacaaccttttattacatcaagaaggagctaaaatggcagtgcgtttagctggtgggctgcagaaaatggttgccttgctcaacaaaacaaatgttaaattcttggctattacgacagactgccttcaaattttagcttatggcaaccaagaaagcaagctcatcatactggctagtggtggaccccaagctttagtaaatataatgaggacctatacttacgaaaaactactgtggaccacaagcagagtgctgaaggtgctatctgtctgctctagtaataagccggctattgtagaagctggtggaatgcaagctttaggacttcacctgacagatccaagtcaacgtcttgttcagaactgtctttggactctcaggaatctttcagatgctgcaactaaacaggaagggatggaaggtctccttgggactcttgttcagcttctgggttcagatgatataaatgtggtcacctgtgcagctggaattctttctaacctcacttgcaataattataagaacaagatgatggtctgccaagtgggtggtatagaggctcttgtgcgtactgtccttcgggctggtgacagggaagacatcactgagcctgccatctgtgctcttcgtcatctgaccagccgacaccaagaagcagagatggcccagaatgcagttcgccttcactatggactaccagttgtggttaagctcttacacccaccatcccactggcctctgataaaggctactgttggattgattcgaaatcttgccctttgtcccgcaaatcatgcacctttgcgtgagcagggtgccattccacgactagttcagttgcttgttcgtgcacatcaggatacccagcgccgtacgtccatgggtgggacacagcagcaatttgtggagggggtccgcatggaagaaatagttgaaggttgtaccggagcccttcacatcctagctcgggatgttcacaaccgaattgttatcagaggactaaataccattccattgtttgtgcagctgctttattctcccattgaaaacatccaaagagtagctgcaggggtcctctgtgaacttgctcaggacaaggaagctgcagaagctattgaagctgagggagccacagctcctctgacagagttacttcactctaggaatgaaggtgtggcgacatatgcagctgctgttttgttccgaatgtctgaggacaagccacaagattacaagaaacggctttcagttgagctgaccagctctctcttcagaacagagccaatggcttggaatgagactgctgatcttggacttgatattggtgcccagggagaaccccttggatatcgccaggatgatcctagctatcgttcttttcactctggtggatatggccaggatgccttgggtatggaccccatgatggaacatgagatgggtggccaccaccctggtgctgactatccagttgatgggctgccagatctggggcatgcccaggacctcatggatgggctgcctccaggtgacagcaatcagctggcctggtttgatactgacctgtaaatcatcctttaggagtaacaatacaaatggattttgggagtgactcaagaagtgaagaatgcacaagaatggatcacaagatggaatttagcaaaccctagccttgcttgttaaattttttttttttttttttaagaatatctgtaatggtactgactttgcttgctttgaagtagctctttttttttttttttttttttttgggagaagaaactgtgtttaaaagttctctctcacggataggtgtaacagttatatagagtagaattcgggggtacaagaaatttttataatttttcttaaaaaaaaatgttggagtatagggggggtggttaaacacacttattttcaaaaaatctccactctcttaaattatagtgtgtgataccttgtggaaataagcggtgttaaacagtgtggtgattcgccttttggtgtttttaaaaactagacaaattagaaagggcggccacatgtagttcccctttaaaattgggctaaaataagggcaggggggtctcatataccgtgtttgggacacaacaccctttgcgggcatttgttgggggggggacaccagaaaaagggtgttttttggacaccctttgttgggcacagcttccccaggtggctttttaccccaaggtgtgttgacccggctgggaaacacacttctaagaaaaagtcgggttttacaagggggcttccaaatttaacttttttatttcttttaaaaaaaaaaagatacaggtatgataagcaactagaagaaagaacaagataanaggggcagatataagactacgcacggggaggaagaaagatgaacgccagggtgtgatggaatggtacgcacaggcgtgatatcatcgagggagcgagtatacacgaggaagaaacagtcaagggtagtggagaccaatcgaggatggaattgaaagaacaagtagtggtaaagatcaacataccagagtatggtatgtggttagtcctgttgctaataaatacacggagtagggatgaataatgag

SEQ ID NO: 278431 - DNA, 1998 bp, Homo sapiens
aatgtctctccctgaactaattgcaagttacggggaacttcgggtatataatgtaaataattacagtctaataattgttcctcaaactttacagaggagaatgccctgtttgttaaccatgtttcttttggcaggagggggtccgcatggaagaaatagttgaaggttgtaccggagcccttcacatcctagctcgggatgttcacaaccgaattgttatcagaggactaaataccattccattgtttgtgcagctgctttattctcccattgaaaacatccaaagagtagctgcaggggtcctctgtgaacttgctcaggacaaggaagctgcagaagctattgaagctgagggagccacagctcctctgacagagttacttcactctaggaatgaaggtgtgggtaagtaaaaaggaaccaaagcctttagcagatgtgtacattgaagtctcagtttttcctcaagggcctttttctccttgtctcttagcgacatatgcagctgctgttttgttccgaatgtctgaggacaagccacaagattacaagaaacggctttcagttgagctgaccagctctctcttcagaacagagccaatggcttggaatgagactgctgatcttggacttgatattggtgcccagggagaaccccttggatatcgccaggatgatcctagctatcgttcttttcactctggtggatatggccaggatgccttgggtatggaccccatgatggaacatgagatgggtggccaccaccctggtgctgactatccagttgatgggctgccagatctggggcatgcccaggacctcatggatgggctgcctccaggtgacagcaatcagctggcctggtttgatactgacctgtaaatcatcctttaggtaagaagttttaaaaagccagtttgggtaaaatacttttactctgcctacagaacttcagaaagacttggttggtagggtgggagtggtttaggctatttgtaaatctgccacaaaaacaggtatatactttgaaaggagatgtcttggaacattggaatgttctcagatttctggttgttatgtgatcatgtgtggaagttattaactttaatgttttttgccacagcttttgcaacttaatactcaaatgagtaacatttgctgttttaaacattaatagcagcctttctctctttatacagctgtattgtctgaacttgcattgtgattggcctgtagagttgctgagagggctcgaggggtgggctggtatctcagaaagtgcctgacacactaaccaagctgagtttcctatgggaacaattgaagtaaactttttgttctggtcctttttggtcgaggagtaacaatacaaatggattttgggagtgactcaagaagtgaagaatgcacaagaatggatcacaagatggaatttagcaaaccctagccttgcttgttaaattttttttttttttttttaagaatatctgtaatggtactgactttgcttgctttgaagtagctcttttttttttttttttttttttttttttttttgcagtaactgttttttaagtctctcgtagtgttaagttatagtgaatactgctacagcaatttctaatttttaagaattgagtaatggtgtagaacactaattaattcataatcactctaattaattgtaatctgaataaagtgtaacaattgtgtagcctttttgtataaaatagacaaatagaaaatggtccaattagtttcctttttaatatgcttaaaataagcaggtggatctatttcatgtttttgatcaaaaactatttgggatatgtatgggtagggtaaatcagtaagaggtgttatttggaaccttgttttggacagtttaccagttgccttttatcccaaagttgttgtaacctgctgtgatacgatgcttcaagagaaaatgcggttataaaaaatggttcagaattaaacttttaattcattcga

SEQ ID NO: 278432 - DNA, 1388 bp, Homo sapiens
ttcaatttctacacattacagtactacttggttcccagagagaaccccttggatatcgccaggatgatcctagctatcgttcttttcactctggtggatatggccaggatgccttgggtatggaccccatgatggaacatgagatgggtggccaccaccctggtgctgactatccagttgatgggctgccagatctggggcatgcccaggacctcatggatgggctgcctccaggtgacagcaatcagctggcctggtttgatactgacctgtaaatcatcctttaggtaagaagttttaaaaagccagtttgggtaaaatacttttactctgcctacagaacttcagaaagacttggttggtagggtgggagtggtttaggctatttgtaaatctgccacaaaaacaggtatatactttgaaaggagatgtcttggaacattggaatgttctcagatttctggttgttatgtgatcatgtgtggaagttattaactttaatgttttttgccacagcttttgcaacttaatactcaaatgagtaacatttgctgttttaaacattaatagcagcctttctctctttatacagctgtattgtctgaacttgcattgtgattggcctgtagagttgctgagagggctcgaggggtgggctggtatctcagaaagtgcctgacacactaaccaagctgagtttcctatgggaacaattgaagtaaactttttgttctggtcctttttggtcgaggagtaacaatacaaatggattttgggagtgactcaagaagtgaagaatgcacaagaatggatcacaagatggaatttagcaaaccctagccttgcttgttaaattttttttttttttttttaagaatatctgtaatggtactgactttgcttgctttgaagtagctcttttttttttttttttttttttttttttttttgcagtaactgttttttaagtctctcgtagtgttaagttatagtgaatactgctacagcaatttctaatttttaagaattgagtaatggtgtagaacactaattaattcataatcactctaattaattgtaatctgaataaagtgtaacaattgtgtagcctttttgtataaaatagacaaatagaaaatggtccaattagtttcctttttaatatgcttaaaataagcaggtggatctatttcatgtttttgatcaaaaactatttgggatatgtatgggtagggtaaatcagtaagaggtgttatttggaaccttgttttggacagtttaccagttgccttttatcccaaagttgttgtaacctgctgtgatacgatgcttcaagagaaaatgcggttataaaaaatggttcagaattaaacttttaattcattcga

SEQ ID NO: 278433 - DNA, 3341 bp, Homo sapiens
atagctgattgatgagttgacatgccatggatccagacagaaaagcggctgttagtcactggcagcaacagtcttacctggactctggaatccattctggtgccactaccacagctccttctctgagtggtaaaggcaatcctgaggaagaggatgtggatacctcccaagtcctgtatgagtgggaacagggattttctcagtccttcactcaagaacaagtagctgatattgatggacagtatgcaatgactcgagctcagagggtacgagctgctatgttccctgagacattagatgagggcatgcagatcccatctacacagtttgatgctgctcatcccactaatgtccagcgtttggctgaaccatcacagatgctgaaacatgcagttgtaaacttgattaactatcaagatgatgcagaacttgccacacgtgcaatccctgaactgacaaaactgctaaatgacgaggaccaggtggtggttaataaggctgcagttatggtccatcagctttctaaaaaggaagcttccagacacgctatcatgcgttctcctcagatggtgtctgctattgtacgtaccatgcagaatacaaatgatgtagaaacagctcgttgtaccgctgggaccttgcataacctttcccatcatcgtgagggcttactggccatctttaagtctggaggcattcctgccctggtgaaaatgcttggttcaccagtggattctgtgttgttttatgccattacaactctccacaaccttttattacatcaagaaggagctaaaatggcagtgcgtttagctggtgggctgcagaaaatggttgccttgctcaacaaaacaaatgttaaattcttggctattacgacagactgccttcaaattttagcttatggcaaccaagaaagcaagctcatcatactggctagtggtggaccccaagctttagtaaatataatgaggacctatacttacgaaaaactactgtggaccacaagcagagtgctgaaggtgctatctgtctgctctagtaataagccggctattgtagaagctggtggaatgcaagctttaggacttcacctgacagatccaagtcaacgtcttgttcagaactgtctttggactctcaggaatctttcagatgctgcaactaaacaggaagggatggaaggtctccttgggactcttgttcagcttctgggttcagatgatataaatgtggtcacctgtgcagctggaattctttctaacctcacttgcaataattataagaacaagatgatggtctgccaagtgggtggtatagaggctcttgtgcgtactgtccttcgggctggtgacagggaagacatcactgagcctgccatctgtgctcttcgtcatctgaccagccgacaccaagaagcagagatggcccagaatgcagttcgccttcactatggactaccagttgtggttaagctcttacacccaccatcccactggcctctgataaaggctactgttggattgattcgaaatcttgccctttgtcccgcaaatcatgcacctttgcgtgagcagggtgccattccacgactagttcagttgcttgttcgtgcacatcaggatacccagcgccgtacgtccatgggtgggacacagcagcaatttgtggagggggtccgcatggaagaaatagttgaaggttgtaccggagcccttcacatcctagctcgggatgttcacaaccgaattgttatcagaggactaaataccattccattgtttgtgcagctgctttattctcccattgaaaacatccaaagagtagctgcaggggtcctctgtgaacttgctcaggacaaggaagctgcagaagctattgaagctgagggagccacagctcctctgacagagttacttcactctaggaatgaaggtgtgggtaagtaaaaaggaaccaaagcctttagcagatgtgtacattgaagtctcagtttttcctcaagggcctttttctccttgtctcttagcgacatatgcagctgctgttttgttccgaatgtctgaggacaagccacaagattacaagaaacggctttcagttgagctgaccagctctctcttcagaacagagccaatggcttggaatgaggtagggaaatgtgagcagttatttatctggtagtttcctagagcaggtatggcagcttgttctttcctctcaaaacacttagtacacattcatttgcattgatgtttccctggcttgagtatttcttctttatgctgtctagcaactgctctgaggaagaactataatacaagctttaaagagtctgttcagaatcattacaaataagttgtgttatttaaaattataattcataagggagaaagatgaaaaatgttaccagattaaagaagatttttcaaaaggatgtaaggaaagaggcagtgttaaacactgttaagaggacagtttatcagtattttttactaaactttaataaaacttttctatttgaatttctgctatgaatttttcttcagcatttgtcctcagtacaggtggttccttgaaacattgtttctaataaaactagaacatcctgatattttatccattctatagagatcattgatggtacacagacatacagtggattatgtttgttgagtgaatggaaagagagattgttaggtttacaacgatgcagctcttgagaccggagtttaagatcagcctgggcaacatagtgaaaccccatctttagctgggcatggagatggatgcctatagtcctagctactggggagacgggggcaggaggattgcttgaacccaggagttaacagactgcactcagtgacagagccagactccaacacaaaaaaaaaaaaaaaaaaagcaaattaccagtgagtagtgtgttacttgggtttttaataggcatcttattaacatgttccaacttgagcccttaactttctccacctacccccttccacaaacctgttttcactgtcttctctgtcttagttaatgtcagctttgtctgtccagctgctcaggctaaaacttttctttcatataacacatcctatcagcagctcctgtttgtgggtaggcattttgcctttttttttttttttttttttaaactgctatatctctagcatgtagaacagtgcctggcagcacataataggtgcttaatataatatttgttgaaagaacaagtcagtgagtatttttaatgtgaggtgcaaagagaaaaaaaaaatgtatctttgaggtgtggagttttgaagaacttccattttctaagcatttgtgtaatg

SEQ ID NO: 278434 - DNA, 5777 bp, Homo sapiens
ttcctaggcggcggccgcggcggcggaggcagcagcggcggcggcagtggcggcggcgaaggtggcggcggctcggccagtactcccggcccccgccatttcggactgggagcgagcgcggcgcaggcactgaaggcggcggcggggccagaggctcagcggctcccaggtgcgggagagaggcctgctgaaaatgactgaatataaacttgtggtagttggagctggtggcgtaggcaagagtgccttgacgatacagctaattcagaatcattttgtggacgaatatgatccaacaatagaggattcctacaggaagcaagtagtaattgatggagaaacctgtctcttggatattctcgacacagcaggtcaagaggagtacagtgcaatgagggaccagtacatgaggactggggagggctttctttgtgtatttgccataaataatactaaatcatttgaagatattcaccattatagagaacaaattaaaagagttaaggactctgaagatgtacctatggtcctagtaggaaataaatgtgatttgccttctagaacagtagacacaaaacaggctcaggacttagcaagaagttatggaattccttttattgaaacatcagcaaagacaagacagggtgttgatgatgccttctatacattagttcgagaaattcgaaaacataaagaaaagatgagcaaagatggtaaaaagaagaaaaagaagtcaaagacaaagtgtgtaattatgtaaatacaatttgtacttttttcttaaggcatactagtacaagtggtaatttttgtacattacactaaattattagcatttgttttagcattacctaatttttttcctgctccatgcagactgttagcttttaccttaaatgcttattttaaaatgacagtggaagtttttttttcctcgaagtgccagtattcccagagttttggtttttgaactagcaatgcctgtgaaaaagaaactgaatacctaagatttctgtcttggggtttttggtgcatgcagttgattacttcttatttttcttaccaattgtgaatgttggtgtgaaacaaattaatgaagcttttgaatcatccctattctgtgttttatctagtcacataaatggattaattactaatttcagttgagaccttctaattggtttttactgaaacattgagggaacacaaatttatgggcttcctgatgatgattcttctaggcatcatgtcctatagtttgtcatccctgatgaatgtaaagttacactgttcacaaaggttttgtctcctttccactgctattagtcatggtcactctccccaaaatattatattttttctataaaaagaaaaaaatggaaaaaaattacaaggcaatggaaactattataaggccatttccttttcacattagataaattactataaagactcctaatagctttttcctgttaaggcagacccagtatgaatgggattattatagcaaccattttggggctatatttacatgctactaaatttttataataattgaaaagattttaacaagtataaaaaaattctcataggaattaaatgtagtctccctgtgtcagactgctctttcatagtataactttaaatcttttcttcaacttgagtctttgaagatagttttaattctgcttgtgacattaaaagattatttgggccagttatagcttattaggtgttgaagagaccaaggttgcaagccaggccctgtgtgaaccttgagctttcatagagagtttcacagcatggactgtgtgccccacggtcatccgagtggttgtacgatgcattggttagtcaaaaatggggagggactagggcagtttggatagctcaacaagatacaatctcactctgtggtggtcctgctgacaaatcaagagcattgcttttgtttcttaagaaaacaaactcttttttaaaaattacttttaaatattaactcaaaagttgagattttggggtggtggtgtgccaagacattaattttttttttaaacaatgaagtgaaaaagttttacaatctctaggtttggctagttctcttaacactggttaaattaacattgcataaacacttttcaagtctgatccatatttaataatgctttaaaataaaaataaaaacaatccttttgataaatttaaaatgttacttattttaaaataaatgaagtgagatggcatggtgaggtgaaagtatcactggactaggttgttggtgacttaggttctagataggtgtcttttaggactctgattttgaggacatcacttactatccatttcttcatgttaaaagaagtcatctcaaactcttagttttttttttttacactatgtgatttatattccatttacataaggatacacttatttgtcaagctcagcacaatctgtaaatttttaacctatgttacaccatcttcagtgccagtcttgggcaaaattgtgcaagaggtgaagtttatatttgaatatccattctcgttttaggactcttcttccatattagtgtcatcttgcctccctaccttccacatgccccatgacttgatgcagttttaatacttgtaattcccctaaccataagatttactgctgctgtggatatctccatgaagttttcccactgagtcacatcagaaatgccctacatcttattttcctcagggctcaagagaatctgacagataccataaagggatttgacctaatcactaattttcaggtggtggctgatgctttgaacatctctttgctgcccaatccattagcgacagtaggatttttcaaccctggtatgaatagacagaaccctatccagtggaaggagaatttaataaagatagtgcagaaagaattccttaggtaatctataactaggactactcctggtaacagtaatacattccattgttttagtaaccagaaatcttcatgcaatgaaaaatactttaattcatgaagcttacttttttttttttggtgtcagagtctcgctcttgtcacccaggctggaatgcagtggcgccatctcagctcactgcaaccttccatcttcccaggttcaagcgattctcgtgcctcggcctcctgagtagctgggattacaggcgtgtgcactacactcaactaatttttgtatttttaggagagacggggtttcacctgttggccaggctggtctcgaactcctgacctcaagtgattcacccaccttggcctcataaacctgttttgcagaactcatttattcagcaaatatttattgagtgcctaccagatgccagtcaccgcacaaggcactgggtatatggtatccccaaacaagagacataatcccggtccttaggtagtgctagtgtggtctgtaatatcttactaaggcctttggtatacgacccagagataacacgatgcgtattttagttttgcaaagaaggggtttggtctctgtgccagctctataattgttttgctacgattccactgaaactcttcgatcaagctactttatgtaaatcacttcattgttttaaaggaataaacttgattatattgtttttttatttggcataactgtgattcttttgggacaattactgtacacattaaggtgtatgtcagatattcatattgacccaaatgtgtaatattccagttttctctgcataagtaattaaaatatacttaaaaattaatagttttatctgggtacaaataaacaggtgcctgaactagttcacagacaaggaaacttctatgtaaaaatcactatgatttctgaattgctatgtgaaactacagatctttggaacactgtttaggtagggtgttaagacttacacagtacctcgtttctacacagagaaagaaatggccatacttcaggaactgcagtgcttatgaggggatatttaggcctcttgaatttttgatgtagatgggcatttttttaaggtagtggttaattacctttatgtgaactttgaatggtttaacaaaagatttgtttttgtagagattttaaagggggagaattctagaaataaatgttacctaattattacagccttaaagataaaaatccttgttgaagttttttaaaaaaaagctaaattacatagacttaggcattaacatgtttgtggaagaatatagcagacgtatattgtatcatttgagtgaatgttcccaagtaggcattctaggctctatttaactgagtcacactgcataggaatttagaacctaacttttataggttatcaaaactgttgtcaccattgcacaattttgtcctaatatatacatagaaactttgtggggcatgttaagttacagtttgcacaagttcatctcatttgtattccattgattttttttttcttctaaacattttttcttcaaacagtatataactttttttaggggatttttttttagacagcaaaaactatctgacgatttccatttgtcaaaaagtaatggtttcttgataattgtgtagtaatgttttttagaacccagcagttaccttaaagctgaatttatatttagtaacttctgtgttaatactggatagcatgaattctgcattgagaacctgaatagctgtcataaaatgaaactttctttctaaagaaagatactcacatgagttcttgaagaatagtcataactagattaagatctgtgttttagtttaatagtttgaagtgcctgtttgggataatgataggtaatttagatgaatttaggggaaaaaaagttatctgcagaaatgttgagggcccatctctccccccacacccccacagagctaactgggttacagtgttttatccgaaagtttccaattccactgtcttgtgttttcatgttgaaaatacttttgcatttttcctttgagtgccaatttcttactagtactatttcttaatgtaacatgtttacctggaatgtattttaactatttttgtatagtgtaaactgaaacatgcacattttgtacattgtgctttcttttgtgggacatatgcagtgtgatccagttgttttccatcatttggttgcgctgacctaggaatgttggtcatatcaaacattaaaaatgaccactcttttaattgaaattaacttttaaatgtttataggagtatgtgctgtgaagtgatctaaaatttgtaatatttttgtcatgaactgtactactcctaattattgtaatgtaataaaaatagttacagtgactaaaaaaaaagtgtgtatttattcatgcaaatttgaactgtttgccccgaaatggatatggaatactttataagccatagacactatagtataccagtgaatcttttatgcagcttgttagaagtatccttttattttctaaaaggtgctgtggatattatgtaaaggcgtgtttgcttaaacaattttccatatttagaagtagatgcaaaacaaatctgcctttatgacaaaaaaataggataacattatttatttatttccttttatcaataaggtaattgatacacaacaggtgacttggttttaggcccaaaggtagcagcagcaacattaataatggaaataattgaatagttagttatgtatgttaatgccagtcaccagcaggctatttcaaggtcagaagtaatgactccatacatattatttatttctataactacatttaaatcattaccagg

SEQ ID NO: 278435 - DNA, 679 bp, Homo sapiens
ttcctaggcggcggccgcggcggcggaggcagcagcggcggcggcagtggcggcggcgaaggtggcggcggctcggccagtactcccggcccccgccatttcggactgggagcgagcgcggcgcaggcactgaaggcggcggcggggccagaggctcagcggctcccaggtgcgggagagaggcctgctgaaaatgactgaatataaacttgtggtagttggagctggtggcgtaggcaagagtgccttgacgatacagctaattcagaatcattttgtggacgaatatgatccaacaatagaggtgttattaagcagtatgtaaaaagtccttacaatacttaatacattaagaaaacatacaatttcaagaggaaatccccgagtaatacattattgacattttcagcagttctagttatattgagaagagcatctcatggaattggcagaatgaagatggagattaaatgagatgatgtttgtaatatgcttatgacagtatctggcatataagtaagggctcagtaaatgttgactgctgtaattactattaatagtaatatgattacctttagtaaaagttattagtttctttaggttttttgtttactacaatatagtaaacaaaatctatacttggaatgtatatattgttttgttttgatacatggaatat

SEQ ID NO: 278436 - DNA, 5081 bp, Homo sapiens
  misc_feature (5072)..(5072): n is a, c, g, or t
ttcctaggcggcggccgcggcggcggaggcagcagcggcggcggcagtggcggcggcgaaggtggcggcggctcggccagtactcccggcccccgccatttcggactgggagcgagcgcggcgcaggcactgaaggcggcggcggggccagaggctcagcggctcccaggtgcgggagagaggcctgctgaaaatgactgaatataaacttgtggtagttggagctggtggcgtaggcaagagtgccttgacgatacagctaattcagaatcattttgtggacgaatatgatccaacaatagaggattcctacaggaagcaagtagtaattgatggagaaacctgtctcttggatattctcgacacagcaggtcaagaggagtacagtgcaatgagggaccagtacatgaggactggggagggctttctttgtgtatttgccataaataatactaaatcatttgaagatattcaccattatagagaacaaattaaaagagttaaggactctgaagatgtacctatggtcctagtaggaaataaatgtgatttgccttctagaacagtagacacaaaacaggctcaggacttagcaagaagttatggaattccttttattgaaacatcagcaaagacaagacagggtgttgatgatgccttctatacattagttcgagaaattcgaaaacataaagaaaagatgagcaaagatggtaaaaagaagaaaaagaagtcaaagacaaagtgtgtaattatgtaaatacaatttgtacttttttcttaaggcatactagtacaagtggtaatttttgtacattacactaaattattagcatttgttttagcattacctaatttttttcctgctccatgcagactgttagcttttaccttaaatgcttattttaaaatgacagtggaagtttttttttcctcgaagtgccagtattcccagagttttggtttttgaactagcaatgcctgtgaaaaagaaactgaatacctaagatttctgtcttggggtttttggtgcatgcagttgattacttcttatttttcttaccaattgtgaatgttggtgtgaaacaaattaatgaagcttttgaatcatccctattctgtgttttatctagtcacataaatggattaattactaatttcagttgagaccttctaattggtttttactgaaacattgagggaacacaaatttatgggcttcctgatgatgattcttctaggcatcatgtcctatagtttgtcatccctgatgaatgtaaagttacactgttcacaaaggttttgtctcctttccactgctattagtcatggtcactctccccaaaatattatattttttctataaaaagaaaaaaatggaaaaaaattacaaggcaatggaaactattataaggccatttccttttcacattagataaattactataaagactcctaatagctttttcctgttaaggcagacccagtatgaatgggattattatagcaaccattttggggctatatttacatgctactaaatttttataataattgaaaagattttaacaagtataaaaaaattctcataggaattaaatgtagtctccctgtgtcagactgctctttcatagtataactttaaatcttttcttcaacttgagtctttgaagatagttttaattctgcttgtgacattaaaagattatttgggccagttatagcttattaggtgttgaagagaccaaggttgcaagccaggccctgtgtgaaccttgagctttcatagagagtttcacagcatggactgtgtgccccacggtcatccgagtggttgtacgatgcattggttagtcaaaaatggggagggactagggcagtttggatagctcaacaagatacaatctcactctgtggtggtcctgctgacaaatcaagagcattgcttttgtttcttaagaaaacaaactcttttttaaaaattacttttaaatattaactcaaaagttgagattttggggtggtggtgtgccaagacattaattttttttttaaacaatgaagtgaaaaagttttacaatctctaggtttggctagttctcttaacactggttaaattaacattgcataaacacttttcaagtctgatccatatttaataatgctttaaaataaaaataaaaacaatccttttgataaatttaaaatgttacttattttaaaataaatgaagtgagatggcatggtgaggtgaaagtatcactggactaggttgttggtgacttaggttctagataggtgtcttttaggactctgattttgaggacatcacttactatccatttcttcatgttaaaagaagtcatctcaaactcttagttttttttttttacactatgtgatttatattccatttacataaggatacacttatttgtcaagctcagcacaatctgtaaatttttaacctatgttacaccatcttcagtgccagtcttgggcaaaattgtgcaagaggtgaagtttatatttgaatatccattctcgttttaggactcttcttccatattagtgtcatcttgcctccctaccttccacatgccccatgacttgatgcagttttaatacttgtaattcccctaaccataagatttactgctgctgtggatatctccatgaagttttcccactgagtcacatcagaaatgccctacatcttattttcctcagggctcaagagaatctgacagataccataaagggatttgacctaatcactaattttcaggtggtggctgatgctttgaacatctctttgctgcccaatccattagcgacagtaggatttttcaaccctggtatgaatagacagaaccctatccagtggaaggagaatttaataaagatagtgcagaaagaattccttaggtaatctataactaggactactcctggtaacagtaatacattccattgttttagtaaccagaaatcttcatgcaatgaaaaatactttaattcatgaagcttacttttttttttttggtgtcagagtctcgctcttgtcacccaggctggaatgcagtggcgccatctcagctcactgcaaccttccatcttcccaggttcaagcgattctcgtgcctcggcctcctgagtagctgggattacaggcgtgtgcactacactcaactaatttttgtatttttaggagagacggggtttcacctgttggccaggctggtctcgaactcctgacctcaagtgattcacccaccttggcctcataaacctgttttgcagaactcatttattcagcaaatatttattgagtgcctaccagatgccagtcaccgcacaaggcactgggtatatggtatccccaaacaagagacataatcccggtccttaggtagtgctagtgtggtctgtaatatcttactaaggcctttggtatacgacccagagataacacgatgcgtattttagttttgcaaagaaggggtttggtctctgtgccagctctataattgttttgctacgattccactgaaactcttcgatcaagctactttatgtaaatcacttcattgttttaaaggaataaacttgattatattgtttttttatttggcataactgtgattcttttgggacaattactgtacacattaaggtgtatgtcagatattcatattgacccaaatgtgtaatattccagttttctctgcataagtaattaaaatatacttaaaaattaatagttttatctgggtacaaataaacaggtgcctgaactagttcacagacaaggaaacttctatgtaaaaatcactatgatttctgaattgctatgtgaaactacagatctttggaacactgtttaggtagggtgttaagacttacacagtacctcgtttctacacagagaaagaaatggccatacttcaggaactgcagtgcttatgaggggatatttaggcctcttgaatttttgatgtagatgggcatttttttaaggtagtggttaattacctttatgtgaactttgaatggtttaacaaaagatttgtttttgtagagattttaaagggggagaattctagaaataaatgttacctaattattacagccttaaagataaaaatccttgttgaagttttttaaaaaaaagctaaattacatagacttaggcattaacatgtttgtggaagaatatagcagacgtatattgtatcatttgagtgaatgttcccaagtaggcattctaggctctatttaactgagtcacactgcataggaatttagaacctaacttttataggttatcaaaactgttgtcaccattgcacaattttgtcctaatatatacatagaaactttgtggggcatgttaagttacagtttgcacaagttcatctcatttgtattccattgattttttttttcttctaaacattttttcttcaaacagtatataactttttttaggggatttttttttagacagcaaaaactatctgacgatttccatttgtcaaaaagtaatggtttcttgataattgtgtagtaatgttttttagaacccagcagttaccttaaagctgaatttatatttagtaacttctgtgttaatactggatagcatgaattctgcattgagaacctgaatagctgtcataaaatgaaactttctttctaaagaaagatactcacatgagttcttgaagaatagtcataactagattaagatctgtgttttagtttaatagtttgaagtgcctgtttgggataatgataggtaatttagatgaatttaggggaaaaaaagttatctgcagaaatgttgagggcccatctctccccccacacccccacagagctaactgggttacagtgttttatccgaaagtttccaattccactgtcttgtgttttcatgttgaaaatacttttgcatttttcctttgagtgccaatttcttactagtactatttcttaatgtaacatgtttacctggaatgtattttaactatttttgtatagtgtaaactgattgggatcctctagancacctccat

SEQ ID NO: 278437 - DNA, 5260 bp, Homo sapiens
ttcctaggcggcggccgcggcggcggaggcagcagcggcggcggcagtggcggcggcgaaggtggcggcggctcggccagtactcccggcccccgccatttcggactgggagcgagcgcggcgcaggcactgaaggcggcggcggggccagaggctcagcggctcccaggtgcgggagagaggcctgctgaaaatgactgaatataaacttgtggtagttggagctggtggcgtaggcaagagtgccttgacgatacagctaattcagaatcattttgtggacgaatatgatccaacaatagaggattcctacaggaagcaagtagtaattgatggagaaacctgtctcttggatattctcgacacagcaggtcaagaggagtacagtgcaatgagggaccagtacatgaggactggggagggctttctttgtgtatttgccataaataatactaaatcatttgaagatattcaccattatagagaacaaattaaaagagttaaggactctgaagatgtacctatggtcctagtaggaaataaatgtgatttgccttctagaacagtagacacaaaacaggctcaggacttagcaagaagttatggaattccttttattgaaacatcagcaaagacaagacagggtgttgatgatgccttctatacattagttcgagaaattcgaaaacataaagaaaagatgagcaaagatggtaaaaagaagaaaaagaagtcaaagacaaagtgtgtaattatgtaaatacaatttgtacttttttcttaaggcatactagtacaagtggtaatttttgtacattacactaaattattagcatttgttttagcattacctaatttttttcctgctccatgcagactgttagcttttaccttaaatgcttattttaaaatgacagtggaagtttttttttcctcgaagtgccagtattcccagagttttggtttttgaactagcaatgcctgtgaaaaagaaactgaatacctaagatttctgtcttggggtttttggtgcatgcagttgattacttcttatttttcttaccaattgtgaatgttggtgtgaaacaaattaatgaagcttttgaatcatccctattctgtgttttatctagtcacataaatggattaattactaatttcagttgagaccttctaattggtttttactgaaacattgagggaacacaaatttatgggcttcctgatgatgattcttctaggcatcatgtcctatagtttgtcatccctgatgaatgtaaagttacactgttcacaaaggttttgtctcctttccactgctattagtcatggtcactctccccaaaatattatattttttctataaaaagaaaaaaatggaaaaaaattacaaggcaatggaaactattataaggccatttccttttcacattagataaattactataaagactcctaatagctttttcctgttaaggcagacccagtatgaatgggattattatagcaaccattttggggctatatttacatgctactaaatttttataataattgaaaagattttaacaagtataaaaaaattctcataggaattaaatgtagtctccctgtgtcagactgctctttcatagtataactttaaatcttttcttcaacttgagtctttgaagatagttttaattctgcttgtgacattaaaagattatttgggccagttatagcttattaggtgttgaagagaccaaggttgcaagccaggccctgtgtgaaccttgagctttcatagagagtttcacagcatggactgtgtgccccacggtcatccgagtggttgtacgatgcattggttagtcaaaaatggggagggactagggcagtttggatagctcaacaagatacaatctcactctgtggtggtcctgctgacaaatcaagagcattgcttttgtttcttaagaaaacaaactcttttttaaaaattacttttaaatattaactcaaaagttgagattttggggtggtggtgtgccaagacattaattttttttttaaacaatgaagtgaaaaagttttacaatctctaggtttggctagttctcttaacactggttaaattaacattgcataaacacttttcaagtctgatccatatttaataatgctttaaaataaaaataaaaacaatccttttgataaatttaaaatgttacttattttaaaataaatgaagtgagatggcatggtgaggtgaaagtatcactggactaggttgttggtgacttaggttctagataggtgtcttttaggactctgattttgaggacatcacttactatccatttcttcatgttaaaagaagtcatctcaaactcttagttttttttttttacactatgtgatttatattccatttacataaggatacacttatttgtcaagctcagcacaatctgtaaatttttaacctatgttacaccatcttcagtgccagtcttgggcaaaattgtgcaagaggtgaagtttatatttgaatatccattctcgttttaggactcttcttccatattagtgtcatcttgcctccctaccttccacatgccccatgacttgatgcagttttaatacttgtaattcccctaaccataagatttactgctgctgtggatatctccatgaagttttcccactgagtcacatcagaaatgccctacatcttattttcctcagggctcaagagaatctgacagataccataaagggatttgacctaatcactaattttcaggtggtggctgatgctttgaacatctctttgctgcccaatccattagcgacagtaggatttttcaaccctggtatgaatagacagaaccctatccagtggaaggagaatttaataaagatagtgcagaaagaattccttaggtaatctataactaggactactcctggtaacagtaatacattccattgttttagtaaccagaaatcttcatgcaatgaaaaatactttaattcatgaagcttacttttttttttttggtgtcagagtctcgctcttgtcacccaggctggaatgcagtggcgccatctcagctcactgcaaccttccatcttcccaggttcaagcgattctcgtgcctcggcctcctgagtagctgggattacaggcgtgtgcactacactcaactaatttttgtatttttaggagagacggggtttcacctgttggccaggctggtctcgaactcctgacctcaagtgattcacccaccttggcctcataaacctgttttgcagaactcatttattcagcaaatatttattgagtgcctaccagatgccagtcaccgcacaaggcactgggtatatggtatccccaaacaagagacataatcccggtccttaggtagtgctagtgtggtctgtaatatcttactaaggcctttggtatacgacccagagataacacgatgcgtattttagttttgcaaagaaggggtttggtctctgtgccagctctataattgttttgctacgattccactgaaactcttcgatcaagctactttatgtaaatcacttcattgttttaaaggaataaacttgattatattgtttttttatttggcataactgtgattcttttgggacaattactgtacacattaaggtgtatgtcagatattcatattgacccaaatgtgtaatattccagttttctctgcataagtaattaaaatatacttaaaaattaatagttttatctgggtacaaataaacaggtgcctgaactagttcacagacaaggaaacttctatgtaaaaatcactatgatttctgaattgctatgtgaaactacagatctttggaacactgtttaggtagggtgttaagacttacacagtacctcgtttctacacagagaaagaaatggccatacttcaggaactgcagtgcttatgaggggatatttaggcctcttgaatttttgatgtagatgggcatttttttaaggtagtggttaattacctttatgtgaactttgaatggtttaacaaaagatttgtttttgtagagattttaaagggggagaattctagaaataaatgttacctaattattacagccttaaagataaaaatccttgttgaagttttttaaaaaaaagctaaattacatagacttaggcattaacatgtttgtggaagaatatagcagacgtatattgtatcatttgagtgaatgttcccaagtaggcattctaggctctatttaactgagtcacactgcataggaatttagaacctaacttttataggttatcaaaactgttgtcaccattgcacaattttgtcctaatatatacatagaaactttgtggggcatgttaagttacagtttgcacaagttcatctcatttgtattccattgattttttttttcttctaaacattttttcttcaaacagtatataactttttttaggggatttttttttagacagcaaaaactatctgacgatttccatttgtcattaccttaaagctgaatttatatttagtaacttctgtgttaatactggatagcatgaattctgcattgagaacctgaatagctgtcataaaatgaaactttctttctaaagaaagatactcacatgagttcttgaagaatagtcataactagattaagatctgtgttttagtttaatagtttgaagtgcctgtttgggataatgataggtaatttagatgaatttaggggaaaaaaagttatctgcagaaatgttgagggcccatctctccccccacacccccacagagctaactgggttacagtgttttatccgaaagtttccaattccactgtcttgtgttttcatgttgaaaatacttttgcatttttcctttgagtgccaatttcttactagtactatttcttaatgtaacatgtttacctggaatgtattttaactatttttgtatagtgtaaactgaaacatgcacattttgtacattgtgctttcttttgtgggacatatgcagtgtgatccagttgttttccatcatttggttgcgctgacctaggaatgttggtcatatcaaacattaaaaatgaccactcttttaattgaaattaacttttaaatgtttataggagtatgtgctgtgaagtgatctaaaatttgtaatatttttgtcatgaactgtactactcctaattattgtaatgtaataaaaatagttacagtgac

SEQ ID NO: 278438 - DNA, 4718 bp, Homo sapiens
  misc_feature (4700)..(4700): n is a, c, g, or t
  misc_feature (4714)..(4714): n is a, c, g, or t
ttcctaggcggcggccgcggcggcggaggcagcagcggcggcggcagtggcggcggcgaaggtggcggcggctcggccagtactcccggcccccgccatttcggactgggagcgagcgcggcgcaggcactgaaggcggcggcggggccagaggctcagcggctcccaggtgcgggagagaggcctgctgaaaatgactgaatataaacttgtggtagttggagctggtggcgtaggcaagagtgccttgacgatacagctaattcagaatcattttgtggacgaatatgatccaacaatagaggattcctacaggaagcaagtagtaattgatggagaaacctgtctcttggatattctcgacacagcaggtcaagaggagtacagtgcaatgagggaccagtacatgaggactggggagggctttctttgtgtatttgccataaataatactaaatcatttgaagatattcaccattatagagaacaaattaaaagagttaaggactctgaagatgtacctatggtcctagtaggaaataaatgtgatttgccttctagaacagtagacacaaaacaggctcaggacttagcaagaagttatggaattccttttattgaaacatcagcaaagacaagacagggtgttgatgatgccttctatacattagttcgagaaattcgaaaacataaagaaaagatgagcaaagatggtaaaaagaagaaaaagaagtcaaagacaaagtgtgtaattatgtaaatacaatttgtacttttttcttaaggcatactagtacaagtggtaatttttgtacattacactaaattattagcatttgttttagcattacctaatttttttcctgctccatgcagactgttagcttttaccttaaatgcttattttaaaatgacagtggaagtttttttttcctcgaagtgccagtattcccagagttttggtttttgaactagcaatgcctgtgaaaaagaaactgaatacctaagatttctgtcttggggtttttggtgcatgcagttgattacttcttatttttcttaccaattgtgaatgttggtgtgaaacaaattaatgaagcttttgaatcatccctattctgtgttttatctagtcacataaatggattaattactaatttcagttgagaccttctaattggtttttactgaaacattgagggaacacaaatttatgggcttcctgatgatgattcttctaggcatcatgtcctatagtttgtcatccctgatgaatgtaaagttacactgttcacaaaggttttgtctcctttccactgctattagtcatggtcactctccccaaaatattatattttttctataaaaagaaaaaaatggaaaaaaattacaaggcaatggaaactattataaggccatttccttttcacattagataaattactataaagactcctaatagctttttcctgttaaggcagacccagtatgaatgggattattatagcaaccattttggggctatatttacatgctactaaatttttataataattgaaaagattttaacaagtataaaaaaattctcataggaattaaatgtagtctccctgtgtcagactgctctttcatagtataactttaaatcttttcttcaacttgagtctttgaagatagttttaattctgcttgtgacattaaaagattatttgggccagttatagcttattaggtgttgaagagaccaaggttgcaagccaggccctgtgtgaaccttgagctttcatagagagtttcacagcatggactgtgtgccccacggtcatccgagtggttgtacgatgcattggttagtcaaaaatggggagggactagggcagtttggatagctcaacaagatacaatctcactctgtggtggtcctgctgacaaatcaagagcattgcttttgtttcttaagaaaacaaactcttttttaaaaattacttttaaatattaactcaaaagttgagattttggggtggtggtgtgccaagacattaattttttttttaaacaatgaagtgaaaaagttttacaatctctaggtttggctagttctcttaacactggttaaattaacattgcataaacacttttcaagtctgatccatatttaataatgctttaaaataaaaataaaaacaatccttttgataaatttaaaatgttacttattttaaaataaatgaagtgagatggcatggtgaggtgaaagtatcactggactaggttgttggtgacttaggttctagataggtgtcttttaggactctgattttgaggacatcacttactatccatttcttcatgttaaaagaagtcatctcaaactcttagttttttttttttacactatgtgatttatattccatttacataaggatacacttatttgtcaagctcagcacaatctgtaaatttttaacctatgttacaccatcttcagtgccagtcttgggcaaaattgtgcaagaggtgaagtttatatttgaatatccattctcgttttaggactcttcttccatattagtgtcatcttgcctccctaccttccacatgccccatgacttgatgcagttttaatacttgtaattcccctaaccataagatttactgctgctgtggatatctccatgaagttttcccactgagtcacatcagaaatgccctacatcttattttcctcagggctcaagagaatctgacagataccataaagggatttgacctaatcactaattttcaggtggtggctgatgctttgaacatctctttgctgcccaatccattagcgacagtaggatttttcaaccctggtatgaatagacagaaccctatccagtggaaggagaatttaataaagatagtgcagaaagaattccttaggtaatctataactaggactactcctggtaacagtaatacattccattgttttagtaaccagaaatcttcatgcaatgaaaaatactttaattcatgaagcttacttttttttttttggtgtcagagtctcgctcttgtcacccaggctggaatgcagtggcgccatctcagctcactgcaaccttccatcttcccaggttcaagcgattctcgtgcctcggcctcctgagtagctgggattacaggcgtgtgcactacactcaactaatttttgtatttttaggagagacggggtttcacctgttggccaggctggtctcgaactcctgacctcaagtgattcacccaccttggcctcataaacctgttttgcagaactcatttattcagcaaatatttattgagtgcctaccagatgccagtcaccgcacaaggcactgggtatatggtatccccaaacaagagacataatcccggtccttaggtagtgctagtgtggtctgtaatatcttactaaggcctttggtatacgacccagagataacacgatgcgtattttagttttgcaaagaaggggtttggtctctgtgccagctctataattgttttgctacgattccactgaaactcttcgatcaagctactttatgtaaatcacttcattgttttaaaggaataaacttgattatattgtttttttatttggcataactgtgattcttttgggacaattactgtacacattaaggtgtatgtcagatattcatattgacccaaatgtgtaatattccagttttctctgcataagtaattaaaatatacttaaaaattaatagttttatctgggtacaaataaacaggtgcctgaactagttcacagacaaggaaacttctatgtaaaaatcactatgatttctgaattgctatgtgaaactacagatctttggaacactgtttaggtagggtgttaagacttacacagtacctcgtttctacacagagaaagaaatggccatacttcaggaactgcagtgcttatgaggggatatttaggcctcttgaatttttgatgtagatgggcatttttttaaggtagtggttaattacctttatgtgaactttgaatggtttaacaaaagatttgtttttgtagagattttaaagggggagaattctagaaataaatgttacctaattattacagccttaaagataaaaatccttgttgaagttttttaaaaaaaagctaaattacatagacttaggcattaacatgtttgtggaagaatatagcagacgtatattgtatcatttgagtgaatgttcccaagtaggcattctaggctctatttaactgagtcacactgcataggaatttagaacctaacttttataggttatcaaaactgttgtcaccattgcacaattttgtcctaatatatacatagaaactttgtggggcatgttaagttacagtttgcacaagttcatctcatttgtattccattgattttttttttcttctaaacattttttcttcaaacagtatataactttttttaggggatttttttttagacagcaaaaactatctgacgatttccatttgtcaaaaagtaatggtttcttgataattgtgtagtaatgttttttagaacccagcagttaccttaaagctgaatttatatttagtaacttctgtgttaatactggatagcatgaattctgcattgagaacctgaatagctgtcatcatactagataagatctgngtttagtttaaagnttga

SEQ ID NO: 278439 - DNA, 894 bp, Homo sapiens
aatcagtttacacaagggatcgacatttcttccattccacactttcacatgacaatatataactttttttaggggatttttttttagacagcaaaaactatctgacgatttccatttgtcaaaaagtaatggtttcttgataattgtgtagtaatgttttttagaacccagcagttaccttaaagctgaatttatatttagtaacttctgtgttaatactggatagcatgaattctgcattgagaacctgaatagctgtcataaaatgaaactttctttctaaagaaagatactcacatgagttcttgaagaatagtcataactagattaagatctgtgttttagtttaatagtttgaagtgcctgtttgggataatgataggtaatttagatgaatttaggggaaaaaaagttatctgcagaaatgttgagggcccatctctccccccacacccccacagagctaactgggttacagtgttttatccgaaagtttccaattccactgtcttgtgttttcatgttgaaaatacttttgcatttttcctttgagtgccaatttcttactagtactatttcttaatgtaacatgtttacctggaatgtattttaactatttttgtatagtgtaaactgaaacatgcacattttgtacattgtgctttcttttgtgggacatatgcagtgtgatccagttgttttccatcatttggttgcgctgacctaggaatgttggtcatatcaaacattaaaaatgaccactcttttaattgaaattaacttttaaatgtttataggagtatgtgctgtgaagtgatctaaaatttgtaatatttttgtcatgaactgtactactcctaattattgtaatgtaataaaaatagttacagtgac

SEQ ID NO: 278440 - DNA, 1140 bp, Homo sapiens
ttcctaggcggcggccgcggcggcggaggcagcagcggcggcggcagtggcggcggcgaaggtggcggcggctcggccagtactcccggcccccgccatttcggactgggagcgagcgcggcgcaggcactgaaggcggcggcggggccagaggctcagcggctcccaggtgcgggagagaggcctgctgaaaatgactgaatataaacttgtggtagttggagctggtggcgtaggcaagagtgccttgacgatacagctaattcagaatcattttgtggacgaatatgatccaacaatagaggattcctacaggaagcaagtagtaattgatggagaaacctgtctcttggatattctcgacacagcaggtcaagaggagtacagtgcaatgagggaccagtacatgaggactggggagggctttctttgtgtatttgccataaataatactaaatcatttgaagatattcaccattatagagaacaaattaaaagagttaaggactctgaagatgtacctatggtcctagtaggaaataaatgtgatttgccttctagaacagtagacacaaaacaggctcaggacttagcaagaagttatggaattccttttattgaaacatcagcaaagacaagacagggtaagtaacactgaaataaatacagatctgttttctgcaaaatcataactgttatgtcatttaatatatcagtttttctctcaattatgctatactaggaaataaaacaatatttagtaaatgtttttgtctcttgagagggcattgcttcttaatccagtgtccatggtactgcttttggctttggtttctttctacattgaaaatttctcttcaattctgagcacatgttaacatttagaattcaagaggtggggatttttttttcccatggttacatatatatatatatatatatatatatataatataaagaacagggcaacaaatttttgcgttttctatttcggtagtacttttaaaccattatgtcatgtttctaggttaaacgttgttgtatttgaagaattttactttggcagaatttttttgaggatgtgtttatttctggagaaaggtctcattaaagaaagacaatacccagaaagccaacaga

SEQ ID NO: 278441 - DNA, 5313 bp, Homo sapiens
ttcctaggcggcggccgcggcggcggaggcagcagcggcggcggcagtggcggcggcgaaggtggcggcggctcggccagtactcccggcccccgccatttcggactgggagcgagcgcggcgcaggcactgaaggcggcggcggggccagaggctcagcggctcccaggtgcgggagagaggcctgctgaaaatgactgaatataaacttgtggtagttggagctggtggcgtaggcaagagtgccttgacgatacagctaattcagaatcattttgtggacgaatatgatccaacaatagaggattcctacaggaagcaagtagtaattgatggagaaacctgtctcttggatattctcgacacagcaggtcaagaggagtacagtgcaatgagggaccagtacatgaggactggggagggctttctttgtgtatttgccataaataatactaaatcatttgaagatattcaccattatagagaacaaattaaaagagttaaggactctgaagatgtacctatggtcctagtaggaaataaatgtgatttgccttctagaacagtagacacaaaacaggctcaggacttagcaagaagttatggaattccttttattgaaacatcagcaaagacaagacagggtgttgatgatgccttctatacattagttcgagaaattcgaaaacataaagaaaagatgagcaaagatggtaaaaagaagaaaaagaagtcaaagacaaagtgtgtaattatgtaaatacaatttgtacttttttcttaaggcatactagtacaagtggtaatttttgtacattacactaaattattagcatttgttttagcattacctaatttttttcctgctccatgcagactgttagcttttaccttaaatgcttattttaaaatgacagtggaagtttttttttcctcgaagtgccagtattcccagagttttggtttttgaactagcaatgcctgtgaaaaagaaactgaatacctaagatttctgtcttggggtttttggtgcatgcagttgattacttcttatttttcttaccaattgtgaatgttggtgtgaaacaaattaatgaagcttttgaatcatccctattctgtgttttatctagtcacataaatggattaattactaatttcagttgagaccttctaattggtttttactgaaacattgagggaacacaaatttatgggcttcctgatgatgattcttctaggcatcatgtcctatagtttgtcatccctgatgaatgtaaagttacactgttcacaaaggttttgtctcctttccactgctattagtcatggtcactctccccaaaatattatattttttctataaaaagaaaaaaatggaaaaaaattacaaggcaatggaaactattataaggccatttccttttcacattagataaattactataaagactcctaatagctttttcctgttaaggcagacccagtatgaatgggattattatagcaaccattttggggctatatttacatgctactaaatttttataataattgaaaagattttaacaagtataaaaaaattctcataggaattaaatgtagtctccctgtgtcagactgctctttcatagtataactttaaatcttttcttcaacttgagtctttgaagatagttttaattctgcttgtgacattaaaagattatttgggccagttatagcttattaggtgttgaagagaccaaggttgcaagccaggccctgtgtgaaccttgagctttcatagagagtttcacagcatggactgtgtgccccacggtcatccgagtggttgtacgatgcattggttagtcaaaaatggggagggactagggcagtttggatagctcaacaagatacaatctcactctgtggtggtcctgctgacaaatcaagagcattgcttttgtttcttaagaaaacaaactcttttttaaaaattacttttaaatattaactcaaaagttgagattttggggtggtggtgtgccaagacattaattttttttttaaacaatgaagtgaaaaagttttacaatctctaggtttggctagttctcttaacactggttaaattaacattgcataaacacttttcaagtctgatccatatttaataatgctttaaaataaaaataaaaacaatccttttgataaatttaaaatgttacttattttaaaataaatgaagtgagatggcatggtgaggtgaaagtatcactggactaggttgttggtgacttaggttctagataggtgtcttttaggactctgattttgaggacatcacttactatccatttcttcatgttaaaagaagtcatctcaaactcttagttttttttttttacactatgtgatttatattccatttacataaggatacacttatttgtcaagctcagcacaatctgtaaatttttaacctatgttacaccatcttcagtgccagtcttgggcaaaattgtgcaagaggtgaagtttatatttgaatatccattctcgttttaggactcttcttccatattagtgtcatcttgcctccctaccttccacatgccccatgacttgatgcagttttaatacttgtaattcccctaaccataagatttactgctgctgtggatatctccatgaagttttcccactgagtcacatcagaaatgccctacatcttattttcctcagggctcaagagaatctgacagataccataaagggatttgacctaatcactaattttcaggtggtggctgatgctttgaacatctctttgctgcccaatccattagcgacagtaggatttttcaaccctggtatgaatagacagaaccctatccagtggaaggagaatttaataaagatagtgcagaaagaattccttaggtaatctataactaggactactcctggtaacagtaatacattccattgttttagtaaccagaaatcttcatgcaatgaaaaatactttaattcatgaagcttacttttttttttttggtgtcagagtctcgctcttgtcacccaggctggaatgcagtggcgccatctcagctcactgcaaccttccatcttcccaggttcaagcgattctcgtgcctcggcctcctgagtagctgggattacaggcgtgtgcactacactcaactaatttttgtatttttaggagagacggggtttcacctgttggccaggctggtctcgaactcctgacctcaagtgattcacccaccttggcctcataaacctgttttgcagaactcatttattcagcaaatatttattgagtgcctaccagatgccagtcaccgcacaaggcactgggtatatggtatccccaaacaagagacataatcccggtccttaggtagtgctagtgtggtctgtaatatcttactaaggcctttggtatacgacccagagataacacgatgcgtattttagttttgcaaagaaggggtttggtctctgtgccagctctataattgttttgctacgattccactgaaactcttcgatcaagctactttatgtaaatcacttcattgttttaaaggaataaacttgattatattgtttttttatttggcataactgtgattcttttgggacaattactgtacacattaaggtgtatgtcagatattcatattgacccaaatgtgtaatattccagttttctctgcataagtaattaaaatatacttaaaaattaatagttttatctgggtacaaataaacaggtgcctgaactagttcacagacaaggaaacttctatgtaaaaatcactatgatttctgaattgctatgtgaaactacagatctttggaacactgtttaggtagggtgttaagacttacacagtacctcgtttctacacagagaaagaaatggccatacttcaggaactgcagtgcttatgaggggatatttaggcctcttgaatttttgatgtagatgggcatttttttaaggtagtggttaattacctttatgtgaactttgaatggtttaacaaaagatttgtttttgtagagattttaaagggggagaattctagaaataaatgttacctaattattacagccttaaagataaaaatccttgttgaagttttttaaaaaaaagctaaattacatagacttaggcattaacatgtttgtggaagaatatagcagacgtatattgtatcatttgagtgaatgttcccaagtaggcattctaggctctatttaactgagtcacactgcataggaatttagaacctaacttttataggttatcaaaactgttgtcaccattgcacaattttgtcctaatatatacatagaaactttgtggggcatgttaagttacagtttgcacaagttcatctcatttgtattccattgattttttttttcttctaaacattttttcttcaaacagtatataactttttttaggggatttttttttagacagcaaaaactatctgacgatttccatttgtcaaaaagtaatggtttcttgataattgtgtagtaatgttttttagaacccagcagttaccttaaagctgaatttatatttagtaacttctgtgttaatactggatagcatgaattctgcattgagaacctgaatagctgtcataaaatgaaactttctttctaaagaaagatactcacatgagttcttgaagaatagtcataactagattaagatctgtgttttagtttaatagtttgaagtgcctgtttgggataatgataggtaatttagatgaatttaggggaaaaaaagttatctgcagaaatgttgagggcccatctctccccccacacccccacagagctaactgggttacagtgttttatccgaaagtttccaattccactgtcttgtgttttcatgttgaaaatacttttgcatttttcctttgagtgccaatttcttactagtactatttcttaatgtaacatgtttacctggaatgtattttaactatttttgtatagtgtaaactgaaacatgcacattttgtacattgtgctttcttttgtgggacatatgcagtgtgatccagttgttttccatcatttggttgcgctgacctaggaatgttggtcatatcaaacattaaaaatgaccactcttttaattgaaattaacttttaaatgtttataggagtatgtgctgtgaagtgatctaaaatttgtaatatttttgtcatgaactgtactactcctaattattgtaatgtaataaaaatagttacagtgac

SEQ ID NO: 278442 - DNA, 841 bp, Homo sapiens
ttcctaggcggcggccgcggcggcggaggcagcagcggcggcggcagtggcggcggcgaaggtggcggcggctcggccagtactcccggcccccgccatttcggactgggagcgagcgcggcgcaggcactgaaggcggcggcggggccagaggctcagcggctcccaggtgcgggagagaggcctgctgaaaatgactgaatataaacttgtggtagttggagctggtggcgtaggcaagagtgccttgacgatacagctaattcagaatcattttgtggacgaatatgatccaacaatagaggattcctacaggaagcaagtagtaattgatggagaaacctgtctcttggatattctcgacacagcaggtcaagaggagtacagtgcaatgagggaccagtacatgaggactggggagggctttctttgtgtatttgccataaataatactaaatcatttgaagatattcaccattatagagaacaaattaaaagagttaaggactctgaagatgtacctatggtcctagtaggaaataaatgtgatttgccttctagaacagtagacacaaaacaggctcaggacttagcaagaagttatggaattccttttattgaaacatcagcaaagacaagacaggagagtggaggatgctttttatacattggtgagggagatccgacaatacagattgaaaaaaatcagcaaagaagaaaagactcctggctgtgtgaaaattaaaaaatgcattataatgtaatctgggtgttgatgatgccttctatacattagttcgagaaattcgaaaacataaagaaaagatgagcaaagatggta

SEQ ID NO: 278443 - DNA, 2051 bp, Homo sapiens
cgcggatagaggagcgggcgccgggaccgggaatccccgagctgcgccttctggggacgcggcccgggctacgtcggggccgtccgtggggagcggggtcctggaggctgcgcggggctgaggcggcctcgatttgggaactgcctgaagatgccggcctaagcctggagtccaggcatggacttccccacaatttcccgatccccttcggggcctccagccatggacttggaggggcccagggacattcttgtgccttcggaggacctcacccctgacagccagtgggaccctatgccaggaggccccggcagcctcagtcggatggaacttgatgagtcaagccttcaggagctggtgcagcagtttgaagctctgccaggcgatctggtgggcccatccccaggtggagccccctgtcccctacacattgccacaggccatggcctggcctcccaggagattgctgatgcccacgggctcctgtctgccgaagctggccgggatgacctgctgggcctcttgcactgcgaggaatgcccgccttcccagactggtcctgaagagcctctagagcctgccccccgactgttgcagccccctgaggacccagatgaggattctgactccccagaatgggtggagggggcctctgctgagcaggagggcagcaggagctcaagcagttccccggaaccctggctggagacggtgcctctagtcacacctgaagagccacccgctggtgcccagagccccgagaccctggcttcctaccctgccccccaggaggtgcctggtccctgtgaccatgaagacctcctggacggtgtcatatttggggccaggtacctggggtccacccagctggtgtcggaacggaacccgcccaccagcacgcgcatggcccaggcccgggaggccatggaccgcgtcaaggcccccgatggggagacccagcccatgacggaggtggacctgttcgtctccaccaagaggatcaaggtcttgacagcggactcccaggaggccatgatggaccacgccctgcataccatctcctacacagccgacatcggctgcgtgctggtgctgatggcgcggcggcggctggcacggaggccggcaccccaggaccacggccgccgcctctacaagatgctctgccacgtattctacgcggaggacgcccagctcatcgcccaggccattggccaggccttcgccgccgcctacagccagttcctacgggaaagcggtattgaccccagccaggtgggcgtgcacccgagcccaggcgcctgccacctccataatggggacctggaccacttctccaacagtgacaactgccgggaggtgcacctcgagaagcggcgaggggagggcctgggcgtggccctggtggagtcgggctggggctccctgctgcccacagccgtcatcgccaacctgctgcacggggggcctgctgagcgctcgggggccctcagcatcggggaccgcctgaccgccatcaacgggaccagcctggtggggctgcccctggctgcgtgccaggccgctgtccgcgagacgaagtcgcagacgtcggtgacactcagcatcgtccactgccctcccgtcaccaccgccatcatccaccggccccacgcccgcgagcagctgggcttctgcgtggaggacggcatcatctgcagcctcctccgtggtggcatcgccgagcgtgggggcatccgcgtcggccaccgcatcattgagatcaatgggcagagtgtggtggccacgccacacgcccgcatcatcgagctgctcaccgaggcctatggcgaggtgcatatcaagacgatgccagctgccacatatcgcctccttacaggccaggagcagcccgtgtacctgtgaccacctcatcccttgcctgccactgtgccttcgcctccatggccccggagccccatcctgggcctgccctggctggccaggaccccagcggttcttggtcctgtatgatttcctaatataaaaacagtaaaagcttatgcatttgg

SEQ ID NO: 278444 - DNA, 934 bp, Homo sapiens
ttgctcagatggggaaactgaggcccagagatagggagggacctgcccccgtcagaggaatgaggccacagtccgtgcagcctcttacagatgtttgcagcctgcctggagagcccggctgtcggcttggcttttggccataaggaagcgatatggctcgggtcagacagcttcgaccccatgcccaccgggcccgagtctgttctctatcacatctgagggggtcttccagaattgagcccctggactccaggtctctggtttatgagagggtaaactgaggcccagagggggctacaacctgccaggctgtccggcagctgagtgaggccaacggcccccgccccacaggagacgaagtcgcagacgtcggtgacactcagcatcgtccactgccctcccgtcaccaccgccatcatccaccggccccacgcccgcgagcagctgggcttctgcgtggaggacggcatcgtgaggccccggcccctggccccggggtgggggggtagggcggccctgagcacggcccctgagcagcccccacctctttcccgtccccctcttttctcccccagatctgcagcctcctccgtggtggcatcgccgagcgtgggggcatccgcgtcggccaccgcatcattgagatcaatgggcagagtgtggtggccacgccacacgcccgcatcatcgagctgctcaccgaggcctatggcgaggtgcatatcaagacgatgccagctgccacatatcgcctccttacaggccaggagcagcccgtgtacctgtgaccacctcatcccttgcctgccactgtgccttcgcctccatggccccggagccccatcctgggcctgccctggctggccaggaccccagcggttcttggtcctgtatgatttcctaatataaaaacagtaaaagcttatgcatttgg

SEQ ID NO: 278445 - DNA, 390 bp, Homo sapiens
tgcctttgcgtcgaccttctgctctgcgtcgaccttctgctctgcgtcgactgcacggggggcctgctgagcgctcgggggccctcagcatcggggaccgcctgaccgccatcaacgggaccagcctggtggggctgcccctggctgcgtgccaggccgctgtccgcgtgagtttcctggtgtggcagggcccccacactcccaggaaggggagctgagtcccagagaggtctcctccctggccaggtctctccagcccagccaggagggacaaagtcgaacttttaagtcctgcccactggtgtgcccttggggaaactgaggcctggagaagggaggccacttgtccagggcacctccctagtaccagagccaggatggaaatgcggg

SEQ ID NO: 278446 - DNA, 2410 bp, Homo sapiens
cgcggatagaggagcgggcgccgggaccgggaatccccgagctgcgccttctggggacgcggcccgggctacgtcggggccgtccgtggggagcggggtcctggaggctgcgcggggctgaggcggcctcgatttgggaactgcctgaagatgccggcctaagcctggagtccaggcatggacttccccacaatttcccgatccccttcggggcctccagccatggacttggaggggcccagggacattcttgtgccttcggaggacctcacccctgacagccagtgggaccctatgccaggaggccccggcagcctcagtcggatggaacttgatgagtcaagccttcaggagctggtgcagcagtttgaagctctgccaggcgatctggtgggcccatccccaggtggagccccctgtcccctacacattgccacaggccatggcctggcctcccaggagattgctgatgcccacgggctcctgtctgccgaagctggccgggatgacctgctgggcctcttgcactgcgaggaatgcccgccttcccagactggtcctgaagagcctctagagcctgccccccgactgttgcagccccctgaggacccagatgaggattctgactccccagaatgggtggagggggcctctgctgagcaggagggcagcaggagctcaagcagttccccggaaccctggctggagacggtgcctctagtcacacctgaagagccacccgctggtgcccagagccccgagaccctggcttcctaccctgccccccaggaggtgcctggtccctgtgaccatgaagacctcctggacggtgtcatatttggggccaggtacctggggtccacccagctggtgtcggaacggaacccgcccaccagcacgcgcatggcccaggcccgggaggccatggaccgcgtcaaggcccccgatggggagacccagcccatgacggaggtggacctgttcgtctccaccaagaggatcaaggtcttgacagcggactcccaggaggccatgatggaccacgccctgcataccatctcctacacagccgacatcggctgcgtgctggtgctgatggcgcggcggcggctggcacggaggccggcaccccaggaccacggccgccgcctctacaagatgctctgccacgtattctacgcggaggacgcccagctcatcgcccaggccattggccaggccttcgccgccgcctacagccagttcctacgggaaagcggtattgaccccagccaggtgggcgtgcacccgagcccaggcgcctgccacctccataatggggacctggaccacttctccaacagtgacaactgccgggaggtgcacctcgagaagcggcgaggggagggcctgggcgtggccctggtggagtcgggctggggctccctgctgcccacagccgtcatcgccaacctgctgcacggggggcctgctgagcgctcgggggccctcagcatcggggaccgcctgaccgccatcaacgggaccagcctggtggggctgcccctggctgcgtgccaggccgctgtccgcgagacgaagtcgcagacgtcggtgacactcagcatcgtccactgccctcccgtcaccaccgccatcatccaccggccccacgcccgcgagcagctgggcttctgcgtggaggacggcatcgtgaggccccggcccctggccccggggtgggggggtagggcggccctgagcacggcccctgagcagcccccacctctttcccgtccccctcttttctcccccagatctgcagcctcctccgtggtggcatcgccgagcgtgggggcatccgcgtcggccaccgcatcattgagatcaatgggcagagtgtggtggccacgccacacgcccgcatcatcgagctgctcaccgaggcctatggcgaggtgcatatcaagacgatgccagctgccacatatcgcctccttacaggccaggagcagcccgtgtacctgtgaccacctcatcccttgcctgccactgtgccttcgcctccatggccccggagccccatcctgggcctgccctggctggccaggaccccagcggttcttggtcctgtatgatttcctaatataaaaacagtaaaagcttatgcatttggcaaagtctcggatcagggtctacgggaccgaggaccttgtccttcctggaagccactagaagccggtgctgtgaaaatactctgtttattaaagaccaggcggagggaggtaaggttgtgggttctgtatgggaaactgagtcccagccccagggagggagaaggaggacggaccagctggcagctctgcttgaagtttcaaggtaatgggtctgaccccagttattaagcttttttatttggagggactactca

SEQ ID NO: 278447 - DNA, 1964 bp, Homo sapiens
aaggcctgggtaaaatcggccgagggcggggctgaggcggctcgatttgggaactgcctgaagatgccggcctaagcctggagtccaggcatggacttccccacaatttcccgatccccttcggggcctccagccatggacttggaggggcccagggacattcttgtgccttcggaggacctcacccctgacagccagtgggaccctatgccaggaggccccggcagcctcagtcggatggaacttgatgagtcaagccttcaggagctggtgcagcagtttgaagctctgccaggcgatctggtgggcccatccccaggtggagccccctgtcccctacacattgccacaggccatggcctggcctcccaggagattgctgatgcccacgggctcctgtctgccgaagctggccgggatgacctgctgggcctcttgcactgcgaggaatgcccgccttcccagactggtcctgaagagcctctagagcctgccccccgactgttgcagccccctgaggacccagatgaggattctgactccccagaatgggtggagggggcctctgctgagcaggagggcagcaggagctcaagcagttccccggaaccctggctggagacggtgcctctagtcacacctgaagagccacccgctggtgcccagagccccgagaccctggcttcctaccctgccccccaggaggtgcctggtccctgtgaccatgaagacctcctggacggtgtcatatttggggccaggtacctggggtccacccagctggtgtcggaacggaacccgcccaccagcacgcgcatggcccaggcccgggaggccatggaccgcgtcaaggcccccgatggggagacccagcccatgacggaggtggacctgttcgtctccaccaagaggatcaaggtcttgacagcggactcccaggaggccatgatggaccacgccctgcataccatctcctacacagccgacatcggctgcgtgctggtgctgatggcgcggcggcggctggcacggaggccggcaccccaggaccacggccgccgcctctacaagatgctctgccacgtattctacgcggaggacgcccagctcatcgcccaggccattggccaggccttcgccgccgcctacagccagttcctacgggaaagcggtattgaccccagccaggtgggcgtgcacccgagcccaggcgcctgccacctccataatggggacctggaccacttctccaacagtgacaactgccgggaggtgcacctcgagaagcggcgaggggagggcctgggcgtggccctggtggagtcgggctggggctccctgctgcccacagccgtcatcgccaacctgctgcacggggggcctgctgagcgctcgggggccctcagcatcggggaccgcctgaccgccatcaacgggaccagcctggtggggctgcccctggctgcgtgccaggccgctgtccgcgagacgaagtcgcagacgtcggtgacactcagcatcgtccactgccctcccgtcaccaccgccatcatccaccggccccacgcccgcgagcagctgggcttctgcgtggaggacggcatcatctgcagcctcctccgtggtggcatcgccgagcgtgggggcatccgcgtcggccaccgcatcattgagatcaatgggcagagtgtggtggccacgccacacgcccgcatcatcgagctgctcaccgaggcctatggcgaggtgcatatcaagacgatgccagctgccacatatcgcctccttacaggccaggagcagcccgtgtacctgtgaccacctcatcccttgcctgccactgtgccttcgcctccatggccccggagccccatcctgggcctgccctggctggccaggaccccagcggttcttggtcctgtatgatttcctaatataaaaacagtaaaagcttatgcatttgg

SEQ ID NO: 278448 - DNA, 1874 bp, Homo sapiens
cctccgcctcccagcttcaagcgattctctcgcctcagcctcctgagtaactggaactataggcatacgccaccatacctggctaagaaattaactttaataacattttaattaagctaacatatttaaaatattatttcaacatacaatcaatatttttaatttacttttttatttttttgagacacagtctcaccttgttgcccaggttgcagtgagctgagatcacaccgccgagctccagcctgggcgacagagcgagaccgtgtctcaaaaaagcaggagtgggactgtctggttccggcctgatcatggaattctggggacacggggtgaaggtatctgtgggtgctagatctggctttgaatccagccatggcctggactcactggtttcccacctgcgagtccttgagggatggacagaaggttctagacctgtgagggccaggctgcttggatggttctagaacagtgggctgtgcttcctggctggagagtgctaagccaccagctagaacactgtgtctcccggccatctcggagagcgtagccctggggcagagcctgtgggagtgggcccctgggggccgaccctcttcgctgtcgccctcagtgcctggtccctgtgaccatgaagacctcctggacggtgtcatatttggggccaggtacctggggtccacccagctggtgtcggaacggaacccgcccaccagcacgcgcatggcccaggcccgggaggccatggaccgcgtcaaggcccccgatggggagacccagcccatgacggaggtggacctgttcgtctccaccaagaggatcaaggtcttgacagcggactcccaggaggccatgatggaccacgccctgcataccatctcctacacagccgacatcggctgcgtgctggtgctgatggcgcggcggcggctggcacggaggccggcaccccaggaccacggccgccgcctctacaagatgctctgccacgtattctacgcggaggacgcccagctcatcgcccaggccattggccaggccttcgccgccgcctacagccagttcctacgggaaagcggtattgaccccagccaggtgggcgtgcacccgagcccaggcgcctgccacctccataatggggacctggaccacttctccaacagtgacaactgccgggaggtgcacctcgagaagcggcgaggggagggcctgggcgtggccctggtggagtcgggctggggctccctgctgcccacagccgtcatcgccaacctgctgcacggggggcctgctgagcgctcgggggccctcagcatcggggaccgcctgaccgccatcaacgggaccagcctggtggggctgcccctggctgcgtgccaggccgctgtccgcgagacgaagtcgcagacgtcggtgacactcagcatcgtccactgccctcccgtcaccaccgccatcatccaccggccccacgcccgcgagcagctgggcttctgcgtggaggacggcatcatctgcagcctcctccgtggtggcatcgccgagcgtgggggcatccgcgtcggccaccgcatcattgagatcaatgggcagagtgtggtggccacgccacacgcccgcatcatcgagctgctcaccgaggcctatggcgaggtgcatatcaagacgatgccagctgccacatatcgcctccttacaggccaggagcagcccgtgtacctgtgaccacctcatcccttgcctgccactgtgccttcgcctccatggccccggagccccatcctgggcctgccctggctggccaggaccccagcggttcttggtcctgtatgatttcctaatataaaaacagtaaaagcttatgcatttgg

SEQ ID NO: 278449 - DNA, 679 bp, Homo sapiens
tgcggccgctgcctccccgggacggccgtaccacgcggacggggaggacggggccaggggactgcagggcggctgcaccgcgaatgcacggggggcctgctgagcgctcgggggccctcagcatcggggaccgcctgaccgccatcaacgggaccagcctggtggggctgcccctggctgcgtgccaggccgctgtccgcgagacgaagtcgcagacgtcggtgacactcagcatcgtccactgccctcccgtcaccaccgccatcatccaccggccccacgcccgcgagcagctgggcttctgcgtggaggacggcatcatctgcagcctcctccgtggtggcatcgccgagcgtgggggcatccgcgtcggccaccgcatcattgagatcaatgggcagagtgtggtggccacgccacacgcccgcatcatcgagctgctcaccgaggcctatggcgaggtgcatatcaagacgatgccagctgccacatatcgcctccttacaggccaggagcagcccgtgtacctgtgaccacctcatcccttgcctgccactgtgccttcgcctccatggccccggagccccatcctgggcctgccctggctggccaggaccccagcggttcttggtcctgtatgatttcctaatataaaaacagtaaaagcttatgcatttgg

SEQ ID NO: 278450 - DNA, 2154 bp, Homo sapiens
gtaaaattggaacgatacagagaagattagcatggcccctgcgcaaggatgacacgcaaattcgtgaagcgttccatattttttggaatcttgctccgtcacccaggctggtgtgcagtggtgcgatctctctcggctcgctgcaacctccgcctcctgggttcaggtgattctcccgcctcagctactcatgagactgaggcgggagaatcgtttgagcccgggaagcggaggttgcagtgagctgagatcacaccgccgagctccagcctgggcgacagagcgagaccgtgtctcaaaaaagcaggagtgggactgtctggttccggcctgatcatggaattctggggacacggggtgaaggtatctgtgggtgctagatctggctttgaatccagccatggcctggactcactggtttcccacctgcgagtccttgagggatggacagaaggttctagacctgtgagggccaggctgcttggatggttctagaacagtgggctgtgcttcctggctggagagtgctaagccaccagctagaacactgtgtctcccggccatctcggagagcgtagccctggggcagagcctgtgggagtgggcccctgggggccgaccctcttcgctgtcgccctcagtgcctggtccctgtgaccatgaagacctcctggacggtgtcatatttggggccaggtacctggggtccacccagctggtgtcggaacggaacccgcccaccagcacgcgcatggcccaggcccgggaggccatggaccgcgtcaaggcccccgatggggagacccagcccatgacggaggtggacctgttcgtctccaccaagaggatcaaggtcttgacagcggactcccaggaggccatgatggaccacgccctgcataccatctcctacacagccgacatcggctgcgtgctggtgctgatggcgcggcggcggctggcacggaggccggcaccccaggaccacggccgccgcctctacaagatgctctgccacgtattctacgcggaggacgcccagctcatcgcccaggccattggccaggccttcgccgccgcctacagccagttcctacgggaaagcggtattgaccccagccaggtgggcgtgcacccgagcccaggcgcctgccacctccataatggggacctggaccacttctccaacagtgacaactgccgggaggtgcacctcgagaagcggcgaggggagggcctgggcgtggccctggtggagtcgggctggggctccctgctgcccacagccgtcatcgccaacctgctgcacggggggcctgctgagcgctcgggggccctcagcatcggggaccgcctgaccgccatcaacgggaccagcctggtggggctgcccctggctgcgtgccaggccgctgtccgcgagacgaagtcgcagacgtcggtgacactcagcatcgtccactgccctcccgtcaccaccgccatcatccaccggccccacgcccgcgagcagctgggcttctgcgtggaggacggcatcatctgcagcctcctccgtggtggcatcgccgagcgtgggggcatccgcgtcggccaccgcatcattgagatcaatgggcagagtgtggtggccacgccacacgcccgcatcatcgagctgctcaccgaggcctatggcgaggtgcatatcaagacgatgccagctgccacatatcgcctccttacaggccaggagcagcccgtgtacctgtgaccacctcatcccttgcctgccactgtgccttcgcctccatggccccggagccccatcctgggcctgccctggctggccaggaccccagcggttcttggtcctgtatgatttcctaatataaaaacagtaaaagcttatgcatttggcaaagtctcggatcagggtctacgggaccgaggaccttgtccttcctggaagccactagaagccggtgctgtgaaaatactctgtttattaaagaccaggcggagggaggtaaggttgtgggttctgtatgggaaactgagtcccagccccagggagggagaaggaggacggaccagctggcagctctgcttgaagtttcaaggtaatgggtctgaccccagttattaagcttttttatttggagggactactca

SEQ ID NO: 278451 - DNA, 2139 bp, Homo sapiens
cgcggatagaggagcgggcgccgggaccgggaatccccgagctgcgccttctggggacgcggcccgggctacgtcggggccgtccgtggggagcggggtcctggaggctgcgcggggctgaggcggcctcgatttgggaactgcctgaagatgccggcctaagcctggagtccaggcatggacttccccacaatttcccgatccccttcggggcctccagccatggacttggaggggcccagggacattcttgtgccttcggaggacctcacccctgacagccagtgggaccctatgccaggaggccccggcagcctcagtcggatggaacttgatgagtcaagccttcaggagctggtgcagcagtttgaagctctgccaggcgatctggtgggcccatccccaggtggagccccctgtcccctacacattgccacaggccatggcctggcctcccaggagattgctgatgcccacgggctcctgtctgccgaagctggccgggatgacctgctgggcctcttgcactgcgaggaatgcccgccttcccagactggtcctgaagagcctctagagcctgccccccgactgttgcagccccctgaggacccagatgaggattctgactccccagaatgggtggagggggcctctgctgagcaggagggcagcaggagctcaagcagttccccggaaccctggctggagacggtgcctctagtcacacctgaagagccacccgctggtgcccaggtagtgcccgccccgccctccaggcatcctggactgcctggaaccaagcagggagactcagtcctgcccctcctctatcttcttccagagccccgagaccctggcttcctaccctgccccccaggaggtgcctggtccctgtgaccatgaagacctcctggacggtgtcatatttggggccaggtacctggggtccacccagctggtgtcggaacggaacccgcccaccagcacgcgcatggcccaggcccgggaggccatggaccgcgtcaaggcccccgatggggagacccagcccatgacggaggtggacctgttcgtctccaccaagaggatcaaggtcttgacagcggactcccaggaggccatgatggaccacgccctgcataccatctcctacacagccgacatcggctgcgtgctggtgctgatggcgcggcggcggctggcacggaggccggcaccccaggaccacggccgccgcctctacaagatgctctgccacgtattctacgcggaggacgcccagctcatcgcccaggccattggccaggccttcgccgccgcctacagccagttcctacgggaaagcggtattgaccccagccaggtgggcgtgcacccgagcccaggcgcctgccacctccataatggggacctggaccacttctccaacagtgacaactgccgggaggtgcacctcgagaagcggcgaggggagggcctgggcgtggccctggtggagtcgggctggggctccctgctgcccacagccgtcatcgccaacctgctgcacggggggcctgctgagcgctcgggggccctcagcatcggggaccgcctgaccgccatcaacgggaccagcctggtggggctgcccctggctgcgtgccaggccgctgtccgcgagacgaagtcgcagacgtcggtgacactcagcatcgtccactgccctcccgtcaccaccgccatcatccaccggccccacgcccgcgagcagctgggcttctgcgtggaggacggcatcatctgcagcctcctccgtggtggcatcgccgagcgtgggggcatccgcgtcggccaccgcatcattgagatcaatgggcagagtgtggtggccacgccacacgcccgcatcatcgagctgctcaccgaggcctatggcgaggtgcatatcaagacgatgccagctgccacatatcgcctccttacaggccaggagcagcccgtgtacctgtgaccacctcatcccttgcctgccactgtgccttcgcctccatggccccggagccccatcctgggcctgccctggctggccaggaccccagcggttcttggtcctgtatgatttcctaatataaaaacagtaaaagcttatgcatttgg

SEQ ID NO: 278452 - DNA, 2142 bp, Homo sapiens
cgcggatagaggagcgggcgccgggaccgggaatccccgagctgcgccttctggggacgcggcccgggctacgtcggggccgtccgtggggagcggggtcctggaggctgcgcggggctgaggcggcctcgatttgggaactgcctgaagatgccggcctaagcctggagtccaggcatggacttccccacaatttcccgatccccttcggggcctccagccatggacttggaggggcccagggacattcttgtgccttcggaggacctcacccctgacagccagtgggaccctatgccaggaggccccggcagcctcagtcggatggaacttgatgagtcaagccttcaggagctggtgcagcagtttgaagctctgccaggcgatctggtgggcccatccccaggtggagccccctgtcccctacacattgccacaggccatggcctggcctcccaggagattgctgatgcccacgggctcctgtctgccgaagctggccgggatgacctgctgggcctcttgcactgcgaggaatgcccgccttcccagactggtcctgaagagcctctagagcctgccccccgactgttgcagccccctgaggacccagatgaggattctgactccccagaatgggtggagggggcctctgctgagcaggagggcagcaggagctcaagcagttccccggaaccctggctggagacggtgcctctagtcacacctgaagagccacccgctggtgcccagagccccgagaccctggcttcctaccctgccccccaggaggtgcctggtccctgtgaccatgaagacctcctggacggtgtcatatttggggccaggtacctggggtccacccagctggtgtcggaacggaacccgcccaccagcacgcgcatggcccaggcccgggaggccatggaccgcgtcaaggcccccgatggggagacccagcccatgacggaggtggacctgttcgtctccaccaagaggatcaaggtcttgacagcggactcccaggaggccatgatggaccacgccctgcataccatctcctacacagccgacatcggctgcgtgctggtgctgatggcgcggcggcggctggcacggaggccggcaccccaggaccacggccgccgcctctacaagatgctctgccacgtattctacgcggaggacgcccagctcatcgcccaggccattggccaggccttcgccgccgcctacagccagttcctacgggaaagcggtattgaccccagccaggtgggcgtgcacccgagcccaggcgcctgccacctccataatggggacctggaccacttctccaacagtgacaactgccgggaggtgcacctcgagaagcggcgaggggagggcctgggcgtggccctggtggagtcgggctggggctccctgctgcccacagccgtcatcgccaacctgctgcacggggggcctgctgagcgctcgggggccctcagcatcggggaccgcctgaccgccatcaacgggaccagcctggtggggctgcccctggctgcgtgccaggccgctgtccgcgagacgaagtcgcagacgtcggtgacactcagcatcgtccactgccctcccgtcaccaccgccatcatccaccggccccacgcccgcgagcagctgggcttctgcgtggaggacggcatcatctgcagcctcctccgtggtggcatcgccgagcgtgggggcatccgcgtcggccaccgcatcattgagatcaatgggcagagtgtggtggccacgccacacgcccgcatcatcgagctgctcaccgaggcctatggcgaggtgtgcgggtggtgggtggtggccaggggcgcccccacgtcccccacgagcccaggcctgccctgagccccgttccgcctccactccccaggtgcatatcaagacgatgccagctgccacatatcgcctccttacaggccaggagcagcccgtgtacctgtgaccacctcatcccttgcctgccactgtgccttcgcctccatggccccggagccccatcctgggcctgccctggctggccaggaccccagcggttcttggtcctgtatgatttcctaatataaaaacagtaaaagcttatgcatttgg

SEQ ID NO: 278453 - DNA, 561 bp, Homo sapiens
gctactctatagttgaagagacgggctcagaaacaggcttctgatgagtctgatgccaaccaggtcctgcccagtctctctgtcttctgtcttgaccctgagtgggcctgtctgctggcactgtgtgggggtcactctacagggctcgggtcatggtccccctgtgtttgtttcagaagcacgagttctctgtggacatgacctgtggaggctgtgctgaagctgtctctcgggtcctcaataagcttggaggagttaagtatgacattgacctgcccaacaagaaggtctgcattgaatctgagcacagcatggacactctgcttgcaaccctgaagaaaacaggaaagactgtttcctaccttggccttgagtagcaggggcctggtccccacagcccacaggatggaccaaagggggcaggatgctgatcctcccgctggcttccagacagacctgggacttggcagtcatgccgggtgatggtgttcctgcggagaccctcagttgtcctattccttcctagcttccctgcaataaaatcaagctgcttttgttgga

SEQ ID NO: 278454 - DNA, 941 bp, Homo sapiens
cttctggagctatctgtatccatgtgggggagccctaatgcacacatcttggattagaaactccactgtcctcattgtttcatctgggtgatgaaacacccagattattttgaagcaaattctagacatcatgcccactccctcctgcccagattattttgaagcaaattctagacatcatgcaatcttacctgtacatatttcagtaaccatgtattgtttggaaaggctcctggaaattcagatgcacagtactcagtaagaatcacccaataagccagctttagtccacatgctcaggcagcatgtctttgaagtctgttttaagaggctcctcagtgactgatttgaagccaggcttgggaacctcaaagatagagtgtttattggttttgaagtcaccttgatcatctgactcttggcagatttatttgccatgattttgttcattgcctttccaacctgtaacaggatagagagtgctgttgactgggtatcctggcagccctggaaattccccagaagagggctttggcagtgattggcttagcaaggttaatgcgttccagccaacctaagtataacagacttcatgggagcagtgtgcagggctggacactggggctctagtcctgctcctgcatctgcaccctgcgttttccacctcacccctgccttttagtgcaagactcttagtgcacccctgcgtcacccctgtctcttagtgcatttattgcctttgcaatgtcgctatgtccacaccagatggcacctttgttccatctaactttccatctttcctagatgctgatcctcccgctggcttccagacagacctgggacttggcagtcatgccgggtgatggtgttcctgcggagaccctcagttgtcctattccttcctagcttccctgcaataaaatcaagctgcttttgttgga

SEQ ID NO: 278455 - DNA, 783 bp, Homo sapiens
agtgaaactgtccttttagggatggatggatgatgtcctgttcaaggcggtgcccttctctggcattccctaacacaagcttgacccgaagtaggcgttctgaaaaaggccgacagtcgatggaggccaacgcagcgcccctctcacctcctctctccgtccaggccgggtgaccacgggcccggcccgcagaaaggaggcggcgcggccggcagggatcaggactggagggggcggagcctccctcgcggccgggcccggagtgggaggggcctccgggaccaggcctctagcgcgcactctcggaagcgcagccgaacccgccctccgaatccagagaggcgctgctgacaccgccgccacaccgccgccacaccgccgctgcctcagtcatgccgaagcacgagttctctgtggacatgacctgtggaggctgtgctgaagctgtctctcgggtcctcaataagcttggaggagttaagtatgacattgacctgcccaacaagaaggtctgcattgaatctgagcacagcatggacactctgcttgcaaccctgaagaaaacaggaaagactgtttcctaccttggccttgagtagcaggggcctggtccccacagcccacaggatggaccaaagggggcaggatgctgatcctcccgctggcttccagacagacctgggacttggcagtcatgccgggtgatggtgttcctgcggagaccctcagttgtcctattccttcctagcttccctgcaataaaatcaagctgcttttgttgga

SEQ ID NO: 278456 - DNA, 442 bp, Homo sapiens
ggacccagatgctgcctctgagaatgcggcccttggatgaaagcagaatcacctgggaagcacgagttctctgtggacatgacctgtggaggctgtgctgaagctgtctctcgggtcctcaataagcttggaggagttaagtatgacattgacctgcccaacaagaaggtctgcattgaatctgagcacagcatggacactctgcttgcaaccctgaagaaaacaggaaagactgtttcctaccttggccttgagtagcaggggcctggtccccacagcccacaggatggaccaaagggggcaggatgctgatcctcccgctggcttccagacagacctgggacttggcagtcatgccgggtgatggtgttcctgcggagaccctcagttgtcctattccttcctagcttccctgcaataaaatcaagctgcttttgttgga

SEQ ID NO: 278457 - DNA, 423 bp, Homo sapiens
tagaggaaagggcaagggtggttgtgagtagtaatttagagcctgaactctttcttgctgtaactgggagggtctgtgcttcctctccccataccccatttcctcttcctgcaggagttaagtatgacattgacctgcccaacaagaaggtctgcattgaatctgagcacagcatggacactctgcttgcaaccctgaagaaaacaggaaagactgtttcctaccttggccttgagtagcaggggcctggtccccacagcccacaggatggaccaaagggggcaggatgctgatcctcccgctggcttccagacagacctgggacttggcagtcatgccgggtgatggtgttcctgcggagaccctcagttgtcctattccttcctagcttccctgcaataaaatcaagctgcttttgttgga

SEQ ID NO: 278458 - DNA, 863 bp, Homo sapiens
agtgaaactgtccttttagggatggatggatgatgtcctgttcaaggcggtgcccttctctggcattccctaacacaagcttgacccgaagtaggcgttctgaaaaaggccgacagtcgatggaggccaacgcagcgcccctctcacctcctctctccgtccaggccgggtgaccacgggcccggcccgcagaaaggaggcggcgcggccggcagggatcaggactggagggggcggagcctccctcgcggccgggcccggagtgggaggggcctccgggaccaggcctctagcgcgcactctcggaagcgcagccgaacccgccctccgaatccagagaggcgctgctgacaccgccgccacaccgccgccacaccgccgctgcctcagtcatgccgagcacagtgacaatccagactcagcggtgtttagagacttggaaagagtttgagaagccacttagccactttattttcagaagcacgagttctctgtggacatgacctgtggaggctgtgctgaagctgtctctcgggtcctcaataagcttggaggagttaagtatgacattgacctgcccaacaagaaggtctgcattgaatctgagcacagcatggacactctgcttgcaaccctgaagaaaacaggaaagactgtttcctaccttggccttgagtagcaggggcctggtccccacagcccacaggatggaccaaagggggcaggatgctgatcctcccgctggcttccagacagacctgggacttggcagtcatgccgggtgatggtgttcctgcggagaccctcagttgtcctattccttcctagcttccctgcaataaaatcaagctgcttttgttgga

SEQ ID NO: 278459 - DNA, 684 bp, Homo sapiens
atccttaattaaattaatcccctccccccgcagccgaacccgccctccgaatccagagaggcgctgctgacaccgccgccacaccgccgccacaccgccgctgcctcagtcatgccgaagcacgagttctctgtggacatgacctgtggaggctgtgctgaagctgtctctcgggtcctcaataagcttggaggagttaagtatgacattgacctgcccaacaagaaggtctgcattgaatctgagcacagcatggacactctgcttgcaaccctgaagaaaacaggaaagactgtttcctaccttggccttgagtagcaggggcctggtccccacagcccacaggatggaccaaagggggcaggatgctgatcctcccgctggcttccagacagacctgggacttggcagtcatgccgggtgatggtgttcctgcggagaccctcagttgtcctattccttcctagcttccctgcaataaaatcaagctgcttttgttggaaaaaaaaaaaataaaaagtttttgcttggggccgaaattagagtcactggcccaatcccccctataggggggcgttaaaaatacctggccgggtttacacgggggggactggaaaacctgggggtaccccattaaaggcctggagaccccttttgccaggtggggttgagcccccccctccc

SEQ ID NO: 278460 - DNA, 707 bp, Homo sapiens
agtgaaactgtccttttagggatggatggatgatgtcctgttcaaggcggtgcccttctctggcattccctaacacaagcttgacccgaagtaggcgttctgaaaaaggccgacagtcgatggaggccaacgcagcgcccctctcacctcctctctccgtccaggccgggtgaccacgggcccggcccgcagaaaggaggcggcgcggccggcagggatcaggactggagggggcggagcctccctcgcggccgggcccggagtgggaggggcctccgggaccaggcctctagcgcgcactctcggaagcgcagccgaacccgccctccgaatccagagaggcgctgctgacaccgccgccacaccgccgccacaccgccgctgcctcagtcatgccggagttaagtatgacattgacctgcccaacaagaaggtctgcattgaatctgagcacagcatggacactctgcttgcaaccctgaagaaaacaggaaagactgtttcctaccttggccttgagtagcaggggcctggtccccacagcccacaggatggaccaaagggggcaggatgctgatcctcccgctggcttccagacagacctgggacttggcagtcatgccgggtgatggtgttcctgcggagaccctcagttgtcctattccttcctagcttccctgcaataaaatcaagctgcttttgttgga

SEQ ID NO: 278461 - DNA, 754 bp, Homo sapiens
atccttaattaaattaatcccctccccccgcagccgaacccgccctccgaatccagagaggcgctgctgacaccgccgccacaccgccgccacaccgccgctgcctcagtcatgccgaagcacgagttctctgtggacatgacctgtggaggctgtgctgaagctgtctctcgggtcctcaataagcttggaggagttaagtatgacattgacctgcccaacaagaaggtctgcattgaatctgagcacagcatggacactctgcttgcaaccctgaagaaaacaggaaagactgtttcctaccttggccttgagtagcaggggcctggtccccacagcccacaggatggaccaaagggggcaggatgctgatcctcccgctggcttccagacagacctgggacttggcagtcatgccgggtgatggtgttcctgcggagaccctcagttgtcctattccttcctagcttccctgcaataaaatcaagctgcttttgttggacaataaacatttcagtgagcctgttacaaaacactggccgggctaacactggcgaacctggtcttgcggtacctaactaatgggctgatgtgatccccttataagattctcaggtccttggcaaatgccctattggggggcttccaataaatgggcgcgattaacacattcatagggaaacccggggtgcgcaatttcttctgtggaagaaatcccctttccggtggagattctcgccgcccggccctcttc

SEQ ID NO: 278462 - DNA, 695 bp, Homo sapiens
  misc_feature (528)..(529): n is a, c, g, or t
atccttaattaaattaatcccctccccccgcagccgaacccgccctccgaatccagagaggcgctgctgacaccgccgccacaccgccgccacaccgccgctgcctcagtcatgccgaagcacgagttctctgtggacatgacctgtggaggctgtgctgaagctgtctctcgggtcctcaataagcttggaggagttaagtatgacattgacctgcccaacaagaaggtctgcattgaatctgagcacagcatggacactctgcttgcaaccctgaagaaaacaggaaagactgtttcctaccttggccttgagtagcaggggcctggtccccacagcccacaggatggaccaaagggggcaggatgctgatcctcccgctggcttccagacagacctgggacttggcagtcatgccgggtgatggtgttcctgcggagaccctcagttgtcctattccttcctagcttccctgcaataaaatcaagctgcttttgttggaaaaaaaaaaaaaaaaaaaaaaaaaannaaaaaaaaaaaaaaaaacctcaagggggggccccgtcccaaattccccctatagggaggccgataaaaatttaattggccggcgttttaacaacttcggaactggaaaaaccctggggttacccaactaaatcgctttggaagtccccctttgcccttggcgttcc

SEQ ID NO: 278463 - DNA, 903 bp, Homo sapiens
ggacccagatgctgcctctgagaatgcggcccttggatgaaagcagaatcacctgggaagcacgagttctctgtggacatgacctgtggaggctgtgctgaagctgtctctcgggtcctcaataagcttggaggagttaagtatgacattgacctgcccaacaagaaggtctgcattgaatctgagcacagcatggacactctgcttgcaaccctgaagaaaacaggaaagactgtttcctaccttggccttgagtagcaggggcctggtccccacagcccacaggatggaccaaagggggcaggatgctgatcctcccgctggcttccagacagacctgggacttggcagtcatgccgggtgatggtgttcctgcggagaccctcagttgtcctattccttcctagcttccctgcaataaaatcaagctgcttttgttggaaaaaaaaaaaaaaaaaaaaaaaaaaaagggggggccgtttaaaattttcccggcgagaggggccccaagtttaacgccgttacccgagttttcttgtgttacaaggggtggccccttattagtggagagcggatattaaaagcataggcacatgggacgcgcggtttttaacacggtgcgtgagaacgtggggaaaaacgtgtgtaaccttgggaaaacttttgggagaggagaacctttacttgtctgggggggggaacatatagggggggagaaacttacattaacgaggagaatttaaaggagctctaaggggaacatttattaaagatttttgaaaggggggtaatacggggcgttaaacacattagcgttgaaaattatgcttagacgggcattgaagaaggtttggggataacggggagatatgtaattgtgggaccattttttataccgggatt

SEQ ID NO: 278464 - DNA, 1204 bp, Homo sapiens
agtgaaactgtccttttagggatggatggatgatgtcctgttcaaggcggtgcccttctctggcattccctaacacaagcttgacccgaagtaggcgttctgaaaaaggccgacagtcgatggaggccaacgcagcgcccctctcacctcctctctccgtccaggccgggtgaccacgggcccggcccgcagaaaggaggcggcgcggccggcagggatcaggactggagggggcggagcctccctcgcggccgggcccggagtgggaggggcctccgggaccaggcctctagcgcgcactctcggaagcgcagccgaacccgccctccgaatccagagaggcgctgctgacaccgccgccacaccgccgccacaccgccgctgcctcagtcatgccgaagcacgagttctctgtggacatgacctgtggaggctgtgctgaagctgtctctcgggtcctcaataagcttggaggagttaagtatgacattgacctgcccaacaagaaggtctgcattgaatctgagcacagcatggacactctgcttgcaaccctgaagaaaacaggaaagactgtttcctaccttggccttgagtagcaggggcctggtccccacagcccacaggatggaccaaagggggcagctgagttggagaatggcaacgaagaccatttggcccacatagcctagactgtttactattttgcccttttcagaagaaaattgtctgtccattgttgcgggaagtcacagaccctgaatggagagaccggctgaagccgcggcagaagaacataaattgtgaagatttaatggacatttatcagttcccaaaattaatacttttataatttcttacgcctgtttttactgcagtctcggaacataaagtgtgaagatttcatggacatttatcacttccccaatcaatacccttgtgatttcctatgcttgtctttactttaatctcttaatcctgtcatcttcataagctgaggatgcatgtcacttcaggaccctgtgatgactgcgttaactgtacaaattgtttgtaaagcatatgtgtttgaacaatatgaaatcagtgcaccctgaaaaaagaacagaataacagcaattttcagggaacaagggagataaccataaggtctgactgcctgcggggttgggcagaatagagccatatttttcttctcacagaa

SEQ ID NO: 278465 - DNA, 751 bp, Homo sapiens
agtgaaactgtccttttagggatggatggatgatgtcctgttcaaggcggtgcccttctctggcattccctaacacaagcttgacccgaagtaggcgttctgaaaaaggccgacagtcgatggaggccaacgcagcgcccctctcacctcctctctccgtccaggccgggtgaccacgggcccggcccgcagaaaggaggcggcgcggccggcagggatcaggactggagggggcggagcctccctcgcggccgggcccggagtgggaggggcctccgggaccaggcctctagcgcgcactctcggaagcgcagccgaacccgccctccgaatccagagaggcgctgctgacaccgccgccacaccgccgccacaccgccgctgcctcagtcatgccgaagcacgagttctctgtggacatgacctgtggaggctgtgctgaagctgtctctcgggtcctcaataagcttggaggagttaagtatgacattgacctgcccaacaagaaggtctgcattgaatctgagcacagcatggacactctgcttgcaaccctgaagaaaacaggaaagactgtttcctaccttggccttgagtagcaggggcctggtccccacagcccacaggatggaccaaagggggcagatgctgatcctccccgcttggggcctttttttttttcccccccccccaaggggggggacaacccccccccaggggggggggacccttaagttgtccttattccttg

SEQ ID NO: 278466 - DNA, 1131 bp, Homo sapiens
agtgaaactgtccttttagggatggatggatgatgtcctgttcaaggcggtgcccttctctggcattccctaacacaagcttgacccgaagtaggcgttctgaaaaaggccgacagtcgatggaggccaacgcagcgcccctctcacctcctctctccgtccaggccgggtgaccacgggcccggcccgcagaaaggaggcggcgcggccggcagggatcaggactggagggggcggagcctccctcgcggccgggcccggagtgggaggggcctccgggaccaggcctctagcgcgcactctcggaagcgcagccgaacccgccctccgaatccagagaggcgctgctgacaccgccgccacaccgccgccacaccgccgctgcctcagtcatgccgaagcacgagttctctgtggacatgacctgtggaggctgtgctgaagctgtctctcgggtcctcaataagcttggaggagttaagtatgacattgacctgcccaacaagaaggtctgcattgaatctgagcacagcatggacactctgcttgcaaccctgaagaaaacaggaaagactgtttcctaccttggccttgagtagcaggggcctggtccccacagcccacaggatggaccaaagggggcagaagaaaattgtctgtccattgttgcgggaagtcacagaccctgaatggagagaccggctgaagccgcggcagaagaacataaattgtgaagatttaatggacatttatcagttcccaaaattaatacttttataatttcttacgcctgtttttactgcagtctcggaacataaagtgtgaagatttcatggacatttatcacttccccaatcaatacccttgtgatttcctatgcttgtctttactttaatctcttaatcctgtcatcttcataagctgaggatgcatgtcacttcaggaccctgtgatgactgcgttaactgtacaaattgtttgtaaagcatatgtgtttgaacaatatgaaatcagtgcaccctgaaaaaagaacagaataacagcaattttcagggaacaagggagataaccataaggtctgactgcctgcggggttgggcagaatagagccatatttttcttctcacagaa

SEQ ID NO: 278467 - DNA, 900 bp, Homo sapiens
agtgaaactgtccttttagggatggatggatgatgtcctgttcaaggcggtgcccttctctggcattccctaacacaagcttgacccgaagtaggcgttctgaaaaaggccgacagtcgatggaggccaacgcagcgcccctctcacctcctctctccgtccaggccgggtgaccacgggcccggcccgcagaaaggaggcggcgcggccggcagggatcaggactggagggggcggagcctccctcgcggccgggcccggagtgggaggggcctccgggaccaggcctctagcgcgcactctcggaagcgcagccgaacccgccctccgaatccagagaggcgctgctgacaccgccgccacaccgccgccacaccgccgctgcctcagtcatgccgaagcacgagttctctgtggacatgacctgtggaggctgtgctgaagctgtctctcgggtcctcaataagcttggaggagttaagtatgacattgacctgcccaacaagaaggtctgcattgaatctgagcacagcatggacactctgcttgcaaccctgaagaaaacaggaaagactgtttcgatgctgatcctcccgctggcttccagacagacctgggacttggcagtcatgccgggtgatggtgttcctgcggagaccctcagttgtcctattccttcctagcttccctgcaataaaatcaagctgcttttgttggaaaaaaaaaaaataaaaagtttttgcttggggccgaaattagagtcactggcccaatcccccctataggggggcgttaaaaatacctggccgggtttacacgggggggactggaaaacctgggggtaccccattaaaggcctggagaccccttttgccaggtggggttgagcccccccctccc

SEQ ID NO: 278468 - DNA, 504 bp, Homo sapiens
ctgtcgccctgcacggtgacccgcgtgtgcgaggccttcatggccaggatccgggtggagaggcgctgctgacaccgccgccacaccgccgccacaccgccgctgcctcagtcatgccgaagcacgagttctctgtggacatgacctgtggaggctgtgctgaagctgtctctcgggtcctcaataagcttggaggagttaagtatgacattgacctgcccaacaagaaggtctgcattgaatctgagcacagcatggacactctgcttgcaaccctgaagaaaacaggaaagactgtttcctaccttggccttgagtagcaggggcctggtccccacagcccacaggatggaccaaagggggcaggatgctgatcctcccgctggcttccagacagacctgggacttggcagtcatgccgggtgatggtgttcctgcggagaccctcagttgtcctattccttcctagcttccctgcaataaaatcaagctgcttttgttgga

SEQ ID NO: 278469 - DNA, 502 bp, Homo sapiens
atccttaattaaattaatcccctccccccgcagccgaacccgccctccgaatccagagaggcgctgctgacaccgccgccacaccgccgccacaccgccgctgcctcagtcatgccgaagcacgagttctctgtggacatgacctgtggaggctgtgctgaagctgtctctcgggtcctcaataagcttggaggagttaagtatgacattgacctgcccaacaagaaggtctgcattgaatctgagcacagcatggacactctgcttgcaaccctgaagaaaacaggaaagactgtttcctaccttggccttgagtagcaggggcctggtccccacagcccacaggatggaccaaagggggcaggatgctgatcctcccgctggcttccagacagacctgggacttggcagtcatgccgggtgatggtgttcctgcggagaccctcagttgtcctattccttcctagcttccctgcaataaaatcaagctgcttttgttgga

SEQ ID NO: 278470 - DNA, 963 bp, Homo sapiens
atccttaattaaattaatcccctccccccgcagccgaacccgccctccgaatccagagaggcgctgctgacaccgccgccacaccgccgccacaccgccgctgcctcagtcatgccgaagcacgagttctctgtggacatgacctgtggaggctgtgctgaagctgtctctcgggtcctcaataagcttggaggagttaagtatgacattgacctgcccaacaagaaggtctgcattgaatctgagcacagcatggacactctgcttgcaaccctgaagaaaacaggaaagactgtttcctaccttggccttgagtagcaggggcctggtccccacagcccacaggatggaccaaagggggcaggatgctgatcctcccgctggcttccagacagacctgggacttggcagtcatgccgggtgatggtgttcctgcggagaccctcagttgtcctattccttcctagcttccctgcaataaaatcaagctgcttttgttggaaaaaaaaaaaaaaaaaaaaaaaaaaaagggggggccgtttaaaattttcccggcgagaggggccccaagtttaacgccgttacccgagttttcttgtgttacaaggggtggccccttattagtggagagcggatattaaaagcataggcacatgggacgcgcggtttttaacacggtgcgtgagaacgtggggaaaaacgtgtgtaaccttgggaaaacttttgggagaggagaacctttacttgtctgggggggggaacatatagggggggagaaacttacattaacgaggagaatttaaaggagctctaaggggaacatttattaaagatttttgaaaggggggtaatacggggcgttaaacacattagcgttgaaaattatgcttagacgggcattgaagaaggtttggggataacggggagatatgtaattgtgggaccattttttataccgggatt

SEQ ID NO: 278471 - DNA, 617 bp, Homo sapiens
atccttaattaaattaatcccctccccccgcagccgaacccgccctccgaatccagagaggcgctgctgacaccgccgccacaccgccgccacaccgccgctgcctcagtcatgccgaagcacgagttctctgtggacatgacctgtggaggctgtgctgaagctgtctctcgggtcctcaataagcttggaggagttaagtatgacattgacctgcccaacaagaaggtctgcattgaatctgagcacagcatggacactctgcttgcaaccctgaagaaaacaggaaagactgtttcctaccttggccttgagtagcaggggcctggtccccacagcccacaggatggaccaaagggggcaggatgctgatcctcccgctggcttccagacagacctgggacttggcagtcatgccgggtgatggtgttcctgcggagaccctcagttgtcctattccttcctagcttccctgcaataaaatcaagctgcttttgttggaggagccttaaggctccccaaacaagaaattaaggctgaataataatattactgaaaaaatgtgactttctttagataaacatgcatcatgcaaactctttaagattttaggaaat

SEQ ID NO: 278472 - DNA, 987 bp, Homo sapiens
tttttttttctgttttggttttttaaccttcatttatttcattggttagttaaactactgcagaaatttttggaaagatcgtcctggtgcttctgcaagcgccaaaagcaaaccatggacctggtagttcaggcagaataccattttttaaaataaaccaaagtctgtattttatccttccccattccacagaccgcagcagactgtggaagctggcgaggcccagtagaatcccgcgaccccacagcctcagcgctcagggttccacggtccagtacaggctaaactgacctcgccgacggccgcgcccacttgggcactttctcccgggtcttgttctacggggcgtttgaggatttcttagtctctttcttccctggcactcttcctccgagggccagaagtctgaattactaggcagctaccagccgcttggagcgggaacctgctgtaagagcgaaacgttgccccacttggcggtgtccagggtcagaagtcagtggtggctatactcggaataaggctgacagttcgcagtgagggaaaaacgtgtaaacctttgggcccacgtagctgccccttttcaccctgcccagcagaaacaaagtgaacgctcttcttttctctgtaagctggaaattaccaagggcatacttgagcctaccaggccccgaggaccccatttcaggcccaaatgtgccagttttacccttgctgagagtgctcactgcagtcttcatcaaccaacttctaagtgggtgtcaatgaggagcagcctcacgctttttctgcagagagaaggtagagagagatgagggctttcggtgtggccctgtgaccccaggctactatcccaggctatggcacgtcttcgccagaaaagcagcgaccgagttatttccctgttgacaatgcccagcagccgggccctgttattataggggttattagaggggtcgccttcttctctaatggttcctgttcagg

SEQ ID NO: 278473 - DNA, 1114 bp, Homo sapiens
tttttttttctgttttggttttttaaccttcatttatttcattggttagttaaactactgcagaaatttttggaaagatcgtcctggtgcttctgcaagcgccaaaagcaaaccatggacctggtagttcaggcagaataccattttttaaaataaaccaaagtctgtattttatccttccccattccacagaccgcagcagactgtggaagctggcgaggcccagtagaatcccgcgaccccacagcctcagcgctcagggttccacggtccagtacaggctaaactgacctcgccgacggccgcgcccacttgggcactttctcccgggtcttgttctacggggcgtttgaggatttcttagtctctttcttccctggcactcttcctccgagggccagaagtctgaattactaggcagctaccagccgcttggagcgggaacctgctgtaagagcgaaacgttgccccacttggcggtgtccaggtctcgcagtaggctcgggtcacaggagggagggggtaggggttcagctccgccgaaagagttagctaccgtcccctcctttctcggccggagacgttaagagttcccggtgaatgacaccgtccagggtcagaagtcagtggtggctatactcggaataaggctgacagttcgcagtgagggaaaaacgtgtaaacctttgggcccacgtagctgccccttttcaccctgcccagcagaaacaaagtgaacgctcttcttttctctgtaagctggaaattaccaagggcatacttgagcctaccaggccccgaggaccccatttcaggcccaaatgtgccagttttacccttgctgagagtgctcactgcagtcttcatcaaccaacttctaagtgggtgtcaatgaggagcagcctcacgctttttctgcagagagaaggtagagagagatgagggctttcggtgtggccctgtgaccccaggctactatcccaggctatggcacgtcttcgccagaaaagcagcgaccgagttatttccctgttgacaatgcccagcagccgggccctgttattataggggttattagaggggtcgccttcttctctaatggttcctgttcagg

SEQ ID NO: 278474 - DNA, 735 bp, Homo sapiens
tctgagagctgtacagtagtggctgaggtggggtttgcagtgaaggatgtgacacaccccagatggagctgaatgggcgtgggacctcaggtcttggccacagtggcctgctgtgcattgatcctgctacagagtgtccattatcagccaggcgcggtggctcacgcctgtaatccctgcactttgggaggccgaggtagggcggatacctgaggtcgggagttcaagaccagcatgaccaacgcagagaaaccccgtctctactaaaaatacaaaattagccgggcgtggtggcgcatgcttgtagtcccagctactcgggaggctgaggcaggagaatcgcttgaacccgggaggcagaggttgagagctgcacacgactgacgtaaccatggagggggccatgtagggctccagccgcctgcagatctccagggaggcacagtcgatgacaaggaggcccggcccattgctgtaccagacctcagagccgctgttgaccacctccatggccttcactgggtaggggttctgccgtgcgtcttcatccgcgatgctgaacttggacctgttggctgtgtgtgagcacaggtaggagcagctgtcctttggggtgccccgcaccacgggaaacacagccacaagcccatcggcgaggcccgctaagaccaggtcacccttcctgccaacagtgtgaaggaccccaaccctgacagagaccagaccctgggatct

SEQ ID NO: 278475 - DNA, 829 bp, Homo sapiens
gggtcaggtcatgctcagacctgtcggaggcagcaccgggcgtatgtagcatgtctgagtcctcgcagtcggtggagaaaggcacactggaagaacttgctggggagctggggaggcttgagggggacctggcagcctggcggggtggggatgaggagtaggaggacatggagcagtagtcagtgagtgattcctggtggatcaggatctgcgtgcccagctcctcactgtacatgatgctcacgtccgcgatggagtccccctcaggcacctttgggttggccgtgtggctggctgccgggggttccgtgtccaagggccgcacgggaaacatgtccctgagggggctggggaccccgcagaagtaccgggcacacagctggtaggtggtggagtggtacatcaccaaggagttggccttgtcatccaggcaccagacgacctcctcccctctgccctcagagctgcacacgactgacgtaaccatggagggggccatgtagggctccagccgcctgcagatctccagggaggcacagtcgatgacaaggaggcccggcccattgctgtaccagacctcagagccgctgttgaccacctccatggccttcactgggtaggggttctgccgtgcgtcttcatccgcgatgctgaacttggacctgttggctgtgtgtgagcacaggtaggagcagctgtcctttggggtgccccgcaccacgggaaacacagccacaagcccatcggcgaggcccgctaagaccaggtcacccttcctgccaacagtgtgaaggaccccaaccctgacagagaccagaccctgggatct

SEQ ID NO: 278476 - DNA, 619 bp, Homo sapiens
ggcatattgctgctgagccagaatgagctgtaccgccagatcctgctgctgatgcacctgctgccgcaagacctgctgctgctaaagccctgccagtcttcctactgctactgtcaggaggtgctggaccggctcatccaatgcgggctcctggttgctgaggagagttgggctacacagagcagctgttccagttcctgcaggccaccgcccaggaagaagggatcttcgagtgtgcggacccaaagctcgccatcagtgctgtctggaccttcagagacctaggggttctgcagcagacgccgagccctgcaggccccaggctccacctgtcccctacttttgccagcctggacaatcaggaaaaactagaacagttcatccggcagttcatttgtagctagaactgtgaggaggagcctgtgctgagacttctcagccccagaacacagctgtgtcctagagccagaagatggagaggaggctgcaaacccttagctgctctataaatataatcattgaggcttgattgtcccttgccatctcttgctttttcccttctttgatgtgataaacaaggggacgagacgagttgtcttttccccagcccagcagcatc

SEQ ID NO: 278477 - DNA, 872 bp, Homo sapiens
ggcatattgctgctgagccagaatgagctgtaccgccagatcctgctgctgatgcacctgctgccgcaagacctgctgctgctaaagccctgccagtcttcctactgctactgtcaggaggtgctggaccggctcatccaatgcgggctcctggttgctgaggagaccccaggctcccggccagcctgtgacacagggcgacagcgattgagcagaaagctgctgtggaaaccgagtggggactttactgatagtgacagtgatgacttcggagaggctgacggccggtacttcaggctcagccagcagtcacactgcccagatttctttcttttcctctgccgcctgctcagcccgctgctcaaggcctttgcacaggctgccgccttcctccgccagggccagctgcccgatactgagttgggctacacagagcagctgttccagttcctgcaggccaccgcccaggaagaagggatcttcgagtgtgcggacccaaagctcgccatcagtgctgtctggaccttcagagacctaggggttctgcagcagacgccgagccctgcaggccccaggctccacctgtcccctacttttgccagcctggacaatcaggaaaaactagaacagttcatccggcagttcatttgtagctagaactgtgaggaggagcctgtgctgagacttctcagccccagaacacagctgtgtcctagagccagaagatggagaggaggctgcaaacccttagctgctctataaatataatcattgaggcttgattgtcccttgccatctcttgctttttcccttctttgatgtgataaacaaggggacgagacgagttgtcttttccccagcccagcagcatc

SEQ ID NO: 278478 - DNA, 2017 bp, Homo sapiens
atggcgcaaccaaagcaagagagggtggcgcgtgccagacaccaacggtcggaaaccgccagacaccaacggtcggaaaccgccaagacaccaacgctcggaaaccgccagacaccaacggtcggaaaccgccagacaccaacgctcggaatccacgccaggccacgacggagggcgactacctcccttctgaccctgctgctggcgttcggaaaaaacgcagtccggtgtgctctgattggtccaggctctttgacgtcacggactcgacctttgacagagccactaggcgaaaaggagagacgggaagtattttttccgccccgcccggaaagggtggagcacaacgtcgaaagcagccgttgggagcccaggaggcggggcgcctgtgggagccgtggagggaactttcccagtccccgaggcggatccggtgttgcatccttggagcgagctgagagctcgagtacagaacctgctaaggccatcaaacctattgatcggaagtcagtccatcagatttgctctgggccggtggtaccgagtctaagcactgcggtgaaggagttagtagaaaacagtctggatgctggtgccactaatattgatctaaagcttaaggactatggagtggatctcattgaagtttcaggcaatggatgtggggtagaagaagaaaacttcgaaggcttaactctgaaacatcacacatctaagattcaagagtttgccgacctacctcaggttgaaacttttggctttcggggggaagctctgagctcactttgtgcactgagtgatgtcaccatttctacctgccatgtatcggcgaaggttgggactcgactggtgtttgatcactatgggaaaatcatccagaaaaccccctacccccaccccagagggatgacagtcagtgtgaagcagttattttctacgctacctgtgcaccataaagaatttcaaaggaatattaagaagaaacgtgcctgcttccccttcgccttctgccgtgattgtcagtttcctgaggcctccccagccatgcttcctgtacagcctgcagaactgactcctagaagtaccccaccccacccctgctccttggaggacaacgtgatcactgtattcagctctgtcaagaatggtccaggttcttctagatgatctgcacaaatggctcctctcctccttcctgatgtctgccattagcactggaataaagttcctgctgaaaatccacatctcccctgggtccggtgttctggaagtgagagagacaatgtcacacctcaaggagacagctctctagacaggaaggttattcacgtcccatgtcaagtctagctagagttcagagcaattgagaagtgcgattttatctcctgcctttcattctataccctgcttctgaaccatcgtgttcaactgtgaaactcacgctttggtgaccctgactccaaaacttaatacacccaaggtcagccccagtgatctgcttcatagcgaggactttgggtgggtcttcccagggagtagggcaccctcagagaatgtggctttggacttcatcacagctagggtcttttgtgtcacttcagatctaaacttgtaactgtgctagatctgtttctaatgtgacaacatcacaaaccacgagtccagaagcctaatccataatcctacctcctcatgacgaagtctcatgctctgtgctcaacatggttagctgcacaagatgtaaaccaaagcttcactgaaccctcgacccaaatcggtaactcaagtgcatcaatcataaagaacctccccgaactcagtatttatgattatttttgaggcagggtctcactctgtcgccccggctggagtgcagtggcaggatcaggtctccctgcagcccgactcccaggctccagcgatcctcctgcctcagctcttgagtagttgggagtaagagatgcctcccacatcgcctggtaatttgtatttgggagaggggatatttcgccacgtt

SEQ ID NO: 278479 - DNA, 444 bp, Homo sapiens
tgggaggctgaagcaggaggattgcttgagcctgggaggtcaaggctgcagtgagctatgattgcgcccctgcactccagcctgggcagcggagggagaccctgtctgaaaataaaaaaagaggtgggggcctatgaccccccctttaattttggcccaaccttagtaacaggatagtcattgagtagggcaaaagtgatgttatgatgtttttcagcctccaatttacagtctaaaacatgtacgcggtggccctgagctgttgtgtaaatggactcactgccctgaggccaccatgctgcaaggaagcccaagctaaccctaggatgtgccctgagacgacatgaagacgcatccccagccagccttccactaccccatccttcactgccccattctcacccccgcccacctccttactccctccaccccgtcgggtaagag

SEQ ID NO: 278480 - DNA, 953 bp, Homo sapiens
cttgaagccagatcaagcaattgggttccttggatttccgaaatagaccccaatattctgcctttaccccggaggatgcagatgtaccttctctcaggccgatgacctcaggcctccacggtccctggagctctaggaaaggtgggcgcgatctcgcgcccacacccagtgctctgggtcataagcctggatctggaaaaacaaatgcgctttgagaagacggggactccccaggatacccctctctcccctcgtccagcctccagcccacccgattcctccccacatcctccacctccccaggccccacccacctcctccaactcctccggggaaacccaagccctgcagcgcatggaacagaagaactggaaccgacgcttctggaacaaggctatctgagagcagttcttcctggccctcgggttcatgggacggcataactggaaccaatgcttagggcgcaagggtatgtgagagtgggtcttcccgtacaggaagtagaagatcttttgtttgggggcctcgtcgtcctcctccatgtcattggccagatagctgaggacagaaatcaggttgctgctcaggggcaccaccaggagagacctccggctgaggtcagcttcccagagaggaaggtaagggaccgtccctagctcaggactggcacccaccctgcagagagccacgccttcctcaggagggctctgctggacagagacctgatcaagggcatctcccactccttcaggatggagacaaaaacccaactggtgaccaagagtggtggcttaggcctggaatcccagcacactgggaggccgaagcaggaggatcacttgaggccaggagtttgagacaggcctgggcaacatagcaagacccttgtctctattaaaaatataaaaaatacgccagacgtggtggctcatgcctgtaatcccagcactttg

SEQ ID NO: 278481 - DNA, 2240 bp, Homo sapiens
atggcgcaaccaaagcaagagagggtggcgcgtgccagacaccaacggtcggaaaccgccagacaccaacggtcggaaaccgccaagacaccaacgctcggaaaccgccagacaccaacggtcggaaaccgccagacaccaacgctcggaatccacgccaggccacgacggagggcgactacctcccttctgaccctgctgctggcgttcggaaaaaacgcagtccggtgtgctctgattggtccaggctctttgacgtcacggactcgacctttgacagagccactaggcgaaaaggagagacgggaagtattttttccgccccgcccggaaagggtggagcacaacgtcgaaagcagccgttgggagcccaggaggcggggcgcctgtgggagccgtggagggaactttcccagtccccgaggcggatccggtgttgcatccttggagcgagctgagagctcgagagacggggatttagctatgttgcccaagctggtctggaactccggagctcaagcagtccgcccgccttggccccccaaagcgctggaattacaggcgtaatgcactgtgcctggcctttaaaaaaaaattgaggttattttggggacagtagagcgtccagacacatcctaatttgcatagctgcgcagttttaaaaaatgcaatgcatttttacctgttaggtacagaacctgctaaggccatcaaacctattgatcggaagtcagtccatcagatttgctctgggccggtggtaccgagtctaagcactgcggtgaaggagttagtagaaaacagtctggatgctggtgccactaatattgatctaaagcttaaggactatggagtggatctcattgaagtttcaggcaatggatgtggggtagaagaagaaaacttcgaaggcttaactctgaaacatcacacatctaagattcaagagtttgccgacctacctcaggttgaaacttttggctttcggggggaagctctgagctcactttgtgcactgagtgatgtcaccatttctacctgccatgtatcggcgaaggttgggactcgactggtgtttgatcactatgggaaaatcatccagaaaaccccctacccccaccccagagggatgacagtcagtgtgaagcagttattttctacgctacctgtgcaccataaagaatttcaaaggaatattaagaagaaacgtgcctgcttccccttcgccttctgccgtgattgtcagtttcctgaggcctccccagccatgcttcctgtacagcctgcagaactgactcctagaagtaccccaccccacccctgctccttggaggacaacgtgatcactgtattcagctctgtcaagaatggtccaggttcttctagatgatctgcacaaatggctcctctcctccttcctgatgtctgccattagcactggaataaagttcctgctgaaaatccacatctcccctgggtccggtgttctggaagtgagagagacaatgtcacacctcaaggagacagctctctagacaggaaggttattcacgtcccatgtcaagtctagctagagttcagagcaattgagaagtgcgattttatctcctgcctttcattctataccctgcttctgaaccatcgtgttcaactgtgaaactcacgctttggtgaccctgactccaaaacttaatacacccaaggtcagccccagtgatctgcttcatagcgaggactttgggtgggtcttcccagggagtagggcaccctcagagaatgtggctttggacttcatcacagctagggtcttttgtgtcacttcagatctaaacttgtaactgtgctagatctgtttctaatgtgacaacatcacaaaccacgagtccagaagcctaatccataatcctacctcctcatgacgaagtctcatgctctgtgctcaacatggttagctgcacaagatgtaaaccaaagcttcactgaaccctcgacccaaatcggtaactcaagtgcatcaatcataaagaacctccccgaactcagtatttatgattatttttgaggcagggtctcactctgtcgccccggctggagtgcagtggcaggatcaggtctccctgcagcccgactcccaggctccagcgatcctcctgcctcagctcttgagtagttgggagtaagagatgcctcccacatcgcctggtaatttgtatttgggagaggggatatttcgccacgtt

SEQ ID NO: 278482 - DNA, 2095 bp, Homo sapiens
atggcgcaaccaaagcaagagagggtggcgcgtgccagacaccaacggtcggaaaccgccagacaccaacggtcggaaaccgccaagacaccaacgctcggaaaccgccagacaccaacggtcggaaaccgccagacaccaacgctcggaatccacgccaggccacgacggagggcgactacctcccttctgaccctgctgctggcgttcggaaaaaacgcagtccggtgtgctctgattggtccaggctctttgacgtcacggactcgacctttgacagagccactaggcgaaaaggagagacgggaagtattttttccgccccgcccggaaagggtggagcacaacgtcgaaagcagccgttgggagcccaggaggcggggcgcctgtgggagccgtggagggaactttcccagtccccgaggcggatccggtgttgcatccttggagcgagctgagagctcgaggtgagctgggctcgcggtcgcccctctcgcgcgccctctttaagaaccacggcgtccaacctccctggaaatggggggaacatggccgaggcgcgtggcgaggccgcctcgtggaggccccggagcggcatcctcagcgccccagcgatccggtgcccattaggtgcgccttgaagccgagtacagaacctgctaaggccatcaaacctattgatcggaagtcagtccatcagatttgctctgggccggtggtaccgagtctaagcactgcggtgaaggagttagtagaaaacagtctggatgctggtgccactaatattgatctaaagcttaaggactatggagtggatctcattgaagtttcaggcaatggatgtggggtagaagaagaaaacttcgaaggcttaatgatgtcaccatttctacctgccatgtatcggcgaaggttgggactcgactggtgtttgatcactatgggaaaatcatccagaaaaccccctacccccaccccagagggatgacagtcagtgtgaagcagttattttctacgctacctgtgcaccataaagaatttcaaaggaatattaagaagaaacgtgcctgcttccccttcgccttctgccgtgattgtcagtttcctgaggcctccccagccatgcttcctgtacagcctgcagaactgactcctagaagtaccccaccccacccctgctccttggaggacaacgtgatcactgtattcagctctgtcaagaatggtccaggttcttctagatgatctgcacaaatggctcctctcctccttcctgatgtctgccattagcactggaataaagttcctgctgaaaatccacatctcccctgggtccggtgttctggaagtgagagagacaatgtcacacctcaaggagacagctctctagacaggaaggttattcacgtcccatgtcaagtctagctagagttcagagcaattgagaagtgcgattttatctcctgcctttcattctataccctgcttctgaaccatcgtgttcaactgtgaaactcacgctttggtgaccctgactccaaaacttaatacacccaaggtcagccccagtgatctgcttcatagcgaggactttgggtgggtcttcccagggagtagggcaccctcagagaatgtggctttggacttcatcacagctagggtcttttgtgtcacttcagatctaaacttgtaactgtgctagatctgtttctaatgtgacaacatcacaaaccacgagtccagaagcctaatccataatcctacctcctcatgacgaagtctcatgctctgtgctcaacatggttagctgcacaagatgtaaaccaaagcttcactgaaccctcgacccaaatcggtaactcaagtgcatcaatcataaagaacctccccgaactcagtatttatgattatttttgaggcagggtctcactctgtcgccccggctggagtgcagtggcaggatcaggtctccctgcagcccgactcccaggctccagcgatcctcctgcctcagctcttgagtagttgggagtaagagatgcctcccacatcgcctggtaatttgtatttgggagaggggatatttcgccacgtt

SEQ ID NO: 278483 - DNA, 2106 bp, Homo sapiens
atggcgcaaccaaagcaagagagggtggcgcgtgccagacaccaacggtcggaaaccgccagacaccaacggtcggaaaccgccaagacaccaacgctcggaaaccgccagacaccaacggtcggaaaccgccagacaccaacgctcggaatccacgccaggccacgacggagggcgactacctcccttctgaccctgctgctggcgttcggaaaaaacgcagtccggtgtgctctgattggtccaggctctttgacgtcacggactcgacctttgacagagccactaggcgaaaaggagagacgggaagtattttttccgccccgcccggaaagggtggagcacaacgtcgaaagcagccgttgggagcccaggaggcggggcgcctgtgggagccgtggagggaactttcccagtccccgaggcggatccggtgttgcatccttggagcgagctgagagctcgagtacagaacctgctaaggccatcaaacctattgatcggaagtcagtccatcagatttgctctgggccggtggtaccgagtctaagcactgcggtgaaggagttagtagaaaacagtctggatgctggtgccactaatattgatctaaagcttaaggactatggagtggatctcattgaagtttcaggcaatggatgtggggtagaagaagaaaacttcgaaggcttaactctgaaacatcacacatctaagattcaagagtttgccgacctacctcaggttgaaacttttggctttcggggggaagctctgagctcactttgtgcactgagtgatgtcaccatttctacctgccatgtatcggcgaaggttgggactcgactggtgtttgatcactatgggaaaatcatccagaaaaccccctacccccaccccagagggatgacagtcagtgtgaagcagttattttctacgctacctgtgcaccataaagaatttcaaaggaatattaagaagtgagtgagcgctcatgggatctggttgtttagaagcatgcaccacctcccgcttcactctctctgtctctcctgctccaccatggccagaaacgtgcctgcttccccttcgccttctgccgtgattgtcagtttcctgaggcctccccagccatgcttcctgtacagcctgcagaactgactcctagaagtaccccaccccacccctgctccttggaggacaacgtgatcactgtattcagctctgtcaagaatggtccaggttcttctagatgatctgcacaaatggctcctctcctccttcctgatgtctgccattagcactggaataaagttcctgctgaaaatccacatctcccctgggtccggtgttctggaagtgagagagacaatgtcacacctcaaggagacagctctctagacaggaaggttattcacgtcccatgtcaagtctagctagagttcagagcaattgagaagtgcgattttatctcctgcctttcattctataccctgcttctgaaccatcgtgttcaactgtgaaactcacgctttggtgaccctgactccaaaacttaatacacccaaggtcagccccagtgatctgcttcatagcgaggactttgggtgggtcttcccagggagtagggcaccctcagagaatgtggctttggacttcatcacagctagggtcttttgtgtcacttcagatctaaacttgtaactgtgctagatctgtttctaatgtgacaacatcacaaaccacgagtccagaagcctaatccataatcctacctcctcatgacgaagtctcatgctctgtgctcaacatggttagctgcacaagatgtaaaccaaagcttcactgaaccctcgacccaaatcggtaactcaagtgcatcaatcataaagaacctccccgaactcagtatttatgattatttttgaggcagggtctcactctgtcgccccggctggagtgcagtggcaggatcaggtctccctgcagcccgactcccaggctccagcgatcctcctgcctcagctcttgagtagttgggagtaagagatgcctcccacatcgcctggtaatttgtatttgggagaggggatatttcgccacgtt

SEQ ID NO: 278484 - DNA, 1208 bp, Homo sapiens
atggcgcaaccaaagcaagagagggtggcgcgtgccagacaccaacggtcggaaaccgccagacaccaacggtcggaaaccgccaagacaccaacgctcggaaaccgccagacaccaacggtcggaaaccgccagacaccaacgctcggaatccacgccaggccacgacggagggcgactacctcccttctgaccctgctgctggcgttcggaaaaaacgcagtccggtgtgctctgattggtccaggctctttgacgtcacggactcgacctttgacagagccactaggcgaaaaggagagacgggaagtattttttccgccccgcccggaaagggtggagcacaacgtcgaaagcagccgttgggagcccaggaggcggggcgcctgtgggagccgtggagggaactttcccagtccccgaggcggatccggtgttgcatccttggagcgagctgagagctcgagtacagaacctgctaaggccatcaaacctattgatcggaagtcagtccatcagatttgctctgggccggtggtaccgagtctaagcactgcggtgaaggagttagtagaaaacagtctggatgctggtgccactaatattgatctaaagcttaaggactatggagtggatctcattgaagtttcaggcaatggatgtggggtagaagaagaaaacttcgaaggcttaactctgaaacatcacacatctaagattcaagagtttgccgacctacctcaggttgaaacttttggctttcggggggaagctctgagctcactttgtgcactgagtgatgtcaccatttctacctgccatgtatcggcgaaggttgggactcgactggtgtttgatcactatgggaaaatcatccagaaaaccccctacccccaccccagagggatgacagtcagtgtgaagcagttattttctacgctacctgtgcaccataaagaatttcaaaggaatattaagaagcctccaatttacagtctaaaacatgtacgcggtggccctgagctgttgtgtaaatggactcactgccctgaggccaccatgctgcaaggaagcccaagctaaccctaggatgtgccctgagacgacatgaagacgcatccccagccagccttccactaccccatccttcactgccccattctcacccccgcccacctccttactccctccaccccgtcgggtaagag

SEQ ID NO: 278485 - DNA, 1169 bp, Homo sapiens
atggcgcaaccaaagcaagagagggtggcgcgtgccagacaccaacggtcggaaaccgccagacaccaacggtcggaaaccgccaagacaccaacgctcggaaaccgccagacaccaacggtcggaaaccgccagacaccaacgctcggaatccacgccaggccacgacggagggcgactacctcccttctgaccctgctgctggcgttcggaaaaaacgcagtccggtgtgctctgattggtccaggctctttgacgtcacggactcgacctttgacagagccactaggcgaaaaggagagacgggaagtattttttccgccccgcccggaaagggtggagcacaacgtcgaaagcagccgttgggagcccaggaggcggggcgcctgtgggagccgtggagggaactttcccagtccccgaggcggatccggtgttgcatccttggagcgagctgagagctcgaggtgagctgggctcgcggtcgcccctctcgcgcgccctctttaagaaccacggcgtccaacctccctggaaatggggggaacatggccgaggcgcgtggcgaggccgcctcgtggaggccccggagcggcatcctcagcgccccagcgatccggtgcccattaggtgcgccttgaagccgagtacagaacctgctaaggccatcaaacctattgatcggaagtcagtccatcagatttgctctgggccggtggtaccgagtctaagcactgcggtgaaggagttagtagaaaacagtctggatgctggtgccactaatattgatctaaagcttaaggactatggagtggatctcattgaagtttcaggcaatggatgtggggtagaagaagaaaacttcgaaggcttaactctgaaacatcacacatctaagattcaagagtttgccgacctacctcaggttgaaacttttggctttcggggggaagctctgagctcactttgtgcactgaggtgataaaatatttttatccattcacttgaccccttagaaaaacctctctgaaaattaattggaatcattattatttacagttttctgtctcaatatctcagcttccagcttctgaattctgttttgtctcactgccaatctaagtcctagtacttctgaaatgtgagcaataaatgaatgaaatgaaaaa

SEQ ID NO: 278486 - DNA, 1327 bp, Homo sapiens
atggcgcaaccaaagcaagagagggtggcgcgtgccagacaccaacggtcggaaaccgccagacaccaacggtcggaaaccgccaagacaccaacgctcggaaaccgccagacaccaacggtcggaaaccgccagacaccaacgctcggaatccacgccaggccacgacggagggcgactacctcccttctgaccctgctgctggcgttcggaaaaaacgcagtccggtgtgctctgattggtccaggctctttgacgtcacggactcgacctttgacagagccactaggcgaaaaggagagacgggaagtattttttccgccccgcccggaaagggtggagcacaacgtcgaaagcagccgttgggagcccaggaggcggggcgcctgtgggagccgtggagggaactttcccagtccccgaggcggatccggtgttgcatccttggagcgagctgagagctcgagagacggggatttagctatgttgcccaagctggtctggaactccggagctcaagcagtccgcccgccttggccccccaaagcgctggaattacaggcgtaatgcactgtgcctggcctttaaaaaaaaattgaggttattttggggacagtagagcgtccagacacatcctaatttgcatagctgcgcagttttaaaaaatgcaatgcatttttacctgttaggtacagaacctgctaaggccatcaaacctattgatcggaagtcagtccatcagatttgctctgggccggtggtaccgagtctaagcactgcggtgaaggagttagtagaaaacagtctggatgctggtgccactaatattgatctaaagcttaaggactatggagtggatctcattgaagtttcaggcaatggatgtggggtagaagaagaaaacttcgaaggcttaactctgaaacatcacacatctaagattcaagagtttgccgacctacctcaggttgaaacttttggctttcggggggaagctctgagctcactttgtgcactgagtgatgtcaccatttctacctgccatgtatcggcgaaggttgggactcgactggtgtttgatcactatgggaaaatcatccagaaaaccccctacccccaccccagagggatgacagtcagtgtgaagcagttattttctacgctacctgtgcaccataaagaatttcaaaggaatattaagaagaaacgtgcctgcttccccttcgccttctgccgtgattgtcagtttcctgaggcctccccagccatgcttcctgtacagcctgcagaactgtgagtcaattaaacctgttttcttcataaaaac

SEQ ID NO: 278487 - DNA, 205 bp, Homo sapiens
cccctctcgcgcgccctctttaagaaccacggcgtccaacctccctggaaatggggggaacatggccgaggcgcgtggcgaggccgcctcgtggaggccccggagcggcatcctcagcgccccagcgatccggtgcccattaggtgcgccttgaagccgaggcaagctccttcggggtgctgggctgcgggcaaagaattcggcc

SEQ ID NO: 278488 - DNA, 2020 bp, Homo sapiens
gccgctcctgccgtgcatgttggggagccagtacatgcaggtgggctccacacggagaggggcgccgaccccgtgatagggctttacctggtacatcggggtggcgcgtgccagacaccaacggtcggaaaccgccagacaccaacgctcggaatccacgccaggccacgacggagggcgactacctcccttctgaccctgctgctggcgttcggaaaaaacgcagtccggtgtgctctgattggtccaggctctttgacgtcacggactcgacctttgacagagccactaggcgaaaaggagagacgggaagtattttttccgccccgcccggaaagggtggagcacaacgtcgaaagcagccgttgggagcccaggaggcggggcgcctgtgggagccgtggagggaactttcccagtccccgaggcggatccggtgttgcatccttggagcgagctgagagctcgagtacagaacctgctaaggccatcaaacctattgatcggaagtcagtccatcagatttgctctgggccggtggtaccgagtctaagcactgcggtgaaggagttagtagaaaacagtctggatgctggtgccactaatattgatctaaagcttaaggactatggagtggatctcattgaagtttcaggcaatggatgtggggtagaagaagaaaacttcgaaggcttaactctgaaacatcacacatctaagattcaagagtttgccgacctacctcaggttgaaacttttggctttcggggggaagctctgagctcactttgtgcactgagtgatgtcaccatttctacctgccatgtatcggcgaaggttgggactcgactggtgtttgatcactatgggaaaatcatccagaaaaccccctacccccaccccagagggatgacagtcagtgtgaagcagttattttctacgctacctgtgcaccataaagaatttcaaaggaatattaagaagaaacgtgcctgcttccccttcgccttctgccgtgattgtcagtttcctgaggcctccccagccatgcttcctgtacagcctgcagaactgactcctagaagtaccccaccccacccctgctccttggaggacaacgtgatcactgtattcagctctgtcaagaatggtccaggttcttctagatgatctgcacaaatggctcctctcctccttcctgatgtctgccattagcactggaataaagttcctgctgaaaatccacatctcccctgggtccggtgttctggaagtgagagagacaatgtcacacctcaaggagacagctctctagacaggaaggttattcacgtcccatgtcaagtctagctagagttcagagcaattgagaagtgcgattttatctcctgcctttcattctataccctgcttctgaaccatcgtgttcaactgtgaaactcacgctttggtgaccctgactccaaaacttaatacacccaaggtcagccccagtgatctgcttcatagcgaggactttgggtgggtcttcccagggagtagggcaccctcagagaatgtggctttggacttcatcacagctagggtcttttgtgtcacttcagatctaaacttgtaactgtgctagatctgtttctaatgtgacaacatcacaaaccacgagtccagaagcctaatccataatcctacctcctcatgacgaagtctcatgctctgtgctcaacatggttagctgcacaagatgtaaaccaaagcttcactgaaccctcgacccaaatcggtaactcaagtgcatcaatcataaagaacctccccgaactcagtatttatgattatttttgaggcagggtctcactctgtcgccccggctggagtgcagtggcaggatcaggtctccctgcagcccgactcccaggctccagcgatcctcctgcctcagctcttgagtagttgggagtaagagatgcctcccacatcgcctggtaatttgtatttgggagaggggatatttcgccacgtt

SEQ ID NO: 278489 - DNA, 2198 bp, Homo sapiens
atggcgcaaccaaagcaagagagggtggcgcgtgccagacaccaacggtcggaaaccgccagacaccaacggtcggaaaccgccaagacaccaacgctcggaaaccgccagacaccaacggtcggaaaccgccagacaccaacgctcggaatccacgccaggccacgacggagggcgactacctcccttctgaccctgctgctggcgttcggaaaaaacgcagtccggtgtgctctgattggtccaggctctttgacgtcacggactcgacctttgacagagccactaggcgaaaaggagagacgggaagtattttttccgccccgcccggaaagggtggagcacaacgtcgaaagcagccgttgggagcccaggaggcggggcgcctgtgggagccgtggagggaactttcccagtccccgaggcggatccggtgttgcatccttggagcgagctgagagctcgaggtgagctgggctcgcggtcgcccctctcgcgcgccctctttaagaaccacggcgtccaacctccctggaaatggggggaacatggccgaggcgcgtggcgaggccgcctcgtggaggccccggagcggcatcctcagcgccccagcgatccggtgcccattaggtgcgccttgaagccgagtacagaacctgctaaggccatcaaacctattgatcggaagtcagtccatcagatttgctctgggccggtggtaccgagtctaagcactgcggtgaaggagttagtagaaaacagtctggatgctggtgccactaatattgatctaaagcttaaggactatggagtggatctcattgaagtttcaggcaatggatgtggggtagaagaagaaaacttcgaaggcttaactctgaaacatcacacatctaagattcaagagtttgccgacctacctcaggttgaaacttttggctttcggggggaagctctgagctcactttgtgcactgagtgatgtcaccatttctacctgccatgtatcggcgaaggttgggactcgactggtgtttgatcactatgggaaaatcatccagaaaaccccctacccccaccccagagggatgacagtcagtgtgaagcagttattttctacgctacctgtgcaccataaagaatttcaaaggaatattaagaagaaacgtgcctgcttccccttcgccttctgccgtgattgtcagtttcctgaggcctccccagccatgcttcctgtacagcctgcagaactgactcctagaagtaccccaccccacccctgctccttggaggacaacgtgatcactgtattcagctctgtcaagaatggtccaggttcttctagatgatctgcacaaatggctcctctcctccttcctgatgtctgccattagcactggaataaagttcctgctgaaaatccacatctcccctgggtccggtgttctggaagtgagagagacaatgtcacacctcaaggagacagctctctagacaggaaggttattcacgtcccatgtcaagtctagctagagttcagagcaattgagaagtgcgattttatctcctgcctttcattctataccctgcttctgaaccatcgtgttcaactgtgaaactcacgctttggtgaccctgactccaaaacttaatacacccaaggtcagccccagtgatctgcttcatagcgaggactttgggtgggtcttcccagggagtagggcaccctcagagaatgtggctttggacttcatcacagctagggtcttttgtgtcacttcagatctaaacttgtaactgtgctagatctgtttctaatgtgacaacatcacaaaccacgagtccagaagcctaatccataatcctacctcctcatgacgaagtctcatgctctgtgctcaacatggttagctgcacaagatgtaaaccaaagcttcactgaaccctcgacccaaatcggtaactcaagtgcatcaatcataaagaacctccccgaactcagtatttatgattatttttgaggcagggtctcactctgtcgccccggctggagtgcagtggcaggatcaggtctccctgcagcccgactcccaggctccagcgatcctcctgcctcagctcttgagtagttgggagtaagagatgcctcccacatcgcctggtaatttgtatttgggagaggggatatttcgccacgtt

SEQ ID NO: 278490 - DNA, 1928 bp, Homo sapiens
atggcgcaaccaaagcaagagagggtggcgcgtgccagacaccaacggtcggaaaccgccagacaccaacggtcggaaaccgccaagacaccaacgctcggaaaccgccagacaccaacggtcggaaaccgccagacaccaacgctcggaatccacgccaggccacgacggagggcgactacctcccttctgaccctgctgctggcgttcggaaaaaacgcagtccggtgtgctctgattggtccaggctctttgacgtcacggactcgacctttgacagagccactaggcgaaaaggagagacgggaagtattttttccgccccgcccggaaagggtggagcacaacgtcgaaagcagccgttgggagcccaggaggcggggcgcctgtgggagccgtggagggaactttcccagtccccgaggcggatccggtgttgcatccttggagcgagctgagagctcgagtacagaacctgctaaggccatcaaacctattgatcggaagtcagtccatcagatttgctctgggccggtggtaccgagtctaagcactgcggtgaaggagttagtagaaaacagtctggatgctggtgccactaatattgatctaaagcttaaggactatggagtggatctcattgaagtttcaggcaatggatgtggggtagaagaagaaaacttcgaaggcttaactctgaaacatcacacatctaagattcaagagtttgccgacctacctcaggttgaaacttttggctttcggggggaagctctgagctcactttgtgcactgagtgatgtcaccatttctacctgccatgtatcggcgaaggttgggactcgactggtgtttgatcactatgggaaaatcatccagaaaaccccctacccccaccccagagggatgacagtcagtgtgaagcagttattttctacgctacctgtgcaccataaagaatttcaaaggaatattaagaaggactcctagaagtaccccaccccacccctgctccttggaggacaacgtgatcactgtattcagctctgtcaagaatggtccaggttcttctagatgatctgcacaaatggctcctctcctccttcctgatgtctgccattagcactggaataaagttcctgctgaaaatccacatctcccctgggtccggtgttctggaagtgagagagacaatgtcacacctcaaggagacagctctctagacaggaaggttattcacgtcccatgtcaagtctagctagagttcagagcaattgagaagtgcgattttatctcctgcctttcattctataccctgcttctgaaccatcgtgttcaactgtgaaactcacgctttggtgaccctgactccaaaacttaatacacccaaggtcagccccagtgatctgcttcatagcgaggactttgggtgggtcttcccagggagtagggcaccctcagagaatgtggctttggacttcatcacagctagggtcttttgtgtcacttcagatctaaacttgtaactgtgctagatctgtttctaatgtgacaacatcacaaaccacgagtccagaagcctaatccataatcctacctcctcatgacgaagtctcatgctctgtgctcaacatggttagctgcacaagatgtaaaccaaagcttcactgaaccctcgacccaaatcggtaactcaagtgcatcaatcataaagaacctccccgaactcagtatttatgattatttttgaggcagggtctcactctgtcgccccggctggagtgcagtggcaggatcaggtctccctgcagcccgactcccaggctccagcgatcctcctgcctcagctcttgagtagttgggagtaagagatgcctcccacatcgcctggtaatttgtatttgggagaggggatatttcgccacgtt

SEQ ID NO: 278491 - DNA, 1874 bp, Homo sapiens
atggcgcaaccaaagcaagagagggtggcgcgtgccagacaccaacggtcggaaaccgccagacaccaacggtcggaaaccgccaagacaccaacgctcggaaaccgccagacaccaacggtcggaaaccgccagacaccaacgctcggaatccacgccaggccacgacggagggcgactacctcccttctgaccctgctgctggcgttcggaaaaaacgcagtccggtgtgctctgattggtccaggctctttgacgtcacggactcgacctttgacagagccactaggcgaaaaggagagacgggaagtattttttccgccccgcccggaaagggtggagcacaacgtcgaaagcagccgttgggagcccaggaggcggggcgcctgtgggagccgtggagggaactttcccagtccccgaggcggatccggtgttgcatccttggagcgagctgagagctcgagtacagaacctgctaaggccatcaaacctattgatcggaagtcagtccatcagatttgctctgggccggtggtaccgagtctaagcactgcggtgaaggagttagtagaaaacagtctggatgctggtgccactaatattgatctaaagcttaaggactatggagtggatctcattgaagtttcaggcaatggatgtggggtagaagaagaaaacttcgaaggcttaactctgaaacatcacacatctaagattcaagagtttgccgacctacctcaggttgaaacttttggctttcggggggaagctctgagctcactttgtgcactgagtgatgtcaccatttctacctgccatgtatcggcgaaggttgggactcgactggtgtttgatcactatgggaaaatcatccagtctacgctacctgtgcaccataaagaatttcaaaggaatattaagaaggactcctagaagtaccccaccccacccctgctccttggaggacaacgtgatcactgtattcagctctgtcaagaatggtccaggttcttctagatgatctgcacaaatggctcctctcctccttcctgatgtctgccattagcactggaataaagttcctgctgaaaatccacatctcccctgggtccggtgttctggaagtgagagagacaatgtcacacctcaaggagacagctctctagacaggaaggttattcacgtcccatgtcaagtctagctagagttcagagcaattgagaagtgcgattttatctcctgcctttcattctataccctgcttctgaaccatcgtgttcaactgtgaaactcacgctttggtgaccctgactccaaaacttaatacacccaaggtcagccccagtgatctgcttcatagcgaggactttgggtgggtcttcccagggagtagggcaccctcagagaatgtggctttggacttcatcacagctagggtcttttgtgtcacttcagatctaaacttgtaactgtgctagatctgtttctaatgtgacaacatcacaaaccacgagtccagaagcctaatccataatcctacctcctcatgacgaagtctcatgctctgtgctcaacatggttagctgcacaagatgtaaaccaaagcttcactgaaccctcgacccaaatcggtaactcaagtgcatcaatcataaagaacctccccgaactcagtatttatgattatttttgaggcagggtctcactctgtcgccccggctggagtgcagtggcaggatcaggtctccctgcagcccgactcccaggctccagcgatcctcctgcctcagctcttgagtagttgggagtaagagatgcctcccacatcgcctggtaatttgtatttgggagaggggatatttcgccacgtt

SEQ ID NO: 278492 - DNA, 1104 bp, Homo sapiens
atggcgcaaccaaagcaagagagggtggcgcgtgccagacaccaacggtcggaaaccgccagacaccaacggtcggaaaccgccaagacaccaacgctcggaaaccgccagacaccaacggtcggaaaccgccagacaccaacgctcggaatccacgccaggccacgacggagggcgactacctcccttctgaccctgctgctggcgttcggaaaaaacgcagtccggtgtgctctgattggtccaggctctttgacgtcacggactcgacctttgacagagccactaggcgaaaaggagagacgggaagtattttttccgccccgcccggaaagggtggagcacaacgtcgaaagcagccgttgggagcccaggaggcggggcgcctgtgggagccgtggagggaactttcccagtccccgaggcggatccggtgttgcatccttggagcgagctgagagctcgagtacagaacctgctaaggccatcaaacctattgatcggaagtcagtccatcagatttgctctgggccggtggtaccgagtctaagcactgcggtgaaggagttagtagaaaacagtctggatgctggtgccactaatattgatctaaagcttaaggactatggagtggatctcattgaagtttcaggcaatggatgtggggtagaagaagaaaacttcgaaggcttaactctgaaacatcacacatctaagattcaagagtttgccgacctacctcaggttgaaacttttggctttcggggggaagctctgagctcactttgtgcactgagtgatgtcaccatttctacctgccatgtatcggcgaaggttgggactcgactggtgtttgatcactatgggaaaatcatccagaaaaccccctacccccaccccagagggatgacagtcagtgtgaagcagttattttctacgctacctgtgcaccataaagaatttcaaaggaatattaagaagaaacgtgcctgcttccccttcgccttctgccgtgattgtcagtttcctgaggcctccccagccatgcttcctgtacagcctgcagaactgtgagtcaattaaacctgttttcttcataaaaac

SEQ ID NO: 278493 - DNA, 988 bp, Homo sapiens
atggcgcaaccaaagcaagagagggtggcgcgtgccagacaccaacggtcggaaaccgccagacaccaacggtcggaaaccgccaagacaccaacgctcggaaaccgccagacaccaacggtcggaaaccgccagacaccaacgctcggaatccacgccaggccacgacggagggcgactacctcccttctgaccctgctgctggcgttcggaaaaaacgcagtccggtgtgctctgattggtccaggctctttgacgtcacggactcgacctttgacagagccactaggcgaaaaggagagacgggaagtattttttccgccccgcccggaaagggtggagcacaacgtcgaaagcagccgttgggagcccaggaggcggggcgcctgtgggagccgtggagggaactttcccagtccccgaggcggatccggtgttgcatccttggagcgagctgagagctcgagtacagaacctgctaaggccatcaaacctattgatcggaagtcagtccatcagatttgctctgggccggtggtaccgagtctaagcactgcggtgaaggagttagtagaaaacagtctggatgctggtgccactaatattgatctaaagcttaaggactatggagtggatctcattgaagtttcaggcaatggatgtggggtagaagaagaaaacttcgaaggcttaactctgaaacatcacacatctaagattcaagagtttgccgacctacctcaggttgaaacttttggctttcggggggaagctctgagctcactttgtgcactgaggtgataaaatatttttatccattcacttgaccccttagaaaaacctctctgaaaattaattggaatcattattatttacagttttctgtctcaatatctcagcttccagcttctgaattctgttttgtctcactgccaatctaagtcctagtacttctgaaatgtgagcaataaatgaatgaaatgaaaaa

SEQ ID NO: 278494 - DNA, 2374 bp, Homo sapiens
ccgggatctcgagatagccgcagctctcgcgatctttctggagccgcacctccacgcggagtccgagcgcgtgtgctgagaccccagggtcgggagggcggagactgggagggagggagaagcccctttggcctgccttacggaagcctgcgagggagggtggtgtccactgcccagttccgtgtcccgatgcccagcgccagcgccagccgcaagagtcaggagaagccgcgggagatcatggacgcggcggaagattatgctaaagagagatatggaatatcttcaatgatacaatcacaagaaaaaccagatcgagttttggttcgggttagagacttgacaatacaaaaagctgatgaagttgtttgggtacgtgcaagagttcatacaagcagagctaaagggaaacagtgcttcttagtcctacgtcagcagcagtttaatgtccaggctcttgtggcggtgggagaccatgcaagcaagcagatggttaaatttgctgccaacatcaacaaagagagcattgtggatgtagaaggtgttgtgagaaaagtgaatcagaaaattggaagctgtacacagcaagacgttgagttacatgttcagaagatttatgtgatcagtttggctgaaccccgtctgcccctgcagctggatgatgctgttcggcctgaggcagaaggagaagaggaaggaagagctactgttaaccaggatacaagattagacaacagagtcattgatcttaggacatcaactagtcaggcagtcttccgtctccagtctggcatctgccatctcttccgagaaactttaattaacaaaggttttgtggaaatccaaactcctaaaattatttcagctgccagtgaaggaggagccaatgtttttactgtgtcatattttaaaaataatgcatacctggctcagtccccacagctatataagcaaatgtgcatttgtgctgattttgagaaggttttctctattggaccagtattcagagcggaagactctaatacccatagacatctaactgagtttgttggtttggacattgaaatggcttttaattaccattaccacgaagttatggaagaaattgctgacaccatggtacaaatattcaaaggacttcaagaaaggtttcagactgaaattcaaacagtgaataaacagttcccatgtgagccattcaaatttttggagccaactctaagactagaatattgtgaagcattggctatgcttagggaagctggagtcgaaatgggagatgaagacgatctgagcacaccaaatgaaaagctgttgggtcatttggtaaaggaaaagtatgatacagatttttatattcttgataaatatccattggctgtaagacctttctataccatgcctgacccaagaaatcccaaacagtccaactcttacgatatgttcatgagaggagaagaaatattgtcaggagctcaaagaatacatgatcctcaactgctaacagagagagctttacatcatggaattgatttggagaaaattaaggcttacattgattccttccgctttggagcccctcctcatgctggtggaggcattggattggaacgagttactatgctgtttctgggattgcataatgttcgtcagacctccatgttccctcgtgatcccaaacgactcactccttaaattcacactttgccacttaactccagtgtggatgacagagcgagaccctgcctcaaaaaaaaaaaaaaaaaaaaaaaaaaaaaaaaaaaaaaaaaaaaaaaaaaaaaaaaaaaaaaaagaaagccacacttattcttttcagtaacctgctagtgcacaggctgtactttaggtacttaaaatatgcactagaataaatttgcaaggccctaaaatatcactgttatttttggagtaattcagtataggttcgtttaaaagagatttttataacttcagacatgcatcagtaggaaataacttgagaaattcatatggttatgttacaaattcatattctgttactacagtaaacgttaagagttttaaacagttaagattgtacaatttttcttcttttctatattacaagggccccagtgttaatgtcttagattttcagtatttgaacttatttttttaaattctgtcattgagataagaataattcaggtagcatctgaaattttaatgaatgtataattggcatatcatggaaaattaaccagaaagtatcagttcttaaaagttatgcctagaaattatgtaaagctaaactactggttagaaagtattcagtgtaatattgtattaatttgttaaattctaaacttgaatttcaataaaattttaaagctaa

SEQ ID NO: 278495 - DNA, 541 bp, Homo sapiens
  misc_feature (33)..(33): n is a, c, g, or t
gcggcccctactactactaaattcgcggccgtncgaccttaaaatatgcactagaataaatttgcaaggccctaaaatatcactgttatttttggagtaattcagtataggttcgtttaaaagagatttttataacttcagacatgcatcagtaggaaataacttgagaaattcatatggttatgttacaaattcatattctgttactacagtaaacgttaagagttttaaacagttaagattgtacaatttttcttcttttctatattacaagggccccagtgttaatgtcttagattttcagtatttgaacttatttttttaaattctgtcattgagataagaataattcaggtagcatctgaaattttaatgaatgtataattggcatatcatggaaaattaaccagaaagtatcagttcttaaaagttatgcctagaaattatgtaaagctaaactactggttagaaagtattcagtgtaatattgtattaatttgttaaattctaaacttgaatttcaataaaattttaaagctaa

SEQ ID NO: 278496 - DNA, 811 bp, Homo sapiens
ccgggatctcgagatagccgcagctctcgcgatctttctggagccgcacctccacgcggagtccgagcgcgtgtgctgagaccccagggtcgggagggcggagactgggagggagggagaagcccctttggcctgccttacggaagcctgcgagggagggtggtgtccactgcccagttccgtgtcccgatgcccagcgccagcgccagccgcaagagtcaggagaagccgcgggagatcatggacgcggcggaagattatgctaaagagagatatggaatatcttcaatgatacaatcacaagaaaaaccagatcgagttttggttcgggttagagacttgacaatacaaaaagctgatgaagttgtttgggtacgtgcaagagttcatacaagcagagctaaagggaaacagtgcttcttagtcctacgtcagcagcagtttaatgtccaggctcttgtggcggtgggagaccatgcaagcaagcagatggttaaatttgctgccaacatcaacaaagagagcattgtggatgtagaaggtgttgtgagaaaagtgaatcagaaaattggaagctgtacacagcaagacgttgagttacatgttcagaaggtaagttttttcaaaatataaaatcgcatatagaaatagatttgggttctaatagttttcatgtcaaatttatatgttcttactaattaatgtaaaatactgaggtttataaattagttactgaatcaattagcttttgttatataacaaatcaccccagtacttagtgacttgaaacaacaaacatttatttgcttac

SEQ ID NO: 278497 - DNA, 444 bp, Homo sapiens
ttttgttgtcgttgccactgtatttacacctcacttacacagggactggtaacccatgctgccttggcaagccaactgcactcctctgtcccaacaagcagggcaatggattgcgaagaggcctcctccgtccccaagcagctacgtcgcccaggggaagagagaaggcgggaaagtccaagagaggagaaaccaaggcccgcgcttaggtgggtgttgtagtgacgagtctgcggttacagccgagcggagttgaaagggggaagcctgcgagggagggtggtgtccactgcccagttccgtgtcccgatgcccagcgccagcgccagccgcaagagtcaggagaagccgcgggagatcatggacgcggcggaagtgggtttcctcctttcctgggcctgggaggacagacccctgggccgggctgcgccgagggagggagga

SEQ ID NO: 278498 - DNA, 636 bp, Homo sapiens
tgcatttattctttttatagtatgatacagatttttatattcttgataaatatccattggctgtaagacctttctataccatgcctgacccaagaaatcccgtaagtaatttggttttaagtaacccattttgaggcagaagggaaattttattgtcactgtcagattgtataataggaataatggttttcattaataatttgcagttttgatagacatacgtattaccattgatgtctgtcaccactggtcaaaatgatattgtaaaatttgaatattctagaaaattagttttaaaaacctatgttaaaatcattttacttggtcatttttctgaagatttatgagagagaaagactatgtaaattataaatagtactactagatttgcatactttagtaaatcatcctgtcattgaccttaaactgggaattcacattgtatcctgggagttaataatctaaataatgtcttacggtcttttaccgtttttccattgcagtggtttctaaactttaccatgcatcagaatcacctggagggctttttaaaacaccagttgctgaggcagaatttctcattagttgctgtggaatgggagcctgataatttgcaggccccactccagaccaagt

SEQ ID NO: 278499 - DNA, 270 bp, Homo sapiens
  misc_feature (231)..(231): n is a, c, g, or t
tccttgtaatccaagcagtcggcagatggttaaatttgctgccaacatcaacaaagagagcattgtggatgtagaaggtgttgtgagaaaagtgaatcagaaaattggaagctgtacacagcaagacgttgagttacatgttcagaagatttatgtgatcagtttggctgaaccccgtctgcccctgcagctggatgatgctgttcggcctgaggcagaaggagaagaggnaggaagagcgactgcttggattacaaggagggtaccgag

SEQ ID NO: 278500 - DNA, 220 bp, Homo sapiens
atcccgggggggggcccgggggggaaaaaaaaaaaaaaaaaaaaagaaagccacacttattcttttcagtaacctgctagtgcacaggctgtactttaggtacttaaaatatgcactagaataaatttgcaaggccctaaaatatcactgttatttttggagtaattcagtataggttcgtttaaaagagatttttagggagagaaagggggagcctcta

SEQ ID NO: 278501 - DNA, 2331 bp, Homo sapiens
ccgggatctcgagatagccgcagctctcgcgatctttctggagccgcacctccacgcggagtccgagcgcgtgtgctgagaccccagggtcgggagggcggagactgggagggagggagaagcccctttggcctgccttacggaagcctgcgagggagggtggtgtccactgcccagttccgtgtcccgatgcccagcgccagcgccagccgcaagagtcaggagaagccgcgggagatcatggacgcggcggaagattatgctaaagagagatatggaatatcttcaatgatacaatcacaagaaaaaccagatcgagttttggttcgggttagagacttgacaatacaaaaagctgatgaagttgtttgggtacgtgcaagagttcatacaagcagagctaaagggaaacagtgcttcttagtcctacgtcagcagcagtttaatgtccaggctcttgtggcggtgggagaccatgcaagcaagcagatggttaaatttgctgccaacatcaacaaagagagcattgtggatgtagaaggtgttgtgagaaaagtgaatcagaaaattggaagctgtacacagcaagacgttgagttacatgttcagaagatttatgtgatcagtttggctgaaccccgtctgcccctgcagctggatgatgctgttcggcctgaggcagaaggagaagaggaaggaagagctactgttaaccaggatacaagattagacaacagagtcattgatcttaggacatcaactagtcaggcagtcttccgtctccagtctggcatctgccatctcttccgagaaactttaattaacaaaggttttgtggaaatccaaactcctaaaattatttcagctgccagtgaaggaggagccaatgtttttactgtgtcatattttaaaaataatgcatacctggctcagtccccacagctatataagcaaatgtgcatttgtgctgattttgagaaggttttctctattggaccagtattcagagcggaagactctaatacccatagacatctaactgagtttgttggtttggacattgaaatggcttttaattaccattaccacgaagttatggaagaaattgctgacaccatggtacaaatattcaaaggacttcaagaaaggtttcagactgaaattcaaacagtgaataaacagttcccatgtgagccattcaaatttttggagccaactctaagactagaatattgtgaagcattggctatgcttagggaagctggagtcgaaatgggagatgaagacgatctgagcacaccaaatgaaaagctgttgggtcatttggtaaaggaaaagtatgatacagatttttatattcttgataaatatccattggctgtaagacctttctataccatgcctgacccaagaaatcccaaacagtccaactcttacgatatgttcatgagaggagaagaaatattgtcaggagctcaaagaatacatgatcctcaactgctaacagagagagctttacatcatggaattgatttggagaaaattaaggcttacattgattccttccgctttggagcccctcctcatgctggtggaggcattggattggaacgagttactatgctgtttctgggattgcataatgttcgtcagacctccatgttccctcgtgatcccaaacgactcactccttaaattcacactttgccacttaactccagtgtggatgacagagcgagaccctgcctcaaaaaaaaaaaaaaaaaaaaagaaagccacacttattcttttcagtaacctgctagtgcacaggctgtactttaggtacttaaaatatgcactagaataaatttgcaaggccctaaaatatcactgttatttttggagtaattcagtataggttcgtttaaaagagatttttataacttcagacatgcatcagtaggaaataacttgagaaattcatatggttatgttacaaattcatattctgttactacagtaaacgttaagagttttaaacagttaagattgtacaatttttcttcttttctatattacaagggccccagtgttaatgtcttagattttcagtatttgaacttatttttttaaattctgtcattgagataagaataattcaggtagcatctgaaattttaatgaatgtataattggcatatcatggaaaattaaccagaaagtatcagttcttaaaagttatgcctagaaattatgtaaagctaaactactggttagaaagtattcagtgtaatattgtattaatttgttaaattctaaacttgaatttcaataaaattttaaagctaa

SEQ ID NO: 278502 - DNA, 2277 bp, Homo sapiens
ccgggatctcgagatagccgcagctctcgcgatctttctggagccgcacctccacgcggagtccgagcgcgtgtgctgagaccccagggtcgggagggcggagactgggagggagggagaagcccctttggcctgccttacggaagcctgcgagggagggtggtgtccactgcccagttccgtgtcccgatgcccagcgccagcgccagccgcaagagtcaggagaagccgcgggagatcatggacgcggcggaagattatgctaaagagagatatggaatatcttcaatgatacaatcacaagaaaaaccagatcgagttttggttcgggttagagacttgacaatacaaaaagctgatgaagttgtttgggtacgtgcaagagttcatacaagcagagctaaagggaaacagtgcttcttagtcctacgtcagcagcagtttaatgtccaggctcttgtggcggtgggagaccatgcaagcaagcagatggttaaatttgctgccaacatcaacaaagagagcattgtggatgtagaaggtgttgtgagaaaagtgaatcagaaaattggaagctgtacacagcaagacgttgagttacatgttcagaagatttatgtgatcagtttggctgaaccccgtctgcccctgcagctggatgatgctgttcggcctgaggcagaaggagaagaggaaggaagagctactgttaaccaggatacaagattagacaacagagtcattgatcttaggacatcaactagtcaggcagtcttccgtctccagtctggcatctgccatctcttccgagaaactttaattaacaaaggttttgtggaaatccaaactcctaaaattatttcagctgccagtgaaggaggagccaatgtttttactgtgtcatattttaaaaataatgcatacctggctcagtccccacagctatataagcaaatgtgcatttgtgctgattttgagaaggttttctctattggaccagtattcagagcggaagactctaatacccatagacatctaactgagtttgttggtttggacattgaaatggcttttaattaccattaccacgaagttatggaagaaattgctgacaccatggtacaaatattcaaaggacttcaagaaaggtttcagactgaaattcaaacagtgaataaacagttcccatgtgagccattcaaatttttggagccaactctaagactagaatattgtgaagcattggctatgcttagggaagctggagtcgaaatgggagatgaagacgatctgagcacaccaaatgaaaagctgttgggtcatttggtaaaggaaaagtatgatacagatttttatattcttgataaatatccattggctgtaagacctttctataccatgcctgacccaagaaatcccaaacagtccaactcttacgatatgttcatgagaggagaagaaatattgtcaggagctcaaagaatacatgatcctcaactgctaacagagagagctttacatcatggaattgatttggagaaaattaaggcttacattgattccttccgctttggagcccctcctcatgctggtggaggcattggattggaacgagttactatgctgtttctgggattgcataatgttcgtcagacctccatgttccctcgtgatcccaaacgactcactccttaaattcacactttgccacttaactccagtgtggatgacagagcgagaccctgcctcaaaaaaaaaaaaaaaaaaaaagaaagccacacttattcttttcagtaacctgctagtgcacaggctgtactttaggtacttaaaatatgcactagaataaatttgcaaggccctaaaatatcactgttatttttggagtaattcagtataggttcgtttaaaagagatttttataacttcagacatgcatcagtaggaaataacttgagaaattcatatggttatgttacaaattcatattctgttactacagtaaacgttaagagttttaaacagttaagattgtacaatttttcttcttttctatattacaagggccccagtgttaatgtcttagattttcagtatttgaacttatttttttaaattctgtcattgagataagaataattcaggtagcatctgaaattttaatgaatgtataattggcatatcatggaaaattaaccagaaagtatcagttcttatgtaatattgtattaatttgttaaattctaaacttgaatttcaataaaattttaaagctaa

SEQ ID NO: 278503 - DNA, 2277 bp, Homo sapiens
ccgggatctcgagatagccgcagctctcgcgatctttctggagccgcacctccacgcggagtccgagcgcgtgtgctgagaccccagggtcgggagggcggagactgggagggagggagaagcccctttggcctgccttacggaagcctgcgagggagggtggtgtccactgcccagttccgtgtcccgatgcccagcgccagcgccagccgcaagagtcaggagaagccgcgggagatcatggacgcggcggaagattatgctaaagagagatatggaatatcttcaatgatacaatcacaagaaaaaccagatcgagttttggttcgggttagagacttgacaatacaaaaagctgatgaagttgtttgggtacgtgcaagagttcatacaagcagagctaaagggaaacagtgcttcttagtcctacgtcagcagcagtttaatgtccaggctcttgtggcggtgggagaccatgcaagcaagcagatggttaaatttgctgccaacatcaacaaagagagcattgtggatgtagaaggtgttgtgagaaaagtgaatcagaaaattggaagctgtacacagcaagacgttgagttacatgttcagaagatttatgtgatcagtttggctgaaccccgtctgcccctgcagctggatgatgctgttcggcctgaggcagaaggagaagaggaaggaagagctactgttaaccaggatacaagattagacaacagagtcattgatcttaggacatcaactagtcaggcagtcttccgtctccagtctggcatctgccatctcttccgagaaactttaattaacaaaggttttgtggaaatccaaactcctaaaattatttcagctgccagtgaaggaggagccaatgtttttactgtgtcatattttaaaaataatgcatacctggctcagtccccacagctatataagcaaatgtgcatttgtgctgattttgagaaggttttctctattggaccagtattcagagcggaagactctaatacccatagacatctaactgagtttgttggtttggacattgaaatggcttttaattaccattaccacgaagttatggaagaaattgctgacaccatggtacaaatattcaaaggacttcaagaaaggtttcagactgaaattcaaacagtgaataaacagttcccatgtgagccattcaaatttttggagccaactctaagactagaatattgtgaagcattggctatgcttagggaagctggagtcgaaatgggagatgaagacgatctgagcacaccaaatgaaaagctgttgggtcatttggtaaaggaaaagtatgatacagatttttatattcttgataaatatccattggctgtaagacctttctataccatgcctgacccaagaaatcccaaacagtccaactcttacgatatgttcatgagaggagaagaaatattgtcaggagctcaaagaatacatgatcctcaactgctaacagagagagctttacatcatggaattgatttggagaaaattaaggcttacattgattccttccgctttggagcccctcctcatgctggtggaggcattggattggaacgagttactatgctgtttctgggattgcataatgttcgtcagacctccatgttccctcgtgatcccaaacgactcactccttaaattcacactttgccacttaactccagtgtggatgacagagcgagaccctgcctcaaaaaaaaaaaaaaaaaaaaagaaagccacacttattcttttcagtaacctgctagtgcacaggctgtactttaggtacttaaaatatgcactagaataaatttgcaaggccctaaaatatcactgttatttttggagtaattcagtataggttcgttttcatatggttatgttacaaattcatattctgttactacagtaaacgttaagagttttaaacagttaagattgtacaatttttcttcttttctatattacaagggccccagtgttaatgtcttagattttcagtatttgaacttatttttttaaattctgtcattgagataagaataattcaggtagcatctgaaattttaatgaatgtataattggcatatcatggaaaattaaccagaaagtatcagttcttaaaagttatgcctagaaattatgtaaagctaaactactggttagaaagtattcagtgtaatattgtattaatttgttaaattctaaacttgaatttcaataaaattttaaagctaa

SEQ ID NO: 278504 - DNA, 1945 bp, Homo sapiens
ccgggatctcgagatagccgcagctctcgcgatctttctggagccgcacctccacgcggagtccgagcgcgtgtgctgagaccccagggtcgggagggcggagactgggagggagggagaagcccctttggcctgccttacggaagcctgcgagggagggtggtgtccactgcccagttccgtgtcccgatgcccagcgccagcgccagccgcaagagtcaggagaagccgcgggagatcatggacgcggcggaagattatgctaaagagagatatggaatatcttcaatgatacaatcacaagaaaaaccagatcgagttttggttcgggttagagacttgacaatacaaaaagctgatgaagttgtttgggtacgtgcaagagttcatacaagcagagctaaagggaaacagtgcttcttagtcctacgtcagcagcagtttaatgtccaggctcttgtggcggtgggagaccatgcaagcaagcagatggttaaatttgctgccaacatcaacaaagagagcattgtggatgtagaaggtgttgtgagaaaagtgaatcagaaaattggaagctgtacacagcaagacgttgagttacatgttcagaagatttatgtgatcagtttggctgaaccccgtctgcccctgcagctggatgatgctgttcggcctgaggcagaaggagaagaggaaggaagagctactgttaaccaggatacaagattagacaacagagtcattgatcttaggacatcaactagtcaggcagtcttccgtctccagtctggcatctgccatctcttccgagaaactttaattaacaaaggttttgtggaaatccaaactcctaaaattatttcagctgccagtgaaggaggagccaatgtttttactgtgtcatattttaaaaataatgcatacctggctcagtccccacagctatataagcaaatgtgcatttgtgctgattttgagaaggttttctctattggaccagtattcagagcggaagactctaatacccatagacatctaactgagtttgttggtttggacattgaaatggcttttaattaccattaccacgaagttatggaagaaattgctgacaccatggtacaaatattcaaaggacttcaagaaaggtttcagactgaaattcaaacagtgaataaacagttcccatgtgagccattcaaatttttggagccaactctaagactagaatattgtgaagcattggctatgcttagggaagctggagtcgaaatgggagatgaagacgatctgagcacaccaaatgaaaagctgttgggtcatttggtaaaggaaaagtatgatacagatttttatattcttgataaatatccattggctgtaagacctttctataccatgcctgacccaagaaatcccaaacagtccaactcttacgatatgttcatgagaggagaagaaatattgtcaggagctcaaagaatacatgatcctcaactgctaacagagagagctttacatcatggaattgatttggagaaaattaaggcttacattgattccttccgctttggagcccctcctcatgctggtggaggcattggattggaacgagttactatgctgtttctgggattgcataatgttcgtcagacctccatgttccctcgtgatcccaaacgactcactccttaaattcacactttgccacttaactccagtgtggatgacagagcgagaccctgcctcaaaaaaaaaaaaaaaaaaaaagaaagccacacttattcttttcagtaacctgctagtgcacaggctgtactttaggtacttaaaatatgcactagaataaatttgcaaggccctaaaatatcactgttatttttggagtaattcagtataggttcgtttaaaagagatttttagggagagaaagggggagcctcta

SEQ ID NO: 278505 - DNA, 2285 bp, Homo sapiens
ttttgttgtcgttgccactgtatttacacctcacttacacagggactggtaacccatgctgccttggcaagccaactgcactcctctgtcccaacaagcagggcaatggattgcgaagaggcctcctccgtccccaagcagctacgtcgcccaggggaagagagaaggcgggaaagtccaagagaggagaaaccaaggcccgcgcttaggattatgctaaagagagatatggaatatcttcaatgatacaatcacaagaaaaaccagatcgagttttggttcgggttagagacttgacaatacaaaaagctgatgaagttgtttgggtacgtgcaagagttcatacaagcagagctaaagggaaacagtgcttcttagtcctacgtcagcagcagtttaatgtccaggctcttgtggcggtgggagaccatgcaagcaagcagatggttaaatttgctgccaacatcaacaaagagagcattgtggatgtagaaggtgttgtgagaaaagtgaatcagaaaattggaagctgtacacagcaagacgttgagttacatgttcagaagatttatgtgatcagtttggctgaaccccgtctgcccctgcagctggatgatgctgttcggcctgaggcagaaggagaagaggaaggaagagctactgttaaccaggatacaagattagacaacagagtcattgatcttaggacatcaactagtcaggcagtcttccgtctccagtctggcatctgccatctcttccgagaaactttaattaacaaaggttttgtggaaatccaaactcctaaaattatttcagctgccagtgaaggaggagccaatgtttttactgtgtcatattttaaaaataatgcatacctggctcagtccccacagctatataagcaaatgtgcatttgtgctgattttgagaaggttttctctattggaccagtattcagagcggaagactctaatacccatagacatctaactgagtttgttggtttggacattgaaatggcttttaattaccattaccacgaagttatggaagaaattgctgacaccatggtacaaatattcaaaggacttcaagaaaggtttcagactgaaattcaaacagtgaataaacagttcccatgtgagccattcaaatttttggagccaactctaagactagaatattgtgaagcattggctatgcttagggaagctggagtcgaaatgggagatgaagacgatctgagcacaccaaatgaaaagctgttgggtcatttggtaaaggaaaagtatgatacagatttttatattcttgataaatatccattggctgtaagacctttctataccatgcctgacccaagaaatcccaaacagtccaactcttacgatatgttcatgagaggagaagaaatattgtcaggagctcaaagaatacatgatcctcaactgctaacagagagagctttacatcatggaattgatttggagaaaattaaggcttacattgattccttccgctttggagcccctcctcatgctggtggaggcattggattggaacgagttactatgctgtttctgggattgcataatgttcgtcagacctccatgttccctcgtgatcccaaacgactcactccttaaattcacactttgccacttaactccagtgtggatgacagagcgagaccctgcctcaaaaaaaaaaaaaaaaaaaaagaaagccacacttattcttttcagtaacctgctagtgcacaggctgtactttaggtacttaaaatatgcactagaataaatttgcaaggccctaaaatatcactgttatttttggagtaattcagtataggttcgtttaaaagagatttttataacttcagacatgcatcagtaggaaataacttgagaaattcatatggttatgttacaaattcatattctgttactacagtaaacgttaagagttttaaacagttaagattgtacaatttttcttcttttctatattacaagggccccagtgttaatgtcttagattttcagtatttgaacttatttttttaaattctgtcattgagataagaataattcaggtagcatctgaaattttaatgaatgtataattggcatatcatggaaaattaaccagaaagtatcagttcttaaaagttatgcctagaaattatgtaaagctaaactactggttagaaagtattcagtgtaatattgtattaatttgttaaattctaaacttgaatttcaataaaattttaaagctaa

SEQ ID NO: 278506 - DNA, 2358 bp, Homo sapiens
ttttgttgtcgttgccactgtatttacacctcacttacacagggactggtaacccatgctgccttggcaagccaactgcactcctctgtcccaacaagcagggcaatggattgcgaagaggcctcctccgtccccaagcagctacgtcgcccaggggaagagagaaggcgggaaagtccaagagaggagaaaccaaggcccgcgcttaggtgggtgttgtagtgacgagtctgcggttacagccgagcggagttgaaagggggaagcctgcgagggagggtggtgtccactgcccagttccgtgtcccgatgcccagcgccagcgccagccgcaagagtcaggagaagccgcgggagatcatggacgcggcggaagattatgctaaagagagatatggaatatcttcaatgatacaatcacaagaaaaaccagggaaacagtgcttcttagtcctacgtcagcagcagtttaatgtccaggctcttgtggcggtgggagaccatgcaagcaagcagatggttaaatttgctgccaacatcaacaaagagagcattgtggatgtagaaggtgttgtgagaaaagtgaatcagaaaattggaagctgtacacagcaagacgttgagttacatgttcagaagatttatgtgatcagtttggctgaaccccgtctgcccctgcagctggatgatgctgttcggcctgaggcagaaggagaagaggaaggaagagctactgttaaccaggatacaagattagacaacagagtcattgatcttaggacatcaactagtcaggcagtcttccgtctccagtctggcatctgccatctcttccgagaaactttaattaacaaaggttttgtggaaatccaaactcctaaaattatttcagctgccagtgaaggaggagccaatgtttttactgtgtcatattttaaaaataatgcatacctggctcagtccccacagctatataagcaaatgtgcatttgtgctgattttgagaaggttttctctattggaccagtattcagagcggaagactctaatacccatagacatctaactgagtttgttggtttggacattgaaatggcttttaattaccattaccacgaagttatggaagaaattgctgacaccatggtacaaatattcaaaggacttcaagaaaggtttcagactgaaattcaaacagtgaataaacagttcccatgtgagccattcaaatttttggagccaactctaagactagaatattgtgaagcattggctatgcttagggaagctggagtcgaaatgggagatgaagacgatctgagcacaccaaatgaaaagctgttgggtcatttggtaaaggaaaagtatgatacagatttttatattcttgataaatatccattggctgtaagacctttctataccatgcctgacccaagaaatcccaaacagtccaactcttacgatatgttcatgagaggagaagaaatattgtcaggagctcaaagaatacatgatcctcaactgctaacagagagagctttacatcatggaattgatttggagaaaattaaggcttacattgattccttccgctttggagcccctcctcatgctggtggaggcattggattggaacgagttactatgctgtttctgggattgcataatgttcgtcagacctccatgttccctcgtgatcccaaacgactcactccttaaattcacactttgccacttaactccagtgtggatgacagagcgagaccctgcctcaaaaaaaaaaaaaaaaaaaaagaaagccacacttattcttttcagtaacctgctagtgcacaggctgtactttaggtacttaaaatatgcactagaataaatttgcaaggccctaaaatatcactgttatttttggagtaattcagtataggttcgtttaaaagagatttttataacttcagacatgcatcagtaggaaataacttgagaaattcatatggttatgttacaaattcatattctgttactacagtaaacgttaagagttttaaacagttaagattgtacaatttttcttcttttctatattacaagggccccagtgttaatgtcttagattttcagtatttgaacttatttttttaaattctgtcattgagataagaataattcaggtagcatctgaaattttaatgaatgtataattggcatatcatggaaaattaaccagaaagtatcagttcttaaaagttatgcctagaaattatgtaaagctaaactactggttagaaagtattcagtgtaatattgtattaatttgttaaattctaaacttgaatttcaataaaattttaaagctaa

SEQ ID NO: 278507 - DNA, 2101 bp, Homo sapiens
aaaacagatcgagtttggtttttcttgtgattgtatcattgaagatattccatatctctctttacataatcacaagaaaaaccatcgagttttggttcgggttagagacttgacaatacaaaaagctgatgaagttgtttgggtacgtgcaagagttcatacaagcagagctaaagggaaacagtgcttcttagtcctacgtcagcagcagtttaatgtccaggctcttgtggcggtgggagaccatgcaagcaagcagatggttaaatttgctgccaacatcaacaaagagagcattgtggatgtagaaggtgttgtgagaaaagtgaatcagaaaattggaagctgtacacagcaagacgttgagttacatgttcagaagatttatgtgatcagtttggctgaaccccgtctgcccctgcagctggatgatgctgttcggcctgaggcagaaggagaagaggaaggaagagctactgttaaccaggatacaagattagacaacagagtcattgatcttaggacatcaactagtcaggcagtcttccgtctccagtctggcatctgccatctcttccgagaaactttaattaacaaaggttttgtggaaatccaaactcctaaaattatttcagctgccagtgaaggaggagccaatgtttttactgtgtcatattttaaaaataatgcatacctggctcagtccccacagctatataagcaaatgtgcatttgtgctgattttgagaaggttttctctattggaccagtattcagagcggaagactctaatacccatagacatctaactgagtttgttggtttggacattgaaatggcttttaattaccattaccacgaagttatggaagaaattgctgacaccatggtacaaatattcaaaggacttcaagaaaggtttcagactgaaattcaaacagtgaataaacagttcccatgtgagccattcaaatttttggagccaactctaagactagaatattgtgaagcattggctatgcttagggaagctggagtcgaaatgggagatgaagacgatctgagcacaccaaatgaaaagctgttgggtcatttggtaaaggaaaagtatgatacagatttttatattcttgataaatatccattggctgtaagacctttctataccatgcctgacccaagaaatcccaaacagtccaactcttacgatatgttcatgagaggagaagaaatattgtcaggagctcaaagaatacatgatcctcaactgctaacagagagagctttacatcatggaattgatttggagaaaattaaggcttacattgattccttccgctttggagcccctcctcatgctggtggaggcattggattggaacgagttactatgctgtttctgggattgcataatgttcgtcagacctccatgttccctcgtgatcccaaacgactcactccttaaattcacactttgccacttaactccagtgtggatgacagagcgagaccctgcctcaaaaaaaaaaaaaaaaaaaaagaaagccacacttattcttttcagtaacctgctagtgcacaggctgtactttaggtacttaaaatatgcactagaataaatttgcaaggccctaaaatatcactgttatttttggagtaattcagtataggttcgtttaaaagagatttttataacttcagacatgcatcagtaggaaataacttgagaaattcatatggttatgttacaaattcatattctgttactacagtaaacgttaagagttttaaacagttaagattgtacaatttttcttcttttctatattacaagggccccagtgttaatgtcttagattttcagtatttgaacttatttttttaaattctgtcattgagataagaataattcaggtagcatctgaaattttaatgaatgtataattggcatatcatggaaaattaaccagaaagtatcagttcttaaaagttatgcctagaaattatgtaaagctaaactactggttagaaagtattcagtgtaatattgtattaatttgttaaattctaaacttgaatttcaataaaattttaaagctaa

SEQ ID NO: 278508 - DNA, 2073 bp, Homo sapiens
taatttcttaatctaattgaacaaatacacaagtatctgcaattgtattgttgtaatggttaaaataaaaatacatggtttttattcatttattgtcaaataccaaaatcttacttagaacattagtatgctgcacaaacattgctatgtctcactttatgggttggttgcctttaaaaaaaacagaccattcacaagtaagttgtttcactaattgttaagaaacatttttcttttatggaattcctacaaattaaaacatctgctcactaaggatttccggtgaaattcctttatatgatcatatatagtcattgtattccagcatgcctttttgccttgtatttattcgtgtcctttcgtcttctctccaattattagaatttaaaaatgttgaaagcaagaattgttaggtttccacagtgcctagcccacagagttagtgcttagtaattaagtacgttgatttaattagattttattactgtcttctagacatcaactagtcaggcagtcttccgtctccagtctggcatctgccatctcttccgagaaactttaattaacaaaggttttgtggaaatccaaactcctaaaattatttcagctgccagtgaaggaggagccaatgtttttactgtgtcatattttaaaaataatgcatacctggctcagtccccacagctatataagcaaatgtgcatttgtgctgattttgagaaggttttctctattggaccagtattcagagcggaagactctaatacccatagacatctaactgagtttgttggtttggacattgaaatggcttttaattaccattaccacgaagttatggaagaaattgctgacaccatggtacaaatattcaaaggacttcaagaaaggtttcagactgaaattcaaacagtgaataaacagttcccatgtgagccattcaaatttttggagccaactctaagactagaatattgtgaagcattggctatgcttagggaagctggagtcgaaatgggagatgaagacgatctgagcacaccaaatgaaaagctgttgggtcatttggtaaaggaaaagtatgatacagatttttatattcttgataaatatccattggctgtaagacctttctataccatgcctgacccaagaaatcccaaacagtccaactcttacgatatgttcatgagaggagaagaaatattgtcaggagctcaaagaatacatgatcctcaactgctaacagagagagctttacatcatggaattgatttggagaaaattaaggcttacattgattccttccgctttggagcccctcctcatgctggtggaggcattggattggaacgagttactatgctgtttctgggattgcataatgttcgtcagacctccatgttccctcgtgatcccaaacgactcactccttaaattcacactttgccacttaactccagtgtggatgacagagcgagaccctgcctcaaaaaaaaaaaaaaaaaaaaagaaagccacacttattcttttcagtaacctgctagtgcacaggctgtactttaggtacttaaaatatgcactagaataaatttgcaaggccctaaaatatcactgttatttttggagtaattcagtataggttcgtttaaaagagatttttataacttcagacatgcatcagtaggaaataacttgagaaattcatatggttatgttacaaattcatattctgttactacagtaaacgttaagagttttaaacagttaagattgtacaatttttcttcttttctatattacaagggccccagtgttaatgtcttagattttcagtatttgaacttatttttttaaattctgtcattgagataagaataattcaggtagcatctgaaattttaatgaatgtataattggcatatcatggaaaattaaccagaaagtatcagttcttaaaagttatgcctagaaattatgtaaagctaaactactggttagaaagtattcagtgtaatattgtattaatttgttaaattctaaacttgaatttcaataaaattttaaagctaa

SEQ ID NO: 278509 - DNA, 1657 bp, Homo sapiens
  misc_feature (1550)..(1550): n is a, c, g, or t
  misc_feature (1638)..(1638): n is a, c, g, or t
  misc_feature (1641)..(1641): n is a, c, g, or t
ccgggatctcgagatagccgcagctctcgcgatctttctggagccgcacctccacgcggagtccgagcgcgtgtgctgagaccccagggtcgggagggcggagactgggagggagggagaagcccctttggcctgccttacggaagcctgcgagggagggtggtgtccactgcccagttccgtgtcccgatgcccagcgccagcgccagccgcaagagtcaggagaagccgcgggagatcatggacgcggcggaagattatgctaaagagagatatggaatatcttcaatgatacaatcacaagaaaaaccagatcgagttttggttcgggttagagacttgacaatacaaaaagctgatgaagttgtttgggtacgtgcaagagttcatacaagcagagctaaagggaaacagtgcttcttagtcctacgtcagcagcagtttaatgtccaggctcttgtggcggtgggagaccatgcaagcaagcagatggttaaatttgctgccaacatcaacaaagagagcattgtggatgtagaaggtgttgtgagaaaagtgaatcagaaaattggaagctgtacacagcaagacgttgagttacatgttcagaagatttatgtgatcagtttggctgaaccccgtctgcccctgcagctggatgatgctgttcggcctgaggcagaaggagaagaggaaggaagagctactgttaaccaggatacaagattagacaacagagtcattgatcttaggacatcaactagtcaggcagtcttccgtctccagtctggcatctgccatctcttccgagaaactttaattaacaaaggttttgtggaaatccaaactcctaaaattatttcagctgccagtgaaggaggagccaatgtttttactgtgtcatattttaaaaataatgcatacctggctcagtccccacagctatataagcaaatgtgcatttgtgctgattttgagaaggttttctctattggaccagtattcagagcggaagactctaatacccatagacatctaactgagtttgttggtttggacattgaaatggcttttaattaccattaccacgaagttatggaagaaattgctgacaccatggtacaaatattcaaaggacttcaagaaaggtttcagactgaaattcaaacagtgaataaacagttcccatgtgagccattcaaatttttggagccaactctaagactagaatattgtgaagcattggctatgcttagggaagctggagtcgaaatgggagatgaagacgatctgagcacaccaaatgaaaagctgttgggtcatttggtaaaggaaaagtatgatacagatttttatattcttgataaatatccattggctgtaagacctttctataccatgcctgacccaagaaatcccaaacagtccaactcttacgatatgttcatgagaggagaagaaatattgtcaggagctcaaagaatacatgatcctcaactgctaacagagagagctttacatcatggaattgatttgggaaaaaaattaanggcttaacatttgattccttcccgcctttgggaagccccctccctccattgcctgggttgggaaggcatttgggaatttgggaaaccnaantttacctaatgcctgt

SEQ ID NO: 278510 - DNA, 1204 bp, Homo sapiens
ccgggatctcgagatagccgcagctctcgcgatctttctggagccgcacctccacgcggagtccgagcgcgtgtgctgagaccccagggtcgggagggcggagactgggagggagggagaagcccctttggcctgccttacggaagcctgcgagggagggtggtgtccactgcccagttccgtgtcccgatgcccagcgccagcgccagccgcaagagtcaggagaagccgcgggagatcatggacgcggcggaagattatgctaaagagagatatggaatatcttcaatgatacaatcacaagaaaaaccagatcgagttttggttcgggttagagacttgacaatacaaaaagctgatgaagttgtttgggtacgtgcaagagttcatacaagcagagctaaagggaaacagtgcttcttagtcctacgtcagcagcagtttaatgtccaggctcttgtggcggtgggagaccatgcaagcaagcagatggttaaatttgctgccaacatcaacaaagagagcattgtggatgtagaaggtgttgtgagaaaagtgaatcagaaaattggaagctgtacacagcaagacgttgagttacatgttcagaagatttatgtgatcagtttggctgaaccccgtctgcccctgcagctggatgatgctgttcggcctgaggcagaaggagaagaggaaggaagagctactgttaaccaggatacaagattagacaacagagtcattgatcttaggacatcaactagtcaggcagtcttccgtctccagtctggcatctgccatctcttccgagaaactttaattaacaaaggttttgtggaaatccaaactcctaaaattatttcagctgccagtgaaggaggagccaatgtttttactgtgtcatattttaaaaataatgcatacctggctcagtccccacagctatataagcaaatgtgcatttgtgctgattttgagaaggttttctctattggaccagtattcagagcggaagactctaatacccatagacatctaactgagtttgttggtttggacattgaaatggcttttaattaccattaccacgaagttatggaagaaattgctgacaccatggtacaaatattcaaaggacttcaagaaaggtaaaaagtattttatgcacctagatggacttaatttcaaatgtttgggcccttta

SEQ ID NO: 278511 - DNA, 1115 bp, Homo sapiens
gggaggagagcacagaatctgatataaacaaagaaaaagttattcagccctcagtagtttaattctactttagagaacaagattgcattgttaattgtaggaaaaaatgaacttgctcttcatgcagcagagatttttttccgtatatatgtaatagaaataggatggtagtcacttgaggactggtgttttttctcttgcagaaacagtccaactcttacgatatgttcatgagaggagaagaaatattgtcaggagctcaaagaatacatgatcctcaactgctaacagagagagctttacatcatggaattgatttggagaaaattaaggcttacattgattccttccgctttggagcccctcctcatgctggtggaggcattggattggaacgagttactatgctgtttctgggattgcataatgttcgtcagacctccatgttccctcgtgatcccaaacgactcactccttaaattcacactttgccacttaactccagtgtggatgacagagcgagaccctgcctcaaaaaaaaaaaaaaaaaaaaagaaagccacacttattcttttcagtaacctgctagtgcacaggctgtactttaggtacttaaaatatgcactagaataaatttgcaaggccctaaaatatcactgttatttttggagtaattcagtataggttcgtttaaaagagatttttataacttcagacatgcatcagtaggaaataacttgagaaattcatatggttatgttacaaattcatattctgttactacagtaaacgttaagagttttaaacagttaagattgtacaatttttcttcttttctatattacaagggccccagtgttaatgtcttagattttcagtatttgaacttatttttttaaattctgtcattgagataagaataattcaggtagcatctgaaattttaatgaatgtataattggcatatcatggaaaattaaccagaaagtatcagttcttaaaagttatgcctagaaattatgtaaagctaaactactggttagaaagtattcagtgtaatattgtattaatttgttaaattctaaacttgaatttcaataaaattttaaagctaa

SEQ ID NO: 278512 - DNA, 1048 bp, Homo sapiens
tcaagcttataaagtcttttgttttgtttttcttattgttacatcatagattttgttcattcgtatagatttttgtggttcacattttagactccataccactcaaggatatattacttagtccttttcatttatagcagcatctttatttctgaatcaatactcaaaacagttttaaataaacccaaaataataagagtcattttctttcctaacaaggaaaagtatttagtttaacgattacatttatgtttgtagttctaagtaagaccctgagagattttcaaaaaggaattaatgattatttttgtcttccccaggattggaacgagttactatgctgtttctgggattgcataatgttcgtcagacctccatgttccctcgtgatcccaaacgactcactccttaaattcacactttgccacttaactccagtgtggatgacagagcgagaccctgcctcaaaaaaaaaaaaaaaaaaaaagaaagccacacttattcttttcagtaacctgctagtgcacaggctgtactttaggtacttaaaatatgcactagaataaatttgcaaggccctaaaatatcactgttatttttggagtaattcagtataggttcgtttaaaagagatttttataacttcagacatgcatcagtaggaaataacttgagaaattcatatggttatgttacaaattcatattctgttactacagtaaacgttaagagttttaaacagttaagattgtacaatttttcttcttttctatattacaagggccccagtgttaatgtcttagattttcagtatttgaacttatttttttaaattctgtcattgagataagaataattcaggtagcatctgaaattttaatgaatgtataattggcatatcatggaaaattaaccagaaagtatcagttcttaaaagttatgcctagaaattatgtaaagctaaactactggttagaaagtattcagtgtaatattgtattaatttgttaaattctaaacttgaatttcaataaaattttaaagctaa

SEQ ID NO: 278513 - DNA, 651 bp, Homo sapiens
cactccctccctgaattcccccctttgccacttaactccagtgtggatgacagagcgagaccctgcctcaaaaaaaaaaaaaaaaaaaaagaaagccacacttattcttttcagtaacctgctagtgcacaggctgtactttaggtacttaaaatatgcactagaataaatttgcaaggccctaaaatatcactgttatttttggagtaattcagtataggttcgtttaaaagagatttttataacttcagacatgcatcagtaggaaataacttgagaaattcatatggttatgttacaaattcatattctgttactacagtaaacgttaagagttttaaacagttaagattgtacaatttttcttcttttctatattacaagggccccagtgttaatgtcttagattttcagtatttgaacttatttttttaaattctgtcattgagataagaataattcaggtagcatctgaaattttaatgaatgtataattggcatatcatggaaaattaaccagaaagtatcagttcttaaaagttatgcctagaaattatgtaaagctaaactactggttagaaagtattcagtgtaatattgtattaatttgttaaattctaaacttgaatttcaataaaattttaaagctaa

SEQ ID NO: 278514 - DNA, 715 bp, Homo sapiens
tgtttatcgatgcccccccgccaggtgcaccgctctagtgttccgtttcctcttcgtgcctcctgggggtttccctttctttcgctctttgccacttaactccagtgtggatgacagagcgagaccctgcctcaaaaaaaaaaaaaaaaaaaaagaaagccacacttattcttttcagtaacctgctagtgcacaggctgtactttaggtacttaaaatatgcactagaataaatttgcaaggccctaaaatatcactgttatttttggagtaattcagtataggttcgtttaaaagagatttttataacttcagacatgcatcagtaggaaataacttgagaaattcatatggttatgttacaaattcatattctgttactacagtaaacgttaagagttttaaacagttaagattgtacaatttttcttcttttctatattacaagggccccagtgttaatgtcttagattttcagtatttgaacttatttttttaaattctgtcattgagataagaataattcaggtagcatctgaaattttaatgaatgtataattggcatatcatggaaaattaaccagaaagtatcagttcttaaaagttatgcctagaaattatgtaaagctaaactactggttagaaagtattcagtgtaatattgtattaatttgttaaattctaaacttgaatttcaataaaattttaaagctaa

SEQ ID NO: 278515 - DNA, 696 bp, Homo sapiens
ccgggatctcgagatagccgcagctctcgcgatctttctggagccgcacctccacgcggagtccgagcgcgtgtgctgagaccccagggtcgggagggcggagactgggagggagggagaagcccctttggcctgccttacggaagcctgcgagggagggtggtgtccactgcccagttccgtgtcccgatgcccagcgccagcgccagccgcaagagtcaggagaagccgcgggagatcatggacgcggcggaagattatgctaaagagagatatggaatatcttcaatgatacaatcacaagaaaaaccagatcgagttttggttcgggttagagacttgacaatacaaaaagctgatgaagttgtttgggtacgtgcaagagttcatacaagcagagctaaaggtaggattggtttcattattaaagctctttcggtaaggactccgaattttttgtcttacatattcctcacagaccaaagtaaatctttaaaaacaaaacaaaaacatgtaacttttctttcttaaaagtcactgtaaagtattaacccatggttaatcaattttagattcctgtaaaacatccttacaaataatttgaccctaaagactgatgaaatctaagacttcaagctacttttctagcatcgctctaaagtttaattattttcagctggagaaggagtagctaaa

SEQ ID NO: 278516 - DNA, 450 bp, Homo sapiens
ttgagcagcatctactaagcactgagtcactgtaccaaggtatactcataagtgattttcagtagtacttgccttttaagaaaagagcagaatagacaactgcgtgttctggccaaattttgtaatcccttgagaaactcaaatagaagaagttccttattaatgtttttaagttgccatttgatcttcaaacactgatttcacgtttctttttcagcacaccaaatgaaaagctgttgggtcatttggtaaaggaaaaggtaggactctttatatgctggatttctttttctaattctgaaatgtctcttgggactaaaaacaattgcagaggggtctgagcttcctagaatggtatgattctggaataaataaaaaccgaagaaggacaacattaaaaaaatttttttcttagaaaattgagaaatattcagacagcctgcctttctc

SEQ ID NO: 278517 - DNA, 437 bp, Homo sapiens
  misc_feature (316)..(316): n is a, c, g, or t
ccgggatctcgagatagccgcagctctcgcgatctttctggagccgcacctccacgcggagtccgagcgcgtgtgctgagaccccagggtcgggagggcggagactgggagggagggagaagcccctttggcctgccttacggaagcctgcgagggagggtggtgtccactgcccagttccgtgtcccgatgcccagcgccagcgccagccgcaagagtcaggagaagccgcgggagatcatggacgcggcggaagattatgctaaagagagatatggaatatcttcaatgatacaatcacaagaaaaaccagacnagtttgcttgggattagagcttgcaaactaaaacgtgatgaagttgtttggactggctaaaggcttatacaacgagcgaatggacagctcttatgcctactcgatcacagattctctcgct

SEQ ID NO: 278518 - DNA, 219 bp, Homo sapiens
ctattcatcggcacctcgctattcatcggcacctcgctattcatcggcactcaaagaatacatgatcctcaactgctaacagagagagctttacatcatggaattgatttggagaaaattaaggcttacattgattccttccgctttggtgcgcgatgaatagcgaggtgccgatgaatagcgaggtgccgatgaatagcgagtgccgatgagagcgaa

SEQ ID NO: 278519 - DNA, 2540 bp, Homo sapiens
ccgggatctcgagatagccgcagctctcgcgatctttctggagccgcacctccacgcggagtccgagcgcgtgtgctgagaccccagggtcgggagggcggagactgggagggagggagaagcccctttggcctgccttacggaagcctgcgagggagggtggtgtccactgcccagttccgtgtcccgatgcccagcgccagcgccagccgcaagagtcaggagaagccgcgggagatcatggacgcggcggaagattatgctaaagagagatatggaatatcttcaatgatacaatcacaagaaaaaccagatcgagttttggttcgggttagagacttgacaatacaaaaagctgatgaagttgtttgggtacgtgcaagagttcatacaagcagagctaaagggaaacagtgcttcttagtcctacgtcagcagcagtttaatgtccaggctcttgtggcggtgggagaccatgcaagcaagcagatggttaaatttgctgccaacatcaacaaagagagcattgtggatgtagaaggtgttgtgagaaaagtgaatcagaaaattggaagctgtacacagcaagacgttgagttacatgttcagaagatttatgtgatcagtttggctgaaccccgtctgcccctgcagctggatgatgctgttcggcctgaggcagaaggagaagaggaaggaagagctactgttaaccaggatacaagattagacaacagagtcattgatcttaggacatcaactagtcaggcagtcttccgtctccagtctggcatctgccatctcttccgagaaactttaattaacaaaggttttgtggaaatccaaactcctaaaattatttcagctgccagtgaaggaggagccaatgtttttactgtgtcatattttaaaaataatgcatacctggctcagtccccacagctatataagcaaatgtgcatttgtgctgattttgagaaggttttctctattggaccagtattcagagcggaagactctaatacccatagacatctaactgagtttgttggtttggacattgaaatggcttttaattaccattaccacgaagttatggaagaaattgctgacaccatggtacaaatattcaaaggacttcaagaaaggtttcagactgaaattcaaacagtgaataaacagttcccatgtgagccattcaaatttttggagccaactctaagactagaatattgtgaagcattggctatgcttagggaagctggagtcgaaatgggagatgaagacgatctgagcacaccaaatgaaaagctgttgggtcatttggtaaaggaaaagtatgatacagatttttatattcttgataaatatccattggctgtaagacctttctataccatgcctgacccaagaaatcccaaacagtccaactcttacgatatgttcatgagaggagaagaaatattgtcaggagctcaaagaatacatgatcctcaactgctaacagagagagctttacatcatggaattgatttggagaaaattaaggcttacattgattccttccgctttggagcccctcctcatgctggtggaggcattggattggaacgagttactatgctgtttctgggattgcataatgttcgtcagacctccatgttccctcgtgatcccaaacgactcactccttaaattcacactttgccacttaactccagtgtggatgacagagcgagaccctgcctcaaaaaaaaaaaaaaaaaaaaagaaagccacacttattcttttcagtaacctgctagtgcacaggctgtactttaggtacttaaaatatgcactagaataaatttgcaaggccctaaaatatcactgttatttttggagtaattcagtataggttcgtttaaaagagatttttataacttcagacatgcatcagtaggaaataacttgagaaattcatatggttatgttacaaattcatattctgttactacagtaaacgttaagagttttaaacagttaagattgtacaatttttcttcttttctatattacaagggccccagtgttaatgtcttagattttcagtatttgaacttatttttttaaattctgtcattgagataagaataattcaggtagcatctgaaattttaatgaatgtataattggcatatcatggaaaattaaccagaaagtatcagttcttaaaagttatgcctagaaattatgtaaagctaaactactggttagaaagtattcagtgtaatattgtattaatttgttaaattctaaacttgaatttcaataaaattttaaagctaattgtagtttttgtgtaactttgtggccaactgattttgtaagtggtgctaggcattcataatttggtaaaagaaaaaatacacaactagtttatataaataaagactaatatgttgtcaacatgtattcatttcaggatattagtttagatgggcgtagggatagagctcttaaagttgacagcttgggtcggttgacagagttcattt

SEQ ID NO: 278520 - DNA, 2512 bp, Homo sapiens
ccgggatctcgagatagccgcagctctcgcgatctttctggagccgcacctccacgcggagtccgagcgcgtgtgctgagaccccagggtcgggagggcggagactgggagggagggagaagcccctttggcctgccttacggaagcctgcgagggagggtggtgtccactgcccagttccgtgtcccgatgcccagcgccagcgccagccgcaagagtcaggagaagccgcgggagatcatggacgcggcggaagattatgctaaagagagatatggaatatcttcaatgatacaatcacaagaaaaaccagatcgagttttggttcgggttagagacttgacaatacaaaaagctgatgaagttgtttgggtacgtgcaagagttcatacaagcagagctaaagggaaacagtgcttcttagtcctacgtcagcagcagtttaatgtccaggctcttgtggcggtgggagaccatgcaagcaagcagatggttaaatttgctgccaacatcaacaaagagagcattgtggatgtagaaggtgttgtgagaaaagtgaatcagaaaattggaagctgtacacagcaagacgttgagttacatgttcagaagatttatgtgatcagtttggctgaaccccgtctgcccctgcagctggatgatgctgttcggcctgaggcagaaggagaagaggaaggaagagctactgttaaccaggatacaagattagacaacagagtcattgatcttaggacatcaactagtcaggcagtcttccgtctccagtctggcatctgccatctcttccgagaaactttaattaacaaaggttttgtggaaatccaaactcctaaaattatttcagctgccagtgaaggaggagccaatgtttttactgtgtcatattttaaaaataatgcatacctggctcagtccccacagctatataagcaaatgtgcatttgtgctgattttgagaaggttttctctattggaccagtattcagagcggaagactctaatacccatagacatctaactgagtttgttggtttggacattgaaatggcttttaattaccattaccacgaagttatggaagaaattgctgacaccatggtacaaatattcaaaggacttcaagaaaggtttcagactgaaattcaaacagtgaataaacagttcccatgtgagccattcaaatttttggagccaactctaagactagaatattgtgaagcattggctatgcttagggaagctggagtcgaaatgggagatgaagacgatctgagcacaccaaatgaaaagctgttgggtcatttggtaaaggaaaagtatgatacagatttttatattcttgataaatatccattggctgtaagacctttctataccatgcctgacccaagaaatcccaaacagtccaactcttacgatatgttcatgagaggagaagaaatattgtcaggagctcaaagaatacatgatcctcaactgctaacagagagagctttacatcatggaattgatttggagaaaattaaggcttacattgattccttccgctttggagcccctcctcatgctggtggaggcattggattggaacgagttactatgctgtttctgggattgcataatgttcgtcagacctccatgttccctcgtgatcccaaacgactcactccttaaattcacactttgccacttaactccagtgtggatgacagagcgagaccctgcctcaaaaaaaaaaaaaaaaaaaaagaaagccacacttattcttttcagtaacctgctagtgcacaggctgtactttaggtacttaaaatatgcactagaataaatttgcaaggccctaaaatatcactgttatttttggagtaattcagtataggttcgtttaaaagagatttttataacttcagacatgcatcagtaggaaataacttgagaaattcatatggttatgttacaaattcatattctgttactacagtaaacgttaagagttttaaacagttaagattgtacaatttttcttcttttctatattacaagggccccagtgttaatgtcttagattttcagtatttgaacttatttttttaaattctgtcattgagataagaataattcaggtagcatctgaaattttaatgaatgtataattggcatatcatggaaaattaaccagaaagtatcagttcttaaaagttatgcctagaaattatgtaaagctaaactactggttagaaagtattcagtgtaatattgtattaatttgttaaattctaaacttgaatttcaataaaattttaaagctaaaaaaaaaaaaaaaaaaaaaaaaaaaaaaaaaaaaaaaaaaaaaaaaaaaaaaagaaggaagagagaaacaagagagagaagagaacaagaaggggggggggggcttgaggtcccggggggggccccagtccacggggttttaaaggggggggcccagggggggcgggggacgaggggcgca

SEQ ID NO: 278521 - DNA, 2389 bp, Homo sapiens
ccgggatctcgagatagccgcagctctcgcgatctttctggagccgcacctccacgcggagtccgagcgcgtgtgctgagaccccagggtcgggagggcggagactgggagggagggagaagcccctttggcctgccttacggaagcctgcgagggagggtggtgtccactgcccagttccgtgtcccgatgcccagcgccagcgccagccgcaagagtcaggagaagccgcgggagatcatggacgcggcggaagattatgctaaagagagatatggaatatcttcaatgatacaatcacaagaaaaaccagatcgagttttggttcgggttagagacttgacaatacaaaaagctgatgaagttgtttgggtacgtgcaagagttcatacaagcagagctaaagggaaacagtgcttcttagtcctacgtcagcagcagtttaatgtccaggctcttgtggcggtgggagaccatgcaagcaagcagatggttaaatttgctgccaacatcaacaaagagagcattgtggatgtagaaggtgttgtgagaaaagtgaatcagaaaattggaagctgtacacagcaagacgttgagttacatgttcagaagatttatgtgatcagtttggctgaaccccgtctgcccctgcagctggatgatgctgttcggcctgaggcagaaggagaagaggaaggaagagctactgttaaccaggatacaagattagacaacagagtcattgatcttaggacatcaactagtcaggcagtcttccgtctccagtctggcatctgccatctcttccgagaaactttaattaacaaaggttttgtggaaatccaaactcctaaaattatttcagctgccagtgaaggaggagccaatgtttttactgtgtcatattttaaaaataatgcatacctggctcagtccccacagctatataagcaaatgtgcatttgtgctgattttgagaaggttttctctattggaccagtattcagagcggaagactctaatacccatagacatctaactgagtttgttggtttggacattgaaatggcttttaattaccattaccacgaagttatggaagaaattgctgacaccatggtacaaatattcaaaggacttcaagaaaggtttcagactgaaattcaaacagtgaataaacagttcccatgtgagccattcaaatttttggagccaactctaagactagaatattgtgaagcattggctatgcttagggaagctggagtcgaaatgggagatgaagacgatctgagcacaccaaatgaaaagctgttgggtcatttggtaaaggaaaagtatgatacagatttttatattcttgataaatatccattggctgtaagacctttctataccatgcctgacccaagaaatcccaaacagtccaactcttacgatatgttcatgagaggagaagaaatattgtcaggagctcaaagaatacatgatcctcaactgctaacagagagagctttacatcatggaattgatttggagaaaattaaggcttacattgattccttccgctttggagcccctcctcatgctggtggaggcattggattggaacgagttactatgctgtttctgggattgcataatgttcgtcagacctccatgttccctcgtgatcccaaacgactcactccttaaattcacactttgccacttaactccagtgtggatgacagagcgagaccctgcctccttaaaatatgcactagaataaatttgcaaggccctaaaatatcactgttatttttggagtaattcagtataggttcgtttaaaagagatttttataacttcagacatgcatcagtaggaaataacttgagaaattcatatggttatgttacaaattcatattctgttactacagtaaacgttaagagttttaaacagttaagattgtacaatttttcttcttttctatattacaagggccccagtgttaatgtcttagattttcagtatttgaacttatttttttaaattctgtcattgagataagaataattcaggtagcatctgaaattttaatgaatgtataattggcatatcatggaaaattaaccagaaagtatcagttcttaaaagttatgcctagaaattatgtaaagctaaactactggttagaaagtattcagtgtaatattgtattaatttgttaaattctaaacttgaatttcaataaaattttaaagctaagaaaataaacaactcgaggggggcggtaccattgcctataggtcgttaaatccgggggcggttagagtggagggacgcggttacattaagttggacatccttgtcgggtgtataagaaggagtgtttgcatgatgt

SEQ ID NO: 278522 - DNA, 2421 bp, Homo sapiens
ttttgttgtcgttgccactgtatttacacctcacttacacagggactggtaacccatgctgccttggcaagccaactgcactcctctgtcccaacaagcagggcaatggattgcgaagaggcctcctccgtccccaagcagctacgtcgcccaggggaagagagaaggcgggaaagtccaagagaggagaaaccaaggcccgcgcttaggtgggtgttgtagtgacgagtctgcggttacagccgagcggagttgaaagggctgttagaagaatggagcagaagtcgcagttgggacgaagctgaagagagctggcattcgcccaggtctacagccagccacctggattatgctaaagagagatatggaatatcttcaatgatacaatcacaagaaaaaccagatcgagttttggttcgggttagagacttgacaatacaaaaagctgatgaagttgtttgggtacgtgcaagagttcatacaagcagagctaaagggaaacagtgcttcttagtcctacgtcagcagcagtttaatgtccaggctcttgtggcggtgggagaccatgcaagcaagcagatggttaaatttgctgccaacatcaacaaagagagcattgtggatgtagaaggtgttgtgagaaaagtgaatcagaaaattggaagctgtacacagcaagacgttgagttacatgttcagaagatttatgtgatcagtttggctgaaccccgtctgcccctgcagctggatgatgctgttcggcctgaggcagaaggagaagaggaaggaagagctactgttaaccaggatacaagattagacaacagagtcattgatcttaggacatcaactagtcaggcagtcttccgtctccagtctggcatctgccatctcttccgagaaactttaattaacaaaggttttgtggaaatccaaactcctaaaattatttcagctgccagtgaaggaggagccaatgtttttactgtgtcatattttaaaaataatgcatacctggctcagtccccacagctatataagcaaatgtgcatttgtgctgattttgagaaggttttctctattggaccagtattcagagcggaagactctaatacccatagacatctaactgagtttgttggtttggacattgaaatggcttttaattaccattaccacgaagttatggaagaaattgctgacaccatggtacaaatattcaaaggacttcaagaaaggtttcagactgaaattcaaacagtgaataaacagttcccatgtgagccattcaaatttttggagccaactctaagactagaatattgtgaagcattggctatgcttagggaagctggagtcgaaatgggagatgaagacgatctgagcacaccaaatgaaaagctgttgggtcatttggtaaaggaaaagtatgatacagatttttatattcttgataaatatccattggctgtaagacctttctataccatgcctgacccaagaaatcccaaacagtccaactcttacgatatgttcatgagaggagaagaaatattgtcaggagctcaaagaatacatgatcctcaactgctaacagagagagctttacatcatggaattgatttggagaaaattaaggcttacattgattccttccgctttggagcccctcctcatgctggtggaggcattggattggaacgagttactatgctgtttctgggattgcataatgttcgtcagacctccatgttccctcgtgatcccaaacgactcactccttaaattcacactttgccacttaactccagtgtggatgacagagcgagaccctgcctcaaaaaaaaaaaaaaaaaaaaagaaagccacacttattcttttcagtaacctgctagtgcacaggctgtactttaggtacttaaaatatgcactagaataaatttgcaaggccctaaaatatcactgttatttttggagtaattcagtataggttcgtttaaaagagatttttataacttcagacatgcatcagtaggaaataacttgagaaattcatatggttatgttacaaattcatattctgttactacagtaaacgttaagagttttaaacagttaagattgtacaatttttcttcttttctatattacaagggccccagtgttaatgtcttagattttcagtatttgaacttatttttttaaattctgtcattgagataagaataattcaggtagcatctgaaattttaatgaatgtataattggcatatcatggaaaattaaccagaaagtatcagttcttaaaagttatgcctagaaattatgtaaagctaaactactggttagaaagtattcagtgtaatattgtattaatttgttaaattctaaacttgaatttcaataaaattttaaagctaa

SEQ ID NO: 278523 - DNA, 1843 bp, Homo sapiens
ttaccaggatacagctatacacatcaacaaagagagcattgtggatgtagaaggtgttgtgagaaaagtgaatcagaaaattggaagctgtacacagcaagacgttgagttacatgttcagaagatttatgtgatcagtttggctgaaccccgtctgcccctgcagctggatgatgctgttcggcctgaggcagaaggagaagaggaaggaagagctactgttaaccaggatacaagattagacaacagagtcattgatcttaggacatcaactagtcaggcagtcttccgtctccagtctggcatctgccatctcttccgagaaactttaattaacaaaggttttgtggaaatccaaactcctaaaattatttcagctgccagtgaaggaggagccaatgtttttactgtgtcatattttaaaaataatgcatacctggctcagtccccacagctatataagcaaatgtgcatttgtgctgattttgagaaggttttctctattggaccagtattcagagcggaagactctaatacccatagacatctaactgagtttgttggtttggacattgaaatggcttttaattaccattaccacgaagttatggaagaaattgctgacaccatggtacaaatattcaaaggacttcaagaaaggtttcagactgaaattcaaacagtgaataaacagttcccatgtgagccattcaaatttttggagccaactctaagactagaatattgtgaagcattggctatgcttagggaagctggagtcgaaatgggagatgaagacgatctgagcacaccaaatgaaaagctgttgggtcatttggtaaaggaaaagtatgatacagatttttatattcttgataaatatccattggctgtaagacctttctataccatgcctgacccaagaaatcccaaacagtccaactcttacgatatgttcatgagaggagaagaaatattgtcaggagctcaaagaatacatgatcctcaactgctaacagagagagctttacatcatggaattgatttggagaaaattaaggcttacattgattccttccgctttggagcccctcctcatgctggtggaggcattggattggaacgagttactatgctgtttctgggattgcataatgttcgtcagacctccatgttccctcgtgatcccaaacgactcactccttaaattcacactttgccacttaactccagtgtggatgacagagcgagaccctgcctcaaaaaaaaaaaaaaaaaaaaagaaagccacacttattcttttcagtaacctgctagtgcacaggctgtactttaggtacttaaaatatgcactagaataaatttgcaaggccctaaaatatcactgttatttttggagtaattcagtataggttcgtttaaaagagatttttataacttcagacatgcatcagtaggaaataacttgagaaattcatatggttatgttacaaattcatattctgttactacagtaaacgttaagagttttaaacagttaagattgtacaatttttcttcttttctatattacaagggccccagtgttaatgtcttagattttcagtatttgaacttatttttttaaattctgtcattgagataagaataattcaggtagcatctgaaattttaatgaatgtataattggcatatcatggaaaattaaccagaaagtatcagttcttaaaagttatgcctagaaattatgtaaagctaaactactggttagaaagtattcagtgtaatattgtattaatttgttaaattctaaacttgaatttcaataaaattttaaagctaa

SEQ ID NO: 278524 - DNA, 2250 bp, Homo sapiens
ccgggatctcgagatagccgcagctctcgcgatctttctggagccgcacctccacgcggagtccgagcgcgtgtgctgagaccccagggtcgggagggcggagactgggagggagggagaagcccctttggcctgccttacggaagcctgcgagggagggtggtgtccactgcccagttccgtgtcccgatgcccagcgccagcgccagccgcaagagtcaggagaagccgcgggagatcatggacgcggcggaagattatgctaaagagagatatggaatatcttcaatgatacaatcacaagaaaaaccagatcgagttttggttcgggttagagacttgacaatacaaaaagctgatgaagttgtttgggtacgtgcaagagttcatacaagcagagctaaagggaaacagtgcttcttagtcctacgtcagcagcagtttaatgtccaggctcttgtggcggtgggagaccatgcaagcaagcagatggttaaatttgctgccaacatcaacaaagagagcattgtggatgtagaaggtgttgtgagaaaagtgaatcagaaaattggaagctgtacacagcaagacgttgagttacatgttcagaagatttatgtgatcagtttggctgaaccccgtctgcccctgcagctggatgatgctgttcggcctgaggcagaaggagaagaggaaggaagagctactgttaaccaggatacaagattagacaacagagtcattgatcttaggacatcaactagtcaggcagtcttccgtctccagtctggcatctgccatctcttccgagaaactttaattaacaaaggttttgtggaaatccaaactcctaaaattatttcagctgccagtgaaggaggagccaatgtttttactgtgtcatattttaaaaataatgcatacctggctcagtccccacagctatataagcaaatgtgcatttgtgctgattttgagaaggttttctctattggaccagtattcagagcggaagactctaatacccatagacatctaactgagtttgttggtttggacattgaaatggcttttaattaccattaccacgaagttatggaagaaattgctgacaccatggtacaaatattcaaaggacttcaagaaaggtttcagactgaaattcaaacagtgaataaacagttcccatgtgagccattcaaatttttggagccaactctaagactagaatattgtgaagcattggctatgcttagggaagctggagtcgaaatgggagatgaagacgatctgagcacaccaaatgaaaagctgttgggtcatttggtaaaggaaaagaaacagtccaactcttacgatatgttcatgagaggagaagaaatattgtcaggagctcaaagaatacatgatcctcaactgctaacagagagagctttacatcatggaattgatttggagaaaattaaggcttacattgattccttccgctttggagcccctcctcatgctggtggaggcattggattggaacgagttactatgctgtttctgggattgcataatgttcgtcagacctccatgttccctcgtgatcccaaacgactcactccttaaattcacactttgccacttaactccagtgtggatgacagagcgagaccctgcctcaaaaaaaaaaaaaaaaaaaaagaaagccacacttattcttttcagtaacctgctagtgcacaggctgtactttaggtacttaaaatatgcactagaataaatttgcaaggccctaaaatatcactgttatttttggagtaattcagtataggttcgtttaaaagagatttttataacttcagacatgcatcagtaggaaataacttgagaaattcatatggttatgttacaaattcatattctgttactacagtaaacgttaagagttttaaacagttaagattgtacaatttttcttcttttctatattacaagggccccagtgttaatgtcttagattttcagtatttgaacttatttttttaaattctgtcattgagataagaataattcaggtagcatctgaaattttaatgaatgtataattggcatatcatggaaaattaaccagaaagtatcagttcttaaaagttatgcctagaaattatgtaaagctaaactactggttagaaagtattcagtgtaatattgtattaatttgttaaattctaaacttgaatttcaataaaattttaaagctaa

SEQ ID NO: 278525 - DNA, 1894 bp, Homo sapiens
ccgggatctcgagatagccgcagctctcgcgatctttctggagccgcacctccacgcggagtccgagcgcgtgtgctgagaccccagggtcgggagggcggagactgggagggagggagaagcccctttggcctgccttacggaagcctgcgagggagggtggtgtccactgcccagttccgtgtcccgatgcccagcgccagcgccagccgcaagagtcaggagaagccgcgggagatcatggacgcggcggaagattatgctaaagagagatatggaatatcttcaatgatacaatcacaagaaaaaccagatcgagttttggttcgggttagagacttgacaatacaaaaagctgatgaagttgtttgggtacgtgcaagagttcatacaagcagagctaaagggaaacagtgcttcttagtcctacgtcagcagcagtttaatgtccaggctcttgtggcggtgggagaccatgcaagcaagcagatggttaaatttgctgccaacatcaacaaagagagcattgtggatgtagaaggtgttgtgagaaaagtgaatcagaaaattggaagctgtacacagcaagacgttgagttacatgttcagaagatttatgtgatcagtttggctgaaccccgtctgcccctgcagctggatgatgctgttcggcctgaggcagaaggagaagaggaaggaagagctactgttaaccaggatacaagattagacaacagagtcattgatcttaggacatcaactagtcaggcagtcttccgtctccagtctggcatctgccatctcttccgagaaactttaattaacaaaggttttgtggaaatccaaactcctaaaattatttcagctgccagtgaaggaggagccaatgtttttactgtgtcatattttaaaaataatgcatacctggctcagtccccacagctatataagcaaatgtgcatttgtgctgattttgagaaggttttctctattggaccagtattcagagcggaagactctaatacccatagacatctaactgagtttgttggtttggacattgaaatggcttttaattaccattaccacgaagttatggaagaaattgctgacaccatggtacaaatattcaaaggacttcaagaaaggtttcagactgaaattcaaacagtgaataaacagttcccatgtgagccattcaaatttttggagccaactctaagactagaatattgtgaagcattggctatgcttagggaagctggagtcgaaatgggagatgaagacgatctgagcacaccaaatgaaaagctgttgggtcatttggtaaaggaaaagtatgatacagatttttatattcttgataaatatccattggctgtaagacctttctataccatgcctgacccaagaaatcccaaacagtccaactcttacgatatgttcatgagaggagaagaaatattgtcaggagctcaaagaatacatgatcctcaactgctaacagagagagctttacatcatggaattgatttggagaaaattaaggcttacattgattccttccgctttggagcccctcctcatgctggtggaggcattggtaatattctgttattgcttacaaataagttcataagttctaagtataatacaaatttgaattacaagaatttttaaaagtgaattacgacataagtgaaaatttgatttccaagaaacaaaataaacagctaacttgtgtgttataaaatattattgtcataaagttctagccattttttttctcttaagaatttagaagccaaatgtcttgtaagtggagtatcctgttttctctctgctgctgtgagttcattcgcattagcacaaattaaagctctaccttaaaata

SEQ ID NO: 278526 - DNA, 1084 bp, Homo sapiens
caaaagacgacccaaatctacaacaacttttactaattttcgaccttacacaccaaatgaaaagctgttgggtcatttggtaaaggaaaagtatgatacagatttttatattcttgataaatatccattggctgtaagacctttctataccatgcctgacccaagaaatcccaaacagtccaactcttacgatatgttcatgagaggagaagaaatattgtcaggagctcaaagaatacatgatcctcaactgctaacagagagagctttacatcatggaattgatttggagaaaattaaggcttacattgattccttccgctttggagcccctcctcatgctggtggaggcattggattggaacgagttactatgctgtttctgggattgcataatgttcgtcagacctccatgttccctcgtgatcccaaacgactcactccttaaattcacactttgccacttaactccagtgtggatgacagagcgagaccctgcctcaaaaaaaaaaaaaaaaaaaaagaaagccacacttattcttttcagtaacctgctagtgcacaggctgtactttaggtacttaaaatatgcactagaataaatttgcaaggccctaaaatatcactgttatttttggagtaattcagtataggttcgtttaaaagagatttttataacttcagacatgcatcagtaggaaataacttgagaaattcatatggttatgttacaaattcatattctgttactacagtaaacgttaagagttttaaacagttaagattgtacaatttttcttcttttctatattacaagggccccagtgttaatgtcttagattttcagtatttgaacttatttttttaaattctgtcattgagataagaataattcaggtagcatctgaaattttaatgaatgtataattggcatatcatggaaaattaaccagaaagtatcagttcttaaaagttatgcctagaaattatgtaaagctaaactactggttagaaagtattcagtgtaatattgtattaatttgttaaattctaaacttgaatttcaataaaattttaaagctaa

SEQ ID NO: 278527 - DNA, 890 bp, Homo sapiens
ccgggatctcgagatagccgcagctctcgcgatctttctggagccgcacctccacgcggagtccgagcgcgtgtgctgagaccccagggtcgggagggcggagactgggagggagggagaagcccctttggcctgccttacggaagcctgcgagggagggtggtgtccactgcccagttccgtgtcccgatgcccagcgccagcgccagccgcaagagtcaggagaagccgcgggagatcatggacgcggcggaagattatgctaaagagagatatggaatatcttcaatgatacaatcacaagaaaaaccagatcgagttttggttcgggttagagacttgacaatacaaaaagctgatgaagttgtttgggtacgtgcaagagttcatacaagcagagctaaagggaaacagtgcttcttagtcctacgtcagcagcagtttaatgtccaggctcttgtggcggtgggagaccatgcaagcaagcagatggttaaatttgctgccaacatcaacaaagagagcattgtggatgtagaaggtgttgtgagaaaagtgaatcagaaaattggaagctgtacacagcaagacgttgagttacatgttcagaagatttatgtgatcagtttggctgaaccccgtctgcccctgcagctggatgatgctgttcggcctgaggcagaaggagaagaggtaaaaattatacttatgaaatattatgcttccgctgtatatttagtttgcaaaacattgaaaacctgatgtactaagggtgtctgtgaattgattttgagctccattgttatttaaacttactcttaaaatcagcaattctcaaaccttttggtatcgagttgccttttacattattaaaaataattaagaaccct

SEQ ID NO: 278528 - DNA, 651 bp, Homo sapiens
aattttcttgcagagacaagacaaagtgcttgtaagacatagaactgagtgttgtaattaccttaatctctcctgccacgatttaaggggagcacagcttcaacacttcaaaaacgaagcactatcatgggaaagaaagctcgttttcaacaagcgccaacaataaacaggtcagatctggtttcttctctgaaagaatctctaaaaggaactggtcaaaaatatctgtaaactattttaaatgcttattattttacgtaacaacagagaccaagtgctgaacacagaccttggctgcgtctgttcagtgaggttttagcaatgacactctagaaatgccctagtgttatgtcaggactgaaagtttatcatataatcttccactagggattctctaaagcttgggtaagtggcatcttctctcatcaatgttcatttaatgaaaagtgaaataaaccaacagattatcagatgctgtcagttttggagcttcaacccaaaataatagtccttttgctttgtatttttggtaatgttgaagtcactgtgtatgtttgtttggtcaatgtttccgcagtatttattaaaacatacttttttttttcttcaaataaaaaagtaaccagacatatcagggggatctctagagtc

SEQ ID NO: 278529 - DNA, 2380 bp, Homo sapiens
aattcggcactaggaagtgggagttgggtcgtgatgtgacagtcaaaggacttagccggaaagggtagagttaatgcatgacagacaaggggactctcatctgaaaatttgtgtgtctttgtttcttctcaggttctccttactatgacaatgtccgccccctctcttaccctgattcggatgctgtgctgatttgctttgacatcagtagaccagagaccctggacagtgtcctcaaaaagtggaaaggtgaaatccaggaattttgtccaaataccaaaatgctcttggtcggctgcaagtctgatctgcggacagatgttagtacattagtagagctctccaatcacaggcagacgccagtgtcctatgaccagggggcaaatatggccaaacagattggagcagctacttatatcgaatgctcagctttacagtcggaaaatagcgtcagagacatttttcacgttgccaccttggcatgtgtaaataagacaaataaaaacgttaagcggaacaaatcacagagagccacaaagcggatttcacacatgcctagcagaccagaactctcggcagttgctacggacttacgaaaggacaaagcgaagagctgcactgtgatgtgaatctttcattatctttaatgaagacaaaggaatctagtgtaaaaaacaacagcaaacaaaaaggtgaagtctaaatgaagtgcacagccaaagtcatgtataccagaggcttaggaggcgtttgagaggatactcatctttttggaatcctgaccttaggttcggcatgtagaccaagtgatgagaagtgaatacatggaagagtttttaagtgtgacttgaaaaatatgcctccaagaagaaaaatcacactctgaatggtgcttgcatttttgggttttttttttttgttataatctattcatggatctccactttgatttaatttttaaatgttttaatctcctttacaaaaagtatacgttaatataccgtcctcaagggggaactggcactgtgaccttagcatttagttttctagaggatgtgatctaatttctttctagctcatcattaaaaaggaaattgtatcaggacccatgggatatatccagaggcaaactttatgaggctttgaaatcttgccttcctgaagatagctgagtaggatggttctaaggaaagcctttgcaatcttgcaagatttgtagaccagcactacaaagatcgcatagatcaaataggaaaaaaaatgtcgatttttattcagtctgatggttctgttcttcattgtgattgtcattaaaaagtggtaaattgctcaatgtaatatttttgtgcgctgtttagaagttgtgtgattttttgccatcgttgataaaaatgcaaagtcaaataaaaggtgtcttggtttgatgtcatagaatgatccaaggagagaaaaaaggtagttactgttttcaccagaaaaggtaatgagtgaaggaaagaatagtagcagaaagcacagtttgtgagtaaagctgtctggaattaagttaccaaaaatacaaagcaaaaggactattattttgggttgaagctccaaaactgacagcatctgataatctgttggtttatttcacttttcattaaatgaacattgatgagagaagatgccacttacccaagctttagagaatccctagtggaagattatatgataaactttcagtcctgacataacactagggcatttctagagtgtcattgctaaaacctcactgaacagatgcagccaaggtctgtgttcagcacttggtctctgttgttacgtaaaataataagcatttaaaatagtttacagatatttttgaccagttccttttagagattctttcagagaagaaaccagatctgacctgtttattgttggcgcttgttgaaaacgagctttctttcccatgatagtgcttcgtttttgaagtgttgaagctgtgctccccttaaatcgtggcaggagagattaaggtaattacaacactcagttctatgtcttacaagcactttgtcttgtctctgcaagaaaattcgattccagtcatttcccataaaatacagacattttaccaacataatatgctttgattgatgcagcattatgctttgggcagtattacaaaatagctggcgagtgctttctgtatttaaatattgtaaaaagaaaataagttataactgttataaagcagaacttttgttgcattttttaaactgttgaagtcactgtgtatgtttgtttggtcaatgtttccgcagtatttattaaaacatacttttttttttcttcaaataaaaaagtaaccagacatatcagggggatctctagagtc

SEQ ID NO: 278530 - DNA, 1742 bp, Homo sapiens
atgtgctggggtgactctagaggaccagtgtcatgtataccagaggcttaggaggcgtttgagaggatactcatctttttggaatcctgaccttaggttcggcatgtagaccaagtgatgagaagtgaatacatggaagagtttttaagtgtgacttgaaaaatatgccaaaaaatgagagatacaaatgagctagaggaagatgaggggggatgcgagtacctccaagaagaaaaatcacactctgaatggtgcttgcatttttgggttttttttttttgttataatctattcatggatctccactttgatttaatttttaaatgttttaatctcctttacaaaaagtatacgttaatataccgtcctcaagggggaactggcactgtgaccttagcatttagttttctagaggatgtgatctaatttctttctagctcatcattaaaaaggaaattgtatcaggacccatgggatatatccagaggcaaactttatgaggctttgaaatcttgccttcctgaagatagctgagtaggatggttctaaggaaagcctttgcaatcttgcaagatttgtagaccagcactacaaagatcgcatagatcaaataggaaaaaaaatgtcgatttttattcagtctgatggttctgttcttcattgtgattgtcattaaaaagtggtaaattgctcaatgtaatatttttgtgcgctgtttagaagttgtgtgattttttgccatcgttgataaaaatgcaaagtcaaataaaaggtgtcttggtttgatgtcatagaatgatccaaggagagaaaaaaggtagttactgttttcaccagaaaaggtaatgagtgaaggaaagaatagtagcagaaagcacagtttgtgagtaaagctgtctggaattaagttaccaaaaatacaaagcaaaaggactattattttgggttgaagctccaaaactgacagcatctgataatctgttggtttatttcacttttcattaaatgaacattgatgagagaagatgccacttacccaagctttagagaatccctagtggaagattatatgataaactttcagtcctgacataacactagggcatttctagagtgtcattgctaaaacctcactgaacagatgcagccaaggtctgtgttcagcacttggtctctgttgttacgtaaaataataagcatttaaaatagtttacagatatttttgaccagttccttttagagattctttcagagaagaaaccagatctgacctgtttattgttggcgcttgttgaaaacgagctttctttcccatgatagtgcttcgtttttgaagtgttgaagctgtgctccccttaaatcgtggcaggagagattaaggtaattacaacactcagttctatgtcttacaagcactttgtcttgtctctgcaagaaaattcgattccagtcatttcccataaaatacagacattttaccaacataatatgctttgattgatgcagcattatgctttgggcagtattacaaaatagctggcgagtgctttctgtatttaaatattgtaaaaagaaaataagttataactgttataaagcagaacttttgttgcattttttaaactgttgaagtcactgtgtatgtttgtttggtcaatgtttccgcagtatttattaaaacatacttttttttttcttcaaataaaaaagtaaccagacatatcagggggatctctagagtc

SEQ ID NO: 278531 - DNA, 214 bp, Homo sapiens
tggtattagaagatgctagctaactttcccccaaagtcttattgctggttaaaatcccttcttttgcttctcagggggcaaatatggccaaacagattggagcagctacttatatcgaatgctcagctttacagtcggaaaatagcgtcagagacatttttcacgttgccaccttggcatgtgtaaataagacaaataaaaacgttaagcggaa

SEQ ID NO: 278532 - DNA, 2434 bp, Homo sapiens
aattcggcactaggaagtgggagttgggtcgtgatgtgacagtcaaaggacttagccggaaagggtagagttaatgcatgacagacaaggggactctcatctgaaaatttgtgtgtctttgtttcttctcaggttctccttactatgacaatgtccgccccctctcttaccctgattcggatgctgtgctgatttgctttgacatcagtagaccagagaccctggacagtgtcctcaaaaagtggaaaggtgaaatccaggaattttgtccaaataccaaaatgctcttggtcggctgcaagtctgatctgcggacagatgttagtacattagtagagctctccaatcacaggcagacgccagtgtcctatgaccagggggcaaatatggccaaacagattggagcagctacttatatcgaatgctcagctttacagtcggaaaatagcgtcagagacatttttcacgttgccaccttggcatgtgtaaataagacaaataaaaacgttaagcggaacaaatcacagagagccacaaagcggatttcacacatgcctagcagaccagaactctcggcagttgctacggacttacgaaaggacaaagcgaagagctgcactgtgatgtgaatctttcattatctttaatgaagacaaaggaatctagtgtaaaaaacaacagcaaacaaaaaggtgaagtctaaatgaagtgcacagccaaagtcatgtataccagaggcttaggaggcgtttgagaggatactcatctttttggaatcctgaccttaggttcggcatgtagaccaagtgatgagaagtgaatacatggaagagtttttaagtgtgacttgaaaaatatgccaaaaaatgagagatacaaatgagctagaggaagatgaggggggatgcgagtacctccaagaagaaaaatcacactctgaatggtgcttgcatttttgggttttttttttttgttataatctattcatggatctccactttgatttaatttttaaatgttttaatctcctttacaaaaagtatacgttaatataccgtcctcaagggggaactggcactgtgaccttagcatttagttttctagaggatgtgatctaatttctttctagctcatcattaaaaaggaaattgtatcaggacccatgggatatatccagaggcaaactttatgaggctttgaaatcttgccttcctgaagatagctgagtaggatggttctaaggaaagcctttgcaatcttgcaagatttgtagaccagcactacaaagatcgcatagatcaaataggaaaaaaaatgtcgatttttattcagtctgatggttctgttcttcattgtgattgtcattaaaaagtggtaaattgctcaatgtaatatttttgtgcgctgtttagaagttgtgtgattttttgccatcgttgataaaaatgcaaagtcaaataaaaggtgtcttggtttgatgtcatagaatgatccaaggagagaaaaaaggtagttactgttttcaccagaaaaggtaatgagtgaaggaaagaatagtagcagaaagcacagtttgtgagtaaagctgtctggaattaagttaccaaaaatacaaagcaaaaggactattattttgggttgaagctccaaaactgacagcatctgataatctgttggtttatttcacttttcattaaatgaacattgatgagagaagatgccacttacccaagctttagagaatccctagtggaagattatatgataaactttcagtcctgacataacactagggcatttctagagtgtcattgctaaaacctcactgaacagatgcagccaaggtctgtgttcagcacttggtctctgttgttacgtaaaataataagcatttaaaatagtttacagatatttttgaccagttccttttagagattctttcagagaagaaaccagatctgacctgtttattgttggcgcttgttgaaaacgagctttctttcccatgatagtgcttcgtttttgaagtgttgaagctgtgctccccttaaatcgtggcaggagagattaaggtaattacaacactcagttctatgtcttacaagcactttgtcttgtctctgcaagaaaattcgattccagtcatttcccataaaatacagacattttaccaacataatatgctttgattgatgcagcattatgctttgggcagtattacaaaatagctggcgagtgctttctgtatttaaatattgtaaaaagaaaataagttataactgttataaagcagaacttttgttgcattttttaaactgttgaagtcactgtgtatgtttgtttggtcaatgtttccgcagtatttattaaaacatacttttttttttcttcaaataaaaaagtaaccagacatatcagggggatctctagagtc

SEQ ID NO: 278533 - DNA, 2380 bp, Homo sapiens
aattcggcactaggaagtgggagttgggtcgtgatgtgacagtcaaaggacttagccggaaagggtagagttaatgcatgacagacaaggggactctcatctgaaaatttgtgtgtctttgtttcttctcaggttctccttactatgacaatgtccgccccctctcttaccctgattcggatgctgtgctgatttgctttgacatcagtagaccagagaccctggacagtgtcctcaaaaagtggaaaggtgaaatccaggaattttgtccaaataccaaaatgctcttggtcggctgcaagtctgatctgcggacagatgttagtacattagtagagctctccaatcacaggcagacgccagtgtcctatgaccagggggcaaatatggccaaacagattggagcagctacttatatcgaatgctcagctttacagtcggaaaatagcgtcagagacatttttcacgttgccaccttggcatgtgtaaataagacaaataaaaacgttaagcggaacaaatcacagagagccacaaagcggatttcacacatgcctagcagaccagaactctcggcagttgctacggacttacgaaaggacaaagcgaagagctgcactgtgatgtgaatctttcattatctttaatgaagacaaaggaatctagtgtaaaaaacaacagcaaacaaaaaggcgtttgagaggatactcatctttttggaatcctgaccttaggttcggcatgtagaccaagtgatgagaagtgaatacatggaagagtttttaagtgtgacttgaaaaatatgccaaaaaatgagagatacaaatgagctagaggaagatgaggggggatgcgagtacctccaagaagaaaaatcacactctgaatggtgcttgcatttttgggttttttttttttgttataatctattcatggatctccactttgatttaatttttaaatgttttaatctcctttacaaaaagtatacgttaatataccgtcctcaagggggaactggcactgtgaccttagcatttagttttctagaggatgtgatctaatttctttctagctcatcattaaaaaggaaattgtatcaggacccatgggatatatccagaggcaaactttatgaggctttgaaatcttgccttcctgaagatagctgagtaggatggttctaaggaaagcctttgcaatcttgcaagatttgtagaccagcactacaaagatcgcatagatcaaataggaaaaaaaatgtcgatttttattcagtctgatggttctgttcttcattgtgattgtcattaaaaagtggtaaattgctcaatgtaatatttttgtgcgctgtttagaagttgtgtgattttttgccatcgttgataaaaatgcaaagtcaaataaaaggtgtcttggtttgatgtcatagaatgatccaaggagagaaaaaaggtagttactgttttcaccagaaaaggtaatgagtgaaggaaagaatagtagcagaaagcacagtttgtgagtaaagctgtctggaattaagttaccaaaaatacaaagcaaaaggactattattttgggttgaagctccaaaactgacagcatctgataatctgttggtttatttcacttttcattaaatgaacattgatgagagaagatgccacttacccaagctttagagaatccctagtggaagattatatgataaactttcagtcctgacataacactagggcatttctagagtgtcattgctaaaacctcactgaacagatgcagccaaggtctgtgttcagcacttggtctctgttgttacgtaaaataataagcatttaaaatagtttacagatatttttgaccagttccttttagagattctttcagagaagaaaccagatctgacctgtttattgttggcgcttgttgaaaacgagctttctttcccatgatagtgcttcgtttttgaagtgttgaagctgtgctccccttaaatcgtggcaggagagattaaggtaattacaacactcagttctatgtcttacaagcactttgtcttgtctctgcaagaaaattcgattccagtcatttcccataaaatacagacattttaccaacataatatgctttgattgatgcagcattatgctttgggcagtattacaaaatagctggcgagtgctttctgtatttaaatattgtaaaaagaaaataagttataactgttataaagcagaacttttgttgcattttttaaactgttgaagtcactgtgtatgtttgtttggtcaatgtttccgcagtatttattaaaacatacttttttttttcttcaaataaaaaagtaaccagacatatcagggggatctctagagtc

SEQ ID NO: 278534 - DNA, 1986 bp, Homo sapiens
cccgggcaggttagaagacagcaggggaactcgagaagttggttgttttcagcagattaaaacaatacagatttatcagcaagactgttgaacgcataactgcccaagatgcctgtccctccccctccagcacccccgccgcccccgacgtttgcactggccaatacagagaagcctaccttgaataagacagagcaggctgggagaaatgctctcctttctgatatcagcaaagggaagaaactaaagaagacggtcaccaatgacagaagtgcaccaatactggacaaacctaaaggagctggtgctggaggcggtggtggtggctttggtggaggcggcggatttggcggaggaggtggtggcggaggcggtggaagttttggagggggcggacctccaggtctgggaggattgttccaggctggaatgccgaagctgagatccacggccaacagggataatgattctggaggaagccgaccaccattgttgccaccgggaggaagatccacatctgcgaaacccttttcacccccaagtggcccagggaggtttcctgtgccttctccaggccacagaagtggtcccccagagcctcagaggaaccgaatgccgcccccaaggcccgacgtgggctcaaagcctgatagcattcctcctccagtacctagtactccaagacccattcaatcaagtctgcacaaccgggggtccccaccagtgcccggaggccccaggcagcccagccccgggcccactcctccccctttccctggaaaccgcggcactgctttgggaggaggctcaatacgtcagtcccccttgagctcctcctcgcccttctccaaccggcctcccctgccgcctacccccagcagggccttggatgacaaaccccctccaccacctcctccagtgggcaacaggccctccatccacagggaagcggttccccctcctcctcctcagaacaacaagcctccagtgccttccactccgcggccttcggcctcctcacaggccccacctccgccgccacctcccagcaggcccgggccgcctcctctgcctccaagttccagcggcaatgacgaaaccccaagactcccacagcggaatctgtccctcagttcgtccacgcccccgttaccttcgccaggacgttcaggtcctcttcctcccccgcccagtgagagacccccacctccagtgagggacccgccaggccgatcaggccccctcccaccacctcctccagtaagcagaaacggcagcacatctcgggccctgcctgctacccctcagttgccatccaggagtggagtagacagtcccaggagtggacccaggcctccccttcctcctgataggcccagtgctggggcacctcccccacctccaccatcaacatctattagaaatggcttccaagactctccatgtgaagatgagtgggaaagcagattctacttccatccgatttccgatttgccacctccagagccatatgtacaaacgaccaaaagttatcccagcaaactggcaagaaacgaaagccggagtggatccaaccgaagagaaaggggtgctccaccactccctcccatcccgaggtgatctttgcctgctcttctctacccaagctcaagagctgcttctgttgctatctaagaactgcataccctcctccctgcttcttcccttgtgcctcatgtatgggcaggaggaaaggtgggagggggagtgggaatatgcgtgtgtgggtgggaatcggtaagaaatgcacctagcttttcatattgtgtttattctccaggctattgcttgcttcagctgcagcctgcctgtgctggctgctggggtcgataggcttttgtcgtaataggcagagatgacttgcatcccagctttccaccaaccaaattcaaacattcactgcttatttgttacagactgtaattattaaagtccctgagagctgtt

SEQ ID NO: 278535 - DNA, 791 bp, Homo sapiens
gtatactctgtaactctaccagggaagggattgcctatgtgcctgattgattttttactctgccatttcaatttccctctatttcgtcatcagtcagaaggttggtgctgtttaaaggggaaaaaaaagctctaagtgtccccttctcccaaaaaaaggaaccagaaaatgacaagaagagttgcatttgtctatgaaagtgcatagaaagcttttcctggaaaagaataaactgggaaaagatgagtccttgaagtagaaccctgtcatagtgcaacaaactgaatttaagaggcatctgttcccagcttatacaacatccagtaccagttccacagccaacaatggatagatttggtcgtccttgaagcatttagagacctgtagaatgaacttaacttctgaaaactgggtgcggggccaatagaggggctgctcaatacctcaccagcctgctacgcggaaggctagatggagggctgctaaaggaagagaactgctgttccacctccgcctcctccctgcagtgtggcttcttagaaaaggagataccgctggccctccatattcacaagctctgcatctgtgggttcagccaactatggatcgaaatatgcaacttcaaattatcttcattcaggaaggagaaccctgagttcttctgggttggatctaagcatgtaagactattgagttacatttgacttctgaagtcactttttgtctttactttttagtcagcttgtgaaagcaaaaagcatcttatttttaaaatacctatgttagtaccc

SEQ ID NO: 278536 - DNA, 620 bp, Homo sapiens
cccgggcaggttagaagacagcaggggaactcgagaagttggttgttttcagcagattaaaacaatacaggaaccagaaaatgacaagaagagttgcatttgtctatgaaagtgcatagaaagcttttcctggaaaagaataaactgggaaaagatgagtccttgaagtagaaccctgtcatagtgcaacaaactgaatttaagaggcatctgttcccagcttatacaacatccagtaccagttccacagccaacaatggatagatttggtcgtccttgaagcatttagagacctgtagaatgaacttaacttctgaaaactgggtgcggggccaatagaggggctgctcaatacctcaccagcctgctacgcggaaggctagatggagggctgctaaaggaagagaactgctgttccacctccgcctcctccctgcagtgtggcttcttagaaaaggagataccgctggccctccatattcacaagctctgcatctgtgggttcagccaactatggatcgaaatatgcaacttcaaattatcttcattcaggaaggagaaccctgagttcttctgggttggatctaagcatggaagccagctaccgtgttaagagctgc

SEQ ID NO: 278537 - DNA, 152 bp, Homo sapiens
tcaagcttctaacgatgtacggggacatgcactatgtaaacagacacattttgctatctgtgtcatcaggatagtgtaagtggtagggtagagactaccctagacatctgcatctttgtaagttagccagacaataaagaaaagcagaatga

SEQ ID NO: 278538 - DNA, 4490 bp, Homo sapiens
cccgggcaggttagaagacagcaggggaactcgagaagttggttgttttcagcagattaaaacaatacagatttatcagcaagactgttgaacgcataactgcccaagatgcctgtccctccccctccagcacccccgccgcccccgacgtttgcactggccaatacagagaagcctaccttgaataagacagagcaggctgggagaaatgctctcctttctgatatcagcaaagggaagaaactaaagaagacggtcaccaatgacagaagtgcaccaatactggacaaacctaaaggagctggtgctggaggcggtggtggtggctttggtggaggcggcggatttggcggaggaggtggtggcggaggcggtggaagttttggagggggcggacctccaggtctgggaggattgttccaggctggaatgccgaagctgagatccacggccaacagggataatgattctggaggaagccgaccaccattgttgccaccgggaggaagatccacatctgcgaaacccttttcacccccaagtggcccagggaggtttcctgtgccttctccaggccacagaagtggtcccccagagcctcagaggaaccgaatgccgcccccaaggcccgacgtgggctcaaagcctgatagcattcctcctccagtacctagtactccaagacccattcaatcaagtctgcacaaccgggggtccccaccagtgcccggaggccccaggcagcccagccccgggcccactcctccccctttccctggaaaccgcggcactgctttgggaggaggctcaatacgtcagtcccccttgagctcctcctcgcccttctccaaccggcctcccctgccgcctacccccagcagggccttggatgacaaaccccctccaccacctcctccagtgggcaacaggccctccatccacagggaagcggttccccctcctcctcctcagaacaacaagcctccagtgccttccactccgcggccttcggcctcctcacaggccccacctccgccgccacctcccagcaggcccgggccgcctcctctgcctccaagttccagcggcaatgacgaaaccccaagactcccacagcggaatctgtccctcagttcgtccacgcccccgttaccttcgccaggacgttcaggtcctcttcctcccccgcccagtgagagacccccacctccagtgagggacccgccaggccgatcaggccccctcccaccacctcctccagtaagcagaaacggcagcacatctcgggccctgcctgctacccctcagttgccatccaggagtggagtagacagtcccaggagtggacccaggcctccccttcctcctgataggcccagtgctggggcacctcccccacctccaccatcaacatctattagaaatggcttccaagactctccatgtgaagatgagtgggaaagcagattctacttccatccgatttccgatttgccacctccagagccatatgtacaaacgaccaaaagttatcccagcaaactggcaagaaacgaaagccggagtggatccaaccgaagagaaaggggtgctccaccactccctcccatcccgaggtgatctttgcctgctcttctctacccaagctcaagagctgcttctgttgctatctaagaactgcataccctcctccctgcttcttcccttgtgcctcatgctattgcttgcttcagctgcagcctgcctgtgctggctgctggggtcgataggcttttgtcgtaataggcagagatgacttgcatcccagctttccaccaaccaaattcaaacattcactgcttatttgttacagactgtaattattaaagtccctgagagctgttttctcccgttcctttttcgcatgcttggcctcctctctgtttctatgaaccacagaccacctaagcaagctgctgagtaagggctcactggaaacttgcagtcacaggatgtccaatctttggcagtccgagcttggctctaggacagagctgtccaatagaaatataatgtgagccccatatacaatttttacatttctaatatattttaaacaagtgaagttaatatgcatccaaaatatttcaacctgtaatcaacataaaattttaatgagatattttatattattttttggtactgaatcttcaaaatccagagtgtattttacacttaccgcacatctccattcagactagtcacatttttaagtgctcagtagccacatgtggctggtggctactggattagacagcacgagtctggaagatggaagctagtgcagaaacctcttgtttaaaaaacaaaaaaggcaagatgggcttgagcgattcaagaggcaactaaaaataaaattaggacccagcaccttgtttgacacacagtttgaccttcgattttcctcccttaacttccctcttcccttaatatctgtatacaagtgttgcttcaaagtaccaaggtcagaaattgattcagtacggtttactaaagtcatgtggaataaagccattggaaacaaatggaaagcctgtcgggacttctgggctcagaaccagctggctcacgcactccacttgtcagctggacttctgccttgtgaaatggaagcagcctttgttcctttctggctgagcaagctcctgaggctgggagagactaggaaggcttggtaggaggggaaaaaagtcaggaaaagatatcaaatcagaaacatggaagaagaagggaaccgatttgagttggtgggcaaaactctaaaaatctaaatctgatgcttatgtaagggttgagcgaattagggagattgctagtggaaattggagggaatttgttttgcatcatttgtctaggatctatgcaaatatagctccactaaaggaccatagggaagagccagccttgccttttcttatatgattttgtttacaaaattttactgggacttttaaatctagctatagagttgggaaaaaatatttccacttagatattttacatggttttgtttaaaattaccattacttgttttttaaaaacacatgaccacatatgtatatgtatatctacctaaacattgtatcatggtttcagtatgttattcatgtattactgggagatgctaccaagaaaccaacccaaagaaaattctgaaaaatacatttctatttatagaataaatgtttcatttatataaaagcaaaagaacttagagttctaataaatgggatgtctaataaattatgaagttactgatttgaatatattatatttttataacttccttgccaaagtcctgatttagtacattagagaacctgtgtttcctctctcctctaccattcatctctcttccatacagtcatttgggctttttactcaaagagaatcaagaaataataagatataacaagcttggcaaagtgttggctttttaaaaaaaaatttttttaatctctagcagtttggtaatttagcagcatcatttatttgggattcttttatctgatttcaacagtgaaaaacatccctatgataaagcctaatgacccatttcacaaaagatggaatttgcccttcctagaaaatatgacggagaaaagtctgactcagagaaagtgagtctgaattttataaggggtagtaagaattggacaattcctttgcatatctgaacttggcaggtaccgttctaaatctgaaacagggtgatagctcaaagttgccattcatccagaatagattgttttagaatgtagtgtttaagtgactgtttcattaatacacctacaccctttctttgaaagtttgcaacctaattgcatctaaaactatgaataagttctgtggtaaaatcttaaactatggaaaattacaaaaatgaatttttcttccctgaaatcagagcttacatgtgtgtttttttataacattttcagataaatgtattcaacatgtaatacagtattttaacattcacctcttattttatattgaaatgtattacagtattaaaactcagtgttcagtatttatttcactatgcattttatttagtaaaagccaggagaaatgtttaatccaatggtgccttactttgtgatttaaaagaaatcaacttttttttatgtctaagtagtagattatttgcatatttgtaaaaactgttaggtctttatattttaaagtgtaataccagttttgttattttagtagcagaaatgggatgattgttaaagttccccaaaaatgttggcatgaaattaatttttccctccttatagtcaaggaccgtagaggaagaaaaacttttttttcatatcatgcactatgtaaacagacacattttgctatctgtgtcatcaggatagtgtaagtggtagggtagagactaccctagacatctgcatctttgtaagttagccagacaataaagaaaagcagaatga

SEQ ID NO: 278539 - DNA, 4728 bp, Homo sapiens
cacagaaggacgtctgcctctgactcagtatgtcacatttaacaagaggccagagcttgtccaaaatggctgtccaaaaacgaccccacacttgcgttagaagatgatacctttttcagggacagttttctctcttggctcctgtcccgctggccctctgtctgcctgtgtccctgaccatggctccctgcagtaccctttaacgatttatcagcaagactgttgaacgcataactgcccaagatgcctgtccctccccctccagcacccccgccgcccccgacgtttgcactggccaatacagagaagcctaccttgaataagacagagcaggctgggagaaatgctctcctttctgatatcagcaaagggaagaaactaaagaagacggtcaccaatgacagaagtgcaccaatactggacaaacctaaaggagctggtgctggaggcggtggtggtggctttggtggaggcggcggatttggcggaggaggtggtggcggaggcggtggaagttttggagggggcggacctccaggtctgggaggattgttccaggctggaatgccgaagctgagatccacggccaacagggataatgattctggaggaagccgaccaccattgttgccaccgggaggaagatccacatctgcgaaacccttttcacccccaagtggcccagggaggtttcctgtgccttctccaggccacagaagtggtcccccagagcctcagaggaaccgaatgccgcccccaaggcccgacgtgggctcaaagcctgatagcattcctcctccagtacctagtactccaagacccattcaatcaagtctgcacaaccgggggtccccaccagtgcccggaggccccaggcagcccagccccgggcccactcctccccctttccctggaaaccgcggcactgctttgggaggaggctcaatacgtcagtcccccttgagctcctcctcgcccttctccaaccggcctcccctgccgcctacccccagcagggccttggatgacaaaccccctccaccacctcctccagtgggcaacaggccctccatccacagggaagcggttccccctcctcctcctcagaacaacaagcctccagtgccttccactccgcggccttcggcctcctcacaggccccacctccgccgccacctcccagcaggcccgggccgcctcctctgcctccaagttccagcggcaatgacgaaaccccaagactcccacagcggaatctgtccctcagttcgtccacgcccccgttaccttcgccaggacgttcaggtcctcttcctcccccgcccagtgagagacccccacctccagtgagggacccgccaggccgatcaggccccctcccaccacctcctccagtaagcagaaacggcagcacatctcgggccctgcctgctacccctcagttgccatccaggagtggagtagacagtcccaggagtggacccaggcctccccttcctcctgataggcccagtgctggggcacctcccccacctccaccatcaacatctattagaaatggcttccaagactctccatgtgaagatgagtgggaaagcagattctacttccatccgatttccgatttgccacctccagagccatatgtacaaacgaccaaaagttatcccagcaaactggcaagaaacgaaagccggagtggatccaaccgaagagaaaggggtgctccaccactccctcccatcccgaggtgatctttgcctgctcttctctacccaagctcaagagctgcttctgttgctatctaagaactgcataccctcctccctgcttcttcccttgtgcctcatgtatgggcaggaggaaaggtgggagggggagtgggaatatgcgtgtgtgggtgggaatcggtaagaaatgcacctagcttttcatattgtgtttattctccaggctattgcttgcttcagctgcagcctgcctgtgctggctgctggggtcgataggcttttgtcgtaataggcagagatgacttgcatcccagctttccaccaaccaaattcaaacattcactgcttatttgttacagactgtaattattaaagtccctgagagctgttttctcccgttcctttttcgcatgcttggcctcctctctgtttctatgaaccacagaccacctaagcaagctgctgagtaagggctcactggaaacttgcagtcacaggatgtccaatctttggcagtccgagcttggctctaggacagagctgtccaatagaaatataatgtgagccccatatacaatttttacatttctaatatattttaaacaagtgaagttaatatgcatccaaaatatttcaacctgtaatcaacataaaattttaatgagatattttatattattttttggtactgaatcttcaaaatccagagtgtattttacacttaccgcacatctccattcagactagtcacatttttaagtgctcagtagccacatgtggctggtggctactggattagacagcacgagtctggaagatggaagctagtgcagaaacctcttgtttaaaaaacaaaaaaggcaagatgggcttgagcgattcaagaggcaactaaaaataaaattaggacccagcaccttgtttgacacacagtttgaccttcgattttcctcccttaacttccctcttcccttaatatctgtatacaagtgttgcttcaaagtaccaaggtcagaaattgattcagtacggtttactaaagtcatgtggaataaagccattggaaacaaatggaaagcctgtcgggacttctgggctcagaaccagctggctcacgcactccacttgtcagctggacttctgccttgtgaaatggaagcagcctttgttcctttctggctgagcaagctcctgaggctgggagagactaggaaggcttggtaggaggggaaaaaagtcaggaaaagatatcaaatcagaaacatggaagaagaagggaaccgatttgagttggtgggcaaaactctaaaaatctaaatctgatgcttatgtaagggttgagcgaattagggagattgctagtggaaattggagggaatttgttttgcatcatttgtctaggatctatgcaaatatagctccactaaaggaccatagggaagagccagccttgccttttcttatatgattttgtttacaaaattttactgggacttttaaatctagctatagagttgggaaaaaatatttccacttagatattttacatggttttgtttaaaattaccattacttgttttttaaaaacacatgaccacatatgtatatgtatatctacctaaacattgtatcatggtttcagtatgttattcatgtattactgggagatgctaccaagaaaccaacccaaagaaaattctgaaaaatacatttctatttatagaataaatgtttcatttatataaaagcaaaagaacttagagttctaataaatgggatgtctaataaattatgaagttactgatttgaatatattatatttttataacttccttgccaaagtcctgatttagtacattagagaacctgtgtttcctctctcctctaccattcatctctcttccatacagtcatttgggctttttactcaaagagaatcaagaaataataagatataacaagcttggcaaagtgttggctttttaaaaaaaaatttttttaatctctagcagtttggtaatttagcagcatcatttatttgggattcttttatctgatttcaacagtgaaaaacatccctatgataaagcctaatgacccatttcacaaaagatggaatttgcccttcctagaaaatatgacggagaaaagtctgactcagagaaagtgagtctgaattttataaggggtagtaagaattggacaattcctttgcatatctgaacttggcaggtaccgttctaaatctgaaacagggtgatagctcaaagttgccattcatccagaatagattgttttagaatgtagtgtttaagtgactgtttcattaatacacctacaccctttctttgaaagtttgcaacctaattgcatctaaaactatgaataagttctgtggtaaaatcttaaactatggaaaattacaaaaatgaatttttcttccctgaaatcagagcttacatgtgtgtttttttataacattttcagataaatgtattcaacatgtaatacagtattttaacattcacctcttattttatattgaaatgtattacagtattaaaactcagtgttcagtatttatttcactatgcattttatttagtaaaagccaggagaaatgtttaatccaatggtgccttactttgtgatttaaaagaaatcaacttttttttatgtctaagtagtagattatttgcatatttgtaaaaactgttaggtctttatattttaaagtgtaataccagttttgttattttagtagcagaaatgggatgattgttaaagttccccaaaaatgttggcatgaaattaatttttccctccttatagtcaaggaccgtagaggaagaaaaacttttttttcatatcatgcactatgtaaacagacacattttgctatctgtgtcatcaggatagtgtaagtggtagggtagagactaccctagacatctgcatctttgtaagttagccagacaataaagaaaagcagaatga

SEQ ID NO: 278540 - DNA, 4634 bp, Homo sapiens
ggagcgcttttcctgcccgcccggctcagccctgcggaccccgggagaagtttcccagaaaaaatgcccagcgcggcgcggggctgcggagtcgtccggagccgctgcgcgatttatcagcaagactgttgaacgcataactgcccaagatgcctgtccctccccctccagcacccccgccgcccccgacgtttgcactggccaatacagagaagcctaccttgaataagacagagcaggctgggagaaatgctctcctttctgatatcagcaaagggaagaaactaaagaagacggtcaccaatgacagaagtgcaccaatactggacaaacctaaaggagctggtgctggaggcggtggtggtggctttggtggaggcggcggatttggcggaggaggtggtggcggaggcggtggaagttttggagggggcggacctccaggtctgggaggattgttccaggctggaatgccgaagctgagatccacggccaacagggataatgattctggaggaagccgaccaccattgttgccaccgggaggaagatccacatctgcgaaacccttttcacccccaagtggcccagggaggtttcctgtgccttctccaggccacagaagtggtcccccagagcctcagaggaaccgaatgccgcccccaaggcccgacgtgggctcaaagcctgatagcattcctcctccagtacctagtactccaagacccattcaatcaagtctgcacaaccgggggtccccaccagtgcccggaggccccaggcagcccagccccgggcccactcctccccctttccctggaaaccgcggcactgctttgggaggaggctcaatacgtcagtcccccttgagctcctcctcgcccttctccaaccggcctcccctgccgcctacccccagcagggccttggatgacaaaccccctccaccacctcctccagtgggcaacaggccctccatccacagggaagcggttccccctcctcctcctcagaacaacaagcctccagtgccttccactccgcggccttcggcctcctcacaggccccacctccgccgccacctcccagcaggcccgggccgcctcctctgcctccaagttccagcggcaatgacgaaaccccaagactcccacagcggaatctgtccctcagttcgtccacgcccccgttaccttcgccaggacgttcaggtcctcttcctcccccgcccagtgagagacccccacctccagtgagggacccgccaggccgatcaggccccctcccaccacctcctccagtaagcagaaacggcagcacatctcgggccctgcctgctacccctcagttgccatccaggagtggagtagacagtcccaggagtggacccaggcctccccttcctcctgataggcccagtgctggggcacctcccccacctccaccatcaacatctattagaaatggcttccaagactctccatgtgaagatgagtgggaaagcagattctacttccatccgatttccgatttgccacctccagagccatatgtacaaacgaccaaaagttatcccagcaaactggcaagaaacgaaagccggagtggatccaaccgaagagaaaggggtgctccaccactccctcccatcccgaggtgatctttgcctgctcttctctacccaagctcaagagctgcttctgttgctatctaagaactgcataccctcctccctgcttcttcccttgtgcctcatgtatgggcaggaggaaaggtgggagggggagtgggaatatgcgtgtgtgggtgggaatcggtaagaaatgcacctagcttttcatattgtgtttattctccaggctattgcttgcttcagctgcagcctgcctgtgctggctgctggggtcgataggcttttgtcgtaataggcagagatgacttgcatcccagctttccaccaaccaaattcaaacattcactgcttatttgttacagactgtaattattaaagtccctgagagctgttttctcccgttcctttttcgcatgcttggcctcctctctgtttctatgaaccacagaccacctaagcaagctgctgagtaagggctcactggaaacttgcagtcacaggatgtccaatctttggcagtccgagcttggctctaggacagagctgtccaatagaaatataatgtgagccccatatacaatttttacatttctaatatattttaaacaagtgaagttaatatgcatccaaaatatttcaacctgtaatcaacataaaattttaatgagatattttatattattttttggtactgaatcttcaaaatccagagtgtattttacacttaccgcacatctccattcagactagtcacatttttaagtgctcagtagccacatgtggctggtggctactggattagacagcacgagtctggaagatggaagctagtgcagaaacctcttgtttaaaaaacaaaaaaggcaagatgggcttgagcgattcaagaggcaactaaaaataaaattaggacccagcaccttgtttgacacacagtttgaccttcgattttcctcccttaacttccctcttcccttaatatctgtatacaagtgttgcttcaaagtaccaaggtcagaaattgattcagtacggtttactaaagtcatgtggaataaagccattggaaacaaatggaaagcctgtcgggacttctgggctcagaaccagctggctcacgcactccacttgtcagctggacttctgccttgtgaaatggaagcagcctttgttcctttctggctgagcaagctcctgaggctgggagagactaggaaggcttggtaggaggggaaaaaagtcaggaaaagatatcaaatcagaaacatggaagaagaagggaaccgatttgagttggtgggcaaaactctaaaaatctaaatctgatgcttatgtaagggttgagcgaattagggagattgctagtggaaattggagggaatttgttttgcatcatttgtctaggatctatgcaaatatagctccactaaaggaccatagggaagagccagccttgccttttcttatatgattttgtttacaaaattttactgggacttttaaatctagctatagagttgggaaaaaatatttccacttagatattttacatggttttgtttaaaattaccattacttgttttttaaaaacacatgaccacatatgtatatgtatatctacctaaacattgtatcatggtttcagtatgttattcatgtattactgggagatgctaccaagaaaccaacccaaagaaaattctgaaaaatacatttctatttatagaataaatgtttcatttatataaaagcaaaagaacttagagttctaataaatgggatgtctaataaattatgaagttactgatttgaatatattatatttttataacttccttgccaaagtcctgatttagtacattagagaacctgtgtttcctctctcctctaccattcatctctcttccatacagtcatttgggctttttactcaaagagaatcaagaaataataagatataacaagcttggcaaagtgttggctttttaaaaaaaaatttttttaatctctagcagtttggtaatttagcagcatcatttatttgggattcttttatctgatttcaacagtgaaaaacatccctatgataaagcctaatgacccatttcacaaaagatggaatttgcccttcctagaaaatatgacggagaaaagtctgactcagagaaagtgagtctgaattttataaggggtagtaagaattggacaattcctttgcatatctgaacttggcaggtaccgttctaaatctgaaacagggtgatagctcaaagttgccattcatccagaatagattgttttagaatgtagtgtttaagtgactgtttcattaatacacctacaccctttctttgaaagtttgcaacctaattgcatctaaaactatgaataagttctgtggtaaaatcttaaactatggaaaattacaaaaatgaatttttcttccctgaaatcagagcttacatgtgtgtttttttataacattttcagataaatgtattcaacatgtaatacagtattttaacattcacctcttattttatattgaaatgtattacagtattaaaactcagtgttcagtatttatttcactatgcattttatttagtaaaagccaggagaaatgtttaatccaatggtgccttactttgtgatttaaaagaaatcaacttttttttatgtctaagtagtagattatttgcatatttgtaaaaactgttaggtctttatattttaaagtgtaataccagttttgttattttagtagcagaaatgggatgattgttaaagttccccaaaaatgttggcatgaaattaatttttccctccttatagtcaaggaccgtagaggaagaaaaacttttttttcatatcatgcactatgtaaacagacacattttgctatctgtgtcatcaggatagtgtaagtggtagggtagagactaccctagacatctgcatctttgtaagttagccagacaataaagaaaagcagaatga

SEQ ID NO: 278541 - DNA, 4462 bp, Homo sapiens
aatgacagaagtgcaccaatactggacaaacctaaaggaagctggtgctggaggcggtggtggtcgtcttctttagtttcttctcctttctgatatcagcaaagggaagaaactaaagaagacggtcaccaatgacagaagtgcaccaatactggacaaacctaaaggagctggtgctggaggcggtggtggtggctttggtggaggcggcggatttggcggaggaggtggtggcggaggcggtggaagttttggagggggcggacctccaggtctgggaggattgttccaggctggaatgccgaagctgagatccacggccaacagggataatgattctggaggaagccgaccaccattgttgccaccgggaggaagatccacatctgcgaaacccttttcacccccaagtggcccagggaggtttcctgtgccttctccaggccacagaagtggtcccccagagcctcagaggaaccgaatgccgcccccaaggcccgacgtgggctcaaagcctgatagcattcctcctccagtacctagtactccaagacccattcaatcaagtctgcacaaccgggggtccccaccagtgcccggaggccccaggcagcccagccccgggcccactcctccccctttccctggaaaccgcggcactgctttgggaggaggctcaatacgtcagtcccccttgagctcctcctcgcccttctccaaccggcctcccctgccgcctacccccagcagggccttggatgacaaaccccctccaccacctcctccagtgggcaacaggccctccatccacagggaagcggttccccctcctcctcctcagaacaacaagcctccagtgccttccactccgcggccttcggcctcctcacaggccccacctccgccgccacctcccagcaggcccgggccgcctcctctgcctccaagttccagcggcaatgacgaaaccccaagactcccacagcggaatctgtccctcagttcgtccacgcccccgttaccttcgccaggacgttcaggtcctcttcctcccccgcccagtgagagacccccacctccagtgagggacccgccaggccgatcaggccccctcccaccacctcctccagtaagcagaaacggcagcacatctcgggccctgcctgctacccctcagttgccatccaggagtggagtagacagtcccaggagtggacccaggcctccccttcctcctgataggcccagtgctggggcacctcccccacctccaccatcaacatctattagaaatggcttccaagactctccatgtgaagatgagtgggaaagcagattctacttccatccgatttccgatttgccacctccagagccatatgtacaaacgaccaaaagttatcccagcaaactggcaagaaacgaaagccggagtggatccaaccgaagagaaaggggtgctccaccactccctcccatcccgaggtgatctttgcctgctcttctctacccaagctcaagagctgcttctgttgctatctaagaactgcataccctcctccctgcttcttcccttgtgcctcatgtatgggcaggaggaaaggtgggagggggagtgggaatatgcgtgtgtgggtgggaatcggtaagaaatgcacctagcttttcatattgtgtttattctccaggctattgcttgcttcagctgcagcctgcctgtgctggctgctggggtcgataggcttttgtcgtaataggcagagatgacttgcatcccagctttccaccaaccaaattcaaacattcactgcttatttgttacagactgtaattattaaagtccctgagagctgttttctcccgttcctttttcgcatgcttggcctcctctctgtttctatgaaccacagaccacctaagcaagctgctgagtaagggctcactggaaacttgcagtcacaggatgtccaatctttggcagtccgagcttggctctaggacagagctgtccaatagaaatataatgtgagccccatatacaatttttacatttctaatatattttaaacaagtgaagttaatatgcatccaaaatatttcaacctgtaatcaacataaaattttaatgagatattttatattattttttggtactgaatcttcaaaatccagagtgtattttacacttaccgcacatctccattcagactagtcacatttttaagtgctcagtagccacatgtggctggtggctactggattagacagcacgagtctggaagatggaagctagtgcagaaacctcttgtttaaaaaacaaaaaaggcaagatgggcttgagcgattcaagaggcaactaaaaataaaattaggacccagcaccttgtttgacacacagtttgaccttcgattttcctcccttaacttccctcttcccttaatatctgtatacaagtgttgcttcaaagtaccaaggtcagaaattgattcagtacggtttactaaagtcatgtggaataaagccattggaaacaaatggaaagcctgtcgggacttctgggctcagaaccagctggctcacgcactccacttgtcagctggacttctgccttgtgaaatggaagcagcctttgttcctttctggctgagcaagctcctgaggctgggagagactaggaaggcttggtaggaggggaaaaaagtcaggaaaagatatcaaatcagaaacatggaagaagaagggaaccgatttgagttggtgggcaaaactctaaaaatctaaatctgatgcttatgtaagggttgagcgaattagggagattgctagtggaaattggagggaatttgttttgcatcatttgtctaggatctatgcaaatatagctccactaaaggaccatagggaagagccagccttgccttttcttatatgattttgtttacaaaattttactgggacttttaaatctagctatagagttgggaaaaaatatttccacttagatattttacatggttttgtttaaaattaccattacttgttttttaaaaacacatgaccacatatgtatatgtatatctacctaaacattgtatcatggtttcagtatgttattcatgtattactgggagatgctaccaagaaaccaacccaaagaaaattctgaaaaatacatttctatttatagaataaatgtttcatttatataaaagcaaaagaacttagagttctaataaatgggatgtctaataaattatgaagttactgatttgaatatattatatttttataacttccttgccaaagtcctgatttagtacattagagaacctgtgtttcctctctcctctaccattcatctctcttccatacagtcatttgggctttttactcaaagagaatcaagaaataataagatataacaagcttggcaaagtgttggctttttaaaaaaaaatttttttaatctctagcagtttggtaatttagcagcatcatttatttgggattcttttatctgatttcaacagtgaaaaacatccctatgataaagcctaatgacccatttcacaaaagatggaatttgcccttcctagaaaatatgacggagaaaagtctgactcagagaaagtgagtctgaattttataaggggtagtaagaattggacaattcctttgcatatctgaacttggcaggtaccgttctaaatctgaaacagggtgatagctcaaagttgccattcatccagaatagattgttttagaatgtagtgtttaagtgactgtttcattaatacacctacaccctttctttgaaagtttgcaacctaattgcatctaaaactatgaataagttctgtggtaaaatcttaaactatggaaaattacaaaaatgaatttttcttccctgaaatcagagcttacatgtgtgtttttttataacattttcagataaatgtattcaacatgtaatacagtattttaacattcacctcttattttatattgaaatgtattacagtattaaaactcagtgttcagtatttatttcactatgcattttatttagtaaaagccaggagaaatgtttaatccaatggtgccttactttgtgatttaaaagaaatcaacttttttttatgtctaagtagtagattatttgcatatttgtaaaaactgttaggtctttatattttaaagtgtaataccagttttgttattttagtagcagaaatgggatgattgttaaagttccccaaaaatgttggcatgaaattaatttttccctccttatagtcaaggaccgtagaggaagaaaaacttttttttcatatcatgcactatgtaaacagacacattttgctatctgtgtcatcaggatagtgtaagtggtagggtagagactaccctagacatctgcatctttgtaagttagccagacaataaagaaaagcagaatga

SEQ ID NO: 278542 - DNA, 4338 bp, Homo sapiens
cacgaggcaaaccccctccaccacctcctccagtgggcaacaggccctccatccacagggaagcggttccccctcctcctcctcagaacaacaagcctccagtgccttccactccgcggtggaagttttggagggggcggacctccaggtctgggaggattgttccaggctggaatgccgaagctgagatccacggccaacagggataatgattctggaggaagccgaccaccattgttgccaccgggaggaagatccacatctgcgaaacccttttcacccccaagtggcccagggaggtttcctgtgccttctccaggccacagaagtggtcccccagagcctcagaggaaccgaatgccgcccccaaggcccgacgtgggctcaaagcctgatagcattcctcctccagtacctagtactccaagacccattcaatcaagtctgcacaaccgggggtccccaccagtgcccggaggccccaggcagcccagccccgggcccactcctccccctttccctggaaaccgcggcactgctttgggaggaggctcaatacgtcagtcccccttgagctcctcctcgcccttctccaaccggcctcccctgccgcctacccccagcagggccttggatgacaaaccccctccaccacctcctccagtgggcaacaggccctccatccacagggaagcggttccccctcctcctcctcagaacaacaagcctccagtgccttccactccgcggccttcggcctcctcacaggccccacctccgccgccacctcccagcaggcccgggccgcctcctctgcctccaagttccagcggcaatgacgaaaccccaagactcccacagcggaatctgtccctcagttcgtccacgcccccgttaccttcgccaggacgttcaggtcctcttcctcccccgcccagtgagagacccccacctccagtgagggacccgccaggccgatcaggccccctcccaccacctcctccagtaagcagaaacggcagcacatctcgggccctgcctgctacccctcagttgccatccaggagtggagtagacagtcccaggagtggacccaggcctccccttcctcctgataggcccagtgctggggcacctcccccacctccaccatcaacatctattagaaatggcttccaagactctccatgtgaagatgagtgggaaagcagattctacttccatccgatttccgatttgccacctccagagccatatgtacaaacgaccaaaagttatcccagcaaactggcaagaaacgaaagccggagtggatccaaccgaagagaaaggggtgctccaccactccctcccatcccgaggtgatctttgcctgctcttctctacccaagctcaagagctgcttctgttgctatctaagaactgcataccctcctccctgcttcttcccttgtgcctcatgtatgggcaggaggaaaggtgggagggggagtgggaatatgcgtgtgtgggtgggaatcggtaagaaatgcacctagcttttcatattgtgtttattctccaggctattgcttgcttcagctgcagcctgcctgtgctggctgctggggtcgataggcttttgtcgtaataggcagagatgacttgcatcccagctttccaccaaccaaattcaaacattcactgcttatttgttacagactgtaattattaaagtccctgagagctgttttctcccgttcctttttcgcatgcttggcctcctctctgtttctatgaaccacagaccacctaagcaagctgctgagtaagggctcactggaaacttgcagtcacaggatgtccaatctttggcagtccgagcttggctctaggacagagctgtccaatagaaatataatgtgagccccatatacaatttttacatttctaatatattttaaacaagtgaagttaatatgcatccaaaatatttcaacctgtaatcaacataaaattttaatgagatattttatattattttttggtactgaatcttcaaaatccagagtgtattttacacttaccgcacatctccattcagactagtcacatttttaagtgctcagtagccacatgtggctggtggctactggattagacagcacgagtctggaagatggaagctagtgcagaaacctcttgtttaaaaaacaaaaaaggcaagatgggcttgagcgattcaagaggcaactaaaaataaaattaggacccagcaccttgtttgacacacagtttgaccttcgattttcctcccttaacttccctcttcccttaatatctgtatacaagtgttgcttcaaagtaccaaggtcagaaattgattcagtacggtttactaaagtcatgtggaataaagccattggaaacaaatggaaagcctgtcgggacttctgggctcagaaccagctggctcacgcactccacttgtcagctggacttctgccttgtgaaatggaagcagcctttgttcctttctggctgagcaagctcctgaggctgggagagactaggaaggcttggtaggaggggaaaaaagtcaggaaaagatatcaaatcagaaacatggaagaagaagggaaccgatttgagttggtgggcaaaactctaaaaatctaaatctgatgcttatgtaagggttgagcgaattagggagattgctagtggaaattggagggaatttgttttgcatcatttgtctaggatctatgcaaatatagctccactaaaggaccatagggaagagccagccttgccttttcttatatgattttgtttacaaaattttactgggacttttaaatctagctatagagttgggaaaaaatatttccacttagatattttacatggttttgtttaaaattaccattacttgttttttaaaaacacatgaccacatatgtatatgtatatctacctaaacattgtatcatggtttcagtatgttattcatgtattactgggagatgctaccaagaaaccaacccaaagaaaattctgaaaaatacatttctatttatagaataaatgtttcatttatataaaagcaaaagaacttagagttctaataaatgggatgtctaataaattatgaagttactgatttgaatatattatatttttataacttccttgccaaagtcctgatttagtacattagagaacctgtgtttcctctctcctctaccattcatctctcttccatacagtcatttgggctttttactcaaagagaatcaagaaataataagatataacaagcttggcaaagtgttggctttttaaaaaaaaatttttttaatctctagcagtttggtaatttagcagcatcatttatttgggattcttttatctgatttcaacagtgaaaaacatccctatgataaagcctaatgacccatttcacaaaagatggaatttgcccttcctagaaaatatgacggagaaaagtctgactcagagaaagtgagtctgaattttataaggggtagtaagaattggacaattcctttgcatatctgaacttggcaggtaccgttctaaatctgaaacagggtgatagctcaaagttgccattcatccagaatagattgttttagaatgtagtgtttaagtgactgtttcattaatacacctacaccctttctttgaaagtttgcaacctaattgcatctaaaactatgaataagttctgtggtaaaatcttaaactatggaaaattacaaaaatgaatttttcttccctgaaatcagagcttacatgtgtgtttttttataacattttcagataaatgtattcaacatgtaatacagtattttaacattcacctcttattttatattgaaatgtattacagtattaaaactcagtgttcagtatttatttcactatgcattttatttagtaaaagccaggagaaatgtttaatccaatggtgccttactttgtgatttaaaagaaatcaacttttttttatgtctaagtagtagattatttgcatatttgtaaaaactgttaggtctttatattttaaagtgtaataccagttttgttattttagtagcagaaatgggatgattgttaaagttccccaaaaatgttggcatgaaattaatttttccctccttatagtcaaggaccgtagaggaagaaaaacttttttttcatatcatgcactatgtaaacagacacattttgctatctgtgtcatcaggatagtgtaagtggtagggtagagactaccctagacatctgcatctttgtaagttagccagacaataaagaaaagcagaatga

SEQ ID NO: 278543 - DNA, 4055 bp, Homo sapiens
cagctaggaaaccaagttccatagggtaccagcttgctcagggtcaagattcacattagcatttatagccatggatgttgattagctgtttgtcactccctgtgtttatctgcctccccaaagaggaagaaccaagaagaaactcttactgctctcaggatgactggtatttggtttcctgatgccacttctgcctggaaacagatcatatacatcacagaaacatgcttctgtaattaacaacaaaactatgcatttaaagaactttgttcttctgaagacctaaaataatttcataactatcttattctttttaaaaaaattctttcatcatgtcacagtaattagttcaatagctctttaaaggattataaaatgtttttttaaatatacggttgtccgtgtaaacagattttcacctgttttcaatttcactgtgccatctccaatctgagtgctaattcaaagccaaaacacccatttagctatcagtatgcacttgttttgcatatacatgtgtacacatgtgcaatttttgtgtttctgtgtgtttactcatttctcagccaaatatcctagaaaatcaccctaattaaagggcatgtgtccagcaagtcctcatcagctgtacaccaatggtgaccacggtaatggaatgtggatgtaaggttctgcactaagtgtctttttttgctccaggccccctcccaccacctcctccagtaagcagaaacggcagcacatctcgggccctgcctgctacccctcagttgccatccaggagtggagtagacagtcccaggagtggacccaggcctccccttcctcctgataggcccagtgctggggcacctcccccacctccaccatcaacatctattagaaatggcttccaagactctccatgtgaagatgagtgggaaagcagattctacttccatccgatttccgatttgccacctccagagccatatgtacaaacgaccaaaagttatcccagcaaactggcaagaaacgaaagccggagtggatccaaccgaagagaaaggggtgctccaccactccctcccatcccgaggtgatctttgcctgctcttctctacccaagctcaagagctgcttctgttgctatctaagaactgcataccctcctccctgcttcttcccttgtgcctcatgtatgggcaggaggaaaggtgggagggggagtgggaatatgcgtgtgtgggtgggaatcggtaagaaatgcacctagcttttcatattgtgtttattctccaggctattgcttgcttcagctgcagcctgcctgtgctggctgctggggtcgataggcttttgtcgtaataggcagagatgacttgcatcccagctttccaccaaccaaattcaaacattcactgcttatttgttacagactgtaattattaaagtccctgagagctgttttctcccgttcctttttcgcatgcttggcctcctctctgtttctatgaaccacagaccacctaagcaagctgctgagtaagggctcactggaaacttgcagtcacaggatgtccaatctttggcagtccgagcttggctctaggacagagctgtccaatagaaatataatgtgagccccatatacaatttttacatttctaatatattttaaacaagtgaagttaatatgcatccaaaatatttcaacctgtaatcaacataaaattttaatgagatattttatattattttttggtactgaatcttcaaaatccagagtgtattttacacttaccgcacatctccattcagactagtcacatttttaagtgctcagtagccacatgtggctggtggctactggattagacagcacgagtctggaagatggaagctagtgcagaaacctcttgtttaaaaaacaaaaaaggcaagatgggcttgagcgattcaagaggcaactaaaaataaaattaggacccagcaccttgtttgacacacagtttgaccttcgattttcctcccttaacttccctcttcccttaatatctgtatacaagtgttgcttcaaagtaccaaggtcagaaattgattcagtacggtttactaaagtcatgtggaataaagccattggaaacaaatggaaagcctgtcgggacttctgggctcagaaccagctggctcacgcactccacttgtcagctggacttctgccttgtgaaatggaagcagcctttgttcctttctggctgagcaagctcctgaggctgggagagactaggaaggcttggtaggaggggaaaaaagtcaggaaaagatatcaaatcagaaacatggaagaagaagggaaccgatttgagttggtgggcaaaactctaaaaatctaaatctgatgcttatgtaagggttgagcgaattagggagattgctagtggaaattggagggaatttgttttgcatcatttgtctaggatctatgcaaatatagctccactaaaggaccatagggaagagccagccttgccttttcttatatgattttgtttacaaaattttactgggacttttaaatctagctatagagttgggaaaaaatatttccacttagatattttacatggttttgtttaaaattaccattacttgttttttaaaaacacatgaccacatatgtatatgtatatctacctaaacattgtatcatggtttcagtatgttattcatgtattactgggagatgctaccaagaaaccaacccaaagaaaattctgaaaaatacatttctatttatagaataaatgtttcatttatataaaagcaaaagaacttagagttctaataaatgggatgtctaataaattatgaagttactgatttgaatatattatatttttataacttccttgccaaagtcctgatttagtacattagagaacctgtgtttcctctctcctctaccattcatctctcttccatacagtcatttgggctttttactcaaagagaatcaagaaataataagatataacaagcttggcaaagtgttggctttttaaaaaaaaatttttttaatctctagcagtttggtaatttagcagcatcatttatttgggattcttttatctgatttcaacagtgaaaaacatccctatgataaagcctaatgacccatttcacaaaagatggaatttgcccttcctagaaaatatgacggagaaaagtctgactcagagaaagtgagtctgaattttataaggggtagtaagaattggacaattcctttgcatatctgaacttggcaggtaccgttctaaatctgaaacagggtgatagctcaaagttgccattcatccagaatagattgttttagaatgtagtgtttaagtgactgtttcattaatacacctacaccctttctttgaaagtttgcaacctaattgcatctaaaactatgaataagttctgtggtaaaatcttaaactatggaaaattacaaaaatgaatttttcttccctgaaatcagagcttacatgtgtgtttttttataacattttcagataaatgtattcaacatgtaatacagtattttaacattcacctcttattttatattgaaatgtattacagtattaaaactcagtgttcagtatttatttcactatgcattttatttagtaaaagccaggagaaatgtttaatccaatggtgccttactttgtgatttaaaagaaatcaacttttttttatgtctaagtagtagattatttgcatatttgtaaaaactgttaggtctttatattttaaagtgtaataccagttttgttattttagtagcagaaatgggatgattgttaaagttccccaaaaatgttggcatgaaattaatttttccctccttatagtcaaggaccgtagaggaagaaaaacttttttttcatatcatgcactatgtaaacagacacattttgctatctgtgtcatcaggatagtgtaagtggtagggtagagactaccctagacatctgcatctttgtaagttagccagacaataaagaaaagcagaatga

SEQ ID NO: 278544 - DNA, 4672 bp, Homo sapiens
cccgggcaggttagaagacagcaggggaactcgagaagttggttgttttcagcagattaaaacaatacagatttatcagcaagactgttgaacgcataactgcccaagatgcctgtccctccccctccagcacccccgccgcccccgacgtttgcactggccaatacagagaagcctaccttgaataagacagagcaggctgggagaaatgctctcctttctgatatcagcaaagggaagaaactaaagaagacggtcaccaatgacagaagtgcaccaatactggacaaacctaaaggagctggtgctggaggcggtggtggtggctttggtggaggcggcggatttggcggaggaggtggtggcggaggcggtggaagttttggagggggcggacctccaggtctgggaggattgttccaggctggaatgccgaagctgagatccacggccaacagggataatgattctggaggaagccgaccaccattgttgccaccgggaggaagatccacatctgcgaaacccttttcacccccaagtggcccagggaggtttcctgtgccttctccaggccacagaagtggtcccccagagcctcagaggaaccgaatgccgcccccaaggcccgacgtgggctcaaagcctgatagcattcctcctccagtacctagtactccaagacccattcaatcaagtctgcacaaccgggggtccccaccagtgcccggaggccccaggcagcccagccccgggcccactcctccccctttccctggaaaccgcggcactgctttgggaggaggctcaatacgtcagtcccccttgagctcctcctcgcccttctccaaccggcctcccctgccgcctacccccagcagggccttggatgacaaaccccctccaccacctcctccagtgggcaacaggccctccatccacagggaagcggttccccctcctcctcctcagaacaacaagcctccagtgccttccactccgcggccttcggcctcctcacaggccccacctccgccgccacctcccagcaggcccgggccgcctcctctgcctccaagttccagcggcaatgacgaaaccccaagactcccacagcggaatctgtccctcagttcgtccacgcccccgttaccttcgccaggacgttcaggtcctcttcctcccccgcccagtgagagacccccacctccagtgagggacccgccaggccgatcaggccccctcccaccacctcctccagtaagcagaaacggcagcacatctcgggccctgcctgctacccctcagttgccatccaggagtggagtagacagtcccaggagtggacccaggcctccccttcctcctgataggcccagtgctggggcacctcccccacctccaccatcaacatctattagaaatggcttccaagactctccatgtgaagatgagtgggaaagcagattctacttccatccgatttccgatttgccacctccagagccatatgtacaaacgaccaaaagttatcccagcaaactggcaagaaacgaaagccggagtggatccaaccgaagagaaaggggtgctccaccactccctcccatcccgaggtgatctttgcctgctcttctctacccaagctcaagagctgcttctgttgctatctaagaactgcataccctcctccctgcttcttcccttgtgcctcatgtatgggcaggaggaaaggtgggagggggagtgggaatatgcgtgtgtgggtgggaatcggtaagaaatgcacctagcttttcatattgtgtttattctccaggctattgcttgcttcagctgcagcctgcctgtgctggctgctggggtcgataggcttttgtcgtaataggcagagatgacttgcatcccagctttccaccaaccaaattcaaacattcactgcttatttgttacagactgtaattattaaagtccctgagagctgttttctcccgttcctttttcgcatgcttggcctcctctctgtttctatgaaccacagaccacctaagcaagctgctgagtaagggctcactggaaacttgcagtcacaggatgtccaatctttggcagtccgagcttggctctaggacagagctgtccaatagaaatataatgtgagccccatatacaatttttacatttctaatatattttaaacaagtgaagttaatatgcatccaaaatatttcaacctgtaatcaacataaaattttaatgagatattttatattattttttggtactgaatcttcaaaatccagagtgtattttacacttaccgcacatctccattcagactagtcacatttttaagtgctcagtagccacatgtggctggtggctactggattagacagcacgagtctggaagatggaagctagtgcagaaacctcttgtttaaaaaacaaaaaaggcaagatgggcttgagcgattcaagaggcaactaaaaataaaattaggacccagcaccttgtttgacacacagtttgaccttcgattttcctcccttaacttccctcttcccttaatatctgtatacaagtgttgcttcaaagtaccaaggtcagaaattgattcagtacggtttactaaagtcatgtggaataaagccattggaaacaaatggaaagcctgtcgggacttctgggctcagaaccagctggctcacgcactccacttgtcagctggacttctgccttgtgaaatggaagcagcctttgttcctttctggctgagcaagctcctgaggctgggagagactaggaaggcttggtaggaggggaaaaaagtcaggaaaagatatcaaatcagaaacatggaagaagaagggaaccgatttgagttggtgggcaaaactctaaaaatctaaatctgatgcttatgtaagggttgagcgaattagggagattgctagtggaaattggagggaatttgttttgcatcatttgtctaggatctatgcaaatatagctccactaaaggaccatagggaagagccagccttgccttttcttatatgattttgtttacaaaattttactgggacttttaaatctagctatagagttgggaaaaaatatttccacttagatattttacatggttttgtttaaaattaccattacttgttttttaaaaacacatgaccacatatgtatatgtatatctacctaaacattgtatcatggtttcagtatgttattcatgtattactgggagatgctaccaagaaaccaacccaaagaaaattctgaaaaatacatttctatttatagaataaatgtttcatttatataaaagcaaaagaacttagagttctaataaatgggatgtctaataaattatgaagttactgatttgaatatattatatttttataacttccttgccaaagtcctgatttagtacattagagaacctgtgtttcctctctcctctaccattcatctctcttccatacagtcatttgggctttttactcaaagagaatcaagaaataataagatataacaagcttggcaaagtgttggctttttaaaaaaaaatttttttaatctctagcagtttggtaatttagcagcatcatttatttgggattcttttatctgatttcaacagtgaaaaacatccctatgataaagcctaatgacccatttcacaaaagatggaatttgcccttcctagaaaatatgacggagaaaagtctgactcagagaaagtgagtctgaattttataaggggtagtaagaattggacaattcctttgcatatctgaacttggcaggtaccgttctaaatctgaaacagggtgatagctcaaagttgccattcatccagaatagattgttttagaatgtagtgtttaagtgactgtttcattaatacacctacaccctttctttgaaagtttgcaacctaattgcatctaaaactatgaataagttctgtggtaaaatcttaaactatggaaaattacaaaaatgaatttttcttccctgaaatcagagcttacatgtgtgtttttttataacattttcagataaatgtattcaacatgtaatacagtattttaacattcacctcttattttatattgaaatgtattacagtattaaaactcagtgttcagtatttatttcactatgcattttatttagtaaaagccaggagaaatgtttaatccaatggtgccttactttgtgatttaaaagaaatcaacttttttttatgtctaagtagtagattatttgcatatttgtaaaaactgttaggtctttatattttaaagtgtaataccagttttgttattttagtagcagaaatgggatgattgttaaagttccccaaaaatgttggcatgaaattaatttttccctccttatagtcaaggaccgtagaggaagaaaaacttttttttcatatcatgcactatgtaaacagacacattttgctatctgtgtcatcaggatagtgtaagtggtagggtagagactaccctagacatctgcatctttgtaagttagccagacaataaagaaaagcagaatgatatggtgtcaactggtggtttttcttttaagtattgtttatgtaaatataaacaaaaaaacaagtgtctgttttcggtt

SEQ ID NO: 278545 - DNA, 1762 bp, Homo sapiens
cccgggcaggttagaagacagcaggggaactcgagaagttggttgttttcagcagattaaaacaatacagatttatcagcaagactgttgaacgcataactgcccaagatgcctgtccctccccctccagcacccccgccgcccccgacgtttgcactggccaatacagagaagcctaccttgaataagacagagcaggctgggagaaatgctctcctttctgatatcagcaaagggaagaaactaaagaagacggtcaccaatgacagaagtgcaccaatactggacaaacctaaaggagctggtgctggaggcggtggtggtggctttggtggaggcggcggatttggcggaggaggtggtggcggaggcggtggaagttttggagggggcggacctccaggtctgggaggattgttccaggctggaatgccgaagctgagatccacggccaacagggataatgattctggaggaagccgaccaccattgttgccaccgggaggaagatccacatctgcgaaacccttttcacccccaagtggcccagggaggtttcctgtgccttctccaggccacagaagtggtcccccagagcctcagaggaaccgaatgccgcccccaaggcccgacgtgggctcaaagcctgatagcattcctcctccagtacctagtactccaagacccattcaatcaagtctgcacaaccgggggtccccaccagtgcccggaggccccaggcagcccagccccgggcccactcctccccctttccctggaaaccgcggcactgctttgggaggaggctcaatacgtcagtcccccttgagctcctcctcgcccttctccaaccggcctcccctgccgcctacccccagcagggccttggatgacaaaccccctccaccacctcctccagtgggcaacaggccctccatccacagggaagcggttccccctcctcctcctcagaacaacaagcctccagtgccttccactccgcggccttcggcctcctcacaggccccacctccgccgccacctcccagcaggcccgggccgcctcctctgcctccaagttccagcggcaatgacgaaaccccaagactcccacagcggaatctgtccctcagttcgtccacgcccccgttaccttcgccaggacgttcaggtcctcttcctcccccgcccagtgagagacccccacctccagtgagggacccgccaggccgatcaggccccctcccaccacctcctccagtaagcagaaacggcagcacatctcgggccctgcctgctacccctcagttgccatccaggagtggagtagacagtcccaggagtggacccaggcctccccttcctcctgataggcccagtgctggggcacctcccccacctccaccatcaacatctattagaaatggcttccaagactctccatgtgaagatgagtgggaaagcagattctacttccatccgatttccgatttgccacctccagagccatatgtacaaacgaccaaaagttatcccagcaaactggcaagaaacgaaagccggagtggatccaaccgaagagaaaggggtgctccaccactccctcccatcccgaggtgatctttgcctgctcttctctacccaagctcaagagctgcttctgttgctatctaagaactgcataccctcctccctgcttcttcccttgtgcctcatccagtaagcagaaacggcagcacatctcgggccctgcctgctaccc

SEQ ID NO: 278546 - DNA, 1686 bp, Homo sapiens
cacagaaggacgtctgcctctgactcagtatgtcacatttaacaagaggccagagcttgtccaaaatggctgtccaaaaacgaccccacacttgcgttagaagatgatacctttttcagggacagttttctctcttggctcctgtcccgctggccctctgtctgcctgtgtccctgaccatggctccctgcagtaccctttaacgatttatcagcaagactgttgaacgcataactgcccaagatgcctgtccctccccctccagcacccccgccgcccccgacgtttgcactggccaatacagagaagcctaccttgaataagacagagcaggctgggagaaatgctctcctttctgatatcagcaaagggaagaaactaaagaagacggtcaccaatgacagaagtgcaccaatactggacaaacctaaaggagctggtgctggaggcggtggtggtggctttggtggaggcggcggatttggcggaggaggtggtggcggaggcggtggaagttttggagggggcggacctccaggtctgggaggattgttccaggctggaatgccgaagctgagatccacggccaacagggataatgattctggaggaagccgaccaccattgttgccaccgggaggaagatccacatctgcgaaacccttttcacccccaagtggcccagggaggtttcctgtgccttctccaggccacagaagtggtcccccagagcctcagaggaaccgaatgccgcccccaaggcccgacgtgggctcaaagcctgatagcattcctcctccagtacctagtactccaagacccattcaatcaagtctgcacaaccgggggtccccaccagtgcccggaggccccaggcagcccagccccgggcccactcctcccccacctccagtgagggacccgccaggccgatcaggccccctcccaccacctcctccagtaagcagaaacggcagcacatctcgggccctgcctgctacccctcagttgccatccaggagtggagtagacagtcccaggagtggacccaggcctccccttcctcctgataggcccagtgctggggcacctcccccacctccaccatcaacatctattagaaatggcttccaagactctccatgtgaagatgagtgggaaagcagattctacttccatccgatttccgatttgccacctccagagccatatgtacaaacgaccaaaagttatcccagcaaactggcaagaaacgaaagccggagtggatccaaccgaagagaaaggggtgctccaccactccctcccatcccgaggtgatctttgcctgctcttctctacccaagctcaagagctgcttctgttgctatctaagaactgcataccctcctccctgcttcttcccttgtgcctcatgtatgggcaggaggaaaggtgggagggggagtgggaatatgcgtgtgtgggtgggaatcggtaagaaatgcacctagcttttcatattgtgtttattctccaggctattgcttgcttcagctgcagcctgcctgtgctggctgctggggtcgataggcttttgtcgtaataggcagagatgacttgcatcccagctttccaccaaccaaattcaaacattcactgcttatttgttacagactgtaattattaaagtccctgagagctgtt

SEQ ID NO: 278547 - DNA, 419 bp, Homo sapiens
atacatagctcgattccccttttggggtctttgctagtaaactgtaattctttcagtaagtcactgctttactgaatggtgaagatttggaatgtcttctttgatttccaggccaacaatggatagatttggtcgtccttgaagcatttagagacctgtagaatgaacttaacttctgaaaactgggtgcggggccaatagaggggctgctcaatacctcaccagcctgctacgcggaaggctagatggagggctgctaaaggaagagaactgctgttccacctccgcctcctccctgcagtgtggcttcttaggcaagtcccagtttagaagtcatctaactaagtgaacattcttgaactgccaccagacctctcctaaaacttttttctaagcaaagaccccaaaagggggatcct

SEQ ID NO: 278548 - DNA, 316 bp, Homo sapiens
tctgtgcctttcgttacgtaagtcttcatagcacattgtctgtcactgaagatactgcttgtttctcttcccagatgagtgggaaagcagattctacttccatccgatttccgatttgccacctccagagccatatgtacaaacgaccaaaagttatcccagcaaactggcaagaaacgaaagccggagtgagtatttctgccaaggtttttgaagattcacgcttgagtagcctgagtgacactcgggctatatagaaagtccaggcttcttgcctggagtggggtagagaaccctttggagccatctacattct

SEQ ID NO: 278549 - DNA, 1279 bp, Homo sapiens
  misc_feature (435)..(435): n is a, c, g, or t
  misc_feature (438)..(438): n is a, c, g, or t
  misc_feature (951)..(951): n is a, c, g, or t
  misc_feature (1279)..(1279): n is a, c, g, or t
cggacgcgtgggtcgacccacgcgtccggactcagtatgtcacatttaacaagaggccagagcttgtccaaaatggctgtccaaaaacgaccccacacttgcgttagaagatgatacctttttcagggacagttttctctcttggctcctgtcccgctggccctctgtctgcctgtgtccctgaccatggctccctgcagtaccctttaacgatttatcagcaagactgttgaacgcataactgcccaagatgcctgtccctccccctccagcacccccgccgcccccgacgtttgcactggccaatacagagaagcctaccttgaataagacagagcaggctgggagaaatgctctcctttctgatatcagcaaagggaagaaactaaagaagacggtcaccaatgacagaagtgcaccaatactggacaaacntanaggagctggtgctggaggcggggaggctggctccgccggcaggcagacggactaacggccgaaggacagtgagaaggcaggcagcaggtgacaacgataccgaagcgcgggacacacccatccaacaacagcaaaagatacgcaccacagcatagaaaagcccgaaagccacaaacaccacggcaccaaacaagggaactaaaggaatacatgagaaggaagacggaacacagcaaaagtgagacaacagcggagcgacgatcgaaactacagaaaaaccacaaaacaaccacacgaaagtggaaccaagagaacagaaaccagatgacacatacgaaaggcaaagagaaatacgaaaccagcaaaagacacacagacggaaacagagaagagaggaccacaaaaagtagaaagaaagagtagaccgcacagcagcagaaaaaaacaaacgacacaacacatagaaccaacgacaacccactagagcaagatagcaaaaaaggagacacacgnaaatcagaacagagagcacaagagacgcaaagcaagcagaagacaccccagccccgagaacaacacagacgcacgatcaccgcagggctacaaacagacccaagaagagaaaacgacacaagacccacagagaagacgcgaggagaaaacgaagcagagagcacaaaacgaaaaaacagaccagagcagagcaacacacacagaaccacagacaagcaccaacgacagacgaaaacgaggccaagaaacagcaagagacgaccaaccaaacacacaacacagcccaggacagcacggacacaacgaacagcagcacaaaaaacaaagn

SEQ ID NO: 278550 - DNA, 4593 bp, Homo sapiens
cccgggcaggttagaagacagcaggggaactcgagaagttggttgttttcagcagattaaaacaatacagatttatcagcaagactgttgaacgcataactgcccaagatgcctgtccctccccctccagcacccccgccgcccccgacgtttgcactggccaatacagagaagcctaccttgaataagacagagcaggctgggagaaatgctctcctttctgatatcagcaaagggaagaaactaaagaagacggtcaccaatgacagaagtgcaccaatactggacaaacctaaaggagctggtgctggaggcggtggtggtggctttggtggaggcggcggatttggcggaggaggtggtggcggaggcggtggaagttttggagggggcggacctccaggtctgggaggattgttccaggctggaatgccgaagctgagatccacggccaacagggataatgattctggaggaagccgaccaccattgttgccaccgggaggaagatccacatctgcgaaacccttttcacccccaagtggcccagggaggtttcctgtgccttctccaggccacagaagtggtcccccagagcctcagaggaaccgaatgccgcccccaaggcccgacgtgggctcaaagcctgatagcattcctcctccagtacctagtactccaagacccattcaatcaagtctgcacaaccgggggtccccaccagtgcccggaggccccaggcagcccagccccgggcccactcctccccctttccctggaaaccgcggcactgctttgggaggaggctcaatacgtcagtcccccttgagctcctcctcgcccttctccaaccggcctcccctgccgcctacccccagcagggccttggatgacaaaccccctccaccacctcctccagtgggcaacaggccctccatccacagggaagcggttccccctcctcctcctcagaacaacaagcctccagtgccttccactccgcggccttcggcctcctcacaggccccacctccgccgccacctcccagcaggcccgggccgcctcctctgcctccaagttccagcggcaatgacgaaaccccaagactcccacagcggaatctgtccctcagttcgtccacgcccccgttaccttcgccaggacgttcaggtcctcttcctcccccgcccagtgagagacccccacctccagtgagggacccgccaggccgatcaggccccctcccaccacctcctccagtaagcagaaacggcagcacatctcgggccctgcctgctacccctcagttgccatccaggagtggagtagacagtcccaggagtggacccaggcctccccttcctcctgataggcccagtgctggggcacctcccccacctccaccatcaacatctattagaaatggcttccaagactctccatgtgaagatgagtgggaaagcagattctacttccatccgatttccgatttgccacctccagagccatatgtacaaacgaccaaaagttatcccagcaaactggcaagaaacgaaagccggagtggatccaaccgaagagaaaggggtgctccaccactccctcccatcccgaggtgatctttgcctgctcttctctacccaagctcaagagctgcttctgttgctatctaagaactgcataccctcctccctgcttcttcccttgtgcctcatgtatgggcaggaggaaaggtgggagggggagtgggaatatgcgtgtgtgggtgggaatcggtaagaaatgcacctagcttttcatattgtgtttattctccaggctattgcttgcttcagctgcagcctgcctgtgctggctgctggggtcgataggcttttgtcgtaataggcagagatgacttgcatcccagctttccaccaaccaaattcaaacattcactgcttatttgttacagactgtaattattaaagtccctgagagctgttttctcccgttcctttttcgcatgcttggcctcctctctgtttctatgaaccacagaccacctaagcaagctgctgagtaagggctcactggaaacttgcagtcacaggatgtccaatctttggcagtccgagcttggctctaggacagagctgtccaatagaaatataatgtgagccccatatacaatttttacatttctaatatattttaaacaagtgaagttaatatgcatccaaaatatttcaacctgtaatcaacataaaattttaatgagatattttatattattttttggtactgaatcttcaaaatccagagtgtattttacacttaccgcacatctccattcagactagtcacatttttaagtgctcagtagccacatgtggctggtggctactggattagacagcacgagtctggaagatggaagctagtgcagaaacctcttgtttaaaaaacaaaaaaggcaagatgggcttgagcgattcaagaggcaactaaaaataaaattaggacccagcaccttgtttgacacacagtttgaccttcgattttcctcccttaacttccctcttcccttaatatctgtatacaagtgttgcttcaaagtaccaaggtcagaaattgattcagtacggtttactaaagtcatgtggaataaagccattggaaacaaatggaaagcctgtcgggacttctgggctcagaaccagctggctcacgcactccacttgtcagctggacttctgccttgtgaaatggaagcagcctttgttcctttctggctgagcaagctcctgaggctgggagagactaggaaggcttggtaggaggggaaaaaagtcaggaaaagatatcaaatcagaaacatggaagaagaagggaaccgatttgagttggtgggcaaaactctaaaaatctaaatctgatgcttatgtaagggttgagcgaattagggagattgctagtggaaattggagggaatttgttttgcatcatttgtctaggatctatgcaaatatagctccactaaaggaccatagggaagagccagccttgccttttcttatatgattttgtttacaaaattttactgggacttttaaatctagctatagagttgggaaaaaatatttccacttagatattttacatggttttgtttaaaattaccattacttgttttttaaaaacacatgaccacatatgtatatgtatatctacctaaacattgtatcatggtttcagtatgttattcatgtattactgggagatgctaccaagaaaccaacccaaagaaaattctgaaaaatacatttctatttatagaataaatgtttcatttatataaaagcaaaagaacttagagttctaataaatgggatgtctaataaattatgaagttactgatttgaatatattatatttttataacttccttgccaaagtcctgatttagtacattagagaacctgtgtttcctctctcctctaccattcatctctcttccatacagtcatttgggctttttactcaaagagaatcaagaaataataagatataacaagcttggcaaagtgttggctttttaaaaaaaaatttttttaatctctagcagtttggtaatttagcagcatcatttatttgggattcttttatctgatttcaacagtgaaaaacatccctatgataaagcctaatgacccatttcacaaaagatggaatttgcccttcctagaaaatatgacggagaaaagtctgactcagagaaagtgagtctgaattttataaggggtagtaagaattggacaattcctttgcatatctgaacttggcaggtaccgttctaaatctgaaacagggtgatagctcaaagttgccattcatccagaatagattgttttagaatgtagtgtttaagtgactgtttcattaatacacctacaccctttctttgaaagtttgcaacctaattgcatctaaaactatgaataagttctgtggtaaaatcttaaactatggaaaattacaaaaatgaatttttcttccctgaaatcagagcttacatgtgtgtttttttataacattttcagataaatgtattcaacatgtaatacagtattttaacattcacctcttattttatattgaaatgtattacagtattaaaactcagtgttcagtatttatttcactatgcattttatttagtaaaagccaggagaaatgtttaatccaatggtgccttactttgtgatttaaaagaaatcaacttttttttatgtctaagtagtagattatttgcatatttgtaaaaactgttaggtctttatattttaaagtgtaataccagttttgttattttagtagcagaaatgggatgattgttaaagttccccaaaaatgttggcatgaaattaatttttccctccttatagtcaaggaccgtagaggaagaaaaacttttttttcatatcatgcactatgtaaacagacacattttgctatctgtgtcatcaggatagtgtaagtggtagggtagagactaccctagacatctgcatctttgtaagttagccagacaataaagaaaagcagaatga

SEQ ID NO: 278551 - DNA, 4556 bp, Homo sapiens
gagaagaagcccttagcctaatgaagcgataagatttatcagcaagactgttgaacgcataactgcccaagatgcctgtccctccccctccagcacccccgccgcccccgacgtttgcactggccaatacagagaagcctaccttgaataagacagagcaggctgggagaaatgctctcctttctgatatcagcaaagggaagaaactaaagaagacggtcaccaatgacagaagtgcaccaatactggacaaacctaaaggagctggtgctggaggcggtggtggtggctttggtggaggcggcggatttggcggaggaggtggtggcggaggcggtggaagttttggagggggcggacctccaggtctgggaggattgttccaggctggaatgccgaagctgagatccacggccaacagggataatgattctggaggaagccgaccaccattgttgccaccgggaggaagatccacatctgcgaaacccttttcacccccaagtggcccagggaggtttcctgtgccttctccaggccacagaagtggtcccccagagcctcagaggaaccgaatgccgcccccaaggcccgacgtgggctcaaagcctgatagcattcctcctccagtacctagtactccaagacccattcaatcaagtctgcacaaccgggggtccccaccagtgcccggaggccccaggcagcccagccccgggcccactcctccccctttccctggaaaccgcggcactgctttgggaggaggctcaatacgtcagtcccccttgagctcctcctcgcccttctccaaccggcctcccctgccgcctacccccagcagggccttggatgacaaaccccctccaccacctcctccagtgggcaacaggccctccatccacagggaagcggttccccctcctcctcctcagaacaacaagcctccagtgccttccactccgcggccttcggcctcctcacaggccccacctccgccgccacctcccagcaggcccgggccgcctcctctgcctccaagttccagcggcaatgacgaaaccccaagactcccacagcggaatctgtccctcagttcgtccacgcccccgttaccttcgccaggacgttcaggtcctcttcctcccccgcccagtgagagacccccacctccagtgagggacccgccaggccgatcaggccccctcccaccacctcctccagtaagcagaaacggcagcacatctcgggccctgcctgctacccctcagttgccatccaggagtggagtagacagtcccaggagtggacccaggcctccccttcctcctgataggcccagtgctggggcacctcccccacctccaccatcaacatctattagaaatggcttccaagactctccatgtgaagatgagtgggaaagcagattctacttccatccgatttccgatttgccacctccagagccatatgtacaaacgaccaaaagttatcccagcaaactggcaagaaacgaaagccggagtggatccaaccgaagagaaaggggtgctccaccactccctcccatcccgaggtgatctttgcctgctcttctctacccaagctcaagagctgcttctgttgctatctaagaactgcataccctcctccctgcttcttcccttgtgcctcatgtatgggcaggaggaaaggtgggagggggagtgggaatatgcgtgtgtgggtgggaatcggtaagaaatgcacctagcttttcatattgtgtttattctccaggctattgcttgcttcagctgcagcctgcctgtgctggctgctggggtcgataggcttttgtcgtaataggcagagatgacttgcatcccagctttccaccaaccaaattcaaacattcactgcttatttgttacagactgtaattattaaagtccctgagagctgttttctcccgttcctttttcgcatgcttggcctcctctctgtttctatgaaccacagaccacctaagcaagctgctgagtaagggctcactggaaacttgcagtcacaggatgtccaatctttggcagtccgagcttggctctaggacagagctgtccaatagaaatataatgtgagccccatatacaatttttacatttctaatatattttaaacaagtgaagttaatatgcatccaaaatatttcaacctgtaatcaacataaaattttaatgagatattttatattattttttggtactgaatcttcaaaatccagagtgtattttacacttaccgcacatctccattcagactagtcacatttttaagtgctcagtagccacatgtggctggtggctactggattagacagcacgagtctggaagatggaagctagtgcagaaacctcttgtttaaaaaacaaaaaaggcaagatgggcttgagcgattcaagaggcaactaaaaataaaattaggacccagcaccttgtttgacacacagtttgaccttcgattttcctcccttaacttccctcttcccttaatatctgtatacaagtgttgcttcaaagtaccaaggtcagaaattgattcagtacggtttactaaagtcatgtggaataaagccattggaaacaaatggaaagcctgtcgggacttctgggctcagaaccagctggctcacgcactccacttgtcagctggacttctgccttgtgaaatggaagcagcctttgttcctttctggctgagcaagctcctgaggctgggagagactaggaaggcttggtaggaggggaaaaaagtcaggaaaagatatcaaatcagaaacatggaagaagaagggaaccgatttgagttggtgggcaaaactctaaaaatctaaatctgatgcttatgtaagggttgagcgaattagggagattgctagtggaaattggagggaatttgttttgcatcatttgtctaggatctatgcaaatatagctccactaaaggaccatagggaagagccagccttgccttttcttatatgattttgtttacaaaattttactgggacttttaaatctagctatagagttgggaaaaaatatttccacttagatattttacatggttttgtttaaaattaccattacttgttttttaaaaacacatgaccacatatgtatatgtatatctacctaaacattgtatcatggtttcagtatgttattcatgtattactgggagatgctaccaagaaaccaacccaaagaaaattctgaaaaatacatttctatttatagaataaatgtttcatttatataaaagcaaaagaacttagagttctaataaatgggatgtctaataaattatgaagttactgatttgaatatattatatttttataacttccttgccaaagtcctgatttagtacattagagaacctgtgtttcctctctcctctaccattcatctctcttccatacagtcatttgggctttttactcaaagagaatcaagaaataataagatataacaagcttggcaaagtgttggctttttaaaaaaaaatttttttaatctctagcagtttggtaatttagcagcatcatttatttgggattcttttatctgatttcaacagtgaaaaacatccctatgataaagcctaatgacccatttcacaaaagatggaatttgcccttcctagaaaatatgacggagaaaagtctgactcagagaaagtgagtctgaattttataaggggtagtaagaattggacaattcctttgcatatctgaacttggcaggtaccgttctaaatctgaaacagggtgatagctcaaagttgccattcatccagaatagattgttttagaatgtagtgtttaagtgactgtttcattaatacacctacaccctttctttgaaagtttgcaacctaattgcatctaaaactatgaataagttctgtggtaaaatcttaaactatggaaaattacaaaaatgaatttttcttccctgaaatcagagcttacatgtgtgtttttttataacattttcagataaatgtattcaacatgtaatacagtattttaacattcacctcttattttatattgaaatgtattacagtattaaaactcagtgttcagtatttatttcactatgcattttatttagtaaaagccaggagaaatgtttaatccaatggtgccttactttgtgatttaaaagaaatcaacttttttttatgtctaagtagtagattatttgcatatttgtaaaaactgttaggtctttatattttaaagtgtaataccagttttgttattttagtagcagaaatgggatgattgttaaagttccccaaaaatgttggcatgaaattaatttttccctccttatagtcaaggaccgtagaggaagaaaaacttttttttcatatcatgcactatgtaaacagacacattttgctatctgtgtcatcaggatagtgtaagtggtagggtagagactaccctagacatctgcatctttgtaagttagccagacaataaagaaaagcagaatga

SEQ ID NO: 278552 - DNA, 4823 bp, Homo sapiens
cccgggcaggttagaagacagcaggggaactcgagaagttggttgttttcagcagattaaaacaatacagatttatcagcaagactgttgaacgcataactgcccaagatgcctgtccctccccctccagcacccccgccgcccccgacgtttgcactggccaatacagagaagcctaccttgaataagacagagcaggctgggagaaatgctctcctttctgatatcagcaaagggaagaaactaaagaagacggtcaccaatgacagaagtgcaccaatactggacaaacctaaaggagctggtgctggaggcggtggtggtggctttggtggaggcggcggatttggcggaggaggtggtggcggaggcggtggaagttttggagggggcggacctccaggtctgggaggattgttccaggctggaatgccgaagctgagatccacggccaacagggataatgattctggaggaagccgaccaccattgttgccaccgggaggaagatccacatctgcgaaacccttttcacccccaagtggcccagggaggtttcctgtgccttctccaggccacagaagtggtcccccagagcctcagaggaaccgaatgccgcccccaaggcccgacgtgggctcaaagcctgatagcattcctcctccagtacctagtactccaagacccattcaatcaagtctgcacaaccgggggtccccaccagtgcccggaggccccaggcagcccagccccgggcccactcctccccctttccctggaaaccgcggcactgctttgggaggaggctcaatacgtcagtcccccttgagctcctcctcgcccttctccaaccggcctcccctgccgcctacccccagcagggccttggatgacaaaccccctccaccacctcctccagtgggcaacaggccctccatccacagggaagcggttccccctcctcctcctcagaacaacaagcctccagtgccttccactccgcggccttcggcctcctcacaggccccacctccgccgccacctcccagcaggcccgggccgcctcctctgcctccaagttccagcggcaatgacgaaaccccaagactcccacagcggaatctgtccctcagttcgtccacgcccccgttaccttcgccaggacgttcaggtcctcttcctcccccgcccagtgagagacccccacctccagtgagggacccgccaggccgatcaggccccctcccaccacctcctccagtaagcagaaacggcagcacatctcgggccctgcctgctacccctcagttgccatccaggagtggagtagacagtcccaggagtggacccaggcctccccttcctcctgataggcccagtgctggggcacctcccccacctccaccatcaacatctattagaaatggcttccaagactctccatgtgaagatgagtgggaaagcagattctacttccatccgatttccgatttgccacctccagagccatatgtacaaacgaccaaaagttatcccagcaaactggcaagaaacgaaagccggagtggatccaaccgaagagaaaggggtgctccaccactccctcccatcccgaggtgatctttgcctgctcttctctacccaagctcaagagctgcttctgttgctatctaagaactgcataccctcctccctgcttcttcccttgtgcctcatgtatgggcaggaggaaaggtgggagggggagtgggaatatgcgtgtgtgggtgggaatcggtaagaaatgcacctagcttttcatattgtgtttattctccaggctattgcttgcttcagctgcagcctgcctgtgctggctgctggggtcgataggcttttgtcgtaataggcagagatgacttgcatcccagctttccaccaaccaaattcaaacattcactgcttatttgttacagactgtaattattaaagtccctgagagctgttttctcccgttcctttttcgcatgcttggcctcctctctgtttctatgaaccacagaccacctaagcaagctgctgagtaagggctcactggaaacttgcagtcacaggatgtccaatctttggcagtccgagcttggctctaggacagagctgtccaatagaaatataatgtgagccccatatacaatttttacatttctaatatattttaaacaagtgaagttaatatgcatccaaaatatttcaacctgtaatcaacataaaattttaatgagatattttatattattttttggtactgaatcttcaaaatccagagtgtattttacacttaccgcacatctccattcagactagtcacatttttaagtgctcagtagccacatgtggctggtggctactggattagacagcacgagtctggaagatggaagctagtgcagaaacctcttgtttaaaaaacaaaaaaggcaagatgggcttgagcgattcaagaggcaactaaaaataaaattaggacccagcaccttgtttgacacacagtttgaccttcgattttcctcccttaacttccctcttcccttaatatctgtatacaagtgttgcttcaaagtaccaaggtcagaaattgattcagtacggtttactaaagtcatgtggaataaagccattggaaacaaatggaaagcctgtcgggacttctgggctcagaaccagctggctcacgcactccacttgtcagctggacttctgccttgtgaaatggaagcagcctttgttcctttctggctgagcaagctcctgaggctgggagagactaggaaggcttggtaggaggggaaaaaagtcaggaaaagatatcaaatcagaaacatggaagaagaagggaaccgatttgagttggtgggcaaaactctaaaaatctaaatctgatgcttatgtaagggttgagcgaattagggagattgctagtggaaattggagggaatttgttttgcatcatttgtctaggatctatgcaaatatagctccactaaaggaccatagggaagagccagccttgccttttcttatatgattttgtttacaaaattttactgggacttttaaatctagctatagagttgggaaaaaatatttccacttagatattttacatggttttgtttaaaattaccattacttgttttttaaaaacacatgaccacatatgtatatgtatatctacctaaacattgtatcatggtttcagtatgttattcatgtattactgggagatgctaccaagaaaccaacccaaagaaaattctgaaaaatacatttctatttatagaataaatgtttcatttatataaaagcaaaagaacttagagttctaataaatgggatgtctaataaattatgaagttactgatttgaatatattatatttttataacttccttgccaaagtcctgatttagtacattagagaacctgtgtttcctctctcctctaccattcatctctcttccatacagtcatttgggctttttactcaaagagaatcaagaaataataagatataacaagcttggcaaagtgttggctttttaaaaaaaaatttttttaatctctagcagtttggtaatttagcagcatcatttatttgggattcttttatctgatttcaacagtgaaaaacatccctatgataaagcctaatgacccatttcacaaaagatggaatttgcccttcctagaaaatatgacggagaaaagtctgactcagagaaagtgagtctgaattttataaggggtagtaagaattggacaattcctttgcatatctgaacttggcaggtaccgttctaaatctgaaacagggtgatagctcaaagttgccattcatccagaatagattgttttagaatgtagtgtttaagtgactgtttcattaatacacctacaccctttctttgaaagtttgcaacctaattgcatctaaaactatgaataagttctgtggtaaaatcttaaactatggaaaattacaaaaatgaatttttcttccctgaaatcagagcttacatgtgtgtttttttataacattttcagataaatgtattcaacatgtaatacagtattttaacattcacctcttattttatattgaaatgtattacagtattaaaactcagtgttcagtatttatttcactatgcattttatttagtaaaagccaggagaaatgtttaatccaatggtgccttactttgtgatttaaaagaaatcaacttttttttatgtctaagtagtagattatttgcatatttgtaaaaactgttaggtctttatattttaaagtgtaataccagttttgttattttagtagcagaaatgggatgattgttaaagttccccaaaaatgttggcatgaaattaatttttccctccttatagtcaaggaccgtagaggaagaaaaacttttttttcatatcatgcactatgtaaacagacacattttgctatctgtgtcatcaggatagtgtaagtggtagggtagagactaccctagacatctgcatctttgtaagttagccagacaataaagaaaagcagaatgaaaaaaaaaaacccatcgcaaaaacaaagggggggggcaaaaattcccggggggccagttacgcgcacccgtttttgtaacaagggggccaataggggcgataaaaaacaggcggggggttacaacgcggaggcaaacggcctgggtttggaagaccctcggtgggaaatgggccccccaaatacgcccggaacaaactggttatggtaacccatcggggaatgcggataa

SEQ ID NO: 278553 - DNA, 2608 bp, Homo sapiens
  misc_feature (1855)..(1855): n is a, c, g, or t
  misc_feature (1862)..(1863): n is a, c, g, or t
  misc_feature (2592)..(2592): n is a, c, g, or t
  misc_feature (2594)..(2594): n is a, c, g, or t
cacagaaggacgtctgcctctgactcagtatgtcacatttaacaagaggccagagcttgtccaaaatggctgtccaaaaacgaccccacacttgcgttagaagatgatacctttttcagggacagttttctctcttggctcctgtcccgctggccctctgtctgcctgtgtccctgaccatggctccctgcagtaccctttaacgatttatcagcaagactgttgaacgcataactgcccaagatgcctgtccctccccctccagcacccccgccgcccccgacgtttgcactggccaatacagagaagcctaccttgaataagacagagcaggctgggagaaatgctctcctttctgatatcagcaaagggaagaaactaaagaagacggtcaccaatgacagaagtgcaccaatactggacaaacctaaaggagctggtgctggaggcggtggtggtggctttggtggaggcggcggatttggcggaggaggtggtggcggaggcggtggaagttttggagggggcggacctccaggtctgggaggattgttccaggctggaatgccgaagctgagatccacggccaacagggataatgattctggaggaagccgaccaccattgttgccaccgggaggaagatccacatctgcgaaacccttttcacccccaagtggcccagggaggtttcctgtgccttctccaggccacagaagtggtcccccagagcctcagaggaaccgaatgccgcccccaaggcccgacgtgggctcaaagcctgatagcattcctcctccagtacctagtactccaagacccattcaatcaagtctgcacaaccgggggtccccaccagtgcccggaggccccaggcagcccagccccgggcccactcctccccctttccctggaaaccgcggcactgctttgggaggaggctcaatacgtcagtcccccttgagctcctcctcgcccttctccaaccggcctcccctgccgcctacccccagcagggccttggatgacaaaccccctccaccacctcctccagtgggcaacaggccctccatccacagggaagcggttccccctcctcctcctcagaacaacaagcctccagtgccttccactccgcggccttcggcctcctcacaggccccacctccgccgccacctcccagcaggcccgggccgcctcctctgcctccaagttccagcggcaatgacgaaaccccaagactcccacagcggaatctgtccctcagttcgtccacgcccccgttaccttcgccaggacgttcaggtcctcttcctcccccgcccagtgagagacccccacctccagtgagggacccgccaggccgatcaggccccctcccaccacctcctccagtaagcagaaacggcagcacatctcgggccctgcctgctacccctcagttgccatccaggagtggagtagacagtcccaggagtggacccaggcctccccttcctcctgataggcccagtgctggggcacctcccccacctccaccatcaacatctattagaaatggcttccaagactctccatgtgaagatgagtgggaaagcagattctacttccatccgatttccgatttgccacctccagagccatatgtacaaacgaccaaaagttatcccagcaaactggcaagaaacgaaagccggagtgagtatttctgccaaggtttttgaagattcacgcttgagtagcctgagtgacactcgggctatatagaaagtccaggcttcttgcctggagtggggtagagaaccctttggagccatctacattctagtaaattccccttccacaggcagtgangaaattnnagatgcccagaatgcatatgagaaacagttattttaatgtgtcattacaagctcaaaataccgtggtttgctagtattaaattttattattttacttctttggacgtcttcctctgttttcatcttcctgagacagcacaagtagagccatcttctattccttctagttttgaaattggcataatgtctgattaattataacaaaaactccctttaactgccttgatcttttaaacgtattgtaatcatagctttacagagcattacatgaaaatgtaaatatatccataatctctccacataatagatattttcattttaccagattctcatccaattttttatccatataattctgtttttttatgtagttataatgacgatgtacagttttttggcggggtttacataacattgcttagtaaatagtgcccatgttatcacatggtttttatttcagcatatagtaatttaccattaccatggacatttaaattatttctgttgttctgctaatgtaggtaatgctaccataaagaactaaattgcttttcctccattgaagaagaatgtcaacaagaaaggaaaaatagacaaactggaattttataacagtaaatgtataggaagtgttacagctctttgagaatttgtctagcaggctttccagggttttgctggaaagcctctgaaatttacttttaaaaaaacacaatagctgggcatggngnctcacgcctgtaat

SEQ ID NO: 278554 - DNA, 1885 bp, Homo sapiens
cacagaaggacgtctgcctctgactcagtatgtcacatttaacaagaggccagagcttgtccaaaatggctgtccaaaaacgaccccacacttgcgttagaagatgatacctttttcagggacagttttctctcttggctcctgtcccgctggccctctgtctgcctgtgtccctgaccatggctccctgcagtaccctttaacgatttatcagcaagactgttgaacgcataactgcccaagatgcctgtccctccccctccagcacccccgccgcccccgacgtttgcactggccaatacagagaagcctaccttgaataagacagagcaggctgggagaaatgctctcctttctgatatcagcaaagggaagaaactaaagaagacggtcaccaatgacagaagtgcaccaatactggacaaacctaaaggagctggtgctggaggcggtggtggtggctttggtggaggcggcggatttggcggaggaggtggtggcggaggcggtggaagttttggagggggcggacctccaggtctgggaggattgttccaggctggaatgccgaagctgagatccacggccaacagggataatgattctggaggaagccgaccaccattgttgccaccgggaggaagatccacatctgcgaaacccttttcacccccaagtggcccagggaggtttcctgtgccttctccaggccacagaagtggtcccccagagcctcagaggaaccgaatgccgcccccaaggcccgacgtgggctcaaagcctgatagcattcctcctccagtacctagtactccaagacccattcaatcaagtctgcacaaccgggggtccccaccagtgcccggaggccccaggcagcccagccccgggcccactcctccccctttccctggaaaccgcggcactgctttgggaggaggctcaatacgtcagtcccccttgagctcctcctcgcccttctccaaccggcctcccctgccgcctacccccagcagggccttggatgacaaaccccctccaccacctcctccagtgggcaacaggccctccatccacagggaagcggttccccctcctcctcctcagaacaacaagcctccagtgccttccactccgcggccttcggcctcctcacaggccccacctccgccgccacctcccagcaggcccgggccgcctcctctgcctccaagttccagcggcaatgacgaaaccccaagactcccacagcggaatctgtccctcagttcgtccacgcccccgttaccttcgccaggacgttcaggtcctcttcctcccccgcccagtgagagacccccacctccagtgagggacccgccaggccgatcaggtatgacaagacgtggagtgagttgcttccaaaacccagcctgcccaaatgtaccaataatcctgtcagtcaagatagtctaacaaaagcaggcataagtaaactcagactgctttgtgcttttaagtggcacacgacacgtgtgatcgtgacctcgtgtaaaccccgggggaaagtgggaccaatatttctgttggtgttttagagatgaggacactgagtagctaataaagttaaatggtcacgagctagttaataaagaagaggcaagaactttcatcttccatctctgaagtgtacttgccagtccactaccctgcctccctagagagaatttcggcggtcttaattgggaaaataagtccccacctcccgcaggagggctctgttattccaacaagaggggaagttcttcaagagctaatgaacttctcctgtacttctctcttcattcgccaggctttgaggccatttccctattcattaaagactaatgtttaaaaagtcaaattt

SEQ ID NO: 278555 - DNA, 1272 bp, Homo sapiens
  misc_feature (428)..(428): n is a, c, g, or t
  misc_feature (431)..(431): n is a, c, g, or t
  misc_feature (944)..(944): n is a, c, g, or t
  misc_feature (1272)..(1272): n is a, c, g, or t
cacagaaggacgtctgcctctgactcagtatgtcacatttaacaagaggccagagcttgtccaaaatggctgtccaaaaacgaccccacacttgcgttagaagatgatacctttttcagggacagttttctctcttggctcctgtcccgctggccctctgtctgcctgtgtccctgaccatggctccctgcagtaccctttaacgatttatcagcaagactgttgaacgcataactgcccaagatgcctgtccctccccctccagcacccccgccgcccccgacgtttgcactggccaatacagagaagcctaccttgaataagacagagcaggctgggagaaatgctctcctttctgatatcagcaaagggaagaaactaaagaagacggtcaccaatgacagaagtgcaccaatactggacaaacntanaggagctggtgctggaggcggggaggctggctccgccggcaggcagacggactaacggccgaaggacagtgagaaggcaggcagcaggtgacaacgataccgaagcgcgggacacacccatccaacaacagcaaaagatacgcaccacagcatagaaaagcccgaaagccacaaacaccacggcaccaaacaagggaactaaaggaatacatgagaaggaagacggaacacagcaaaagtgagacaacagcggagcgacgatcgaaactacagaaaaaccacaaaacaaccacacgaaagtggaaccaagagaacagaaaccagatgacacatacgaaaggcaaagagaaatacgaaaccagcaaaagacacacagacggaaacagagaagagaggaccacaaaaagtagaaagaaagagtagaccgcacagcagcagaaaaaaacaaacgacacaacacatagaaccaacgacaacccactagagcaagatagcaaaaaaggagacacacgnaaatcagaacagagagcacaagagacgcaaagcaagcagaagacaccccagccccgagaacaacacagacgcacgatcaccgcagggctacaaacagacccaagaagagaaaacgacacaagacccacagagaagacgcgaggagaaaacgaagcagagagcacaaaacgaaaaaacagaccagagcagagcaacacacacagaaccacagacaagcaccaacgacagacgaaaacgaggccaagaaacagcaagagacgaccaaccaaacacacaacacagcccaggacagcacggacacaacgaacagcagcacaaaaaacaaagn

SEQ ID NO: 278556 - DNA, 422 bp, Homo sapiens
aacttaggctaggtacgaggctcggtgtcaagtggctcctgtaaggcagcaaggtagcgtggccggcgcccgagctggggttgtgtccctgctgggctgccgttccagctggactgccgccatggaactcagcgccgaatacctccgcgagaagctgcagcgggacctggaggcggagcatgtggaggtggaggacacgaccctcaaccgttgctcctgtagcttccgagtcctggtggtgtcggccaagttcgaggggaaaccgctgcttcagagacacaggctggtgaacgcgtgcctagcagaagagctcccgcacatccatgcctttgaacagaaaaccctgaccccagaccagtgggcacgtgagcgacagaaatgagggactgggatctgcacagccattaaattataaatctgga

SEQ ID NO: 278557 - DNA, 548 bp, Homo sapiens
aagcagtggtaacaacgcagagtacgcgggaagcagtggtaacaacgcagagtacgcgggaagcagtggtaacaacgcagagtacgcgggaagcagtggtaacaacgcagagtacgcggaaagcagtggtaacaacgcagagtacgcggggccagaagtggctcctgtaaggcagcaaggtagcgtggccggcgcccgagctggggttgtgtccctgctgggctgccgttccagctggactgccgccatggaactcagcgccgaatacctccgcgagaagctgcagcgggacctggaggcggagcatgtggaggtggaggacacgaccctcaaccgttgctcctgtagcttccgagtcctggtggtgtcggccaagttcgaggggaaaccgctgcttcagagacacaggctggtgaacgcgtgcctagcagaagagctcccgcacatccatgcctttgaacagaaaaccctgaccccagaccagtgggcacgtgagcgacagaaatgagggactgggatctgcacagccattaaattataaatctgga

SEQ ID NO: 278558 - DNA, 372 bp, Homo sapiens
actagtaatactactagtgaattcactagtaatattactagtgaattcactagtaatctgagttgagccgccggacaaggggaaaagagctcggggggcgggttcggcaccattcatattcttccgctcggtaggaggtggaggacacgaccctcaaccgttgctcctgtagcttccgagtcctggtggtgtcggccaagttcgaggggaaaccgctgcttcagagacacaggctggtgaacgcgtgcctagcagaagagctcccgcacatccatgcctttgaacagaaaaccctgaccccagaccagtgggcacgtgagcgacagaaatgagggactgggatctgcacagccattaaattataaatctgga

SEQ ID NO: 278559 - DNA, 445 bp, Homo sapiens
  misc_feature (147)..(147): n is a, c, g, or t
tgtagttaagtttgacctcaattgactacaaagtttgtagttaaatttgactacaattggaaatgccaaaaactcactaataggggtgagtctttaattgtaatgactttgttttatccacattacatatttatgtatttcactgtnatgtcaacatgtctgcagaatcactgtatgtaacaaacagccatatttaagacatgcctggataaataaaattggtaggaatgttttcttgccattatatttaacttttcttctttttccttgacaaatcttgataagtttttttatattagttttattttctagaaaatgtcttatgaatttctcctatttgctctagcatgcttacagaaaatgtcagtgtttcttacagctcaaatttgtatagttgttttaaaatgcggtctctttcttcttcccctggtacttttttctttct

SEQ ID NO: 278560 - DNA, 481 bp, Homo sapiens
gggaagcttctctattaccctccttaccaccacagctccagccaagcttggagtgatctgcaaacccaatatgtgagtttagtgtatagaaaacacatgaatgaaaggcaaaaggggccaacattggtatttgggtttttttttttttgagctgtcactaggctcctgaccttccctctgaactccaccctgcagggcaggccaacagacaagctttctttctttctttttcttttttttatatgagatggagactcgctctctcgcccaggctgcaatgcagtagcacgatctccgctcactgtaacctccccctcctgggttcaagcgattcttctgcctcagcctcccgagtagctgggattacaggaggctgaggcaagagaatcacttgaacccaggaggcggaggtttcagtgagcccagatcacaccactgcactccagcctgggcaacagagtgagactctgtctcaaaaaaa

SEQ ID NO: 278561 - DNA, 467 bp, Homo sapiens
gggaagcttctctattaccctccttaccaccacagctccagccaagcttggagtgatctgcaaacccaatatgtgagtttagtgtatagaaaacacatgaatgaaaggcaaaaggggccaacattggtatttgggtttttttttttttgagctgtcactaggctcctgaccttccctctgaactccaccctgcagggcaggccaacagacaagctttctttctttctttttcttttttttatatgagatggagactcgctctctcgcccaggctgcaatgcagtagcacgatctccgctcactgtaacctccccctcctgggttcaagcgaaaaattagacaaaatcttaagtagtaatttagaaaatagaatgaatattaagaaaaaaaaagaaatagatattgaagaaaagtaaaagaaaagaaaaaaagaaatggaaaaaattaaaaaaaaaaagtatagatat

SEQ ID NO: 278562 - DNA, 4007 bp, Homo sapiens
  misc_feature (40)..(40): n is a, c, g, or t
  misc_feature (3709)..(3709): n is a, c, g, or t
aaaggctaggtaggaggctggggtgaattcggccgagggncggtccttctcaacaggcctgtgccccgcggggtcgcctcctctgggacgccttcctcccggcacagaaggcctccccctctcaccaggccctcgcccgctggtccgccaggccccgccttttttgcggcccccattgtgctgctggacccgacgagcagtgttgacagtgaaccccacgtagacgcggccccggtaccgggggttcaggcagtagagcaggtagacgccgaaaaagcgccctggcctcgccgcgacccccgcgggacccatcgggccttggggttcgggaaccacagcagggggttgattgccgtgacctagggtccagggagggctggatcgctagggctgcagggtgcttgcttcggaacaagctctcggggactatccggaggcagcctgcaggaagccgtagcgccggtacgtgcccctctcctgtctggaggcgggtgtagaagtccgaccgcggaagccagactgctgtccagtcggcgagcgcgtaccattcagcatcggctccgcccgagtcccaccttcctcaggctctgattggctgacacatggcaagcgcgaaaagcctggaccgctggaaagcccggctgcttgagggcggaagtactgcgttgacgtacgccttagtaagggcggaagtgagttttccagcggaagtggctcctgtaaggcagcaaggtagcgtggccggcgcccgagctggggttgtgtccctgctgggctgccgttccagctggactgccgccatggaactcagcgccgaatacctccgcgagaagctgcagcgggacctggaggcggagcatgtggaggtggaggacacgaccctcaaccgttgctcctgtagcttccgagtcctggtggtgtcggccaagttcgaggggaaaccgctgcttcagagacacaggtaaggccctgggagcaccttgcctagctcctgtaccacaaccccagccactccccctacccctgcaacctgactcccgcactccccctggcgtggctcagggaccttgaggatcccgccttcgtgacccctgcttcgagtatttcgatgtagaccctctctccaagtacgtgttcccacggcctggggactacaaccttggggacaccagtctcttgggtcaccctagcctcggggtgtgcgatcaccgctggccttttcctaaccccatctctcgccccaggctggtgaacgcgtgcctagcagaagagctcccgcacatccatgcctttgaacagaaaaccctgaccccagaccagtgggcacgtgagcgacagaaatgagggactgggatctgcacagccattaaattataaatctggaccagcttctgtgtcgatgtgtgtgtgggaggggtgctgaggccgagtctaggacctggcctctccctgccctgcctccgtccattgttttaccttggacacgtctctgtccccatctaggcctctatccctgcttgtaaaatgaaagttctaccgtaaaagtcccttccagggtctaccgagaaagccttctctctgcaactccgtttagacatctaggagtctgtactgccaccacctacccacctcctagagagctcagggttcctcctctctgctagccttcaagatgcagagatgagaaagtgatcggggtttcagggccctgaccagttgaacaaacctctccctgacattaccgcagtatcagaggcaccatatagaattccacatattccttgcaggttccccccggccttctcaggcccaagagggagtggtgcccaggtaggggctcatcaactcctggaatgctgatgttttcagacccactggagaaggttccagtggccccatagccctgggcttaatgtgtctacagctgcccccggaggaccatggaggttttaagaatagtgggtgtgggacggggataggggtgagattagagtaggaatataaggctgacctgagtcagaaaattggggcaggtgatgcccctgtatcagtcttcataacaggttagtagggttgctaggaccttgtttgttttatttgttttttgttgtttgagacagggtcttgctctgtcgcccaggctggagtgccgtggcgccatctcagctcattgcaacctctgcctcccaggttcaaaagattcttgtgcttcagcctcctgagtagctgggattacaggggtgcaccaccatgcccggctaatttttgtacttttagtagagacagggtttcaccatgttggccaggccagtctcaaactcctggcctcaagtgatctgcccgccttggtctcctaaagtgctggaattttaggcgtgagccattgtacctggcccagattgctaggactttgaacagaggtccctgagacctagggagggagcccaaataacctagttggggccagggctcgttgagagtgagaaattgcaagtttcagccatcacacactcttttcctgcgttttttgtttgtttgtttgtttgttttgagacagagtcttggctctgttgcccaggctggagtgcagtagcatgatcttggctcactacaacttccccctcccgggttcaagcgattctcctgcctcagcctccctagtagctgggattacaggcacacgccaccatgcccagctaatttttggggtttttttattgtttgtttgtttgtctgtttttgagacagagtttcactcttgttgcccaggctggagtgcaatggcacgatctcggctcaccacaacctccgcctcctgggttcaagcgattctcttgtctcagcctcccaagtagctgggattacagagagacggtatctcgccgtgttgctcaggcaggtctcaaactcctgggctcaaatgatcctgccgcctcagcctcccacagtgctgggattatagacgtgagtccccatgcccagcctccctcgttatttttatctttggacctgcagtttaaaagatgcctaccctgttctgtacagagtaatgagatgtgtgacggctgcaaaccaggtgtttttttctgaggctgtgttgacagctgctaatgagtgtgttggtgttttgctcggcagcttggatcctagcatgactatacattgtgacatggtcattacatatggattagaccaactggagaattgccagacttgtggtaccgattatatcatctcagtcttgaatttactcacgctgattgttgaacagataaatacgaaactgccatcatcatttgtagaaaaactgtttataccatcatctaaactactattcttgcgttatcataaagaaaaagaggttgttgctgtagcccatgctgtttatcaagcaatgctcagcttgaagaatattcctgttttggagactgcctataagttaatattgggagaaatgacttgtgccctaaacaacctcctgcacagtctgcaacttcctgaggcctgttctgaaataaaacatgaggcttttaagaatcatgtgttcaatgtagacaatgcaaaatttgtagttaaatttgacctcagtgccctgactacaattggaaatgccaaaaactcactaataggggtgagtctttaattgtaatgactttgttttatccacagttaagccttttctcattacatatttatgtatttcactgtnatgtcaacatgtctgcagaatcactgtatgtaacaaacagccatatttaagacatgcctggataaataaaattggtaggaatgttttcttgccattatatttaacttttcttctttttccttgacaaatcttgataagtttttttatattagttttattttctagaaaatgtcttatgaatttctcctatttgctctagcatgcttacagaaaatgtcagtgtttcttacagctcaaatttgtatagttgttttaaaatgcggtctctttcttcttcccctggtacttttttctttct

SEQ ID NO: 278563 - DNA, 1101 bp, Homo sapiens
  misc_feature (40)..(40): n is a, c, g, or t
aaaggctaggtaggaggctggggtgaattcggccgagggncggtccttctcaacaggcctgtgccccgcggggtcgcctcctctgggacgccttcctcccggcacagaaggcctccccctctcaccaggccctcgcccgctggtccgccaggccccgccttttttgcggcccccattgtgctgctggacccgacgagcagtgttgacagtgaaccccacgtagacgcggccccggtaccgggggttcaggcagtagagcaggtagacgccgaaaaagcgccctggcctcgccgcgacccccgcgggacccatcgggccttggggttcgggaaccacagcagggggttgattgccgtgacctagggtccagggagggctggatcgctagggctgcagggtgcttgcttcggaacaagctctcggggactatccggaggcagcctgcaggaagccgtagcgccggtacgtgcccctctcctgtctggaggcgggtgtagaagtccgaccgcggaagccagactgctgtccagtcggcgagcgcgtaccattcagcatcggctccgcccgagtcccaccttcctcaggctctgattggctgacacatggcaagcgcgaaaagcctggaccgctggaaagcccggctgcttgagggcggaagtactgcgttgacgtacgccttagtaagggcggaagtgagttttccagcggaagtggctcctgtaaggcagcaaggtagcgtggccggcgcccgagctggggttgtgtccctgctgggctgccgttccagctggactgccgccatggaactcagcgccgaatacctccgcgagaagctgcagcgggacctggaggcggagcatgtggaggtggaggacacgaccctcaaccgttgctcctgtagcttccgagtcctggtggtgtcggccaagttcgaggggaaaccgctgcttcagagacacaggctggtgaacgcgtgcctagcagaagagctcccgcacatccatgcctttgaacagaaaaccctgaccccagaccagtgggcacgtgagcgacagaaatgagggactgggatctgcacagccattaaattataaatctgga

SEQ ID NO: 278564 - DNA, 3073 bp, Homo sapiens
  misc_feature (40)..(40): n is a, c, g, or t
aaaggctaggtaggaggctggggtgaattcggccgagggncggtccttctcaacaggcctgtgccccgcggggtcgcctcctctgggacgccttcctcccggcacagaaggcctccccctctcaccaggccctcgcccgctggtccgccaggccccgccttttttgcggcccccattgtgctgctggacccgacgagcagtgttgacagtgaaccccacgtagacgcggccccggtaccgggggttcaggcagtagagcaggtagacgccgaaaaagcgccctggcctcgccgcgacccccgcgggacccatcgggccttggggttcgggaaccacagcagggggttgattgccgtgacctagggtccagggagggctggatcgctagggctgcagggtgcttgcttcggaacaagctctcggggactatccggaggcagcctgcaggaagccgtagcgccggtacgtgcccctctcctgtctggaggcgggtgtagaagtccgaccgcggaagccagactgctgtccagtcggcgagcgcgtaccattcagcatcggctccgcccgagtcccaccttcctcaggctctgattggctgacacatggcaagcgcgaaaagcctggaccgctggaaagcccggctgcttgagggcggaagtactgcgttgacgtacgccttagtaagggcggaagtgagttttccagcggaagtggctcctgtaaggcagcaaggtagcgtggccggcgcccgagctggggttgtgtccctgctgggctgccgttccagctggactgccgccatggaactcagcgccgaatacctccgcgagaagctgcagcgggacctggaggcggagcatgtggaggtggaggacacgaccctcaaccgttgctcctgtagcttccgagtcctggtggtgtcggccaagttcgaggggaaaccgctgcttcagagacacaggctggtgaacgcgtgcctagcagaagagctcccgcacatccatgcctttgaacagaaaaccctgaccccagaccagtgggcacgtgagcgacagaaatgagggactgggatctgcacagccattaaattataaatctggaccagcttctgtgtcgatgtgtgtgtgggaggggtgctgaggccgagtctaggacctggcctctccctgccctgcctccgtccattgttttaccttggacacgtctctgtccccatctaggcctctatccctgcttgtaaaatgaaagttctaccgtaaaagtcccttccagggtctaccgagaaagccttctctctgcaactccgtttagacatctaggagtctgtactgccaccacctacccacctcctagagagctcagggttcctcctctctgctagccttcaagatgcagagatgagaaagtgatcggggtttcagggccctgaccagttgaacaaacctctccctgacattaccgcagtatcagaggcaccatatagaattccacatattccttgcaggttccccccggccttctcaggcccaagagggagtggtgcccaggtaggggctcatcaactcctggaatgctgatgttttcagacccactggagaaggttccagtggccccatagccctgggcttaatgtgtctacagctgcccccggaggaccatggaggttttaagaatagtgggtgtgggacggggataggggtgagattagagtaggaatataaggctgacctgagtcagaaaattggggcaggtgatgcccctgtatcagtcttcataacaggttagtagggttgctaggaccttgtttgttttatttgttttttgttgtttgagacagggtcttgctctgtcgcccaggctggagtgccgtggcgccatctcagctcattgcaacctctgcctcccaggttcaaaagattcttgtgcttcagcctcctgagtagctgggattacaggggtgcaccaccatgcccggctaatttttgtacttttagtagagacagggtttcaccatgttggccaggccagtctcaaactcctggcctcaagtgatctgcccgccttggtctcctaaagtgctggaattttaggcgtgagccattgtacctggcccagattgctaggactttgaacagaggtccctgagacctagggagggagcccaaataacctagttggggccagggctcgttgagagtgagaaattgcaagtttcagccatcacacactcttttcctgcgttttttgtttgtttgtttgtttgttttgagacagagtcttggctctgttgcccaggctggagtgcagtagcatgatcttggctcactacaacttccccctcccgggttcaagcgattctcctgcctcagcctccctagtagctgggattacaggcacacgccaccatgcccagctaatttttggggtttttttattgtttgtttgtttgtctgtttttgagacagagtttcactcttgttgcccaggctggagtgcaatggcacgatctcggctcaccacaacctccgcctcctgggttcaagcgattctcttgtctcagcctcccaagtagctgggattacagagagacggtatctcgccgtgttgctcaggcaggtctcaaactcctgggctcaaatgatcctgccgcctcagcctcccacagtgctgggattatagacgtgagtccccatgcccagcctccctcgttatttttatctttggacctgcagtttaaaagatgcctaccctgtaagtgatggttggttcatttcctcacaagcaacagtgccagcagagtcacgtgcaacgtgatgttttggttgactaggaaaggcagatttttggtaaatttgggaattattgaggttctaagctagggccttaaatagttcagctgtgtcagctctgagaaggagctcggaaacggagagcagcctcctggcccacatcagcatggctggtttctacccacgaaggccctgttcctgtgatgtagtaagtcagggggcatcccacatcccctgccatgggtcagtcccctcagcgcggtggaggggaagctctagggctg

SEQ ID NO: 278565 - DNA, 2520 bp, Homo sapiens
aagcagtggtaacaacgcagagtacgcgggaagcagtggtaacaacgcagagtacgcgggaagcagtggtaacaacgcagagtacgcgggaagcagtggtaacaacgcagagtacgcggaaagcagtggtaacaacgcagagtacgcggggccagaagtggctcctgtaaggcagcaaggtagcgtggccggcgcccgagctggggttgtgtccctgctgggctgccgttccagctggactgccgccatggaactcagcgccgaatacctccgcgagaagctgcagcgggacctggaggcggagcatgtggaggtggaggacacgaccctcaaccgttgctcctgtagcttccgagtcctggtggtgtcggccaagttcgaggggaaaccgctgcttcagagacacaggctggtgaacgcgtgcctagcagaagagctcccgcacatccatgcctttgaacagaaaaccctgaccccagaccagtgggcacgtgagcgacagaaatgagggactgggatctgcacagccattaaattataaatctggaccagcttctgtgtcgatgtgtgtgtgggaggggtgctgaggccgagtctaggacctggcctctccctgccctgcctccgtccattgttttaccttggacacgtctctgtccccatctaggcctctatccctgcttgtaaaatgaaagttctaccgtaaaagtcccttccagggtctaccgagaaagccttctctctgcaactccgtttagacatctaggagtctgtactgccaccacctacccacctcctagagagctcagggttcctcctctctgctagccttcaagatgcagagatgagaaagtgatcggggtttcagggccctgaccagttgaacaaacctctccctgacattaccgcagtatcagaggcaccatatagaattccacatattccttgcaggttccccccggccttctcaggcccaagagggagtggtgcccaggtaggggctcatcaactcctggaatgctgatgttttcagacccactggagaaggttccagtggccccatagccctgggcttaatgtgtctacagctgcccccggaggaccatggaggttttaagaatagtgggtgtgggacggggataggggtgagattagagtaggaatataaggctgacctgagtcagaaaattggggcaggtgatgcccctgtatcagtcttcataacaggttagtagggttgctaggaccttgtttgttttatttgttttttgttgtttgagacagggtcttgctctgtcgcccaggctggagtgccgtggcgccatctcagctcattgcaacctctgcctcccaggttcaaaagattcttgtgcttcagcctcctgagtagctgggattacaggggtgcaccaccatgcccggctaatttttgtacttttagtagagacagggtttcaccatgttggccaggccagtctcaaactcctggcctcaagtgatctgcccgccttggtctcctaaagtgctggaattttaggcgtgagccattgtacctggcccagattgctaggactttgaacagaggtccctgagacctagggagggagcccaaataacctagttggggccagggctcgttgagagtgagaaattgcaagtttcagccatcacacactcttttcctgcgttttttgtttgtttgtttgtttgttttgagacagagtcttggctctgttgcccaggctggagtgcagtagcatgatcttggctcactacaacttccccctcccgggttcaagcgattctcctgcctcagcctccctagtagctgggattacaggcacacgccaccatgcccagctaatttttggggtttttttattgtttgtttgtttgtctgtttttgagacagagtttcactcttgttgcccaggctggagtgcaatggcacgatctcggctcaccacaacctccgcctcctgggttcaagcgattctcttgtctcagcctcccaagtagctgggattacagagagacggtatctcgccgtgttgctcaggcaggtctcaaactcctgggctcaaatgatcctgccgcctcagcctcccacagtgctgggattatagacgtgagtccccatgcccagcctccctcgttatttttatctttggacctgcagtttaaaagatgcctaccctgtaagtgatggttggttcatttcctcacaagcaacagtgccagcagagtcacgtgcaacgtgatgttttggttgactaggaaaggcagatttttggtaaatttgggaattattgaggttctaagctagggccttaaatagttcagctgtgtcagctctgagaaggagctcggaaacggagagcagcctcctggcccacatcagcatggctggtttctacccacgaaggccctgttcctgtgatgtagtaagtcagggggcatcccacatcccctgccatgggtcagtcccctcagcgcggtggaggggaagctctagggctg

SEQ ID NO: 278566 - DNA, 3073 bp, Homo sapiens
  misc_feature (40)..(40): n is a, c, g, or t
aaaggctaggtaggaggctggggtgaattcggccgagggncggtccttctcaacaggcctgtgccccgcggggtcgcctcctctgggacgccttcctcccggcacagaaggcctccccctctcaccaggccctcgcccgctggtccgccaggccccgccttttttgcggcccccattgtgctgctggacccgacgagcagtgttgacagtgaaccccacgtagacgcggccccggtaccgggggttcaggcagtagagcaggtagacgccgaaaaagcgccctggcctcgccgcgacccccgcgggacccatcgggccttggggttcgggaaccacagcagggggttgattgccgtgacctagggtccagggagggctggatcgctagggctgcagggtgcttgcttcggaacaagctctcggggactatccggaggcagcctgcaggaagccgtagcgccggtacgtgcccctctcctgtctggaggcgggtgtagaagtccgaccgcggaagccagactgctgtccagtcggcgagcgcgtaccattcagcatcggctccgcccgagtcccaccttcctcaggctctgattggctgacacatggcaagcgcgaaaagcctggaccgctggaaagcccggctgcttgagggcggaagtactgcgttgacgtacgccttagtaagggcggaagtgagttttccagcggaagtggctcctgtaaggcagcaaggtagcgtggccggcgcccgagctggggttgtgtccctgctgggctgccgttccagctggactgccgccatggaactcagcgccgaatacctccgcgagaagctgcagcgggacctggaggcggagcatgtggaggtggaggacacgaccctcaaccgttgctcctgtagcttccgagtcctggtggtgtcggccaagttcgaggggaaaccgctgcttcagagacacaggctggtgaacgcgtgcctagcagaagagctcccgcacatccatgcctttgaacagaaaaccctgaccccagaccagtgggcacgtgagcgacagaaatgagggactgggatctgcacagccattaaattataaatctggaccagcttctgtgtcgatgtgtgtgtgggaggggtgctgaggccgagtctaggacctggcctctccctgccctgcctccgtccattgttttaccttggacacgtctctgtccccatctaggcctctatccctgcttgtaaaatgaaagttctaccgtaaaagtcccttccagggtctaccgagaaagccttctctctgcaactccgtttagacatctaggagtctgtactgccaccacctacccacctcctagagagctcagggttcctcctctctgctagccttcaagatgcagagatgagaaagtgatcggggtttcagggccctgaccagttgaacaaacctctccctgacattaccgcagtatcagaggcaccatatagaattccacatattccttgcaggttccccccggccttctcaggcccaagagggagtggtgcccaggtaggggctcatcaactcctggaatgctgatgttttcagacccactggagaaggttccagtggccccatagccctgggcttaatgtgtctacagctgcccccggaggaccatggaggttttaagaatagtgggtgtgggacggggataggggtgagattagagtaggaatataaggctgacctgagtcagaaaattggggcaggtgatgcccctgtatcagtcttcataacaggttagtagggttgctaggaccttgtttgttttatttgttttttgttgtttgagacagggtcttgctctgtcgcccaggctggagtgccgtggcgccatctcagctcattgcaacctctgcctcccaggttcaaaagattcttgtgcttcagcctcctgagtagctgggattacaggggtgcaccaccatgcccggctaatttttgtacttttagtagagacagggtttcaccatgttggccaggccagtctcaaactcctggcctcaagtgatctgcccgccttggtctcctaaagtgctggaattttaggcgtgagccattgtacctggcccagattgctaggactttgaacagaggtccctgagacctagggagggagcccaaataacctagttggggccagggctcgttgagagtgagaaattgcaagtttcagccatcacacactcttttcctgcgttttttgtttgtttgtttgtttgttttgagacagagtcttggctctgttgcccaggctggagtgcagtagcatgatcttggctcactacaacttccccctcccgggttcaagcgattctcctgcctcagcctccctagtagctgggattacaggcacacgccaccatgcccagctaatttttggggtttttttattgtttgtttgtttgtctgtttttgagacagagtttcactcttgttgcccaggctggagtgcaatggcacgatctcggctcaccacaacctccgcctcctgggttcaagcgattctcttgtctcagcctcccaagtagctgggattacaggtatgtgctaccacgcccggctaatcttgtatttttaatagagacagggtttctccatgttgttcaggctggtcttgaactcccgacctcaggtgatccacccgcctcggcctccaaaagtgctgggattacaggcgtgtgccacttatgcccagctttcttttttgttttcttcccacacctctactgcccaagtagttttctatggcatactgaagaggtggggcctggaaatgacgccatgggtggtccctgcttgatatgaaccaaaccttactatggctaagacgcccatcccaaacagccctgtgtcctcccatctcaggatcacctgctaagttgggtatcaaaacctattcccacacccactccccacaaggcctgacagacctgttcctgccaggtctctcacagaggtcaggcccaggcagaacccacaggaagggctagagaggcagaagcactcactacacgggggaaggctctgaa

SEQ ID NO: 278567 - DNA, 1348 bp, Homo sapiens
  misc_feature (40)..(40): n is a, c, g, or t
  misc_feature (1124)..(1124): n is a, c, g, or t
aaaggctaggtaggaggctggggtgaattcggccgagggncggtccttctcaacaggcctgtgccccgcggggtcgcctcctctgggacgccttcctcccggcacagaaggcctccccctctcaccaggccctcgcccgctggtccgccaggccccgccttttttgcggcccccattgtgctgctggacccgacgagcagtgttgacagtgaaccccacgtagacgcggccccggtaccgggggttcaggcagtagagcaggtagacgccgaaaaagcgccctggcctcgccgcgacccccgcgggacccatcgggccttggggttcgggaaccacagcagggggttgattgccgtgacctagggtccagggagggctggatcgctagggctgcagggtgcttgcttcggaacaagctctcggggactatccggaggcagcctgcaggaagccgtagcgccggtacgtgcccctctcctgtctggaggcgggtgtagaagtccgaccgcggaagccagactgctgtccagtcggcgagcgcgtaccattcagcatcggctccgcccgagtcccaccttcctcaggctctgattggctgacacatggcaagcgcgaaaagcctggaccgctggaaagcccggctgcttgagggcggaagtactgcgttgacgtacgccttagtaagggcggaagtgagttttccagcggaagtggctcctgtaaggcagcaaggtagcgtggccggcgcccgagctggggttgtgtccctgctgggctgccgttccagctggactgccgccatggaactcagcgccgaatacctccgcgagaagctgcagcgggacctggaggcggagcatgtggaggtggaggacacgaccctcaaccgttgctcctgtagcttccgagtcctggtggtgtcggccaagttcgaggggaaaccgctgcttcagagacacaggctggtgaacgcgtgcctagcagaagagctcccgcacatccatgcctttgaacagaaaaccctgaccccagaccagtgggcacgtgagcgacagaaatgagggactgggatctgcacagccattaaattataaatctggaaaaaaaaaaaaaaaaaaaaaaanaaacaaaaaaaaaaaaaacacaaaaaaaacacacccgcgggcgcgcacctctgtcgggggggggggaaaaagggggaagaaaaggggccggggcaccaggcgagcgtacgcaggcacaggagatttgggacaaagagggcggaagaccacgggggaccccacaaaaaggagggggcgaaaaagtaggaaaacgcgccgggaacacaggggaaagagagcgagga

SEQ ID NO: 278568 - DNA, 1709 bp, Homo sapiens
  misc_feature (40)..(40): n is a, c, g, or t
  misc_feature (1411)..(1411): n is a, c, g, or t
aaaggctaggtaggaggctggggtgaattcggccgagggncggtccttctcaacaggcctgtgccccgcggggtcgcctcctctgggacgccttcctcccggcacagaaggcctccccctctcaccaggccctcgcccgctggtccgccaggccccgccttttttgcggcccccattgtgctgctggacccgacgagcagtgttgacagtgaaccccacgtagacgcggccccggtaccgggggttcaggcagtagagcaggtagacgccgaaaaagcgccctggcctcgccgcgacccccgcgggacccatcgggccttggggttcgggaaccacagcagggggttgattgccgtgacctagggtccagggagggctggatcgctagggctgcagggtgcttgcttcggaacaagctctcggggactatccggaggcagcctgcaggaagccgtagcgccggtacgtgcccctctcctgtctggaggcgggtgtagaagtccgaccgcggaagccagactgctgtccagtcggcgagcgcgtaccattcagcatcggctccgcccgagtcccaccttcctcaggctctgattggctgacacatggcaagcgcgaaaagcctggaccgctggaaagcccggctgcttgagggcggaagtactgcgttgacgtacgccttagtaagggcggaagtgagttttccagcggaagtggctcctgtaaggcagcaaggtagcgtggccggcgcccgagctggggttgtgtccctgctgggctgccgttccagctggactgccgccatggaactcagcgccgaatacctccgcgagaagctgcagcgggacctggaggcggagcatgtggaggtggaggacacgaccctcaaccgttgctcctgtagcttccgagtcctggtggtgtcggccaagttcgaggggaaaccgctgcttcagagacacagattgttgaacagataaatacgaaactgccatcatcatttgtagaaaaactgtttataccatcatctaaactactattcttgcgttatcataaagaaaaagaggttgttgctgtagcccatgctgtttatcaagcaatgctcagcttgaagaatattcctgttttggagactgcctataagttaatattgggagaaatgacttgtgccctaaacaacctcctgcacagtctgcaacttcctgaggcctgttctgaaataaaacatgaggcttttaagaatcatgtgttcaatgtagacaatgcaaaatttgtagttaaatttgacctcagtgccctgactacaattggaaatgccaaaaactcactaataggggtgagtctttaattgtaatgactttgttttatccacagttaagccttttctcattacatatttatgtatttcactgtnatgtcaacatgtctgcagaatcactgtatgtaacaaacagccatatttaagacatgcctggataaataaaattggtaggaatgttttcttgccattatatttaacttttcttctttttccttgacaaatcttgataagtttttttatattagttttattttctagaaaatgtcttatgaatttctcctatttgctctagcatgcttacagaaaatgtcagtgtttcttacagctcaaatttgtatagttgttttaaaatgcggtctctttcttcttcccctggtacttttttctttct

SEQ ID NO: 278569 - DNA, 2101 bp, Homo sapiens
  misc_feature (40)..(40): n is a, c, g, or t
  misc_feature (1803)..(1803): n is a, c, g, or t
aaaggctaggtaggaggctggggtgaattcggccgagggncggtccttctcaacaggcctgtgccccgcggggtcgcctcctctgggacgccttcctcccggcacagaaggcctccccctctcaccaggccctcgcccgctggtccgccaggccccgccttttttgcggcccccattgtgctgctggacccgacgagcagtgttgacagtgaaccccacgtagacgcggccccggtaccgggggttcaggcagtagagcaggtagacgccgaaaaagcgccctggcctcgccgcgacccccgcgggacccatcgggccttggggttcgggaaccacagcagggggttgattgccgtgacctagggtccagggagggctggatcgctagggctgcagggtgcttgcttcggaacaagctctcggggactatccggaggcagcctgcaggaagccgtagcgccggtacgtgcccctctcctgtctggaggcgggtgtagaagtccgaccgcggaagccagactgctgtccagtcggcgagcgcgtaccattcagcatcggctccgcccgagtcccaccttcctcaggctctgattggctgacacatggcaagcgcgaaaagcctggaccgctggaaagcccggctgcttgagggcggaagtactgcgttgacgtacgccttagtaagggcggaagtgagttttccagcggaagtggctcctgtaaggcagcaaggtagcgtggccggcgcccgagctggggttgtgtccctgctgggctgccgttccagctggactgccgccatggaactcagcgccgaatacctccgcgagaagctgcagcgggacctggaggcggagcatgtggaggtggaggacacgaccctcaaccgttgctcctgtagcttccgagtcctggtggtgtcggccaagttcgaggggaaaccgctgcttcagagacacagagagacggtatctcgccgtgttgctcaggcaggtctcaaactcctgggctcaaatgatcctgccgcctcagcctcccacagtgctgggattatagacgtgagtccccatgcccagcctccctcgttatttttatctttggacctgcagtttaaaagatgcctaccctgttctgtacagagtaatgagatgtgtgacggctgcaaaccaggtgtttttttctgaggctgtgttgacagctgctaatgagtgtgttggtgttttgctcggcagcttggatcctagcatgactatacattgtgacatggtcattacatatggattagaccaactggagaattgccagacttgtggtaccgattatatcatctcagtcttgaatttactcacgctgattgttgaacagataaatacgaaactgccatcatcatttgtagaaaaactgtttataccatcatctaaactactattcttgcgttatcataaagaaaaagaggttgttgctgtagcccatgctgtttatcaagcaatgctcagcttgaagaatattcctgttttggagactgcctataagttaatattgggagaaatgacttgtgccctaaacaacctcctgcacagtctgcaacttcctgaggcctgttctgaaataaaacatgaggcttttaagaatcatgtgttcaatgtagacaatgcaaaatttgtagttaaatttgacctcagtgccctgactacaattggaaatgccaaaaactcactaataggggtgagtctttaattgtaatgactttgttttatccacagttaagccttttctcattacatatttatgtatttcactgtnatgtcaacatgtctgcagaatcactgtatgtaacaaacagccatatttaagacatgcctggataaataaaattggtaggaatgttttcttgccattatatttaacttttcttctttttccttgacaaatcttgataagtttttttatattagttttattttctagaaaatgtcttatgaatttctcctatttgctctagcatgcttacagaaaatgtcagtgtttcttacagctcaaatttgtatagttgttttaaaatgcggtctctttcttcttcccctggtacttttttctttct

SEQ ID NO: 278570 - DNA, 1830 bp, Homo sapiens
  misc_feature (40)..(40): n is a, c, g, or t
  misc_feature (1532)..(1532): n is a, c, g, or t
aaaggctaggtaggaggctggggtgaattcggccgagggncggtccttctcaacaggcctgtgccccgcggggtcgcctcctctgggacgccttcctcccggcacagaaggcctccccctctcaccaggccctcgcccgctggtccgccaggccccgccttttttgcggcccccattgtgctgctggacccgacgagcagtgttgacagtgaaccccacgtagacgcggccccggtaccgggggttcaggcagtagagcaggtagacgccgaaaaagcgccctggcctcgccgcgacccccgcgggacccatcgggccttggggttcgggaaccacagcagggggttgattgccgtgacctagggtccagggagggctggatcgctagggctgcagggtgcttgcttcggaacaagctctcggggactatccggaggcagcctgcaggaagccgtagcgccggtacgtgcccctctcctgtctggaggcgggtgtagaagtccgaccgcggaagccagactgctgtccagtcggcgagcgcgtaccattcagcatcggctccgcccgagtcccaccttcctcaggctctgattggctgacacatggcaagcgcgaaaagcctggaccgctggaaagcccggctgcttgagggcggaagtactgcgttgacgtacgccttagtaagggcggaagtgagttttccagcggaagtggctcctgtaaggcagcaaggtagcgtggccggcgcccgagctggggttgtgtccctgctgggctgccgttccagctggactgccgccatggaactcagcgccgaatacctccgcgagaagctgcagcgggacctggaggcggagcatgtggaggtggaggacacgaccctcaaccgttgctcctgtagcttccgagtcctggtggtgtcggccaagttcgaggggaaaccgctgcttcagagacacagcttggatcctagcatgactatacattgtgacatggtcattacatatggattagaccaactggagaattgccagacttgtggtaccgattatatcatctcagtcttgaatttactcacgctgattgttgaacagataaatacgaaactgccatcatcatttgtagaaaaactgtttataccatcatctaaactactattcttgcgttatcataaagaaaaagaggttgttgctgtagcccatgctgtttatcaagcaatgctcagcttgaagaatattcctgttttggagactgcctataagttaatattgggagaaatgacttgtgccctaaacaacctcctgcacagtctgcaacttcctgaggcctgttctgaaataaaacatgaggcttttaagaatcatgtgttcaatgtagacaatgcaaaatttgtagttaaatttgacctcagtgccctgactacaattggaaatgccaaaaactcactaataggggtgagtctttaattgtaatgactttgttttatccacagttaagccttttctcattacatatttatgtatttcactgtnatgtcaacatgtctgcagaatcactgtatgtaacaaacagccatatttaagacatgcctggataaataaaattggtaggaatgttttcttgccattatatttaacttttcttctttttccttgacaaatcttgataagtttttttatattagttttattttctagaaaatgtcttatgaatttctcctatttgctctagcatgcttacagaaaatgtcagtgtttcttacagctcaaatttgtatagttgttttaaaatgcggtctctttcttcttcccctggtacttttttctttct

SEQ ID NO: 278571 - DNA, 2129 bp, Homo sapiens
  misc_feature (40)..(40): n is a, c, g, or t
  misc_feature (1831)..(1831): n is a, c, g, or t
aaaggctaggtaggaggctggggtgaattcggccgagggncggtccttctcaacaggcctgtgccccgcggggtcgcctcctctgggacgccttcctcccggcacagaaggcctccccctctcaccaggccctcgcccgctggtccgccaggccccgccttttttgcggcccccattgtgctgctggacccgacgagcagtgttgacagtgaaccccacgtagacgcggccccggtaccgggggttcaggcagtagagcaggtagacgccgaaaaagcgccctggcctcgccgcgacccccgcgggacccatcgggccttggggttcgggaaccacagcagggggttgattgccgtgacctagggtccagggagggctggatcgctagggctgcagggtgcttgcttcggaacaagctctcggggactatccggaggcagcctgcaggaagccgtagcgccggtacgtgcccctctcctgtctggaggcgggtgtagaagtccgaccgcggaagccagactgctgtccagtcggcgagcgcgtaccattcagcatcggctccgcccgagtcccaccttcctcaggctctgattggctgacacatggcaagcgcgaaaagcctggaccgctggaaagcccggctgcttgagggcggaagtactgcgttgacgtacgccttagtaagggcggaagtgagttttccagcggaagtggctcctgtaaggcagcaaggtagcgtggccggcgcccgagctggggttgtgtccctgctgggctgccgttccagctggactgccgccatggaactcagcgccgaatacctccgcgagaagctgcagcgggacctggaggcggagcatgtggaggtggaggacacgaccctcaaccgttgctcctgtagcttccgagtcctggtggtgtcggccaagttcgaggggaaaccgctgcttcagagacacaggctggagtgcaatggcacgatctcggctcaccacaacctccgcctcctgggttcaagcgattctcttgtctcagcctcccaagtagctgggattacagagagacggtatctcgccgtgttgctcaggcaggtctcaaactcctgggctcaaatgatcctgccgcctcagcctcccacagtgctgggattatagacgttctgtacagagtaatgagatgtgtgacggctgcaaaccaggtgtttttttctgaggctgtgttgacagctgctaatgagtgtgttggtgttttgctcggcagcttggatcctagcatgactatacattgtgacatggtcattacatatggattagaccaactggagaattgccagacttgtggtaccgattatatcatctcagtcttgaatttactcacgctgattgttgaacagataaatacgaaactgccatcatcatttgtagaaaaactgtttataccatcatctaaactactattcttgcgttatcataaagaaaaagaggttgttgctgtagcccatgctgtttatcaagcaatgctcagcttgaagaatattcctgttttggagactgcctataagttaatattgggagaaatgacttgtgccctaaacaacctcctgcacagtctgcaacttcctgaggcctgttctgaaataaaacatgaggcttttaagaatcatgtgttcaatgtagacaatgcaaaatttgtagttaaatttgacctcagtgccctgactacaattggaaatgccaaaaactcactaataggggtgagtctttaattgtaatgactttgttttatccacagttaagccttttctcattacatatttatgtatttcactgtnatgtcaacatgtctgcagaatcactgtatgtaacaaacagccatatttaagacatgcctggataaataaaattggtaggaatgttttcttgccattatatttaacttttcttctttttccttgacaaatcttgataagtttttttatattagttttattttctagaaaatgtcttatgaatttctcctatttgctctagcatgcttacagaaaatgtcagtgtttcttacagctcaaatttgtatagttgttttaaaatgcggtctctttcttcttcccctggtacttttttctttct

SEQ ID NO: 278572 - DNA, 1426 bp, Homo sapiens
  misc_feature (40)..(40): n is a, c, g, or t
aaaggctaggtaggaggctggggtgaattcggccgagggncggtccttctcaacaggcctgtgccccgcggggtcgcctcctctgggacgccttcctcccggcacagaaggcctccccctctcaccaggccctcgcccgctggtccgccaggccccgccttttttgcggcccccattgtgctgctggacccgacgagcagtgttgacagtgaaccccacgtagacgcggccccggtaccgggggttcaggcagtagagcaggtagacgccgaaaaagcgccctggcctcgccgcgacccccgcgggacccatcgggccttggggttcgggaaccacagcagggggttgattgccgtgacctagggtccagggagggctggatcgctagggctgcagggtgcttgcttcggaacaagctctcggggactatccggaggcagcctgcaggaagccgtagcgccggtacgtgcccctctcctgtctggaggcgggtgtagaagtccgaccgcggaagccagactgctgtccagtcggcgagcgcgtaccattcagcatcggctccgcccgagtcccaccttcctcaggctctgattggctgacacatggcaagcgcgaaaagcctggaccgctggaaagcccggctgcttgagggcggaagtactgcgttgacgtacgccttagtaagggcggaagtgagttttccagcggaagtggctcctgtaaggcagcaaggtagcgtggccggcgcccgagctggggttgtgtccctgctgggctgccgttccagctggactgccgccatggaactcagcgccgaatacctccgcgagaagctgcagcgggacctggaggcggagcatgtggaggtggaggacacgaccctcaaccgttgctcctgtagcttccgagtcctggtggtgtcggccaagttcgaggggaaaccgctgcttcagagacacaggttctgtacagagtaatgagatgtgtgacggctgcaaaccaggtgtttttttctgaggctgtgttgacagctgctaatgagtgtgttggtgttttgctcggcagcttggatcctagcatgactatacattgtgacatggtcattacatatggattagaccaactggagaattgccagacttgtggtaccgattatatcatctcagtcttgaatttactcacgctgattgttgaacagataaatacgaaactgccatcatcatttgtagaaaaactgtttataccatcatctaaactactattcttgcgttatcataaagaaaaagaggtgtgctgtagcccatgtgttatcaagcaagctcagtgagaatattctgttgggaatgctatagtatttggggaatggttgggcctaaaaattcggaagctggattctgggtgtttgaaaacatgaggttaaaacttg

SEQ ID NO: 278573 - DNA, 1384 bp, Homo sapiens
  misc_feature (40)..(40): n is a, c, g, or t
aaaggctaggtaggaggctggggtgaattcggccgagggncggtccttctcaacaggcctgtgccccgcggggtcgcctcctctgggacgccttcctcccggcacagaaggcctccccctctcaccaggccctcgcccgctggtccgccaggccccgccttttttgcggcccccattgtgctgctggacccgacgagcagtgttgacagtgaaccccacgtagacgcggccccggtaccgggggttcaggcagtagagcaggtagacgccgaaaaagcgccctggcctcgccgcgacccccgcgggacccatcgggccttggggttcgggaaccacagcagggggttgattgccgtgacctagggtccagggagggctggatcgctagggctgcagggtgcttgcttcggaacaagctctcggggactatccggaggcagcctgcaggaagccgtagcgccggtacgtgcccctctcctgtctggaggcgggtgtagaagtccgaccgcggaagccagactgctgtccagtcggcgagcgcgtaccattcagcatcggctccgcccgagtcccaccttcctcaggctctgattggctgacacatggcaagcgcgaaaagcctggaccgctggaaagcccggctgcttgagggcggaagtactgcgttgacgtacgccttagtaagggcggaagtgagttttccagcggaagtggctcctgtaaggcagcaaggtagcgtggccggcgcccgagctggggttgtgtccctgctgggctgccgttccagctggactgccgccatggaactcagcgccgaatacctccgcgagaagctgcagcgggacctggaggcggagcatgtggaggtggaggacacgaccctcaaccgttgctcctgtagcttccgagtcctggtggtgtcggccaagttcgaggggaaaccgctgcttcagagacacaggtaaggccctgggagcaccttgcctagctcctgtaccacaaccccagccactccccctacccctgcaacctgactcccgcactccccctggcgtggctcagggaccttgaggatcccgccttcgtgacccctgcttcgagtatttcgatgtagaccctctctccaagtacgtgttcccacggcctggggactacaaccttggggacaccagtctcttgggtcaccctagcctcggggtgtgcgatcaccgctggccttttcctaaccccatctctcgccccaggctggtgaacgcgtgcctagcagaagagctcccgcacatccatgcctttgaacagaaaaccctgaccccagaccagtgggcacgtgagcgacagaaatgagggactgggatctgcacagccattaaattataaatctgga

SEQ ID NO: 278574 - DNA, 3318 bp, Homo sapiens
  misc_feature (40)..(40): n is a, c, g, or t
aaaggctaggtaggaggctggggtgaattcggccgagggncggtccttctcaacaggcctgtgccccgcggggtcgcctcctctgggacgccttcctcccggcacagaaggcctccccctctcaccaggccctcgcccgctggtccgccaggccccgccttttttgcggcccccattgtgctgctggacccgacgagcagtgttgacagtgaaccccacgtagacgcggccccggtaccgggggttcaggcagtagagcaggtagacgccgaaaaagcgccctggcctcgccgcgacccccgcgggacccatcgggccttggggttcgggaaccacagcagggggttgattgccgtgacctagggtccagggagggctggatcgctagggctgcagggtgcttgcttcggaacaagctctcggggactatccggaggcagcctgcaggaagccgtagcgccggtacgtgcccctctcctgtctggaggcgggtgtagaagtccgaccgcggaagccagactgctgtccagtcggcgagcgcgtaccattcagcatcggctccgcccgagtcccaccttcctcaggctctgattggctgacacatggcaagcgcgaaaagcctggaccgctggaaagcccggctgcttgagggcggaagtactgcgttgacgtacgccttagtaagggcggaagtgagttttccagcggaagtggctcctgtaaggcagcaaggtagcgtggccggcgcccgagctggggttgtgtccctgctgggctgccgttccagctggactgccgccatggaactcagcgccgaatacctccgcgagaagctgcagcgggacctggaggcggagcatgtgcttccgagtcctggtggtgtcggccaagttcgaggggaaaccgctgcttcagagacacaggtaaggccctgggagcaccttgcctagctcctgtaccacaaccccagccactccccctacccctgcaacctgactcccgcactccccctggcgtggctcagggaccttgaggatcccgccttcgtgacccctgcttcgagtatttcgatgtagaccctctctccaagtacgtgttcccacggcctggggactacaaccttggggacaccagtctcttgggtcaccctagcctcggggtgtgcgatcaccgctggccttttcctaaccccatctctcgccccaggctggtgaacgcgtgcctagcagaagagctcccgcacatccatgcctttgaacagaaaaccctgaccccagaccagtgggcacgtgagcgacagaaatgagggactgggatctgcacagccattaaattataaatctggaccagcttctgtgtcgatgtgtgtgtgggaggggtgctgaggccgagtctaggacctggcctctccctgccctgcctccgtccattgttttaccttggacacgtctctgtccccatctaggcctctatccctgcttgtaaaatgaaagttctaccgtaaaagtcccttccagggtctaccgagaaagccttctctctgcaactccgtttagacatctaggagtctgtactgccaccacctacccacctcctagagagctcagggttcctcctctctgctagccttcaagatgcagagatgagaaagtgatcggggtttcagggccctgaccagttgaacaaacctctccctgacattaccgcagtatcagaggcaccatatagaattccacatattccttgcaggttccccccggccttctcaggcccaagagggagtggtgcccaggtaggggctcatcaactcctggaatgctgatgttttcagacccactggagaaggttccagtggccccatagccctgggcttaatgtgtctacagctgcccccggaggaccatggaggttttaagaatagtgggtgtgggacggggataggggtgagattagagtaggaatataaggctgacctgagtcagaaaattggggcaggtgatgcccctgtatcagtcttcataacaggttagtagggttgctaggaccttgtttgttttatttgttttttgttgtttgagacagggtcttgctctgtcgcccaggctggagtgccgtggcgccatctcagctcattgcaacctctgcctcccaggttcaaaagattcttgtgcttcagcctcctgagtagctgggattacaggggtgcaccaccatgcccggctaatttttgtacttttagtagagacagggtttcaccatgttggccaggccagtctcaaactcctggcctcaagtgatctgcccgccttggtctcctaaagtgctggaattttaggcgtgagccattgtacctggcccagattgctaggactttgaacagaggtccctgagacctagggagggagcccaaataacctagttggggccagggctcgttgagagtgagaaattgcaagtttcagccatcacacactcttttcctgcgttttttgtttgtttgtttgtttgttttgagacagagtcttggctctgttgcccaggctggagtgcagtagcatgatcttggctcactacaacttccccctcccgggttcaagcgattctcctgcctcagcctccctagtagctgggattacaggcacacgccaccatgcccagctaatttttggggtttttttattgtttgtttgtttgtctgtttttgagacagagtttcactcttgttgcccaggctggagtgcaatggcacgatctcggctcaccacaacctccgcctcctgggttcaagcgattctcttgtctcagcctcccaagtagctgggattacagagagacggtatctcgccgtgttgctcaggcaggtctcaaactcctgggctcaaatgatcctgccgcctcagcctcccacagtgctgggattatagacgtgagtccccatgcccagcctccctcgttatttttatctttggacctgcagtttaaaagatgcctaccctgtaagtgatggttggttcatttcctcacaagcaacagtgccagcagagtcacgtgcaacgtgatgttttggttgactaggaaaggcagatttttggtaaatttgggaattattgaggttctaagctagggccttaaatagttcagctgtgtcagctctgagaaggagctcggaaacggagagcagcctcctggcccacatcagcatggctggtttctacccacgaaggccctgttcctgtgatgtagtaagtcagggggcatcccacatcccctgccatgggtcagtcccctcagcgcggtggaggggaagctctagggctg

SEQ ID NO: 278575 - DNA, 3432 bp, Homo sapiens
  misc_feature (40)..(40): n is a, c, g, or t
aaaggctaggtaggaggctggggtgaattcggccgagggncggtccttctcaacaggcctgtgccccgcggggtcgcctcctctgggacgccttcctcccggcacagaaggcctccccctctcaccaggccctcgcccgctggtccgccaggccccgccttttttgcggcccccattgtgctgctggacccgacgagcagtgttgacagtgaaccccacgtagacgcggccccggtaccgggggttcaggcagtagagcaggtagacgccgaaaaagcgccctggcctcgccgcgacccccgcgggacccatcgggccttggggttcgggaaccacagcagggggttgattgccgtgacctagggtccagggagggctggatcgctagggctgcagggtgcttgcttcggaacaagctctcggggactatccggaggcagcctgcaggaagccgtagcgccggtacgtgcccctctcctgtctggaggcgggtgtagaagtccgaccgcggaagccagactgctgtccagtcggcgagcgcgtaccattcagcatcggctccgcccgagtcccaccttcctcaggctctgattggctgacacatggcaagcgcgaaaagcctggaccgctggaaagcccggctgcttgagggcggaagtactgcgttgacgtacgccttagtaagggcggaagtgagttttccagcggaagtggctcctgtaaggcagcaaggtagcgtggccggcgcccgagctggggttgtgtccctgctgggctgccgttccagctggactgccgccatggaactcagcgccgaatacctccgcgagaagctgcagcgggacctggaggcggagcatgtgtgagttgagccgccggacaaggggaaaagagctcggggggcgggttcggcaccattcatattcttccgctcggtaggaggtggaggacacgaccctcaaccgttgctcctgtagcttccgagtcctggtggtgtcggccaagttcgaggggaaaccgctgcttcagagacacaggtaaggccctgggagcaccttgcctagctcctgtaccacaaccccagccactccccctacccctgcaacctgactcccgcactccccctggcgtggctcagggaccttgaggatcccgccttcgtgacccctgcttcgagtatttcgatgtagaccctctctccaagtacgtgttcccacggcctggggactacaaccttggggacaccagtctcttgggtcaccctagcctcggggtgtgcgatcaccgctggccttttcctaaccccatctctcgccccaggctggtgaacgcgtgcctagcagaagagctcccgcacatccatgcctttgaacagaaaaccctgaccccagaccagtgggcacgtgagcgacagaaatgagggactgggatctgcacagccattaaattataaatctggaccagcttctgtgtcgatgtgtgtgtgggaggggtgctgaggccgagtctaggacctggcctctccctgccctgcctccgtccattgttttaccttggacacgtctctgtccccatctaggcctctatccctgcttgtaaaatgaaagttctaccgtaaaagtcccttccagggtctaccgagaaagccttctctctgcaactccgtttagacatctaggagtctgtactgccaccacctacccacctcctagagagctcagggttcctcctctctgctagccttcaagatgcagagatgagaaagtgatcggggtttcagggccctgaccagttgaacaaacctctccctgacattaccgcagtatcagaggcaccatatagaattccacatattccttgcaggttccccccggccttctcaggcccaagagggagtggtgcccaggtaggggctcatcaactcctggaatgctgatgttttcagacccactggagaaggttccagtggccccatagccctgggcttaatgtgtctacagctgcccccggaggaccatggaggttttaagaatagtgggtgtgggacggggataggggtgagattagagtaggaatataaggctgacctgagtcagaaaattggggcaggtgatgcccctgtatcagtcttcataacaggttagtagggttgctaggaccttgtttgttttatttgttttttgttgtttgagacagggtcttgctctgtcgcccaggctggagtgccgtggcgccatctcagctcattgcaacctctgcctcccaggttcaaaagattcttgtgcttcagcctcctgagtagctgggattacaggggtgcaccaccatgcccggctaatttttgtacttttagtagagacagggtttcaccatgttggccaggccagtctcaaactcctggcctcaagtgatctgcccgccttggtctcctaaagtgctggaattttaggcgtgagccattgtacctggcccagattgctaggactttgaacagaggtccctgagacctagggagggagcccaaataacctagttggggccagggctcgttgagagtgagaaattgcaagtttcagccatcacacactcttttcctgcgttttttgtttgtttgtttgtttgttttgagacagagtcttggctctgttgcccaggctggagtgcagtagcatgatcttggctcactacaacttccccctcccgggttcaagcgattctcctgcctcagcctccctagtagctgggattacaggcacacgccaccatgcccagctaatttttggggtttttttattgtttgtttgtttgtctgtttttgagacagagtttcactcttgttgcccaggctggagtgcaatggcacgatctcggctcaccacaacctccgcctcctgggttcaagcgattctcttgtctcagcctcccaagtagctgggattacagagagacggtatctcgccgtgttgctcaggcaggtctcaaactcctgggctcaaatgatcctgccgcctcagcctcccacagtgctgggattatagacgtgagtccccatgcccagcctccctcgttatttttatctttggacctgcagtttaaaagatgcctaccctgtaagtgatggttggttcatttcctcacaagcaacagtgccagcagagtcacgtgcaacgtgatgttttggttgactaggaaaggcagatttttggtaaatttgggaattattgaggttctaagctagggccttaaatagttcagctgtgtcagctctgagaaggagctcggaaacggagagcagcctcctggcccacatcagcatggctggtttctacccacgaaggccctgttcctgtgatgtagtaagtcagggggcatcccacatcccctgccatgggtcagtcccctcagcgcggtggaggggaagctctagggctg

SEQ ID NO: 278576 - DNA, 1510 bp, Homo sapiens
  misc_feature (40)..(40): n is a, c, g, or t
aaaggctaggtaggaggctggggtgaattcggccgagggncggtccttctcaacaggcctgtgccccgcggggtcgcctcctctgggacgccttcctcccggcacagaaggcctccccctctcaccaggccctcgcccgctggtccgccaggccccgccttttttgcggcccccattgtgctgctggacccgacgagcagtgttgacagtgaaccccacgtagacgcggccccggtaccgggggttcaggcagtagagcaggtagacgccgaaaaagcgccctggcctcgccgcgacccccgcgggacccatcgggccttggggttcgggaaccacagcagggggttgattgccgtgacctagggtccagggagggctggatcgctagggctgcagggtgcttgcttcggaacaagctctcggggactatccggaggcagcctgcaggaagccgtagcgccggtacgtgcccctctcctgtctggaggcgggtgtagaagtccgaccgcggaagccagactgctgtccagtcggcgagcgcgtaccattcagcatcggctccgcccgagtcccaccttcctcaggctctgattggctgacacatggcaagcgcgaaaagcctggaccgctggaaagcccggctgcttgagggcggaagtactgcgttgacgtacgccttagtaagggcggaagtgagttttccagcggaagtggctcctgtaaggcagcaaggtagcgtggccggcgcccgagctggggttgtgtccctgctgggctgccgttccagctggactgccgccatggaactcagcgccgaatacctccgcgagaagctgcagcgggacctggaggcggagcatgtgcttccgagtcctggtggtgtcggccaagttcgaggggaaaccgctgcttcagagacacaggctggagtgcaatggcacgatctcggctcaccacaacctccgcctcctgggttcaagcgattctcttgtctcagcctcccaagtagctgggattacaggtatgtgctaccacgcccggctaatcttgtatttttaatagagacagggtttctccatgttgttcaggctggtcttgaactcccgacctcaggtgatccacccgcctcggcctccaaaagtgctgggattacaggcgtgtgccacttatgcccagctttcttttttgttttcttcccacacctctactgcccaagtagttttctatggcatactgaagaggtggggcctggaaatgacgccatgggtggtccctgcttgatatgaaccaaaccttactatggctaagacgcccatcccaaacagccctgtgtcctcccatctcaggatcacctgctaagttgggtatcaaaacctattcccacacccactccccacaaggcctgacagacctgttcctgccaggtctctcacagaggtcaggcccaggcagaacccacaggaagggctagagaggcagaagcactcactacacgggggaaggctctgaa

SEQ ID NO: 278577 - DNA, 896 bp, Homo sapiens
gggaagcttctctattaccctccttaccaccacagctccagccaagcttggagtgatctgcaaacccaatatgtgagtttagtgtatagaaaacacatgaatgaaaggcaaaaggggccaacattggtatttgggtttttttttttttgagctgtcactaggctcctgaccttccctctgaactccaccctgcagggcaggccaacagacaagctttctttctttctttttcttttttttatatgagatggagactcgctctctcgcccaggctgcaatgcagtagcacgatctccgctcactgtaacctccccctcctgggttcaagcgattcttctgcctcagcctcccgagtagctgggattacaggtgcacaccaccacatccggttaatttttgtatttttaagagacggtatctcgccgtgttgctcaggcaggtctcaaactcctgggctcaaatgatcctgccgcctcagcctcccacagtgctgggattatagacgtgagtccccatgcccagcctccctcgttatttttatctttggacctgcagtttaaaagatgcctaccctgtaagtgatggttggttcatttcctcacaagcaacagtgccagcagagtcacgtgcaacgtgatgttttggttgactaggaaaggcagatttttggtaaatttgggaattattgaggttctaagctagggccttaaatagttcagctgtgtcagctctgagaaggagctcggaaacggagagcagcctcctggcccacatcagcatggctggtttctacccacgaaggccctgttcctgtgatgtagtaagtcagggggcatcccacatcccctgccatgggtcagtcccctcagcgcggtggaggggaagctctagggctg

SEQ ID NO: 278578 - DNA, 1063 bp, Homo sapiens
  misc_feature (40)..(40): n is a, c, g, or t
aaaggctaggtaggaggctggggtgaattcggccgagggncggtccttctcaacaggcctgtgccccgcggggtcgcctcctctgggacgccttcctcccggcacagaaggcctccccctctcaccaggccctcgcccgctggtccgccaggccccgccttttttgcggcccccattgtgctgctggacccgacgagcagtgttgacagtgaaccccacgtagacgcggccccggtaccgggggttcaggcagtagagcaggtagacgccgaaaaagcgccctggcctcgccgcgacccccgcgggacccatcgggccttggggttcgggaaccacagcagggggttgattgccgtgacctagggtccagggagggctggatcgctagggctgcagggtgcttgcttcggaacaagctctcggggactatccggaggcagcctgcaggaagccgtagcgccggtacgtgcccctctcctgtctggaggcgggtgtagaagtccgaccgcggaagccagactgctgtccagtcggcgagcgcgtaccattcagcatcggctccgcccgagtcccaccttcctcaggctctgattggctgacacatggcaagcgcgaaaagcctggaccgctggaaagcccggctgcttgagggcggaagtactgcgttgacgtacgccttagtaagggcggaagtgagttttccagcggaagtggctcctgtaaggcagcaaggtagcgtggccggcgcccgagctggggttgtgtccctgctgggctgccgttccagctggactgccgccatggaactcagcgccgaatacctccgcgagaagctgcagcgggacctggaggcggagcatgtgcttccgagtcctggtggtgtcggccaagttcgaggggaaaccgctgcttcagagacacaggctggtgaacgcgtgcctagcagaagagctcccgcacatccatgcctttgaacagaaaaccctgaccccagaccagtgggcacgtgagcgacagaaatgagggactgggatctgcacagccattaaattataaatctgga

SEQ ID NO: 278579 - DNA, 1087 bp, Homo sapiens
  misc_feature (40)..(40): n is a, c, g, or t
aaaggctaggtaggaggctggggtgaattcggccgagggncggtccttctcaacaggcctgtgccccgcggggtcgcctcctctgggacgccttcctcccggcacagaaggcctccccctctcaccaggccctcgcccgctggtccgccaggccccgccttttttgcggcccccattgtgctgctggacccgacgagcagtgttgacagtgaaccccacgtagacgcggccccggtaccgggggttcaggcagtagagcaggtagacgccgaaaaagcgccctggcctcgccgcgacccccgcgggacccatcgggccttggggttcgggaaccacagcagggggttgattgccgtgacctagggtccagggagggctggatcgctagggctgcagggtgcttgcttcggaacaagctctcggggactatccggaggcagcctgcaggaagccgtagcgccggtacgtgcccctctcctgtctggaggcgggtgtagaagtccgaccgcggaagccagactgctgtccagtcggcgagcgcgtaccattcagcatcggctccgcccgagtcccaccttcctcaggctctgattggctgacacatggcaagcgcgaaaagcctggaccgctggaaagcccggctgcttgagggcggaagtactgcgttgacgtacgccttagtaagggcggaagtgagttttccagcggaagtggctcctgtaaggcagcaaggtagcgtggccggcgcccgagctggggttgtgtccctgctgggctgccgttccagctggactgccgccatggaactcagcgccgaatacctccgcgagaagctgcagcgggacctggaggcggagcatgtgcttccgagtcctggtggtgtcggccaagttcgaggggaaaccgctgcttcagagacacaggctggtgaacgcgtgcctagcagaagagctcccgcacatccatgcctttgaacagaaaaccctgaccccagaccagtgggcacgtgagcgacagaaatgagggactgggatctgcacagccattaaattataaatctggaaaaaaaaaatatataaacccggcc

SEQ ID NO: 278580 - DNA, 1906 bp, Homo sapiens
  misc_feature (40)..(40): n is a, c, g, or t
  misc_feature (1608)..(1608): n is a, c, g, or t
aaaggctaggtaggaggctggggtgaattcggccgagggncggtccttctcaacaggcctgtgccccgcggggtcgcctcctctgggacgccttcctcccggcacagaaggcctccccctctcaccaggccctcgcccgctggtccgccaggccccgccttttttgcggcccccattgtgctgctggacccgacgagcagtgttgacagtgaaccccacgtagacgcggccccggtaccgggggttcaggcagtagagcaggtagacgccgaaaaagcgccctggcctcgccgcgacccccgcgggacccatcgggccttggggttcgggaaccacagcagggggttgattgccgtgacctagggtccagggagggctggatcgctagggctgcagggtgcttgcttcggaacaagctctcggggactatccggaggcagcctgcaggaagccgtagcgccggtacgtgcccctctcctgtctggaggcgggtgtagaagtccgaccgcggaagccagactgctgtccagtcggcgagcgcgtaccattcagcatcggctccgcccgagtcccaccttcctcaggctctgattggctgacacatggcaagcgcgaaaagcctggaccgctggaaagcccggctgcttgagggcggaagtactgcgttgacgtacgccttagtaagggcggaagtgagttttccagcggaagtggctcctgtaaggcagcaaggtagcgtggccggcgcccgagctggggttgtgtccctgctgggctgccgttccagctggactgccgccatggaactcagcgccgaatacctccgcgagaagctgcagcgggacctggaggcggagcatgtgtgagttgagccgccggacaaggggaaaagagctcggggggcgggttcggcaccattcatattcttccgctcggtaggaggtggaggacacgaccctcaaccgttgctcctgtagcttccgagtcctggtggtgtcggccaagttcgaggggaaaccgctgcttcagagacacagcttggatcctagcatgactatacattgtgacatggtcattacatatggattagaccaactggagaattgccagacttgtggtaccgattatatcatctcagtcttgaatttactcacgctgattgttgaacagataaatacgaaactgccatcatcatttgtagaaaaactgtttataccatcatctaaactactattcttgcgttatcataaagaaaaagaggttgttgctgtagcccatgctgtttatcaagcaatgctcagcttgaagaatattcctgttttggagactgcctataagttaatattgggagaaatgacttgtgccctaaacaacctcctgcacagtctgcaacttcctgaggcctgttctgaaataaaacatgaggcttttaagaatcatgtgttcaatgtagacaatgcaaaatttgtagttaaatttgacctcagtgccctgactacaattggaaatgccaaaaactcactaataggggtgagtctttaattgtaatgactttgttttatccacagttaagccttttctcattacatatttatgtatttcactgtnatgtcaacatgtctgcagaatcactgtatgtaacaaacagccatatttaagacatgcctggataaataaaattggtaggaatgttttcttgccattatatttaacttttcttctttttccttgacaaatcttgataagtttttttatattagttttattttctagaaaatgtcttatgaatttctcctatttgctctagcatgcttacagaaaatgtcagtgtttcttacagctcaaatttgtatagttgttttaaaatgcggtctctttcttcttcccctggtacttttttctttct

SEQ ID NO: 278581 - DNA, 969 bp, Homo sapiens
ccccagcagccgccccagccgcagccgcagccgcccggctcgtctgccaccaccccgggcggcggcagcggcggctcgctcagcgccatgccgccgcccagccccgactcagagaacggcttctaccccgggctgccgtcgtccatgaacccggccttcttccctagcttctcgcccgtgtcgccgcacggctgcactgggctcagcgttccgacgagcggcggcggcggcggcggcttcggcggccccttctcggctaccgctgtgccccctccgccgccgcccgccatgaatatacctcaacagcagcccccgccgcccgcggcgccgcagcagccgcagagccggaggtcgcccgtcagcccgcagctccagcagcagcaccaggcggcggccgccgccttcctgcagcagaggaactcctataaccaccaccagcctcttctgaaacagtctccctggagcaaccatcagagcagtggctggggcactggaagtatgtcctggggagcaatgcatggcagagatcatcgtagaaccggaaacatgggaatcccaggaactatgaatcagatatctccattgaagaaaccgttttctggtaatgtcatagcaccaccgaaatttactcgctcaactccatcactgactccaaaatcttggattgaagataatgtgttcagaacagacaacaatagtaatacactcttacccttacaggatcgaagtagaatgtatgacagtttgaatatgcactctttggaaaattcccttatcgatattatgagagcagagcatgatcctcttaagggtaggtgactttttaaaaaaatatatgtttatattatacaccaatttgcttatcttactagtttttatatgaaagtgaaacctaagtagcacctatatccaatataaaactctcttacacatttattaatgagaatctttgtttttatgaaatgccat

SEQ ID NO: 278582 - DNA, 258 bp, Homo sapiens
aaaataatattagggcttttttgcatctaatttaaatttatcttcactaattcaccgattattttttctaaatgtggcctaatacgttgattagactttttttttctttcagtatttttattattttcttgaagttcccttatggctattgcaagtgaggtttttgttttgttttgtttttttcttaaacctttagaggatggaatgaggatttaagatagagctttattttttgttttctttctttctttcgttggg

SEQ ID NO: 278583 - DNA, 2109 bp, Homo sapiens
ccccagcagccgccccagccgcagccgcagccgcccggctcgtctgccaccaccccgggcggcggcagcggcggctcgctcagcgccatgccgccgcccagccccgactcagagaacggcttctaccccgggctgccgtcgtccatgaacccggccttcttccctagcttctcgcccgtgtcgccgcacggctgcactgggctcagcgttccgacgagcggcggcggcggcggcggcttcggcggccccttctcggctaccgctgtgccccctccgccgccgcccgccatgaatatacctcaacagcagcccccgccgcccgcggcgccgcagcagccgcagagccggaggtcgcccgtcagcccgcagctccagcagcagcaccaggcggcggccgccgccttcctgcagcagaggaactcctataaccaccaccagcctcttctgaaacagtctccctggagcaaccatcagagcagtggctggggcactggaagtatgtcctggggagcaatgcatggcagagatcatcgtagaaccggaaacatgggaatcccaggaactatgaatcagatatctccattgaagaaaccgttttctggtaatgtcatagcaccaccgaaatttactcgctcaactccatcactgactccaaaatcttggattgaagataatgtgttcagaacagacaacaatagtaatacactcttacccttacaggtgagatctagtttgcagttgccagcttggggctcagattcactccaagatagttggtgcactgcagccggaacatccagaatagaccaggatcgaagtagaatgtatgacagtttgaatatgcactctttggaaaattcccttatcgatattatgagagcagagcatgatcctcttaagggtcgattgagctatccacatccaggaactgacaatctgttgatgttaaatggtcgttcttccctctttccaatagatgatggcttgcttgatgatggtcacagtgatcaagttggagttttaaattcacccacctgttattcagctcaccaaaatggagagcgaatagaacgcttctctcgaaaagtttttgttggtggtcttcctccagatattgatgaagatgaaataactgctagcttcagaagatttgggcctttggtagtagattggcctcataaagcagaaagcaagtcctattttccaccaaaaggctatgcatttcttctctttcaagaagagagctcagttcaggcactcattgatgcttgtattgaagaagatggaaaactctatctgtgtgtttctagccctactatcaaggacaaaccagttcaaatacgtccttggaatttaagtgatagtgattttgtaatggatggttctcagcctttggatccccgaaaaacaatttttgttggaggtgttcctaggccattaagggctgtggaacttgctatgatcatggaccggctgtatggtggagtttgttatgcaggaattgatacagatcctgagctaaaatacccaaaaggtgctgggcgagttgctttctccaatcagcagagctatattgctgccattagtgctcggtttgttcagcttcagcatggtgatattgataaacgtgtggaggtaaagccatatgtgctagatgaccagatgtgtgatgaatgccagggcgcacgctgtggtggaaaatttgctccctttttttgtgccaatgtcacttgcctgcagtattactgtgagttttgttgggcaaatatccactctcgtgctggacgtgagttccataagccattggtaaaggaaggtgctgatcgcccacgtcagatccacttccgctggaactaagaatagcaaactggcctctgtttaacaaggaaagaaagggtgcatgtggcttactgtgtctgaagatactgacatgcagaagaaataagtgcattcttctgcttttcaccccagctatcaatacatgcatctttatcagcagccaaaacactacaagcctcttgtttttcaccaaaaccctacatctcaggcttactaatttttgtgatattttcatgttcaaataaaatgtttttttgtattttcaaaaag

SEQ ID NO: 278584 - DNA, 2019 bp, Homo sapiens
ccccagcagccgccccagccgcagccgcagccgcccggctcgtctgccaccaccccgggcggcggcagcggcggctcgctcagcgccatgccgccgcccagccccgactcagagaacggcttctaccccgggctgccgtcgtccatgaacccggccttcttccctagcttctcgcccgtgtcgccgcacggctgcactgggctcagcgttccgacgagcggcggcggcggcggcggcttcggcggccccttctcggctaccgctgtgccccctccgccgccgcccgccatgaatatacctcaacagcagcccccgccgcccgcggcgccgcagcagccgcagagccggaggtcgcccgtcagcccgcagctccagcagcagcaccaggcggcggccgccgccttcctgcagcagaggaactcctataaccaccaccagcctcttctgaaacagtctccctggagcaaccatcagagcagtggctggggcactggaagtatgtcctggggagcaatgcatggcagagatcatcgtagaaccggaaacatgggaatcccaggaactatgaatcagatatctccattgaagaaaccgttttctggtaatgtcatagcaccaccgaaatttactcgctcaactccatcactgactccaaaatcttggattgaagataatgtgttcagaacagacaacaatagtaatacactcttacccttacaggatcgaagtagaatgtatgacagtttgaatatgcactctttggaaaattcccttatcgatattatgagagcagagcatgatcctcttaagggtcgattgagctatccacatccaggaactgacaatctgttgatgttaaatggtcgttcttccctctttccaatagatgatggcttgcttgatgatggtcacagtgatcaagttggagttttaaattcacccacctgttattcagctcaccaaaatggagagcgaatagaacgcttctctcgaaaagtttttgttggtggtcttcctccagatattgatgaagatgaaataactgctagcttcagaagatttgggcctttggtagtagattggcctcataaagcagaaagcaagtcctattttccaccaaaaggctatgcatttcttctctttcaagaagagagctcagttcaggcactcattgatgcttgtattgaagaagatggaaaactctatctgtgtgtttctagccctactatcaaggacaaaccagttcaaatacgtccttggaatttaagtgatagtgattttgtaatggatggttctcagcctttggatccccgaaaaacaatttttgttggaggtgttcctaggccattaagggctgtggaacttgctatgatcatggaccggctgtatggtggagtttgttatgcaggaattgatacagatcctgagctaaaatacccaaaaggtgctgggcgagttgctttctccaatcagcagagctatattgctgccattagtgctcggtttgttcagcttcagcatggtgatattgataaacgtgtggaggtaaagccatatgtgctagatgaccagatgtgtgatgaatgccagggcgcacgctgtggtggaaaatttgctccctttttttgtgccaatgtcacttgcctgcagtattactgtgagttttgttgggcaaatatccactctcgtgctggacgtgagttccataagccattggtaaaggaaggtgctgatcgcccacgtcagatccacttccgctggaactaagaatagcaaactggcctctgtttaacaaggaaagaaagggtgcatgtggcttactgtgtctgaagatactgacatgcagaagaaataagtgcattcttctgcttttcaccccagctatcaatacatgcatctttatcagcagccaaaacactacaagcctcttgtttttcaccaaaaccctacatctcaggcttactaatttttgtgatattttcatgttcaaataaaatgtttttttgtattttcaaaaag

SEQ ID NO: 278585 - DNA, 422 bp, Homo sapiens
ctttctttcgttgggtgggtatggggaagacaactgctcatttctgatgaaaacttctatgctattgaaggtgagatctagtttgcagttgccagcttggggctcagattcactccaagatagttggtgcactgcagccggaacatccagaatagaccaggtaggctgcacagtgtatactttttaggatttcggttaggagtttagtatttatattatgagtaggatttattatttactttcttattatacctattgaaacatatgttagaggacactgaagcaatttattttttaaggatcacctgctttgaactatttaatgtaagaaattttttattttcaaatttaagagtaatccttttataattctaaaacataataaactttttttggaaaaaggaattatatacacaagagca

SEQ ID NO: 278586 - DNA, 507 bp, Homo sapiens
agactcctctgcgggagaggagaatagctgtactctaagcagttcgcagggagcatctttcagcagctgaaacagctttgcggccttgctgtaatgaagatctgccagcacccggtgttgtttcctaaggtgttcatcaccaacctagaaccaaaccaaaacaagcaacaaatccttcacgagaaagaaagaaaacaactgtgtaagcagacatcagtgtaaaccttagcactgtctcttgatgagataagaggaggatggcagtgacaggagtgtggtggcgagccagtcacctgcagtcaaccacggctcattgctctcaccatgcctgttacatgaaggtatgtatgtataggaaaaagcactgaaaaactctccagtttcaggcatccactggggatcttggaacgcatcctccaaggataagtggggtctactgtacaacacttaagtataaccctcttcactattaaccaaatgatattaaaataagcaaagaaaaacaac

SEQ ID NO: 278587 - DNA, 468 bp, Homo sapiens
agactcctctgcgggagaggagaatagctgtactctaagcagttcgcagggagcatctttcagcagctgaaacagctttgcggccttgctgtaatgaagatctgccagcacccggtgttgtttcctaaggtgttcatcaccaacctagaaccaaaccaaaacaagcaacaaatccttcacgagaaagaaagaaaacaactgtgtaagcagacatcagtgtaaaccttagcactgtctcttgatgagataagaggaggatggcagtgacaggagtgtggtggcgagccagtcacctgcagtcaaccacggctcattgctctcaccatgcctgttacatgaagtttcaggcatccactggggatcttggaacgcatcctccaaggataagtggggtctactgtacaacacttaagtataaccctcttcactattaaccaaatgatattaaaataagcaaagaaaaacaac

SEQ ID NO: 278588 - DNA, 322 bp, Homo sapiens
aacctggcaccttatacggtcaccgcttgtgggattgaagcgatcgctttagcaaatctaagagtggccgcacaaaagcttattgcctgccagagagcttaaggtgccacacaaggaaagccacagtcaactgtgactcagtttccactgagaaaattctcctctgctttgaagtctgtcccctccccataacttaatcccttagcagaaactgcatgtctgttgcctccctcccgcacctttctgcacaccggcttcactccccggagagcacggctaccgacaaatcgcttccccttctgggttttggttgcttaggcgc

SEQ ID NO: 278589 - DNA, 787 bp, Homo sapiens
tcagaatgtcatcgacaagtttcaaaaatatctcgtccacattgaagttatccttggcacttgcttcacagaaccgcatcccagtgatctgctgtgcaaactgagaagaaacacacacctatttcctctgtgtggggcctcacagaccagcgtgcgagcatgagaatgaatttaaaggagcacgaagtcaaaaaagtgcaaacaaattaggaggatgtgactgagttatcactgtattgataatttctttgtaatttttaaaataagtaatttattaaaagaaacagtacctcaagcgctaagcacagtgtgtggcaaccgtgcctcccacgccctctcaccttttccccctgctgcctggtgatttctctgtccgtttcacagtccaacttatttccaactaagagaagctctgcatcttctgaagcatactgtggaattttaaaagaagccacatttcaaagatgggcatcgccatatactgacagcagaaatataaaccgatacagtatttttcgctaatttacatttgtccattcacttccactgtctttgaggttctaccagttcccaggcaggactgggcagcagtgcaaggcagggctcactgtgtcttagaaagaactagggcacaggcattaagaaccacaatgctcttggctgttgacccaacaattcccaagacctcttcctaaggaaatgattcaacatacaggcaaagctctacactcaaaatggttatcaactgaaaaacctacaagtcaaacaaaatggctcaagaatcaag

SEQ ID NO: 278590 - DNA, 631 bp, Homo sapiens
  misc_feature (48)..(48): n is a, c, g, or t
ggggctctagtgtatattcatggcccgttggctttacatttgcattantgatgatggtgcagtcagcctcagtttccaaagccggaaaaggatcctctagtagccacggtgtggcagctgctctgaaccaggacctggacccggacccaaagtgccatgtctttaatgttagctcccagcgatgccagatgggatcagcacagccctgcctctgctgctaattgttcctctaaagtaatcgccatgcgttctttgggcttcatctttaaaggaatgaagcaactgagattattctggaaaaccttttggcagttagtgaaattagagtacaactaagaacattttcagacctccactgtggatgacctgggtataatctcacaaatcgatgggactgcaaggattgtaaactgaaatgaacatgattatactctgttggaagagcctaagaggaaactgatgccatgagtttcagagagtaatgcttaaccccagttacacaggatgccgtcttgtgtttcctcttgtttagttacccactacagtgattttgtgatctgctaatgggttgccacccacaaccattgctttagcacttttacttcaaatcaatgaaggattgataaaagtt

SEQ ID NO: 278591 - DNA, 1014 bp, Homo sapiens
  misc_feature (48)..(48): n is a, c, g, or t
  misc_feature (785)..(785): n is a, c, g, or t
  misc_feature (787)..(787): n is a, c, g, or t
  misc_feature (793)..(793): n is a, c, g, or t
  misc_feature (797)..(797): n is a, c, g, or t
  misc_feature (808)..(809): n is a, c, g, or t
  misc_feature (812)..(812): n is a, c, g, or t
  misc_feature (814)..(814): n is a, c, g, or t
  misc_feature (818)..(820): n is a, c, g, or t
  misc_feature (856)..(856): n is a, c, g, or t
  misc_feature (858)..(858): n is a, c, g, or t
  misc_feature (861)..(861): n is a, c, g, or t
  misc_feature (878)..(879): n is a, c, g, or t
  misc_feature (884)..(884): n is a, c, g, or t
  misc_feature (899)..(899): n is a, c, g, or t
  misc_feature (904)..(904): n is a, c, g, or t
  misc_feature (906)..(906): n is a, c, g, or t
  misc_feature (916)..(916): n is a, c, g, or t
  misc_feature (922)..(923): n is a, c, g, or t
  misc_feature (933)..(934): n is a, c, g, or t
  misc_feature (940)..(940): n is a, c, g, or t
  misc_feature (942)..(942): n is a, c, g, or t
  misc_feature (946)..(946): n is a, c, g, or t
  misc_feature (952)..(952): n is a, c, g, or t
  misc_feature (959)..(959): n is a, c, g, or t
ggggctctagtgtatattcatggcccgttggctttacatttgcattantgatgatggtgcagtcagcctcagtttccaaagccggaaaaggatcctctagtagccacggtgtggcagctgctctgaaccaggacctggacccggacccaaagtgccatgtctttaatgttagctcccagcgatgccagatgggatcagcacagccctgcctctgctgctaattgttcctctaaagtaatcgccatgcgttctttgggcttcatctttaaaggaatgaagcaactgagattattctggaaaaccttttggcagttagtgaaattagagtacaactaagaacattttcagacctccactgtggatgacctgggtataatctcacaaatcgatgggactgcaaggattgtaaactgaaatgaacatgattatactctgttggaagagcctaagaggaaactgatgccatgagtttcagagagtaatgcttaaccccagttacacaggatgccgtcttgtgtttcctcttgtttagttacccactacagtgattttgtgatctgctaatgggttgccacccacaaccattgctttagcacttttacttcaaatcaatgaaggattgataaaagttctcctggtgtctccgcagagtgccttccaggaacagatctttgcatagaatatcagtggtttccttttttgtttcaaatagtggtcagaaaatacccagtgttgactcaccaaggcaatcagcttcctttttccctttttttgtttttttttgntntttttncaanttttatatctnngcntnattnnnttatttattttttgagacggagttccactctgtcgncnagntggagtgaatggtcaanntgggntcactggaacctcanctccngntcaagcaatntccggnncagccctganngggganangggngacctntaaaaangggttaccctttgcagaaggctaatcgaacggaagacgctcatccacggggatag

SEQ ID NO: 278592 - DNA, 427 bp, Homo sapiens
cccccccccccccccttcctttataaaaaagtaatcgccatgcgttctttgggcttcatctttaaaggaatgaagcaactgagattattctggaaaaccttttggcagttagtgaaattagagtacaactaagaacattttcagacctccactgtggatgacctgggtataatctcacaaatcgatgggactgcaaggattgtaaactgaaatgaacatgattatactctgttggaagagcctaagaggaaactgatgccatgagtttcagagagtaatgcttaaccccagttacacaggatgccgtcttgtgtttcctcttgtttagttacccactacagtgattttgtgatctgctaatgggttgccacccacaaccattgctttagcacttttacttcaaatcaatgaaggattgataaaagtt

SEQ ID NO: 278593 - DNA, 811 bp, Homo sapiens
gagtaatgctgctatgaaatgcatagtgcacgtagctgagtccctgctttcagttctttgggcatatactcaggagtggaatgctggatcctatcgtaattctgtttacttttttgaggaaccaccatgctgttgccgcagtatatgcaccattttacattcccaccagcaacacacaaaggttctgatatttccacatcctcaccaacacttgatttctttgttcttttttgttttagtagagacagggtttcaaccatgttgcccaggttggtctcaaactcctgagctcaggcaatccacccgccttggcctcccaaagtgctaggattacaggtgtgagccaccacacccagctattttttctttcgttttttaattttaaagttggggggggtctcaatttgttaccctggctggtctcgaactcccggacttaagcgatcctctggctccaagcccactaccagtctcaggtttctttactaaaagatcactacctttttttctcttatctgctgccatgtgagatgtggctttcaccttccgccatgattgtgaggccttcccagccacgtggaactgtaagtccaagtagagccctctttggtaggattacctagaccctatacacggattaacatagtcaaggattcatagacaaaaagatataaatatgcctagcatagctcagggagggattgacgggcagaaccaagggacgagaggatcacaacaacggtgggcaacccaaaacaacgcggggaggcacgagtcgaagcagagagaaacacaacgcgatgaagagata

SEQ ID NO: 278594 - DNA, 2803 bp, Homo sapiens
  misc_feature (231)..(231): n is a, c, g, or t
  misc_feature (234)..(234): n is a, c, g, or t
  misc_feature (250)..(250): n is a, c, g, or t
ggcgcctgaggctgccgggtagcccagcaggccgagggaggaagtagcgtggagccggtgccgagccggggcgaagctggatcccctagatatactgtcttcaagctcactgatattttcctctgcttgatccattgtgctgttgagagcctctagtaaatttttcagactgacagaccaaggatgcagctgctactaccggaggtgtgtggcaccttacctcagcaaggnatnaaccgagtggccatgntacggccggaggtcggccgcgtggctggaagacatggccactccagtcggtgttgagcacggcgagcagtctcaggcctttagtgatgatgattaaaggtggtggctgtggccttgaaaacagtcatgtgaaaactcatcaccttaaggtgttaagtgtaaggatcttcatgatgaaatttctgtaaatggtgcagtcagcctcagtttccaaagccggaaaaggatcctctagtagccacggtgtggcagctgctctgaaccaggacctggacccggacccaaagtgccatgtctttaatgttagctcccagcgatgccagatgggatcagcacagccctgcctctgctgctaattgttcctctaaagtaatcgccatgcgttctttgggcttcatctttaaaggaatgaagcaactgagattattctggaaaaccttttggcagttagtgaaattagagtacaactaagaacattttcagacctccactgtggatgacctgggtataatctcacaaatcgatgggactgcaaggattgtaaactgaaatgaacatgattatactctgttggaagagcctaagaggaaactgatgccatgagtttcagagagtaatgcttaaccccagttacacaggatgccgtcttgtgtttcctcttgtttagttacccactacagtgattttgtgatctgctaatgggttgccacccacaaccattgctttagcacttttacttcaaatcaatgaaggattgataaaagttctcctggtgtctccgcagagtgccttccaggaacagatctttgcatagaatatcagtggtttccttttttgtttcaaatagtggtcagaaaatacccagtgttgactcaccaaggcaatcagcttcctttttccctttttttgttttttttttaacattttatattttggctttattttattttattttattttataacattttatatttttgctttattttattttattttattttttgagacggagttccactctgtcgccaggctggagtgaagtggtacaatcttggctcactgcaacctccacctcccgggttcaagcaattctcctggctcagcctcctgagtgctgggactacaggcgcgtaccttctttagtagagactgggtttcaccatgttggccaggatggtctctatctcctgaccttgtgatctgcctgcctcagcttcccaaagtgctgagatgacaggtgtgagccatcagacccagcatttttttttttaatttaaatttaaattttttttcatttttttgagaggttttttttgtttgtttggttgttgttgttgttgttgttgttgttgtttttgagacagtcttgctctgtcacccaggctgggagtgcagtggcatgatctctgcaacctctacctcccaggttcaagcaattcttgtgcctcagcctcccaagtaactgggactacaggtgcacgctaccacacctggctgatttttttttgttttagtagagacagggtttcaaccatgttgcccaggttggtctcaaactcctgagctcaggcaatccacccgccttggcctcccaaagtgctaggattacaggtgtgagccaccacacccagctattttttctttcgttttttaattttaaagttggggggggtctcaatttgttaccctggctggtctcgaactcccggacttaagcgatcctctggctccaagcccactaccagtctcaggtttctttactaaaagatcactacctttttttctcttatctgctgccatgtgagatgtggctttcaccttccgccatgattgtgaggccttcccagccacgtggaactgtaagtccaataaacctcttttgtaaattaaaaaaaaatcactatttaagatactaggatggattgtgactgttgaggagtacttacatatcctacatttgactacattatttccaaaccaagtattccatccaaaggaacatactgctatcatagagaccaaggagggactgtttaaggttgccaaggtgaagcgagctgagaggctttgtcctcgtgccagtaactctgaaatctctcttaattcctgctgtccaggcagcagaatgccatggtttccccaagtaggtagctgctttagcagttaaagcccaaatgtctgttctgttgatcagaggtctctgaatttctgaagtggtgtttcgtttctggtgactgagttaatcctttacaatccctcttgtaaagtgtgctaatagaaagaatccacctttcaaagctgcagaaccagaccgtgccctaaattgaccaacgtagctgatgtgcctcaggaagtctcttgccagctgtccctgtgaagaccccctcctcccccccagctgctgccttgcacactgaagcatctcagactgtgcaaagccgtgtagtcatcaagacagtaaatcccagggcttggttaagtgctgtgtgataacttgtttggatgagacttaacttaaaaccacttacaataaacttgggaaactaccgtca

SEQ ID NO: 278595 - DNA, 2782 bp, Homo sapiens
  misc_feature (231)..(231): n is a, c, g, or t
  misc_feature (234)..(234): n is a, c, g, or t
  misc_feature (250)..(250): n is a, c, g, or t
  misc_feature (1565)..(1565): n is a, c, g, or t
  misc_feature (1574)..(1574): n is a, c, g, or t
  misc_feature (1587)..(1587): n is a, c, g, or t
ggcgcctgaggctgccgggtagcccagcaggccgagggaggaagtagcgtggagccggtgccgagccggggcgaagctggatcccctagatatactgtcttcaagctcactgatattttcctctgcttgatccattgtgctgttgagagcctctagtaaatttttcagactgacagaccaaggatgcagctgctactaccggaggtgtgtggcaccttacctcagcaaggnatnaaccgagtggccatgntacggccggaggtcggccgcgtggctggaagacatggccactccagtcggtgttgagcacggcgagcagtctcaggcctttagtgatgatgattaaaggtggtggctgtggccttgaaaacagtcatgtgaaaactcatcaccttaaggtgttaagtgtaaggatcttcatgatgaaatttctgtaaatggtgcagtcagcctcagtttccaaagccggaaaaggatcctctagtagccacggtgtggcagctgctctgaaccaggacctggacccggacccaaagtgccatgtctttaatgttagctcccagcgatgccagatgggatcagcacagccctgcctctgctgctaattgttcctctaaagtaatcgccatgcgttctttgggcttcatctttaaaggaatgaagcaactgagattattctggaaaaccttttggcagttagtgaaattagagtacaactaagaacattttcagacctccactgtggatgacctgggtataatctcacaaatcgatgggactgcaaggattgtaaactgaaatgaacatgattatactctgttggaagagcctaagaggaaactgatgccatgagtttcagagagtaatgcttaaccccagttacacaggatgccgtcttgtgtttcctcttgtttagttacccactacagtgattttgtgatctgctaatgggttgccacccacaaccattgctttagcacttttacttcaaatcaatgaaggattgataaaagttctcctggtgtctccgcagagtgccttccaggaacagatctttgcatagaatatcagtggtttccttttttgtttcaaatagtggtcagaaaatacccagtgttgactcaccaaggcaatcagcttcctttttccctttttttgttttttttttaacattttatattttggctttattttattttattttattttataacattttatatttttgctttattttattttattttattttttgagacggagttccactctgtcgccaggctggagtgaagtggtacaatcttggctcactgcaacctccacctcccgggttcaagcaattctcctggctcagcctcctgagtgctgggactacaggcgcgtaccttctttagtagagactgggtttcaccatgttggccaggatggtctctatctcctgaccttgtgatctgcctgcctcagcttcccaaagtgctgagatgacaggtgtgagccatcagacccagcatttttttttttaatttaaatttaaattttttttcatttttttgagaggtttggtnggttgtcgntgtgtcgtgtttngagacagtcttgctctgtcacccaggctgggagtgcagtggcatgatctctgcaacctctacctcccaggttcaagcaattcttgtgcctcagcctcccaagtaactgggactacaggtgcacgctaccacacctggctgatttttttttgttttagtagagacagggtttcaaccatgttgcccaggttggtctcaaactcctgagctcaggcaatccacccgccttggcctcccaaagtgctaggattacaggtgtgagccaccacacccagctattttttctttcgttttttaattttaaagttggggggggtctcaatttgttaccctggctggtctcgaactcccggacttaagcgatcctctggctccaagcccactaccagtctcaggtttctttactaaaagatcactacctttttttctcttatctgctgccatgtgagatgtggctttcaccttccgccatgattgtgaggccttcccagccacgtggaactgtaagtccaataaacctcttttgtaaattaaaaaaaaatcactatttaagatactaggatggattgtgactgttgaggagtacttacatatcctacatttgactacattatttccaaaccaagtattccatccaaaggaacatactgctatcatagagaccaaggagggactgtttaaggttgccaaggtgaagcgagctgagaggctttgtcctcgtgccagtaactctgaaatctctcttaattcctgctgtccaggcagcagaatgccatggtttccccaagtaggtagctgctttagcagttaaagcccaaatgtctgttctgttgatcagaggtctctgaatttctgaagtggtgtttcgtttctggtgactgagttaatcctttacaatccctcttgtaaagtgtgctaatagaaagaatccacctttcaaagctgcagaaccagaccgtgccctaaattgaccaacgtagctgatgtgcctcaggaagtctcttgccagctgtccctgtgaagaccccctcctcccccccagctgctgccttgcacactgaagcatctcagactgtgcaaagccgtgtagtcatcaagacagtaaatcccagggcttggttaagtgctgtgtgataacttgtttggatgagacttaacttaaaaccacttacaataaacttgggaaactaccgtca

SEQ ID NO: 278596 - DNA, 2704 bp, Homo sapiens
  misc_feature (231)..(231): n is a, c, g, or t
  misc_feature (234)..(234): n is a, c, g, or t
  misc_feature (250)..(250): n is a, c, g, or t
ggcgcctgaggctgccgggtagcccagcaggccgagggaggaagtagcgtggagccggtgccgagccggggcgaagctggatcccctagatatactgtcttcaagctcactgatattttcctctgcttgatccattgtgctgttgagagcctctagtaaatttttcagactgacagaccaaggatgcagctgctactaccggaggtgtgtggcaccttacctcagcaaggnatnaaccgagtggccatgntacggccggaggtcggccgcgtggctggaagacatggccactccagtcggtgttgagcacggcgagcagtctcaggcctttagtgatgatggtgcagtcagcctcagtttccaaagccggaaaaggatcctctagtagccacggtgtggcagctgctctgaaccaggacctggacccggacccaaagtgccatgtctttaatgttagctcccagcgatgccagatgggatcagcacagccctgcctctgctgctaattgttcctctaaagtaatcgccatgcgttctttgggcttcatctttaaaggaatgaagcaactgagattattctggaaaaccttttggcagttagtgaaattagagtacaactaagaacattttcagacctccactgtggatgacctgggtataatctcacaaatcgatgggactgcaaggattgtaaactgaaatgaacatgattatactctgttggaagagcctaagaggaaactgatgccatgagtttcagagagtaatgcttaaccccagttacacaggatgccgtcttgtgtttcctcttgtttagttacccactacagtgattttgtgatctgctaatgggttgccacccacaaccattgctttagcacttttacttcaaatcaatgaaggattgataaaagttctcctggtgtctccgcagagtgccttccaggaacagatctttgcatagaatatcagtggtttccttttttgtttcaaatagtggtcagaaaatacccagtgttgactcaccaaggcaatcagcttcctttttccctttttttgttttttttttaacattttatattttggctttattttattttattttattttataacattttatatttttgctttattttattttattttattttttgagacggagttccactctgtcgccaggctggagtgaagtggtacaatcttggctcactgcaacctccacctcccgggttcaagcaattctcctggctcagcctcctgagtgctgggactacaggcgcgtaccttctttagtagagactgggtttcaccatgttggccaggatggtctctatctcctgaccttgtgatctgcctgcctcagcttcccaaagtgctgagatgacaggtgtgagccatcagacccagcatttttttttttaatttaaatttaaattttttttcatttttttgagaggttttttttgtttgtttggttgttgttgttgttgttgttgttgttgtttttgagacagtcttgctctgtcacccaggctgggagtgcagtggcatgatctctgcaacctctacctcccaggttcaagcaattcttgtgcctcagcctcccaagtaactgggactacaggtgcacgctaccacacctggctgatttttttttgttttagtagagacagggtttcaaccatgttgcccaggttggtctcaaactcctgagctcaggcaatccacccgccttggcctcccaaagtgctaggattacaggtgtgagccaccacacccagctattttttctttcgttttttaattttaaagttggggggggtctcaatttgttaccctggctggtctcgaactcccggacttaagcgatcctctggctccaagcccactaccagtctcaggtttctttactaaaagatcactacctttttttctcttatctgctgccatgtgagatgtggctttcaccttccgccatgattgtgaggccttcccagccacgtggaactgtaagtccaataaacctcttttgtaaattaaaaaaaaatcactatttaagatactaggatggattgtgactgttgaggagtacttacatatcctacatttgactacattatttccaaaccaagtattccatccaaaggaacatactgctatcatagagaccaaggagggactgtttaaggttgccaaggtgaagcgagctgagaggctttgtcctcgtgccagtaactctgaaatctctcttaattcctgctgtccaggcagcagaatgccatggtttccccaagtaggtagctgctttagcagttaaagcccaaatgtctgttctgttgatcagaggtctctgaatttctgaagtggtgtttcgtttctggtgactgagttaatcctttacaatccctcttgtaaagtgtgctaatagaaagaatccacctttcaaagctgcagaaccagaccgtgccctaaattgaccaacgtagctgatgtgcctcaggaagtctcttgccagctgtccctgtgaagaccccctcctcccccccagctgctgccttgcacactgaagcatctcagactgtgcaaagccgtgtagtcatcaagacagtaaatcccagggcttggttaagtgctgtgtgataacttgtttggatgagacttaacttaaaaccacttacaataaacttgggaaactaccgtca

SEQ ID NO: 278597 - DNA, 2406 bp, Homo sapiens
  misc_feature (231)..(231): n is a, c, g, or t
  misc_feature (234)..(234): n is a, c, g, or t
  misc_feature (250)..(250): n is a, c, g, or t
ggcgcctgaggctgccgggtagcccagcaggccgagggaggaagtagcgtggagccggtgccgagccggggcgaagctggatcccctagatatactgtcttcaagctcactgatattttcctctgcttgatccattgtgctgttgagagcctctagtaaatttttcagactgacagaccaaggatgcagctgctactaccggaggtgtgtggcaccttacctcagcaaggnatnaaccgagtggccatgntacggccggaggtcggccgcgtggctggaagacatggccactccagtcggtgttgagcacggcgagcagtctcaggcctttagtgatgatgattaaaggtggtggctgtggccttgaaaacagtcatgtgaaaactcatcaccttaaggtgttaagtgtaaggatcttcatgatgaaatttctgtaaatggtgcagtcagcctcagtttccaaagccggaaaaggatcctctagtagccacggtgtggcagctgctctgaaccaggacctggacccggacccaaagtgccatgtctttaatgttagctcccagcgatgccagatgggatcagcacagccctgcctctgctgctaattgttcctctaaagtaatcgccatgcgttctttgggcttcatctttaaaggaatgaagcaactgagattattctggaaaaccttttggcagttagtgaaattagagtacaactaagaacattttcagacctccactgtggatgacctgggtataatctcacaaatcgatgggactgcaaggattgtaaactgaaatgaacatgattatactctgttggaagagcctaagaggaaactgatgccatgagtttcagagagtaatgcttaaccccagttacacaggatgccgtcttgtgtttcctcttgtttagttacccactacagtgattttgtgatctgctaatgggttgccacccacaaccattgctttagcacttttacttcaaatcaatgaaggattgataaaagttctcctggtgtctccgcagagtgccttccaggaacagatctttgcatagaatatcagtggtttccttttttgtttcaaatagtggtcagaaaatacccagtgttgactcaccaaggcaatcagcttcctttttccctttttttgttttttttttaacattttatattttggctttattttattttattttattttatgagacagtcttgctctgtcacccaggctgggagtgcagtggcatgatctctgcaacctctacctcccaggttcaagcaattcttgtgcctcagcctcccaagtaactgggactacaggtgcacgctaccacacctggctgatttttttttgttttagtagagacagggtttcaaccatgttgcccaggttggtctcaaactcctgagctcaggcaatccacccgccttggcctcccaaagtgctaggattacaggtgtgagccaccacacccagctattttttctttcgttttttaattttaaagttggggggggtctcaatttgttaccctggctggtctcgaactcccggacttaagcgatcctctggctccaagcccactaccagtctcaggtttctttactaaaagatcactacctttttttctcttatctgctgccatgtgagatgtggctttcaccttccgccatgattgtgaggccttcccagccacgtggaactgtaagtccaataaacctcttttgtaaattaaaaaaaaatcactatttaagatactaggatggattgtgactgttgaggagtacttacatatcctacatttgactacattatttccaaaccaagtattccatccaaaggaacatactgctatcatagagaccaaggagggactgtttaaggttgccaaggtgaagcgagctgagaggctttgtcctcgtgccagtaactctgaaatctctcttaattcctgctgtccaggcagcagaatgccatggtttccccaagtaggtagctgctttagcagttaaagcccaaatgtctgttctgttgatcagaggtctctgaatttctgaagtggtgtttcgtttctggtgactgagttaatcctttacaatccctcttgtaaagtgtgctaatagaaagaatccacctttcaaagctgcagaaccagaccgtgccctaaattgaccaacgtagctgatgtgcctcaggaagtctcttgccagctgtccctgtgaagaccccctcctcccccccagctgctgccttgcacactgaagcatctcagactgtgcaaagccgtgtagtcatcaagacagtaaatcccagggcttggttaagtgctgtgtgataacttgtttggatgagacttaacttaaaaccacttacaataaacttgggaaactaccgtca

SEQ ID NO: 278598 - DNA, 3041 bp, Homo sapiens
  misc_feature (231)..(231): n is a, c, g, or t
  misc_feature (234)..(234): n is a, c, g, or t
  misc_feature (250)..(250): n is a, c, g, or t
  misc_feature (2818)..(2819): n is a, c, g, or t
  misc_feature (2822)..(2822): n is a, c, g, or t
  misc_feature (2829)..(2829): n is a, c, g, or t
ggcgcctgaggctgccgggtagcccagcaggccgagggaggaagtagcgtggagccggtgccgagccggggcgaagctggatcccctagatatactgtcttcaagctcactgatattttcctctgcttgatccattgtgctgttgagagcctctagtaaatttttcagactgacagaccaaggatgcagctgctactaccggaggtgtgtggcaccttacctcagcaaggnatnaaccgagtggccatgntacggccggaggtcggccgcgtggctggaagacatggccactccagtcggtgttgagcacggcgagcagtctcaggcctttagtgatgatgattaaaggtggtggctgtggccttgaaaacagtcatgtgaaaactcatcaccttaaggtgttaagtgtaaggatcttcatgatgaaatttctgtaaatggtgcagtcagcctcagtttccaaagccggaaaaggatcctctagtagccacggtgtggcagctgctctgaaccaggacctggacccggacccaaagtgccatgtctttaatgttagctcccagcgatgccagatgggatcagcacagccctgcctctgctgctaattgttcctctaaagtaatcgccatgcgttctttgggcttcatctttaaaggaatgaagcaactgagattattctggaaaaccttttggcagttagtgaaattagagtacaactaagaacattttcagacctccactgtggatgacctgggtataatctcacaaatcgatgggactgcaaggattgtaaactgaaatgaacatgattatactctgttggaagagcctaagaggaaactgatgccatgagtttcagagagtaatgcttaaccccagttacacaggatgccgtcttgtgtttcctcttgtttagttacccactacagtgattttgtgatctgctaatgggttgccacccacaaccattgctttagcacttttacttcaaatcaatgaaggattgataaaagttctcctggtgtctccgcagagtgccttccaggaacagatctttgcatagaatatcagtggtttccttttttgtttcaaatagtggtcagaaaatacccagtgttgactcaccaaggcaatcagcttcctttttccctttttttgttttttttttaacattttatattttggctttattttattttattttattttataacattttatatttttgctttattttattttattttattttttgagacggagttccactctgtcgccaggctggagtgaagtggtacaatcttggctcactgcaacctccacctcccgggttcaagcaattctcctggctcagcctcctgagtgctgggactacaggcgcgtaccttctttagtagagactgggtttcaccatgttggccaggatggtctctatctcctgaccttgtgatctgcctgcctcagcttcccaaagtgctgagatgacaggtgtgagccatcagacccagcatttttttttttaatttaaatttaaattttttttcatttttttgagaggttttttttgtttgtttggttgttgttgttgttgttgttgttgttgtttttgagacagtcttgctctgtcacccaggctgggagtgcagtggcatgatctctgcaacctctacctcccaggttcaagcaattcttgtgcctcagcctcccaagtaactgggactacaggtgcacgctaccacacctggctgatttttttttgttttagtagagacagggtttcaaccatgttgcccaggttggtctcaaactcctgagctcaggcaatccacccgccttggcctcccaaagtgctaggattacaggtgtgagccaccacacccagctattttttctttcgttttttaattttaaagttggggggggtctcaatttgttaccctggctggtctcgaactcccggacttaagcgatcctctggctccaagcccactaccagtctcaggtttctttactaaaagatcactacctttttttctcttatctgctgccatgtgagatgtggctttcaccttccgccatgattgtgaggccttcccagccacgtggaactgtaagtccaataaacctcttttgtaaattaaaaaaaaatcactatttaagatactaggatggattgtgactgttgaggagtacttacatatcctacatttgactacattatttccaaaccaagtattccatccaaaggaacatactgctatcatagagaccaaggagggactgtttaaggttgccaaggtgaagcgagctgagaggctttgtcctcgtgccagtaactctgaaatctctcttaattcctgctgtccaggcagcagaatgccatggtttccccaagtaggtagctgctttagcagttaaagcccaaatgtctgttctgttgatcagaggtctctgaatttctgaagtggtgtttcgtttctggtgactgagttaatcctttacaatccctcttgtaaagtgtgctaatagaaagaatccacctttcaaagctgcagaaccagaccgtgccctaaattgaccaacgtagctgatgtgcctcaggaagtctcttgccagctgtccctgtgaagaccccctcctcccccccagctgctgccttgcacactgaagcatctcagactgtgcaaagccgtgtagtcatcaagacagtaaatcccagggcttggttaagtgctgtgtgataacttgtttggatgagacttaacttaaaaccacttacaataaacttgggaaactaccgtcaaaaaaaaaacaaaannacnaaacacnacaaacacaaacactggggtggggcgggactggagccccctggtgaggaaagctttttgtaaaaccacttcgcggtgggggcgcggcggcaggcccccacgactgcggaatggtgaacacggggcgtcacaagcagcgggttccccgagggggaaaacccccggggggcacgaaccacaaggcgcggcgcgtccccacgcaatcaaaacaag

SEQ ID NO: 278599 - DNA, 3457 bp, Homo sapiens
  misc_feature (231)..(231): n is a, c, g, or t
  misc_feature (234)..(234): n is a, c, g, or t
  misc_feature (250)..(250): n is a, c, g, or t
ggcgcctgaggctgccgggtagcccagcaggccgagggaggaagtagcgtggagccggtgccgagccggggcgaagctggatcccctagatatactgtcttcaagctcactgatattttcctctgcttgatccattgtgctgttgagagcctctagtaaatttttcagactgacagaccaaggatgcagctgctactaccggaggtgtgtggcaccttacctcagcaaggnatnaaccgagtggccatgntacggccggaggtcggccgcgtggctggaagacatggccactccagtcggtgttgagcacggcgagcagtctcaggcctttagtgatgatgattaaaggtggtggctgtggccttgaaaacagtcatgtgaaaactcatcaccttaaggtgttaagtgtaaggatcttcatgatgaaatttctgtaaatggtgcagtcagcctcagtttccaaagccggaaaaggatcctctagtagccacggtgtggcagctgctctgaaccaggacctggacccggacccaaagtgccatgtctttaatgttagctcccagcgatgccagatgggatcagcacagccctgcctctgctgctaattgttcctctaaagtaatcgccatgcgttctttgggcttcatctttaaaggaatgaagcaactgagattattctggaaaaccttttggcagttagtgaaattagagtacaactaagaacattttcagacctccactgtggatgacctgggtataatctcacaaatcgatgggactgcaaggattgtaaactgaaatgaacatgattatactctgttggaagagcctaagaggaaactgatgccatgagtttcagagagtaatgcttaaccccagttacacaggatgccgtcttgtgtttcctcttgtttagttacccactacagtgattttgtgatctgctaatgggttgccacccacaaccattgctttagcacttttacttcaaatcaatgaaggattgataaaagttctcctggtgtctccgcagagtgccttccaggaacagatctttgcatagaatatcagtggtttccttttttgtttcaaatagtggtcagaaaatacccagtgttgactcaccaaggcaatcagcttcctttttccctttttttgttttttttttaacattttatattttggctttattttattttattttattttataacattttatatttttgctttattttattttattttattttttgagacggagttccactctgtcgccaggctggagtgaagtggtacaatcttggctcactgcaacctccacctcccgggttcaagcaattctcctggctcagcctcctgagtgctgggactacaggcgcgtaccttctttagtagagactgggtttcaccatgttggccaggatggtctctatctcctgaccttgtgatctgcctgcctcagcttcccaaagtgctgagatgacaggtgtgagccatcagacccagcatttttttttttaatttaaatttaaattttttttcatttttttgagaggttttttttgtttgtttggttgttgttgttgttgttgttgttgttgtttttgagacagtcttgctctgtcacccaggctgggagtgcagtggcatgatctctgcaacctctacctcccaggttcaagcaattcttgtgcctcagcctcccaagtaactgggactacaggtgcacgctaccacacctggctgatttttttttgttttagtagagacagggtttcaaccatgttgcccaggttggtctcaaactcctgagctcaggcaatccacccgccttggcctcccaaagtgctaggattacaggtgtgagccaccacacccagctattttttctttcgttttttaattttaaagttggggggggtctcaatttgttaccctggctggtctcgaactcccggacttaagcgatcctctggctccaagcccactaccagtctcaggtttctttactaaaagatcactacctttttttctcttatctgctgccatgtgagatgtggctttcaccttccgccatgattgtgaggccttcccagccacgtggaactgtaagtccaataaacctcttttgtaaattaaaaaaaaatcactatttaagatactaggatggattgtgactgttgaggagtacttacatatcctacatttgactacattatttccaaaccaagtattccatccaaaggaacatactgctatcatagagaccaaggagggactgtttaaggttgccaaggtgaagcgagctgagaggctttgtcctcgtgccagtaactctgaaatctctcttaattcctgctgtccaggcagcagaatgccatggtttccccaagtaggtagctgctttagcagttaaagcccaaatgtctgttctgttgatcagaggtctctgaatttctgaagtggtgtttcgtttctggtgactgagttaatcctttacaatccctcttgtaaagtgtgctaatagaaagaatccacctttcaaagctgcagaaccagaccgtgccctaaattgaccaacgtagctgatgtgcctcaggaagtctcttgccagctgtccctgtgaagaccccctcctcccccccagctgctgccttgcacactgaagcatctcagactgtgcaaagccgtgtagtcatcaagacagtaaatcccagggcttggttaagtgctgtgtgataacttgtttggatgagacttaacttaaaaccacttacaataaacttgggaaactaccgtcagctgagttcaaatttactgacgccatgatatgaggatgaaggtttattacctggtgacatcatcctgttggtgacatcatcctgttggtgacaaggtggtgatacatctctaatgggacttccctcagtggcaggcaggctgccaagcaactaacccccatcaagtgccagaccctcccagtgttctgagagtcatctccatgctaaacagcctgcgttttatatgatttctctacccagccaaaaaaaaaaaaatggtccatcatgtacgcagttatctagtcttaagttatattctggcttttttctcccactttattatggagcagaagtaagcctatcatgttcttagaaaggctcttaagaggtgtcctggagtccttgaatcactttagcatctggggtaggatgtgccaccaggaggatttgggctggagcgtgtgtgtttgcctttgacctggactgctgtctgatcttgctgaacactccaccgacatttcctaaagttgctcagtgccaatccagcaaagcagtccattttcccttggccaagattgagatgtattgttttagatacagaagagttcttggatgagccaaggacaagctggggtgtcctatattgaacagacctcgatgaaaatcttgaattca

SEQ ID NO: 278600 - DNA, 3502 bp, Homo sapiens
  misc_feature (231)..(231): n is a, c, g, or t
  misc_feature (234)..(234): n is a, c, g, or t
  misc_feature (250)..(250): n is a, c, g, or t
ggcgcctgaggctgccgggtagcccagcaggccgagggaggaagtagcgtggagccggtgccgagccggggcgaagctggatcccctagatatactgtcttcaagctcactgatattttcctctgcttgatccattgtgctgttgagagcctctagtaaatttttcagactgacagaccaaggatgcagctgctactaccggaggtgtgtggcaccttacctcagcaaggnatnaaccgagtggccatgntacggccggaggtcggccgcgtggctggaagacatggccactccagtcggtgttgagcacggcgagcagtctcaggcctttagtgatgatggtaaggctgcctgggtgggaaaacggggtcttccttgacacgacactaacatacttggcttcccttcctcagagacgaagtggtgacgataatctcggtttctccctcatagggtggttaggagggttaaaagtactggatgagaaaatgctttccaaacgttgagaaaatgttactatgtgaagggagagagctcaagcccgtcctcggcgtcatagggccggcttctgcgggggagagcgcctaacaacctgggcagccccgtgcgcctccgccgcgcgtgtgctgagcgtcatgcccaggggtcttcggtgcccgcgcacgggcagactctgacgatggtggttcttaattcagcatcaggagtgttaacgtgtgaagacgtgattccgcttggagtgtcttgaggacggccccaatcggtagttcatatttagctttacagataggagtcaataggattgtaaacttctggaaagccgtagttttaacaacgagccttttttcctcccccagaggcctttctttgtttggcatctgcagagacggtgaaaagcagagctccaggttgaaggatcagagtaatagatggagcccttaacatgagtaagagtgggtgcaggcagggcctgagtggtcactagaaatgagaaagcacagttggtgccatcacatacattcacctcctgctttattctgaagttcaagtatgagaatacgtgttgacatacaagccagctatgattaaaggtggtggctgtggccttgaaaacagtcatgtgaaaactcatcaccttaaggtgttaagtgtaaggatcttcatgatgaaatttctgtaaatggtgcagtcagcctcagtttccaaagccggaaaaggatcctctagtagccacggtgtggcagctgctctgaaccaggacctggacccggacccaaagtgccatgtctttaatgttagctcccagcgatgccagatgggatcagcacagccctgcctctgctgctaattgttcctctaaagtaatcgccatgcgttctttgggcttcatctttaaaggaatgaagcaactgagattattctggaaaaccttttggcagttagtgaaattagagtacaactaagaacattttcagacctccactgtggatgacctgggtataatctcacaaatcgatgggactgcaaggattgtaaactgaaatgaacatgattatactctgttggaagagcctaagaggaaactgatgccatgagtttcagagagtaatgcttaaccccagttacacaggatgccgtcttgtgtttcctcttgtttagttacccactacagtgattttgtgatctgctaatgggttgccacccacaaccattgctttagcacttttacttcaaatcaatgaaggattgataaaagttctcctggtgtctccgcagagtgccttccaggaacagatctttgcatagaatatcagtggtttccttttttgtttcaaatagtggtcagaaaatacccagtgttgactcaccaaggcaatcagcttcctttttccctttttttgtttttttttaacattttatatttttgctttattttattttattttattttttgagacggagttccactctgtcgccaggctggagtgaagtggtacaatcttggctcactgcaacctccacctcccgggttcaagcaattctcctggctcagcctcctgagtgctgggactacaggcgcgtaccttctttagtagagactgggtttcaccatgttggccaggatggtctctatctcctgaccttgtgatctgcctgcctcagcttcccaaagtgctgagatgacaggtgtgagccatcagacccagcatttttttttttaatttaaatttaaattttttttcatttttttgagaggttttttttgtttgtttggttgttgttgttgttgttgttgttgttgtttttgagacagtcttgctctgtcacccaggctgggagtgcagtggcatgatctctgcaacctctacctcccaggttcaagcaattcttgtgcctcagcctcccaagtaactgggactacaggtgcacgctaccacacctggctgatttttttttgttttagtagagacagggtttcaaccatgttgcccaggttggtctcaaactcctgagctcaggcaatccacccgccttggcctcccaaagtgctaggattacaggtgtgagccaccacacccagctattttttctttcgttttttaattttaaagttggggggggtctcaatttgttaccctggctggtctcgaactcccggacttaagcgatcctctggctccaagcccactaccagtctcaggtttctttactaaaagatcactacctttttttctcttatctgctgccatgtgagatgtggctttcaccttccgccatgattgtgaggccttcccagccacgtggaactgtaagtccaataaacctcttttgtaaattaaaaaaaaatcactatttaagatactaggatggattgtgactgttgaggagtacttacatatcctacatttgactacattatttccaaaccaagtattccatccaaaggaacatactgctatcatagagaccaaggagggactgtttaaggttgccaaggtgaagcgagctgagaggctttgtcctcgtgccagtaactctgaaatctctcttaattcctgctgtccaggcagcagaatgccatggtttccccaagtaggtagctgctttagcagttaaagcccaaatgtctgttctgttgatcagaggtctctgaatttctgaagtggtgtttcgtttctggtgactgagttaatcctttacaatccctcttgtaaagtgtgctaatagaaagaatccacctttcaaagctgcagaaccagaccgtgccctaaattgaccaacgtagctgatgtgcctcaggaagtctcttgccagctgtccctgtgaagaccccctcctcccccccagctgctgccttgcacactgaagcatctcagactgtgcaaagccgtgtagtcatcaagacagtaaatcccagggcttggttaagtgctgtgtgataacttgtttggatgagacttaacttaaaaccacttacaataaacttgggaaactaccgtca

SEQ ID NO: 278601 - DNA, 1756 bp, Homo sapiens
aaaactaggctaggtacgaggccgggtggtggagtttttttttgtttttgttttttttcccctttttttttccctcagcatatcctgctgagagcccagtctagagcatcattcctctaaaacgtgaaaagcaaatgagtgattgtcctgctttctctagtcctttgattatggctctgaggatacaggctgtatgaggtggcaggaatgcacaagtacccaggatttgatttatgcccttattgtggaatgaaagtgcttgttacatatttcaagaaaatgaatgcgctcttagaaacagattggaatgtaggatgtatgccagcttgtggcaatgagaatgcttaatgactctgaccttgcctctgctccagggtcctgacatttaggggaaaccacggctgtttggtttctatgtgctttgttaaggacgccagggaggtctcctaagtttgtagcttagatcctgtctgaatgtcacgactggcatgtgagcaagaaagaaaccaagtggtgctggagagtggggtgcccagcttgtgttcccactggaatgccaggcttgaagtgcacacagattgcctttcttttctgttgaaaggggaggtgtgggccgggcgcggtggctcacgcctgtaatcccagcactttgggaggccgaggcgggtggatcatgaggtcaggagatcgagaccatcctggtaattttttgttttagtagagacagggtttcaaccatgttgcccaggttggtctcaaactcctgagctcaggcaatccacccgccttggcctcccaaagtgctaggattacaggtgtgagccaccacacccagctattttttctttcgttttttaattttaaagttggggggggtctcaatttgttaccctggctggtctcgaactcccggacttaagcgatcctctggctccaagcccactaccagtctcaggtttctttactaaaagatcactacctttttttctcttatctgctgccatgtgagatgtggctttcaccttccgccatgattgtgaggccttcccagccacgtggaactgtaagtccaataaacctcttttgtaaattaaaaaaaaatcactatttaagatactaggatggattgtgactgttgaggagtacttacatatcctacatttgactacattatttccaaaccaagtattccatccaaaggaacatactgctatcatagagaccaaggagggactgtttaaggttgccaaggtgaagcgagctgagaggctttgtcctcgtgccagtaactctgaaatctctcttaattcctgctgtccaggcagcagaatgccatggtttccccaagtaggtagctgctttagcagttaaagcccaaatgtctgttctgttgatcagaggtctctgaatttctgaagtggtgtttcgtttctggtgactgagttaatcctttacaatccctcttgtaaagtgtgctaatagaaagaatccacctttcaaagctgcagaaccagaccgtgccctaaattgaccaacgtagctgatgtgcctcaggaagtctcttgccagctgtccctgtgaagaccccctcctcccccccagctgctgccttgcacactgaagcatctcagactgtgcaaagccgtgtagtcatcaagacagtaaatcccagggcttggttaagtgctgtgtgataacttgtttggatgagacttaacttaaaaccacttacaataaacttgggaaactaccgtca

SEQ ID NO: 278602 - DNA, 1155 bp, Homo sapiens
  misc_feature (15)..(15): n is a, c, g, or t
  misc_feature (17)..(17): n is a, c, g, or t
  misc_feature (92)..(92): n is a, c, g, or t
  misc_feature (94)..(94): n is a, c, g, or t
  misc_feature (119)..(119): n is a, c, g, or t
  misc_feature (122)..(122): n is a, c, g, or t
  misc_feature (203)..(203): n is a, c, g, or t
ggcgcggcggccgcngngggtgctgggagccagcgcctgcctcgccgcgccctcgctgcctgccactccgtcttgtgccctgttctccgcancngtgcagaggcggcgggctggggagngangcggctgccagcacgaggttcccagcctgctgggaagcccctagacgcgcctgaggggccgggctacgagcggctgagaanatgatgcatcctgttgccagcagtaacccagctattttttctttcgttttttaattttaaagttggggggggtctcaatttgttaccctggctggtctcgaactcccggacttaagcgatcctctggctccaagcccactaccagtctcaggtttctttactaaaagatcactacctttttttctcttatctgctgccatgtgagatgtggctttcaccttccgccatgattgtgaggccttcccagccacgtggaactgtaagtccaataaacctcttttgtaaattaaaaaaaaatcactatttaagatactaggatggattgtgactgttgaggagtacttacatatcctacatttgactacattatttccaaaccaagtattccatccaaaggaacatactgctatcatagagaccaaggagggactgtttaaggttgccaaggtgaagcgagctgagaggctttgtcctcgtgccagtaactctgaaatctctcttaattcctgctgtccaggcagcagaatgccatggtttccccaagtaggtagctgctttagcagttaaagcccaaatgtctgttctgttgatcagaggtctctgaatttctgaagtggtgtttcgtttctggtgactgagttaatcctttacaatccctcttgtaaagtgtgctaatagaaagaatccacctttcaaagctgcagaaccagaccgtgccctaaattgaccaacgtagctgatgtgcctcaggaagtctcttgccagctgtccctgtgaagaccccctcctcccccccagctgctgccttgcacactgaagcatctcagactgtgcaaagccgtgtagtcatcaagacagtaaatcccagggcttggttaagtgctgtgtgataacttgtttggatgagacttaacttaaaaccacttacaataaacttgggaaactaccgtca

SEQ ID NO: 278603 - DNA, 1265 bp, Homo sapiens
  misc_feature (231)..(231): n is a, c, g, or t
  misc_feature (234)..(234): n is a, c, g, or t
  misc_feature (250)..(250): n is a, c, g, or t
ggcgcctgaggctgccgggtagcccagcaggccgagggaggaagtagcgtggagccggtgccgagccggggcgaagctggatcccctagatatactgtcttcaagctcactgatattttcctctgcttgatccattgtgctgttgagagcctctagtaaatttttcagactgacagaccaaggatgcagctgctactaccggaggtgtgtggcaccttacctcagcaaggnatnaaccgagtggccatgntacggccggaggtcggccgcgtggctggaagacatggccactccagtcggtgttgagcacggcgagcagtctcaggcctttagtgatgatgattaaaggtggtggctgtggccttgaaaacagtcatgtgaaaactcatcaccttaaggtgttaagtgtaaggatcttcatgatgaaatttctgtaaatggtgcagtcagcctcagtttccaaagccggaaaaggatcctctagtagccacggtgtggcagctgctctgaaccaggacctggacccggacccaaagtgccatgtctttaatgttagctcccagcgatgccagatgggatcagcacagccctgcctctgctgctaattgttcctctaaagtaatcgccatgcgttctttgggcttcatctttaaaggaatgaagcaactgagattattctggaaaaccttttggcagttagtgaaattagagtacaactaagaacattttcagacctccactgtggatgacctgggtataatctcacaaatcgatgggactgcaaggattgtaaactgaaatgaacatgattatactctgttggaagagcctaagaggaaactgatgccatgagtttcagagagtaatgcttaaccccagttacacaggatgccgtcttgtgtttcctcttgtttagttacccactacagtgattttgtgatctgctaatgggttgccacccacaaccattgctttagcacttttacttcaaatcaatgaaggattgataaaagttctcctggtgtctccgcagagtgccttccaggaacagatctttgcatagaatatcagtggtttccttttttgtttcaaatagtggtcagaaaatacccagtgttgactcaccaaggcaatcagcttcctttttccctttttttgtttttttttaacattttatatttttgctttattttattttattttatttattttattttattttatttatttttgaacgcctccactcattccccagcctggacata

SEQ ID NO: 278604 - DNA, 1398 bp, Homo sapiens
  misc_feature (231)..(231): n is a, c, g, or t
  misc_feature (234)..(234): n is a, c, g, or t
  misc_feature (250)..(250): n is a, c, g, or t
  misc_feature (1169)..(1169): n is a, c, g, or t
  misc_feature (1171)..(1171): n is a, c, g, or t
  misc_feature (1177)..(1177): n is a, c, g, or t
  misc_feature (1181)..(1181): n is a, c, g, or t
  misc_feature (1192)..(1193): n is a, c, g, or t
  misc_feature (1196)..(1196): n is a, c, g, or t
  misc_feature (1198)..(1198): n is a, c, g, or t
  misc_feature (1202)..(1204): n is a, c, g, or t
  misc_feature (1240)..(1240): n is a, c, g, or t
  misc_feature (1242)..(1242): n is a, c, g, or t
  misc_feature (1245)..(1245): n is a, c, g, or t
  misc_feature (1262)..(1263): n is a, c, g, or t
  misc_feature (1268)..(1268): n is a, c, g, or t
  misc_feature (1283)..(1283): n is a, c, g, or t
  misc_feature (1288)..(1288): n is a, c, g, or t
  misc_feature (1290)..(1290): n is a, c, g, or t
  misc_feature (1300)..(1300): n is a, c, g, or t
  misc_feature (1306)..(1307): n is a, c, g, or t
  misc_feature (1317)..(1318): n is a, c, g, or t
  misc_feature (1324)..(1324): n is a, c, g, or t
  misc_feature (1326)..(1326): n is a, c, g, or t
  misc_feature (1330)..(1330): n is a, c, g, or t
  misc_feature (1336)..(1336): n is a, c, g, or t
  misc_feature (1343)..(1343): n is a, c, g, or t
ggcgcctgaggctgccgggtagcccagcaggccgagggaggaagtagcgtggagccggtgccgagccggggcgaagctggatcccctagatatactgtcttcaagctcactgatattttcctctgcttgatccattgtgctgttgagagcctctagtaaatttttcagactgacagaccaaggatgcagctgctactaccggaggtgtgtggcaccttacctcagcaaggnatnaaccgagtggccatgntacggccggaggtcggccgcgtggctggaagacatggccactccagtcggtgttgagcacggcgagcagtctcaggcctttagtgatgatgattaaaggtggtggctgtggccttgaaaacagtcatgtgaaaactcatcaccttaaggtgttaagtgtaaggatcttcatgatgaaatttctgtaaatggtgcagtcagcctcagtttccaaagccggaaaaggatcctctagtagccacggtgtggcagctgctctgaaccaggacctggacccggacccaaagtgccatgtctttaatgttagctcccagcgatgccagatgggatcagcacagccctgcctctgctgctaattgttcctctaaagtaatcgccatgcgttctttgggcttcatctttaaaggaatgaagcaactgagattattctggaaaaccttttggcagttagtgaaattagagtacaactaagaacattttcagacctccactgtggatgacctgggtataatctcacaaatcgatgggactgcaaggattgtaaactgaaatgaacatgattatactctgttggaagagcctaagaggaaactgatgccatgagtttcagagagtaatgcttaaccccagttacacaggatgccgtcttgtgtttcctcttgtttagttacccactacagtgattttgtgatctgctaatgggttgccacccacaaccattgctttagcacttttacttcaaatcaatgaaggattgataaaagttctcctggtgtctccgcagagtgccttccaggaacagatctttgcatagaatatcagtggtttccttttttgtttcaaatagtggtcagaaaatacccagtgttgactcaccaaggcaatcagcttcctttttccctttttttgtttttttttgntntttttncaanttttatatctnngcntnattnnnttatttattttttgagacggagttccactctgtcgncnagntggagtgaatggtcaanntgggntcactggaacctcanctccngntcaagcaatntccggnncagccctganngggganangggngacctntaaaaangggttaccctttgcagaaggctaatcgaacggaagacgctcatccacggggatag

SEQ ID NO: 278605 - DNA, 1377 bp, Homo sapiens
aaaactaggctaggtacgaggccgggtggtggagtttttttttgtttttgttttttttcccctttttttttccctcagcatatcctgctgagagcccagtctagagcatcattcctctaaaacgtgaaaagcaaatgagtgattgtcctgctttctctagtcctttgattatggctctgaggatacaggctgtatgaggtggcaggaatgcacaagtacccaggatttgatttatgcccttattgtggaatgaaagtgcttgttacatatttcaagaaaatgaatgcgctcttagaaacagattggaatgtaggatgtatgccagcttgtggcaatgagaatgcttaatgactctgaccttgcctctgctccagggtcctgacatttaggggaaaccacggctgtttggtttctatgtgctttgttaaggacgccagggaggtctcctaagtttgtagcttagatcctgtctgaatgtcacgactggcatgtgagcaagaaagaaaccaagtggtgctggtctcgaactcccggacttaagcgatcctctggctccaagcccactaccagtctcaggtttctttactaaaagatcactacctttttttctcttatctgctgccatgtgagatgtggctttcaccttccgccatgattgtgaggccttcccagccacgtggaactgtaagtccaataaacctcttttgtaaattaaaaaaaaatcactatttaagatactaggatggattgtgactgttgaggagtacttacatatcctacatttgactacattatttccaaaccaagtattccatccaaaggaacatactgctatcatagagaccaaggagggactgtttaaggttgccaaggtgaagcgagctgagaggctttgtcctcgtgccagtaactctgaaatctctcttaattcctgctgtccaggcagcagaatgccatggtttccccaagtaggtagctgctttagcagttaaagcccaaatgtctgttctgttgatcagaggtctctgaatttctgaagtggtgtttcgtttctggtgactgagttaatcctttacaatccctcttgtaaagtgtgctaatagaaagaatccacctttcaaagctgcagaaccagaccgtgccctaaattgaccaacgtagctgatgtgcctcaggaagtctcttgccagctgtccctgtgaagaccccctcctcccccccagctgctgccttgcacactgaagcatctcagactgtgcaaagccgtgtagtcatcaagacagtaaatcccagggcttggttaagtgctgtgtgataacttgtttggatgagacttaacttaaaaccacttacaataaacttgggaaactaccgtca

SEQ ID NO: 278606 - DNA, 720 bp, Homo sapiens
atgatacgactcgagtcagtacccgggagtagtccaataaacctcttttgtaaattaaaaaaaaatcactatttaagatactaggatggattgtgactgttgaggagtacttacatatcctacatttgactacattatttccaaaccaagtattccatccaaaggaacatactgctatcatagagaccaaggagggactgtttaaggttgccaaggtgaagcgagctgagaggctttgtcctcgtgccagtaactctgaaatctctcttaattcctgctgtccaggcagcagaatgccatggtttccccaagtaggtagctgctttagcagttaaagcccaaatgtctgttctgttgatcagaggtctctgaatttctgaagtggtgtttcgtttctggtgactgagttaatcctttacaatccctcttgtaaagtgtgctaatagaaagaatccacctttcaaagctgcagaaccagaccgtgccctaaattgaccaacgtagctgatgtgcctcaggaagtctcttgccagctgtccctgtgaagaccccctcctcccccccagctgctgccttgcacactgaagcatctcagactgtgcaaagccgtgtagtcatcaagacagtaaatcccagggcttggttaagtgctgtgtgataacttgtttggatgagacttaacttaaaaccacttacaataaacttgggaaactaccgtca

SEQ ID NO: 278607 - DNA, 1015 bp, Homo sapiens
  misc_feature (231)..(231): n is a, c, g, or t
  misc_feature (234)..(234): n is a, c, g, or t
  misc_feature (250)..(250): n is a, c, g, or t
ggcgcctgaggctgccgggtagcccagcaggccgagggaggaagtagcgtggagccggtgccgagccggggcgaagctggatcccctagatatactgtcttcaagctcactgatattttcctctgcttgatccattgtgctgttgagagcctctagtaaatttttcagactgacagaccaaggatgcagctgctactaccggaggtgtgtggcaccttacctcagcaaggnatnaaccgagtggccatgntacggccggaggtcggccgcgtggctggaagacatggccactccagtcggtgttgagcacggcgagcagtctcaggcctttagtgatgatgattaaaggtggtggctgtggccttgaaaacagtcatgtgaaaactcatcaccttaaggtgttaagtgtaaggatcttcatgatgaaatttctgtaaatggtgcagtcagcctcagtttccaaagccggaaaaggatcctctagtagccacggtgtggcagctgctctgaaccaggacctggacccggacccaaagtgccatgtctttaatgttagctcccagcgatgccagatgggatcagcacagccctgcctctgctgctaattgttcctctaaagtaatcgccatgcgttctttgggcttcatctttaaaggaatgaagcaactgagattattctggaaaaccttttggcagttagtgaaattagagtacaactaagaacattttcagacctccactgtggatgacctgggtataatctcacaaatcgatgggactgcaaggattgtaaactgaaatgaacatgattatactctgttggaagagcctaagaggaaactgatgccatgagtttcagagagtaatgcttaaccccagttacacaggatgccgtcttgtgtttcctcttgtttagttacccactacagtgattttgtgatctgctaatgggttgccacccacaaccattgctttagcacttttacttcaaatcaatgaaggattgataaaagtt

SEQ ID NO: 278608 - DNA, 1303 bp, Homo sapiens
  misc_feature (231)..(231): n is a, c, g, or t
  misc_feature (234)..(234): n is a, c, g, or t
  misc_feature (250)..(250): n is a, c, g, or t
  misc_feature (1145)..(1145): n is a, c, g, or t
  misc_feature (1147)..(1147): n is a, c, g, or t
  misc_feature (1150)..(1150): n is a, c, g, or t
  misc_feature (1167)..(1168): n is a, c, g, or t
  misc_feature (1173)..(1173): n is a, c, g, or t
  misc_feature (1188)..(1188): n is a, c, g, or t
  misc_feature (1193)..(1193): n is a, c, g, or t
  misc_feature (1195)..(1195): n is a, c, g, or t
  misc_feature (1205)..(1205): n is a, c, g, or t
  misc_feature (1211)..(1212): n is a, c, g, or t
  misc_feature (1222)..(1223): n is a, c, g, or t
  misc_feature (1229)..(1229): n is a, c, g, or t
  misc_feature (1231)..(1231): n is a, c, g, or t
  misc_feature (1235)..(1235): n is a, c, g, or t
  misc_feature (1241)..(1241): n is a, c, g, or t
  misc_feature (1248)..(1248): n is a, c, g, or t
ggcgcctgaggctgccgggtagcccagcaggccgagggaggaagtagcgtggagccggtgccgagccggggcgaagctggatcccctagatatactgtcttcaagctcactgatattttcctctgcttgatccattgtgctgttgagagcctctagtaaatttttcagactgacagaccaaggatgcagctgctactaccggaggtgtgtggcaccttacctcagcaaggnatnaaccgagtggccatgntacggccggaggtcggccgcgtggctggaagacatggccactccagtcggtgttgagcacggcgagcagtctcaggcctttagtgatgatggtgcagtcagcctcagtttccaaagccggaaaaggatcctctagtagccacggtgtggcagctgctctgaaccaggacctggacccggacccaaagtgccatgtctttaatgttagctcccagcgatgccagatgggatcagcacagccctgcctctgctgctaattgttcctctaaagtaatcgccatgcgttctttgggcttcatctttaaaggaatgaagcaactgagattattctggaaaaccttttggcagttagtgaaattagagtacaactaagaacattttcagacctccactgtggatgacctgggtataatctcacaaatcgatgggactgcaaggattgtaaactgaaatgaacatgattatactctgttggaagagcctaagaggaaactgatgccatgagtttcagagagtaatgcttaaccccagttacacaggatgccgtcttgtgtttcctcttgtttagttacccactacagtgattttgtgatctgctaatgggttgccacccacaaccattgctttagcacttttacttcaaatcaatgaaggattgataaaagttctcctggtgtctccgcagagtgccttccaggaacagatctttgcatagaatatcagtggtttccttttttgtttcaaatagtggtcagaaaatacccagtgttgactcaccaaggcaatcagcttcctttttccctttttttgttttttttttaacattttatattttggctttattttattttattttattttattttattttttgagacggagttccactctgtcgncnagntggagtgaatggtcaanntgggntcactggaacctcanctccngntcaagcaatntccggnncagccctganngggganangggngacctntaaaaangggttaccctttgcagaaggctaatcgaacggaagacgctcatccacggggatag

SEQ ID NO: 278609 - DNA, 1042 bp, Homo sapiens
  misc_feature (231)..(231): n is a, c, g, or t
  misc_feature (234)..(234): n is a, c, g, or t
  misc_feature (250)..(250): n is a, c, g, or t
ggcgcctgaggctgccgggtagcccagcaggccgagggaggaagtagcgtggagccggtgccgagccggggcgaagctggatcccctagatatactgtcttcaagctcactgatattttcctctgcttgatccattgtgctgttgagagcctctagtaaatttttcagactgacagaccaaggatgcagctgctactaccggaggtgtgtggcaccttacctcagcaaggnatnaaccgagtggccatgntacggccggaggtcggccgcgtggctggaagacatggccactccagtcggtgttgagcacggcgagcagtctcaggcctttagtgatgatgattaaaggtggtggctgtggccttgaaaacagtcatgtgaaaactcatcaccttaaggtgttaagtgtaaggatcttcatgatgaaatttctgtaaatggtgcagtcagcctcagtttccaaagccggaaaaggatcctctagtagccacggtgtggcagctgctctgaaccaggacctggacccggacccaaagtgccatgtctttaatgttagctcccagcgatgccagatgggatcagcacagccctgcctctgctgctaattgttcctctaaagtaatcgccatgcgttctttgggcttcatctttaaaggaatgaagcaactgagattattctggaaaaccttttggcagttagtgaaattagagtacaactaagaacattttcagacctccactgtggatgacctgggtataatctcacaaatcgatgggactgcaaggattgtaaactgaaatgaacatgattatactctgttggaagagcctaagaggaaactgatgccatgagtttcagagagtaatgcttaaccccagttacacaggatgccgtcttgtgtttcctcttgtttagttacccactacagtgattttgtgatctgctaatgggttgccacccacaaccattgctttagcacttttacttcaaatcaatgaaggattgataaaagttaaaaaaaaaaaaggggggcggaaaaaa

SEQ ID NO: 278610 - DNA, 1093 bp, Homo sapiens
aaaactaggctaggtacgaggccgggtggtggagtttttttttgtttttgttttttttcccctttttttttccctcagcatatcctgctgagagcccagtctagagcatcattcctctaaaacgtgaaaagcaaatgagtgattgtcctgctttctctagtcctttgattatggctctgaggatacaggctgtatgaggtggcaggaatgcacaagtacccaggatttgatttatgcccttattgtggaatgaaagtgcttgttacatatttcaagaaaatgaatgcgctcttagaaacagattggaatgtaggatgtatgccagcttgtggcaatgagaatgcttaatgactctgaccttgcctctgctccagggtcctgacatttaggggaaaccacggctgtttggtttctatgtgctttgttaaggacgccagggaggtctcctaagtttgtagcttagatcctgtctgaatgtcacgactggcatgtgagcaagaaagaaaccaagtggtgctggagagtggggtgcccagcttgtgttcccactggaatgccaggcttgaagtgcacacagattgcctttcttttctgttgaaaggggaggtgtgggccgggcgcggtggctcacgcctgtaatcccagcactttgggaggccgaggcgggtggatcatgaggtcaggagatcgagaccatcctggtaattttttgttttagtagagacagggtttcaaccatgttgcccaggttggtctcaaactcctgagctcaggcaatccacccgccttggcctcccaaagtgctaggattacaggtgtgagccaccacacccagctattttttctttcgttttttaattttaaagttggggggggtctcaatttgttaccctggctggtctcgaactcccggacttaagcgatcctctggctccaagcccactaccagtctcaggtttctttactaaaagatcactacctttttttctcttatctgctgccatgtgagatgtggctttcaccttccgccatgattgtgaggccttcccagccacgtggaactgtaagtccaataaacctcttttgtaaatta

SEQ ID NO: 278611 - DNA, 436 bp, Homo sapiens
aggacctggacccggacccaaagtgccatgtctttaatgtgagtaagtagacgaactggtaaacaggcttggtttggtttgggggagtggtaatcttttttgcttcccctgctctggacttaaagcaatgggggcagggagactttagtagcattttgttgctaggtgtctgcaataagagacgaaactgaactgctttgccggaaacaagtgaaatgattgctttcctgtttgtaagatttgtttacatctttcgtatccgtaagaagtcccacaagcctatgatggttagttatccctgtctgaaaatctggactgagggaaataatctattctgaggcttaagggtttggctccatggtttttttttgtttttgttttttttcccctttttttttccctcagcatatcctgctgagagcccagtctagagcat

SEQ ID NO: 278612 - DNA, 2759 bp, Homo sapiens
  misc_feature (231)..(231): n is a, c, g, or t
  misc_feature (234)..(234): n is a, c, g, or t
  misc_feature (250)..(250): n is a, c, g, or t
ggcgcctgaggctgccgggtagcccagcaggccgagggaggaagtagcgtggagccggtgccgagccggggcgaagctggatcccctagatatactgtcttcaagctcactgatattttcctctgcttgatccattgtgctgttgagagcctctagtaaatttttcagactgacagaccaaggatgcagctgctactaccggaggtgtgtggcaccttacctcagcaaggnatnaaccgagtggccatgntacggccggaggtcggccgcgtggctggaagacatggccactccagtcggtgttgagcacggcgagcagtctcaggcctttagtgatgatgattaaaggtggtggctgtggccttgaaaacagtcatgtgaaaactcatcaccttaaggtgttaagtgtaaggatcttcatgatgaaatttctgtaaatggtgcagtcagcctcagtttccaaagccggaaaaggatcctctagtagccacggtgtggcagctgctctgaaccaggacctggacccggacccaaagtgccatgtctttaatgttagctcccagcgatgccagatgggatcagcacagccctgcctctgctgctaattgttcctctaaagtaatcgccatgcgttctttgggcttcatctttaaaggaatgaagcaactgagattattctggaaaaccttttggcagttagtgaaattagagtacaactaagaacattttcagacctccactgtggatgacctgggtataatctcacaaatcgatgggactgcaaggattgtaaactgaaatgaacatgattatactctgttggaagagcctaagaggaaactgatgccatgagtttcagagagtaatgcttaaccccagttacacaggatgccgtcttgtgtttcctcttgtttagttacccactacagtgattttgtgatctgctaatgggttgccacccacaaccattgctttagcacttttacttcaaatcaatgaaggattgataaaagttctcctggtgtctccgcagagtgccttccaggaacagatctttgcatagaatatcagtggtttccttttttgtttcaaatagtggtcagaaaatacccagtgttgactcaccaaggcaatcagcttcctttttccctttttttgtttttttttaacattttatatttttgctttattttattttattttattttttgagacggagttccactctgtcgccaggctggagtgaagtggtacaatcttggctcactgcaacctccacctcccgggttcaagcaattctcctggctcagcctcctgagtgctgggactacaggcgcgtaccttctttagtagagactgggtttcaccatgttggccaggatggtctctatctcctgaccttgtgatctgcctgcctcagcttcccaaagtgctgagatgacaggtgtgagccatcagacccagcatttttttttttaatttaaatttaaattttttttcatttttttgagaggttttttttgtttgtttggttgttgttgttgttgttgttgttgttgtttttgagacagtcttgctctgtcacccaggctgggagtgcagtggcatgatctctgcaacctctacctcccaggttcaagcaattcttgtgcctcagcctcccaagtaactgggactacaggtgcacgctaccacacctggctgatttttttttgttttagtagagacagggtttcaaccatgttgcccaggttggtctcaaactcctgagctcaggcaatccacccgccttggcctcccaaagtgctaggattacaggtgtgagccaccacacccagctattttttctttcgttttttaattttaaagttggggggggtctcaatttgttaccctggctggtctcgaactcccggacttaagcgatcctctggctccaagcccactaccagtctcaggtttctttactaaaagatcactacctttttttctcttatctgctgccatgtgagatgtggctttcaccttccgccatgattgtgaggccttcccagccacgtggaactgtaagtccaataaacctcttttgtaaattaaaaaaaaatcactatttaagatactaggatggattgtgactgttgaggagtacttacatatcctacatttgactacattatttccaaaccaagtattccatccaaaggaacatactgctatcatagagaccaaggagggactgtttaaggttgccaaggtgaagcgagctgagaggctttgtcctcgtgccagtaactctgaaatctctcttaattcctgctgtccaggcagcagaatgccatggtttccccaagtaggtagctgctttagcagttaaagcccaaatgtctgttctgttgatcagaggtctctgaatttctgaagtggtgtttcgtttctggtgactgagttaatcctttacaatccctcttgtaaagtgtgctaatagaaagaatccacctttcaaagctgcagaaccagaccgtgccctaaattgaccaacgtagctgatgtgcctcaggaagtctcttgccagctgtccctgtgaagaccccctcctcccccccagctgctgccttgcacactgaagcatctcagactgtgcaaagccgtgtagtcatcaagacagtaaatcccagggcttggttaagtgctgtgtgataacttgtttggatgagacttaacttaaaaccacttacaataaacttgggaaactaccgtca

SEQ ID NO: 278613 - DNA, 2660 bp, Homo sapiens
  misc_feature (231)..(231): n is a, c, g, or t
  misc_feature (234)..(234): n is a, c, g, or t
  misc_feature (250)..(250): n is a, c, g, or t
ggcgcctgaggctgccgggtagcccagcaggccgagggaggaagtagcgtggagccggtgccgagccggggcgaagctggatcccctagatatactgtcttcaagctcactgatattttcctctgcttgatccattgtgctgttgagagcctctagtaaatttttcagactgacagaccaaggatgcagctgctactaccggaggtgtgtggcaccttacctcagcaaggnatnaaccgagtggccatgntacggccggaggtcggccgcgtggctggaagacatggccactccagtcggtgttgagcacggcgagcagtctcaggcctttagtgatgatggtgcagtcagcctcagtttccaaagccggaaaaggatcctctagtagccacggtgtggcagctgctctgaaccaggacctggacccggacccaaagtgccatgtctttaatgttagctcccagcgatgccagatgggatcagcacagccctgcctctgctgctaattgttcctctaaagtaatcgccatgcgttctttgggcttcatctttaaaggaatgaagcaactgagattattctggaaaaccttttggcagttagtgaaattagagtacaactaagaacattttcagacctccactgtggatgacctgggtataatctcacaaatcgatgggactgcaaggattgtaaactgaaatgaacatgattatactctgttggaagagcctaagaggaaactgatgccatgagtttcagagagtaatgcttaaccccagttacacaggatgccgtcttgtgtttcctcttgtttagttacccactacagtgattttgtgatctgctaatgggttgccacccacaaccattgctttagcacttttacttcaaatcaatgaaggattgataaaagttctcctggtgtctccgcagagtgccttccaggaacagatctttgcatagaatatcagtggtttccttttttgtttcaaatagtggtcagaaaatacccagtgttgactcaccaaggcaatcagcttcctttttccctttttttgtttttttttaacattttatatttttgctttattttattttattttattttttgagacggagttccactctgtcgccaggctggagtgaagtggtacaatcttggctcactgcaacctccacctcccgggttcaagcaattctcctggctcagcctcctgagtgctgggactacaggcgcgtaccttctttagtagagactgggtttcaccatgttggccaggatggtctctatctcctgaccttgtgatctgcctgcctcagcttcccaaagtgctgagatgacaggtgtgagccatcagacccagcatttttttttttaatttaaatttaaattttttttcatttttttgagaggttttttttgtttgtttggttgttgttgttgttgttgttgttgttgtttttgagacagtcttgctctgtcacccaggctgggagtgcagtggcatgatctctgcaacctctacctcccaggttcaagcaattcttgtgcctcagcctcccaagtaactgggactacaggtgcacgctaccacacctggctgatttttttttgttttagtagagacagggtttcaaccatgttgcccaggttggtctcaaactcctgagctcaggcaatccacccgccttggcctcccaaagtgctaggattacaggtgtgagccaccacacccagctattttttctttcgttttttaattttaaagttggggggggtctcaatttgttaccctggctggtctcgaactcccggacttaagcgatcctctggctccaagcccactaccagtctcaggtttctttactaaaagatcactacctttttttctcttatctgctgccatgtgagatgtggctttcaccttccgccatgattgtgaggccttcccagccacgtggaactgtaagtccaataaacctcttttgtaaattaaaaaaaaatcactatttaagatactaggatggattgtgactgttgaggagtacttacatatcctacatttgactacattatttccaaaccaagtattccatccaaaggaacatactgctatcatagagaccaaggagggactgtttaaggttgccaaggtgaagcgagctgagaggctttgtcctcgtgccagtaactctgaaatctctcttaattcctgctgtccaggcagcagaatgccatggtttccccaagtaggtagctgctttagcagttaaagcccaaatgtctgttctgttgatcagaggtctctgaatttctgaagtggtgtttcgtttctggtgactgagttaatcctttacaatccctcttgtaaagtgtgctaatagaaagaatccacctttcaaagctgcagaaccagaccgtgccctaaattgaccaacgtagctgatgtgcctcaggaagtctcttgccagctgtccctgtgaagaccccctcctcccccccagctgctgccttgcacactgaagcatctcagactgtgcaaagccgtgtagtcatcaagacagtaaatcccagggcttggttaagtgctgtgtgataacttgtttggatgagacttaacttaaaaccacttacaataaacttgggaaactaccgtca

SEQ ID NO: 278614 - DNA, 3847 bp, Homo sapiens
  misc_feature (231)..(231): n is a, c, g, or t
  misc_feature (234)..(234): n is a, c, g, or t
  misc_feature (250)..(250): n is a, c, g, or t
ggcgcctgaggctgccgggtagcccagcaggccgagggaggaagtagcgtggagccggtgccgagccggggcgaagctggatcccctagatatactgtcttcaagctcactgatattttcctctgcttgatccattgtgctgttgagagcctctagtaaatttttcagactgacagaccaaggatgcagctgctactaccggaggtgtgtggcaccttacctcagcaaggnatnaaccgagtggccatgntacggccggaggtcggccgcgtggctggaagacatggccactccagtcggtgttgagcacggcgagcagtctcaggcctttagtgatgatggtaaggctgcctgggtgggaaaacggggtcttccttgacacgacactaacatacttggcttcccttcctcagagacgaagtggtgacgataatctcggtttctccctcatagggtggttaggagggttaaaagtactggatgagaaaatgctttccaaacgttgagaaaatgttactatgtgaagggagagagctcaagcccgtcctcggcgtcatagggccggcttctgcgggggagagcgcctaacaacctgggcagccccgtgcgcctccgccgcgcgtgtgctgagcgtcatgcccaggggtcttcggtgcccgcgcacgggcagactctgacgatggtggttcttaattcagcatcaggagtgttaacgtgtgaagacgtgattccgcttggagtgtcttgaggacggccccaatcggtagttcatatttagctttacagataggagtcaataggattgtaaacttctggaaagccgtagttttaacaacgagccttttttcctcccccagaggcctttctttgtttggcatctgcagagacggtgaaaagcagagctccaggttgaaggatcagagtaatagatggagcccttaacatgagtaagagtgggtgcaggcagggcctgagtggtcactagaaatgagaaagcacagttggtgccatcacatacattcacctcctgctttattctgaagttcaagtatgagaatacgtgttgacatacaagccagctatggtaagaaattactcaaaattcagaatgctaattattttaatgataaaaatgagtagcgtctttgcccgtgtgatttggggccactaggtgtcattgtaaccagcgtggatcctcgttagggcatgcagggatgaaagagacatggcaaatgaattttggatcgctaggatttaggaatctttgttattggctgagctgaggatgatttaaagttatccctgtctgaaatggtatcttttgtgaggaggtctgacttgctgaggctcagctgtttaatacaaatctggagaataaaccttaaggtggtttctgttagaatgaagcctgttatccttctcttttatgattaaaggtggtggctgtggccttgaaaacagtcatgtgaaaactcatcaccttaaggtgttaagtgtaaggatcttcatgatgaaatttctgtaaatggtgcagtcagcctcagtttccaaagccggaaaaggatcctctagtagccacggtgtggcagctgctctgaaccaggacctggacccggacccaaagtgccatgtctttaatgttagctcccagcgatgccagatgggatcagcacagccctgcctctgctgctaattgttcctctaaagtaatcgccatgcgttctttgggcttcatctttaaaggaatgaagcaactgagattattctggaaaaccttttggcagttagtgaaattagagtacaactaagaacattttcagacctccactgtggatgacctgggtataatctcacaaatcgatgggactgcaaggattgtaaactgaaatgaacatgattatactctgttggaagagcctaagaggaaactgatgccatgagtttcagagagtaatgcttaaccccagttacacaggatgccgtcttgtgtttcctcttgtttagttacccactacagtgattttgtgatctgctaatgggttgccacccacaaccattgctttagcacttttacttcaaatcaatgaaggattgataaaagttctcctggtgtctccgcagagtgccttccaggaacagatctttgcatagaatatcagtggtttccttttttgtttcaaatagtggtcagaaaatacccagtgttgactcaccaaggcaatcagcttcctttttccctttttttgtttttttttaacattttatatttttgctttattttattttattttattttttgagacggagttccactctgtcgccaggctggagtgaagtggtacaatcttggctcactgcaacctccacctcccgggttcaagcaattctcctggctcagcctcctgagtgctgggactacaggcgcgtaccttctttagtagagactgggtttcaccatgttggccaggatggtctctatctcctgaccttgtgatctgcctgcctcagcttcccaaagtgctgagatgacaggtgtgagccatcagacccagcatttttttttttaatttaaatttaaattttttttcatttttttgagaggttttttttgtttgtttggttgttgttgttgttgttgttgttgttgtttttgagacagtcttgctctgtcacccaggctgggagtgcagtggcatgatctctgcaacctctacctcccaggttcaagcaattcttgtgcctcagcctcccaagtaactgggactacaggtgcacgctaccacacctggctgatttttttttgttttagtagagacagggtttcaaccatgttgcccaggttggtctcaaactcctgagctcaggcaatccacccgccttggcctcccaaagtgctaggattacaggtgtgagccaccacacccagctattttttctttcgttttttaattttaaagttggggggggtctcaatttgttaccctggctggtctcgaactcccggacttaagcgatcctctggctccaagcccactaccagtctcaggtttctttactaaaagatcactacctttttttctcttatctgctgccatgtgagatgtggctttcaccttccgccatgattgtgaggccttcccagccacgtggaactgtaagtccaataaacctcttttgtaaattaaaaaaaaatcactatttaagatactaggatggattgtgactgttgaggagtacttacatatcctacatttgactacattatttccaaaccaagtattccatccaaaggaacatactgctatcatagagaccaaggagggactgtttaaggttgccaaggtgaagcgagctgagaggctttgtcctcgtgccagtaactctgaaatctctcttaattcctgctgtccaggcagcagaatgccatggtttccccaagtaggtagctgctttagcagttaaagcccaaatgtctgttctgttgatcagaggtctctgaatttctgaagtggtgtttcgtttctggtgactgagttaatcctttacaatccctcttgtaaagtgtgctaatagaaagaatccacctttcaaagctgcagaaccagaccgtgccctaaattgaccaacgtagctgatgtgcctcaggaagtctcttgccagctgtccctgtgaagaccccctcctcccccccagctgctgccttgcacactgaagcatctcagactgtgcaaagccgtgtagtcatcaagacagtaaatcccagggcttggttaagtgctgtgtgataacttgtttggatgagacttaacttaaaaccacttacaataaacttgggaaactaccgtca

SEQ ID NO: 278615 - DNA, 3127 bp, Homo sapiens
  misc_feature (231)..(231): n is a, c, g, or t
  misc_feature (234)..(234): n is a, c, g, or t
  misc_feature (250)..(250): n is a, c, g, or t
  misc_feature (2815)..(2815): n is a, c, g, or t
  misc_feature (2829)..(2829): n is a, c, g, or t
  misc_feature (2840)..(2840): n is a, c, g, or t
  misc_feature (2849)..(2849): n is a, c, g, or t
ggcgcctgaggctgccgggtagcccagcaggccgagggaggaagtagcgtggagccggtgccgagccggggcgaagctggatcccctagatatactgtcttcaagctcactgatattttcctctgcttgatccattgtgctgttgagagcctctagtaaatttttcagactgacagaccaaggatgcagctgctactaccggaggtgtgtggcaccttacctcagcaaggnatnaaccgagtggccatgntacggccggaggtcggccgcgtggctggaagacatggccactccagtcggtgttgagcacggcgagcagtctcaggcctttagtgatgatgattaaaggtggtggctgtggccttgaaaacagtcatgtgaaaactcatcaccttaaggtgttaagtgtaaggatcttcatgatgaaatttctgtaaatggtgcagtcagcctcagtttccaaagccggaaaaggatcctctagtagccacggtgtggcagctgctctgaaccaggacctggacccggacccaaagtgccatgtctttaatgttagctcccagcgatgccagatgggatcagcacagccctgcctctgctgctaattgttcctctaaagtaatcgccatgcgttctttgggcttcatctttaaaggaatgaagcaactgagattattctggaaaaccttttggcagttagtgaaattagagtacaactaagaacattttcagacctccactgtggatgacctgggtataatctcacaaatcgatgggactgcaaggattgtaaactgaaatgaacatgattatactctgttggaagagcctaagaggaaactgatgccatgagtttcagagagtaatgcttaaccccagttacacaggatgccgtcttgtgtttcctcttgtttagttacccactacagtgattttgtgatctgctaatgggttgccacccacaaccattgctttagcacttttacttcaaatcaatgaaggattgataaaagttctcctggtgtctccgcagagtgccttccaggaacagatctttgcatagaatatcagtggtttccttttttgtttcaaatagtggtcagaaaatacccagtgttgactcaccaaggcaatcagcttcctttttccctttttttgttttttttttaacattttatattttggctttattttattttattttattttataacattttatatttttgctttattttattttattttattttttgagacggagttccactctgtcgccaggctggagtgaagtggtacaatcttggctcactgcaacctccacctcccgggttcaagcaattctcctggctcagcctcctgagtgctgggactacaggcgcgtaccttctttagtagagactgggtttcaccatgttggccaggatggtctctatctcctgaccttgtgatctgcctgcctcagcttcccaaagtgctgagatgacaggtgtgagccatcagacccagcatttttttttttaatttaaatttaaattttttttcatttttttgagaggttttttttgtttgtttggttgttgttgttgttgttgttgttgttgtttttgagacagtcttgctctgtcacccaggctgggagtgcagtggcatgatctctgcaacctctacctcccaggttcaagcaattcttgtgcctcagcctcccaagtaactgggactacaggtgcacgctaccacacctggctgatttttttttgttttagtagagacagggtttcaaccatgttgcccaggttggtctcaaactcctgagctcaggcaatccacccgccttggcctcccaaagtgctaggattacaggtgtgagccaccacacccagctattttttctttcgttttttaattttaaagttggggggggtctcaatttgttaccctggctggtctcgaactcccggacttaagcgatcctctggctccaagcccactaccagtctcaggtttctttactaaaagatcactacctttttttctcttatctgctgccatgtgagatgtggctttcaccttccgccatgattgtgaggccttcccagccacgtggaactgtaagtccaataaacctcttttgtaaattaaaaaaaaatcactatttaagatactaggatggattgtgactgttgaggagtacttacatatcctacatttgactacattatttccaaaccaagtattccatccaaaggaacatactgctatcatagagaccaaggagggactgtttaaggttgccaaggtgaagcgagctgagaggctttgtcctcgtgccagtaactctgaaatctctcttaattcctgctgtccaggcagcagaatgccatggtttccccaagtaggtagctgctttagcagttaaagcccaaatgtctgttctgttgatcagaggtctctgaatttctgaagtggtgtttcgtttctggtgactgagttaatcctttacaatccctcttgtaaagtgtgctaatagaaagaatccacctttcaaagctgcagaaccagaccgtgccctaaattgaccaacgtagctgatgtgcctcaggaagtctcttgccagctgtccctgtgaagaccccctcctcccccccagctgctgccttgcacactgaagcatctcagactgtgcaaagccgtgtagtcatcaagacagtaaatcccagggcttggttaagtgctgtgtgataacttgtttggatgagacttaacttaaaaccacttacaataaacttgggaaactaccgtcaaaaaaaaaaaanaaaaaaaaaaaaanaaaaaaaaaanaaaaaaaanaaaaaaaaaaaaaaaaaaaaaaaggggggggcgccggtaatagatgtctctctccagcgagggggccccacatgtttacgcacgtaacccccaacactgcttttttcgtctcaaacaagggggcgccccactattagaggggggctcatctacatcctgagcacacgagccggtgccgctccttataaacaagcccccgtactacgggcgacaaacacgcccctacgcgtcgatatcttggtgacaacagcccgctctgtggggcggtagcacacacg

SEQ ID NO: 278616 - DNA, 2987 bp, Homo sapiens
  misc_feature (231)..(231): n is a, c, g, or t
  misc_feature (234)..(234): n is a, c, g, or t
  misc_feature (250)..(250): n is a, c, g, or t
ggcgcctgaggctgccgggtagcccagcaggccgagggaggaagtagcgtggagccggtgccgagccggggcgaagctggatcccctagatatactgtcttcaagctcactgatattttcctctgcttgatccattgtgctgttgagagcctctagtaaatttttcagactgacagaccaaggatgcagctgctactaccggaggtgtgtggcaccttacctcagcaaggnatnaaccgagtggccatgntacggccggaggtcggccgcgtggctggaagacatggccactccagtcggtgttgagcacggcgagcagtctcaggcctttagtgatgatgattaaaggtggtggctgtggccttgaaaacagtcatgtgaaaactcatcaccttaaggtgttaagtgtaaggatcttcatgatgaaatttctgtaaatggtgcagtcagcctcagtttccaaagccggaaaaggatcctctagtagccacggtgtggcagctgctctgaaccaggacctggacccggacccaaagtgccatgtctttaatgttagctcccagcgatgccagatgggatcagcacagccctgcctctgctgctaattgttcctctaaagtaatcgccatgcgttctttgggcttcatctttaaaggaatgaagcaactgagattattctggaaaaccttttggcagttagtgaaattagagtacaactaagaacattttcagacctccactgtggatgacctgggtataatctcacaaatcgatgggactgcaaggattgtaaactgaaatgaacatgattatactctgttggaagagcctaagaggaaactgatgccatgagtttcagagagtaatgcttaaccccagttacacaggatgccgtcttgtgtttcctcttgtttagttacccactacagtgattttgtgatctgctaatgggttgccacccacaaccattgctttagcacttttacttcaaatcaatgaaggattgataaaagttctcctggtgtctccgcagagtgccttccaggaacagatctttgcatagaatatcagtggtttccttttttgtttcaaatagtggtcagaaaatacccagtgttgactcaccaaggcaatcagcttcctttttccctttttttgttttttttttaacattttatattttggctttattttattttattttattttataacattttatatttttgctttattttattttattttattttttgagacggagttccactctgtcgccaggctggagtgaagtggtacaatcttggctcactgcaacctccacctcccgggttcaagcaattctcctggctcagcctcctgagtgctgggactacaggcgcgtaccttctttagtagagactgggtttcaccatgttggccaggatggtctctatctcctgaccttgtgatctgcctgcctcagcttcccaaagtgctgagatgacaggtgtgagccatcagacccagcatttttttttttaatttaaatttaaattttttttcatttttttgagaggttttttttgtttgtttggttgttgttgttgttgttgttgttgttgtttttgagacagtcttgctctgtcacccaggctgggagtgcagtggcatgatctctgcaacctctacctcccaggttcaagcaattcttgtgcctcagcctcccaagtaactgggactacaggtgcacgctaccacacctggctgatttttttttgttttagtagagacagggtttcaaccatgttgcccaggttggtctcaaactcctgagctcaggcaatccacccgccttggcctcccaaagtgctaggattacaggtgtgagccaccacacccagctattttttctttcgttttttaattttaaagttggggggggtctcaatttgttaccctggctggtctcgaactcccggacttaagcgatcctctggctccaagcccactaccagtctcaggtttctttactaaaagatcactacctttttttctcttatctgctgccatgtgagatgtggctttcaccttccgccatgattgtgaggccttcccagccacgtggaactgtaagtccaataaacctcttttgtaaattaaaaaaaaatcactatttaagatactaggatggattgtgactgttgaggagtacttacatatcctacatttgactacattatttccaaaccaagtattccatccaaaggaacatactgctatcatagagaccaaggagggactgtttaaggttgccaaggtgaagcgagctgagaggctttgtcctcgtgccagtaactctgaaatctctcttaattcctgctgtccaggcagcagaatgccatggtttccccaagtaggtagctgctttagcagttaaagcccaaatgtctgttctgttgatcagaggtctctgaatttctgaagtggtgtttcgtttctggtgactgagttaatcctttacaatccctcttgtaaagtgtgctaatagaaagaatccacctttcaaagctgcagaaccagaccgtgccctaaattgaccaacgtagctgatgtgcctcaggaagtctcttgccagctgtccctgtgaagaccccctcctcccccccagctgctgccttgcacactgaagcatctcagactgtgcaaagccgtgtagtcatcaagacagtaaatcccagggcttggttaagtcgctgtgtagataaccttgtttggattgagactttaagcttaaaagcactttaacaagtaaactgtgggaaaactaccgtcgaaaataaaaaaaagaataaaaaaaaaaaaaatcagggggattatatggggggggggaaaaaaaggattaagaaaaggacatggaaaaggtattaatggaacacgtttttagaaaaggggaaaatggggggcccataaggggaaataattaaaaaaaggactgtatggagtgga

SEQ ID NO: 278617 - DNA, 3315 bp, Homo sapiens
  misc_feature (231)..(231): n is a, c, g, or t
  misc_feature (234)..(234): n is a, c, g, or t
  misc_feature (250)..(250): n is a, c, g, or t
ggcgcctgaggctgccgggtagcccagcaggccgagggaggaagtagcgtggagccggtgccgagccggggcgaagctggatcccctagatatactgtcttcaagctcactgatattttcctctgcttgatccattgtgctgttgagagcctctagtaaatttttcagactgacagaccaaggatgcagctgctactaccggaggtgtgtggcaccttacctcagcaaggnatnaaccgagtggccatgntacggccggaggtcggccgcgtggctggaagacatggccactccagtcggtgttgagcacggcgagcagtctcaggcctttagtgatgatgattaaaggtggtggctgtggccttgaaaacagtcatgtgaaaactcatcaccttaaggtgttaagtgtaaggatcttcatgatgaaatttctgtaaatggtgcagtcagcctcagtttccaaagccggaaaaggatcctctagtagccacggtgtggcagctgctctgaaccaggacctggacccggacccaaagtgccatgtctttaatgttagctcccagcgatgccagatgggatcagcacagccctgcctctgctgctaattgttcctctaaagtaatcgccatgcgttctttgggcttcatctttaaaggaatgaagcaactgagattattctggaaaaccttttggcagttagtgaaattagagtacaactaagaacattttcagacctccactgtggatgacctgggtataatctcacaaatcgatgggactgcaaggattgtaaactgaaatgaacatgattatactctgttggaagagcctaagaggaaactgatgccatgagtttcagagagtaatgcttaaccccagttacacaggatgccgtcttgtgtttcctcttgtttagttacccactacagtgattttgtgatctgctaatgggttgccacccacaaccattgctttagcacttttacttcaaatcaatgaaggattgataaaagttctcctggtgtctccgcagagtgccttccaggaacagatctttgcatagaatatcagtggtttccttttttgtttcaaatagtggtcagaaaatacccagtgttgactcaccaaggcaatcagcttcctttttccctttttttgttttttttttaacattttatattttggctttattttattttattttattttataacattttatatttttgctttattttattttattttattttttgagacggagttccactctgtcgccaggctggagtgaagtggtacaatcttggctcactgcaacctccacctcccgggttcaagcaattctcctggctcagcctcctgagtgctgggactacaggcgcgtaccttctttagtagagactgggtttcaccatgttggccaggatggtctctatctcctgaccttgtgatctgcctgcctcagcttcccaaagtgctgagatgacaggtgtgagccatcagacccagcatttttttttttaatttaaatttaaattttttttcatttttttgagaggttttttttgtttgtttggttgttgttgttgttgttgttgttgttgtttttgagacagtcttgctctgtcacccaggctgggagtgcagtggcatgatctctgcaacctctacctcccaggttcaagcaattcttgtgcctcagcctcccaagtaactgggactacaggtgcacgctaccacacctggctgatttttttttgttttagtagagacagggtttcaaccatgttgcccaggttggtctcaaactcctgagctcaggcaatccacccgccttggcctcccaaagtgctaggattacaggtgtgagccaccacacccagctattttttctttcgttttttaattttaaagttggggggggtctcaatttgttaccctggctggtctcgaactcccggacttaagcgatcctctggctccaagcccactaccagtctcaggtttctttactaaaagatcactacctttttttctcttatctgctgccatgtgagatgtggctttcaccttccgccatgattgtgaggccttcccagccacgtggaactgtaagtccaataaacctcttttgtaaattaaaaaaaaatcactatttaagatactaggatggattgtgactgttgaggagtacttacatatcctacatttgactacattatttccaaaccaagtattccatccaaaggaacatactgctatcatagagaccaaggagggactgtttaaggttgccaaggtgaagcgagctgagaggctttgtcctcgtgccagtaactctgaaatctctcttaattcctgctgtccaggcagcagaatgccatggtttccccaagtaggtagctgctttagcagttaaagcccaaatgtctgttctgttgatcagaggtctctgaatttctgaagtggtgtttcgtttctggtgactgagttaatcctttacaatccctcttgtaaagtgtgctaatagaaagaatccacctttcaaagctgcagaaccagaccgtgccctaaattgaccaacgtagctgatgtgcctcaggaagtctcttgccagctgtccctgtgaagaccccctcctcccccccagctgctgccttgcacactgaagcatctcagactgtgcaaagccgtgtagtcatcaagacagtaaatcccagggcttggttaaaaaaaaaaaaaaaaaaaaaaaaaaaaaaaaaaaaaaaaaaaaaaccaagaaaaacaaaacagaggacagccaaccggcaaacaagcacgccacggaagacggtgcacagcccacacgacacccgacccaaggccaaaggaacacggcagcgcgcaaccaggaccgagtacatgtaacgaacaacgagcggacggacagccgacagagaggcgcgagagatacaaacaattgatccaggcaacactgggcaaagagaacacccatacgaccaggcagactcacaaaggccagcttcacaacagagtacaagacacgtcggcagacacataacaaacacgacgtaggaagaaacagcagcaccacttcgctagatgcagcgcgaagccaggctgtcgcgcacgaccgccgcacactaatatcacctgcgccaataaacactacgaactcccagcgccacccccacctactgcccgtagcgcgacgaagcaaacaccgtcgcagccagcagcagacaccgactcgcatgcgcaccgcaaccaggcgcgacccaccacaccacggtagaccaaacgcgaaccgaagctc

SEQ ID NO: 278618 - DNA, 2293 bp, Homo sapiens
  misc_feature (231)..(231): n is a, c, g, or t
  misc_feature (234)..(234): n is a, c, g, or t
  misc_feature (250)..(250): n is a, c, g, or t
ggcgcctgaggctgccgggtagcccagcaggccgagggaggaagtagcgtggagccggtgccgagccggggcgaagctggatcccctagatatactgtcttcaagctcactgatattttcctctgcttgatccattgtgctgttgagagcctctagtaaatttttcagactgacagaccaaggatgcagctgctactaccggaggtgtgtggcaccttacctcagcaaggnatnaaccgagtggccatgntacggccggaggtcggccgcgtggctggaagacatggccactccagtcggtgttgagcacggcgagcagtctcaggcctttagtgatgatgattaaaggtggtggctgtggccttgaaaacagtcatgtgaaaactcatcaccttaaggtgttaagtgtaaggatcttcatgatgaaatttctgtaaatggtgcagtcagcctcagtttccaaagccggaaaaggatcctctagtagccacggtgtggcagctgctctgaaccaggacctggacccggacccaaagtgccatgtctttaatgttagctcccagcgatgccagatgggatcagcacagccctgcctctgctgctaattgttcctctaaagtaatcgccatgcgttctttgggcttcatctttaaaggaatgaagcaactgagattattctggaaaaccttttggcagttagtgaaattagagtacaactaagaacattttcagacctccactgtggatgacctgggtataatctcacaaatcgatgggactgcaaggattgtaaactgaaatgaacatgattatactctgttggaagagcctaagaggaaactgatgccatgagtttcagagagtaatgcttaaccccagttacacaggatgccgtcttgtgtttcctcttgtttagttacccactacagtgaccttgtgatctgcctgcctcagcttcccaaagtgctgagatgacaggtgtgagccatcagacccagcatttttttttttaatttaaatttaaattttttttcatttttttgagaggttttttttgtttgtttggttgttgttgttgttgttgttgttgttgtttttgagacagtcttgctctgtcacccaggctgggagtgcagtggcatgatctctgcaacctctacctcccaggttcaagcaattcttgtgcctcagcctcccaagtaactgggactacaggtgcacgctaccacacctggctgatttttttttgttttagtagagacagggtttcaaccatgttgcccaggttggtctcaaactcctgagctcaggcaatccacccgccttggcctcccaaagtgctaggattacaggtgtgagccaccacacccagctattttttctttcgttttttaattttaaagttggggggggtctcaatttgttaccctggctggtctcgaactcccggacttaagcgatcctctggctccaagcccactaccagtctcaggtttctttactaaaagatcactacctttttttctcttatctgctgccatgtgagatgtggctttcaccttccgccatgattgtgaggccttcccagccacgtggaactgtaagtccaataaacctcttttgtaaattaaaaaaaaatcactatttaagatactaggatggattgtgactgttgaggagtacttacatatcctacatttgactacattatttccaaaccaagtattccatccaaaggaacatactgctatcatagagaccaaggagggactgtttaaggttgccaaggtgaagcgagctgagaggctttgtcctcgtgccagtaactctgaaatctctcttaattcctgctgtccaggcagcagaatgccatggtttccccaagtaggtagctgctttagcagttaaagcccaaatgtctgttctgttgatcagaggtctctgaatttctgaagtggtgtttcgtttctggtgactgagttaatcctttacaatccctcttgtaaagtgtgctaatagaaagaatccacctttcaaagctgcagaaccagaccgtgccctaaattgaccaacgtagctgatgtgcctcaggaagtctcttgccagctgtccctgtgaagaccccctcctcccccccagctgctgccttgcacactgaagcatctcagactgtgcaaagccgtgtagtcatcaagacagtaaatcccagggcttggttaagtgctgtgtgataacttgtttggatgagacttaacttaaaaccacttacaataaacttgggaaactaccgtca

SEQ ID NO: 278619 - DNA, 1752 bp, Homo sapiens
  misc_feature (231)..(231): n is a, c, g, or t
  misc_feature (234)..(234): n is a, c, g, or t
  misc_feature (250)..(250): n is a, c, g, or t
ggcgcctgaggctgccgggtagcccagcaggccgagggaggaagtagcgtggagccggtgccgagccggggcgaagctggatcccctagatatactgtcttcaagctcactgatattttcctctgcttgatccattgtgctgttgagagcctctagtaaatttttcagactgacagaccaaggatgcagctgctactaccggaggtgtgtggcaccttacctcagcaaggnatnaaccgagtggccatgntacggccggaggtcggccgcgtggctggaagacatggccactccagtcggtgttgagcacggcgagcagtctcaggcctttagtgatgactttagtagagactgggtttcaccatgttggccaggatggtctctatctcctgaccttgtgatctgcctgcctcagcttcccaaagtgctgagatgacaggtgtgagccatcagacccagcatttttttttttaatttaaatttaaattttttttcatttttttgagaggtttttttggtgttggtttggtggtggtgtggtggtggtggtggttttggagacagtcttgctctgtcacccaggctgggagtgcagtggcatgatctctgcaacctctacctcccaggttcaagcaattcttgtgcctcagcctcccaagtaactgggactacaggtgcacgctaccacacctggctgatttttttttgttttagtagagacagggtttcaaccatgttgcccaggttggtctcaaactcctgagctcaggcaatccacccgccttggcctcccaaagtgctaggattacaggtgtgagccaccacacccagctattttttctttcgttttttaattttaaagttggggggggtctcaatttgttaccctggctggtctcgaactcccggacttaagcgatcctctggctccaagcccactaccagtctcaggtttctttactaaaagatcactacctttttttctcttatctgctgccatgtgagatgtggctttcaccttccgccatgattgtgaggccttcccagccacgtggaactgtaagtccaataaacctcttttgtaaattaaaaaaaaatcactatttaagatactaggatggattgtgactgttgaggagtacttacatatcctacatttgactacattatttccaaaccaagtattccatccaaaggaacatactgctatcatagagaccaaggagggactgtttaaggttgccaaggtgaagcgagctgagaggctttgtcctcgtgccagtaactctgaaatctctcttaattcctgctgtccaggcagcagaatgccatggtttccccaagtaggtagctgctttagcagttaaagcccaaatgtctgttctgttgatcagaggtctctgaatttctgaagtggtgtttcgtttctggtgactgagttaatcctttacaatccctcttgtaaagtgtgctaatagaaagaatccacctttcaaagctgcagaaccagaccgtgccctaaattgaccaacgtagctgatgtgcctcaggaagtctcttgccagctgtccctgtgaagaccccctcctcccccccagctgctgccttgcacactgaagcatctcagactgtgcaaagccgtgtagtcatcaagacagtaaatcccagggcttggttaagtgctgtgtgataacttgtttggatgagacttaacttaaaaccacttacaataaacttgggaaactaccgtca

SEQ ID NO: 278620 - DNA, 2140 bp, Homo sapiens
  misc_feature (231)..(231): n is a, c, g, or t
  misc_feature (234)..(234): n is a, c, g, or t
  misc_feature (250)..(250): n is a, c, g, or t
ggcgcctgaggctgccgggtagcccagcaggccgagggaggaagtagcgtggagccggtgccgagccggggcgaagctggatcccctagatatactgtcttcaagctcactgatattttcctctgcttgatccattgtgctgttgagagcctctagtaaatttttcagactgacagaccaaggatgcagctgctactaccggaggtgtgtggcaccttacctcagcaaggnatnaaccgagtggccatgntacggccggaggtcggccgcgtggctggaagacatggccactccagtcggtgttgagcacggcgagcagtctcaggcctttagtgatgatgattaaaggtggtggctgtggccttgaaaacagtcatgtgaaaactcatcaccttaaggtgttaagtgtaaggatcttcatgatgaaatttctgtaaatggtgcagtcagcctcagtttccaaagccggaaaaggatcctctagtagccacggtgtggcagctgctctgaaccaggacctggacccggacccaaagtgccatgtctttaatgttagctcccagcgatgccagatgggatcagcacagccctgcctctgctgctaattgttcctctaaagtaatcgccatgcgttctttgggcttcatctttaaaggaatgaagcaactgagattattctggaaaaccttttggcagttagtgaaattagagtacaactaagaacattttcagacctccactgtggatgacctgggtataatctcacaaatcgatgggactgcaaggattgtaaactgaaatgaacatgattatactctgttggaagagcctaagaggaaactgatgccatgagtttcagagagtaatgcttaaccccagttacacaggatgccgtcttgtgtttcctcttgtttagttacccactacagtgattttgtgatctgctaatgggttgccacccacaaccattgctttagcacttttacttcaaatcaatgaaggattgataaaagttctcctggtgtctccgcagagtgccttccaggaacagatctttgcatagaatatcagtggtttccttttttgtttcaaatagtggtcagaaaatacccagtgttgactcaccaaggcaatcagcttcctttttccctttttttgttttttttttaacattttatattttggctttattttattttattttattttataacattttatatttttgctttattttattttattttattttttgagacggagttccactctgtcgccaggctggagtgaagtggtacaatcttggctcactgcaacctccacctcccgggttcaagcaattctcctggctcagcctcctgagtgctgggactacaggcgcgtaccttctttagtagagactgggtttcaccatgttggccaggatggtctctatctcctgaccttgtgatctgcctgcctcagcttcccaaagtgctgagatgacaggtgtgagccatcagacccagcatttttttttttaatttaaatttaaattttttttcatttttttgagaggttttttttgtttgtttggttgttgttgttgttgttgttgttgttgtttttgagacagtcttgctctgtcacccaggctgggagtgcagtggcatgatctctgcaacctctacctcccaggttcaagcaattcttgtgcctcagcctcccaagtaactgggactacaggtgcacgctaccacacctggctgatttttttttgttttagtagagacagggtttcaaccatgttgcccaggttggtctcaaactcctgagctcaggcaatccacccgccttggcctcccaaagtgctaggattacaggtgtgagccaccacacccagctattttttctttcgttttttaattttaaagttggggggggtctcaatttgttaccctggctggtctcgaactcccggacttaagcgatcctctggctccaagcccactaccagtctcaggtttctttactaaaagatcactacctttttttctcttatctgctgccatgtgagatgtggctttcaccttccgccatgattgtgaggccttcccagccacgtggaactgtaagtccaataaacctcttttgtaaatta

SEQ ID NO: 278621 - DNA, 1644 bp, Homo sapiens
  misc_feature (231)..(231): n is a, c, g, or t
  misc_feature (234)..(234): n is a, c, g, or t
  misc_feature (250)..(250): n is a, c, g, or t
ggcgcctgaggctgccgggtagcccagcaggccgagggaggaagtagcgtggagccggtgccgagccggggcgaagctggatcccctagatatactgtcttcaagctcactgatattttcctctgcttgatccattgtgctgttgagagcctctagtaaatttttcagactgacagaccaaggatgcagctgctactaccggaggtgtgtggcaccttacctcagcaaggnatnaaccgagtggccatgntacggccggaggtcggccgcgtggctggaagacatggccactccagtcggtgttgagcacggcgagcagtctcaggcctttagtgatgatggtgcagtcagcctcagtttccaaagccggaaaaggatcctctagtagccacggtgtggcagctgctctgaaccaggacctggacccggacccaaagtgccatgtctttaatgttagctcccagcgatgccagatgggatcagcacagccctgcctctgctgctaattgttcctctaaagtaatcgccatgcgttctttgggcttcatctttaaaggaatgaagcaactgagattattctggaaaaccttttggcagttagtgaaattagagtacaactaagaacattttcagacctccactgtggatgacctgggtataatctcacaaatcgatgggactgcaaggattgtaaactgaaatgaacatgattatactctgttggaagagcctaagaggaaactgatgccatgagtttcagagagtaatgcttaaccccagttacacaggatgccgtcttgtgtttcctcttgtttagttacccactacagctaccagtctcaggtttctttactaaaagatcactacctttttttctcttatctgctgccatgtgagatgtggctttcaccttccgccatgattgtgaggccttcccagccacgtggaactgtaagtccaataaacctcttttgtaaattaaaaaaaaatcactatttaagatactaggatggattgtgactgttgaggagtacttacatatcctacatttgactacattatttccaaaccaagtattccatccaaaggaacatactgctatcatagagaccaaggagggactgtttaaggttgccaaggtgaagcgagctgagaggctttgtcctcgtgccagtaactctgaaatctctcttaattcctgctgtccaggcagcagaatgccatggtttccccaagtaggtagctgctttagcagttaaagcccaaatgtctgttctgttgatcagaggtctctgaatttctgaagtggtgtttcgtttctggtgactgagttaatcctttacaatccctcttgtaaagtgtgctaatagaaagaatccacctttcaaagctgcagaaccagaccgtgccctaaattgaccaacgtagctgatgtgcctcaggaagtctcttgccagctgtccctgtgaagaccccctcctcccccccagctgctgccttgcacactgaagcatctcagactgtgcaaagccgtgtagtcatcaagacagtaaatcccagggcttggttaagtgctgtgtgataacttgtttggatgagacttaacttaaaaccacttacaataaacttgggaaactaccgtca

SEQ ID NO: 278622 - DNA, 916 bp, Homo sapiens
  misc_feature (231)..(231): n is a, c, g, or t
  misc_feature (234)..(234): n is a, c, g, or t
  misc_feature (250)..(250): n is a, c, g, or t
ggcgcctgaggctgccgggtagcccagcaggccgagggaggaagtagcgtggagccggtgccgagccggggcgaagctggatcccctagatatactgtcttcaagctcactgatattttcctctgcttgatccattgtgctgttgagagcctctagtaaatttttcagactgacagaccaaggatgcagctgctactaccggaggtgtgtggcaccttacctcagcaaggnatnaaccgagtggccatgntacggccggaggtcggccgcgtggctggaagacatggccactccagtcggtgttgagcacggcgagcagtctcaggcctttagtgatgatggtgcagtcagcctcagtttccaaagccggaaaaggatcctctagtagccacggtgtggcagctgctctgaaccaggacctggacccggacccaaagtgccatgtctttaatgttagctcccagcgatgccagatgggatcagcacagccctgcctctgctgctaattgttcctctaaagtaatcgccatgcgttctttgggcttcatctttaaaggaatgaagcaactgagattattctggaaaaccttttggcagttagtgaaattagagtacaactaagaacattttcagacctccactgtggatgacctgggtataatctcacaaatcgatgggactgcaaggattgtaaactgaaatgaacatgattatactctgttggaagagcctaagaggaaactgatgccatgagtttcagagagtaatgcttaaccccagttacacaggatgccgtcttgtgtttcctcttgtttagttacccactacagtgattttgtgatctgctaatgggttgccacccacaaccattgctttagcacttttacttcaaatcaatgaaggattgataaaagtt

SEQ ID NO: 278623 - DNA, 1146 bp, Homo sapiens
  misc_feature (231)..(231): n is a, c, g, or t
  misc_feature (234)..(234): n is a, c, g, or t
  misc_feature (250)..(250): n is a, c, g, or t
ggcgcctgaggctgccgggtagcccagcaggccgagggaggaagtagcgtggagccggtgccgagccggggcgaagctggatcccctagatatactgtcttcaagctcactgatattttcctctgcttgatccattgtgctgttgagagcctctagtaaatttttcagactgacagaccaaggatgcagctgctactaccggaggtgtgtggcaccttacctcagcaaggnatnaaccgagtggccatgntacggccggaggtcggccgcgtggctggaagacatggccactccagtcggtgttgagcacggcgagcagtctcaggcctttagtgatgatggtgcagtcagcctcagtttccaaagccggaaaaggatcctctagtagccacggtgtggcagctgctctgaaccaggacctggacccggacccaaagtgccatgtctttaatgttagctcccagcgatgccagatgggatcagcacagccctgcctctgctgctaattgttcctctaaagtaatcgccatgcgttctttgggcttcatctttaaaggaatgaagcaactgagattattctggaaaaccttttggcagttagtgaaattagagtacaactaagaacattttcagacctccactgtggatgacctgggtataatctcacaaatcgatgggactgcaaggattgtaaactgaaatgaacatgattatactctgtaaaaaaacacaagaacaaaaaagaaaaaagaaaaagaaaaataggaaaaaaaaaaagaaacggggggggcattattggggggggggggaaaaagggtataagaaggggggggggtaaaggtgtgttcggcggccccctttttttgtcacaagggggggaaaagggggggccccagaagggagggcactaaaggttcagaagaagcggatttagctttttttttgggtggaaaaaatgataacacaaagaggtcaacgatcataaaaaagggagcagagaggaaaaaaagaggagggaaacaaaagtgaacaagaaattacaaagcacgaagttcatttattagagtttgatagattgatgtagtgaaaagtaaatagagatgaagaagagaagaatgatatgtggaaacagagtaagtgtctttg

SEQ ID NO: 278624 - DNA, 762 bp, Homo sapiens
aatgctgtgcagctagttttcttcatgaagttctaaattactcactgcttcttttcttggtattattatcttaactttttttagagcttatccttctaaactttaaaaaataaacatgaatattcaaaaataagtataattaaatgctcttatgctaaatatttgtacttaaattattttaattattattttgtaacatacttccctttcccttatttaataatacgtctttccagattaaaatatggagatctacataattttgaatgagtgtataatttcccattgcttgtttgctccataatgtttctttatttatttatttattttgagacagagtcgcttgaacctgggaggcggagcttgcagtgagccgagatcgcaccactgcactccagcctgggcaacagagtgagactgtctcaaaaaaaaaaaaaaaaaaaaaaaaaaaaaaatttactgggtatctgtttcactttgtaggtcatcagaagattgagagaaagaggagaaccaatcagactatttggagagactgattatgatgcttttcaacgtttaaggaaaatagagatcctcacaccagaagttaacaagagtctcactccgtcacctacgctggaatgcggtggcataatcatggctcatggcagctgcaacctcctgggcttaagcagtcctcccacctcagcctctcaagtagctgggattacaggcgctttttgttcattttaaaaataaacttgtctttttgtaaatgga

SEQ ID NO: 278625 - DNA, 1533 bp, Homo sapiens
tctctctcatcccagcttccgccggaagcggctcctgtcagttgttctcaggtgtttgggcttgttgttccgtatactcagtgggttcgcggccgccggcccagtgaggctgggttcgaggagctggagcgggaaactggagcttaaattctggcggcgagatggacattctgaaatcagagatccttcggaagcggcagctggtggaggacaggaacctgctggtggaaaataaaaaatatttcaagcgtagtgagctcgccaaaaaagaagaggaagcatattttgaaagatgtggctacaagatacagccaaaagaggaggaccagaaaccattaacttcatcgaatccagtgttagaacttgaactggcagaggaaaaattacctatgacgctttctaggcaagaggtcatcagaagattgagagaaagaggagaaccaatcagactatttggagagactgattatgatgcttttcaacgtttaaggaaaatagagatcctcacaccagaagttaacaagggattgaggaatgatttgaaagcagccttggataagattgatcagcagtacctcaatgaaatcgtcggcggtcaggagcctggagaggaagacacacagaatgatctgaaagttcatgaggaaaacaccacaattgaagagttagaggcgcttggagagtccttagggaaaggcgatgatcataaggacatggacatcatcaccaaattcctgaagtttcttcttggcgtttgggctaaagaattgaatgccagagaagattatgtgaaacgcagtgtgcagggtaaactgaacagtgcgacccagaaacagaccgagtcctacctaagaccactttttagaaagctacggaaaaggaatcttcctgctgatattaaagaatcaataacggatattattaaattcatgttgcagagagaatacgtgaaggcaaatgatgcttatcttcagatggccattggaaatgcgccttggcccatcggtgtcactatggttggtatccatgccagaactggcagagaaaagattttttccaagcatgttgcacatgttttaaatgacgaaactcagcggaaatatattcagggattgaagaggttaatgaccatttgccagaaacactttcctacagacccatccaaatgtgtggagtacaatgcactgtgagatctgtgtatggtgtgttaataacaataagaaacttagggaagcaggctgtggacttctggaattaccaacaggaatgaggaaagaagaaaactggagtttccagtctctgagttctacctgatgtaactcttgattggttttaagaactttgttggccttcatttcatatctgactgcaagctgatttttctttcttgctttcattttaattagtccaaaattaagttttaaagatttttcctcacaatttaaatccatagacaacagaagggggtttaaaatgacctttttttcagttgacccgaaagttgtggttagatgattaaaaagaaacatttga

SEQ ID NO: 278626 - DNA, 1514 bp, Homo sapiens
  misc_feature (330)..(330): n is a, c, g, or t
tctctctcatcccagcttccgccggaagcggctcctgtcagttgttctcaggtgtttgggcttgttgttccgtatactcagtgggttcgcggccgccggcccagtgaggctgggttcgaggagctggagcgggaaactggagcttaaattctggcggcgagatggacattctgaaatcagagatccttcggaagcggcagctggtggaggacaggaacctgctggtggcaaatgatgcttatcttcagatggccattggaaatgcgccttggcccatcggtgtcactatgtgaagttgacacaaaattaaccatcacagctgccttcctntgggcctcatgttatatgagaacagtattgggtgtacacttaaagcgttctgggaatatgaatcccttctgcaccctggaatcaccagtccagccatgcatggagctggggaaagcaggccctgaattgtctagagagacttggtggaggaagccacggcccgccttgtccctgcgggtcccggccaggtgtgtgtgtgccccagctcgactctcggtggtctccaggctgcagcagaaggaataccttgggccctgtgctaatcacgagtctttcctgttcggagcagtgaggcctgagaccctcaacagtgctgtgtgtacagaaggcccccagaatccacacaaaggggccgcctgaaacctagagcatttgtgaaggaggaaaatggaaggaacaactggatgttgtaaatgtttctcatctggccttaaaatccatgaaagctggaaaatcacaaggcatctgtgcatatactggtggattttaatgagagtcctgtgtttggagcaccagaaataaaccagcttcagaagcaaagatctgaacgtctatgacactctttcgagctgacacagtgaagaacatagaaggagaactcacccagtctgccagggtcacagaatgatcatactcaagatcttcctggggagtcaatggcaaatttcactgggctattttacagatgaagaaggaacataaagaaggttctgggaccccgaagtccacggaacacccaccattacctgatctttggagcttgtcatttggccagtggaccctaataaacgtccacggggatgtggggatagaatgccggagcctggctcgctagggcatccaggttcttccttcctctttgccctgctgtctccaggcaccaagaatctcctacagttccccaaagatgaaccccccattatctcaggtcactctgtttcccccgatctttaccaaattcctgactcagagttcctcccatttgcttctgactctcattttattcttacctctcattttattcttatgatgtttaccatttctcttctcctcagtgtccctctctgagtggtaagagtatgttaataagccagtgctgagaccggagcacgaggcaactgctcaatgttggtcattgtcactgttattaaatgtaacttaagggaatgagtggtttcttcctt

SEQ ID NO: 278627 - DNA, 1172 bp, Homo sapiens
gctgtatgcaaacatgtcaagctatcaaagggagctgcctttcggtttcattaattttgttgtgtgcagcttccactgaaggcttcagggcacctgatctcttttgtgtgttgagaaagagcaagtgcttggccaggacacagccctttttcttgcaccctgagacatcctaagacactggctgtttcacctgccccagtgtatttgctgtcttcatcagctctctttctccccctgacattcttgcctggcattttgagtcagcctgagtataatccaaaccgaaatgaaatgctgtctggaaatcttaccaaagaagcacagtcccacttcgtgcttccatctccccacatcccaaggaccaccgcctactttaagagaacacagacaattcacctctataaaggcacagccaggaaaaggagtaggcagaggtgacagcagatcatggggcttctcttgaaaggaagacacctcccagtgatgaaccctcatcatccatttactgacatatccttatgtcaccaggatctgaacgtctatgacactctttcgagctgacacagtgaagaacatagaaggagaactcacccagtctgccagggtcacagaatgatcatactcaagatcttcctggggagtcaatggcaaatttcactgggctattttacagatgaagaaggaacataaagaaggttctgggaccccgaagtccacggaacacccaccattacctgatctttggagcttgtcatttggccagtggaccctaataaacgtccacggggatgtggggatagaatgccggagcctggctcgctagggcatccaggttcttccttcctctttgccctgctgtctccaggcaccaagaatctcctacagttccccaaagatgaaccccccattatctcaggtcactctgtttcccccgatctttaccaaattcctgactcagagttcctcccatttgcttctgactctcattttattcttacctctcattttattcttatgatgtttaccatttctcttctcctcagtgtccctctctgagtggtaagagtatgttaataagccagtgctgagaccggagcacgaggcaactgctcaatgttggtcattgtcactgttattaaatgtaacttaagggaatgagtggtttcttcctt

SEQ ID NO: 278628 - DNA, 1931 bp, Homo sapiens
ttttttttttaagtattttaggtaggtatcaccatttaggttgggtagaagtaattcttaaatcttaagaagcaatcatagatatgtggaagccaatagtcattactagggatcatgattcggaaaaacagcctctcttcaatgatcctgaatgagccctttgaattcctctcctgcaactgatctccccatggggagtggtgagggatgggtgacaggaagggaccctaacccaaagtagttcagagcgggtgagttttaggagcatttcggtaccaaacacagcttcacgattgagaatcatcagtcatccccagctttctatttcatttgctaacctctctaggaacaactggatgttgtaaatgtttctcatctggccttaaaatccatgaaagctggaaaatcacaaggcatctgtgcatatactggtggattttaatgagagtcctgtgtttggagcaccagaaataaaccagcttcagaagcaaagtaagaaaaggcccttgattatgacactggccatgggtattactatatgtaggtggtatgtggatgattctgggacacctgtcctgcaaactttgtctccaccctaagctgacttttgacattgtgcctgactgaaaaacttctaatgggagaggtggttgggccttgcaggggtcctatgtttttcttagggggacagtctctccctaactccacgtggtcctggtggtgctctccaccatggcgccatcctcactcccgtgggggccaggggacaaggaacccaacggggccgggccaatgagagtcccccgatcaaaatccctggttcaaaggtggccacgtgcctgagcagctttgaaaccacaaggatgtcatttcctcctgagaactaggttaacaggaggaggaagcagagctagagatggaaggagacccagccagcccgggctccagtgacatcggctggtacacgcttttgtttgcttacgcttgttgaactgagtttttcatatgtaactaacgaatactggcacatgtaagtagtttcttaaactgttgatgaaatttttgtttctaacacaaacatgatctgggtctgtttgggataaaacttccctaaggggtttcatgagatcttaggaacacttagccagtgtttcccaaagtagtcctgtgagttgctctgaggggaaaaaaagcttccatggataaataaatttgaggattctgcctttcagaggcctgaaatgtaaatgtatatgaaacatatattaaaggttctgagaagtcctggattagtttgccacagaacttctggaacagtatcacctattaacatccacagaacacactttgaaaaatactcttaaatgggctaatattatgaaatgtagttgactctcttgtatgttggatcctaaacagtttctggttgaaactattaaagttgagtcataattgtgacaacataatctgcttcagagggactaaaagtgcactatgtattgatcataaaggctcaagaaagaccattgagttcaaagcagtgatgtttggatcaggcagtagatgaggttaagggttcctgtggtggtttatttggtatgtgaagagcctaactgttggctggcccatggtgttctcctgtggttcattatggaggcttctgggtcacagaacccacatatgagagggcatcgggaggatctggatgatggggtgggagatgctggattggtggtttggttctcaggtggctcctagaggagccgcagtatggaaaccactggcctgctcctgcctctgagaaaatgaagctggaggaaaagatgtaaagatgtattttttccaaacttgcgatgttttatacagaatctttcttagtgcttccacatagttattgaagtacgtaaggtatttttaaagctataaatgtt

SEQ ID NO: 278629 - DNA, 339 bp, Homo sapiens
tctctctcatcccagcttccgccggaagcggctcctgtcagttgttctcaggtgtttgggcttgttgttccgtatactcagtgggttcgcggccgccggcccagtgaggctgggttcgaggagctggagcgggaaactggagcttaaattctggcggcgagatggacattctgaaatcagagatccttcggaagcggcagctggtggaggacaggaacctgctggtggtgaggaccctgcggtcgtgggggtcgggatgtaagagtgagagtatgtgatggtctgaagctacatgcacagaattcccatcagctgtatcatggctagttctatgtttac

SEQ ID NO: 278630 - DNA, 1724 bp, Homo sapiens
tctctctcatcccagcttccgccggaagcggctcctgtcagttgttctcaggtgtttgggcttgttgttccgtatactcagtgggttcgcggccgccggcccagtgaggctgggttcgaggagctggagcgggaaactggagcttaaattctggcggcgagatggacattctgaaatcagagatccttcggaagcggcagctggtggaggacaggaacctgctggtggaaaataaaaaatatttcaagcgtagtgagctcgccaaaaaagaagaggaagcatattttgaaagatgtggctacaagatacagccaaaagaggaggaccagaaaccattaacttcatcgaatccagtgttagaacttgaactggcagaggaaaaattacctatgacgctttctaggcaagaggtcatcagaagattgagagaaagaggagaaccaatcagactatttggagagactgattatgatgcttttcaacgtttaaggaaaatagagatcctcacaccagaagttaacaagggattgaggaatgatttgaaagcagccttggataagattgatcagcagtacctcaatgaaatcgtcggcggtcaggagcctggagaggaagacacacagaatgatctgaaagttcatgaggaaaacaccacaattgaagagttagaggcgcttggagagtccttagggaaaggcgatgatcataaggacatggacatcatcaccaaattcctgaagtttcttcttggcgtttgggctaaagaattgaatgccagagaagattatgtgaaacgcagtgtgcagggtaaactgaacagtgcgacccagaaacagaccgagtcctacctaagaccactttttagaaagctacggaaaaggaatcttcctgctgatattaaagaatcaataacggatattattaaattcatgttgcagagagaatacgtgaaggcaaatgatgcttatcttcagatggccattggaaatgcgccttggcccatcggtgtcactatggttggtatccatgccagaactggcagagaaaagattttttccaagcatgttgcacatgttttaaatgacgaaactcagcggaaatatattcagggattgaagaggttaatgaccatttgccagaaacactttcctacagacccatccaaatgtgtggagtacaatgcactgtgagatctgtgtatggtgtgttaataacaataagaaacttagggaagcaggctgtggacttctggaattaccaacaggaatgaggaaagaagaaaactggagtttccagtctctgagttctacctgatgtaactcttgattggttttaagaactttgttggccttcatttcatatctgactgcaagctgatttttctttcttgctttcattttaattagtccaaaattaagttttaaagatttttcctcacaatttaaatccatagacaacagaagggggtttaaaatgacctttttttcagttgacccgaaagttgtggttagatgattaaaaagaaacatttgaggatggacttaattatttcagtaaaatattataatttgcctattgtcttttatgtaatatttatataaaatatttttatatatttcaaaaacatgggaccattgaatgaaactttatagtccttaaatgttgctgaacttttgctgtcttgcaatagaatttgaatgtaaatattattactggtaaaaaaa

SEQ ID NO: 278631 - DNA, 1630 bp, Homo sapiens
tctctctcatcccagcttccgccggaagcggctcctgtcagttgttctcaggtgtttgggcttgttgttccgtatactcagtgggttcgcggccgccggcccagtgaggctgggttcgaggagctggagcgggaaactggagcttaaattctggcggcgagatggacattctgaaatcagagatccttcggaagcggcagctggtggaggacaggaacctgctggtggaaaataaaaaatatttcaagcgtagtgagctcgccaaaaaagaagaggaagcatattttgaaagatgtggctacaagatacagccaaaagaggaggaccagaaaccattaacttcatcgaatccagtgttagaacttgaactggcagaggaaaaattacctatgacgctttctaggcaagaggtcatcagaagattgagagaaagaggagaaccaatcagactatttggagagactgattatgatgcttttcaacgtttaaggaaaatagagatcctcacaccagaagttaacaagggattgaggaatgatttgaaagcagccttggataagattgatcagcagtacctcaatgaaatcgtcggcggtcaggagcctggagaggaagacacacagaatgatctgaaagttcatgaggaaaacaccacaattgaagagttagaggcgcttggagagtccttagggaaaggcgatgatcataaggacatggacatcatcaccaaattcctgaagtttcttcttggcgtttgggctaaagaattgaatgccagagaagattatgtgaaacgcagtgtgcagggtaaactgaacagtgcgacccagaaacagaccgagtcctacctaagaccactttttagaaagctacggaaaaggaatcttcctgctgatattaaagaatcaataacggatattattaaattcatgttgcagagagaatacgtgaaggcaaatgatgcttatcttcagatggccattggaaatgcgccttggcccatcggtgtcactatggttggtatccatgccagaactggcagagaaaagattttttccaagcatgttgcacatgttttaaatgacgaaactcagcggaaatatattcagggattgaagaggttaatgaccatttgccagaaacactttcctacagacccatccaaatgtgtggagtacaatgcactgtgagatctgtgtatggtgtgttaataacaataagaaacttagggaagcaggctgtggacttctggaattaccaacaggaatgaggaaagaagaaaactggagtttccagtctctgagttctacctgatgtaactcttgattggttttaagaactttgttggccttcatttcatatctgactgcaagctgatttttctttcttgctttcattttaattagtccaaaattaagttttaaagatttttcctcacaatttaaatccatagacaacagaagggggtttaaaatgacctttttttcagttgacccgaaagttgtggttagatgattaaaaagaaacatttgaggatggacttaattatttcagtaaaatattataatttgcaaaaagacaaaaaacaaaacaaaacaaacaaaagaacatgtgtgtgtgcgcgcgcgcg

SEQ ID NO: 278632 - DNA, 1583 bp, Homo sapiens
tctctctcatcccagcttccgccggaagcggctcctgtcagttgttctcaggtgtttgggcttgttgttccgtatactcagtgggttcgcggccgccggcccagtgaggctgggttcgaggagctggagcgggaaactggagcttaaattctggcggcgagatggacattctgaaatcagagatccttcggaagcggcagctggtggaggacaggaacctgctggtggaaaataaaaaatatttcaagcgtagtgagctcgccaaaaaagaagaggaagcatattttgaaagatgtggctacaagatacagccaaaagaggaggaccagaaaccattaacttcatcgaatccagtgttagaacttgaactggcagaggaaaaattacctatgacgctttctaggcaagaggtcatcagaagattgagagaaagaggagaaccaatcagactatttggagagactgattatgatgcttttcaacgtttaaggaaaatagagatcctcacaccagaagttaacaagggattgaggaatgatttgaaagcagccttggataagattgatcagcagtacctcaatgaaatcgtcggcggtcaggagcctggagaggaagacacacagaatgatctgaaagttcatgaggaaaacaccacaattgaagagttagaggcgcttggagagtccttagggaaaggcgatgatcataaggacatggacatcatcaccaaattcctgaagaatcttcctgctgatattaaagaatcaataacggatattattaaattcatgttgcagagagaatacgtgaaggcaaatgatgcttatcttcagatggccattggaaatgcgccttggcccatcggtgtcactatggttggtatccatgccagaactggcagagaaaagattttttccaagcatgttgcacatgttttaaatgacgaaactcagcggaaatatattcagggattgaagaggttaatgaccatttgccagaaacactttcctacagacccatccaaatgtgtggagtacaatgcactgtgagatctgtgtatggtgtgttaataacaataagaaacttagggaagcaggctgtggacttctggaattaccaacaggaatgaggaaagaagaaaactggagtttccagtctctgagttctacctgatgtaactcttgattggttttaagaactttgttggccttcatttcatatctgactgcaagctgatttttctttcttgctttcattttaattagtccaaaattaagttttaaagatttttcctcacaatttaaatccatagacaacagaagggggtttaaaatgacctttttttcagttgacccgaaagttgtggttagatgattaaaaagaaacatttgaggatggacttaattatttcagtaaaatattataatttgcctattgtcttttatgtaatatttatataaaatatttttatatatttcaaaaacatgggaccattgaatgaaactttatagtccttaaatgttgctgaacttttgctgtcttgcaatagaatttgaatgtaaatattattactggtaaaaaaa

SEQ ID NO: 278633 - DNA, 2240 bp, Homo sapiens
  misc_feature (1056)..(1056): n is a, c, g, or t
tctctctcatcccagcttccgccggaagcggctcctgtcagttgttctcaggtgtttgggcttgttgttccgtatactcagtgggttcgcggccgccggcccagtgaggctgggttcgaggagctggagcgggaaactggagcttaaattctggcggcgagatggacattctgaaatcagagatccttcggaagcggcagctggtggaggacaggaacctgctggtggaaaataaaaaatatttcaagcgtagtgagctcgccaaaaaagaagaggaagcatattttgaaagatgtggctacaagatacagccaaaagaggaggaccagaaaccattaacttcatcgaatccagtgttagaacttgaactggcagaggaaaaattacctatgacgctttctaggcaagaggtcatcagaagattgagagaaagaggagaaccaatcagactatttggagagactgattatgatgcttttcaacgtttaaggaaaatagagatcctcacaccagaagttaacaagggattgaggaatgatttgaaagcagccttggataagattgatcagcagtacctcaatgaaatcgtcggcggtcaggagcctggagaggaagacacacagaatgatctgaaagttcatgaggaaaacaccacaattgaagagttagaggcgcttggagagtccttagggaaaggcgatgatcataaggacatggacatcatcaccaaattcctgaagtttcttcttggcgtttgggctaaagaattgaatgccagagaagattatgtgaaacgcagtgtgcagggtaaactgaacagtgcgacccagaaacagaccgagtcctacctaagaccactttttagaaagctacggaaaaggaatcttcctgctgatattaaagaatcaataacggatattattaaattcatgttgcagagagaatacgtgaaggcaaatgatgcttatcttcagatggccattggaaatgcgccttggcccatcggtgtcactatgtgaagttgacacaaaattaaccatcacagctgccttcctntgggcctcatgttatatgagaacagtattgggtgtacacttaaagcgttctgggaatatgaatcccttctgcaccctggaatcaccagtccagccatgcatggagctggggaaagcaggccctgaattgtctagagagacttggtggaggaagccacggcccgccttgtccctgcgggtcccggccaggtgtgtgtgtgccccagctcgactctcggtggtctccaggctgcagcagaaggaataccttgggccctgtgctaatcacgagtctttcctgttcggagcagtgaggcctgagaccctcaacagtgctgtgtgtacagaaggcccccagaatccacacaaaggggccgcctgaaacctagagcatttgtgaaggaggaaaatggaaggaacaactggatgttgtaaatgtttctcatctggccttaaaatccatgaaagctggaaaatcacaaggcatctgtgcatatactggtggattttaatgagagtcctgtgtttggagcaccagaaataaaccagcttcagaagcaaagatctgaacgtctatgacactctttcgagctgacacagtgaagaacatagaaggagaactcacccagtctgccagggtcacagaatgatcatactcaagatcttcctggggagtcaatggcaaatttcactgggctattttacagatgaagaaggaacataaagaaggttctgggaccccgaagtccacggaacacccaccattacctgatctttggagcttgtcatttggccagtggaccctaataaacgtccacggggatgtggggatagaatgccggagcctggctcgctagggcatccaggttcttccttcctctttgccctgctgtctccaggcaccaagaatctcctacagttccccaaagatgaaccccccattatctcaggtcactctgtttcccccgatctttaccaaattcctgactcagagttcctcccatttgcttctgactctcattttattcttacctctcattttattcttatgatgtttaccatttctcttctcctcagtgtccctctctgagtggtaagagtatgttaataagccagtgctgagaccggagcacgaggcaactgctcaatgttggtcattgtcactgttattaaatgtaacttaagggaatgagtggtttcttcctt

SEQ ID NO: 278634 - DNA, 1845 bp, Homo sapiens
tctctctcatcccagcttccgccggaagcggctcctgtcagttgttctcaggtgtttgggcttgttgttccgtatactcagtgggttcgcggccgccggcccagtgaggctgggttcgaggagctggagcgggaaactggagcttaaattctggcggcgagatggacattctgaaatcagagatccttcggaagcggcagctggtggaggacaggaacctgctggtgaggaactcgattgaggaccagaggtccagtcacaagtaacaagccactagccaggtgcttcaggaagaccgccctcttgcctctgtggaatccagtgaggatgatcagaacgttccccggggaaaataaaaaatatttcaagcgtagtgagctcgccaaaaaagaagaggaagcatattttgaaagatgtggctacaagatacagccaaaagaggaggaccagaaaccattaacttcatcgaatccagtgttagaacttgaactggcagaggaaaaattacctatgacgctttctaggcaagaggtcatcagaagattgagagaaagaggagaaccaatcagactatttggagagactgattatgatgcttttcaacgtttaaggaaaatagagatcctcacaccagaagttaacaagggattgaggaatgatttgaaagcagccttggataagattgatcagcagtacctcaatgaaatcgtcggcggtcaggagcctggagaggaagacacacagaatgatctgaaagttcatgaggaaaacaccacaattgaagagttagaggcgcttggagagtccttagggaaaggcgatgatcataaggacatggacatcatcaccaaattcctgaagtttcttcttggcgtttgggctaaagaattgaatgccagagaagattatgtgaaacgcagtgtgcagggtaaactgaacagtgcgacccagaaacagaccgagtcctacctaagaccactttttagaaagctacggaaaaggaatcttcctgctgatattaaagaatcaataacggatattattaaattcatgttgcagagagaatacgtgaaggcaaatgatgcttatcttcagatggccattggaaatgcgccttggcccatcggtgtcactatggttggtatccatgccagaactggcagagaaaagattttttccaagcatgttgcacatgttttaaatgacgaaactcagcggaaatatattcagggattgaagaggttaatgaccatttgccagaaacactttcctacagacccatccaaatgtgtggagtacaatgcactgtgagatctgtgtatggtgtgttaataacaataagaaacttagggaagcaggctgtggacttctggaattaccaacaggaatgaggaaagaagaaaactggagtttccagtctctgagttctacctgatgtaactcttgattggttttaagaactttgttggccttcatttcatatctgactgcaagctgatttttctttcttgctttcattttaattagtccaaaattaagttttaaagatttttcctcacaatttaaatccatagacaacagaagggggtttaaaatgacctttttttcagttgacccgaaagttgtggttagatgattaaaaagaaacatttgaggatggacttaattatttcagtaaaatattataatttgcctattgtcttttatgtaatatttatataaaatatttttatatatttcaaaaacatgggaccattgaatgaaactttatagtccttaaatgttgctgaacttttgctgtcttgcaatagaatttgaatgtaaatattattactggtaaaaaaa

SEQ ID NO: 278635 - DNA, 1872 bp, Homo sapiens
tctctctcatcccagcttccgccggaagcggctcctgtcagttgttctcaggtgtttgggcttgttgttccgtatactcagtgggttcgcggccgccggcccagtgaggctgggttcgaggagctggagcgggaaactggagcttaaattctggcggcgagatggacattctgaaatcagagatccttcggaagcggcagctggtggaggacaggaacctgctggtgaggaactcgattgaggaccagaggtccagtcacaagtaacaagccactagccaggtgcttcaggaagaccgccctcttgcctctgtggaatccagtgaggatgatcagaacgttccccggggaaaataaaaaatatttcaagcgtagtgagctcgccaaaaaagaagaggaagcatattttgaaagatgtggctacaagcctataaatgagaagccatctggagagatacagccaaaagaggaggaccagaaaccattaacttcatcgaatccagtgttagaacttgaactggcagaggaaaaattacctatgacgctttctaggcaagaggtcatcagaagattgagagaaagaggagaaccaatcagactatttggagagactgattatgatgcttttcaacgtttaaggaaaatagagatcctcacaccagaagttaacaagggattgaggaatgatttgaaagcagccttggataagattgatcagcagtacctcaatgaaatcgtcggcggtcaggagcctggagaggaagacacacagaatgatctgaaagttcatgaggaaaacaccacaattgaagagttagaggcgcttggagagtccttagggaaaggcgatgatcataaggacatggacatcatcaccaaattcctgaagtttcttcttggcgtttgggctaaagaattgaatgccagagaagattatgtgaaacgcagtgtgcagggtaaactgaacagtgcgacccagaaacagaccgagtcctacctaagaccactttttagaaagctacggaaaaggaatcttcctgctgatattaaagaatcaataacggatattattaaattcatgttgcagagagaatacgtgaaggcaaatgatgcttatcttcagatggccattggaaatgcgccttggcccatcggtgtcactatggttggtatccatgccagaactggcagagaaaagattttttccaagcatgttgcacatgttttaaatgacgaaactcagcggaaatatattcagggattgaagaggttaatgaccatttgccagaaacactttcctacagacccatccaaatgtgtggagtacaatgcactgtgagatctgtgtatggtgtgttaataacaataagaaacttagggaagcaggctgtggacttctggaattaccaacaggaatgaggaaagaagaaaactggagtttccagtctctgagttctacctgatgtaactcttgattggttttaagaactttgttggccttcatttcatatctgactgcaagctgatttttctttcttgctttcattttaattagtccaaaattaagttttaaagatttttcctcacaatttaaatccatagacaacagaagggggtttaaaatgacctttttttcagttgacccgaaagttgtggttagatgattaaaaagaaacatttgaggatggacttaattatttcagtaaaatattataatttgcctattgtcttttatgtaatatttatataaaatatttttatatatttcaaaaacatgggaccattgaatgaaactttatagtccttaaatgttgctgaacttttgctgtcttgcaatagaatttgaatgtaaatattattactggtaaaaaaa

SEQ ID NO: 278636 - DNA, 1670 bp, Homo sapiens
tctctctcatcccagcttccgccggaagcggctcctgtcagttgttctcaggtgtttgggcttgttgttccgtatactcagtgggttcgcggccgccggcccagtgaggctgggttcgaggagctggagcgggaaactggagcttaaattctggcggcgagatggacattctgaaatcagagatccttcggaagcggcagctggtggaggacaggaacctgctggtggaaaataaaaaatatttcaagcgtagtgagctcgccaaaaaagaagaggaagcatattttgaaagatgtggctacaagatacagccaaaagaggaggaccagaaaccattaacttcatcgaatccagtgttagaacttgaactggcagaggaaaaattacctatgacgctttctaggcaagaggtcatcagaagattgagagaaagaggagaaccaatcagactatttggagagactgattatgatgcttttcaacgtttaaggacagccttggataagattgatcagcagtacctcaatgaaatcgtcggcggtcaggagcctggagaggaagacacacagaatgatctgaaagttcatgaggaaaacaccacaattgaagagttagaggcgcttggagagtccttagggaaaggcgatgatcataaggacatggacatcatcaccaaattcctgaagtttcttcttggcgtttgggctaaagaattgaatgccagagaagattatgtgaaacgcagtgtgcagggtaaactgaacagtgcgacccagaaacagaccgagtcctacctaagaccactttttagaaagctacggaaaaggaatcttcctgctgatattaaagaatcaataacggatattattaaattcatgttgcagagagaatacgtgaaggcaaatgatgcttatcttcagatggccattggaaatgcgccttggcccatcggtgtcactatggttggtatccatgccagaactggcagagaaaagattttttccaagcatgttgcacatgttttaaatgacgaaactcagcggaaatatattcagggattgaagaggttaatgaccatttgccagaaacactttcctacagacccatccaaatgtgtggagtacaatgcactgtgagatctgtgtatggtgtgttaataacaataagaaacttagggaagcaggctgtggacttctggaattaccaacaggaatgaggaaagaagaaaactggagtttccagtctctgagttctacctgatgtaactcttgattggttttaagaactttgttggccttcatttcatatctgactgcaagctgatttttctttcttgctttcattttaattagtccaaaattaagttttaaagatttttcctcacaatttaaatccatagacaacagaagggggtttaaaatgacctttttttcagttgacccgaaagttgtggttagatgattaaaaagaaacatttgaggatggacttaattatttcagtaaaatattataatttgcctattgtcttttatgtaatatttatataaaatatttttatatatttcaaaaacatgggaccattgaatgaaactttatagtccttaaatgttgctgaacttttgctgtcttgcaatagaatttgaatgtaaatattattactggtaaaaaaa

SEQ ID NO: 278637 - DNA, 1538 bp, Homo sapiens
  misc_feature (1056)..(1056): n is a, c, g, or t
tctctctcatcccagcttccgccggaagcggctcctgtcagttgttctcaggtgtttgggcttgttgttccgtatactcagtgggttcgcggccgccggcccagtgaggctgggttcgaggagctggagcgggaaactggagcttaaattctggcggcgagatggacattctgaaatcagagatccttcggaagcggcagctggtggaggacaggaacctgctggtggaaaataaaaaatatttcaagcgtagtgagctcgccaaaaaagaagaggaagcatattttgaaagatgtggctacaagatacagccaaaagaggaggaccagaaaccattaacttcatcgaatccagtgttagaacttgaactggcagaggaaaaattacctatgacgctttctaggcaagaggtcatcagaagattgagagaaagaggagaaccaatcagactatttggagagactgattatgatgcttttcaacgtttaaggaaaatagagatcctcacaccagaagttaacaagggattgaggaatgatttgaaagcagccttggataagattgatcagcagtacctcaatgaaatcgtcggcggtcaggagcctggagaggaagacacacagaatgatctgaaagttcatgaggaaaacaccacaattgaagagttagaggcgcttggagagtccttagggaaaggcgatgatcataaggacatggacatcatcaccaaattcctgaagtttcttcttggcgtttgggctaaagaattgaatgccagagaagattatgtgaaacgcagtgtgcagggtaaactgaacagtgcgacccagaaacagaccgagtcctacctaagaccactttttagaaagctacggaaaaggaatcttcctgctgatattaaagaatcaataacggatattattaaattcatgttgcagagagaatacgtgaaggcaaatgatgcttatcttcagatggccattggaaatgcgccttggcccatcggtgtcactatgtgaagttgacacaaaattaaccatcacagctgccttcctntgggcctcatgttatatgagaacagtattgggtgtacacttaaagcgttctgggaatatgaatcccttctgcaccctggaatcaccagtccagccatgcatggagctggggaaagcaggccctgaattgtctagagagacttggtggaggaagccacggcccgccttgtccctgcgggtcccggccaggtgtgtgtgtgccccagctcgactctcggtggtctccaggctgcagcagaaggaataccttggtatttgtttcattttagtgtccatccttacccttctggtctggtagagcctatggttattcttggattccacatacatgaaaagcgaagatttttctttgtttttatgcttaagctaacttcagttctgctttcccacaaaactacccccaccctggctcctgtccctggctgtcaatgcctttccaataggaagtcattagagtgagaaaaaaattccacccccacccca

SEQ ID NO: 278638 - DNA, 3035 bp, Homo sapiens
  misc_feature (1056)..(1056): n is a, c, g, or t
tctctctcatcccagcttccgccggaagcggctcctgtcagttgttctcaggtgtttgggcttgttgttccgtatactcagtgggttcgcggccgccggcccagtgaggctgggttcgaggagctggagcgggaaactggagcttaaattctggcggcgagatggacattctgaaatcagagatccttcggaagcggcagctggtggaggacaggaacctgctggtggaaaataaaaaatatttcaagcgtagtgagctcgccaaaaaagaagaggaagcatattttgaaagatgtggctacaagatacagccaaaagaggaggaccagaaaccattaacttcatcgaatccagtgttagaacttgaactggcagaggaaaaattacctatgacgctttctaggcaagaggtcatcagaagattgagagaaagaggagaaccaatcagactatttggagagactgattatgatgcttttcaacgtttaaggaaaatagagatcctcacaccagaagttaacaagggattgaggaatgatttgaaagcagccttggataagattgatcagcagtacctcaatgaaatcgtcggcggtcaggagcctggagaggaagacacacagaatgatctgaaagttcatgaggaaaacaccacaattgaagagttagaggcgcttggagagtccttagggaaaggcgatgatcataaggacatggacatcatcaccaaattcctgaagtttcttcttggcgtttgggctaaagaattgaatgccagagaagattatgtgaaacgcagtgtgcagggtaaactgaacagtgcgacccagaaacagaccgagtcctacctaagaccactttttagaaagctacggaaaaggaatcttcctgctgatattaaagaatcaataacggatattattaaattcatgttgcagagagaatacgtgaaggcaaatgatgcttatcttcagatggccattggaaatgcgccttggcccatcggtgtcactatgtgaagttgacacaaaattaaccatcacagctgccttcctntgggcctcatgttatatgagaacagtattgggtgtacacttaaagcgttctgggaatatgaatcccttctgcaccctggaatcaccagtccagccatgcatggagctggggaaagcaggccctgaattgtctagagagacttggtggaggaagccacggcccgccttgtccctgcgggtcccggccaggtgtgtgtgtgccccagctcgactctcggtggtctccaggctgcagcagaaggaataccttgggccctgtgctaatcacgagtctttcctgttcggagcagtgaggcctgagaccctcaacagtgctgtgtgtacagaaggcccccagaatccacacaaaggggccgcctgaaacctagagcatttgtgaaggaggaaaatggaaggaacaactggatgttgtaaatgtttctcatctggccttaaaatccatgaaagctggaaaatcacaaggcatctgtgcatatactggtggattttaatgagagtcctgtgtttggagcaccagaaataaaccagcttcagaagcaaagtaagaaaaggcccttgattatgacactggccatgggtattactatatgtaggtggtatgtggatgattctgggacacctgtcctgcaaactttgtctccaccctaagctgacttttgacattgtgcctgactgaaaaacttctaatgggagaggtggttgggccttgcaggggtcctatgtttttcttagggggacagtctctccctaactccacgtggtcctggtggtgctctccaccatggcgccatcctcactcccgtgggggccaggggacaaggaacccaacggggccgggccaatgagagtcccccgatcaaaatccctggttcaaaggtggccacgtgcctgagcagctttgaaaccacaaggatgtcatttcctcctgagaactaggttaacaggaggaggaagcagagctagagatggaaggagacccagccagcccgggctccagtgacatcggctggtacacgcttttgtttgcttacgcttgttgaactgagtttttcatatgtaactaacgaatactggcacatgtaagtagtttcttaaactgttgatgaaatttttgtttctaacacaaacatgatctgggtctgtttgggataaaacttccctaaggggtttcatgagatcttaggaacacttagccagtgtttcccaaagtagtcctgtgagttgctctgaggggaaaaaaagcttccatggataaataaatttgaggattctgcctttcagaggcctgaaatgtaaatgtatatgaaacatatattaaaggttctgagaagtcctggattagtttgccacagaacttctggaacagtatcacctattaacatccacagaacacactttgaaaaatactcttaaatgggctaatattatgaaatgtagttgactctcttgtatgttggatcctaaacagtttctggttgaaactattaaagttgagtcataattgtgacaacataatctgcttcagagggactaaaagtgcactatgtattgatcataaaggctcaagaaagaccattgagttcaaagcagtgatgtttggatcaggcagtagatgaggttaagggttcctgtggtggtttatttggtatgtgaagagcctaactgttggctggcccatggtgttctcctgtggttcattatggaggcttctgggtcacagaacccacatatgagagggcatcgggaggatctggatgatggggtgggagatgctggattggtggtttggttctcaggtggctcctagaggagccgcagtatggaaaccactggcctgctcctgcctctgagaaaatgaagctggaggaaaagatgtaaagatgtattttttccaaacttgcgatgttttatacagaatctttcttagtgcttccacatagttattgaagtacgtaaggtatttttaaagctataaatgtt

SEQ ID NO: 278639 - DNA, 1392 bp, Homo sapiens
tctctctcatcccagcttccgccggaagcggctcctgtcagttgttctcaggtgtttgggcttgttgttccgtatactcagtgggttcgcggccgccggcccagtgaggctgggttcgaggagctggagcgggaaactggagcttaaattctggcggcgagatggacattctgaaatcagagatccttcggaagcggcagctggtggaggacaggaacctgctggtggaaaataaaaaatatttcaagcgtagtgagctcgccaaaaaagaagaggaagcatattttgaaagatgtggctacaagatacagccaaaagaggaggaccagaaaccattaacttcatcgaatccagtgttagaacttgaactggcagaggaaaaattacctatgacgctttctaggcaagaggtcatcagaagattgagagaaagaggagaaccaatcagactatttggagagactgattatgatgcttttcaacgtttaaggaaaatagagatcctcacaccagaagttaacaagggattgaggaatgatttgaaagcagccttggataagattgatcagcagtacctcaatgaaatcgtcggcggtcaggagcctggagaggaagacacacagaatgatctgaaagttcatgaggaaaacaccacaattgaagagttagaggcgcttggagagtccttagggaaaggcgatgatcataaggacatggacatcatcaccaaattcctgaagaatcttcctgctgatattaaagaatcaataacggatattattaaattcatgttgcagagagaatacgtgaaggcaaatgatgcttatcttcagatggccattggaaatgcgccttggcccatcggtgtcactatggttggtatccatgccagaactggcagagaaaagattttttccaagcatgttgcacatgttttaaatgacgaaactcagcggaaatatattcagggattgaagaggttaatgaccatttgccagaaacactttcctacagacccatccaaatgtgtggagtacaatgcactgtgagatctgtgtatggtgtgttaataacaataagaaacttagggaagcaggctgtggacttctggaattaccaacaggaatgaggaaagaagaaaactggagtttccagtctctgagttctacctgatgtaactcttgattggttttaagaactttgttggccttcatttcatatctgactgcaagctgatttttctttcttgctttcattttaattagtccaaaattaagttttaaagatttttcctcacaatttaaatccatagacaacagaagggggtttaaaatgacctttttttcagttgacccgaaagttgtggttagatgattaaaaagaaacatttga

SEQ ID NO: 278640 - DNA, 992 bp, Homo sapiens
  misc_feature (899)..(899): n is a, c, g, or t
  misc_feature (948)..(948): n is a, c, g, or t
  misc_feature (992)..(992): n is a, c, g, or t
tctctctcatcccagcttccgccggaagcggctcctgtcagttgttctcaggtgtttgggcttgttgttccgtatactcagtgggttcgcggccgccggcccagtgaggctgggttcgaggagctggagcgggaaactggagcttaaattctggcggcgagatggacattctgaaatcagagatccttcggaagcggcagctggtggaggacaggaacctgctggtggaaaataaaaaatatttcaagcgtagtgagctcgccaaaaaagaagaggaagcatattttgaaagatgtggctacaagatacagccaaaagaggaggaccagaaaccattaacttcatcgaatccagtgttagaacttgaactggcagaggaaaaattacctatgacgctttctaggcaagaggtcatcagaagattgagagaaagaggagaaccaatcagactatttggagagactgattatgatgcttttcaacgtttaaggaaaatagagatcctcacaccagaagttaacaagggattgaggaatgatttgaaagcagccttggataagattgatcagcagtacctcaatgaaatcgtcggcggtcaggagcctggagaggaagacacacagaatgatctgaaagttcatgaggaaaacaccacaattgaagagttagaggcgcttggagagtccttagggaaaggcgatgatcataaggacatggacatcatcaccaaattcctgaagtttcttcttggcgtttgggctaaagaattgaatgccagagaagattatgtgaaacgcagtgtgcagggtaaactgaacagtgcgacccagaaacagaccgagtcctacctaagaccactttttagaaagctacggaaaaggaatcttcctgctgatatntaaagaaatccaaaaattttaaaaaaaaaaccccccggggggggggggnaaaaaattttaaaaaaatttttcttttacagatggccattggan

SEQ ID NO: 278641 - DNA, 975 bp, Homo sapiens
cagccaggcctgcactgagaaggatatgttcaccttgacagggccctgtgctaatcacgagtctttcctgttcggagcagtgaggcctgagaccctcaacagtgctgtgtgtacagaaggcccccagaatccacacaaaggggccgcctgaaacctagagcatttgtgaaggaggaaaatggaaggaacaactggatgttgtaaatgtttctcatctggccttaaaatccatgaaagctggaaaatcacaaggcatctgtgcatatactggtggattttaatgagagtcctgtgtttggagcaccagaaataaaccagcttcagaagcaaagatctgaacgtctatgacactctttcgagctgacacagtgaagaacatagaaggagaactcacccagtctgccagggtcacagaatgatcatactcaagatcttcctggggagtcaatggcaaatttcactgggctattttacagatgaagaaggaacataaagaaggttctgggaccccgaagtccacggaacacccaccattacctgatctttggagcttgtcatttggccagtggaccctaataaacgtccacggggatgtggggatagaatgccggagcctggctcgctagggcatccaggttcttccttcctctttgccctgctgtctccaggcaccaagaatctcctacagttccccaaagatgaaccccccattatctcaggtcactctgtttcccccgatctttaccaaattcctgactcagagttcctcccatttgcttctgactctcattttattcttacctctcattttattcttatgatgtttaccatttctcttctcctcagtgtccctctctgagtggtaagagtatgttaataagccagtgctgagaccggagcacgaggcaactgctcaatgttggtcattgtcactgttattaaatgtaacttaagggaatgagtggtttcttcctt

SEQ ID NO: 278642 - DNA, 460 bp, Homo sapiens
  misc_feature (172)..(172): n is a, c, g, or t
tgcccatatgcactgagaagggccatgtgtttactcggtctaccaattcaaatgttaatctcatccaaaaacaccctcacagatacctttggaatgatgtttaaccaaatatttgggtaccgtcttccccagtgaagttgacacaaaattaaccatcacagctgccttcctntgggcctcatgttatatgagaacagtattgggtaagttgggtttccattatattctgctgaactcagtccccaagcaatgtatgcattactcaaacttcttgaccttcaaaatcatcaagtgacttgtggcaagtgtgccatggtgctgaggtctttgttcatttcgactggaataaaatcggactttgccacatcctcctaagataaaatagatgtgagagcatttacttgaagtggttctgtggatgttggtacattgtgatttcagttacagaaaagccacagat

SEQ ID NO: 278643 - DNA, 257 bp, Homo sapiens
ggttactatagaggatcccgcactgtggtcaggatgccgtgggcgcagccactcaggactgtcaaagggctcagtgctgtcagagagggactacgagagcctcgtcatgatgcgcatgcgccaggcggccgagcggcaacagctgatcgcacggatgcagcaggaagaccaggaggggccgcctacgtagccccagctccagccatccacccctcagcccttttcttcaacgtcaccaataaatttttttttttttt

SEQ ID NO: 278644 - DNA, 1240 bp, Homo sapiens
tgctgggatgacaggcgtgagccaccgcaccggccaatcataatcttttaaatgagtctccccgttgatggggatcttggctggctagtatcaacagtgttgtagagagcatccttgtatatttatttttgccatacttctacaagtccagattcctaggacttgggtcaaagggaaagaacattttaaattttgatggctgaattttcttccagataggttgccccagtttatatgcccaccaagaatgtgtagagtacctgtcttcgagtggctgtcgagaaagcggggtactgtgctcctgcctgttgcagcagcccctggacatctgcagtggtaaagaaggcgtataggcagaaggccctctcctgccacccagacaaaaatccagataatcccagagcagctgaactcttccaccagctttctcaggccttggaggtgctgaccgatgctgcagccagggctgcatatgacaaggtcaggaaagccaagaagcaagcagcagagaggacccagaaacttgatgagaaaaggaagaaagtgaagcttgacctggaggcccgggagcggcaggcccaggcccaggagagtgaggaggaagaggagagccggagcaccaggacactagagcaagagatcgaacgcctgagagaagagggttcccggcagctggaggaacagcagaggctcatccgggagcagatacgccaggagcgtgaccagaggttgagaggaaaggcagaaaatactgaaggccaaggaacccccaaactaaagctaaaatggaagtgcaagaaggaggatgagtcaaaaggtggctactccaaagacgtcctcctacggcttttgcagaagtatggtgaggttctcaacctggtgctttccagtaagaagccaggcactgctgtggtggagtttgcaaccgtcaaggcagcggagctggctgtccagaatgaagttggcctggtggataaccctctgaagatttcctggttggagggacagccccaggatgccgtgggccgcagccactcaggactgtcaaagggctcagtgctgtcagagagggactacgagagcctcgtcatgatgcgcatgcgccaggcggccgagcggcaacagctgatcgcacggatgcagcaggaagaccaggaggggccgcctacgtagccccagctccagccatccacccctcagcccttttcttcaacgtcaccaataaatttttttttttttt

SEQ ID NO: 278645 - DNA, 1303 bp, Homo sapiens
tgctgggatgacaggcgtgagccaccgcaccggccaatcataatcttttaaatgagtctccccgttgatggggatcttggctggctagtatcaacagtgttgtagagagcatccttgtatatttatttttgccatacttctacaagtccagattcctaggacttgggtcaaagggaaagaacattttaaattttgatggctgaattttcttccagataggttgccccagtttatatgcccaccaagaatgtgtagagtacctgtcttcgagtggctgtcgagaaagcggggtactgtgctcctgcctgttgcagcagcccctggacatctgcagtggtaaagaaggcgtataggcagaaggccctctcctgccacccagacaaaaatccagataatcccagagcagctgaactcttccaccagctttctcaggccttggaggtgctgaccgatgctgcagccagggctgcatatgacaaggtcaggaaagccaagaagcaagcagcagagaggacccagaaacttgatgagaaaaggaagaaagtgaagcttgacctggaggcccgggagcggcaggcccaggcccaggagagtgaggaggaagaggagagccggagcaccaggacactagagcaagagatcgaacgcctgagagaagagggttcccggcagctggaggaacagcagaggctcatccgggagcagatacgccaggagcgtgaccagaggttgagaggaaaggcagaaaatactgaaggccaaggaacccccaaactaaagctaaaatggaagtgcaagaaggaggatgagtcaaaaggtggctactccaaagacgtcctcctacggcttttgcagaaggtcggccctgttgacgtccactctttcctatcatctcagtccacgtctcagtccacaccctagtatggtgaggttctcaacctggtgctttccagtaagaagccaggcactgctgtggtggagtttgcaaccgtcaaggcagcggagctggctgtccagaatgaagttggcctggtggataaccctctgaagatttcctggttggagggacagccccaggatgccgtgggccgcagccactcaggactgtcaaagggctcagtgctgtcagagagggactacgagagcctcgtcatgatgcgcatgcgccaggcggccgagcggcaacagctgatcgcacggatgcagcaggaagaccaggaggggccgcctacgtagccccagctccagccatccacccctcagcccttttcttcaacgtcaccaataaatttttttttttttt

SEQ ID NO: 278646 - DNA, 1022 bp, Homo sapiens
tcttgggagttgtagtacgaggatccgtcaggccggaaccatggcagtgaccaaggagctcttacagatggacctgtacgcgctgctaggcattgaggagaaggcagcggacaaagaggtaaagaaggcgtataggcagaaggccctctcctgccacccagacaaaaatccagataatcccagagcagctgaactcttccaccagctttctcaggccttggaggtgctgaccgatgctgcagccagggctgcatatgacaaggtcaggaaagccaagaagcaagcagcagagaggacccagaaacttgatgagaaaaggaagaaagtgaagcttgacctggaggcccgggagcggcaggcccaggcccaggagagtgaggaggaagaggagagccggagcaccaggacactagagcaagagatcgaacgcctgagagaagagggttcccggcagctggaggaacagcagaggctcatccgggagcagatacgccaggagcgtgaccagaggttgagaggaaaggcagaaaatactgaaggccaaggaacccccaaactaaagctaaaatggaagtgcaagaaggaggatgagtcaaaaggtggctactccaaagacgtcctcctacggcttttgcagaagtatggtgaggttctcaacctggtgctttccagtaagaagccaggcactgctgtggtggagtttgcaaccgtcaaggcagcggagctggctgtccagaatgaagttggcctggtggataaccctctgaagatttcctggttggagggacagccccaggatgccgtgggccgcagccactcaggactgtcaaagggctcagtgctgtcagagagggactacgagagcctcgtcatgatgcgcatgcgccaggcggccgagcggcaacagctgatcgcacggatgcagcaggaagaccaggaggggccgcctacgtagccccagctccagccatccacccctcagcccttttcttcaacgtcaccaataaatttttttttttttt

SEQ ID NO: 278647 - DNA, 1096 bp, Homo sapiens
tcttgggagttgtagtacgaggatccgtcaggccggaaccatggcagtgaccaaggagctcttacagatggacctgtacgcgctgctaggcattgaggagaaggcagcggacaaagaggtaaagaaggcgtataggcagaaggccctctcctgccacccagacaaaaatccagataatcccagagcagctgaactcttccaccagctttctcaggccttggaggtgctgaccgatgctgcagccagggctgcatatgacaaggtcaggaaagccaagaagcaagcagcagagaggacccagaaacttgatgagaaaaggaagaaagtgaagcttgacctggaggcccgggagcggcaggcccaggcccaggagagtgaggaggaagaggagagccggagcaccaggacactagagcaagagatcgaacgcctgagagaagagggttcccggcagctggaggaacagcagaggctcatccgggagcagatacgccaggagcgtgaccagaggttgagaggaaaggcagaaaatactgaaggccaaggaacccccaaactaaagctaaaatggaagtgcaagaaggaggatgagtcaaaaggtggctactccaaagacgtcctcctacggcttttgcagaagtatggtgaggttctcaacctggtgctttccagtaagaagccaggcactgctgtggtggagtttgcaaccgtcaaggcagcggagctggctgtccagaatgaagttggcctggtggataaccctctgaagatttcctggttggagggacagccccaggatgccgtgggccgcagccactcaggactgtcaaagggctcagtgctgtcagagagggactacgagagcctcgtcatgatgcgcatgcgccaggcggccgagcggcaacagctgatcgcacggatgcagcaggaagaccaggaggggccgcctacgtagccccagctccagccatccacccctcagcccttttcttcaacgtcaccaataaattttttttttttttttttttttttttttttttttttttttttttgttttttttttttttgtggtggggggggggggggtggggagatg

SEQ ID NO: 278648 - DNA, 5449 bp, Homo sapiens
caacgtcatcgcggggcgccgcggcgccgggcggggagcggcggacggtctaggcggggctggaggcggtggctgcggttgcgggaccgggagatggctgcgatttagttttgaggatgctacaggcagcagcagggctggcaccctgtgtcacaggcactatgctgggccttcctaccacttgtgtgtggcttggtagtggcctagggtctctcctccctgctgaagtccctctcctgcaggtggccgtctgcccggcccagcaccatgcacacgcttgtgttcttgagcacacggcaggtgctgcagtgccagccagctgcctgccaggccctgcccctgctgccacgcgaactcttccccctgctgttcaaggtggccttcatggacaagaagacagtggtactgcgcgagttggtacacacgtggcccttcccgctgctcagtttccagcagctgctacaggagtgtgcccactgcagccgtgccctcctgcaggagcggcctagcactgagagcatgcaggctgttatcctggggctgactgcccggctccacacctcagagcctggggccagcacacagcccctctgcaggaagcatgcgctgcgggtgctggacatgacgggcctcttggatgatggtgtggaacaggatcctggcaccatgagcatgtgggactgtactgctgccgtagctcgcacatgcattgcccagcagcagggtggggccgcagagcctgggccagcccccatccccgtggaggtgcgcgtggacctgcgggtgaaccgggcctcctatgcgttcctgcgggaggcactccgaagcagcgtgggcagcccgctgcggctctgctgccgggacctgcgagctgaggacctgcccatgcgcaacactgtggccctgctgcagcttctggatgcaggctgcctgcgccgcgtggacctgcgcttcaacaatctgggcctgcgcggcctgtctgtgatcatcccacacgtggcccgcttccagcacctggccagcctgcggctccactatgtgcatggggattcaaggcagccctccgtggatggcgaggacaacttccgctacttccttgcccagatgggccgcttcacctgtctgcgtgagctcagcatgggctcctctctcctttcagggaggctggaccagctgctcagcaccctgcagagccccctggagagcctggagttggccttctgtgctctgctgcctgaggacctacgcttcctggcacggagcccacatgctgcccacctcaagaagttggacctgagtggtaacgacctgtctggcagccagctggcacccttccagggtctgttgcaggcatcagcagccacactgttgcatctggagctgactgagtgtcagctcgcagacacccagctgttggccacactacccatcctgactcagtgcgccagtctccggtaccttggcctctatggcaacccactgtccatggcgggcctcaaggagctgctgcgggactcagtggcacaggctgagctgcgtactgtggtgcaccccttccctgtggactgctatgagggcttgccctggccgccgcctgcctctgtcctgctggaggcctccatcaatgaggagaagtttgcccgcgtagaagctgagttgcaccagctgcttctagcctcaggccgtgcccatgtgctctggaccacggacatctacgggcgactggctgcggactacttcagcctatgatgaagtagctctgggtgagacacaggccgccctgcagtctctttaggtaggcagggcctttgctgggacccctggtggaggccttcacaaaagcactggttactggtttcctgctgggtctaccttgcttctgggcacacctcaagcctcccctgctttctgcagtgccccacgcggttttccctgcacttgctccataattggctgatcatctgtgggccccggggctggatgtcaggcctccattgccctgctcagtttggctgcatttggctgccgtctggggtcctggtcctttgtgcaaatgctttgggattccagttgtgagctgagagagatgatggcctctctgggcctttcctctccctttactgagagctcagtgcttctggggttgaagttggacagaggcctgcttcagggaagctgggagtccccaggcactcacgcctcttacgtgttccctaccctgccacccagccaccccactgggctgggctcgggctggagggggtcatcaaggtacacatgtgcctggaagttgaatttgtggctgtttttttttctgtccacgttggtcacccttatccttatctctgctgtcacccccaacatggccaccgggcaacaactgccatccagcctgtcgccccgcccttcgcggggcagccccgtcggcactgccggccagtccttgctcttcccacctttcggaggcccaagatcctactgtggccggccagggccagcgagggaccccccccatgcagagctggaggttggggtgatgtcttttcggaagagcttcaagggaggtgttggggcctccccggccaccttccattgctaccccaggattcccgagtgcaacgttcccggctcgcgccccacacacggctcagcgcacactgcgcggcttccacctttactgacggagcatgcgcgaggccgcaccggccaatctccggcgcccacgtcatccgcgcgcccgcggccctagcagtggatctcgtaggcgaccggcgggggcacgcggagtcccggccccgccccctgttccgggccgcagtcagcgggcgcctccgccggaccctcggcgaagagcggcttggagcggttgatgacgaacatctcgtggccgcgctcgtcgcggagctcctctagctgtgcgaacgtacaggggccgtccaagtagtcgttgacgaacagcgctccctcccccggaggcccccgcgccttttttcgcctgcggcgccggcgacagatcatggcgaccaggagcagcgccgtgagcgccagcagcgcgatggccgccgcaatggccgtctgtgtggccacgcccagggcgcggaaggccatgctgcccgcctcgggccggggctcgctgccggcggggcgggcggccggaggcggcggttgcgcgggctgctgcggctgctgccgggacgcgttgaccaggagccggaagggcacgcgggcagcgccgccggcgttggaggcctcgcactcgtacttaccggcgtgcgccagcgtgatgttgctgaggaagagcatgccgctgcccgtgtcggatgccgagtgtccgcccaggcccagcaacccgccttctagctgggcctgggctcgcggccggccctcgcgaggctggggcacctttctccaggtcaccaatggctgcgggtagccggaggcttggcaggcaacccgcaggtcctcacccaggttggctgtgagctccagcggctgcacgtggacagagggcggaatgcagatgaggctgctgtgggatacgtccaggagactctggagcgccaggcgcgggggctctgcacacatgatcttcctgtccctggaggtgagcagccgctggccgccctccttgatccaggcccccagccagtgcagggcgcagtcacagcgccatgggttctctgtgggagagcagcgttaggcaggtggcttgagggtgctgctaaaacagcctgtgcagttggggttttgcaggccaggacagaggcctctttcccacctcccacagcgttttcacacggagtccaaggccctgccaccccttccttgaccccaagctccttggggcggcaggcccttcaccctcgcccccctcccctttagctctgtgatgcctgcctgttacagatcacttctccgtcggtctctgagaaagcacctgctccttaagtcttcctgcaacaagtgccactgtttttaggaacctgggcgtccacatagacatctcaccagcactgaaacctcacaagtcctctcagccttgcctttggatgccctctcttgggaatgtccccagtcctggtcagctgtctctctcctttgcaattttgtctgcctcccctcagcctaaaagtgtgcagaaccctcaattctgttaagtcaccctgtggagttcctgtcttctgttttccccaggcagggtgcctgagctgtattccccagcacacccactcccgcagccctccagtgtggctgcaggcggtggtgcagccttccagactgctgcccagttgcctgatgtcagagcccctccacacatgagcctgctccctactgccaacaccgtggcccagacagagacgctttccgaggaagaggtacctgtgaggcgcaggacttgcagactggccaggggctgcagggcctctcggctgatggtgcccagctggttcctgctgaggtccagcagtgctagggaggacagccccgctagagcctggtcctccagcagctcaatgctgttttcttgcaggtgaagctcctgcagtcgctgaagtaaggacagcagatcgtgaggaaaaagggcgccgaggttgggggcatgtctctcttcttaccaagctagactgggttgccttttctaactattccagccctacagggcgaggggccataatggagtatcccgcccctttagaccccaggcgctcaccggcaggtgcaagaaggtgaaatccagcagccgcgccagctggttgcccgccaggtagagcacgcgcagctgggccaggcctacgaaggcgccgctgcgcaagccgcgcagccggttgctagtgagcgccagctccagcaggcgcggctgcgcgcggaaggcgccggcctccagggcgcgcaggctgttgttgtgcaggtagagccggcgcagagcggcgagtggcgccagggctcccggctctaggcgggcgatgttgttgtcctgcaggaacagtgtctgcaggccggggaaagaggaggcgcttaccccgttgcgggggtcttcctctccctgggggcaccccgtcctcccgcagctccacacggtgcccacctgcgtccctggcgggattcccagcgggacgacgcgcaaccgcagggcgccacactccaccgtggcgctgtagcagcggcaggctgctgggcagccggcggcgcggagcggcagtagtagcagcagcagcggcagcagtgcgggggccctcagggccatctcccgaggcccggttcctcaccggcccttccgcggttcagccgcagacgcgtgccctcctgaaacacaggttggcaggccagtctcggcagtcgagagccagccaatagatggaatggaggcctgcacctgcgtctaacttttgacactataaataggttcaagaaactaataaaacgttctggttttctcctttgaaaaaaa

SEQ ID NO: 278649 - DNA, 5147 bp, Homo sapiens
caacgtcatcgcggggcgccgcggcgccgggcggggagcggcggacggtctaggcggggctggaggcggtggctgcggttgcgggaccgggagatggctgcgatttagttttgaggatgctacaggcagcagcagggctggcaccctgtgtcacaggcactatgctgggccttcctaccacttgtgtgtggcttggtagtggcctagggtctctcctccctgctgaagtccctctcctgcaggtggccgtctgcccggcccagcaccatgcacacgcttgtgttcttgagcacacggcaggtgctgcagtgccagccagctgcctgccaggccctgcccctgctgccacgcgaactcttccccctgctgttcaaggtggccttcatggacaagaagacagtggtactgcgcgagttggtacacacgtggcccttcccgctgctcagtttccagcagctgctacaggagtgtgcccactgcagccgtgccctcctgcaggagcggcctagcactgagagcatgcaggctgttatcctggggctgactgcccggctccacacctcagagcctggggccagcacacagcccctctgcaggaagcatgcgctgcgggtgctggacatgacgggcctcttggatgatggtgtggaacaggatcctggcaccatgagcatgtgggactgtactgctgccgtagctcgcacatgcattgcccagcagcagggtggggccgcagagcctgggccagcccccatccccgtggaggtgcgcgtggacctgcgggtgaaccgggcctcctatgcgttcctgcgggaggcactccgaagcagcgtgggcagcccgctgcggctctgctgccgggacctgcgagctgaggacctgcccatgcgcaacactgtggccctgctgcagcttctggatgcaggctgcctgcgccgcgtggacctgcgcttcaacaatctgggcctgcgcggcctgtctgtgatcatcccacacgtggcccgcttccagcacctggccagcctgcggctccactatgtgcatggggattcaaggcagccctccgtggatggcgaggacaacttccgctacttccttgcccagatgggccgcttcacctgtctgcgtgagctcagcatgggctcctctctcctttcagggaggctggaccagctgctcagcaccctgcagagccccctggagagcctggagttggccttctgtgctctgctgcctgaggacctacgcttcctggcacggagcccacatgctgcccacctcaagaagttggacctgagtggtaacgacctgtctggcagccagctggcacccttccagggtctgttgcaggcatcagcagccacactgttgcatctggagctgactgagtgtcagctcgcagacacccagctgttggccacactacccatcctgactcagtgcgccagtctccggtaccttggcctctatggcaacccactgtccatggcgggcctcaaggagctgctgcgggactcagtggcacaggctgagctgcgtactgtggtgcaccccttccctgtggactgctatgagggcttgccctggccgccgcctgcctctgtcctgctggaggcctccatcaatgaggagaagtttgcccgcgtagaagctgagttgcaccagctgcttctagcctcaggccgtgcccatgtgctctggaccacggacatctacgggcgactggctgcggactacttcagcctatgatgaagtagctctgggtgagacacaggccgccctgcagtctctttaggtaggcagggcctttgctgggacccctggtggaggccttcacaaaagcactggttactggtttcctgctgggtctaccttgcttctgggcacacctcaagcctcccctgctttctgcagtgccccacgcggttttccctgcacttgctccataattggctgatcatctgtgggccccggggctggatgtcaggcctccattgccctgctcagtttggctgcatttggctgccgtctggggtcctggtcctttgtgcaaatgctttgggattccagttgtgagctgagagagatgatggcctctctgggcctttcctctccctttactgagagctcagtgcttctggggttgaagttggacagaggcctgcttcagggaagctgggagtccccaggcactcacgcctcttacgtgttccctaccctgccacccagccaccccactgggctgggctcgggctggagggggtcatcaaggtacacatgtgcctggaagttgaatttgtggctgtttttttttctgtccacgttggtcacccttatccttatctctgctgtcacccccaacatggccaccgggcaacaactgccatccagcctgtcgccccgcccttcgcggggcagccccgtcggcactgccggccagtccttgctcttcccacctttcggaggcccaagatcctactgtggccggccagggccagcgagggaccccccccatgcagagctggaggttggggtgatgtcttttcggaagagcttcaagggaggtgttggggcctccccggccaccttccattgctaccccaggattcccgagtgcaacgttcccggctcgcgccccacacacggctcagcgcacactgcgcggcttccacctttactgacggagcatgcgcgaggccgcaccggccaatctccggcgcccacgtcatccgcgcgcccgcggccctagcagtggatctcgtaggcgaccggcgggggcacgcggagtcccggccccgccccctgttccgggccgcagtcagcgggcgcctccgccggaccctcggcgaagagcggcttggagcggttgatgacgaacatctcgtggccgcgctcgtcgcggagctcctctagctgtgcgaacgtacaggggccgtccaagtagtcgttgacgaacagcgctccctcccccggaggcccccgcgccttttttcgcctgcggcgccggcgacagatcatggcgaccaggagcagcgccgtgagcgccagcagcgcgatggccgccgcaatggccgtctgtgtggccacgcccagggcgcggaaggccatgctgcccgcctcgggccggggctcgctgccggcggggcgggcggccggaggcggcggttgcgcgggctgctgcggctgctgccgggacgcgttgaccaggagccggaagggcacgcgggcagcgccgccggcgttggaggcctcgcactcgtacttaccggcgtgcgccagcgtgatgttgctgaggaagagcatgccgctgcccgtgtcggatgccgagtgtccgcccaggcccagcaacccgccttctagctgggcctgggctcgcggccggccctcgcgaggctggggcacctttctccaggtcaccaatggctgcgggtagccggaggcttggcaggcaacccgcaggtcctcacccaggttggctgtgagctccagcggctgcacgtggacagagggcggaatgcagatgaggctgctgtgggatacgtccaggagactctggagcgccaggcgcgggggctctgcacacatgatcttcctgtccctggagatcacttctccgtcggtctctgagaaagcacctgctccttaagtcttcctgcaacaagtgccactgtttttaggaacctgggcgtccacatagacatctcaccagcactgaaacctcacaagtcctctcagccttgcctttggatgccctctcttgggaatgtccccagtcctggtcagctgtctctctcctttgcaattttgtctgcctcccctcagcctaaaagtgtgcagaaccctcaattctgttaagtcaccctgtggagttcctgtcttctgttttccccaggcagggtgcctgagctgtattccccagcacacccactcccgcagccctccagtgtggctgcaggcggtggtgcagccttccagactgctgcccagttgcctgatgtcagagcccctccacacatgagcctgctccctactgccaacaccgtggcccagacagagacgctttccgaggaagaggtacctgtgaggcgcaggacttgcagactggccaggggctgcagggcctctcggctgatggtgcccagctggttcctgctgaggtccagcagtgctagggaggacagccccgctagagcctggtcctccagcagctcaatgctgttttcttgcaggtgaagctcctgcagtcgctgaagtaaggacagcagatcgtgaggaaaaagggcgccgaggttgggggcatgtctctcttcttaccaagctagactgggttgccttttctaactattccagccctacagggcgaggggccataatggagtatcccgcccctttagaccccaggcgctcaccggcaggtgcaagaaggtgaaatccagcagccgcgccagctggttgcccgccaggtagagcacgcgcagctgggccaggcctacgaaggcgccgctgcgcaagccgcgcagccggttgctagtgagcgccagctccagcaggcgcggctgcgcgcggaaggcgccggcctccagggcgcgcaggctgttgttgtgcaggtagagccggcgcagagcggcgagtggcgccagggctcccggctctaggcgggcgatgttgttgtcctgcaggaacagtgtctgcaggccggggaaagaggaggcgcttaccccgttgcgggggtcttcctctccctgggggcaccccgtcctcccgcagctccacacggtgcccacctgcgtccctggcgggattcccagcgggacgacgcgcaaccgcagggcgccacactccaccgtggcgctgtagcagcggcaggctgctgggcagccggcggcgcggagcggcagtagtagcagcagcagcggcagcagtgcgggggccctcagggccatctcccgaggcccggttcctcaccggcccttccgcggttcagccgcagacgcgtgccctcctgaaacacaggttggcaggccagtctcggcagtcgagagccagccaatagatggaatggaggcctgcacctgcgtctaacttttgacactataaataggttcaagaaactaataaaacgttctggttttctcctttgaaaaaaa

SEQ ID NO: 278650 - DNA, 5296 bp, Homo sapiens
caacgtcatcgcggggcgccgcggcgccgggcggggagcggcggacggtctaggcggggctggaggcggtggctgcggttgcgggaccggtggccgtctgcccggcccagcaccatgcacacgcttgtgttcttgagcacacggcaggtgctgcagtgccagccagctgcctgccaggccctgcccctgctgccacgcgaactcttccccctgctgttcaaggtggccttcatggacaagaagacagtggtactgcgcgagttggtacacacgtggcccttcccgctgctcagtttccagcagctgctacaggagtgtgcccactgcagccgtgccctcctgcaggagcggcctagcactgagagcatgcaggctgttatcctggggctgactgcccggctccacacctcagagcctggggccagcacacagcccctctgcaggaagcatgcgctgcgggtgctggacatgacgggcctcttggatgatggtgtggaacaggatcctggcaccatgagcatgtgggactgtactgctgccgtagctcgcacatgcattgcccagcagcagggtggggccgcagagcctgggccagcccccatccccgtggaggtgcgcgtggacctgcgggtgaaccgggcctcctatgcgttcctgcgggaggcactccgaagcagcgtgggcagcccgctgcggctctgctgccgggacctgcgagctgaggacctgcccatgcgcaacactgtggccctgctgcagcttctggatgcaggctgcctgcgccgcgtggacctgcgcttcaacaatctgggcctgcgcggcctgtctgtgatcatcccacacgtggcccgcttccagcacctggccagcctgcggctccactatgtgcatggggattcaaggcagccctccgtggatggcgaggacaacttccgctacttccttgcccagatgggccgcttcacctgtctgcgtgagctcagcatgggctcctctctcctttcagggaggctggaccagctgctcagcaccctgcagagccccctggagagcctggagttggccttctgtgctctgctgcctgaggacctacgcttcctggcacggagcccacatgctgcccacctcaagaagttggacctgagtggtaacgacctgtctggcagccagctggcacccttccagggtctgttgcaggcatcagcagccacactgttgcatctggagctgactgagtgtcagctcgcagacacccagctgttggccacactacccatcctgactcagtgcgccagtctccggtaccttggcctctatggcaacccactgtccatggcgggcctcaaggagctgctgcgggactcagtggcacaggctgagctgcgtactgtggtgcaccccttccctgtggactgctatgagggcttgccctggccgccgcctgcctctgtcctgctggaggcctccatcaatgaggagaagtttgcccgcgtagaagctgagttgcaccagctgcttctagcctcaggccgtgcccatgtgctctggaccacggacatctacgggcgactggctgcggactacttcagcctatgatgaagtagctctgggtgagacacaggccgccctgcagtctctttaggtaggcagggcctttgctgggacccctggtggaggccttcacaaaagcactggttactggtttcctgctgggtctaccttgcttctgggcacacctcaagcctcccctgctttctgcagtgccccacgcggttttccctgcacttgctccataattggctgatcatctgtgggccccggggctggatgtcaggcctccattgccctgctcagtttggctgcatttggctgccgtctggggtcctggtcctttgtgcaaatgctttgggattccagttgtgagctgagagagatgatggcctctctgggcctttcctctccctttactgagagctcagtgcttctggggttgaagttggacagaggcctgcttcagggaagctgggagtccccaggcactcacgcctcttacgtgttccctaccctgccacccagccaccccactgggctgggctcgggctggagggggtcatcaaggtacacatgtgcctggaagttgaatttgtggctgtttttttttctgtccacgttggtcacccttatccttatctctgctgtcacccccaacatggccaccgggcaacaactgccatccagcctgtcgccccgcccttcgcggggcagccccgtcggcactgccggccagtccttgctcttcccacctttcggaggcccaagatcctactgtggccggccagggccagcgagggaccccccccatgcagagctggaggttggggtgatgtcttttcggaagagcttcaagggaggtgttggggcctccccggccaccttccattgctaccccaggattcccgagtgcaacgttcccggctcgcgccccacacacggctcagcgcacactgcgcggcttccacctttactgacggagcatgcgcgaggccgcaccggccaatctccggcgcccacgtcatccgcgcgcccgcggccctagcagtggatctcgtaggcgaccggcgggggcacgcggagtcccggccccgccccctgttccgggccgcagtcagcgggcgcctccgccggaccctcggcgaagagcggcttggagcggttgatgacgaacatctcgtggccgcgctcgtcgcggagctcctctagctgtgcgaacgtacaggggccgtccaagtagtcgttgacgaacagcgctccctcccccggaggcccccgcgccttttttcgcctgcggcgccggcgacagatcatggcgaccaggagcagcgccgtgagcgccagcagcgcgatggccgccgcaatggccgtctgtgtggccacgcccagggcgcggaaggccatgctgcccgcctcgggccggggctcgctgccggcggggcgggcggccggaggcggcggttgcgcgggctgctgcggctgctgccgggacgcgttgaccaggagccggaagggcacgcgggcagcgccgccggcgttggaggcctcgcactcgtacttaccggcgtgcgccagcgtgatgttgctgaggaagagcatgccgctgcccgtgtcggatgccgagtgtccgcccaggcccagcaacccgccttctagctgggcctgggctcgcggccggccctcgcgaggctggggcacctttctccaggtcaccaatggctgcgggtagccggaggcttggcaggcaacccgcaggtcctcacccaggttggctgtgagctccagcggctgcacgtggacagagggcggaatgcagatgaggctgctgtgggatacgtccaggagactctggagcgccaggcgcgggggctctgcacacatgatcttcctgtccctggaggtgagcagccgctggccgccctccttgatccaggcccccagccagtgcagggcgcagtcacagcgccatgggttctctgtgggagagcagcgttaggcaggtggcttgagggtgctgctaaaacagcctgtgcagttggggttttgcaggccaggacagaggcctctttcccacctcccacagcgttttcacacggagtccaaggccctgccaccccttccttgaccccaagctccttggggcggcaggcccttcaccctcgcccccctcccctttagctctgtgatgcctgcctgttacagatcacttctccgtcggtctctgagaaagcacctgctccttaagtcttcctgcaacaagtgccactgtttttaggaacctgggcgtccacatagacatctcaccagcactgaaacctcacaagtcctctcagccttgcctttggatgccctctcttgggaatgtccccagtcctggtcagctgtctctctcctttgcaattttgtctgcctcccctcagcctaaaagtgtgcagaaccctcaattctgttaagtcaccctgtggagttcctgtcttctgttttccccaggcagggtgcctgagctgtattccccagcacacccactcccgcagccctccagtgtggctgcaggcggtggtgcagccttccagactgctgcccagttgcctgatgtcagagcccctccacacatgagcctgctccctactgccaacaccgtggcccagacagagacgctttccgaggaagaggtacctgtgaggcgcaggacttgcagactggccaggggctgcagggcctctcggctgatggtgcccagctggttcctgctgaggtccagcagtgctagggaggacagccccgctagagcctggtcctccagcagctcaatgctgttttcttgcaggtgaagctcctgcagtcgctgaagtaaggacagcagatcgtgaggaaaaagggcgccgaggttgggggcatgtctctcttcttaccaagctagactgggttgccttttctaactattccagccctacagggcgaggggccataatggagtatcccgcccctttagaccccaggcgctcaccggcaggtgcaagaaggtgaaatccagcagccgcgccagctggttgcccgccaggtagagcacgcgcagctgggccaggcctacgaaggcgccgctgcgcaagccgcgcagccggttgctagtgagcgccagctccagcaggcgcggctgcgcgcggaaggcgccggcctccagggcgcgcaggctgttgttgtgcaggtagagccggcgcagagcggcgagtggcgccagggctcccggctctaggcgggcgatgttgttgtcctgcaggaacagtgtctgcaggccggggaaagaggaggcgcttaccccgttgcgggggtcttcctctccctgggggcaccccgtcctcccgcagctccacacggtgcccacctgcgtccctggcgggattcccagcgggacgacgcgcaaccgcagggcgccacactccaccgtggcgctgtagcagcggcaggctgctgggcagccggcggcgcggagcggcagtagtagcagcagcagcggcagcagtgcgggggccctcagggccatctcccgaggcccggttcctcaccggcccttccgcggttcagccgcagacgcgtgccctcctgaaacacaggttggcaggccagtctcggcagtcgagagccagccaatagatggaatggaggcctgcacctgcgtctaacttttgacactataaataggttcaagaaactaataaaacgttctggttttctcctttgaaaaaaa

SEQ ID NO: 278651 - DNA, 5652 bp, Homo sapiens
cttcgcgaaacgcaggcgaccgaggaccgtcgcgttccctgcggccggcgggaggggagggggcgtcgcacggaggtgcctgcctcccttggtgggcaggccgtctgctttggtgttctcccgtgacaagtgctcggttggtctgtcctgtcagagcgagtatgatcgttgagatctgtccaccggcagaactaggccgagggttggtgtctgggacttttcaggaaccggtgccttaaggacttacttgtatgtggaaaagtcgacaaaaagaagggccttggggccagagtgtcttccccggcccccttccctggcttgtcactcaggctgtgaccttgggccaggccgaggccttcattttctaatctgtcacagggagatggctgcgatttagttttgaggatgctacaggcagcagcagggctggcaccctgtgtcacaggtggccgtctgcccggcccagcaccatgcacacgcttgtgttcttgagcacacggcaggtgctgcagtgccagccagctgcctgccaggccctgcccctgctgccacgcgaactcttccccctgctgttcaaggtggccttcatggacaagaagacagtggtactgcgcgagttggtacacacgtggcccttcccgctgctcagtttccagcagctgctacaggagtgtgcccactgcagccgtgccctcctgcaggagcggcctagcactgagagcatgcaggctgttatcctggggctgactgcccggctccacacctcagagcctggggccagcacacagcccctctgcaggaagcatgcgctgcgggtgctggacatgacgggcctcttggatgatggtgtggaacaggatcctggcaccatgagcatgtgggactgtactgctgccgtagctcgcacatgcattgcccagcagcagggtggggccgcagagcctgggccagcccccatccccgtggaggtgcgcgtggacctgcgggtgaaccgggcctcctatgcgttcctgcgggaggcactccgaagcagcgtgggcagcccgctgcggctctgctgccgggacctgcgagctgaggacctgcccatgcgcaacactgtggccctgctgcagcttctggatgcaggctgcctgcgccgcgtggacctgcgcttcaacaatctgggcctgcgcggcctgtctgtgatcatcccacacgtggcccgcttccagcacctggccagcctgcggctccactatgtgcatggggattcaaggcagccctccgtggatggcgaggacaacttccgctacttccttgcccagatgggccgcttcacctgtctgcgtgagctcagcatgggctcctctctcctttcagggaggctggaccagctgctcagcaccctgcagagccccctggagagcctggagttggccttctgtgctctgctgcctgaggacctacgcttcctggcacggagcccacatgctgcccacctcaagaagttggacctgagtggtaacgacctgtctggcagccagctggcacccttccagggtctgttgcaggcatcagcagccacactgttgcatctggagctgactgagtgtcagctcgcagacacccagctgttggccacactacccatcctgactcagtgcgccagtctccggtaccttggcctctatggcaacccactgtccatggcgggcctcaaggagctgctgcgggactcagtggcacaggctgagctgcgtactgtggtgcaccccttccctgtggactgctatgagggcttgccctggccgccgcctgcctctgtcctgctggaggcctccatcaatgaggagaagtttgcccgcgtagaagctgagttgcaccagctgcttctagcctcaggccgtgcccatgtgctctggaccacggacatctacgggcgactggctgcggactacttcagcctatgatgaagtagctctgggtgagacacaggccgccctgcagtctctttaggtaggcagggcctttgctgggacccctggtggaggccttcacaaaagcactggttactggtttcctgctgggtctaccttgcttctgggcacacctcaagcctcccctgctttctgcagtgccccacgcggttttccctgcacttgctccataattggctgatcatctgtgggccccggggctggatgtcaggcctccattgccctgctcagtttggctgcatttggctgccgtctggggtcctggtcctttgtgcaaatgctttgggattccagttgtgagctgagagagatgatggcctctctgggcctttcctctccctttactgagagctcagtgcttctggggttgaagttggacagaggcctgcttcagggaagctgggagtccccaggcactcacgcctcttacgtgttccctaccctgccacccagccaccccactgggctgggctcgggctggagggggtcatcaaggtacacatgtgcctggaagttgaatttgtggctgtttttttttctgtccacgttggtcacccttatccttatctctgctgtcacccccaacatggccaccgggcaacaactgccatccagcctgtcgccccgcccttcgcggggcagccccgtcggcactgccggccagtccttgctcttcccacctttcggaggcccaagatcctactgtggccggccagggccagcgagggaccccccccatgcagagctggaggttggggtgatgtcttttcggaagagcttcaagggaggtgttggggcctccccggccaccttccattgctaccccaggattcccgagtgcaacgttcccggctcgcgccccacacacggctcagcgcacactgcgcggcttccacctttactgacggagcatgcgcgaggccgcaccggccaatctccggcgcccacgtcatccgcgcgcccgcggccctagcagtggatctcgtaggcgaccggcgggggcacgcggagtcccggccccgccccctgttccgggccgcagtcagcgggcgcctccgccggaccctcggcgaagagcggcttggagcggttgatgacgaacatctcgtggccgcgctcgtcgcggagctcctctagctgtgcgaacgtacaggggccgtccaagtagtcgttgacgaacagcgctccctcccccggaggcccccgcgccttttttcgcctgcggcgccggcgacagatcatggcgaccaggagcagcgccgtgagcgccagcagcgcgatggccgccgcaatggccgtctgtgtggccacgcccagggcgcggaaggccatgctgcccgcctcgggccggggctcgctgccggcggggcgggcggccggaggcggcggttgcgcgggctgctgcggctgctgccgggacgcgttgaccaggagccggaagggcacgcgggcagcgccgccggcgttggaggcctcgcactcgtacttaccggcgtgcgccagcgtgatgttgctgaggaagagcatgccgctgcccgtgtcggatgccgagtgtccgcccaggcccagcaacccgccttctagctgggcctgggctcgcggccggccctcgcgaggctggggcacctttctccaggtcaccaatggctgcgggtagccggaggcttggcaggcaacccgcaggtcctcacccaggttggctgtgagctccagcggctgcacgtggacagagggcggaatgcagatgaggctgctgtgggatacgtccaggagactctggagcgccaggcgcgggggctctgcacacatgatcttcctgtccctggaggtgagcagccgctggccgccctccttgatccaggcccccagccagtgcagggcgcagtcacagcgccatgggttctctgtgggagagcagcgttaggcaggtggcttgagggtgctgctaaaacagcctgtgcagttggggttttgcaggccaggacagaggcctctttcccacctcccacagcgttttcacacggagtccaaggccctgccaccccttccttgaccccaagctccttggggcggcaggcccttcaccctcgcccccctcccctttagctctgtgatgcctgcctgttacagatcacttctccgtcggtctctgagaaagcacctgctccttaagtcttcctgcaacaagtgccactgtttttaggaacctgggcgtccacatagacatctcaccagcactgaaacctcacaagtcctctcagccttgcctttggatgccctctcttgggaatgtccccagtcctggtcagctgtctctctcctttgcaattttgtctgcctcccctcagcctaaaagtgtgcagaaccctcaattctgttaagtcaccctgtggagttcctgtcttctgttttccccaggcagggtgcctgagctgtattccccagcacacccactcccgcagccctccagtgtggctgcaggcggtggtgcagccttccagactgctgcccagttgcctgatgtcagagcccctccacacatgagcctgctccctactgccaacaccgtggcccagacagagacgctttccgaggaagaggtacctgtgaggcgcaggacttgcagactggccaggggctgcagggcctctcggctgatggtgcccagctggttcctgctgaggtccagcagtgctagggaggacagccccgctagagcctggtcctccagcagctcaatgctgttttcttgcaggtgaagctcctgcagtcgctgaagtaaggacagcagatcgtgaggaaaaagggcgccgaggttgggggcatgtctctcttcttaccaagctagactgggttgccttttctaactattccagccctacagggcgaggggccataatggagtatcccgcccctttagaccccaggcgctcaccggcaggtgcaagaaggtgaaatccagcagccgcgccagctggttgcccgccaggtagagcacgcgcagctgggccaggcctacgaaggcgccgctgcgcaagccgcgcagccggttgctagtgagcgccagctccagcaggcgcggctgcgcgcggaaggcgccggcctccagggcgcgcaggctgttgttgtgcaggtagagccggcgcagagcggcgagtggcgccagggctcccggctctaggcgggcgatgttgttgtcctgcaggaacagtgtctgcaggccggggaaagaggaggcgcttaccccgttgcgggggtcttcctctccctgggggcaccccgtcctcccgcagctccacacggtgcccacctgcgtccctggcgggattcccagcgggacgacgcgcaaccgcagggcgccacactccaccgtggcgctgtagcagcggcaggctgctgggcagccggcggcgcggagcggcagtagtagcagcagcagcggcagcagtgcgggggccctcagggccatctcccgaggcccggttcctcaccggcccttccgcggttcagccgcagacgcgtgccctcctgaaacacaggttggcaggccagtctcggcagtcgagagccagccaatagatggaatggaggcctgcacctgcgtctaacttttgacactataaataggttcaagaaactaataaaacgttctggttttctcctttgaaaaaaa

SEQ ID NO: 278652 - DNA, 1697 bp, Homo sapiens
acctagaggacccataagcggatagggcggaatgcagatgaggctgctgtggacagagggcggaatgcagatgaggctgctgtgggatacgtccaggagactctggagcgccaggcgcgggggctctgcacacatgatcttcctgtccctggagatcacttctccgtcggtctctgagaaagcacctgctccttaagtcttcctgcaacaagtgccactgtttttaggaacctgggcgtccacatagacatctcaccagcactgaaacctcacaagtcctctcagccttgcctttggatgccctctcttgggaatgtccccagtcctggtcagctgtctctctcctttgcaattttgtctgcctcccctcagcctaaaagtgtgcagaaccctcaattctgttaagtcaccctgtggagttcctgtcttctgttttccccaggcagggtgcctgagctgtattccccagcacacccactcccgcagccctccagtgtggctgcaggcggtggtgcagccttccagactgctgcccagttgcctgatgtcagagcccctccacacatgagcctgctccctactgccaacaccgtggcccagacagagacgctttccgaggaagaggtacctgtgaggcgcaggacttgcagactggccaggggctgcagggcctctcggctgatggtgcccagctggttcctgctgaggtccagcagtgctagggaggacagccccgctagagcctggtcctccagcagctcaatgctgttttcttgcaggtgaagctcctgcagtcgctgaagtaaggacagcagatcgtgaggaaaaagggcgccgaggttgggggcatgtctctcttcttaccaagctagactgggttgccttttctaactattccagccctacagggcgaggggccataatggagtatcccgcccctttagaccccaggcgctcaccggcaggtgcaagaaggtgaaatccagcagccgcgccagctggttgcccgccaggtagagcacgcgcagctgggccaggcctacgaaggcgccgctgcgcaagccgcgcagccggttgctagtgagcgccagctccagcaggcgcggctgcgcgcggaaggcgccggcctccagggcgcgcaggctgttgttgtgcaggtagagccggcgcagagcggcgagtggcgccagggctcccggctctaggcgggcgatgttgttgtcctgcaggaacagtgtctgcaggccggggaaagaggaggcgcttaccccgttgcgggggtcttcctctccctgggggcaccccgtcctcccgcagctccacacggtgcccacctgcgtccctggcgggattcccagcgggacgacgcgcaaccgcagggcgccacactccaccgtggcgctgtagcagcggcaggctgctgggcagccggcggcgcggagcggcagtagtagcagcagcagcggcagcagtgcgggggccctcagggccatctcccgaggcccggttcctcaccggcccttccgcggttcagccgcagacgcgtgccctcctgaaacacaggttggcaggccagtctcggcagtcgagagccagccaatagatggaatggaggcctgcacctgcgtctaacttttgacactataaataggttcaagaaactaataaaacgttctggttttctcctttgaaaaaaa

SEQ ID NO: 278653 - DNA, 2617 bp, Homo sapiens
caacgtcatcgcggggcgccgcggcgccgggcggggagcggcggacggtctaggcggggctggaggcggtggctgcggttgcgggaccgggagatggctgcgatttagttttgaggatgctacaggcagcagcagggctggcaccctgtgtcacaggcactatgctgggccttcctaccacttgtgtgtggcttggtagtggcctagggtctctcctccctgctgaagtccctctcctgcaggtggccgtctgcccggcccagcaccatgcacacgcttgtgttcttgagcacacggcaggtgctgcagtgccagccagctgcctgccaggccctgcccctgctgccacgcgaactcttccccctgctgttcaaggtggccttcatggacaagaagacagtggtactgcgcgagttggtacacacgtggcccttcccgctgctcagtttccagcagctgctacaggagtgtgcccactgcagccgtgccctcctgcaggagcggcctagcactgagagcatgcaggctgttatcctggggctgactgcccggctccacacctcagagcctggggccagcacacagcccctctgcaggaagcatgcgctgcgggtgctggacatgacgggcctcttggatgatggtgtggaacaggatcctggcaccatgagcatgtgggactgtactgctgccgtagctcgcacatgcattgcccagcagcagggtggggccgcagagcctgggccagcccccatccccgtggaggtgcgcgtggacctgcgggtgaaccgggcctcctatgcgttcctgcgggaggcactccgaagcagcgtgggcagcccgctgcggctctgctgccgggacctgcgagctgaggacctgcccatgcgcaacactgtggccctgctgcagcttctggatgcaggctgcctgcgccgcgtggacctgcgcttcaacaatctgggcctgcgcggcctgtctgtgatcatcccacacgtggcccgcttccagcacctggccagcctgcggctccactatgtgcatggggattcaaggcagccctccgtggatggcgaggacaacttccgctacttccttgcccagatgggccgcttcacctgtctgcgtgagctcagcatgggctcctctctcctttcagggaggctggaccagctgctcagcaccctgcagagccccctggagagcctggagttggccttctgtgctctgctgcctgaggacctacgcttcctggcacggagcccacatgctgcccacctcaagaagttggacctgagtggtaacgacctgtctggcagccagctggcacccttccagggtctgttgcaggcatcagcagccacactgttgcatctggagctgactgagtgtcagctcgcagacacccagctgttggccacactacccatcctgactcagtgcgccagtctccggtaccttggcctctatggcaacccactgtccatggcgggcctcaaggagctgctgcgggactcagtggcacaggctgagctgcgtactgtggtgcaccccttccctgtggactgctatgagggcttgccctggccgccgcctgcctctgtcctgctggaggcctccatcaatgaggagaagtttgcccgcgtagaagctgagttgcaccagctgcttctagcctcaggccgtgcccatgtgctctggaccacggacatctacgggcgactggctgcggactacttcagcctatgatgaagtagctctgggtgagacacaggccgccctgcagtctctttaggtaggcagggcctttgctgggacccctggtggaggccttcacaaaagcactggttactggtttcctgctgggtctaccttgcttctgggcacacctcaagcctcccctgctttctgcagtgccccacgcggttttccctgcacttgctccataattggctgatcatctgtgggccccggggctggatgtcaggcctccattgccctgctcagtttggctgcatttggctgccgtctggggtcctggtcctttgtgcaaatgctttgggattccagttgtgagctgagagagatgatggcctctctgggcctttcctctccctttactgagagctcagtgcttctggggttgaagttggacagaggcctgcttcagggaagctgggagtccccaggcactcacgcctcttacgtgttccctaccctgccacccagccaccccactgggctgggctcgggctggagggggtcatcaaggtacacatgtgcctggcaaaaaaaaaaaaaaaaaaaaaaatttttgggccgctggggctctgaaagaagtttctaaacacattctcgttgggcccacggggccccataagggccactgcggcacctgggggccacaacacggttgtccccaaagggaagaacccgggcggcacaagaacaaacgggcgcctgggggtctctctaccgcaatataaaaaaaacgccgcggggggccagcccgagcggggttctgggaacaaaacccccgaaggggagggctcaggggcagcccagcagcgggagccccaccacccagggaggccaacgaagcgccaaatataaaact

SEQ ID NO: 278654 - DNA, 5382 bp, Homo sapiens
caacgtcatcgcggggcgccgcggcgccgggcggggagcggcggacggtctaggcggggctggaggcggtggctgcggttgcgggaccggcactatgctgggccttcctaccacttgtgtgtggcttggtagtggcctagggtctctcctccctgctgaagtccctctcctgcaggtggccgtctgcccggcccagcaccatgcacacgcttgtgttcttgagcacacggcaggtgctgcagtgccagccagctgcctgccaggccctgcccctgctgccacgcgaactcttccccctgctgttcaaggtggccttcatggacaagaagacagtggtactgcgcgagttggtacacacgtggcccttcccgctgctcagtttccagcagctgctacaggagtgtgcccactgcagccgtgccctcctgcaggagcggcctagcactgagagcatgcaggctgttatcctggggctgactgcccggctccacacctcagagcctggggccagcacacagcccctctgcaggaagcatgcgctgcgggtgctggacatgacgggcctcttggatgatggtgtggaacaggatcctggcaccatgagcatgtgggactgtactgctgccgtagctcgcacatgcattgcccagcagcagggtggggccgcagagcctgggccagcccccatccccgtggaggtgcgcgtggacctgcgggtgaaccgggcctcctatgcgttcctgcgggaggcactccgaagcagcgtgggcagcccgctgcggctctgctgccgggacctgcgagctgaggacctgcccatgcgcaacactgtggccctgctgcagcttctggatgcaggctgcctgcgccgcgtggacctgcgcttcaacaatctgggcctgcgcggcctgtctgtgatcatcccacacgtggcccgcttccagcacctggccagcctgcggctccactatgtgcatggggattcaaggcagccctccgtggatggcgaggacaacttccgctacttccttgcccagatgggccgcttcacctgtctgcgtgagctcagcatgggctcctctctcctttcagggaggctggaccagctgctcagcaccctgcagagccccctggagagcctggagttggccttctgtgctctgctgcctgaggacctacgcttcctggcacggagcccacatgctgcccacctcaagaagttggacctgagtggtaacgacctgtctggcagccagctggcacccttccagggtctgttgcaggcatcagcagccacactgttgcatctggagctgactgagtgtcagctcgcagacacccagctgttggccacactacccatcctgactcagtgcgccagtctccggtaccttggcctctatggcaacccactgtccatggcgggcctcaaggagctgctgcgggactcagtggcacaggctgagctgcgtactgtggtgcaccccttccctgtggactgctatgagggcttgccctggccgccgcctgcctctgtcctgctggaggcctccatcaatgaggagaagtttgcccgcgtagaagctgagttgcaccagctgcttctagcctcaggccgtgcccatgtgctctggaccacggacatctacgggcgactggctgcggactacttcagcctatgatgaagtagctctgggtgagacacaggccgccctgcagtctctttaggtaggcagggcctttgctgggacccctggtggaggccttcacaaaagcactggttactggtttcctgctgggtctaccttgcttctgggcacacctcaagcctcccctgctttctgcagtgccccacgcggttttccctgcacttgctccataattggctgatcatctgtgggccccggggctggatgtcaggcctccattgccctgctcagtttggctgcatttggctgccgtctggggtcctggtcctttgtgcaaatgctttgggattccagttgtgagctgagagagatgatggcctctctgggcctttcctctccctttactgagagctcagtgcttctggggttgaagttggacagaggcctgcttcagggaagctgggagtccccaggcactcacgcctcttacgtgttccctaccctgccacccagccaccccactgggctgggctcgggctggagggggtcatcaaggtacacatgtgcctggaagttgaatttgtggctgtttttttttctgtccacgttggtcacccttatccttatctctgctgtcacccccaacatggccaccgggcaacaactgccatccagcctgtcgccccgcccttcgcggggcagccccgtcggcactgccggccagtccttgctcttcccacctttcggaggcccaagatcctactgtggccggccagggccagcgagggaccccccccatgcagagctggaggttggggtgatgtcttttcggaagagcttcaagggaggtgttggggcctccccggccaccttccattgctaccccaggattcccgagtgcaacgttcccggctcgcgccccacacacggctcagcgcacactgcgcggcttccacctttactgacggagcatgcgcgaggccgcaccggccaatctccggcgcccacgtcatccgcgcgcccgcggccctagcagtggatctcgtaggcgaccggcgggggcacgcggagtcccggccccgccccctgttccgggccgcagtcagcgggcgcctccgccggaccctcggcgaagagcggcttggagcggttgatgacgaacatctcgtggccgcgctcgtcgcggagctcctctagctgtgcgaacgtacaggggccgtccaagtagtcgttgacgaacagcgctccctcccccggaggcccccgcgccttttttcgcctgcggcgccggcgacagatcatggcgaccaggagcagcgccgtgagcgccagcagcgcgatggccgccgcaatggccgtctgtgtggccacgcccagggcgcggaaggccatgctgcccgcctcgggccggggctcgctgccggcggggcgggcggccggaggcggcggttgcgcgggctgctgcggctgctgccgggacgcgttgaccaggagccggaagggcacgcgggcagcgccgccggcgttggaggcctcgcactcgtacttaccggcgtgcgccagcgtgatgttgctgaggaagagcatgccgctgcccgtgtcggatgccgagtgtccgcccaggcccagcaacccgccttctagctgggcctgggctcgcggccggccctcgcgaggctggggcacctttctccaggtcaccaatggctgcgggtagccggaggcttggcaggcaacccgcaggtcctcacccaggttggctgtgagctccagcggctgcacgtggacagagggcggaatgcagatgaggctgctgtgggatacgtccaggagactctggagcgccaggcgcgggggctctgcacacatgatcttcctgtccctggaggtgagcagccgctggccgccctccttgatccaggcccccagccagtgcagggcgcagtcacagcgccatgggttctctgtgggagagcagcgttaggcaggtggcttgagggtgctgctaaaacagcctgtgcagttggggttttgcaggccaggacagaggcctctttcccacctcccacagcgttttcacacggagtccaaggccctgccaccccttccttgaccccaagctccttggggcggcaggcccttcaccctcgcccccctcccctttagctctgtgatgcctgcctgttacagatcacttctccgtcggtctctgagaaagcacctgctccttaagtcttcctgcaacaagtgccactgtttttaggaacctgggcgtccacatagacatctcaccagcactgaaacctcacaagtcctctcagccttgcctttggatgccctctcttgggaatgtccccagtcctggtcagctgtctctctcctttgcaattttgtctgcctcccctcagcctaaaagtgtgcagaaccctcaattctgttaagtcaccctgtggagttcctgtcttctgttttccccaggcagggtgcctgagctgtattccccagcacacccactcccgcagccctccagtgtggctgcaggcggtggtgcagccttccagactgctgcccagttgcctgatgtcagagcccctccacacatgagcctgctccctactgccaacaccgtggcccagacagagacgctttccgaggaagaggtacctgtgaggcgcaggacttgcagactggccaggggctgcagggcctctcggctgatggtgcccagctggttcctgctgaggtccagcagtgctagggaggacagccccgctagagcctggtcctccagcagctcaatgctgttttcttgcaggtgaagctcctgcagtcgctgaagtaaggacagcagatcgtgaggaaaaagggcgccgaggttgggggcatgtctctcttcttaccaagctagactgggttgccttttctaactattccagccctacagggcgaggggccataatggagtatcccgcccctttagaccccaggcgctcaccggcaggtgcaagaaggtgaaatccagcagccgcgccagctggttgcccgccaggtagagcacgcgcagctgggccaggcctacgaaggcgccgctgcgcaagccgcgcagccggttgctagtgagcgccagctccagcaggcgcggctgcgcgcggaaggcgccggcctccagggcgcgcaggctgttgttgtgcaggtagagccggcgcagagcggcgagtggcgccagggctcccggctctaggcgggcgatgttgttgtcctgcaggaacagtgtctgcaggccggggaaagaggaggcgcttaccccgttgcgggggtcttcctctccctgggggcaccccgtcctcccgcagctccacacggtgcccacctgcgtccctggcgggattcccagcgggacgacgcgcaaccgcagggcgccacactccaccgtggcgctgtagcagcggcaggctgctgggcagccggcggcgcggagcggcagtagtagcagcagcagcggcagcagtgcgggggccctcagggccatctcccgaggcccggttcctcaccggcccttccgcggttcagccgcagacgcgtgccctcctgaaacacaggttggcaggccagtctcggcagtcgagagccagccaatagatggaatggaggcctgcacctgcgtctaacttttgacactataaataggttcaagaaactaataaaacgttctggttttctcctttgaaaaaaa

SEQ ID NO: 278655 - DNA, 4901 bp, Homo sapiens
caacgtcatcgcggggcgccgcggcgccgggcggggagcggcggacggtctaggcggggctggaggcggtggctgcggttgcgggaccgggagatggctgcgatttagttttgaggatgctacaggcagcagcagggctggcaccctgtgtcacaggcactatgctgggccttcctaccacttgtgtgtggcttggtagtggcctagggtctctcctccctgctgaagtccctctcctgcaggtggccgtctgcccggcccagcaccatgcacacgcttgtgttcttgagcacacggcaggtgctgcagtgccagccagctgcctgccaggccctgcccctgctgccacgcgaactcttccccctgctgttcaaggtggccttcatggacaagaagacagtggtactgcgcgagttggtacacacgtggcccttcccgctgctcagtttccagcagctgctacaggagtgtgcccactgcagccgtgccctcctgcaggagcggcctagcactgagagcatgcaggctgttatcctggggctgactgcccggctccacacctcagagcctggggccagcacacagcccctctgcaggaagcatgcgctgcgggtgctggacatgacgggcctcttggatgatggtgtggaacaggatcctggcaccatgagcatgtgggactgtactgctgccgtagctcgcacatgcattgcccagcagcagggtggggccgcagagcctgggccagcccccatccccgtggaggtgcgcgtggacctgcgggtgaaccgggcctcctatgcgttcctgcgggaggcactccgaagcagcgtgggcagcccgctgcggctctgctgccgggacctgcgagctgaggacctgcccatgcgcaacactgtggccctgctgcagcttctggatgcaggctgcctgcgccgcgtggacctgcgcttcaacaatctgggcctgcgcggcctgtctgtgatcatcccacacgtggcccgcttccagcacctggccagcctgcggctccactatgtgcatggggattcaaggcagccctccgtggatggcgaggacaacttccgctacttccttgcccagatgggccgcttcacctgtctgcgtgagctcagcatgggctcctctctcctttcagggaggctggaccagctgctcagcaccctgcagagccccctggagagcctggagttggccttctgtgctctgctgcctgaggacctacgcttcctggcacggagcccacatgctgcccacctcaagaagttggacctgagtggtaacgacctgtctggcagccagctggcacccttccagggtctgttgcaggcatcagcagccacactgttgcatctggagctgactgagtgtcagctcgcagacacccagctgttggccacactacccatcctgactcagtgcgccagtctccggtaccttggcctctatggcaacccactgtccatggcgggcctcaaggagctgctgcgggactcagtggcacaggctgagctgcgtactgtggtgcaccccttccctgtggactgctatgagggcttgccctggccgccgcctgcctctgtcctgctggaggcctccatcaatgaggagaagtttgcccgcgtagaagctgagttgcaccagctgcttctagcctcaggccgtgcccatgtgctctggaccacggacatctacgggcgactggctgcggactacttcagcctatgatgaagtagctctgggtgagacacaggccgccctgcagtctctttaggtaggcagggcctttgctgggacccctggtggaggccttcacaaaagcactggttactggtttcctgctgggtctaccttgcttctgggcacacctcaagcctcccctgctttctgcagtgccccacgcggttttccctgcacttgctccataattggctgatcatctgtgggccccggggctggatgtcaggcctccattgccctgctcagtttggctgcatttggctgccgtctggggtcctggtcctttgtgcaaatgctttgggattccagttgtgagctgagagagatgatggcctctctgggcctttcctctccctttactgagagctcagtgcttctggggttgaagttggacagaggcctgcttcagggaagctgggagtccccaggcactcacgcctcttacgtgttccctaccctgccacccagccaccccactgggctgggctcgggctggagggggtcatcaaggtacacatgtgcctggaagttgaatttgtggctgtttttttttctgtccacgttggtcacccttatccttatctctgctgtcacccccaacatggccaccgggcaacaactgccatccagcctgtcgccccgcccttcgcggggcagccccgtcggcactgccggccagtccttgctcttcccacctttcggaggcccaagatcctactgtggccggccagggccagcgagggaccccccccatgcagagctggaggttggggtgatgtcttttcggaagagcttcaagggaggtgttggggcctccccggccaccttccattgctaccccaggattcccgagtgcaacgttcccggctcgcgccccacacacggctcagcgcacactgcgcggcttccacctttactgacggagcatgcgcgaggccgcaccggccaatctccggcgcccacgtcatccgcgcgcccgcggccctagcagtggatctcgtaggcgaccggcgggggcacgcggagtcccggccccgccccctgttccgggccgcagtcagcgggcgcctccgccggaccctcggcgaagagcggcttggagcggttgatgacgaacatctcgtggccgcgctcgtcgcggagctcctctagctgtgcgaacgtacaggggccgtccaagtagtcgttgacgaacagcgctccctcccccggaggcccccgcgccttttttcgcctgcggcgccggcgacagatcatggcgaccaggagcagcgccgtgagcgccagcagcgcgatggccgccgcaatggccgtctgtgtggccacgcccagggcgcggaaggccatgctgcccgcctcgggccggggctcgctgccggcggggcgggcggccggaggcggcggttgcgcgggctgctgcggctgctgccgggacgcgttgaccaggagccggaagggcacgcgggcagcgccgccggcgttggaggcctcgcactcgtacttaccggcgtgcgccagcgtgatgttgctgaggaagagcatgccgctgcccgtgtcggatgccgagtgtccgcccaggcccagcaacccgccttctagctgggcctgggctcgcggccggccctcgcgaggctggggcacctttctccaggtcaccaatggctgcgggtagccggaggcttggcaggcaacccgcaggtcctcacccaggttggctgtgagctccagcggctgcacgtggacagagggcggaatgcagatgaggctgctgtgggatacgtccaggagactctggagcgccaggcgcgggggctctgcacacatgatcttcctgtccctggaggtgagcagccgctggccgccctccttgatccaggcccccagccagtgcagggcgcagtcacagcgccatgggttctctgtgggagagcagcgttaggcaggtggcttgagggtgctgctaaaacagcctgtgcagttggggttttgcaggccaggacagaggcctctttcccacctcccacagcgttttcacacggagtccaaggccctgccaccccttccttgaccccaagctccttggggcggcaggcccttcaccctcgcccccctcccctttagctctgtgatgcctgcctgttacagatcacttctccgtcggtctctgagaaagcacctgctccttaagtcttcctgcaacaagtgccactgtttttaggaacctgggcgtccacatagacatctcaccagcactgaaacctcacaagtcctctcagccttgcctttggatgccctctcttgggaatgtccccagtcctggtcagctgtctctctcctttgcaattttgtctgcctcccctcagcctaaaagtgtgcagaaccctcaattctgttaagtcacccggcaggtgcaagaaggtgaaatccagcagccgcgccagctggttgcccgccaggtagagcacgcgcagctgggccaggcctacgaaggcgccgctgcgcaagccgcgcagccggttgctagtgagcgccagctccagcaggcgcggctgcgcgcggaaggcgccggcctccagggcgcgcaggctgttgttgtgcaggtagagccggcgcagagcggcgagtggcgccagggctcccggctctaggcgggcgatgttgttgtcctgcaggaacagtgtctgcaggccggggaaagaggaggcgcttaccccgttgcgggggtcttcctctccctgggggcaccccgtcctcccgcagctccacacggtgcccacctgcgtccctggcgggattcccagcgggacgacgcgcaaccgcagggcgccacactccaccgtggcgctgtagcagcggcaggctgctgggcagccggcggcgcggagcggcagtagtagcagcagcagcggcagcagtgcgggggccctcagggccatctcccgaggcccggttcctcaccggcccttccgcggttcagccgcagacgcgtgccctcctgaaacacaggttggcaggccagtctcggcagtcgagagccagccaatagatggaatggaggcctgcacctgcgtctaacttttgacactataaataggttcaagaaactaataaaacgttctggttttctcctttgaaaaaaa

SEQ ID NO: 278656 - DNA, 5535 bp, Homo sapiens
caacgtcatcgcggggcgccgcggcgccgggcggggagcggcggacggtctaggcggggctggaggcggtggctgcggttgcgggaccgggagatggctgcgatttagttttgaggatgctacaggcagcagcagggctggcaccctgtgtcacaggcactatgctgggccttcctaccacttgtgtgtggcttggtagtggcctagggtctctcctccctgctgaagtccctctcctgcaggtggccgtctgcccggcccagcaccatgcacacgcttgtgttcttgagcacacggcaggtgctgcagtgccagccagctgcctgccaggccctgcccctgctgccacgcgaactcttccccctgctgttcaaggtggccttcatggacaagaagacagtggtactgcgcgagttggtacacacgtggcccttcccgctgctcagtttccagcagctgctacaggagtgtgcccactgcagccgtgccctcctgcaggagcggcctagcactgagagcatgcaggctgttatcctggggctgactgcccggctccacacctcagagcctggggccagcacacagcccctctgcaggaagcatgcgctgcgggtgctggacatgacgggcctcttggatgatggtgtggaacaggatcctggcaccatgagcatgtgggactgtactgctgccgtagctcgcacatgcattgcccagcagcagggtggggccgcagagcctgggccagcccccatccccgtggaggtgcgcgtggacctgcgggtgaaccgggcctcctatgcgttcctgcgggaggcactccgaagcagcgtgggcagcccgctgcggctctgctgccgggacctgcgagctgaggacctgcccatgcgcaacactgtggccctgctgcagcttctggatgcaggctgcctgcgccgcgtggacctgcgcttcaacaatctgggcctgcgcggcctgtctgtgatcatcccacacgtggcccgcttccagcacctggccagcctgcggctccactatgtgcatggggattcaaggcagccctccgtggatggcgaggacaacttccgctacttccttgcccagatgggccgcttcacctgtctgcgtgagctcagcatgggctcctctctcctttcagggaggctggaccagctgctcagcaccctgcagagccccctggagagcctggagttggccttctgtgctctgctgcctgaggacctacgcttcctggcacggagcccacatgctgcccacctcaagaagttggacctgagtggtaacgacctgtctggcagccagctggcacccttccagggtctgttgcaggcatcagcagccacactgttgcatctggagctgactgagtgtcagctcgcagacacccagctgttggccacactacccatcctgactcagtgcgccagtctccggtaccttggcctctatggcaacccactgtccatggcgggcctcaaggagctgctgcgggactcagtggcacaggctgagctgcgtactgtggtgcaccccttccctgtggactgctatgagggcttgccctggccgccgcctgcctctgtcctgctggaggcctccatcaatgaggagaagtttgcccgcgtagaagctgagttgcaccagctgcttctagcctcaggccgtgcccatgtgctctggaccacggacatctacgggcgactggctgcggactacttcagcctatgatgaagtagctctgggtgagacacaggccgccctgcagtctctttaggtaggcagggcctttgctgggacccctggtggaggccttcacaaaagcactggttactggtttcctgctgggtctaccttgcttctgggcacacctcaagcctcccctgctttctgcagtgccccacgcggttttccctgcacttgctccataattggctgatcatctgtgggccccggggctggatgtcaggcctccattgccctgctcagtttggctgcatttggctgccgtctggggtcctggtcctttgtgcaaatgctttgggattccagttgtgagctgagagagatgatggcctctctgggcctttcctctccctttactgagagctcagtgcttctggggttgaagttggacagaggcctgcttcagggaagctgggagtccccaggcactcacgcctcttacgtgttccctaccctgccacccagccaccccactgggctgggctcgggctggagggggtcatcaaggtacacatgtgcctggaagttgaatttgtggctgtttttttttctgtccacgttggtcacccttatccttatctctgctgtcacccccaacatggccaccgggcaacaactgccatccagcctgtcgccccgcccttcgcggggcagccccgtcggcactgccggccagtccttgctcttcccacctttcggaggcccaagatcctactgtggccggccagggccagcgagggaccccccccatgcagagctggaggttggggtgatgtcttttcggaagagcttcaagggaggtgttggggcctccccggccaccttccattgctaccccaggattcccgagtgcaacgttcccggctcgcgccccacacacggctcagcgcacactgcgcggcttccacctttactgacggagcatgcgcgaggccgcaccggccaatctccggcgcccacgtcatccgcgcgcccgcggccctagcagtggatctcgtaggcgaccggcgggggcacgcggagtcccggccccgccccctgttccgggccgcagtcagcgggcgcctccgccggaccctcggcgaagagcggcttggagcggttgatgacgaacatctcgtggccgcgctcgtcgcggagctcctctagctgtgcgaacgtacaggggccgtccaagtagtcgttgacgaacagcgctccctcccccggaggcccccgcgccttttttcgcctgcggcgccggcgacagatcatggcgaccaggagcagcgccgtgagcgccagcagcgcgatggccgccgcaatggccgtctgtgtggccacgcccagggcgcggaaggccatgctgcccgcctcgggccggggctcgctgccggcggggcgggcggccggaggcggcggttgcgcgggctgctgcggctgctgccgggacgcgttgaccaggagccggaagggcacgcgggcagcgccgccggcgttggaggcctcgcactcgtacttaccggcgtgcgccagcgtgatgttgctgaggaagagcatgccgctgcccgtgtcggatgccgagtgtccgcccaggcccagcaacccgccttctagctgggcctgggctcgcggccggccctcgcgaggctggggcacctttctccaggtcaccaatggctgcgggtagccggaggcttggcaggcaacccgcaggtcctcacccaggttggctgtgagctccagcggctgcacgtggacagagggcggaatgcagatgaggctgctgtgggatacgtccaggagactctggagcgccaggcgcgggggctctgcacacatgatcttcctgtccctggaggtgagcagccgctggccgccctccttgatccaggcccccagccagtgcagggcgcagtcacagcgccatgggttctctgtgggagagcagcgttaggcaggtggcttgagggtgctgctaaaacagcctgtgcagttggggttttgcaggccaggacagaggcctctttcccacctcccacagcgttttcacacggagtccaaggccctgccaccccttccttgaccccaagctccttggggcggcaggcccttcaccctcgcccccctcccctttagctctgtgatgcctgcctgttacagatcacttctccgtcggtctctgagaaagcacctgctccttaagtcttcctgcaacaagtgccactgtttttaggaacctgggcgtccacatagacatctcaccagcactgaaacctcacaagtcctctcagccttgcctttggatgccctctcttgggaatgtccccagtcctggtcagctgtctctctcctttgcaattttgtctgcctcccctcagcctaaaagtgtgcagaaccctcaattctgttaagtcaccctgtggagttcctgtcttctgttttccccaggcagggtgcctgagctgtattccccagcacacccactcccgcagccctccagtgtggctgcaggcggtggtgcagccttccagactgctgcccagttgcctgatgtcagagcccctccacacatgagcctgctccctactgccaacaccgtggcccagacagagacgctttccgaggaagaggtacctgtgaggcgcaggacttgcagactggccaggggctgcagggcctctcggctgatggtgcccagctggttcctgctgaggtccagcagtgctagggaggacagccccgctagagcctggtcctccagcagctcaatgctgttttcttgcaggtgaagctcctgcagtcgctgaagtaaggacagcagatcgtgaggaaaaagggcgccgaggttgggggcatgtctctcttcttaccaagctagactgggttgccttttctaactattccagccctacagggcgaggggccataatggagtatcccgcccctttagaccccaggcgctcaccggcaggtgcaagaaggtgaaatccagcagccgcgccagctggttgcccgccaggtagagcacgcgcagctgggccaggcctacgaaggcgccgctgcgcaagccgcgcagccggttgctagtgagcgccagctccagcaggcgcggctgcgcgcggaaggcgccggcctccagggcgcgcaggctgttgttgtgcaggtagagccggcgcagagcggcgagtggcgccagggctcccggctctaggcgggcgatgttgttgtcctgcaggaacagtgtctgcaggccggggaaagaggaggcgcttaccccgttgcgggggtcttcctctccctgggggcaccccgtcctcccgcagctccacacggtgcccacctgcgtccctggcgggattcccagcgggacgacgcgcaaccgcagggcgccacactccaccgtggcgctgtagcagcggcaggctgctgggcagccggcggcgcggagcggcagtagtagcagcagcagcggcagcagtgcgggggccctcagggccatctcccgaggcccggttcctcaccggcccttccgcggttcagccgcagacgcgtgccctcctgaaacacaggttggcaggccagtctcggcagtcgagagccagccaatagatggaatggaggcctgcacctgcgtctaacttttgacactataaataggttcaagaaactaataaaacgttctggttttctcctttgaaaaaaaaaaattgataaaaattcacttttaatttttgtataaatcatgcttatttttttaactcccttgaggggggggcccggccccaattt

SEQ ID NO: 278657 - DNA, 4295 bp, Homo sapiens
caacgtcatcgcggggcgccgcggcgccgggcggggagcggcggacggtctaggcggggctggaggcggtggctgcggttgcgggaccgggagatggctgcgatttagttttgaggatgctacaggcagcagcagggctggcaccctgtgtcacaggcactatgctgggccttcctaccacttgtgtgtggcttggtagtggcctagggtctctcctccctgctgaagtccctctcctgcaggtggccgtctgcccggcccagcaccatgcacacgcttgtgttcttgagcacacggcaggtgctgcagtgccagccagctgcctgccaggccctgcccctgctgccacgcgaactcttccccctgctgttcaaggtggccttcatggacaagaagacagtggtactgcgcgagttggtacacacgtggcccttcccgctgctcagtttccagcagctgctacaggagtgtgcccactgcagccgtgccctcctgcaggagcggcctagcactgagagcatgcaggctgttatcctggggctgactgcccggctccacacctcagagcctggggccagcacacagcccctctgcaggaagcatgcgctgcgggtgctggacatgacgggcctcttggatgatggtgtggaacaggatcctggcaccatgagcatgtgggactgtactgctgccgtagctcgcacatgcattgcccagcagcagggtggggccgcagagcctgggccagcccccatccccgtggaggtgcgcgtggacctgcgggtgaaccgggcctcctatgcgttcctgcgggaggcactccgaagcagcgtgggcagcccgctgcggctctgctgccgggacctgcgagctgaggacctgcccatgcgcaacactgtggccctgctgcagcttctggatgcaggctgcctgcgccgcgtggacctgcgcttcaacaatctgggcctgcgcggcctgtctgtgatcatcccacacgtggcccgcttccagcacctggccagcctgcgtccccaggcactcacgcctcttacgtgttccctaccctgccacccagccaccccactgggctgggctcgggctggagggggtcatcaaggtacacatgtgcctggaagttgaatttgtggctgtttttttttctgtccacgttggtcacccttatccttatctctgctgtcacccccaacatggccaccgggcaacaactgccatccagcctgtcgccccgcccttcgcggggcagccccgtcggcactgccggccagtccttgctcttcccacctttcggaggcccaagatcctactgtggccggccagggccagcgagggaccccccccatgcagagctggaggttggggtgatgtcttttcggaagagcttcaagggaggtgttggggcctccccggccaccttccattgctaccccaggattcccgagtgcaacgttcccggctcgcgccccacacacggctcagcgcacactgcgcggcttccacctttactgacggagcatgcgcgaggccgcaccggccaatctccggcgcccacgtcatccgcgcgcccgcggccctagcagtggatctcgtaggcgaccggcgggggcacgcggagtcccggccccgccccctgttccgggccgcagtcagcgggcgcctccgccggaccctcggcgaagagcggcttggagcggttgatgacgaacatctcgtggccgcgctcgtcgcggagctcctctagctgtgcgaacgtacaggggccgtccaagtagtcgttgacgaacagcgctccctcccccggaggcccccgcgccttttttcgcctgcggcgccggcgacagatcatggcgaccaggagcagcgccgtgagcgccagcagcgcgatggccgccgcaatggccgtctgtgtggccacgcccagggcgcggaaggccatgctgcccgcctcgggccggggctcgctgccggcggggcgggcggccggaggcggcggttgcgcgggctgctgcggctgctgccgggacgcgttgaccaggagccggaagggcacgcgggcagcgccgccggcgttggaggcctcgcactcgtacttaccggcgtgcgccagcgtgatgttgctgaggaagagcatgccgctgcccgtgtcggatgccgagtgtccgcccaggcccagcaacccgccttctagctgggcctgggctcgcggccggccctcgcgaggctggggcacctttctccaggtcaccaatggctgcgggtagccggaggcttggcaggcaacccgcaggtcctcacccaggttggctgtgagctccagcggctgcacgtggacagagggcggaatgcagatgaggctgctgtgggatacgtccaggagactctggagcgccaggcgcgggggctctgcacacatgatcttcctgtccctggaggtgagcagccgctggccgccctccttgatccaggcccccagccagtgcagggcgcagtcacagcgccatgggttctctgtgggagagcagcgttaggcaggtggcttgagggtgctgctaaaacagcctgtgcagttggggttttgcaggccaggacagaggcctctttcccacctcccacagcgttttcacacggagtccaaggccctgccaccccttccttgaccccaagctccttggggcggcaggcccttcaccctcgcccccctcccctttagctctgtgatgcctgcctgttacagatcacttctccgtcggtctctgagaaagcacctgctccttaagtcttcctgcaacaagtgccactgtttttaggaacctgggcgtccacatagacatctcaccagcactgaaacctcacaagtcctctcagccttgcctttggatgccctctcttgggaatgtccccagtcctggtcagctgtctctctcctttgcaattttgtctgcctcccctcagcctaaaagtgtgcagaaccctcaattctgttaagtcaccctgtggagttcctgtcttctgttttccccaggcagggtgcctgagctgtattccccagcacacccactcccgcagccctccagtgtggctgcaggcggtggtgcagccttccagactgctgcccagttgcctgatgtcagagcccctccacacatgagcctgctccctactgccaacaccgtggcccagacagagacgctttccgaggaagaggtacctgtgaggcgcaggacttgcagactggccaggggctgcagggcctctcggctgatggtgcccagctggttcctgctgaggtccagcagtgctagggaggacagccccgctagagcctggtcctccagcagctcaatgctgttttcttgcaggtgaagctcctgcagtcgctgaagtaaggacagcagatcgtgaggaaaaagggcgccgaggttgggggcatgtctctcttcttaccaagctagactgggttgccttttctaactattccagccctacagggcgaggggccataatggagtatcccgcccctttagaccccaggcgctcaccggcaggtgcaagaaggtgaaatccagcagccgcgccagctggttgcccgccaggtagagcacgcgcagctgggccaggcctacgaaggcgccgctgcgcaagccgcgcagccggttgctagtgagcgccagctccagcaggcgcggctgcgcgcggaaggcgccggcctccagggcgcgcaggctgttgttgtgcaggtagagccggcgcagagcggcgagtggcgccagggctcccggctctaggcgggcgatgttgttgtcctgcaggaacagtgtctgcaggccggggaaagaggaggcgcttaccccgttgcgggggtcttcctctccctgggggcaccccgtcctcccgcagctccacacggtgcccacctgcgtccctggcgggattcccagcgggacgacgcgcaaccgcagggcgccacactccaccgtggcgctgtagcagcggcaggctgctgggcagccggcggcgcggagcggcagtagtagcagcagcagcggcagcagtgcgggggccctcagggccatctcccgaggcccggttcctcaccggcccttccgcggttcagccgcagacgcgtgccctcctgaaacacaggttggcaggccagtctcggcagtcgagagccagccaatagatggaatggaggcctgcacctgcgtctaacttttgacactataaataggttcaagaaactaataaaacgttctggttttctcctttgaaaaaaa

SEQ ID NO: 278658 - DNA, 1299 bp, Homo sapiens
aggcaccctggcctggggaaaacagaagacaggaactccacgaggcagggtgcctgagctgtattccccagcacacccactcccgcagccctccagtgtggctgcaggcggtggtgcagccttccagactgctgcccagttgcctgatgtcagagcccctccacacatgagcctgctccctactgccaacaccgtggcccagacagagacgctttccgaggaagaggtacctgtgaggcgcaggacttgcagactggccaggggctgcagggcctctcggctgatggtgcccagctggttcctgctgaggtccagcagtgctagggaggacagccccgctagagcctggtcctccagcagctcaatgctgttttcttgcaggtgaagctcctgcagtcgctgaagtaaggacagcagatcgtgaggaaaaagggcgccgaggttgggggcatgtctctcttcttaccaagctagactgggttgccttttctaactattccagccctacagggcgaggggccataatggagtatcccgcccctttagaccccaggcgctcaccggcaggtgcaagaaggtgaaatccagcagccgcgccagctggttgcccgccaggtagagcacgcgcagctgggccaggcctacgaaggcgccgctgcgcaagccgcgcagccggttgctagtgagcgccagctccagcaggcgcggctgcgcgcggaaggcgccggcctccagggcgcgcaggctgttgttgtgcaggtagagccggcgcagagcggcgagtggcgccagggctcccggctctaggcgggcgatgttgttgtcctgcaggaacagtgtctgcaggccggggaaagaggaggcgcttaccccgttgcgggggtcttcctctccctgggggcaccccgtcctcccgcagctccacacggtgcccacctgcgtccctggcgggattcccagcgggacgacgcgcaaccgcagggcgccacactccaccgtggcgctgtagcagcggcaggctgctgggcagccggcggcgcggagcggcagtagtagcagcagcagcggcagcagtgcgggggccctcagggccatctcccgaggcccggttcctcaccggcccttccgcggttcagccgcagacgcgtgccctcctgaaacacaggttggcaggccagtctcggcagtcgagagccagccaatagatggaatggaggcctgcacctgcgtctaacttttgacactataaataggttcaagaaactaataaaacgttctggttttctcctttgaaaaaaa

SEQ ID NO: 278659 - DNA, 1574 bp, Homo sapiens
agtccgtgcgcgagggcgccggcgagccgtctcggaagcagcatgcaggcgcgctactccgtgtccgaccccaacgccctgggagtggtgccctacctgagcgagcagaattactaccgggctgcgggcagctacggcggcatggccagccccatgggcgtctattccggccacccggagcagtacagcgcggggatgggccgctcctacgcgccctaccaccaccaccagcccgcggcgcctaaggacctggtgaagccgccctacagctacatcgcgctcatcaccatggccatccagaacgcgcccgagaagaagatcaccttgaacggcatctaccagttcatcatggaccgcttccccttctaccgggagaacaagcagggctggcagaacagcatccgccacaacctctcgctcaacgagtgcttcgtcaaggtgccccgcgacgacaagaagcccggcaagggcagttactggaccctggacccggactcctacaacatgttcgagaacggcagcttcctgcggcgccggcggcgcttcaaaaagaaggacgtgtccaaggagaaggaggagcgggcccacctcaaggagccgcccccggcggcgtccaagggcgccccggccaccccccacctagcggacgcccccaaggaggccgagaagaaggtggtgatcaagagcgaggcggcgtccccggcgctgccggtcatcaccaaggtggagacgctgagccccgagagcgcgctgcagggcagcccgcgcagcgcggcctccacgcccgccggctcccccgacggctcgctgccggagcaccacgccgcggcgcccaacgggctgcctggcttcagcgtggagaacatcatgaccctgcgaacgtcgccgccgggcggagagctgagcccgggggccggacgcgcgggcctggtggtgccgccgctggcgctgccctacgccgccgcgccgcccgccgcctacggccagccgtgcgctcagggcctggaggccggggccgccgggggctaccagtgcagcatgcgagcgatgagcctgtacaccggggccgagcggccggcgcacatgtgcgtcccgcccgccctggacgaggccctctcggaccacccgagcggccccacgtcgcccctgagcgctctcaacctcgccgccggccaggagggcgcgctcgccgccacgggccaccaccaccagcaccacggccaccaccacccgcaggcgccgccgcccccgccggctccccagccccagccgacgccgcagcccggggccgccgcggcgcaggcggcctcctggtatctcaaccacagcggggacctgaaccacctccccggccacacgttcgcggcccagcagcaaactttccccaacgtgcgggagatgttcaactcccaccggctggggattgagaactcgaccctcggggagtcccaggtgagtggcaatgccagctgccagctgccctacagatccacgccgcctctctatcgccacgcagccccctactcctacgactgcacgaaatactgacgtgtcccgggacctcccctccccgg

SEQ ID NO: 278660 - DNA, 680 bp, Homo sapiens
caactgttgggaaagggaaaaaaacagcatcactcagttgaacactttgatacttggtatttgtcaggttaggtactggggatgctaaatgaatgaaattacccatttcataagaggactcaatctagtgaaggagaaaggaaaatggtatagtgtataggtgctatataataaatggaagcacaagttgctttggggacataacgaggcatctgcaccagaatggacaaattggaaaggatttctggagaaatcaccagaaaagtcttaagtggattttccctgtgcacatacaaatggcatggaggtcaggaagaacatagcatgtttaggaatggggataggagtgagttggaaaatagcccacaaagataacgtcacttgccttatgccaggcactaccctaagccccttaatcccttatttaagtgcttccttaatcttcacaactcagtaagatagagactgctgttattcccgttttatagatgaggaaaaagactaaggatcacagttggaaagatactagaggaatataattagaatcttatctaacatttgaactttgtaaaccttagggtctgaggagtattcctcaaaaaatgtttataatgatcagtaagaataattttataccatgattcattaaacaatacataaaacaagttcacaagacaata

SEQ ID NO: 278661 - DNA, 307 bp, Homo sapiens
cttctgtctacatataatacagttgaagacagctcagcttcattatccaagtgcttggggagcagtgcagaggggataaattcccaggtcatcctaggaatggccagtctctaaaataaaaagggaacagagtccataactcttctaagaagaggaagcaaatcaaagcctggaattcaaagctttcttcagcagagtcaacagaccaataaagaaagggagtccctctgcctgtggcattgtccacactcacagggtcccacactcttatttgttcctacagagtaaaacgaggctagaaatacct

SEQ ID NO: 278662 - DNA, 222 bp, Homo sapiens
tggaaaaaaaagtaggacagtgagacaacacagtgagacaacgtcagtcacaatgagctgacctaaagtaggggtcagctgggggaagaatagcacaaatcacattggaatgaaagatatgactacataatgtttattgcgatctattttaaggcttttcatggcttaagttgtaattttgatgtaactaaagtttacattgttttctcaaagaataacgca

SEQ ID NO: 278663 - DNA, 207 bp, Homo sapiens
gatgagtaggattttagtatgaggaacaaaggaagaagagtatttcagccctacaaacagcatgatcaaagatctactccacagctcttctcccttcctggaagagaatgatgctgtgaatgtccaatatccaatgaaatgccagcatatcaaaatggatgctaatagttgaccttcccaaagcctcactgatgctctgctcatctt

SEQ ID NO: 278664 - DNA, 712 bp, Homo sapiens
tggaaaaaaaagtaggacagtgagacaacacagtgagacaacgtcagtcacaatgagctgacctaaagtaggggtcagctgggggaagaatagcacaaatcacattggaatgaaagatatgactacataatgtttattgcgatctattttaaggcttttcatggatcttttcagctatgcacatggttagtcataatgattgtcattttaggtcagagtttctcagccttagcattgttgacattttggttaattctttgttgtaggggctgtcctgtacactgtagggtgtttagcagcatccctgatctctacctactaaatgccaggagcaacacagtacctccagctcagttgtgacaactactgaatgtctccagacaactactgaatgtctccagacattgcagagaaattgagtctggttgagaagtcactgttttagggcataatttttgggtagactgttagattctttgtgttcgttgtctctggcctgtataactcttcttaattatctgctactcaaatgtatttgggatcagccactgtcttccatttctcttttgctcacagatctactccacagctcttctcccttcctggaagagaatgatgctgtgaatgtccaatatccaatgaaatgccagcatatcaaaatggatgctaatagttgaccttcccaaagcctcactgatgctctgctcatctt

SEQ ID NO: 278665 - DNA, 1172 bp, Homo sapiens
gatgagtcatgcctatgcctgggagactggcagggaagttggggaggtacatgaagcataatcagagttaccagtgttcggtgaaccaccgaaccagtgtttgctttcatacgaccgcgtgtcagatcatctactcttccaccagtaaatctattttgctgagggatacacaaaagaagcactgaaaaactatacataagattttctttaggtaattttttattaatatttcaatgttggtagaatactgctacatacccagaattcaggattttctactatattctattctagtacaaaatgagattttttcccctcaaaatcagttcacaataacttctaatacatctgttatgaaaaatgcttaattcttcatataactatgtgtcttatatatagggtgatcgtacaatttattatacaaaatgggacatacctgagagtgaaaggaagcactattaaaaattaaggtgggactacaggcatgaaaccagaactgtcttaggccaactaggacatatgcttatcatctttatatacccggtgacctcctatgtcagcaaataaagaatatatactaatatcaatagatcaccatgctgtactattgagtgagaaaccgtagtagcagaaggaactgtgaggtgggagacagtagtatggggaaagacatgaacaccacagccctgttttctatacaaatatatacatatatgaaatttggggacattagtaaaaggggtctttggccttatccgtaatattttaacattatataagaaaaatacatctatgcattatttgtatagttacttttaaatctaagttacacagaagcactctgaatgtgtagaaataaaagcttgatgattttgggttggctttctagccccacaatttaaaaccaacacacaccgctatgggtgtttatagacatcaaaatttagagcagagaggcatagatgcctacttgttctctagcatggtgtaattgactctgcaatctcaagaaaagaaaaactcattttcagtttagagctcaaaacgtgactgaattgagtaattgaaaaccatggtatcaagcctgtaatcccagcactttgggaggccgaggtgggtggatcacctgagctcaggagttcgataccatcacggctgacatggtgaaaccc

SEQ ID NO: 278666 - DNA, 1304 bp, Homo sapiens
cagatcttttaaaatgtcactttactagaggctcttcttggctaccctatatgaaataaattccttcattttactccattgcacttagacataccatatatttacttcatccatctctaccatacaatataacgtgcttgagggcagggatattttattaacatatatatctctagtacctgaacaaagtgtgaaaaaagtagatggtcaataaaatgctgaatgaccaaatggaacttgttggggactctattaaatacaaatcaattaagctaaattaatgtactttcagtccagagaaaatgttgcaaaaagagttacagaagaaacagaaggcatcatggtacatcccaaccaggagcctgcagtgatagctggacaagggacaattgccctggaagtgctgaaccaggtaaaatagctgagttcttcctgtttagctactggtaaagctgttgggctatattcaattattttatatgtatacattaaatataaaactgcttacagtttatattttcactaaaggttcctttggtggatgcactggtggtacctgtaggtggaggaggaatgcttgctggaatagcaattacagttaaggtgagcagcttctggaggattccctgcttcaagcagaggatttactttacatcctaaatgttctgtatacacgtgctcaacattctgcacacattaccattccttccccttattcctttgggacttgagatgaaggcccatctctgcctcactactctatttactattattattattttttgagacagattctcgctgttgcccaggctggagtgcagtggcacgatcctggcccactgcagcctccacctcccgggttcaagcgattctcctgtctcagcctcctgagtagctgggattacaggcatgagccaccacaccccgctaatttttttgtattttttttagtagagacagggtttcaccatgttggtcaggctggtcttgaactcctgaccttgcgatccacccgccttggcctcccaaagtgttgggattacaggcgtgagccactgcgcccggcctatttattatttctaatatttttattttttttaagagatggggtcttgctgtgttggccaggttggtctggaactcctgggctcaagcagtccttactttggcctcccaaagtgctaggattacaggtgtgagccaccgcacccagccaactctcttcttaatccatgacaattttacagcacaaaagcagttacaagtgacaccatcatagtcttttccctgaattccatgtcatc

SEQ ID NO: 278667 - DNA, 2760 bp, Homo sapiens
ccgacgcggagatccgcacacgctccagcccttccgccatcttcgcggctgctgctacagccgtagcggctccgccaccgccgcgcgcagccaggaaaccaccacagacgggcggcgcgcgcgctcgcccacctcccggcctttccccgccccctgccgccctccctttccgaacgacggtggccgcgctgggaggaaaagcgcccgccgccggttccagaggggcgggaccggagcgagagcctgggtggggcgggcgggcgctgcgcgtgcgcagaggtgcggccggggaggcgcgcggaggctggagctggaggcgcggcgccggtgagctgagaaccatgtgtgctcagtattgcatctcctttgctgatgttgaaaaagctcatatcaacattcgagattctatccacctcacaccagtgctaacaagctccattttgaatcaactaacagggcgcaatcttttcttcaaatgtgaactcttccagaaaacaggatcttttaagattcgtggtgctctcaatgccgtcagaagcttggttcctgatgctttagaaaggaagccgaaagctgttgttactcacagcagtggaaaccatggccaggctctcacctatgctgccaaattggaaggaattcctgcttatattgtggtgccccagacagctccagactgtaaaaaacttgcaatacaagcctacggagcgtcaattgtatactgtgaacctagtgatgagtccagagaaaatgttgcaaaaagagttacagaagaaacagaaggcatcatggtacatcccaaccaggagcctgcagtgatagctggacaagggacaattgccctggaagtgctgaaccaggttcctttggtggatgcactggtggtacctgtaggtggaggaggaatgcttgctggaatagcaattacagttaaggctctgaaacctagtgtgaaggtatatgctgctgaaccctcaaatgcagatgactgctaccagtccaagctgaaggggaaactgatgcccaatctttatcctccagaaaccatagcagatggtgtcaaatccagcattggcttgaacacctggcctattatcagggaccttgtggatgatatcttcactgtcacagaggatgaaattaagtgtgcaacccagctggtgtgggagaggatgaaactactcattgaacctacagctggtgttggagtggctgctgtgctgtctcaacattttcaaactgtttccccagaagtaaagaacatttgtattgtgctcagtggtggaaatgtagacttaacctcctccataacttgggtgaagcaggctgaaaggccagcttcttatcagtctgtttctgtttaatttacagaaaaggaaatggtgggaattcagtgtctttagatactgaagacattttgtttcctagtattgtcaactcttagttatcagattcttaatggagagtggctatttcattaagatttaatagttttttttggactaagtagtggaaaaacttttatacttaactgagacattttgtcaaggctaaaaaaaagtcttgcaaaatggggcagtggactgacaggctgacatagaaaataaactttgcccaatcacaacttgtgcctcccatccctggagtactgactggcaccggtaagacagaatctctctgaatccattactccatgcccccttgaggcactgttgaagaaatctcacttttcagccagggtactggttctggtacatatggatcataagtccatttggggaagactcgtttatacaggttcatcagtactgtgtcttgagattttagcttcccatcaaagctgcatttcatgtggccatgggtacctagaaagacatcagaacaagtcggtcaaattaaaagtagaaaattttaaagcaatgacttccaacccaacagtcatttagcaacactgcagaaatgcagacatggtctcaaatcccgtgtttccttacctaaaggttccttgatatgtcctctccggccccacttcgttctcagttccactggtttaaaccacagcacatcctcttagaatcaaacacattaaagaccaagatgaaacatttacccacaaaatgtaaacccaacctttataccacaaaggcaatcagatcccatcctcctccttcatacccacctctgttgaagaacatgtaacgtactactgccatcttagtaaaaattttgaaaggatgaccactcagaacaactctcttgatgaccattctgtctggatctactgacataagatggcctgtagcaatgaggctgtgcattcctaaaggacaaaagcaaagaagctatttaggaatttacaggccaaagtcttcatttattgcccagtccatttaaagacccatgcaagagcctggtttgtcatccctgccctagcccaatctgaggctaagattggtaaactgtaagcccacacttaaccttgtcaataggttcttgaaaacttgtacttcaagagaaatgatgtataacaaaaccatactttttctcatcagttgttacaaggaaaggatgttgaacaaaaggcagttatttgaggactggctatacactgtttcacgtaaaagttggagttttcattgttctattaacaatgttaaatgaagacttactgtattttgaaaaccatcattaccttctccataccatttggctcccaaatttaaataaacaagagaaaacggtgttcatctaaaaaggacc

SEQ ID NO: 278668 - DNA, 2876 bp, Homo sapiens
ccgacgcggagatccgcacacgctccagcccttccgccatcttcgcggctgctgctacagccgtagcggctccgccaccgccgcgcgcagccaggaaaccaccacagacgggcggcgcgcgcgctcgcccacctcccggcctttccccgccccctgccgccctccctttccgaacgacggtggccgcgctgggaggaaaagcgcccgccgccggttccagaggggcgggaccggagcgagagcctgggtggggcgggcgggcgctgcgcgtgcgcagaggtgcggccggggaggcgcgcggaggctggagctggaggcgcggcgccggtgagctgagaaccatgtgtgctcagtattgcatctcctttgctgatgttgaaaaagctcatatcaacattcgagattctatccacctcacaccagtgctaacaagctccattttgaatcaactaacagggcgcaatcttttcttcaaatgtgaactcttccagaaaacaggatcttttaagattcgtggtgctctcaatgccgtcagaagcttggttcctgatgctttagaaaggaagccgaaagctgttgttactcacagcagtggaaaccatggccaggctctcacctatgctgccaaattggaaggaattcctgcttatattgtggtgccccagacagctccagactgtaaaaaacttgcaatacaagcctacggagcgtcaattgtatactgtgaacctagtgatgagtccagagaaaatgttgcaaaaagagttacagaagaaacagaaggcatcatggtacatcccaaccaggagcctgcagtgatagctggacaagggacaattgccctggaagtgctgaaccaggtaaaatagctgagttcttcctgtttagctactggtaaagctgttgggctatattcaattattttatatgtatacattaaatataaaactgcttacagtttatattttcactaaaggttcctttggtggatgcactggtggtacctgtaggtggaggaggaatgcttgctggaatagcaattacagttaaggctctgaaacctagtgtgaaggtatatgctgctgaaccctcaaatgcagatgactgctaccagtccaagctgaaggggaaactgatgcccaatctttatcctccagaaaccatagcagatggtgtcaaatccagcattggcttgaacacctggcctattatcagggaccttgtggatgatatcttcactgtcacagaggatgaaattaagtgtgcaacccagctggtgtgggagaggatgaaactactcattgaacctacagctggtgttggagtggctgctgtgctgtctcaacattttcaaactgtttccccagaagtaaagaacatttgtattgtgctcagtggtggaaatgtagacttaacctcctccataacttgggtgaagcaggctgaaaggccagcttcttatcagtctgtttctgtttaatttacagaaaaggaaatggtgggaattcagtgtctttagatactgaagacattttgtttcctagtattgtcaactcttagttatcagattcttaatggagagtggctatttcattaagatttaatagttttttttggactaagtagtggaaaaacttttatacttaactgagacattttgtcaaggctaaaaaaaagtcttgcaaaatggggcagtggactgacaggctgacatagaaaataaactttgcccaatcacaacttgtgcctcccatccctggagtactgactggcaccggtaagacagaatctctctgaatccattactccatgcccccttgaggcactgttgaagaaatctcacttttcagccagggtactggttctggtacatatggatcataagtccatttggggaagactcgtttatacaggttcatcagtactgtgtcttgagattttagcttcccatcaaagctgcatttcatgtggccatgggtacctagaaagacatcagaacaagtcggtcaaattaaaagtagaaaattttaaagcaatgacttccaacccaacagtcatttagcaacactgcagaaatgcagacatggtctcaaatcccgtgtttccttacctaaaggttccttgatatgtcctctccggccccacttcgttctcagttccactggtttaaaccacagcacatcctcttagaatcaaacacattaaagaccaagatgaaacatttacccacaaaatgtaaacccaacctttataccacaaaggcaatcagatcccatcctcctccttcatacccacctctgttgaagaacatgtaacgtactactgccatcttagtaaaaattttgaaaggatgaccactcagaacaactctcttgatgaccattctgtctggatctactgacataagatggcctgtagcaatgaggctgtgcattcctaaaggacaaaagcaaagaagctatttaggaatttacaggccaaagtcttcatttattgcccagtccatttaaagacccatgcaagagcctggtttgtcatccctgccctagcccaatctgaggctaagattggtaaactgtaagcccacacttaaccttgtcaataggttcttgaaaacttgtacttcaagagaaatgatgtataacaaaaccatactttttctcatcagttgttacaaggaaaggatgttgaacaaaaggcagttatttgaggactggctatacactgtttcacgtaaaagttggagttttcattgttctattaacaatgttaaatgaagacttactgtattttgaaaaccatcattaccttctccataccatttggctcccaaatttaaataaacaagagaaaacggtgttcatctaaaaaggacc

SEQ ID NO: 278669 - DNA, 2428 bp, Homo sapiens
cagatcttttaaaatgtcactttactagaggctcttcttggctaccctatatgaaataaattccttcattttactccattgcacttagacataccatatatttacttcatccatctctaccatacaatataacgtgcttgagggcagggatattttattaacatatatatctctagtacctgaacaaagtgtgaaaaaagtagatggtcaataaaatgctgaatgaccaaatggaacttgttggggactctattaaatacaaatcaattaagctaaattaatgtactttcagtccagagaaaatgttgcaaaaagagttacagaagaaacagaaggcatcatggtacatcccaaccaggagcctgcagtgatagctggacaagggacaattgccctggaagtgctgaaccaggtaaaatagctgagttcttcctgtttagctactggtaaagctgttgggctatattcaattattttatatgtatacattaaatataaaactgcttacagtttatattttcactaaaggttcctttggtggatgcactggtggtacctgtaggtggaggaggaatgcttgctggaatagcaattacagttaaggctctgaaacctagtgtgaaggtatatgctgctgaaccctcaaatgcagatgactgctaccagtccaagctgaaggggaaactgatgcccaatctttatcctccagaaaccatagcagatggtgtcaaatccagcattggcttgaacacctggcctattatcagggaccttgtggatgatatcttcactgtcacagaggatgaaattaagtgtgcaacccagctggtgtgggagaggatgaaactactcattgaacctacagctggtgttggagtggctgctgtgctgtctcaacattttcaaactgtttccccagaagtaaagaacatttgtattgtgctcagtggtggaaatgtagacttaacctcctccataacttgggtgaagcaggctgaaaggccagcttcttatcagtctgtttctgtttaatttacagaaaaggaaatggtgggaattcagtgtctttagatactgaagacattttgtttcctagtattgtcaactcttagttatcagattcttaatggagagtggctatttcattaagatttaatagttttttttggactaagtagtggaaaaacttttatacttaactgagacattttgtcaaggctaaaaaaaagtcttgcaaaatggggcagtggactgacaggctgacatagaaaataaactttgcccaatcacaacttgtgcctcccatccctggagtactgactggcaccggtaagacagaatctctctgaatccattactccatgcccccttgaggcactgttgaagaaatctcacttttcagccagggtactggttctggtacatatggatcataagtccatttggggaagactcgtttatacaggttcatcagtactgtgtcttgagattttagcttcccatcaaagctgcatttcatgtggccatgggtacctagaaagacatcagaacaagtcggtcaaattaaaagtagaaaattttaaagcaatgacttccaacccaacagtcatttagcaacactgcagaaatgcagacatggtctcaaatcccgtgtttccttacctaaaggttccttgatatgtcctctccggccccacttcgttctcagttccactggtttaaaccacagcacatcctcttagaatcaaacacattaaagaccaagatgaaacatttacccacaaaatgtaaacccaacctttataccacaaaggcaatcagatcccatcctcctccttcatacccacctctgttgaagaacatgtaacgtactactgccatcttagtaaaaattttgaaaggatgaccactcagaacaactctcttgatgaccattctgtctggatctactgacataagatggcctgtagcaatgaggctgtgcattcctaaaggacaaaagcaaagaagctatttaggaatttacaggccaaagtcttcatttattgcccagtccatttaaagacccatgcaagagcctggtttgtcatccctgccctagcccaatctgaggctaagattggtaaactgtaagcccacacttaaccttgtcaataggttcttgaaaacttgtacttcaagagaaatgatgtataacaaaaccatactttttctcatcagttgttacaaggaaaggatgttgaacaaaaggcagttatttgaggactggctatacactgtttcacgtaaaagttggagttttcattgttctattaacaatgttaaatgaagacttactgtattttgaaaaccatcattaccttctccataccatttggctcccaaatttaaataaacaagagaaaacggtgttcatctaaaaaggacc

SEQ ID NO: 278670 - DNA, 1752 bp, Homo sapiens
ccgacgcggagatccgcacacgctccagcccttccgccatcttcgcggctgctgctacagccgtagcggctccgccaccgccgcgcgcagccaggaaaccaccacagacgggcggcgcgcgcgctcgcccacctcccggcctttccccgccccctgccgccctccctttccgaacgacggtggccgcgctgggaggaaaagcgcccgccgccggttccagaggggcgggaccggagcgagagcctgggtggggcgggcgggcgctgcgcgtgcgcagaggtgcggccggggaggcgcgcggaggctggagctggaggcgcggcgccggtgagctgagaaccatgtgtgctcagtattgcatctcctttgctgatgttgaaaaagctcatatcaacattcgagattctatccacctcacaccagtgctaacaagctccattttgaatcaactaacagggcgcaatcttttcttcaaatgtgaactcttccagaaaacaggatcttttaagattcgtggtgctctcaatgccgtcagaagcttggttcctgatgctttagaaaggaagccgaaagctgttgttactcacagcagtggaaaccatggccaggctctcacctatgctgccaaattggaaggaattcctgcttatattgtggtgccccagacagctccagactgtaaaaaacttgcaatacaagcctacggagcgtcaattgtatactgtgaacctagtgatgagtccagagaaaatgttgcaaaaagagttacagaagaaacagaaggcatcatggtacatcccaaccaggagcctgcagtgatagctggacaagggacaattgccctggaagtgctgaaccaggtaaaatagctgagttcttcctgtttagctactggtaaagctgttgggctatattcaattattttatatgtatacattaaatataaaactgcttacagtttatattttcactaaaggttcctttggtggatgcactggtggtacctgtaggtggaggaggaatgcttgctggaatagcaattacagttaaggtgagcagcttctggaggattccctgcttcaagcagaggatttactttacatcctaaatgttctgtatacacgtgctcaacattctgcacacattaccattccttccccttattcctttgggacttgagatgaaggcccatctctgcctcactactctatttactattattattattttttgagacagattctcgctgttgcccaggctggagtgcagtggcacgatcctggcccactgcagcctccacctcccgggttcaagcgattctcctgtctcagcctcctgagtagctgggattacaggcatgagccaccacaccccgctaatttttttgtattttttttagtagagacagggtttcaccatgttggtcaggctggtcttgaactcctgaccttgcgatccacccgccttggcctcccaaagtgttgggattacaggcgtgagccactgcgcccggcctatttattatttctaatatttttattttttttaagagatggggtcttgctgtgttggccaggttggtctggaactcctgggctcaagcagtccttactttggcctcccaaagtgctaggattacaggtgtgagccaccgcacccagccaactctcttcttaatccatgacaattttacagcacaaaagcagttacaagtgacaccatcatagtcttttccctgaattccatgtcatc

SEQ ID NO: 278671 - DNA, 2705 bp, Homo sapiens
ccgacgcggagatccgcacacgctccagcccttccgccatcttcgcggctgctgctacagccgtagcggctccgccaccgccgcgcgcagccaggaaaccaccacagacgggcggcgcgcgcgctcgcccacctcccggcctttccccgccccctgccgccctccctttccgaacgacggtggccgcgctgggaggaaaagcgcccgccgccggttccagaggggcgggaccggagcgagagcctgggtggggcgggcgggcgctgcgcgtgcgcagaggtgcggccggggaggcgcgcggaggctggagctggaggcgcggcgccggtgagctgagaaccatgtgtgctcagtattgcatctcctttgctgatgttgaaaaagctcatatcaacattcgagattctatccacctcacaccagtgctaacaagctccattttgaatcaactaacagggcgcaatcttttcttcaaatgtgaactcttccagaaaacaggatcttttaagattcgtggtgctctcaatgccgtcagaagcttggttcctgatgctttagaaaggaagccgaaagctgttgttactcacagcagtggaaaccatggccaggctctcacctatgctgccaaattggaaggaattcctgcttatattgtggtgccccagacagctccagactgtaaaaaacttgcaatacaagcctacggagcgtcaattgtatactgtgaacctagtgatgagatcccaaccaggagcctgcagtgatagctggacaagggacaattgccctggaagtgctgaaccaggttcctttggtggatgcactggtggtacctgtaggtggaggaggaatgcttgctggaatagcaattacagttaaggctctgaaacctagtgtgaaggtatatgctgctgaaccctcaaatgcagatgactgctaccagtccaagctgaaggggaaactgatgcccaatctttatcctccagaaaccatagcagatggtgtcaaatccagcattggcttgaacacctggcctattatcagggaccttgtggatgatatcttcactgtcacagaggatgaaattaagtgtgcaacccagctggtgtgggagaggatgaaactactcattgaacctacagctggtgttggagtggctgctgtgctgtctcaacattttcaaactgtttccccagaagtaaagaacatttgtattgtgctcagtggtggaaatgtagacttaacctcctccataacttgggtgaagcaggctgaaaggccagcttcttatcagtctgtttctgtttaatttacagaaaaggaaatggtgggaattcagtgtctttagatactgaagacattttgtttcctagtattgtcaactcttagttatcagattcttaatggagagtggctatttcattaagatttaatagttttttttggactaagtagtggaaaaacttttatacttaactgagacattttgtcaaggctaaaaaaaagtcttgcaaaatggggcagtggactgacaggctgacatagaaaataaactttgcccaatcacaacttgtgcctcccatccctggagtactgactggcaccggtaagacagaatctctctgaatccattactccatgcccccttgaggcactgttgaagaaatctcacttttcagccagggtactggttctggtacatatggatcataagtccatttggggaagactcgtttatacaggttcatcagtactgtgtcttgagattttagcttcccatcaaagctgcatttcatgtggccatgggtacctagaaagacatcagaacaagtcggtcaaattaaaagtagaaaattttaaagcaatgacttccaacccaacagtcatttagcaacactgcagaaatgcagacatggtctcaaatcccgtgtttccttacctaaaggttccttgatatgtcctctccggccccacttcgttctcagttccactggtttaaaccacagcacatcctcttagaatcaaacacattaaagaccaagatgaaacatttacccacaaaatgtaaacccaacctttataccacaaaggcaatcagatcccatcctcctccttcatacccacctctgttgaagaacatgtaacgtactactgccatcttagtaaaaattttgaaaggatgaccactcagaacaactctcttgatgaccattctgtctggatctactgacataagatggcctgtagcaatgaggctgtgcattcctaaaggacaaaagcaaagaagctatttaggaatttacaggccaaagtcttcatttattgcccagtccatttaaagacccatgcaagagcctggtttgtcatccctgccctagcccaatctgaggctaagattggtaaactgtaagcccacacttaaccttgtcaataggttcttgaaaacttgtacttcaagagaaatgatgtataacaaaaccatactttttctcatcagttgttacaaggaaaggatgttgaacaaaaggcagttatttgaggactggctatacactgtttcacgtaaaagttggagttttcattgttctattaacaatgttaaatgaagacttactgtattttgaaaaccatcattaccttctccataccatttggctcccaaatttaaataaacaagagaaaacggtgttcatctaaaaaggacc

SEQ ID NO: 278672 - DNA, 1712 bp, Homo sapiens
cgcggaggggcccggcgctagtagcccgcagacagcgcggcggcccccagcgggagaggcagcctggcggccaggacagcgcggccgggcgcctccgcgcggtgctctgggagttgtaggcacttgcctctcctctctccttcagctactggctctcgaaactcaaggacctaccggtgggtgggcgcctgtgactcccaggctgcgaacgccgggaactcagtttcttcagaaatgctcgaaccaggacggctcctggagtcctcgcgccctcgcagaaggactacgggccccggcgaccccgggggcggggcttccggcgcgctgccttgtgggcacggtagttccgccgggtctggcttccgcctgccgagcggccccggaccgcaggccggactacacttcccgtcggcccgcctgctctcccgatgccgccttggcgcgagacgttggcaagcagagtgtctccaagatggccgcttggggaaggaggcgtcttggcccgggcagcagtggcggcagcgcccgagagagggaaccaacagtgtttgtaatgaagaacatcagactctgagctgtaacctgaattcttgtccaaaattcagcacactggcaacgagcacatcaaacagattgccacttgtcctgtcggcgtctttgagacacacttgcccatctaggaaagcacagtgcaggtatctgtgttctgccaccgtgtgccagcccggaccagctcacagacagccctgcctgtcttacttgggctgctcggcttcactgtctcagggcccctgaacctcccagagccctccgtgattgttggaatggtgagcttgtcggccacagactgctacattgtgcatgagatctacaatggggagaatgcccaagaccagtttgagtacgagctggagcaggccctggaagcccagtacaagtacattgtgattgagcccactcgcattggcgacgagacagcccgctggatcaccgtgggcaactgcctgcacaagacggccgtgctggcgggcaccgcctgcctcttcaccccgttggcgctgcccttagattattcccactacatttccctgcccgctggtgtgctgagcctggcctgctgcaccctctatgggatctcctggcagtttgacccttgctgcaagtaccaagtggagtacgacgcctataaactgtcgcgcctgcctctgcacacactcacctcctccaccccggtggtgctggtccggaaggacgacctgcacagaaagagactgcacaacacgatagcactggccgccctggtgtactgtgtaaagaagatttacgaactctatgccgtatgatttcagtagaacagggagcgaagcaaaaccacccggcccacaagagacaacagagtattcagatcgccacactctgtgaggcagcagagcctgggcaggtgtttggcttagtatttgttatttttaaaaaataacagatcacgggtgtacccagggtttttcagctcattacactaagatgtggatttccataacccaagaggggggtctgaggctgtggaagtccgactgggcagtggaatgctgatggaggcagacgctgccgagggggtgtggacgtgctttgggggaggtctttaagtctattgtttaactgtaccatccagagcccaccagaagctattgatcattaaaattatgagaatttca

SEQ ID NO: 278673 - DNA, 944 bp, Homo sapiens
cgtgagtgcgtctatgtgcccaggggcagcacgtggctgtgcagctgccctgagagagggtgagcttgtcggccacagactgctacattgtgcatgagatctacaatggggagaatgcccaagaccagtttgagtacgagctggagcaggccctggaagcccagtacaagtacattgtgattgagcccactcgcattggcgacgagacagcccgctggatcaccgtgggcaactgcctgcacaagacggccgtgctggcgggcaccgcctgcctcttcaccccgttggcgctgcccttagattattcccactacatttccctgcccgctggtgtgctgagcctggcctgctgcaccctctatgggatctcctggcagtttgacccttgctgcaagtaccaagtggagtacgacgcctataaactgtcgcgcctgcctctgcacacactcacctcctccaccccggtggtgctggtccggaaggacgacctgcacagaaagagactgcacaacacgatagcactggccgccctggtgtactgtgtaaagaagatttacgaactctatgccgtatgatttcagtagaacagggagcgaagcaaaaccacccggcccacaagagacaacagagtattcagatcgccacactctgtgaggcagcagagcctgggcaggtgtttggcttagtatttgttatttttaaaaaataacagatcacgggtgtacccagggtttttcagctcattacactaagatgtggatttccataacccaagaggggggtctgaggctgtggaagtccgactgggcagtggaatgctgatggaggcagacgctgccgagggggtgtggacgtgctttgggggaggtctttaagtctattgtttaactgtaccatccagagcccaccagaagctattgatcattaaaattatgagaatttca

SEQ ID NO: 278674 - DNA, 1705 bp, Homo sapiens
cgcggaggggcccggcgctagtagcccgcagacagcgcggcggcccccagcgggagaggcagcctggcggccaggacagcgcggccgggcgcctccgcgcggtgctctgggagttgtaggcacttgcctctcctctctccttcagctactggctctcgaaactcaaggacctaccggtgggtgggcgcctgtgactcccaggctgcgaacgccgggaactcagtttcttcagaaatgctcgaaccaggacggctcctggagtcctcgcgccctcgcagaaggactacgggccccggcgaccccgggggcggggcttccggcgcgctgccttgtgggcacggtagttccgccgggtctggcttccgcctgccgagcggccccggaccgcaggccggactacacttcccgtcggcccgcctgctctcccgatgccgccttggcgcgagacgttggcaagcagagtgtctccaagatggccgcttggggaaggaggcgtcttggcccgggcagcagtggcggcagcgcccgagagagggaaccaacagtgtttgtaatgaagaacatcagactctgagctgtaacctgaattcttgtccaaaattcagcacactggcaacgagcacatcaaacagattgccacttgtcctgtcggcgtctttgagacacacttgcccatctaggaaagcacagtgcaggtatctgtgttctgccaccgtgtgccagcccggaccagctcacagacagccctgcctgtcttacttgggctgctcggcttcactgtctcagggcccctgaacctcccagagccctccgtgattgttggaatggtgagcttgtcggccacagactgctacattgtgcatgagatctacaatggggagaatgcccaagaccagtttgagtacgagctggagcaggccctggaagcccagtacaagtacattgtgattgagcccactcgcattggcgacgagacagcccgctggatcaccgtgggcaactgcctgcacaagacggccgtgctggcgggcaccgcctgcctcttcaccccgttggcgctgcccttagattattcccactacatttccctgcccgctggtgtgctgagcctggcctgctgcaccctctatgggatctcctggcagtttgacccttgctgcaagtaccaagtggagtacgacgcctataaactgtcgcgcctgcctctgcacacactcaactctgtgaggcagcagagcctgggcaggtgtttggcttagtatttgttatttttaaaaaataacagatcacgggtgtacccagggtttttcagctcattacactaagatgtggatttccataacccaagaggggggtctgaggctgtggaagtccgactgggcagtggaatgctgatggaggcagacgctgccgagggggtgtggacgtgctttgggggaggtctttaagtctattgtttaactgtaccatccagagcccaccagaagctattgatcattaaaattatgagaatttcaactcccgctgttctctctttccatgactgcccgcagctgctgctgcacatctgctctgggtggcggcttgcacatggaaggagcaggtgccatggtagccaccctgccctgctcctagctgcggcccagtgttaccacttacagcgacgacaagcctagatccaaggtagtcctggggccaaaccccg

SEQ ID NO: 278675 - DNA, 1420 bp, Homo sapiens
cgcggaggggcccggcgctagtagcccgcagacagcgcggcggcccccagcgggagaggcagcctggcggccaggacagcgcggccgggcgcctccgcgcggtgctctgggagttgtaggcacttgcctctcctctctccttcagctactggctctcgaaactcaaggacctaccggtgggtgggcgcctgtgactcccaggctgcgaacgccgggaactcagtttcttcagaaatgctcgaaccaggacggctcctggagtcctcgcgccctcgcagaaggactacgggccccggcgaccccgggggcggggcttccggcgcgctgccttgtgggcacggtagttccgccgggtctggcttccgcctgccgagcggccccggaccgcaggccggactacacttcccgtcggcccgcctgctctcccgatgccgccttggcgcgagacgttggcaagcagagtgtctccaagatggccgcttggggaaggaggcgtcttggcccgggcagcagtggcggcagcgcccgagagagggtgagcttgtcggccacagactgctacattgtgcatgagatctacaatggggagaatgcccaagaccagtttgagtacgagctggagcaggccctggaagcccagtacaagtacattgtgattgagcccactcgcattggcgacgagacagcccgctggatcaccgtgggcaactgcctgcacaagacggccgtgctggcgggcaccgcctgcctcttcaccccgttggcgctgcccttagattattcccactacatttccctgcccgctggtgtgctgagcctggcctgctgcaccctctatgggatctcctggcagtttgacccttgctgcaagtaccaagtggagtacgacgcctataaactgtcgcgcctgcctctgcacacactcacctcctccaccccggtggtgctggtccggaaggacgacctgcacagaaagagactgcacaacacgatagcactggccgccctggtgtactgtgtaaagaagatttacgaactctatgccgtatgatttcagtagaacagggagcgaagcaaaaccacccggcccacaagagacaacagagtattcagatcgccacactctgtgaggcagcagagcctgggcaggtgtttggcttagtatttgttatttttaaaaaataacagatcacgggtgtacccagggtttttcagctcattacactaagatgtggatttccataacccaagaggggggtctgaggctgtggaagtccgactgggcagtggaatgctgatggaggcagacgctgccgagggggtgtggacgtgctttgggggaggtctttaagtctattgtttaactgtaccatccagagcccaccagaagctattgatcattaaaattatgagaatttca

SEQ ID NO: 278676 - DNA, 1608 bp, Homo sapiens
cgcggaggggcccggcgctagtagcccgcagacagcgcggcggcccccagcgggagaggcagcctggcggccaggacagcgcggccgggcgcctccgcgcggtgctctgggagttgtaggcacttgcctctcctctctccttcagctactggctctcgaaactcaaggacctaccggtgggtgggcgcctgtgactcccaggctgcgaacgccgggaactcagtttcttcagaaatgctcgaaccaggacggctcctggagtcctcgcgccctcgcagaaggactacgggccccggcgaccccgggggcggggcttccggcgcgctgccttgtgggcacggtagttccgccgggtctggcttccgcctgccgagcggccccggaccgcaggccggactacacttcccgtcggcccgcctgctctcccgatgccgccttggcgcgagacgttggcaagcagagtgtctccaagatggccgcttggggaaggaggcgtcttggcccgggcagcagtggcggcagcgcccgagagagggtgagcttgtcggccacagactgctacattgtgcatgagatctacaatggggagaatgcccaagaccagtttgagtacgagctggagcaggccctggaagcccagtacaagtacattgtgattgagcccactcgcattggcgacgagacagcccgctggatcaccgtgggcaactgcctgcacaagacggccgtgctggcgggcaccgcctgcctcttcaccccgttggcgctgcccttagattattcccactacatttccctgcccgctggtgtgctgagcctggcctgctgcaccctctatgggatctcctggcagtttgacccttgctgcaagtaccaagtggagtacgacgcctataaactgtcgcgcctgcctctgcacacactcacctcctccaccccggtggtgctggtccggaaggacgacctgcacagaaagagactgcacaacacgatagcactggccgccctggtgtactgtgtaaagaagatttacgaactctatgccgtatgatttcagtagaacagggagcgaagcaaaaccacccggcccacaagagacaacagagtattcagatcgccacactctgtgaggcagcagagcctgggcaggtgtttggcttagtatttgttatttttaaaaaataacagatcacgggtgtacccagggtttttcagctcattacactaagatgtggatttccataacccaagaggggggtctgaggctgtggaagtccgactgggcagtggaatgctgatggaggcagacgctgccgagggggtgtggacgtgctttgggggaggtctttaagtctattgtttaactgtaccatccagagcccaccagaagctattgatcattaaaattatgagaatttcaactcccgctgttctctctttccatgactgcccgcagctgctgctgcacatctgctctgggtggcggcttgcacatggaaggagcaggtgccatggtagccaccctgccctgctcctagctgcggcccagtgttaccacttacagcgacgacaagcctagatccaaggtagtcctggggccaaaccccg

SEQ ID NO: 278677 - DNA, 1860 bp, Homo sapiens
cgcggaggggcccggcgctagtagcccgcagacagcgcggcggcccccagcgggagaggcagcctggcggccaggacagcgcggccgggcgcctccgcgcggtgctctgggagttgtaggcacttgcctctcctctctccttcagctactggctctcgaaactcaaggacctaccggtgggtgggcgcctgtgactcccaggctgcgaacgccgggaactcagtttcttcagaaatgctcgaaccaggacggctcctggagtcctcgcgccctcgcagaaggactacgggccccggcgaccccgggggcggggcttccggcgcgctgccttgtgggcacggtagttccgccgggtctggcttccgcctgccgagcggccccggaccgcaggccggactacacttcccgtcggcccgcctgctctcccgatgccgccttggcgcgagacgttggcaagcagagtgtctccaagatggccgcttggggaaggaggcgtcttggcccgggcagcagtggcggcagcgcccgagagagggaaccaacagtgtttgtaatgaagaacatcagactctgagctgtaacctgaattcttgtccaaaattcagcacactggcaacgagcacatcaaacagattgccacttgtcctgtcggcgtctttgagacacacttgcccatctaggaaagcacagtgcaggtatctgtgttctgccaccgtgtgccagcccggaccagctcacagacagccctgcctgtcttacttgggctgctcggcttcactgtctcagggcccctgaacctcccagagccctccgtgattgttggaatgactacaggtacacaccagcatgacacctcagccatgagaagctgcccgcgtccagacttctgcctttcatggacaccgagaaggttctggagcaggaagtgagccacctcccgctcttcttggcagtggaaggaggccctcccacggggtgagcttgtcggccacagactgctacattgtgcatgagatctacaatggggagaatgcccaagaccagtttgagtacgagctggagcaggccctggaagcccagtacaagtacattgtgattgagcccactcgcattggcgacgagacagcccgctggatcaccgtgggcaactgcctgcacaagacggccgtgctggcgggcaccgcctgcctcttcaccccgttggcgctgcccttagattattcccactacatttccctgcccgctggtgtgctgagcctggcctgctgcaccctctatgggatctcctggcagtttgacccttgctgcaagtaccaagtggagtacgacgcctataaactgtcgcgcctgcctctgcacacactcacctcctccaccccggtggtgctggtccggaaggacgacctgcacagaaagagactgcacaacacgatagcactggccgccctggtgtactgtgtaaagaagatttacgaactctatgccgtatgatttcagtagaacagggagcgaagcaaaaccacccggcccacaagagacaacagagtattcagatcgccacactctgtgaggcagcagagcctgggcaggtgtttggcttagtatttgttatttttaaaaaataacagatcacgggtgtacccagggtttttcagctcattacactaagatgtggatttccataacccaagaggggggtctgaggctgtggaagtccgactgggcagtggaatgctgatggaggcagacgctgccgagggggtgtggacgtgctttgggggaggtctttaagtctattgtttaactgtaccatccagagcccaccagaagctattgatcattaaaattatgagaatttca

SEQ ID NO: 278678 - DNA, 918 bp, Homo sapiens
  misc_feature (7)..(7): n is a, c, g, or t
gaaattntcataattttaatggtcaatagcttggtgagcttgtcggccacagactgctacattgtgcatgagatctacaatggggagaatgcccaagaccagtttgagtacgagctggagcaggccctggaagcccagtacaagtacattgtgattgagcccactcgcattggcgacgagacagcccgctggatcaccgtgggcaactgcctgcacaagacggccgtgctggcgggcaccgcctgcctcttcaccccgttggcgctgcccttagattattcccactacatttccctgcccgctggtgtgctgagcctggcctgctgcaccctctatgggatctcctggcagtttgacccttgctgcaagtaccaagtggagtacgacgcctataaactgtcgcgcctgcctctgcacacactcacctcctccaccccggtggtgctggtccggaaggacgacctgcacagaaagagactgcacaacacgatagcactggccgccctggtgtactgtgtaaagaagatttacgaactctatgccgtatgatttcagtagaacagggagcgaagcaaaaccacccggcccacaagagacaacagagtattcagatcgccacactctgtgaggcagcagagcctgggcaggtgtttggcttagtatttgttatttttaaaaaataacagatcacgggtgtacccagggtttttcagctcattacactaagatgtggatttccataacccaagaggggggtctgaggctgtggaagtccgactgggcagtggaatgctgatggaggcagacgctgccgagggggtgtggacgtgctttgggggaggtctttaagtctattgtttaactgtaccatccagagcccaccagaagctattgatcattaaaattatgagaatttca

SEQ ID NO: 278679 - DNA, 1558 bp, Homo sapiens
cgcggaggggcccggcgctagtagcccgcagacagcgcggcggcccccagcgggagaggcagcctggcggccaggacagcgcggccgggcgcctccgcgcggtgctctgggagttgtaggcacttgcctctcctctctccttcagctactggctctcgaaactcaaggacctaccggtgggtgggcgcctgtgactcccaggctgcgaacgccgggaactcagtttcttcagaaatgctcgaaccaggacggctcctggagtcctcgcgccctcgcagaaggactacgggccccggcgaccccgggggcggggcttccggcgcgctgccttgtgggcacggtagttccgccgggtctggcttccgcctgccgagcggccccggaccgcaggccggactacacttcccgtcggcccgcctgctctcccgatgccgccttggcgcgagacgttggcaagcagagtgtctccaagatggccgcttggggaaggaggcgtcttggcccgggcagcagtggcggcagcgcccgagagagggaaccaacagtgtttgtaatgaagaacatcagactctgagctgtaacctgaattcttgtccaaaattcagcacactggcaacgagcacatcaaacagattgccacttgtcctgtcggcgtctttgagacacacttgcccatctaggaaagcacagtgcaggtatctgtgttctgccaccgtgtgccagcccggaccagctcacagacagccctgcctgtcttacttgggctgctcggcttcactgtctcagggcccctgaacctcccagagccctccgtgattgttggaatggtgagcttgtcggccacagactgctacattgtgcatgagatctacaatggggagaatgcccaagaccagtttgagtacgagctggagcaggccctggaagcccagtacaagtacattgtgattgagcccactcgcattggcgacgagacagcccgctggatcaccgtgggcaactgcctgcacaagacggccgtgctggcgggcaccgcctgcctcttcaccccgttggcgctgcccttagattattcccactacatttccctgcccgctggtgtgctgagcctggcctgctgcaccctctatgggatctcctggcagtttgacccttgctgcaagtaccaagtggagtacgacgcctataaactgtcgcgcctgcctctgcacacactcacacccggcccacaagagacaacagagtattcagatcgccacactctgtgaggcagcagagcctgggcaggtgtttggcttagtatttgttatttttaaaaaataacagatcacgggtgtacccagggtttttcagctcattacactaagatgtggatttccataacccaagaggggggtctgaggctgtggaagtccgactgggcagtggaatgctgatggaggcagacgctgccgagggggtgtggacgtgctttgggggaggtctttaagtctattgtttaactgtaccatccagagcccaccagaagctattgatcattaaaattatgagaatttca

SEQ ID NO: 278680 - DNA, 421 bp, Homo sapiens
aaaggagatgaggacccaagtgagatgtgctctccgcagtgcaggctcagacctcccccagcgctgaaacacagttaagtgctcctcagcctaatcatcctgtctctctctctctctccctttcctgccccctccatcaaaaggggtgagcttgtcggccacagactgctacattgtgcatgagatctacaatggggagaatgcccaagaccagtttgagtacgagctggagcaggccctggaagcccagtacaagtacattgtgattgagcccactcgcattggcgacgagacagcccgctggatcaccgtgggcaactgcctgcacaagacggccgtgctggcgggcaccgcctgcctcttcaccccgttggcgctgcccttagattattcccactacatttccctgcccgctggtgtg

SEQ ID NO: 278681 - DNA, 1996 bp, Homo sapiens
gatctcagcgatgtcctctctgtgctcccagctgggaaacatattggtgaatgtcaggggctccagaccagcgtggataaggtaagacttgggggctggtttcttgagattttttcctgtagttacacagattgcaatgtcagtagaccccagggagaccctgtctttctctgatttcccttgaaatcttttcttctttgccagaactcatgacttcatgcttaaaatgcaagttaccagtagttcataacaacacatggataatgtttatataagatgtttgttagtttcatgcctgtgactaccatagtgacctataatcaacctgagtctatacttcttgaacctaacaaaacgctgtgtattcctggaagggagagagaggctctgtctgcagcttctgggtggagcattttcttcctcctgaattcacctgtagagtcatccgtctcatttcctagcacaggattaactcccataatgactgacggcgaacgacagcatcttatacatccacattcactataacattgagtggaaggtttcatatgttatttattgctaaagagtttttcaggaagagaatccattgcacatactcagtgacattaaactagttgtgtcaatgaaaccataaaaattaaataagattaattactggcattttcattttatataaaagactagaaatttcatgtgtatagtaaagaaccatgaacttactatgggtatttctctttggatataatactaaaaataataatgaataataaaaaggttggcaatggccgttcactgtttgggggagacctccattctccaacagcgtggtagtgcttgcagataatgtacagggcagaggccaacttgtctctcagcatgatcaaccccgagtacagcggggttttaatctgcctggggcattccacaatacagcctttatccttgagggtaacaagttagcctcataatatcagagagaaaaactagttcttcttcatgctggcagctgagaatgcgctaatctaaaacttaatacatctcaaaaagttaaaggggaaaaaattggtttcatcaccacctgccaggctttatggatggatgctggctgacatgcacagaaggggaagggggtctcctggctgcgcatgcctgaggggcttccccatctgttccgtgctgcaggcatgttagagggagcctcacctttgcagtactggagcacagtctccatcgcactcttccggtcggaggcccagcggatgcgggcggaaccagtgatcttgttctcgatgggccaccagccttgccagaggtacacctcgtggtgattgtcaacaaggaaaagtgctgtgagggcagggacagggccagaccatcaggagctccttcacggacacttctagctcactcctcccccaacctagtggatgttgtccctcttgactgcagtgtcacagggggaaacccccttggccatcaaaccaggggcaaaggggcaaacagagaaacccaggataccccagccctttgacagttcaacggggagaagcctgtaggcagagagaagtggtgtcaaggagttggtctttttcattcctcgtcctccaggtcctcctccctttgccccagctcaaggccctggcccttctggatactggcagggctgtgctaagagtggaagggataatgcatgtgccactcaaggggctgttagcaccgcatatctccaaagagcacaatcaacactggagcgcacatctcactgcagacaggtcagtggcgttcctgccctgcacgcgattgcttagcagtgaggtgagctcatggctctcttacagagaaatgggccttaaaaagcaaaactgccaccgggagtggtggctcatgcctgtaatcccagtgctttgggaggctgaggaggaaggactgcttgagcccggaggttgaagaccagcctgggccacatgatgagaccctatctctacaaaaaaaa

SEQ ID NO: 278682 - DNA, 5214 bp, Homo sapiens
agccactgttatgcaaagttcaagggcctctctcacacttagctgggggaggagtgaatacagcctttctgaagaaagaaaaattaagtaatagcaaaatcattaagtgtttatgattcataaatacagtttttgtcaactaaaaaaataaaatatgtagaagtcaaaaaagtgtctatgattcagaaatgccaccgttagaagttgccataagagtgcacacaaaaaggacatatgggtcaaagtgtttgcagcagtgttgtcccaaataaggacattttgcaacattgtggggtggttaaaataactatagaatatgcattagaatacaatgaaaccattaaacataatgtggaagaatattgtatattatagggaaatgctcataatatatagtgacaatttaaaaagcagattacaaaacaatatgccaagacatgatttctgcccaagtctgccctgatgggtgagctaaccaaggttgctgcactgtgagggcataggggctgcccctcagcccccaccccagccactgggctcctcaggaaaggacacgtgagtgtttactgcacatcctacagatgaggagctcacaaggaccctggatgggggagtcctctgaggttgctggagctgctgcagccatcttgtcactgccaggggagagctctctctgagagcgaaggcacagtggaggaaagcagaactaagaagagacagagaaagcgaaagtgggagagagagagagatatgaggtgacaaagtgtgggtccttggatcctgcttggtgtaaagctagcctgctcctggactttacagataataaattccttcctcatcagattaacctgggtttttgtggcttgtaaccaaaagggtctgcacggcccacacacaggctcccagctcatttcctttgcaatgagtggtaactggaggcgggcggtgcatggacctgccttgcaaggcttctctgttagtggtgcctggagcccactctctcagctggcacagccagtgtgacacatcagtccgggtgtgtcctggacctaccccctttctgggtgcaaaccagaactgaggatgccgagggtggtgggggggtagtttcctgcctcagggctgtgctcctgctacctctttgcctaaaattctcccctctctgtgctcccagggccagctcctttgtatgctctgtgattctttgaacagcgccccctctgagaagccttccctgaccacctggctgaggacatcattctgtcccagcttccatttgctttgggagtggcctcctgacacttcacttccgtgaggcagggaccagttctgtcctggtcactgctgtatccccagctctagataaggcctgagacatcgtaggagtgccagggatctttggttactgagaaaacgagcagctagatcaaggttcccaacaccaacacgctggggacatgttgggagtcaacttagccctaccagcaggtggaactagttttgctgctccaaaacagagttctagctatggggacagccactagagagcagagctaagtccatgctatgctgaggggccacagtctgccctgaactgtgcctcccagcctggagctagtgagggggccgagcctgggagctgacagatgagggctcggcgtggggacttttggaggggagggcattttcttgatcttaccatgggggcaacagctagatgggtagggggggacccactcaaggacatactgcggcttcaggcttcgaccagcccagaacgctcgctccatctgagggtcttgatatcagggtgtggcgtcaggagccggagcctacgggttgaaagccaagagtgggcaatcaaagctgaaaccaggcccacgacttaggagctggagagcacacagggctgaacactcgagttggtgaccaggaaaccagggagcaaagtctccagggtgcttgggcaagaccccagatggtctgcagcaacgcacgggcaacacgggatgatcagcgctacgtggtgagaaacttacctccttttgcaggacaacattttccagtccttctgagtaaatcaaagagaagtctcagcttggtgattgcaggtctctaatgcttatttctctgtctctgtctctctctctttaacaaaagtctaccagcggcctcaggctcagggcctgtctcaggtaaaagcgggttagggtgtaataacagtgatcggtttcattgtgtttatttttgtagctactttctaattatagcaagtgattctgagtttccatttaggatagtaataggaagtttctttttcaagtaaatgtgcataagtaaaaggagactgctcaaaggaaaacagctggtgattgatagaacaggctgtggcattgttgggccccagagggaagggctgtgtgagcatgcaggaaattctgggaaggcagctaaatgcagttgctgcatgggggccaggaagcatttggagacgtggctgggcacagcttggcttttgagcccaagagaggcctgctggggatgtgttgggagccaacctacccctaccagcaggtggaactggttttgccactccaaaacagagttccagctatggggacagccactagagagcagagctaagggcattctaggccaaggggtcacagtccaccctgaactgtgcctcccagcctgaagccagaaagctcagggaggctagcggccctgcccaggcctcagcactgaccctgcacccctaggcccagctggatgacccctaagagcttcctggaatttggatgcagggttattctgtgtgtgctgcctctcagagcatgtcactttgacgtggacatctcgggtctggttctggtgctgtccctgtctcgccacgtgaccctggataagtcatctctccaggccttgatttccccatctgtaaacagaggtgagtgaaatgatctttaaaggcgtgtcagtccattttgcattgctataaaggaatacctgaggttgggtagcttataaagaaaagagggttatttggctcacagttgtgcaggttgtacagaagcatggcaccagcattgcttcttgtgaagcttcaggaagcttccacttatggtggaaggggaagggggagttcgtgacttacatggcaagagagggagcaagagccatgtcaggctcttctaaacaaccagctctcatgtaaactaacagagtgagaactcattcattaccacggggagggcaccaagccatccatgagggacctgcccccatgagccaaacatctcccaccaggccacaccttcaacactgggagtcacattcagcatgagatttggaggtgaccaccatgcatccaaaccatatcaaggacccatttcggtgaggggaccaggaacatatcccttcccctctcctccacatcctttaatgtggagttcagcaaggaaagtagggcttgggtcaaattaaagcctggtcttaatttcctggtccagttattagctgtgtaaccctgggcaagtcacttaaccccctcaggttacaatgttacaaatgatcacattttcctcaactgaaaaatgggataggaacatgtcccaagcagagctggagtgacggtgctatcaatggcccggcagtgcctggtcacacagtaggcctggggagccctgacttttaccgcacagggagctgcttgcagagcttgttttcaattgtgggcttggcagggaactgccggcatcccaggggacagggtctcatgaggatgcctaatcccagctcaaagtggagaccccaggactccatcacagccagtgggggggagtggctgctgcagcagggagggcttcattggaatgaacccctttaagctccagtccaaatgcccagagtggttttgcaggtatggttgtgaggctggcatggtagtcccatctgcagtcccctgggatgaggcacctgtatggtagagggcccgggtggagagaagagaaggatggggatgaacccaggaccacagatggcccagttccatggatgattttcattgaggtgccttcaagtcagttcaacactgggcttctcaacctttgaggtatgcaggtaagagtcacctgcggcagtgggggatgctcttgttaaagtgcagactccgattaagcaggtctagggtggggcctgaaattctgtgttcctaacaaggctccatcctgggtatggaggtcaggtaccccctcacctctcctgtggacccagcttttgaggggtcaggagaagaatgttcagtcccagctgccaccactctaaagtcccctagaaacaaggactaatacaggtggcgtgggagagggcccaggcaaacagggaggtggggtaccccggtggggctgcagtgggccctgcggaaagcttgctggaggtgggggcctaaggaattcaaggacttgttccaggaacccaaggaacgagtgggctctaactgctgcagcatatgggagatgccaggaggagctggctgtggcaggccatcccagtccatcagacaacttgtagtggatgaagatgcagtgtccatggccagaagaaactcccgtggatgctcaggccaaggctgccagaagcacgaggaggggcagcattgagtgtcatcgggaaaaggcaaagtgatggtcctgaagctgccccatgtggccagtccctttttgggaagcctgaataaatccatttcctgtgcactgtgtgggaagccaacccctcttcagagcacctctgaactcaacaggatcctacacttcttataggcctggcttgatgctgacatccttcagccccagggaagacctaaagatctccaggtcttgaggcacctggaacacctccacctgagaccactttaacatgatttctctgcttgagggattttggaccatgctgtgtgtattcagccctaaaacatgggcgagtgcccgcttgcagttcaaattctcagaggaagttccctgtactccacccagtgccaagtttagtttgtgcaaatttccttaatgtcccctcctgtacaacaggcttatttggtgttaaccctcatatcgggggtctaactctttggttttccagcttttgtgctggaatatcccattaaactgtccatgttgggtattttttctttgttagtaaacatttgttgcatattgt

SEQ ID NO: 278683 - DNA, 3752 bp, Homo sapiens
agccactgttatgcaaagttcaagggcctctctcacacttagctgggggaggagtgaatacagcctttctgaagaaagaaaaattaagtaatagcaaaatcattaagtgtttatgattcataaatacagtttttgtcaactaaaaaaataaaatatgtagaagtcaaaaaagtgtctatgattcagaaatgccaccgttagaagttgccataagagtgcacacaaaaaggacatatgggtcaaagtgtttgcagcagtgttgtcccaaataaggacattttgcaacattgtggggtggttaaaataactatagaatatgcattagaatacaatgaaaccattaaacataatgtggaagaatattgtatattatagggaaatgctcataatatatagtgacaatttaaaaagcagattacaaaacaatatgccaagacatgatttctgcccaagtctgccctgatgggtgagctaaccaaggttgctgcactgtgagggcataggggctgcccctcagcccccaccccagccactgggctcctcaggaaaggacacgtgagtgtttactgcacatcctacagatgaggagctcacaaggaccctggatgggggagtcctctgaggttgctggagctgctgcagccatcttgtcactgccaggggagagctctctctgagagcgaaggcacagtggaggaaagcagaactaagaagagacagagaaagcgaaagtgggagagagagagagatatgaggtgacaaagtgtgggtccttggatcctgcttggtgtaaagctagcctgctcctggactttacagataataaattccttcctcatcagattaacctgggtttttgtggcttgtaaccaaaagggtctgcacggcccacacacaggctcccagctcatttcctttgcaatgagtggtaactggaggcgggcggtgcatggacctgccttgcaaggcttctctgttagtggtgcctggagcccactctctcagctggcacagccagtgtgacacatcagtccgggtgtgtcctggacctaccccctttctgggtgcaaaccagaactgaggatgccgagggtggtgggggggtagtttcctgcctcagggctgtgctcctgctacctctttgcctaaaattctcccctctctgtgctcccagggccagctcctttgtatgctctgtgattctttgaacagcgccccctctgagaagccttccctgaccacctggctgaggacatcattctgtcccagcttccatttgctttgggagtggcctcctgacacttcacttccgtgaggcagggaccagttctgtcctggtcactgctgtatccccagctctagataaggcctgagacatcgtaggagtgccagggatctttggttactgagaaaacgagcagctagatcaaggttcccaacaccaacacgctggggacatgttgggagtcaacttagccctaccagcaggtggaactagttttgctgctccaaaacagagttctagctatggggacagccactagagagcagagctaagtccatgctatgctgaggggccacagtctgccctgaactgtgcctcccagcctggagctagtgagggggccgagcctgggagctgacagatgagggctcggcgtggggacttttggaggggagggcattttcttgatcttaccatgggggcaacagctagatgggtagggggggacccactcaaggacatactgcggcttcaggcttcgaccagcccagaacgctcgctccatctgagggtcttgatatcagggtgtggcgtcaggagccggagcctacgggttgaaagccaagagtgggcaatcaaagctgaaaccaggcccacgacttaggagctggagagcacacagggctgaacactcgagttggtgaccaggaaaccagggagcaaagtctccagggtgcttgggcaagaccccagatggtctgcagcaacgcacgggcaacacgggatgatcagcgctacgtggtgagaaacttacctccttttgcaggacaacattttccagtccttctgagtaaatcaaagagaagtctcagcttggtgattgcaggtctctaatgcttatttctctgtctctgtctctctctctttaacaaaagtctaccagcggcctcaggctcagggcctgtctcaggtaaaagcgggttagggtgtaataacagtgatcggtttcattgtgtttatttttgtagctactttctaattatagcaagtgattctgagtttccatttaggatagtaataggaagtttctttttcaagtaaatgtgcataagtaaaaggagactgctcaaaggaaaacagctggtgattgatagaacaggctgtggcattgttgggccccagagggaagggctgtgtgagcatgcaggaaattctgggaaggcagctaaatgcagttgctgcatgggggccaggaagcatttggagacgtggctgggcacagcttggcttttgagcccaagagaggcctgctggggatgtgttgggagccaacctacccctaccagcaggtggaactggttttgccactccaaaacagagttccagctatggggacagccactagagagcagagctaagggcattctaggccaaggggtcacagtccaccctgaactgtgcctcccagcctgaagccagaaagctcagggaggctagcggccctgcccaggcctcagcactgaccctgcacccctaggcccagctggatgacccctaagagcttcctggaatttggatgcagggttattctgtgtgtgctgcctctcagagcatgtcactttgacgtggacatctcgggtctggttctggtgctgtccctgtctcgccacgtgaccctggataagtcatctctccaggccttgatttccccatctgtaaacagaggaacccaaggaacgagtgggctctaactgctgcagcatatgggagatgccaggaggagctggctgtggcaggccatcccagtccatcagacaacttgtagtggatgaagatgcagtgtccatggccagaagaaactcccgtggatgctcaggccaaggctgccagaagcacgaggaggggcagcattgagtgtcatcgggaaaaggcaaagtgatggtcctgaagctgccccatgtggccagtccctttttgggaagcctgaataaatccatttcctgtgcactgtgtgggaagccaacccctcttcagagcacctctgaactcaacaggatcctacacttcttataggcctggcttgatgctgacatccttcagccccagggaagacctaaagatctccaggtcttgaggcacctggaacacctccacctgagaccactttaacatgatttctctgcttgagggattttggaccatgctgtgtgtattcagccctaaaacatgggcgagtgcccgcttgcagttcaaattctcagaggaagttccctgtactccacccagtgccaagtttagtttgtgcaaatttccttaatgtcccctcctgtacaacaggcttatttggtgttaaccctcatatcgggggtctaactctttggttttccagcttttgtgctggaatatcccattaaactgtccatgttgggtattttttctttgttagtaaacatttgttgcatattgttgatagcattttagatttgaagaaataactgacaaaatcaatattttctgtttcatcatt

SEQ ID NO: 278684 - DNA, 4326 bp, Homo sapiens
agccactgttatgcaaagttcaagggcctctctcacacttagctgggggaggagtgaatacagcctttctgaagaaagaaaaattaagtaatagcaaaatcattaagtgtttatgattcataaatacagtttttgtcaactaaaaaaataaaatatgtagaagtcaaaaaagtgtctatgattcagaaatgccaccgttagaagttgccataagagtgcacacaaaaaggacatatgggtcaaagtgtttgcagcagtgttgtcccaaataaggacattttgcaacattgtggggtggttaaaataactatagaatatgcattagaatacaatgaaaccattaaacataatgtggaagaatattgtatattatagggaaatgctcataatatatagtgacaatttaaaaagcagattacaaaacaatatgccaagacatgatttctgcccaagtctgccctgatgggtgagctaaccaaggttgctgcactgtgagggcataggggctgcccctcagcccccaccccagccactgggctcctcaggaaaggacacgtgagtgtttactgcacatcctacagatgaggagctcacaaggaccctggatgggggagtcctctgaggttgctggagctgctgcagccatcttgtcactgccaggggagagctctctctgagagcgaaggcacagtggaggaaagcagaactaagaagagacagagaaagcgaaagtgggagagagagagagatatgaggtgacaaagtgtgggtccttggatcctgcttggtgtaaagctagcctgctcctggactttacagataataaattccttcctcatcagattaacctgggtttttgtggcttgtaaccaaaagggtctgcacggcccacacacaggctcccagctcatttcctttgcaatgagtggtaactggaggcgggcggtgcatggacctgccttgcaaggcttctctgttagtggtgcctggagcccactctctcagctggcacagccagtgtgacacatcagtccgggtgtgtcctggacctaccccctttctgggtgcaaaccagaactgaggatgccgagggtggtgggggggtagtttcctgcctcagggctgtgctcctgctacctctttgcctaaaattctcccctctctgtgctcccagggccagctcctttgtatgctctgtgattctttgaacagcgccccctctgagaagccttccctgaccacctggctgaggacatcattctgtcccagcttccatttgctttgggagtggcctcctgacacttcacttccgtgaggcagggaccagttctgtcctggtcactgctgtatccccagctctagataaggcctgagacatcgtaggagtgccagggatctttggttactgagaaaacgagcagctagatcaaggttcccaacaccaacacgctggggacatgttgggagtcaacttagccctaccagcaggtggaactagttttgctgctccaaaacagagttctagctatggggacagccactagagagcagagctaagtccatgctatgctgaggggccacagtctgccctgaactgtgcctcccagcctggagctagtgagggggccgagcctgggagctgacagatgagggctcggcgtggggacttttggaggggagggcattttcttgatcttaccatgggggcaacagctagatgggtagggggggacccactcaaggacatactgcggcttcaggcttcgaccagcccagaacgctcgctccatctgagggtcttgatatcagggtgtggcgtcaggagccggagcctacgggttgaaagccaagagtgggcaatcaaagctgaaaccaggcccacgacttaggagctggagagcacacagggctgaacactcgagttggtgaccaggaaaccagggagcaaagtctccagggtgcttgggcaagaccccagatggtctgcagcaacgcacgggcaacacgggatgatcagcgctacgtggtgagaaacttacctccttttgcaggacaacattttccagtccttctgagtaaatcaaagagaagtctcagcttggtgattgcaggtctctaatgcttatttctctgtctctgtctctctctctttaacaaaagtctaccagcggcctcaggctcagggcctgtctcaggtaaaagcgggttagggtgtaataacagtgatcggtttcattgtgtttatttttgtagctactttctaattatagcaagtgattctgagtttccatttaggatagtaataggaagtttctttttcaagtaaatgtgcataagtaaaaggagactgctcaaaggaaaacagctggtgattgatagaacaggctgtggcattgttgggccccagagggaagggctgtgtgagcatgcaggaaattctgggaaggcagctaaatgcagttgctgcatgggggccaggaagcatttggagacgtggctgggcacagcttggcttttgagcccaagagaggcctgctggggatgtgttgggagccaacctacccctaccagcaggtggaactggttttgccactccaaaacagagttccagctatggggacagccactagagagcagagctaagggcattctaggccaaggggtcacagtccaccctgaactgtgcctcccagcctgaagccagaaagctcagggaggctagcggccctgcccaggcctcagcactgaccctgcacccctaggcccagctggatgacccctaagagcttcctggaatttggatgcagggttattctgtgtgtgctgcctctcagagcatgtcactttgacgtggacatctcgggtctggttctggtgctgtccctgtctcgccacgtgaccctggataagtcatctctccaggccttgatttccccatctgtaaacagaggaacccaaggaacgagtgggctctaactgctgcagcatatgggagatgccaggaggagctggctgtggcaggccatcccagtccatcagacaacttgtagtggatgaagatgcagtgtccatggccagaagaaactcccgtggatgctcaggccaaggctgccagaagcacgaggaggggcagcattgagtgtcatcgggaaaaggcaaagtgatggtcctgaagctgccccatgtggccagtccctttttgggaagcctgaataaatccatttcctgtgcactgtgtgggaagccaacccctcttcagagcacctctgaactcaacaggatcctacacttcttataggcctggcttgatgctgacatccttcagccccagggaagacctaaagatctccaggtcttgaggcacctggaacacctccacctgagaccactttaacatgatttctctgcttgagggattttggaccatgctgtgtgtattcagccctaaaacatgggcgagtgcccgcttgcagttcaaattctcagaggaagttccctgtactccacccagtgccaagtttagtttgtgcaaatttccttaatgtcccctcctgtacaacaggcttatttggtgttaaccctcatatcgggggtctaactctttggttttccagcttttgtgctggaatatcccattaaactgtccatgttgggtattttttctttgttagtaaacatttgttgcatattgttgatagcattttagatttgaagaaataactgacaaaatcaatattttctgtttcatcattacaaatagactcatagctctttaatttttccatttaacactttaattttccataggcctagattttcaagaagtccaatatctctcacttgaagtgtcttttccctggagtagattgggagatttgagggatatctgtccaaagatgagacagtctgtttctagtttcccatccagcctgatggggcgtctacagtttttaccacaaggtgtcgctgttgaacagattctggtgcagtctagtgcatagctgtccacttctagagtgatcacttgctgggccaagttcctctccttaagtggtgtctcacattaaggttcccaaattacagactcattaattcaccctaataagctcatccaggcagtttaggtcttcaggggcttccagcctccaacacacattgggccaaaaccagcctgtaccaccagctccaagccctgtgttgaatctaggtcattggtccagatgccccttcattctgggcctgtggtgtcctttccagacagcagacctcagttaagggcatcccagtccatcagagaagttccaggatcacagaccctcaaaaggg

SEQ ID NO: 278685 - DNA, 4195 bp, Homo sapiens
agccactgttatgcaaagttcaagggcctctctcacacttagctgggggaggagtgaatacagcctttctgaagaaagaaaaattaagtaatagcaaaatcattaagtgtttatgattcataaatacagtttttgtcaactaaaaaaataaaatatgtagaagtcaaaaaagtgtctatgattcagaaatgccaccgttagaagttgccataagagtgcacacaaaaaggacatatgggtcaaagtgtttgcagcagtgttgtcccaaataaggacattttgcaacattgtggggtggttaaaataactatagaatatgcattagaatacaatgaaaccattaaacataatgtggaagaatattgtatattatagggaaatgctcataatatatagtgacaatttaaaaagcagattacaaaacaatatgccaagacatgatttctgcccaagtctgccctgatgggtgagctaaccaaggttgctgcactgtgagggcataggggctgcccctcagcccccaccccagccactgggctcctcaggaaaggacacgtgagtgtttactgcacatcctacagatgaggagctcacaaggaccctggatgggggagtcctctgaggttgctggagctgctgcagccatcttgtcactgccaggggagagctctctctgagagcgaaggcacagtggaggaaagcagaactaagaagagacagagaaagcgaaagtgggagagagagagagatatgaggtgacaaagtgtgggtccttggatcctgcttggtgtaaagctagcctgctcctggactttacagataataaattccttcctcatcagattaacctgggtttttgtggcttgtaaccaaaagggtctgcacggcccacacacaggctcccagctcatttcctttgcaatgagtggtaactggaggcgggcggtgcatggacctgccttgcaaggcttctctgttagtggtgcctggagcccactctctcagctggcacagccagtgtgacacatcagtccgggtgtgtcctggacctaccccctttctgggtgcaaaccagaactgaggatgccgagggtggtgggggggtagtttcctgcctcagggctgtgctcctgctacctctttgcctaaaattctcccctctctgtgctcccagggccagctcctttgtatgctctgtgattctttgaacagcgccccctctgagaagccttccctgaccacctggctgaggacatcattctgtcccagcttccatttgctttgggagtggcctcctgacacttcacttccgtgaggcagggaccagttctgtcctggtcactgctgtatccccagctctagataaggcctgagacatcgtaggagtgccagggatctttggttactgagaaaacgagcagctagatcaaggttcccaacaccaacacgctggggacatgttgggagtcaacttagccctaccagcaggtggaactagttttgctgctccaaaacagagttctagctatggggacagccactagagagcagagctaagtccatgctatgctgaggggccacagtctgccctgaactgtgcctcccagcctggagctagtgagggggccgagcctgggagctgacagatgagggctcggcgtggggacttttggaggggagggcattttcttgatcttaccatgggggcaacagctagatgggtagggggggacccactcaaggacatactgcggcttcaggcttcgaccagcccagaacgctcgctccatctgagggtcttgatatcagggtgtggcgtcaggagccggagcctacgggttgaaagccaagagtgggcaatcaaagctgaaaccaggcccacgacttaggagctggagagcacacagggctgaacactcgagttggtgaccaggaaaccagggagcaaagtctccagggtgcttgggcaagaccccagatggtctgcagcaacgcacgggcaacacgggatgatcagcgctacgtggtgagaaacttacctccttttgcaggacaacattttccagtccttctgagtaaatcaaagagaagtctcagcttggtgattgcaggtctctaatgcttatttctctgtctctgtctctctctctttaacaaaagtctaccagcggcctcaggctcagggcctgtctcaggtaaaagcgggttagggtgtaataacagtgatcggtttcattgtgtttatttttgtagctactttctaattatagcaagtgattctgagtttccatttaggatagtaataggaagtttctttttcaagtaaatgtgcataagtaaaaggagactgctcaaaggaaaacagctggtgattgatagaacaggctgtggcattgttgggccccagagggaagggctgtgtgagcatgcaggaaattctgggaaggcagctaaatgcagttgctgcatgggggccaggaagcatttggagacgtggctgggcacagcttggcttttgagcccaagagaggcctgctggggatgtgttgggagccaacctacccctaccagcaggtggaactggttttgccactccaaaacagagttccagctatggggacagccactagagagcagagctaagggcattctaggccaaggggtcacagtccaccctgaactgtgcctcccagcctgaagccagaaagctcagggaggctagcggccctgcccaggcctcagcactgaccctgcacccctaggcccagctggatgacccctaagagcttcctggaatttggatgcagggttattctgtgtgtgctgcctctcagagcatgtcactttgacgtggacatctcgggtctggttctggtgctgtccctgtctcgccacgtgaccctggataagtcatctctccaggccttgatttccccatctgtaaacagaggaacccaaggaacgagtgggctctaactgctgcagcatatgggagatgccaggaggagctggctgtggcaggccatcccagtccatcagacaacttgtagtggatgaagatgcagtgtccatggccagaagaaactcccgtggatgctcaggccaaggctgccagaagcacgaggaggggcagcattgagtgtcatcgggaaaaggcaaagtgatggtcctgaagctgccccatgtggccagtccctttttgggaagcctgaataaatccatttcctgtgcactgtgtgggaagccaacccctcttcagagcacctctgaactcaacaggatcctacacttcttataggcctggcttgatgctgacatccttcagccccagggaagacctaaagatctccaggtcttgaggcacctggaacacctccacctgagaccactttaacatgatttctctgcttgagggattttggaccatgctgtgtgtattcagccctaaaacatgggcgagtgcccgcttgcagttcaaattctcagaggaagttccctgtactccacccagtgccaagtttagtttgtgcaaatttccttaatgtcccctcctgtacaacaggcttatttggtgttaaccctcatatcgggggtctaactctttggttttccagcttttgtgctggaatatcccattaaactgtccatgttgggtattttttctttgttagtaaacatttgttgcatattgttgatagcattttagatttgaagaaataactgacaaaatcaatattttctgtttcatcattacaaatagactcatagctctttaatttttccatttaacactttaattttccataggcctagattttcaagaagtccaatatctctcacttgaagtgtcttttccctggagtagattgggagatttgagggatatctgtccaaagatgagacagtctgtttctagtttcccatccagcctgatggggcgtctacagtttttaccacaaggtgtcgctgttgaacagattctggtgcagtctagtgcatagctgtccacttctagagtgatcacttgctgggccaagttcctctccttaagtggtgtctcacattaaggttcccaaattacagactcattaattcaccctaataagctcatccaggcattggttttgtgttttggagatgaagtggccctggcatcaagaggacgtgggacacaagcagaggcttccaaggggtc

SEQ ID NO: 278686 - DNA, 380 bp, Homo sapiens
aggggtgaaccgagactcagacttacccaaggtcaccaaagctggcagagctcccggctgcctgactgttctgtccaagtgcccccacacctcgacgccttcagcagccgctagctccagggattcctggggaagccaaggccggccggactcctgggagccctggtctggcctccagcgacccctcacccctcacggcacagcatctcttctgcaggacttcagaatgccccctctgggatctcccaaagcagtcggtagccctggcaccctcccccaatcctaaaaccctgctctctccatgaaaccagtccctgcatcttctcatcccatattgttttgcaggctctaccctgagtcattatattcctttctcatcc

SEQ ID NO: 278687 - DNA, 829 bp, Homo sapiens
caggactaagaaccattctgaggatgaatcaggacgaggataagtaagagtttgttcccgtggtgcggagggtcaaggcccacacccggaaacctagcgaggtaaagttgcgtcttggttgtagagacgacaacttctccgcttcctcggcgatggcggcgtccgggagcggtatggcccagaaaacctgggaactggccaacaacatgcaggaagctcagagtatcgatgaaatctacaaatacgacaagaaacagcagcaagaaatcctggcggcgaagccctggactaaggatcaccattactttaagtactgcaaaatctcagcattggctctgctgaagatggtgatgcatgccagatcgggaggcaacttggaagtgatgggtctgatgctaggaaaggtggatggtgaaaccatgatcattatggacagttttgctttgcctgtggagggcactgaaacccgagtaaatgctcaggctgctgcatatgaatacatggctgcatacatagaaaatgcaaaacaggttggccgccttgaaaatgcaatcgggtggtatcatagccaccctggctatggctgctggctttctgggattgatgttagtactcagatgctcaatcagcagttccaggaaccatttgtagcagtggtgattgatccaacaagaacaatatccgcagggaaagtgaatcttggcgcctttaggacatacccaaagggctacaaacctcctgatgaaggaccttctgagtaccagactattccacttaataaaatagaagattttggtgtacactgcaaacagtaagtaatttaaaaaca

SEQ ID NO: 278688 - DNA, 1011 bp, Homo sapiens
  misc_feature (27)..(27): n is a, c, g, or t
  misc_feature (32)..(32): n is a, c, g, or t
aaggaaaactaggctagtacgagcctngtgtnatcggcgaggtcaaggcccacacccggaaacctagcgaggtaaagttgcgtcttggttgtagagacgacaacttctccgcttcctcggcgatggcggcgtccgggagcggtatggcccagaaaacctgggaactggccaacaacatgcaggaagctcagagtatcgatgaaatctacaaatacgacaagaaacagcagcaagaaatcctggcggcgaagccctggactaaggatcaccattactttaagtactgcaaaatctcagcattggctctgctgaagatggtgatgcatgccagatcgggaggcaacttggaagtgatgggtctgatgctaggaaaggtggatggtgaaaccatgatcattatggacagttttgctttgcctgtggagggcactgaaacccgagtaaatgctcaggctgctgcatatgaatacatggctgcatacatagaaaatgcaaaacaggttggccgccttgaaaatgcaatcgggtggtatcatagccaccctggctatggctgctggctttctgggattgatgttagtactcagatgctcaatcagcagttccaggaaccatttgtagcagtggtgattgatccaacaagaacaatatccgcagggaaagtgaatcttggcgcctttaggacatacccaaagggctacaaacctcctgatgaaggaccttctgagtaccagactattccacttaataaaatagaagattttggtgtacactgcaaacaatattatgccttagaagtctcatatttcaaatcctctttggatcgcaaattgcttgagctgttgtggaataaatactgggtgaatacgttgagttcttctagcttgcttactgcgtaccaagcgacatcccgggcgggcttgattgcgaagttagccaaaccgggagaggggttgtggttaacgcgccataaatgctcaacaggaccaacccggggcggagagaggacac

SEQ ID NO: 278689 - DNA, 807 bp, Homo sapiens
ccaaagggctgtaccggtccggaagttttttggactgtcaaggcccacacccggaaacctagcgaggtaaagttgcgtcttggttgtagagacgacaacttctccgcttcctcggcgatggcggcgtccgggagcggtatggcccagaaaacctgggaactggccaacaacatgcaggaagctcagagtatcgatgaaatctacaaatacgacaagaaacagcagcaagaaatcctggcggcgaagccctggactaaggatcaccattactttaagtactgcaaaatctcagcattggctctgctgaagatggtgatgcatgccagatcgggaggcaacttggaagtgatgggtctgatgctaggaaaggtggatggtgaaaccatgatcattatggacagttttgctttgcctgtggagggcactgaaacccgagtaaatgctcaggctgctgcatatgaatacatggctgcatacatagaaaatgcaaaacaggttggccgccttgaaaatgcaatcgggtggtatcatagccaccctggctatggctgctggctttctgggattgatgttagtactcagatgctcaatcagcagttccaggaaccatttgtagcagtggtgattgatcccccagggcaatatccgcggggaagtggatctgggggcccttatgacataccccaagggtgcaaactcctcgtgaagggctctggggccaaaattcccttataaaaaagacttggggggcccgggacatttgccgaaagctattaacccctcgggggaggcggcgggggaaacggg

SEQ ID NO: 278690 - DNA, 949 bp, Homo sapiens
cattttagatacttgctttgagtgtgtgttttgttcatctgtctttatgtatgtcatttatcagtttatctacatttattaattatgaagcaaaaattttactatggcaatgtcttcaattatataagaaatagaacagaagtagtaatcaaaagtagagaattttcctttttggggtagctttacaagaattgcatctcttctgagtattggtggggttttgtcatttcttttgccttatactttttatcatttctaaaatctaaggccttcacccgctaacctaagtttgacttctgattgttggaggatgcttgtgattatttcagaaaaaagcatagtattctttaaaattatttgtcaaattatcctaagtaataaacaaggaataacagattttaatataatataatattagaatcaatctctaattacaggtttgtataattttactcaccttctaaaacagaacaattgtatcaaattttacgttgtcattctcttgtgaaagttctagtaagtaatgaaatggtcaaaaagacatggggaagactaataaaatcacaagggaaaacttcagattggggtggtttgagaagtatgaataaaactaaactcattggagttacatggatggattggggctgatcttgtgtgtttgaaatagttttcaatttatgacatcatgtgatgtgtgtttttttttccagctgtaaaactaccatagaagctatccatggattgatgtctcaggttattaaggataaactgtttaatcaaattaacatctcttaaacagtctctgagaagtactttacctgaaagacagtatgagaaaaatattcaagtaacactttaaaaccagttacccaaaatctgattagaagtataaggtgctctgaagtgtcctaaatattaatatcctgtaataaagctctttaaaatgaaa

SEQ ID NO: 278691 - DNA, 1065 bp, Homo sapiens
agcggactacctgcccatccaggaacaagcaatttacaaatttacaaaaagtagagtttatgctacagagaagacaaaaacgggagctggtcatgccagaaaaaccaaccatgtgatttgagggttgggcctttgcgccatgtgacatcagccaggcctaaggggaatgaatacagcagggctggagatcaagccaaggagcaacaattcaaccaatcattcctacataaggaaaatccagtaaaaactctggacactcaggcttagccaaagaacaccaggaaaactaccacagttaagttggatgtactactcattgcattaaggaatgcacggagaacacacaccatggggaaccctgtggtatcgtgatgttctcatttaagcaacaagaagattcgtctctcgctattactgtaactgctgtttatatcgtcatgtcccggaaaggtccctgtcttccctgaatggtctctaccaacttcacctccggttctaggtgtcatggctgccccaagagtctagagacgacaacttctccgcttcctcggcgatggcggcgtccgggagcggtatggcccagaaaacctgggaactggccaacaacatgcaggaagctcagagtatcgatgaaatctacaaatacgacaagaaacagcagcaagaaatcctggcggcgaagccctggactaaggataaagggagaagccaagatttcgattcatgtcttgacttccaacatgaggtctacacatttttcagcttttggttgaaatctggcaaagcttaggaattaaatttggattctttctgtgggcagacatctaaaaaggctttgtagagacgttgactgactgctctgtaaggctgcttaagttgcttggttatctgcttgcttctgtaacaggctgtgcattttaggttcgtgtactcttaaatatttggaaactgttggcctgcctcactgtctaattgtggctctaattatattcatcctagctgtcttgggctgcattaatgagaccaaaatgtaattttattcaagagtttaattcactgatgacc

SEQ ID NO: 278692 - DNA, 1286 bp, Homo sapiens
atacatgaggacattaataatcaagaaaagaatgcagactataccactggtcaggtctttgatttgtctgaaaagttagagcagtcagaagcccagctgggacgagggagtttcatgttgggtttagaaacgcatgaccgaaaatcagaagacaaacttgccaaagctacaagagacagctgtaaaactaccatagaagctatccatggattgatgtctcaggttattaaggataaactgtttaatcaaattaacatctcttaaacagtctctgagaagtactttacctgaaagacagtatgagaaaaatattcaagtaacactttaaaaccagttacccaaaatctgattagaagtataaggtgctctgaagtgtcctaaatattaatatcctgtaataaagctctttaaaatgaaaaaaaaaaaaaaaaaaaaaaaaaacacaaaaaaaacagaaacaaaaaaacagaaaaagacaaaaggagacacaaagatacacaagaccacgagagaacagcagcgcacaccgagcacctcacccggcgcagcggagaaaggacgacaggagcaaggacaggagggggagggagcagagacaggcacggcgtggcggaggaaaacatgagcaaccacgagaagacgaggagcgagggcggacaggcgagacagaacggctcacagaccacacacagccgaagaggcgaacaaagaaaagaagaaggagccaagcagcacgagaggcaacacaacacagactcagcacccacaccagcgagcaccgaagtacaaacaggacccccagcacacgaacagtcagctgagccagcaccaactagaacagcgagaatgagacgaaccagaccacgaggagacaacgacatgacaggcgcaacacacaaccaaagcgggtagaatagacagagaaaggcagaacgaacgcagcgagacgcaggcgacgcaacagagaagaaacagacagcgacgcgagacagagagagacctgggaggcgcgatagagagcaagaggcaaagaagaagctgagggcgaggcacagggacgaaacgaaaaacaccgaacaggagaggaagcacggtacgagcgacacaaagaggcgagacagacaggaagagagacaagagagacagagaaggcggacagacacgcgaaaacaacgccgaacgagaacaagaagaagaacagacgagaaaccgcaacgacgagggagagcacaagcagagacagcaacagaggagagaaggaacaaaaagagaaagaagcaacgaac

SEQ ID NO: 278693 - DNA, 481 bp, Homo sapiens
aagacctacttattggtattgtcatagagattaggtgagataatgtataaaaagagtcgtctagaatgtatgtaataggagcacagtaacttgtctttcttcttttctccagtaaagggagaagccaagatttcgattcatgtcttgacttccaacatgaggtctacacatttttcagcttttggttgaaatctggcaaagcttaggaattaaatttggattctttctgtgggcagacatctaaaaaggctttgtagagacgttgactgactgctctgtaaggctgcttaagttgcttggttatctgcttgcttctgtaacaggctgtgcattttaggttcgtgtactcttaaatatttggaaactgttggcctgcctcactgtctaattgtggctctaattatattcatcctagctgtcttgggctgcattaatgagaccaaaatgtaattttattcaagagtttaattcactgatgacc

SEQ ID NO: 278694 - DNA, 1514 bp, Homo sapiens
acatgcccttcttccggtgcggaagactataccactcccataccctataactttgtttgttctatttcacacatataattttccgagacaagatgttctcatttaagcaacaagaagattcgtctctcgctattactgtaactgctgtttatatcgtcatgtcccggaaaggtccctgtcttccctgaatggtctctaccaacttcacctccggttctaggtgtcatggctgccccaagagtctaggtaagagtttgttcccgtggtgcggagggtcaaggcccacacccggaaacctagcgaggtaaagttgcgtcttggttgtagagacgacaacttctccgcttcctcggcgatggcggcgtccgggagcggtatggcccagaaaacctgggaactggccaacaacatgcaggaagctcagagtatcgatgaaatctacaaatacgacaagaaacagcagcaagaaatcctggcggcgaagccctggactaaggatcaccattactttaagtactgcaaaatctcagcattggctctgctgaagatggtgatgcatgccagatcgggaggcaacttggaagtgatgggtctgatgctaggaaaggtggatggtgaaaccatgatcattatggacagttttgctttgcctgtggagggcactgaaacccgagtaaatgctcaggctgctgcatatgaatacatggctgcatacatagaaaatgcaaaacaggttggccgccttgaaaatgcaatcgggtggtatcatagccaccctggctatggctgctggctttctgggattgatgttagtactcagatgctcaatcagcagttccaggaaccatttgtagcagtggtgattgatccaacaagaacaatatccgcagggaaagtgaatcttggcgcctttaggacatacccaaagggctacaaacctcctgatgaaggaccttctgagtaccagactattccacttaataaaatagaagattttggtgtacactgcaaacaatattatgccttagaagtctcatatttcaaatcctctttggatcgcaaattgcttgagctgttgtggaataaatactgggtgaatacgttgagttcttctagcttgcttactaatgcagactataccactggtcaggtctttgatttgtctgaaaagttagagcagtcagaagcccagctgggacgagggagtttcatgttgggtttagaaacgcatgaccgaaaatcagaagacaaacttgccaaagctacaagagacagctgtaaaactaccatagaagctatccatggattgatgtctcaggttattaaggataaactgtttaatcaaattaacatctcttaaacagtctctgagaagtactttacctgaaagacagtatgagaaaaatattcaagtaacactttaaaaccagttacccaaaatctgattagaagtataaggtgctctgaagtgtcctaaatattaatatcctgtaataaagctctttaaaatgaaa

SEQ ID NO: 278695 - DNA, 2382 bp, Homo sapiens
acatgcccttcttccggtgcggaagactataccactcccataccctataactttgtttgttctatttcacacatataattttccgagacaagatgttctcatttaagcaacaagaagattcgtctctcgctattactgtaactgctgtttatatcgtcatgtcccggaaaggtccctgtcttccctgaatggtctctaccaacttcacctccggttctaggtgtcatggctgccccaagagtctaggtaagagtttgttcccgtggtgcggagggtcaaggcccacacccggaaacctagcgaggtaaagttgcgtcttggttgtagagacgacaacttctccgcttcctcggcgatggcggcgtccgggagcggtatggcccagaaaacctgggaactggccaacaacatgcaggaagctcagagtatcgatgaaatctacaaatacgacaagaaacagcagcaagaaatcctggcggcgaagccctggactaaggatcaccattactttaagtactgcaaaatctcagcattggctctgctgaagatggtgatgcatgccagatcgggaggcaacttggaagtgatgggtctgatgctaggaaaggtggatggtgaaaccatgatcattatggacagttttgctttgcctgtggagggcactgaaacccgagtaaatgctcaggctgctgcatatgaatacatggctgcatacatagaaaatgcaaaacaggttggccgccttgaaaatgcaatcgggtggtatcatagccaccctggctatggctgctggctttctgggattgatgttagtactcagatgctcaatcagcagttccaggaaccatttgtagcagtggtgattgatccaacaagaacaatatccgcagggaaagtgaatcttggcgcctttaggacatacccaaagggctacaaacctcctgatgaaggaccttctgagtaccagactattccacttaataaaatagaagattttggtgtacactgcaaacaatattatgccttagaagtctcatatttcaaatcctctttggatcgcaaattgcttgagctgttgtggaataaatactgggtgaatacgttgagttcttctagcttgcttactaatgcagactataccactggtcaggtctttgatttgtctgaaaagttagagcagtcagaagcccagctgggacgagggagtttcatgttgggtttagaaacgcatgaccgaaaatcagaagacaaacttgccaaagctacaagagacagctgtaaaactaccatagaagctatccatggattgatgtctcaggttattaaggataaactgtttaatcaaattaacatctcttaaacagtctctgagaagtactttacctgaaagacagtatgagaaaaatattcaagtaacactttaaaaccagttacccaaaatctgattagaagtataaggtgctctgaagtgtcctaaatattaatatcctgtaataaagctctttaaaatgaaaaaaaaaaaaaaaaaaaaaaaaaacacaaaaaaaacagaaacaaaaaaacagaaaaagacaaaaggagacacaaagatacacaagaccacgagagaacagcagcgcacaccgagcacctcacccggcgcagcggagaaaggacgacaggagcaaggacaggagggggagggagcagagacaggcacggcgtggcggaggaaaacatgagcaaccacgagaagacgaggagcgagggcggacaggcgagacagaacggctcacagaccacacacagccgaagaggcgaacaaagaaaagaagaaggagccaagcagcacgagaggcaacacaacacagactcagcacccacaccagcgagcaccgaagtacaaacaggacccccagcacacgaacagtcagctgagccagcaccaactagaacagcgagaatgagacgaaccagaccacgaggagacaacgacatgacaggcgcaacacacaaccaaagcgggtagaatagacagagaaaggcagaacgaacgcagcgagacgcaggcgacgcaacagagaagaaacagacagcgacgcgagacagagagagacctgggaggcgcgatagagagcaagaggcaaagaagaagctgagggcgaggcacagggacgaaacgaaaaacaccgaacaggagaggaagcacggtacgagcgacacaaagaggcgagacagacaggaagagagacaagagagacagagaaggcggacagacacgcgaaaacaacgccgaacgagaacaagaagaagaacagacgagaaaccgcaacgacgagggagagcacaagcagagacagcaacagaggagagaaggaacaaaaagagaaagaagcaacgaac

SEQ ID NO: 278696 - DNA, 1492 bp, Homo sapiens
acatgcccttcttccggtgcggaagactataccactcccataccctataactttgtttgttctatttcacacatataattttccgagacaagatgttctcatttaagcaacaagaagattcgtctctcgctattactgtaactgctgtttatatcgtcatgtcccggaaaggtccctgtcttccctgaatggtctctaccaacttcacctccggttctaggtgtcatggctgccccaagagtctaggtaagagtttgttcccgtggtgcggagggtcaaggcccacacccggaaacctagcgaggtaaagttgcgtcttggttgtagagacgacaacttctccgcttcctcggcgatggcggcgtccgggagcggtatggcccagaaaacctgggaactggccaacaacatgcaggaagctcagagtatcgatgaaatctacaaatacgacaagaaacagcagcaagaaatcctggcggcgaagccctggactaaggatcaccattactttaagtactgcaaaatctcagcattggctctgctgaagatggtgatgcatgccagatcgggaggcaacttggaagtgatgggtctgatgctaggaaaggtggatggtgaaaccatgatcattatggacagttttgctttgcctgtggagggcactgaaacccgagtaaatgctcaggctgctgcatatgaatacatggctgcatacatagaaaatgcaaaacaggttggccgccttgaaaatgcaatcgggtggtatcatagccaccctggctatggctgctggctttctgggattgatgttagtactcagatgctcaatcagcagttccaggaaccatttgtagcagtggtgattgatccaacaagaacaatatccgcagggaaagtgaatcttggcgcctttaggacatacccaaagggctacaaacctcctgatgaaggaccttctgagtaccagactattccacttaataaaatagaagattttggtgtacactgcaaacaatattatgccttagaagtctcatatttcaaatcctctttggatcgcaaattgcttgagctgttgtggaataaatactgggtgaatacgttgagttcttctagcttgcttactaatgcagactataccactggtcaggtctttgatttgtctgaaaagttagagcagtcagaagcccagctgggacgagggagtttcatgttgggtttagaaacgcatgaccgaaaatcagaagacaaacttgccaaagctacaagagacagctgtaaaactaccatagaagctatccatggattgatgtctcaggttattaaggataaactgtttaatcaaattaacatctcttaaacagtctctgagaagtactttacctgaaagacagtatgagaaaaatattcaagtaacactttaaaaccagttacccaaaatctgaagtgtcctaaatattaatatcctgtaataaagctctttaaaatgaaa

SEQ ID NO: 278697 - DNA, 1504 bp, Homo sapiens
acatgcccttcttccggtgcggaagactataccactcccataccctataactttgtttgttctatttcacacatataattttccgagacaagatgttctcatttaagcaacaagaagattcgtctctcgctattactgtaactgctgtttatatcgtcatgtcccggaaaggtccctgtcttccctgaatggtctctaccaacttcacctccggttctaggtgtcatggctgccccaagagtctaggtaagagtttgttcccgtggtgcggagggtcaaggcccacacccggaaacctagcgaggtaaagttgcgtcttggttgtagagacgacaacttctccgcttcctcggcgatggcggcgtccgggagcggtatggcccagaaaacctgggaactggccaacaacatgcaggaagctcagagtatcgatgaaatctacaaatacgacaagaaacagcagcaagaaatcctggcggcgaagccctggactaaggatcaccattactttaagtactgcaaaatctcagcattggctctgctgaagatggtgatgcatgccagatcgggaggcaacttggaagtgatgggtctgatgctaggaaaggtggatggtgaaaccatgatcattatggacagttttgctttgcctgtggagggcactgaaacccgagtaaatgctcaggctgctgcatatgaatacatggctgcatacatagaaaatgcaaaacaggttggccgccttgaaaatgcaatcgggtggtatcatagccaccctggctatggctgctggctttctgggattgatgttagtactcagatgctcaatcagcagttccaggaaccatttgtagcagtggtgattgatccaacaagaacaatatccgcagggaaagtgaatcttggcgcctttaggacatacccaaagggctacaaacctcctgatgaaggaccttctgagtaccagactattccacttaataaaatagaagattttggtgtacactgcaaacaatattatgccttagaagtctcatatttcaaatcctctttggatcgcaaattgcttgagctgttgtggaataaatactgggtgaatacgttgagttcttctagcttgcttactaatgcagactataccactggtcaggtctttgatttgtctgaaaagttagagcagtcagaagcccagctgggacgagggagtttcatgttgggtttagaaacgcatgaccgaaaatcagaagacaaacttgccaaagctacaagagacagctgtaaaactaccatagaagctatccatggattgatgtctcaggttattaaggataaactgtttaatcaaattaacatctcttaaacagtctctgagaagtactttacctgaaagacagtatgagaaaaatattcaagtaacacttttataacagagagctcagatgtgatgagtgagatatagagtcgcttgaaagcgactataatatataaagaccatatgggaata

SEQ ID NO: 278698 - DNA, 1365 bp, Homo sapiens
acatgcccttcttccggtgcggaagactataccactcccataccctataactttgtttgttctatttcacacatataattttccgagacaagatgttctcatttaagcaacaagaagattcgtctctcgctattactgtaactgctgtttatatcgtcatgtcccggaaaggtccctgtcttccctgaatggtctctaccaacttcacctccggttctaggtgtcatggctgccccaagagtctaggtaagagtttgttcccgtggtgcggagggtcaaggcccacacccggaaacctagcgaggtaaagttgcgtcttggttgtagagacgacaacttctccgcttcctcggcgatggcggcgtccgggagcggtatggcccagaaaacctgggaactggccaacaacatgcaggaagctcagagtatcgatgaaatctacaaatacgacaagaaacagcagcaagaaatcctggcggcgaagccctggactaaggatcaccattactttaagtactgcaaaatctcagcattggctctgctgaagatggtgatgcatgccagatcgggaggcaacttggaagtgatgggtctgatgctaggaaaggtggatggtgaaaccatgatcattatggacagttttgctttgcctgtggagggcactgaaacccgagtaaatgctcaggctgctgcatatgaatacatggctgcatacatagaaaatgcaaaacaggttggccgccttgaaaatgcaatcgggtggtatcatagccaccctggctatggctgctggctttctgggattgatgttagtactcagatgctcaatcagcagttccaggaaccatttgtagcagtggtgattgatccaacaagaacaatatccgcagggaaagtgaatcttggcgcctttaggacatacccaaagggctacaaacctcctgatgaaggaccttctgagtaccagactattccacttaataaaatagaagattttggtgtacactgcaaacaatattatgccttagaagtctcatatttcaaatcctctttggatcgcaaattgcttgagctgttgtggaataaatactgggtgaatacgttgagttcttctagcttgcttactctgtaaaactaccatagaagctatccatggattgatgtctcaggttattaaggataaactgtttaatcaaattaacatctcttaaacagtctctgagaagtactttacctgaaagacagtatgagaaaaatattcaagtaacactttaaaaccagttacccaaaatctgattagaagtataaggtgctctgaagtgtcctaaatattaatatcctgtaataaagctctttaaaatgaaa

SEQ ID NO: 278699 - DNA, 1433 bp, Homo sapiens
acatgcccttcttccggtgcggaagactataccactcccataccctataactttgtttgttctatttcacacatataattttccgagacaagatgttctcatttaagcaacaagaagattcgtctctcgctattactgtaactgctgtttatatcgtcatgtcccggaaaggtccctgtcttccctgaatggtctctaccaacttcacctccggttctaggtgtcatggctgccccaagagtctagagacgacaacttctccgcttcctcggcgatggcggcgtccgggagcggtatggcccagaaaacctgggaactggccaacaacatgcaggaagctcagagtatcgatgaaatctacaaatacgacaagaaacagcagcaagaaatcctggcggcgaagccctggactaaggatcaccattactttaagtactgcaaaatctcagcattggctctgctgaagatggtgatgcatgccagatcgggaggcaacttggaagtgatgggtctgatgctaggaaaggtggatggtgaaaccatgatcattatggacagttttgctttgcctgtggagggcactgaaacccgagtaaatgctcaggctgctgcatatgaatacatggctgcatacatagaaaatgcaaaacaggttggccgccttgaaaatgcaatcgggtggtatcatagccaccctggctatggctgctggctttctgggattgatgttagtactcagatgctcaatcagcagttccaggaaccatttgtagcagtggtgattgatccaacaagaacaatatccgcagggaaagtgaatcttggcgcctttaggacatacccaaagggctacaaacctcctgatgaaggaccttctgagtaccagactattccacttaataaaatagaagattttggtgtacactgcaaacaatattatgccttagaagtctcatatttcaaatcctctttggatcgcaaattgcttgagctgttgtggaataaatactgggtgaatacgttgagttcttctagcttgcttactaatgcagactataccactggtcaggtctttgatttgtctgaaaagttagagcagtcagaagcccagctgggacgagggagtttcatgttgggtttagaaacgcatgaccgaaaatcagaagacaaacttgccaaagctacaagagacagctgtaaaactaccatagaagctatccatggattgatgtctcaggttattaaggataaactgtttaatcaaattaacatctcttaaacagtctctgagaagtactttacctgaaagacagtatgagaaaaatattcaagtaacactttaaaaccagttacccaaaatctgattagaagtataaggtgctctgaagtgtcctaaatattaatatcctgtaataaagctctttaaaatgaaa

SEQ ID NO: 278700 - DNA, 1262 bp, Homo sapiens
acatgcccttcttccggtgcggaagactataccactcccataccctataactttgtttgttctatttcacacatataattttccgagacaagatgttctcatttaagcaacaagaagattcgtctctcgctattactgtaactgctgtttatatcgtcatgtcccggaaaggtccctgtcttccctgaatggtctctaccaacttcacctccggttctaggtgtcatggctgccccaagagtctagtcaccattactttaagtactgcaaaatctcagcattggctctgctgaagatggtgatgcatgccagatcgggaggcaacttggaagtgatgggtctgatgctaggaaaggtggatggtgaaaccatgatcattatggacagttttgctttgcctgtggagggcactgaaacccgagtaaatgctcaggctgctgcatatgaatacatggctgcatacatagaaaatgcaaaacaggttggccgccttgaaaatgcaatcgggtggtatcatagccaccctggctatggctgctggctttctgggattgatgttagtactcagatgctcaatcagcagttccaggaaccatttgtagcagtggtgattgatccaacaagaacaatatccgcagggaaagtgaatcttggcgcctttaggacatacccaaagggctacaaacctcctgatgaaggaccttctgagtaccagactattccacttaataaaatagaagattttggtgtacactgcaaacaatattatgccttagaagtctcatatttcaaatcctctttggatcgcaaattgcttgagctgttgtggaataaatactgggtgaatacgttgagttcttctagcttgcttactaatgcagactataccactggtcaggtctttgatttgtctgaaaagttagagcagtcagaagcccagctgggacgagggagtttcatgttgggtttagaaacgcatgaccgaaaatcagaagacaaacttgccaaagctacaagagacagctgtaaaactaccatagaagctatccatggattgatgtctcaggttattaaggataaactgtttaatcaaattaacatctcttaaacagtctctgagaagtactttacctgaaagacagtatgagaaaaatattcaagtaacactttaaaaccagttacccaaaatctgattagaagtataaggtgctctgaagtgtcctaaatattaatatcctgtaataaagctctttaaaatgaaa

SEQ ID NO: 278701 - DNA, 1482 bp, Homo sapiens
acatgcccttcttccggtgcggaagactataccactcccataccctataactttgtttgttctatttcacacatataattttccgagacaagatgttctcatttaagcaacaagaagattcgtctctcgctattactgtaactgctgtttatatcgtcatgtcccggaaaggtccctgtcttccctgaatggtctctaccaacttcacctccggttctaggtgtcatggctgccccaagagtctagagacgacaacttctccgcttcctcggcgatggcggcgtccgggagcggtatggcccagaaaacctgggaactggccaacaacatgcaggaagctcagagtatcgatgaaatctacaaatacgacaagaaacagcagcaagaaatcctggcggcgaagccctggactaaggataaagggagaagccaagatttcgattcatgtcttgacttccaacatgagtcaccattactttaagtactgcaaaatctcagcattggctctgctgaagatggtgatgcatgccagatcgggaggcaacttggaagtgatgggtctgatgctaggaaaggtggatggtgaaaccatgatcattatggacagttttgctttgcctgtggagggcactgaaacccgagtaaatgctcaggctgctgcatatgaatacatggctgcatacatagaaaatgcaaaacaggttggccgccttgaaaatgcaatcgggtggtatcatagccaccctggctatggctgctggctttctgggattgatgttagtactcagatgctcaatcagcagttccaggaaccatttgtagcagtggtgattgatccaacaagaacaatatccgcagggaaagtgaatcttggcgcctttaggacatacccaaagggctacaaacctcctgatgaaggaccttctgagtaccagactattccacttaataaaatagaagattttggtgtacactgcaaacaatattatgccttagaagtctcatatttcaaatcctctttggatcgcaaattgcttgagctgttgtggaataaatactgggtgaatacgttgagttcttctagcttgcttactaatgcagactataccactggtcaggtctttgatttgtctgaaaagttagagcagtcagaagcccagctgggacgagggagtttcatgttgggtttagaaacgcatgaccgaaaatcagaagacaaacttgccaaagctacaagagacagctgtaaaactaccatagaagctatccatggattgatgtctcaggttattaaggataaactgtttaatcaaattaacatctcttaaacagtctctgagaagtactttacctgaaagacagtatgagaaaaatattcaagtaacactttaaaaccagttacccaaaatctgattagaagtataaggtgctctgaagtgtcctaaatattaatatcctgtaataaagctctttaaaatgaaa

SEQ ID NO: 278702 - DNA, 1048 bp, Homo sapiens
ttacaacagctccagttacaacagctccagttacaacagctccagttacaacagctccagttacaacagctgctgctgaagatggtgatgcatgccagatcgggaggcaacttggaagtgatgggtctgatgctaggaaaggtggatggtgaaaccatgatcattatggacagttttgctttgcctgtggagggcactgaaacccgagtaaatgctcaggctgctgcatatgaatacatggctgcatacatagaaaatgcaaaacaggttggccgccttgaaaatgcaatcgggtggtatcatagccaccctggctatggctgctggctttctgggattgatgttagtactcagatgctcaatcagcagttccaggaaccatttgtagcagtggtgattgatccaacaagaacaatatccgcagggaaagtgaatcttggcgcctttaggacatacccaaagggctacaaacctcctgatgaaggaccttctgagtaccagactattccacttaataaaatagaagattttggtgtacactgcaaacaatattatgccttagaagtctcatatttcaaatcctctttggatcgcaaattgcttgagctgttgtggaataaatactgggtgaatacgttgagttcttctagcttgcttactaatgcagactataccactggtcaggtctttgatttgtctgaaaagttagagcagtcagaagcccagctgggacgagggagtttcatgttgggtttagaaacgcatgaccgaaaatcagaagacaaacttgccaaagctacaagagacagctgtaaaactaccatagaagctatccatggattgatgtctcaggttattaaggataaactgtttaatcaaattaacatctcttaaacagtctctgagaagtactttacctgaaagacagtatgagaaaaatattcaagtaacactttaaaaccagttacccaaaatctgattagaagtataaggtgctctgaagtgtcctaaatattaatatcctgtaataaagctctttaaaatgaaa

SEQ ID NO: 278703 - DNA, 1314 bp, Homo sapiens
agcggactacctgcccatccaggaacaagcaatttacaaatttacaaaaagtagagtttatgctacagagaagacaaaaacgggagctggtcatgccagaaaaaccaaccatgtgatttgagggttgggcctttgcgccatgtgacatcagccaggcctaaggggaatgaatacagcagggctggagatcaagccaaggagcaacaattcaaccaatcattcctacataaggaaaatccagtaaaaactctggacactcaggcttagccaaagaacaccaggaaaactaccacagttaagttggatgtactactcattgcattaaggaatgcacggagaacacacaccatggggaaccctgtggtatcgtgatgttctcatttaagcaacaagaagattcgtctctcgctattactgtaactgctgtttatatcgtcatgtcccggaaaggtccctgtcttccctgaatggtctctaccaacttcacctccggttctaggtgtcatggctgccccaagagtctaggtaagagtttgttcccgtggtgcggagggtcaaggcccacacccggaaacctagcgaggtaaagttgcgtcttggttgtagagacgacaacttctccgcttcctcggcgatggcggcgtccgggagcggtatggcccagaaaacctgggaactggccaacaacatgcaggaagctcagagtatcgatgaaatctacaaatacgacaagaaacagcagcaagaaatcctggcggcgaagccctggactaaggatcaccattactttaagtactgcaaaatctcagcattggctctgctgaagatggtgatgcatgccagatcgggaggcaacttggaagtgatgggtctgatgctaggaaaggtggatggtgaaaccatgatcattatggacagttttgctttgcctgtggagggcactgaaacccgagtaaatgctcaggctgctgcatatgaatacatggctgcatacatagaaaatgcaaaacaggttggccgccttgaaaatgcaatcgggtggtatcatagccaccctggctatggctgctggctttctgggattgatgttagtactcagatgctcaatcagcagttccaggaaccatttgtagcagtggtggttactatgggcaaggcggcatgagtggaggtggatggcgtgggatgtactgaaagcaaaaacaccaacatacaagtcttgacaacagcatctggtctactagactttcttacagatttaatttcttttgtatttaaagaactttataatgactgaagtgtcgggaccgagct

SEQ ID NO: 278704 - DNA, 328 bp, Homo sapiens
  misc_feature (27)..(27): n is a, c, g, or t
  misc_feature (32)..(32): n is a, c, g, or t
aaggaaaactaggctagtacgagcctngtgtnatcggcgaggtaagagtttgttcccgtggtgcggagggtcaaggcccacacccggaaacctagcgaggtaaagttgcgtcttggttgtagagacgacaacttctccgcttcctcggcgatggcggcgtccgggagcggtatggcccagaaaacctgggaactggccaacaacatgcaggaagctcagagtatcgatgaaatctacaaatacgacaagaaacagcagattagaagtataaggtgctctgaagtgtcctaaatattaatatcctgtaataaagctctttaaaatgaaa

SEQ ID NO: 278705 - DNA, 380 bp, Homo sapiens
acaaaaacgggagctggtcatgccagaaaaaccaaccatgtgatttgagggttgggcctttgcgccatgtgacatcagccaggcctaaggggaatgaatacagcagggctggagatcaagccaaggagcaacaattcaaccaatcattcctacataaggaaaatccagtaaaaactctggacactcaggcttaggtgaggctgattggcaatattctgtatcctgtcacatactgatgtgctaggagggtaatgtctccctgagactaacagataattaatgtttggaccgtcccagaccttaccctatgtgtctcaacctttggctatttctaatttgtatacttatgctataaaactgtgaccataagtacagcactt

SEQ ID NO: 278706 - DNA, 418 bp, Homo sapiens
atacatgaggacattaataatcaagaaaagaatgcagactataccactggtcaggtctttgatttgtctgaaaagttagagcagtcagaagcccagctgggacgagggagtttcatgttgggtttagaaacgcatgaccgaaaatcagaagacaaacttgccaaagctacaagagacagctgtaaaactaccatagaagctatccatggattgatgtctcaggttattaaggataaactgtttaatcaaattaacatctcttaaacagtctctgagaagtactttacctgaaagacagtatgagaaaaatattcaagtaacactttaaaaccagttacccaaaatctgattagaagtataaggtgctctgaagtgtcctaaatattaatatcctgtaataaagctctttaaaatgaaa

SEQ ID NO: 278707 - DNA, 526 bp, Homo sapiens
atctagaggatcctcagttgacacttcagctgctgaagatggtgatgcatgccagatcgggaggcaacttggaagtgatgggtctgatgctaggaaaggtggatggtgaaaccatgatcattatggacagttttgctttgcctgtggagggcactgaaacccgagtaaatgctcaggctgctgcatatgaatacatggctgcatacatagaaaatgcaaaacaggttggccgccttgaaaatgcaatcgggtggtatcatagccaccctggctatggctgctggctttctgggattgatgttagtactcagatgctcaatcagcagttccaggaaccatttgtagcagtggtggttactatgggcaaggcggcatgagtggaggtggatggcgtgggatgtactgaaagcaaaaacaccaacatacaagtcttgacaacagcatctggtctactagactttcttacagatttaatttcttttgtatttaaagaactttataatgactgaagtgtcgggaccgagct

SEQ ID NO: 278708 - DNA, 1309 bp, Homo sapiens
  misc_feature (27)..(27): n is a, c, g, or t
  misc_feature (32)..(32): n is a, c, g, or t
aaggaaaactaggctagtacgagcctngtgtnatcggcgaggtaagagtttgttcccgtggtgcggagggtcaaggcccacacccggaaacctagcgaggtaaagttgcgtcttggttgtagagacgacaacttctccgcttcctcggcgatggcggcgtccgggagcggtatggcccagaaaacctgggaactggccaacaacatgcaggaagctcagagtatcgatgaaatctacaaatacgacaagaaacagcagcaagaaatcctggcggcgaagccctggactaaggatcaccattactttaagtactgcaaaatctcagcattggctctgctgaagatggtgatgcatgccagatcgggaggcaacttggaagtgatgggtctgatgctaggaaaggtggatggtgaaaccatgatcattatggacagttttgctttgcctgtggagggcactgaaacccgagtaaatgctcaggctgctgcatatgaatacatggctgcatacatagaaaatgcaaaacaggttggccgccttgaaaatgcaatcgggtggtatcatagccaccctggctatggctgctggctttctgggattgatgttagtactcagatgctcaatcagcagttccaggaaccatttgtagcagtggtgattgatccaacaagaacaatatccgcagggaaagtgaatcttggcgcctttaggacatacccaaagggctacaaacctcctgatgaaggaccttctgagtaccagactattccacttaataaaatagaagattttggtgtacactgcaaacaatattatgccttagaagtctcatatttcaaatcctctttggatcgcaaattgcttgagctgttgtggaataaatactgggtgaatacgttgagttcttctagcttgcttactaatgcagactataccactggtcaggtctttgatttgtctgaaaagttagagcagtcagaagcccagctgggacgagggagtttcatgttgggtttagaaacgcatgaccgaaaatcagaagacaaacttgccaaagctacaagagacagctgtaaaactaccatagaagctatccatggattgatgtctcaggttattaaggataaactgtttaatcaaattaacatctcttaaacagtctctgagaagtactttacctgaaagacagtatgagaaaaatattcaagtaacactttaaaaccagttacccaaaatctgattagaagtataaggtgctctgaagtgtcctaaatattaatatcctgtaataaagctctttaaaatgaaa

SEQ ID NO: 278709 - DNA, 1244 bp, Homo sapiens
acatgcccttcttccggtgcggaagactataccactcccataccctataactttgtttgttctatttcacacatataattttccgagacaagatgttctcatttaagcaacaagaagattcgtctctcgctattactgtaactgctgtttatatcgtcatgtcccggaaaggtccctgtcttccctgaatggtctctaccaacttcacctccggttctaggtgtcatggctgccccaagagtctaggtaagagtttgttcccgtggtgcggagggtcaaggcccacacccggaaacctagcgaggtaaagttgcgtcttggttgtagagacgacaacttctccgcttcctcggcgatggcggcgtccgggagcggtatggcccagaaaacctgggaactggccaacaacatgcaggaagctcagagtatcgatgaaatctacaaatacgacaagaaacagcagcaagaaatcctggcggcgaagccctggactaaggatcaccattactttaagtactgcaaaatctcagcattggctctgctgaagatggtgatgcatgccagatcgggaggcaacttggaagtgatgggtctgatgctaggaaaggtggatggtgaaaccatgatcattatggacagttttgctttgcctgtggagggcactgaaacccgagtaaatgctcaggctgctgcatatgaatacatggctgcatacatagaaaatgcaaaacaggttggccgccttgaaaatgcaatcgggtggtatcatagccaccctggctatggctgctggctttctgggattgatgttagtactcagatgctcaatcagcagttccaggaaccatttgtagcagtggtgattgatccaacaagaacaatatccgcagggaaagtgaatcttggcgcctttaggacatacccaaagggctacaaacctcctgatgaaggaccttctgagtaccagactattccacttaataaaatagaagattttggtgtacactgcaaacaatattatgccttagaagtctcatatttcaaatcctctttggatcgcaaattgcttgagctgttgtggaataaatactgggtgaatacgttgagttcttctagcttgcttactgcgtaccaagcgacatcccgggcgggcttgattgcgaagttagccaaaccgggagaggggttgtggttaacgcgccataaatgctcaacaggaccaacccggggcggagagaggacac

SEQ ID NO: 278710 - DNA, 1324 bp, Homo sapiens
acctacgccccgagggagccactgcccctgcccccgctccggggcagcgaatgcagccccaggaccctccaccctcaacctacaccaccccaggccacacctcgccactcacgctccccatccgcggctggctgactcttactcaggggagcgggctcgcgtccggggagacacacagtgctctagaggatcgtcgcggaccgaagaggttacagcggccacctggagcgggaacagcatgacagacctccgggccggggctccgcccctcaggcccagccctccgctcgcccttcgccaaccgccggtcaccattactttaagtactgcaaaatctcagcattggctctgctgaagatggtgatgcatgccagatcgggaggcaacttggaagtgatgggtctgatgctaggaaaggtggatggtgaaaccatgatcattatggacagttttgctttgcctgtggagggcactgaaacccgagtaaatgctcaggctgctgcatatgaatacatggctgcatacatagaaaatgcaaaacaggttggccgccttgaaaatgcaatcgggtggtatcatagccaccctggctatggctgctggctttctgggattgatgttagtactcagatgctcaatcagcagttccaggaaccatttgtagcagtggtgattgatccaacaagaacaatatccgcagggaaagtgaatcttggcgcctttaggacatacccaaagggctacaaacctcctgatgaaggaccttctgagtaccagactattccacttaataaaatagaagattttggtgtacactgcaaacaatattatgccttagaagtctcatatttcaaatcctctttggatcgcaaattgcttgagctgttgtggaataaatactgggtgaatacgttgagttcttctagcttgcttactaatgcagactataccactggtcaggtctttgatttgtctgaaaagttagagcagtcagaagcccagctgggacgagggagtttcatgttgggtttagaaacgcatgaccgaaaatcagaagacaaacttgccaaagctacaagagacagctgtaaaactaccatagaagctatccatggattgatgtctcaggttattaaggataaactgtttaatcaaattaacatctcttaaacagtctctgagaagtactttacctgaaagacagtatgagaaaaatattcaagtaacactttaaaaccagttacccaaaatctgattagaagtataaggtgctctgaagtgtcctaaatattaatatcctgtaataaagctctttaaaatgaaa

SEQ ID NO: 278711 - DNA, 1178 bp, Homo sapiens
atagctgcccgctgctctcggttcgccagtacgctggccggggacttggtcaactcgttctcctgctgtgcccaggggctattaaactgtgggggccacttctcaggctaaatctattgcagcctctccagcctcccatgcaccagccagcttaggaacagttcaccattactttaagtactgcaaaatctcagcattggctctgctgaagatggtgatgcatgccagatcgggaggcaacttggaagtgatgggtctgatgctaggaaaggtggatggtgaaaccatgatcattatggacagttttgctttgcctgtggagggcactgaaacccgagtaaatgctcaggctgctgcatatgaatacatggctgcatacatagaaaatgcaaaacaggttggccgccttgaaaatgcaatcgggtggtatcatagccaccctggctatggctgctggctttctgggattgatgttagtactcagatgctcaatcagcagttccaggaaccatttgtagcagtggtgattgatccaacaagaacaatatccgcagggaaagtgaatcttggcgcctttaggacatacccaaagggctacaaacctcctgatgaaggaccttctgagtaccagactattccacttaataaaatagaagattttggtgtacactgcaaacaatattatgccttagaagtctcatatttcaaatcctctttggatcgcaaattgcttgagctgttgtggaataaatactgggtgaatacgttgagttcttctagcttgcttactaatgcagactataccactggtcaggtctttgatttgtctgaaaagttagagcagtcagaagcccagctgggacgagggagtttcatgttgggtttagaaacgcatgaccgaaaatcagaagacaaacttgccaaagctacaagagacagctgtaaaactaccatagaagctatccatggattgatgtctcaggttattaaggataaactgtttaatcaaattaacatctcttaaacagtctctgagaagtactttacctgaaagacagtatgagaaaaatattcaagtaacactttaaaaccagttacccaaaatctgattagaagtataaggtgctctgaagtgtcctaaatattaatatcctgtaataaagctctttaaaatgaaa

SEQ ID NO: 278712 - DNA, 1332 bp, Homo sapiens
  misc_feature (83)..(83): n is a, c, g, or t
cgtgattgcggatggtcacgggccacacccggatagactatctaggtaaagtcgtgtcttggttgtatatacaagtacttgtnccgctatccatcggggatagggggtcgtactgtgcgatcgggtactggtcacacaaagacctgggagactgtactcccagcaggcactgaagctctaaatatcgattaaatcgacaattacgagccagaaacatctacatgatattccttgtgtcgcgtgtagagctctgtggacattatggtatgagcgagttgcctacttaccttgaatgtatgtagcccaatctcacgcatatgcgctgcttgggtgtagacatggctgatgcatgtccagagtcgtgcaggcaacgttggcatatgtggatggggctggtgctaggaaatggtggatggtgaaaccatgaatctgttataggatggtttcggtttgcccgtgagggggtgccctgtaatgaccagtaaattgctcaggtctgtctgtcctttgaaatacactgtgttggcatatgtataggaatgctaaaactcgttggccgccttgaaaatgcaatcgggtggtatcatagccaccctggctatggctgctggctttctgggattgatgttagtactcagatgctcaatcagcagttccaggaaccatttgtagcagtggtgattgatccaacaagaacaatatccgcagggaaagtgaatcttggcgcctttaggacatacccaaagggctacaaacctcctgatgaaggaccttctgagtaccagactattccacttaataaaatagaagattttggtgtacactgcaaacaatattatgccttagaagtctcatatttcaaatcctctttggatcgcaaattgcttgagctgttgtggaataaatactgggtgaatacgttgagttcttctagcttgcttactaatgcagactataccactggtcaggtctttgatttgtctgaaaagttagagcagtcagaagcccagctgggacgagggagtttcatgttgggtttagaaacgcatgaccgaaaatcagaagacaaacttgccaaagctacaagagacagctgtaaaactaccatagaagctatccatggattgatgtctcaggttattaaggataaactgtttaatcaaattaacatctcttaaacagtctctgagaagtactttacctgaaagacagtatgagaaaaatattcaagtaacactttaaaaccagttacccaaaatctgattagaagtataaggtgctctgaagtgtcctaaatattaatatcctgtaataaagctctttaaaatgaaa

SEQ ID NO: 278713 - DNA, 1245 bp, Homo sapiens
agcggactacctgcccatccaggaacaagcaatttacaaatttacaaaaagtagagtttatgctacagagaagacaaaaacgggagctggtcatgccagaaaaaccaaccatgtgatttgagggttgggcctttgcgccatgtgacatcagccaggcctaaggggaatgaatacagcagggctggagatcaagccaaggagcaacaattcaaccaatcattcctacataaggaaaatccagtaaaaactctggacactcaggcttagccaaagaacaccaggaaaactaccacagttaagttggatgtactactcattgcattaaggaatgcacggagaacacacaccatggggaaccctgtggtatcgtgatgttctcatttaagcaacaagaagattcgtctctcgctattactgtaactgctgtttatatcgtcatgtcccggaaaggtccctgtcttccctgaatggtctctaccaacttcacctccggttctaggtgtcatggctgccccaagagtctaggtaagagtttgttcccgtggtgcggagggtcaaggcccacacccggaaacctagcgaggtaaagttgcgtcttggttgtagagacgacaacttctccgcttcctcggcgatggcggcgtccgggagcggtatggcccagaaaacctgggaactggccaacaacatgcaggaagctcagagtatcgatgaaatctacaaatacgacaagaaacagcagcaagaaatcctggcggcgaagccctggactaaggatcaccattactttaagtactgcaaaatctcagcattggctctgctgaagatggtgatgcatgccagatcgggaggcaacttggaagtgatgggtctgatgctaggaaaggtggatggtgaaaccatgatcattatggacagttttgctttgcctgtggagggcactgaaacccgagtaaatgctcaggctgctgcatatgaatacatggctgcatacatagaaaatgcaaaacaggttggccgccttgaaaatgcaatcgggtggtatcatagccaccctggctatggctgctggctttctgggattgatgttagtactcagatgctcaatcagcagttccaggaaccatttgtagcagtggtgattgatccaacaagaacaatatccgcagggaaagtgaatcttggcgcctttaggacatacccaaaggctacaacccccctaacgcggccggtacgtctgattca

SEQ ID NO: 278714 - DNA, 1324 bp, Homo sapiens
agcggactacctgcccatccaggaacaagcaatttacaaatttacaaaaagtagagtttatgctacagagaagacaaaaacgggagctggtcatgccagaaaaaccaaccatgtgatttgagggttgggcctttgcgccatgtgacatcagccaggcctaaggggaatgaatacagcagggctggagatcaagccaaggagcaacaattcaaccaatcattcctacataaggaaaatccagtaaaaactctggacactcaggcttagccaaagaacaccaggaaaactaccacagttaagttggatgtactactcattgcattaaggaatgcacggagaacacacaccatggggaaccctgtggtatcgtgatgttctcatttaagcaacaagaagattcgtctctcgctattactgtaactgctgtttatatcgtcatgtcccggaaaggtccctgtcttccctgaatggtctctaccaacttcacctccggttctaggtgtcatggctgccccaagagtctaggtaagagtttgttcccgtggtgcggagggtcaaggcccacacccggaaacctagcgaggtaaagttgcgtcttggttgtagagacgacaacttctccgcttcctcggcgatggcggcgtccgggagcggtatggcccagaaaacctgggaactggccaacaacatgcaggaagctcagagtatcgatgaaatctacaaatacgacaagaaacagcagcaagaaatcctggcggcgaagccctggactaaggatcaccattactttaagtactgcaaaatctcagcattggctctgctgaagatggtgatgcatgccagatcgggaggcaacttggaagtgatgggtctgatgctaggaaaggtggatggtgaaaccatgatcattatggacagttttgctttgcctgtggagggcactgaaacccgagtaaatgctcaggctgctgcatatgaatacatggctgcatacatagaaaatgcaaaacaggttggccgccttgaaaatgcaatcgggtggtatcatagccaccctggctatggctgctggctttctgggattgatgttagtactcagatgctcaatcagcagttccaggaaccatttgtagcagtggtgattgatcccccagggcaatatccgcggggaagtggatctgggggcccttatgacataccccaagggtgcaaactcctcgtgaagggctctggggccaaaattcccttataaaaaagacttggggggcccgggacatttgccgaaagctattaacccctcgggggaggcggcgggggaaacggg

SEQ ID NO: 278715 - DNA, 486 bp, Homo sapiens
accatctgtgtgaatacttcactgtgattatctctcaccatcatcaaatagttcagagcactgatcctcacgagttggacatttccccatgaaacagtagccttctgagttcttgcaaggaaatccattgaccctgaactggtccttaggacaggcaggcgagtggccagtgcacatctcaggaaaatcacattcatctttcgccggtctgcatatggaccctgctttttttatctgttgaggaaaaacaaagagactaaatcctggatacatttagggtcatactgcttccctgtactgaagtgtgatgtgagactattcaactgctgaagatctgattttaccttttgctcaagctgtccattatttcaggctgacttttattttttaatgtatcattaaataacatcaaaatggtaacttatgccctattttctcaaacaaaataaaaactcaaagaaaatggagtgtgaaaaaataaggtac

SEQ ID NO: 278716 - DNA, 2129 bp, Homo sapiens
tctttcatgtgtcttctccagactgtaagcttcctgtggacaaggcctgctccgttcaaggctcaatctccagctcctgacacaccatgcgctaggtgctcagtcactaatggtctcgcgaaggagtgatcagtgagtgaagcaggggctgctgcatgggaaaggtgagcgggctggaaatgggtagtccccgcggcgtctcccagtcgggctcctcccgaggaggaaggaaggagagaccccaggtgtagtcgaggggccgggagggaggaggggagggtcgctccaccctggagcgggaatgctgcagggcagctccgggtcgccaggcggcggtttccaggcaacgaccgaacacagacgcgggctagacgctggcgctgagcaacctgaggcctgcagactccgactgggcccctgggcgggcgggacggaccgcggccaaggcgggggcgctggacggtggcggcatggaggacgacgaggaggagaccaccgcgtccacgctgcggggcaagcccaggccgccgcccgtctcggcgcagtccgccttcagctacatcccgccgcggcgcctggaccccaaagagcacagctactactaccgcccggcgcggacaggaattatttccctctatgattgtatttttaagaggcgcctagattatgatcagaagttgcaccgagatgacagagaacatgcaaaaagcctgggacttcatgttaacgaagaggaacaggagaggccggttggagtgctgacgtcttctgtctatgggaagcgcatcaatcagcccattgagcccctaaaccgggactttggccgtgccaaccatgtgcaggctgacttctacaggaagaacgacatccccagcctcaaggaacccggctttgggcacattgctccatcctgaagcatccccgtggcccacagggcatgtccgataccctgtggcctggcaagtttgcacagcgagaaggtggcatctggagcctcctttccccttctcatgacgcctaggagcttggctatgcctgtgttgcatctctacagtgggacacatgaacacgttagcagcccccctcaggttgctgggttaggagcctgaccaacaacacctttagtacatgtgaagagtctctgatgtgatgattttcagctggaattatttttgatcaaatgaatctggagaccgattcattgtgagcacctgaataaaatgaaaactttgtttccccttggtaactgttgggttggtttctgttcactggctctctacatttgccaggattctttggggaggcagtcacaggagtgaggtgcagttgcttttcccacgagttaggggaactcctgctgcctgaacacaaacaaccctgacatgttcccttctccaagaggagatgtgatgacaattgtcttttggcacaattgaactctagaaactccatttttgtttttccagaggtctgaatcccaaataacagaattttgtgcagtagggaccaggagccctagtaaggatgggtggccctggtggccagcaatgctcactattactgctcagagagagggggccagtcatgggaagaggctagatttcggtgttcaacaaacttgggtaaaattctggttgctgcattttctagatttgtgttctagggcaagtcatatcatctacatgagcagacatttcctcatatttaaagtggaatttccaaacctagaagagttcatgcgggaggcaatgagctgctggagcacaggcataacacaggtacccagtgtgtgccccacccagtgccccgtcatcacagcaatgacttgactttaaacagtcttctttttggaagcagtcgcttgtaacctaagttggaaatacttactttggagataatttgaaacttacccaagtattaaagtatcatcagctacatttttaatgaatggatcccttggaagaaatcatctctcatctaccatgattaaatttcccacagtttagcagtgaatgggcaggtggcctaattaatttcaatactgatcgctccatcactggttttattgttttgaatatggaaaaaggattctctaaaaataaatgacactgaattccggcaatttcaag

SEQ ID NO: 278717 - DNA, 818 bp, Homo sapiens
cctggctcccagggagaggcacagcgtcggtcagcagacaaatggacaccctccccgtcataacccgccaggcactgccggagggagtgaacacgtggcctggcacatctgggcatttccaactgttggacgcagggttcttccagcatgcccgttttagaaaccccactatgaggttcgcctgcggtggtgcgaaccccaggctcactcgtcgctctgactgaaagccagggagaaaacaggaagaaagaagctgggaatgcccacaggcagagggaaggtgccagggcctggcggccgggagaggcctccccgtgtgattccagtggccgccaggcagttcagagtgttcaagtgcacagagatgaatggaaccatttctgccctccggagcttgggagttgagcatgagctgtgtcatgggtggcaaactgcatgtgcagtcagggagggcttcctggaagaggtcacccggctcccggctggcccctgaatggctgtcgctgccggaatgactgcccgagtccgagaccctgctcaggtcgctgttctgggaggaattctgagagctggggccgctgtccagctcatcccagccccctccggcctgcccaggctgatgcctcacagctggaggaaacaggacagccggtgagatccctggggcttcaggccagccccatgcccacctcccggggccctggaccaggaggcctcgggggctgagtcctgagctgaggatgggtggccaccttggctccagcttcagcaaacaccagccccatgggcatgtgcttccgccgcgggtcccacccctc

SEQ ID NO: 278718 - DNA, 2047 bp, Homo sapiens
cattgaatcggccctaacgattctcggatcgtcattaggtgtaaccatagagcatgaattacctcttgaggtcatcagcgagaatttacgactgtcaacaaaagcacgtgattccctaacgccccccacccccccaaccccccccccatatttggccgcatacatagcaaaacgaagtacagtgcatcgctataattcattaatacatcataaatcgtgaagcacagggttataacgaccacgatccacaaatcaagccctccaaaatcacccaaatgagctcgtactttgtaaactccttctcggggcgttatccaaatggcccggactatcagttgctaaattatggcagtggcagctctctgagcggctcttacagggatcccgctgccatgcacaccggctcttacggctacaattacaatgggatggacctcagcgtcaaccgctcctcggcctcctccagccactttggggcggtgggcgagagctcgcgcgccttccccgcgcccgcccaggagccccgcttcaggcaagcggcttcgagctgctccctgtcctcgcccgagtccctgccctgcaccaacggcgacagccacggcgccaagccctctgcttcgtccccctccgaccaggcgacctcagccagctccagcgccaatttcaccgaaatagacgaggccagcgcgtcctcggagcctgaggaagcggcaagccagctaagcagccccagcctagctcgggcgcagccagagcccatggccacctccacagccgcgcccgaggggcagactccgcagatattcccctggatgaggaagcttcacatcagccatgatatgaccgggccggacgggaaaagggcccggaccgcgtatacccgctaccagaccctggagctggaaaaggagttccacttcaaccgctacctgacccggcgacggcgcatcgagatcgcccacgcactctgcctgtccgagcgccagatcaagatctggttccagaaccggcgcatgaagtggaagaaggacaacaaattgaaaagtatgagcctggctacagctggcagcgccttccagccctgagcccgcccagaggagcccagcggcccaagagcccgtgccacccccagccctggcccctccaatcctccccgctctgccgccgcccgctggggaccggttcccacaagcctgcctcgccttgtgttacgatatttcgtttgatcttaggtcttcctgtggctccctctctcctggactggttatcttgttattattgttaataataataattattattattttccttccatgctcccaactcccttctgcttgtcccaaatccgccagtgtttctgaatgtttgtgtctgtggttgcagtctttcccccaggaaaaaaaaaaaaaaagaaattcgcatgtttaatgtgaactctcccctccccatctgtgttctaacttatttataaaaagatgatcgctgtattttgagtttcagctggaaacttctgtaaggggcagcagttgaggtggggtagtgccgcagtggggtcaagctgagctggcttcggagatggagtcccttttcattctcctcctcctccctcctcactccctaggcccaagtctcctaggggcttggtcctagggtgggaaggggctagggaggaccaaagggatggtattgagaagagagaaagaagatagtgagatttaagttcctgctgcctgggtaggccccacaaggcctggtctgggagtatacggaaacaaaaatgatcctcagtgcaaaatgtcttgtgtatttctctgtgaatccatgggtctggctagagggcccaaagcttgtaaatatggggatagtctgggtcagacccatctctcccttacccatcttgcttccaagaccatttgtagtgagcgagtggatgctgtgctacgtgtgaaatctgtctttgcggggcctgtctcagtgattcgcttttggtatttgtttgtagctttcctggaagtcaaataaatgtttcccccactcaaaaaaaaat

SEQ ID NO: 278719 - DNA, 1240 bp, Homo sapiens
cattgaatcggccctaacgattctcggatcgtcattaggtgtaaccatagagcatgaattacctcttgaggtcatcagcgagaatttacgactgtcaacaaaagcacgtgattccctaacgccccccacccccccaaccccccccccatatttggccgcatacatagcaaaacgaagtacagtgcatcgctataattcattaatacatcataaatcgtgaagcacagggttataacgaccacgatccacaaatcaagccctccaaaatcacccaaatgagctcgtactttgtaaactccttctcggggcgttatccaaatggcccggactatcagttgctaaattatggcagtggcagctctctgagcggctcttacagggatcccgctgccatgcacaccggctcttacggctacaattacaatgggatggacctcagcgtcaaccgctcctcggcctcctccagccactttggggcggtgggcgagagctcgcgcgccttccccgcgcccgcccaggagccccgcttcaggcaagcggcttcgagctgctccctgtcctcgcccgagtccctgccctgcaccaacggcgacagccacggcgccaagccctctgcttcgtccccctccgaccaggcgacctcagccagctccagcgccaatttcaccgaaatagacgaggccagcgcgtcctcggagcctgaggaagcggcaagccagctaagcagccccagcctagctcgggcgcagccagagcccatggccacctccacagccgcgcccgaggggcagactccgcagatattcccctggatgaggaagcttcacatcagccatggtaattctctctctcttttttgtcttctcggctttccttctctgcgttttggggtgggatgggggggacaaggagagcttggctttaccctaaatatagattcatttttctaagggggagaagtatctaagaggggcctcatagcttcgtagacagagccaaaaagggtctctctgttaagaggggggtatttttaataatttgtttccagcttcggcttaggtttttattagcgcagctgaaccagctttaggataaaggatggggttcatataatgtggggaagggtcctgcttacccctgaaattttgagactgtcgctagcaaagaaggggtgaacagtaaaaggagctttccggggcaaaagtgcaaccgctctcctccctcccggggcgagcggccg

SEQ ID NO: 278720 - DNA, 525 bp, Homo sapiens
aagagtccccaccagcaagaaggctctaccagatgtgtccccttgaccttggggtccccagcctccagaactgaaatgaaaccaatttctacaacataggaatgatttcggcatgtctaggagagtcagagaaaagacgggagggaaatgggggagaaagaaaaacgtgagagaaccttctacttcctgaaaggcaccatgactctggaatgttacctgtaattaagaatgtcagaagaaccgagcctccattctaaagtttctgtggtgaagtcatctgtatttcctaggaaacttgaagaggaacaaactgaaacttgacaaaactcggaagagacttacaagaatcagaagtgcacacatggtgccatatttggaagtcatgaagaaaaactgaacagcattaccgaggaaaaacttcttactcctaaatatgcaacgctgtcagtaagaagcacattaaggctaagggttactaataatatttaaataaatgtggccattatgcttctaggaaattaaaaa

SEQ ID NO: 278721 - DNA, 464 bp, Homo sapiens
gctcaccacctctaaggaggagcactgactgaagacaggaatgatttcggcatgtctaggagagtcagagaaaagacgggagggaaatgggggagaaagaaaaacgtgagagaaccttctacttcctgaaaggcaccatgactctggaatgttacctgtaattaagaatgtcagaagaaccgagcctccattctaaagtttctgtggtgaagtcatctgtatttcctaggaaacttgaagaggaacaaactgaaacttgacaaaactcggaagagacttacaagaatcagaagtgcacacatggtgccatatttggaagtcatgaagaaaaactgaacagcattaccgaggaaaaacttcttactcctaaatatgcaacgctgtcagtaagaagcacattaaggctaagggttactaataatatttaaataaatgtggccattatgcttctaggaaattaaaaa

SEQ ID NO: 278722 - DNA, 435 bp, Homo sapiens
cttcaaaatatataactttatttaataaatattaatattttatgttaatattaaggaaatgaaaccaatttctacaacataggaatgatttcggcatgtctaggagagtcagagaaaagacgggagggaaatgggggagaaagaaaaacgtgagagaaccttctacttcctgaaaggcaccatgactctggaatggtaagtgcacaattttacctgttacttttgcaaatcaagaaaaggcaaaaaagacaagatgatatgctctgatttgtggaattagataaattatttgtctgaagaagtggacaaagaaatggaagttggattttagattgttttcaaactaaaactgttcttcatagcaagcaatgtaagctaggcatagaaacctttttctattcatcagcctctataagtaaaacagaaatatccatg

SEQ ID NO: 278723 - DNA, 522 bp, Homo sapiens
tggcttgacccagcagggaactaggtggcttcagtacaactcaggcatgaagaaccaccaggggaagcacacttaagtcatcatctaatggcttcccagtgtatttcacaataacagctattggcaacaagtaagcaatgctggcacatgggtacatgccaacttgcaagcacacaatagtccttaacagggaccatcaccaccctcataatccctcagtttggaggagcctgggcctgccccaagtgtatagtaatcctacccagccagatccaaactctagtcaaagaagggtccccaaatgtcccagaacactgacctctggagggtgggtggggggtggaaagggacagggaagggcagcaggttgtagggtctgctgtcaaaggtcccattccggaccgtccttctccatcccaccccccgggtctccattgccgcggccctgccccaccactttcagctgaggggtagttcggagctccatggtcccttccctagagcggccgccccctcgggcct

SEQ ID NO: 278724 - DNA, 628 bp, Homo sapiens
gcagaccaaacgccaatgcagaaggctcaagaaagaggcaaacagactagccactgctccaggatgactgtggctctttatgagtgaagagaaagggtggagactgaagacagaactggggacagtgacaggcttggggaagaacagctgattcagcagtcccaagcatctgaacacaaggtggacattctccagggtgacatcgcaaaatacatgggtgaagacaacctagtggccgtgacttggagcacccttcctcacaatgaaggcattctgggccagcctgaaaaacagcatggaaataaatcacctaagtacaagggacctcggtgacaacgctgtgaacatctatggattccgcattcaagtactttgtcacaactgtctccacaagttggtacatcttctgtacaaggcaaagaaaactctaaaaacatacaaaaagtcaatgttaataatgagacattattattaaacatcaacaaagtgccatgttcttcaggctccctaaggaatgctagcactttcagactataaatttttgtatccacataatcattgggaaaaattaactttaatgaaaataatccctaatatttgtgaagtttatggtttttaaaaagaaatt

SEQ ID NO: 278725 - DNA, 599 bp, Homo sapiens
gcagaccaaacgccaatgcagaaggctcaagaaagaggcaaacagactagccactgctccaggatgactgtggctctttatgagtgaagagaaagggtggagactgaagacagaactggggacagtgacaggcttggggaagaacagctgattcagcagtcccaagggtgacatcgcaaaatacatgggtgaagacaacctagtggccgtgacttggagcacccttcctcacaatgaaggcattctgggccagcctgaaaaacagcatggaaataaatcacctaagtacaagggacctcggtgacaacgctgtgaacatctatggattccgcattcaagtactttgtcacaactgtctccacaagttggtacatcttctgtacaaggcaaagaaaactctaaaaacatacaaaaagtcaatgttaataatgagacattattattaaacatcaacaaagtgccatgttcttcaggctccctaaggaatgctagcactttcagactataaatttttgtatccacataatcattgggaaaaattaactttaatgaaaataatccctaatatttgtgaagtttatggtttttaaaaagaaatt

SEQ ID NO: 278726 - DNA, 890 bp, Homo sapiens
gtttttagttagtatgaacgggaaggcgagggtaccatttacagcgacgggtaaccacgcgggaggagcaggtcaactcccgacagtggaggtgaagatgcgtgcgcctccgttgtctccctcgcgcgacgcgtccgccgcccgcggttcggtcgggagcggcagcccgtgctccggttccgttccggttccggctggcgtctgcacctgcgaccaccgtgagcagtcatggcgtactccacagtgcagagagtcgctctggcttctgggcttgtcctggctctgtcgctgctgctgcccaaggccttcctgtcccgcgggaagcggcaggagccgccgccgacacctgaaggaaaattgggccgatttccacctatgatgcatcatcaccaggcaccctcagatggccagactcctggggctcgtttccagaggtctcaccttgccgaggcatttgcaaaggccaaaggatcaggtggaggtgctggaggaggaggtagtggaagaggtctgatggggcagattattccaatctacggttttgggatttttttatatatactgtacattctatttaaggtaagtagaatcatcctaatcatattacatcaatgaaaatctaatatggcaataaaaatcattgtctacattaaaacttcttatagttcataaaattatttcaaatccatcatctctttaaatcctgcctcctcttcatgaggtacttaggatagccattatttcagtttcacataagaaatgtttactcaatgtttaagtgttttgccccaaaattcacaactaacaaggcagaactaggacttgaacatggatcttttggttcttaatccagtgagtgatacaattcaatgcactcccctgccaaaaaa

SEQ ID NO: 278727 - DNA, 5032 bp, Homo sapiens
caaaggaaggaggaactaacttgtggaatgctgagaaaggtaaaaacaccttcatataaggaagaggaacaggctatgacctcatgcttgctttgacaagtataagcatgccagggcaaatatttaggctaaactgtgggagctaagaacagttgatttctttattatggctagcagatatctaagcatgttagcacaggttcttgaataaattttgcttctaagagaagttactattcctaattatatggggagtaaagtctctttgaagaggaatctctactttactttttacacttgtgctttgataattttttacttggaaacctcatcttttggcgttttttttttttgagctatttctctagtgttgctatttgatttaatttctgaccttcatttttgtttcccaaccttttttttttgtttgatatgaggggttccgtgactgaggttctgagctgctgttgatgtgctatacctccttcaattctcagctctcaaaggggaaaacaactgcagaggatgggaaatgctatactgccatgcctggaaacacccacaggaaaattaccagttttgagcttgctcaactgcaagaaaaactgaaggagacagaagcagccatggaaaaattaatcaacagagtgggacctaatggtgagaggataagggcttctgatttcccatgacttaggaaacagaattaagactgtttcattcattgaagatcagaatgccctgcgtacagtctggaaaagtaacatgtgccgcctgaagagacaagagtttgtgataagcagagcacagactgtgacttctgaccaagagaaacggttgctacatcagctccgagaaatcaccagggtcatgaaagaaggaaaattcattgacagattttctccagagaaagaagctgaggaggccccttacatggaggactgggaaggttaccctgaagagacttacccaatttatgacctttcagactgtatcaagcgtaggcaagaaacaatcttggtggattaccctgacccaaaagaactttctgctgaagaaatagctgaaagaatgggaatgatagaagaggaagaatcagatcatttgggttgggaaagtctgcccactgaccccagagcccaggaagataattctgttacctcgtgtgatccaaagccagaaacatgttcctgctgttttcatgaagacgaggatcctgctgtcttggcagagaatgctggattcagtgcagatagctaccctgagcaagaggaaaccaccaaagaagagtggtcccaagactttaaagatgaagggttgggcatcagcaccgataaagcatatacaggcagcatgctgaggaagcgtaacccccagggtttagagtgaaaacagccagtctgaagtatccattactcaagtcccaaggtgacctctctctcctcagatttccttcttggccctgtgccctgcactttcttcactgtgttcaagtgtcatagctatcaggccactatcatggatatcatgtatccttcctggtgctcacacacctgtcaccttgtaaaacacggacattagtgtgaacacaggacagcttcgctctttctcttcctgccctagctcttggttggtttatatataaggaatatatttgtgtatttatatatcagacatttggatgtacctttcagttatttaggatttagaaaattctttttggattttccagaattattttatccttcggggatgacagttatatgtgtatatacaacccaggatgacaaaatcatgggtccggtttttgttgccagggctgctgtctcttttcttgcggtcttcatttctcacgagggtgctgggaacttgatcagtcccctggccttttggcactgtggcagagtacacaagtcatacctttatggacagttagctcacaaaacaactgcataatctgggatcactcttggtaaatcaggtgggtggtgcagccaggagatcccctttcctggtcacaacaggagcacaaagaaaccattatctccatgactagctccagaagctgggcccagggagtcgtgatgaggagtggaggtgtatttggcctgtagaatcaacggcctttgagaaccatacaatgcaccttatatggcttgggtgatcaaataacttaaggtccaaattcaaacactttggaaaaagggagctttaatataattatgccaaggtgataggcataaactaagactgtcctggacgtagggtcacccctgtctatagccatttaagatttttgaacctgatgactaaacaaacaaaaccctctttcctttttagaatatcctgtatgcgctatttcccaccagaggcagaggccacaggagataggccatggttcaggtaggaaatgctcttggtcacatcagaactctagatctgggggaataaacaaacccgaattattaccacactctcaaagttctcttcaatctggactatttgtattccaaagaaaaatttagtgctttagctattcagcaatattgagaaaaaacatgaacacatttatgactttgccttgaccattgacttttctaaaatgtgcttccttttcctttatttccctttttttatacaaagaaaatagcccaaatttctcctcttaggtcattccttaacctctcagagaaccagtttccccatgaattgggaataatgctctatttacagggctgtttggattaaataagatgctgtttataaagtgtctgtgccagggcaaagcatgtggtaggtgcttggtgacagcatgatccctgtcaccactctgtcaagtccagtgttgctgagatgtcacacctgacaccctctaaggctaccctgattgccaggagtggcccagggcccttctgcagtctccgggtgcctttagttataacctcttgtctgggtcagaccattagctttcatgtctgcttctagctacaactgtagcctcccttccttttgccttcaaatctgccacagctgcccggcaacaaaaaagattcctaagcatctcgaggtcctgtttaaatgggttagggtccaagcaagccctgagacatcaagtggttgggtcttttatacctttttcatctctacagccctgttctcttcctaaggccaggcccacaggggatactgaggaaccaccagccccttcaggcggcacagcagaccctgaagagaactgctctaacttaagtaccttctgacttcaccatttttccagcctctgggtgtggttctgatgaaccttaaacttgaaaggcacaggccagaggaaggacagtgttgacccacatgtcattggtgaggttatgatctctttgctattatcacctacttacccacctgaggctcctaggaaacaatgaatgaaaggtatagaaaaaaattaggaagtaaacagggcttttttcccctttatgaaaaaagtacacagaagtgttgaaacgattcaagtttaatttgttgatatatgtgtgtacttagacaaacactaaattctacaacatacataatgtcaacatgggaaaataccaagtttgtcattgcacataccaataaataaatacatttgctccagaataccaaagtttattcaaaaagtcaataaaagcacagttttgcaaatttgtctaaaacgccagataatcttgaacaaaaataaaatgtctgaccactccaaaataggaaaagacaatcttgtgcaaatagacatacacagtctaggcattgtggaaactggctgtgttcccagcaagagatactgcaccctcctgaccgagcagtcaggcttccctttcctagccatcctaagttgcgttctaggaaactctggatctcagcctcatctccagctttgcctggaccttgctagggggagggagggacaggagcacagaggaggagaggagagggatgtgatgtctttcttaggaaagaaaaaaaggcacagtgatgagctataaaggtagtgatgagagctataaaggtagtgatgaaagcaaggaataattttcattcaccccaaatcctacggcaagctttgacaatgtaacatctttatcttgtggttaggaaaatggacctagagagattatgtggtttgctcaaaatcacatagctactaagtgcagtagtgctttctataagaccaacttgcctttccacttggttggaaaatttaaaaaccaaacctgtcgtaatctatctgttctgcccctcccgcctgtatcatgagatgactgaaaattccaggtggccataaactcaaacaagagcctagcccttggcttattaccggtggctactacaaacctacagaccagagcccagggtagtatagagtcccaactctgggccctgactgcaggtcattcaggtcccagtcacagtgaaagcagactcattcagctatctggagaagtgtaatctgagggccacttggcatcctgagttaacacagggatgccgcagctggggtaaggaattagagaagggaaggccagtgttactgcagtaagagaaaaccaggaagtccatctaggagatgaaatttgtgcttgcataacagagccatggaaatggctatcccagcatctcccctcactgcagactccattgtaagcaaagcatggacctttttctttgaaaccaaccctgtcacttgttaaatttagaattacctctaaatgctaagtttatttaagaggtaaatgtcctgctattttcagaatggagaaaaaaaaaaaaaaaaaaaccttctgcttctagaattttgtgccctacttgtcactgaaggaggcaggctccgaaagttctcttatagcttctgattatcacagtcctggcttccaacacctgtgttcgccatagatctggacattatgtgcttcctctgaactagtgtcttgatttttaaggcacattcactagagtatgttcaatttcaaccaaaagcatacgtgcaacataccagttt

SEQ ID NO: 278728 - DNA, 4978 bp, Homo sapiens
gtttttagttagtatgaacgggaaggcgagggtaccatttacagcgacgggtaaccacgcgggaggagcaggtcaactcccgacagtggaggtgaagatgcgtgcgcctccgttgtctccctcgcgcgacgcgtccgccgcccgcggttcggtcgggagcggcagcccgtgctccggttccgttccggttccggctggcgtctgcacctgcgaccaccgtgagcagtcatggcgtactccacagtgcagagagtcgctctggcttctgggcttgtcctggctctgtcgctgctgctgcccaaggccttcctgtcccgcgggaagcggcaggagccgccgccgacacctgaaggaaaattgggccgatttccacctatgatgcatcatcaccaggcaccctcagatggccagactcctggggctcgtttccagaggtctcaccttgccgaggcatttgcaaaggccaaaggatcaggtggaggtgctggaggaggaggtagtggaagaggtctgatggggcagattattccaatctacggttttgggatttttttatatatactgtacattctatttaagctctcaaaggggaaaacaactgcagaggatgggaaatgctatactgccatgcctggaaacacccacaggaaaattaccagttttgagcttgctcaactgcaagaaaaactgaaggagacagaagcagccatggaaaaattaatcaacagagtgggacctaatggtgagagagcacagactgtgacttctgaccaagagaaacggttgctacatcagctccgagaaatcaccagggtcatgaaagaaggaaaattcattgacagattttctccagagaaagaagctgaggaggccccttacatggaggactgggaaggttaccctgaagagacttacccaatttatgacctttcagactgtatcaagcgtaggcaagaaacaatcttggtggattaccctgacccaaaagaactttctgctgaagaaatagctgaaagaatgggaatgatagaagaggaagaatcagatcatttgggttgggaaagtctgcccactgaccccagagcccaggaagataattctgttacctcgtgtgatccaaagccagaaacatgttcctgctgttttcatgaagacgaggatcctgctgtcttggcagagaatgctggattcagtgcagatagctaccctgagcaagaggaaaccaccaaagaagagtggtcccaagactttaaagatgaagggttgggcatcagcaccgataaagcatatacaggcagcatgctgaggaagcgtaacccccagggtttagagtgaaaacagccagtctgaagtatccattactcaagtcccaaggtgacctctctctcctcagatttccttcttggccctgtgccctgcactttcttcactgtgttcaagtgtcatagctatcaggccactatcatggatatcatgtatccttcctggtgctcacacacctgtcaccttgtaaaacacggacattagtgtgaacacaggacagcttcgctctttctcttcctgccctagctcttggttggtttatatataaggaatatatttgtgtatttatatatcagacatttggatgtacctttcagttatttaggatttagaaaattctttttggattttccagaattattttatccttcggggatgacagttatatgtgtatatacaacccaggatgacaaaatcatgggtccggtttttgttgccagggctgctgtctcttttcttgcggtcttcatttctcacgagggtgctgggaacttgatcagtcccctggccttttggcactgtggcagagtacacaagtcatacctttatggacagttagctcacaaaacaactgcataatctgggatcactcttggtaaatcaggtgggtggtgcagccaggagatcccctttcctggtcacaacaggagcacaaagaaaccattatctccatgactagctccagaagctgggcccagggagtcgtgatgaggagtggaggtgtatttggcctgtagaatcaacggcctttgagaaccatacaatgcaccttatatggcttgggtgatcaaataacttaaggtccaaattcaaacactttggaaaaagggagctttaatataattatgccaaggtgataggcataaactaagactgtcctggacgtagggtcacccctgtctatagccatttaagatttttgaacctgatgactaaacaaacaaaaccctctttcctttttagaatatcctgtatgcgctatttcccaccagaggcagaggccacaggagataggccatggttcaggtaggaaatgctcttggtcacatcagaactctagatctgggggaataaacaaacccgaattattaccacactctcaaagttctcttcaatctggactatttgtattccaaagaaaaatttagtgctttagctattcagcaatattgagaaaaaacatgaacacatttatgactttgccttgaccattgacttttctaaaatgtgcttccttttcctttatttccctttttttatacaaagaaaatagcccaaatttctcctcttaggtcattccttaacctctcagagaaccagtttccccatgaattgggaataatgctctatttacagggctgtttggattaaataagatgctgtttataaagtgtctgtgccagggcaaagcatgtggtaggtgcttggtgacagcatgatccctgtcaccactctgtcaagtccagtgttgctgagatgtcacacctgacaccctctaaggctaccctgattgccaggagtggcccagggcccttctgcagtctccgggtgcctttagttataacctcttgtctgggtcagaccattagctttcatgtctgcttctagctacaactgtagcctcccttccttttgccttcaaatctgccacagctgcccggcaacaaaaaagattcctaagcatctcgaggtcctgtttaaatgggttagggtccaagcaagccctgagacatcaagtggttgggtcttttatacctttttcatctctacagccctgttctcttcctaaggccaggcccacaggggatactgaggaaccaccagccccttcaggcggcacagcagaccctgaagagaactgctctaacttaagtaccttctgacttcaccatttttccagcctctgggtgtggttctgatgaaccttaaacttgaaaggcacaggccagaggaaggacagtgttgacccacatgtcattggtgaggttatgatctctttgctattatcacctacttacccacctgaggctcctaggaaacaatgaatgaaaggtatagaaaaaaattaggaagtaaacagggcttttttcccctttatgaaaaaagtacacagaagtgttgaaacgattcaagtttaatttgttgatatatgtgtgtacttagacaaacactaaattctacaacatacataatgtcaacatgggaaaataccaagtttgtcattgcacataccaataaataaatacatttgctccagaataccaaagtttattcaaaaagtcaataaaagcacagttttgcaaatttgtctaaaacgccagataatcttgaacaaaaataaaatgtctgaccactccaaaataggaaaagacaatcttgtgcaaatagacatacacagtctaggcattgtggaaactggctgtgttcccagcaagagatactgcaccctcctgaccgagcagtcaggcttccctttcctagccatcctaagttgcgttctaggaaactctggatctcagcctcatctccagctttgcctggaccttgctagggggagggagggacaggagcacagaggaggagaggagagggatgtgatgtctttcttaggaaagaaaaaaaggcacagtgatgagctataaaggtagtgatgagagctataaaggtagtgatgaaagcaaggaataattttcattcaccccaaatcctacggcaagctttgacaatgtaacatctttatcttgtggttaggaaaatggacctagagagattatgtggtttgctcaaaatcacatagctactaagtgcagtagtgctttctataagaccaacttgcctttccacttggttggaaaatttaaaaaccaaacctgtcgtaatctatctgttctgcccctcccgcctgtatcatgagatgactgaaaattccaggtggccataaactcaaacaagagcctagcccttggcttattaccggtggctactacaaacctacagaccagagcccagggtagtatagagtcccaactctgggccctgactgcaggtcattcaggtcccagtcacagtgaaagcagactcattcagctatctggagaagtgtaatctgagggccacttggcatcctgagttaacacagggatgccgcagctggggtaaggaattagagaagggaaggccagtgttactgcagtaagagaaaaccaggaagtccatctaggagatgaaatttgtgcttgcataacagagccatggaaatggctatcccagcatctcccctcactgcagactccattgtaagcaaagcatggacctttttctttgaaaccaaccctgtcacttgttaaatttagaattacctctaaatgctaagtttatttaagaggtaaatgtcctgctattttcagaatggagaaaaaaaaaaaaaaaaaaaccttctgcttctagaattttgtgccctacttgtcactgaaggaggcaggctccgaaagttctcttatagcttctgattatcacagtcctggcttccaacacctgtgttcgccatagatctggacattatgtgcttcctctgaactagtgtcttgatttttaaggcacattcactagagtatgttcaatttcaaccaaaagcatacgtgcaacataccagttt

SEQ ID NO: 278729 - DNA, 4286 bp, Homo sapiens
caaaggaaggaggaactaacttgtggaatgctgagaaaggtaaaaacaccttcatataaggaagaggaacaggctatgacctcatgcttgctttgacaagtataagcatgccagggcaaatatttaggctaaactgtgggagctaagaacagttgatttctttattatggctagcagatatctaagcatgttagcacaggttcttgaataaattttgcttctaagagaagttactattcctaattatatggggagtaaagtctctttgaagaggaatctctactttactttttacacttgtgctttgataattttttacttggaaacctcatcttttggcgttttttttttttgagctatttctctagtgttgctatttgatttaatttctgaccttcatttttgtttcccaaccttttttttttgtttgatatgaggggttccgtgactgaggttctgagctgctgttgatgtgctatacctccttcaattctcagctctcaaaggggaaaacaactgcagaggatgggaaatgctatactgccatgcctggaaacacccacaggaaaattaccagttttgagcttgctcaactgcaagaaaaactgaaggagacagaagcagccatggaaaaattaatcaacagagtgggacctaatggtgagaggataagggcttctgatttcccatgacttaggaaacagaattaagactgtttcattcattgaagatcagaatgccctgcgtacagtctggaaaagtaacatgtgccgcctgaagagacaagagtttgtgataagcagagcacagactgtgacttctgaccaagagaaacggttgctacatcagctccgagaaatcaccagggtcatgaaagaaggaaaattcattgacagattttctccagagaaagaagctgaggaggccccttacatggaggactgggaaggttaccctgaagagacttacccaatttatgacctttcagactgtatcaagcgtaggcaagaaacaatcttggtggattaccctgacccaaaagaactttctgctgaagaaatagctgaaagaatgggaatgatagaagaggaagaatcagatcatttgggttgggaaagtctgcccactgaccccagagcccaggaagataattctgttacctcgtgtgatccaaagccagaaacatgttcctgctgttttcatgaagacgaggatcctgctgtcttggcagagaatgctggattcagtgcagatagctaccctgagcaagaggaaaccaccaaagaagagtggtcccaagactttaaagatgaagggttgggcatcagcaccgataaagcatatacaggcagcatgctgaggaagcgtaacccccagggtttagagtgaaaacagccagtctgaagtatccattactcaagtcccaaggtgacctctctctcctcagatttccttcttggccctgtgccctgcactttcttcactgtgttcaagtgtcatagctatcaggccactatcatggatatcatgtatccttcctggtgctcacacacctgtcaccttgtaaaacacggacattagtgtgaacacaggacagcttcgctctttctcttcctgccctagctcttggttggtttatatataaggaatatatttgtgtatttatatatcagacatttggatgtacctttcagttatttaggatttagaaaattctttttggattttccagaattattttatccttcggggatgacagttatatgtgtatatacaacccaggatgacaaaatcatgggtccggtttttgttgccagggctgctgtctcttttcttgcggtcttcatttctcacgagggtgctgggaacttgatcagtcccctggccttttggcactgtggcagagtacacaagtcatacctttatggacagttagctcacaaaacaactgcataatctgggatcactcttggtaaatcaggtgggtggtgcagccaggagatcccctttcctggtcacaacaggagcacaaagaaaccattatctccatgactagctccagaagctgggcccagggagtcgtgatgaggagtggaggtgtatttggcctgtagaatcaacggcctttgagaaccatacaatgcaccttatatggcttgggtgatcaaataacttaaggtccaaattcaaacactttggaaaaagggagctttaatataattatgccaaggtgataggcataaactaagactgtcctggacgtagggtcacccctgtctatagccatttaagatttttgaacctgatgactaaacaaacaaaaccctctttcctttttagaatatcctgtatgcgctatttcccaccagaggcagaggccacaggagataggccatggttcagccctgttctcttcctaaggccaggcccacaggggatactgaggaaccaccagccccttcaggcggcacagcagaccctgaagagaactgctctaacttaagtaccttctgacttcaccatttttccagcctctgggtgtggttctgatgaaccttaaacttgaaaggcacaggccagaggaaggacagtgttgacccacatgtcattggtgaggttatgatctctttgctattatcacctacttacccacctgaggctcctaggaaacaatgaatgaaaggtatagaaaaaaattaggaagtaaacagggcttttttcccctttatgaaaaaagtacacagaagtgttgaaacgattcaagtttaatttgttgatatatgtgtgtacttagacaaacactaaattctacaacatacataatgtcaacatgggaaaataccaagtttgtcattgcacataccaataaataaatacatttgctccagaataccaaagtttattcaaaaagtcaataaaagcacagttttgcaaatttgtctaaaacgccagataatcttgaacaaaaataaaatgtctgaccactccaaaataggaaaagacaatcttgtgcaaatagacatacacagtctaggcattgtggaaactggctgtgttcccagcaagagatactgcaccctcctgaccgagcagtcaggcttccctttcctagccatcctaagttgcgttctaggaaactctggatctcagcctcatctccagctttgcctggaccttgctagggggagggagggacaggagcacagaggaggagaggagagggatgtgatgtctttcttaggaaagaaaaaaaggcacagtgatgagctataaaggtagtgatgagagctataaaggtagtgatgaaagcaaggaataattttcattcaccccaaatcctacggcaagctttgacaatgtaacatctttatcttgtggttaggaaaatggacctagagagattatgtggtttgctcaaaatcacatagctactaagtgcagtagtgctttctataagaccaacttgcctttccacttggttggaaaatttaaaaaccaaacctgtcgtaatctatctgttctgcccctcccgcctgtatcatgagatgactgaaaattccaggtggccataaactcaaacaagagcctagcccttggcttattaccggtggctactacaaacctacagaccagagcccagggtagtatagagtcccaactctgggccctgactgcaggtcattcaggtcccagtcacagtgaaagcagactcattcagctatctggagaagtgtaatctgagggccacttggcatcctgagttaacacagggatgccgcagctggggtaaggaattagagaagggaaggccagtgttactgcagtaagagaaaaccaggaagtccatctaggagatgaaatttgtgcttgcataacagagccatggaaatggctatcccagcatctcccctcactgcagactccattgtaagcaaagcatggacctttttctttgaaaccaaccctgtcacttgttaaatttagaattacctctaaatgctaagtttatttaagaggtaaatgtcctgctattttcagaatggagaaaaaaaaaaaaaaaaaaaccttctgcttctagaattttgtgccctacttgtcactgaaggaggcaggctccgaaagttctcttatagcttctgattatcacagtcctggcttccaacacctgtgttcgccatagatctggacattatgtgcttcctctgaactagtgtcttgatttttaaggcacattcactagagtatgttcaatttcaaccaaaagcatacgtgcaacataccagttt

SEQ ID NO: 278730 - DNA, 4473 bp, Homo sapiens
gtttttagttagtatgaacgggaaggcgagggtaccatttacagcgacgggtaaccacgcgggaggagcaggtcaactcccgacagtggaggtgaagatgcgtgcgcctccgttgtctccctcgcgcgacgcgtccgccgcccgcggttcggtcgggagcggcagcccgtgctccggttccgttccggttccggctggcgtctgcacctgcgaccaccgtgagcagtcatggcgtactccacagtgcagagagtcgctctggcttctgggcttgtcctggctctgtcgctgctgctgcccaaggccttcctgtcccgcgggaagcggcaggagccgccgccgacacctgaaggaaaattgggccgatttccacctatgatgcatcatcaccaggcaccctcagatggccagactcctggggctcgtttccagaggtctcaccttgccgaggcatttgcaaaggccaaaggatcaggtggaggtgctggaggaggaggtagtggaagaggtctgatggggcagattattccaatctacggttttgggatttttttatatatactgtacattctatttaagctctcaaaggggaaaacaactgcagaggatgggaaatgctatactgccatgcctggaaacacccacaggaaaattaccagttttgagcttgctcaactgcaagaaaaactgaaggagacagaagcagccatggaaaaattaatcaacagagtgggacctaatggtgagagagcacagactgtgacttctgaccaagagaaacggttgctacatcagctccgagaaatcaccagggtcatgaaagaaggaaaattcattgacagattttctccagagaaagaagctgaggaggccccttacatggaggactgggaaggttaccctgaagagacttacccaatttatgacctttcagactgtatcaagcgtaggcaagaaacaatcttggtggattaccctgacccaaaagaactttctgctgaagaaatagctgaaagaatgggaatgatagaagaggaagaatcagatcatttgggttgggaaagtctgcccactgaccccagagcccaggaagataattctgttacctcgtgtgatccaaagccagaaacatgttcctgctgttttcatgaagacgaggatcctgctgtcttggcagagaatgctggattcagtgcagatagctaccctgagcaagaggaaaccaccaaagaagagtggtcccaagactttaaagatgaagggttgggcatcagcaccgataaagcatatacaggcagcatgctgaggaagcgtaacccccagggtttagagtgaaaacagccagtctgaagtatccattactcaagtcccaaggtgacctctctctcctcagatttccttcttggccctgtgccctgcactttcttcactgtgttcaagtgtcatagctatcaggccactatcatggatatcatgtatccttcctggtgctcacacacctgtcaccttgtaaaacacggacattagtgtgaacacaggacagcttcgctctttctcttcctgcctttcctctatcagagaagttgatccattaagtaattatgtttggtctattgtaattacagatgggaccactcaggggcaaaggtctgactcttcctggtaggtgtaacagatagttcacctgtgaacgaacatcagcttacagatgatgaggacttaaggttgcaagaatgaagatttcagactccaagatcccttattctttgggccttgagcagaatatcctgtatgcgctatttcccaccagaggcagaggccacaggagataggccatggttcaggtaggaaatgctcttggtcacatcagaactctagatctgggggaataaacaaacccgaattattaccacactctcaaagttctcttcaatctggactatttgtattccaaagaaaaatttagtgctttagctattcagcaatattgagaaaaaacatgaacacatttatgactttgccttgaccattgacttttctaaaatgtgcttccttttcctttatttccctttttttatacaaagaaaatagcccaaatttctcctcttaggtcattccttaacctctcagagaaccagtttccccatgaattgggaataatgctctatttacagggctgtttggattaaataagatgctgtttataaagtgtctgtgccagggcaaagcatgtggtaggtgcttggtgacagcatgatccctgtcaccactctgtcaagtccagtgttgctgagatgtcacacctgacaccctctaaggctaccctgattgccaggagtggcccagggcccttctgcagtctccgggtgcctttagttataacctcttgtctgggtcagaccattagctttcatgtctgcttctagctacaactgtagcctcccttccttttgccttcaaatctgccacagctgcccggcaacaaaaaagattcctaagcatctcgaggtcctgtttaaatgggttagggtccaagcaagccctgagacatcaagtggttgggtcttttatacctttttcatctctacagccctgttctcttcctaaggccaggcccacaggggatactgaggaaccaccagccccttcaggcggcacagcagaccctgaagagaactgctctaacttaagtaccttctgacttcaccatttttccagcctctgggtgtggttctgatgaaccttaaacttgaaaggcacaggccagaggaaggacagtgttgacccacatgtcattggtgaggttatgatctctttgctattatcacctacttacccacctgaggctcctaggaaacaatgaatgaaaggtatagaaaaaaattaggaagtaaacagggcttttttcccctttatgaaaaaagtacacagaagtgttgaaacgattcaagtttaatttgttgatatatgtgtgtacttagacaaacactaaattctacaacatacataatgtcaacatgggaaaataccaagtttgtcattgcacataccaataaataaatacatttgctccagaataccaaagtttattcaaaaagtcaataaaagcacagttttgcaaatttgtctaaaacgccagataatcttgaacaaaaataaaatgtctgaccactccaaaataggaaaagacaatcttgtgcaaatagacatacacagtctaggcattgtggaaactggctgtgttcccagcaagagatactgcaccctcctgaccgagcagtcaggcttccctttcctagccatcctaagttgcgttctaggaaactctggatctcagcctcatctccagctttgcctggaccttgctagggggagggagggacaggagcacagaggaggagaggagagggatgtgatgtctttcttaggaaagaaaaaaaggcacagtgatgagctataaaggtagtgatgagagctataaaggtagtgatgaaagcaaggaataattttcattcaccccaaatcctacggcaagctttgacaatgtaacatctttatcttgtggttaggaaaatggacctagagagattatgtggtttgctcaaaatcacatagctactaagtgcagtagtgctttctataagaccaacttgcctttccacttggttggaaaatttaaaaaccaaacctgtcgtaatctatctgttctgcccctcccgcctgtatcatgagatgactgaaaattccaggtggccataaactcaaacaagagcctagcccttggcttattaccggtggctactacaaacctacagaccagagcccagggtagtatagagtcccaactctgggccctgactgcaggtcattcaggtcccagtcacagtgaaagcagactcattcagctatctggagaagtgtaatctgagggccacttggcatcctgagttaacacagggatgccgcagctggggtaaggaattagagaagggaaggccagtgttactgcagtaagagaaaaccaggaagtccatctaggagatgaaatttgtgcttgcataacagagccatggaaatggctatcccagcatctcccctcactgcagactccattgtaagcaaagcatggacctttttctttgaaaccaaccctgtcacttgttaaatttagaattacctctaaatgctaagtttatttaagaggtaaatgtcctgctattttcagaatggagaaaaaaaaaaaaaaaaaaaccttctgcttctagaattttgtgccctacttgtcactgaaggaggcaggctccgaaagttctcttatagcttctgattatcacagtcctggcttccaacacctgtgttcgccatagatctggacattatgtgcttcctctgaactagtgtcttgatttttaaggcacattcactagagtatgttcaatttcaaccaaaagcatacgtgcaacataccagttt

SEQ ID NO: 278731 - DNA, 4222 bp, Homo sapiens
gtttttagttagtatgaacgggaaggcgagggtaccatttacagcgacgggtaaccacgcgggaggagcaggtcaactcccgacagtggaggtgaagatgcgtgcgcctccgttgtctccctcgcgcgacgcgtccgccgcccgcggttcggtcgggagcggcagcccgtgctccggttccgttccggttccggctggcgtctgcacctgcgaccaccgtgagcagtcatggcgtactccacagtgcagagagtcgctctggcttctgggcttgtcctggctctgtcgctgctgctgcccaaggccttcctgtcccgcgggaagcggcaggagccgccgccgacacctgaaggaaaattgggccgatttccacctatgatgcatcatcaccaggcaccctcagatggccagactcctggggctcgtttccagaggtctcaccttgccgaggcatttgcaaaggccaaaggatcaggtggaggtgctggaggaggaggtagtggaagaggtctgatggggcagattattccaatctacggttttgggatttttttatatatactgtacattctatttaagctctcaaaggggaaaacaactgcagaggatgggaaatgctatactgccatgcctggaaacacccacaggaaaattaccagttttgagcttgctcaactgcaagaaaaactgaaggagacagaagcagccatggaaaaattaatcaacagagtgggacctaatggtgagagagcacagactgtgacttctgaccaagagaaacggttgctacatcagctccgagaaatcaccagggtcatgaaagaaggaaaattcattgacagattttctccagagaaagaagctgaggaggccccttacatggaggactgggaaggttaccctgaagagacttacccaatttatgacctttcagactgtatcaagcgtaggcaagaaacaatcttggtggattaccctgacccaaaagaactttctgctgaagaaatagctgaaagaatgggaatgatagaagaggaagaatcagatcatttgggttgggaaagtctgcccactgaccccagagcccaggaagataattctgttacctcgtgtgatccaaagccagaaacatgttcctgctgttttcatgaagacgaggatcctgctgtcttggcagagaatgctggattcagtgcagatagctaccctgagcaagaggaaaccaccaaagaagagtggtcccaagactttaaagatgaagggttgggcatcagcaccgataaagcatatacaggcagcatgctgaggaagcgtaacccccagggtttagagtgaaaacagccagtctgaagtatccattactcaagtcccaagatgggaccactcaggggcaaaggtctgactcttcctggtaggtgtaacagatagttcacctgtgaacgaacatcagcttacagatgatgaggacttaaggttgcaagaatgaagatttcagactccaagatcccttattctttgggccttgagcagaatatcctgtatgcgctatttcccaccagaggcagaggccacaggagataggccatggttcaggtaggaaatgctcttggtcacatcagaactctagatctgggggaataaacaaacccgaattattaccacactctcaaagttctcttcaatctggactatttgtattccaaagaaaaatttagtgctttagctattcagcaatattgagaaaaaacatgaacacatttatgactttgccttgaccattgacttttctaaaatgtgcttccttttcctttatttccctttttttatacaaagaaaatagcccaaatttctcctcttaggtcattccttaacctctcagagaaccagtttccccatgaattgggaataatgctctatttacagggctgtttggattaaataagatgctgtttataaagtgtctgtgccagggcaaagcatgtggtaggtgcttggtgacagcatgatccctgtcaccactctgtcaagtccagtgttgctgagatgtcacacctgacaccctctaaggctaccctgattgccaggagtggcccagggcccttctgcagtctccgggtgcctttagttataacctcttgtctgggtcagaccattagctttcatgtctgcttctagctacaactgtagcctcccttccttttgccttcaaatctgccacagctgcccggcaacaaaaaagattcctaagcatctcgaggtcctgtttaaatgggttagggtccaagcaagccctgagacatcaagtggttgggtcttttatacctttttcatctctacagccctgttctcttcctaaggccaggcccacaggggatactgaggaaccaccagccccttcaggcggcacagcagaccctgaagagaactgctctaacttaagtaccttctgacttcaccatttttccagcctctgggtgtggttctgatgaaccttaaacttgaaaggcacaggccagaggaaggacagtgttgacccacatgtcattggtgaggttatgatctctttgctattatcacctacttacccacctgaggctcctaggaaacaatgaatgaaaggtatagaaaaaaattaggaagtaaacagggcttttttcccctttatgaaaaaagtacacagaagtgttgaaacgattcaagtttaatttgttgatatatgtgtgtacttagacaaacactaaattctacaacatacataatgtcaacatgggaaaataccaagtttgtcattgcacataccaataaataaatacatttgctccagaataccaaagtttattcaaaaagtcaataaaagcacagttttgcaaatttgtctaaaacgccagataatcttgaacaaaaataaaatgtctgaccactccaaaataggaaaagacaatcttgtgcaaatagacatacacagtctaggcattgtggaaactggctgtgttcccagcaagagatactgcaccctcctgaccgagcagtcaggcttccctttcctagccatcctaagttgcgttctaggaaactctggatctcagcctcatctccagctttgcctggaccttgctagggggagggagggacaggagcacagaggaggagaggagagggatgtgatgtctttcttaggaaagaaaaaaaggcacagtgatgagctataaaggtagtgatgagagctataaaggtagtgatgaaagcaaggaataattttcattcaccccaaatcctacggcaagctttgacaatgtaacatctttatcttgtggttaggaaaatggacctagagagattatgtggtttgctcaaaatcacatagctactaagtgcagtagtgctttctataagaccaacttgcctttccacttggttggaaaatttaaaaaccaaacctgtcgtaatctatctgttctgcccctcccgcctgtatcatgagatgactgaaaattccaggtggccataaactcaaacaagagcctagcccttggcttattaccggtggctactacaaacctacagaccagagcccagggtagtatagagtcccaactctgggccctgactgcaggtcattcaggtcccagtcacagtgaaagcagactcattcagctatctggagaagtgtaatctgagggccacttggcatcctgagttaacacagggatgccgcagctggggtaaggaattagagaagggaaggccagtgttactgcagtaagagaaaaccaggaagtccatctaggagatgaaatttgtgcttgcataacagagccatggaaatggctatcccagcatctcccctcactgcagactccattgtaagcaaagcatggacctttttctttgaaaccaaccctgtcacttgttaaatttagaattacctctaaatgctaagtttatttaagaggtaaatgtcctgctattttcagaatggagaaaaaaaaaaaaaaaaaaaccttctgcttctagaattttgtgccctacttgtcactgaaggaggcaggctccgaaagttctcttatagcttctgattatcacagtcctggcttccaacacctgtgttcgccatagatctggacattatgtgcttcctctgaactagtgtcttgatttttaaggcacattcactagagtatgttcaatttcaaccaaaagcatacgtgcaacataccagttt

SEQ ID NO: 278732 - DNA, 4399 bp, Homo sapiens
ctaacatctctagttcccagctatgcagttggaggatcaattcctagaataattatctgctgcaattgcactttctattccagtacccagacagaccatagtgatgtttacgtccattgcctaggagtatttaccactaaatggttggattgtctgatatttctaagcagagcacagactgtgacttctgaccaagagaaacggttgctacatcagctccgagaaatcaccagggtcatgaaagaaggaaaattcattgacagattttctccagagaaagaagctgaggaggccccttacatggaggactgggaaggttaccctgaagagacttacccaatttatgacctttcagactgtatcaagcgtaggcaagaaacaatcttggtggattaccctgacccaaaagaactttctgctgaagaaatagctgaaagaatgggaatgatagaagaggaagaatcagatcatttgggttgggaaagtctgcccactgaccccagagcccaggaagataattctgttacctcgtgtgatccaaagccagaaacatgttcctgctgttttcatgaagacgaggatcctgctgtcttggcagagaatgctggattcagtgcagatagctaccctgagcaagaggaaaccaccaaagaagagtggtcccaagactttaaagatgaagggttgggcatcagcaccgataaagcatatacaggcagcatgctgaggaagcgtaacccccagggtttagagtgaaaacagccagtctgaagtatccattactcaagtcccaaggtgacctctctctcctcagatttccttcttggccctgtgccctgcactttcttcactgtgttcaagtgtcatagctatcaggccactatcatggatatcatgtatccttcctggtgctcacacacctgtcaccttgtaaaacacggacattagtgtgaacacaggacagcttcgctctttctcttcctgccctagctcttggttggtttatatataaggaatatatttgtgtatttatatatcagacatttggatgtacctttcagttatttaggatttagaaaattctttttggattttccagaattattttatccttcggggatgacagttatatgtgtatatacaacccaggatgacaaaatcatgggtccggtttttgttgccagggctgctgtctcttttcttgcggtcttcatttctcacgagggtgctgggaacttgatcagtcccctggccttttggcactgtggcagagtacacaagtcatacctttatggacagttagctcacaaaacaactgcataatctgggatcactcttggtaaatcaggtgggtggtgcagccaggagatcccctttcctggtcacaacaggagcacaaagaaaccattatctccatgactagctccagaagctgggcccagggagtcgtgatgaggagtggaggtgtatttggcctgtagaatcaacggcctttgagaaccatacaatgcaccttatatggcttgggtgatcaaataacttaaggtccaaattcaaacactttggaaaaagggagctttaatataattatgccaaggtgataggcataaactaagactgtcctggacgtagggtcacccctgtctatagccatttaagatttttgaacctgatgactaaacaaacaaaaccctctttcctttttagaatatcctgtatgcgctatttcccaccagaggcagaggccacaggagataggccatggttcaggtaggaaatgctcttggtcacatcagaactctagatctgggggaataaacaaacccgaattattaccacactctcaaagttctcttcaatctggactatttgtattccaaagaaaaatttagtgctttagctattcagcaatattgagaaaaaacatgaacacatttatgactttgccttgaccattgacttttctaaaatgtgcttccttttcctttatttccctttttttatacaaagaaaatagcccaaatttctcctcttaggtcattccttaacctctcagagaaccagtttccccatgaattgggaataatgctctatttacagggctgtttggattaaataagatgctgtttataaagtgtctgtgccagggcaaagcatgtggtaggtgcttggtgacagcatgatccctgtcaccactctgtcaagtccagtgttgctgagatgtcacacctgacaccctctaaggctaccctgattgccaggagtggcccagggcccttctgcagtctccgggtgcctttagttataacctcttgtctgggtcagaccattagctttcatgtctgcttctagctacaactgtagcctcccttccttttgccttcaaatctgccacagctgcccggcaacaaaaaagattcctaagcatctcgaggtcctgtttaaatgggttagggtccaagcaagccctgagacatcaagtggttgggtcttttatacctttttcatctctacagccctgttctcttcctaaggccaggcccacaggggatactgaggaaccaccagccccttcaggcggcacagcagaccctgaagagaactgctctaacttaagtaccttctgacttcaccatttttccagcctctgggtgtggttctgatgaaccttaaacttgaaaggcacaggccagaggaaggacagtgttgacccacatgtcattggtgaggttatgatctctttgctattatcacctacttacccacctgaggctcctaggaaacaatgaatgaaaggtatagaaaaaaattaggaagtaaacagggcttttttcccctttatgaaaaaagtacacagaagtgttgaaacgattcaagtttaatttgttgatatatgtgtgtacttagacaaacactaaattctacaacatacataatgtcaacatgggaaaataccaagtttgtcattgcacataccaataaataaatacatttgctccagaataccaaagtttattcaaaaagtcaataaaagcacagttttgcaaatttgtctaaaacgccagataatcttgaacaaaaataaaatgtctgaccactccaaaataggaaaagacaatcttgtgcaaatagacatacacagtctaggcattgtggaaactggctgtgttcccagcaagagatactgcaccctcctgaccgagcagtcaggcttccctttcctagccatcctaagttgcgttctaggaaactctggatctcagcctcatctccagctttgcctggaccttgctagggggagggagggacaggagcacagaggaggagaggagagggatgtgatgtctttcttaggaaagaaaaaaaggcacagtgatgagctataaaggtagtgatgagagctataaaggtagtgatgaaagcaaggaataattttcattcaccccaaatcctacggcaagctttgacaatgtaacatctttatcttgtggttaggaaaatggacctagagagattatgtggtttgctcaaaatcacatagctactaagtgcagtagtgctttctataagaccaacttgcctttccacttggttggaaaatttaaaaaccaaacctgtcgtaatctatctgttctgcccctcccgcctgtatcatgagatgactgaaaattccaggtggccataaactcaaacaagagcctagcccttggcttattaccggtggctactacaaacctacagaccagagcccagggtagtatagagtcccaactctgggccctgactgcaggtcattcaggtcccagtcacagtgaaagcagactcattcagctatctggagaagtgtaatctgagggccacttggcatcctgagttaacacagggatgccgcagctggggtaaggaattagagaagggaaggccagtgttactgcagtaagagaaaaccaggaagtccatctaggagatgaaatttgtgcttgcataacagagccatggaaatggctatcccagcatctcccctcactgcagactccattgtaagcaaagcatggacctttttctttgaaaccaaccctgtcacttgttaaatttagaattacctctaaatgctaagtttatttaagaggtaaatgtcctgctattttcagaatggagaaaaaaaaaaaaaaaaaaaccttctgcttctagaattttgtgccctacttgtcactgaaggaggcaggctccgaaagttctcttatagcttctgattatcacagtcctggcttccaacacctgtgttcgccatagatctggacattatgtgcttcctctgaactagtgtcttgatttttaaggcacattcactagagtatgttcaatttcaaccaaaagcatacgtgcaacataccagttt

SEQ ID NO: 278733 - DNA, 3379 bp, Homo sapiens
gtttttagttagtatgaacgggaaggcgagggtaccatttacagcgacgggtaaccacgcgggaggagcaggtcaactcccgacagtggaggtgaagatgcgtgcgcctccgttgtctccctcgcgcgacgcgtccgccgcccgcggttcggtcgggagcggcagcccgtgctccggttccgttccggttccggctggcgtctgcacctgcgaccaccgtgagcagtcatggcgtactccacagtgcagagagtcgctctggcttctgggcttgtcctggctctgtcgctgctgctgcccaaggccttcctgtcccgcgggaagcggcaggagccgccgccgacacctgaaggaaaattgggccgatttccacctatgatgcatcatcaccaggcaccctcagatggccagactcctggggctcgtttccagaggtctcaccttgccgaggcatttgcaaaggccaaaggatcaggtggaggtgctggaggaggaggtagtggaagaggtctgatggggcagattattccaatctacggttttgggatttttttatatatactgtacattctatttaagctctcaaaggggaaaacaactgcagaggatgggaaatgctatactgccatgcctggaaacacccacaggaaaattaccagttttgagcttgctcaactgcaagaaaaactgaaggagacagaagcagccatggaaaaattaatcaacagagtgggacctaatggtgagagagcacagactgtgacttctgaccaagagaaacggttgctacatcagctccgagaaatcaccagggtcatgaaagaaggaaaattcattgacagattttctccagagaaagaagctgaggaggccccttacatggaggactgggaaggttaccctgaagagacttacccaatttatgacctttcagactgtatcaagcgtaggcaagaaacaatcttggtggattaccctgacccaaaagaactttctgctgaagaaatagctgaaagaatgggaatgatagaagaggaagaatcagatcatttgggttgggaaagtctgcccactgaccccagagcccaggaagataattctgttacctcgtgtgatccaaagccagaaacatgttcctgctgttttcatgaagacgaggatcctgctgtcttggcagagaatgctggattcagtgcagatagctaccctgagcaagaggaaaccaccaaagaagagtggtcccaagactttaaagatgaagggttgggcatcagcaccgataaagcatatacaggcagcatgctgaggaagcgtaacccccagggtttagagtgaaaacagccagtctgaagtatccattactcaagtcccaaggtgacctctctctcctcagatttccttcttggccctgtgccctgcactttcttcactgtgttcaagtgtcatagctatcaggccactatcatggatatcatgtatccttcctggtgctcacacacctgtcaccttgtaaaacacggacattagtgtgaacacaggacagcttcgctctttctcttcctgcctttcctctatcagagaagttgatccattaagtaattatgtttggtctattgtaattacagatgggaccactcaggggcaaaggtctgactcttcctggtaggtgtaacagatagttcacctgtgaacgaacatcagcttacagatgatgaggacttaaggttgcaagaatgaagatttcagactccaagatcccttattctttgggccttgagcaggttagtagtcccctggtgagaagagaacattttgtttgtggggctaatgggcccagaggagggtaagactctgctgtctaagctgaagcctcttcctcgcagcgagggtcttcctaggaacattgatgctgcctcagacatcctcttttctccagagtagggaagactcccactgatctgagaatgagcccagacgcttgtttggggactgttttactctgatactacctggatatctagcttcctttacccctgttctgcttaacagaactgccaagcccagaagtacctttgcactcctggttttcagtggacagaggaagctttagatagagactttagaccctgccctgcagagtcaagacttgaggccattgaagctgcaggaagccctgcccagggatggtcctgccatgaggaggctgcaaccctataagagggctcaagattgtgaattctgctcctgccatgaggagctcagaaggccaggaagccagcaataggggagagaatctgtgtgcttatggacagtccttacctaaagctgtttctgaatgttgcaccctttgagaaatttcttctcagaaccataaattgaaacaaatgaggactgatcttgtatacaaagtgccaactcaagagggaagttggagtatgtctgttgcagagaaccaatatagcagtgcccaggggtagagaccatgtgttccatactcggatatttgggtctttttgagagagctggggaaagtagcagcaactagattaagactgggaggattttgaccaaactaaaggccttttctccttactgcatctgacgtgtgtcttcttgagacaagatagcacccatgaattacatcatgaggtatgtgtgaattcagtttacatgtaagacctgagagttcgaagagggcacattcccaaagacattcccagtcatgaaatgtagaagactggaaaattaagacattatgtaaaggtagatatggcttttagagttacattatgcttggcatgaataaggtgccaggaaaacagtttaaaattatacatcagcatacagactgctgttagaaggtatgggatcatattaagataatctgtcagctactactaggcatttattgttaattgagttacagaaagtcattcaagactgagtttatagaaagcatattgcatctatctctgtgtagaacatttgattcacattgtgaagaatgcagtttaaaatatactgaatgcaatctagatgtattgtacacgaaaggtgaaaaataacaggtgctctttactgtttagataaattgttttctgtgttatttcccttcgttcactgtgaggggttgattcatgaggagagccctgggttcctggctcaggtttacttttggccttaggataggattcccttattagagataaatactgctgttctcttctagctcattcattcatttagcagtcaattgctcagtgccaggtgctaggaacagaggctcaatctctaccctcagaaaactcagtgtgacgagagagagcctgacagataaaatgaactatgaccctgtaagagggctcaggatcgtgaatcc

SEQ ID NO: 278734 - DNA, 578 bp, Homo sapiens
gcctggtttttcctaggttataattgtagaacaaagattattataatattggaataaagagttatgctataaactaatgattagtaatatatataatcatagctataatctatttctagtataactattcttattctatgtattttctttattatactggaacagcttgtgccctcggtctcttgccttggcagctgggtggcttgcctcccacatggcactgctgggcattgtctgttaatattgaataattgttttaagattattttcaataaggctttaccttttttaacttgcactgtggccatgagctctgccggaagtgacttgttggtgttatctcctcagttataaagtgaagggatttttctttttcagattactgagagtcttccgttactagggcagaggactgctgtttgctgacacaatcttggtgcgttggaagtgaaagggaagaggcactggtggctgtgctttgggcccgagcagccagaagccagttgccatcacctatgacgaggagacagcgcctggggcagagcccagtatggggtgcgttcagggtagatcaggag

SEQ ID NO: 278735 - DNA, 537 bp, Homo sapiens
gcctggtttttcctaggttataattgtagaacaaagattattataatattggaataaagagttatgctataaactaatgattagtaatatatataatcatagctataatctatttctagtataactattcttattctatgtattttctttattatactggaacagcttgtgccctcggtctcttgccttggcagctgggtggcttgcctcccacatggcactgctgggcattgtctgttaatattgaataattgttttaagattattttcaataaggctttaccttttttaacttgcactgtggccatgagctctgccggaagtgacttgttggtgttatctcctcagttataaagtgaagggatttttctttttcagattactgagagtcttccgttactaggtaagtcgccccatccttataactccaggtgacactgactggggtttatgggatgaaagaggagtgtgtgcttggatgatggggtgtgatagtgaaggggtgaaaggtttcttctcacacatagacatcgtgag

SEQ ID NO: 278736 - DNA, 1905 bp, Homo sapiens
gggatttggatggcagagagaaacaggcactgaagatttttggtcaggacagggcagagaaataagaagagttgaaaattcaccaaaggatagataaacccagggcgtttagagaaaacctgtagtgtgcaaaggagcccagaatcctggggcaacttggagggaaatatacttaatttgattcactaagttaggcccagtgaagggattgggtggcataggtagaagccgaaaaataaagtatcttgtattgctggagtagcctctgtttctgaggtcacatccaaacttagcgaggcagcttaacctggtgagagacatgggttcaactcctggcttctgcactgctagggcagaggactgctgtttgctgacacaatcttggtgcgttggaagtgaaagggaagaggcactggtggctgtgctttgggcccgagcagccagaagccagttgccatcacctatgacgaggagacagcgcctggggcagagcccagtatggggcctagccagggctgggttctcacccacctgtgccgccctgccttgttacctggaagcacagccttggggactgagcaggccctcactgtcactttaagaagggaatcagccactttgtgctcaccacctctggggaaggtgtgagaggagagaaggaagtggctgtttggctgctgacaacatgaagacttcctgcgatgagaacagaggcacaggtgccggccctgcagcccccagaacctggactggagggggccatggggcaccggaccctggtcctgccctgggtgctgctgaccttgtgtgtcactgcggggaccccggaggtgtgggttcaagttcggatggaggccaccgagctctcgtccttcaccatccgttgtgggttcctggggtctggctccatctccctggtgactgtgagctgggggggccccgacggtgctggggggaccacgctggctgtgttgcacccagaacgtggcatccggcaatgggcccctgctcgccaggcccgctgggaaacccagagcagcatctctctcatcctggaaggctctggggccagcagcccctgcgccaacaccaccttctgctgcaagtttgcgtccttccctgagggctcctgggaggcctgtgggagcctcccgcccagctcagacccagggctctctgccccgccgactcctgcccccattctgcgggcagacctggccgggatcttgggggtctcaggagtcctcctctttggctgtgtctacctccttcatctgctgcgccgacataagcaccgccctgcccctaggctccagccgtcccgcaccagcccccaggcaccgagagcacgagcatgggcaccaagccaggcctcccaggctgctcttcacgtcccttatgccactatcaacaccagctgccgcccagctactttggacacagctcacccccatggggggccgtcctggtgggcgtcactccccacccacgctgcacaccggccccagggccctgccgcctgggcctccacacccatccctgcacgtggcagctttgtctctgttgagaatggactctacgctcaggcaggggagaggcctcctcacactggtcccggcctcactcttttccctgaccctcgggggcccagggccatggaaggacccttaggagttcgatgagagagaccatgaggccactgggctttccccctcccaggcctcctgggtgtcatccccttactttaattcttgggcctccaataagtgtcccataggtgtctggccaggcccacctgctgcggatgtggtctgtgtgcgtgtgtgggcacaggtgtgagtgtgtgagtgacagttaccccatttcagtcatttcctgctgcaactaagtcagcaacacagtttc

SEQ ID NO: 278737 - DNA, 1245 bp, Homo sapiens
agggggtggaatagaacttaggctaggtacgaggctgggtggtctagagagaggcacaggtgccggccctgcagcccccagaacctggactggagggggccatggggcaccggaccctggtcctgccctgggtgctgctgaccttgtgtgtcactgcggggaccccggaggtgtgggttcaagttcggatggaggccaccgagctctcgtccttcaccatccgttgtgggttcctggggtctggctccatctccctggtgactgtgagctgggggggccccgacggtgctggggggaccacgctggctgtgttgcacccagaacgtggcatccggcaatgggcccctgctcgccaggcccgctgggaaacccagagcagcatctctctcatcctggaaggctctggggccagcagcccctgcgccaacaccaccttctgctgcaagtttgcgtccttccctgagggctcctgggaggcctgtgggagcctcccgcccagctcagacccagggctctctgccccgccgactcctgcccccattctgcgggcagacctggccgggatcttgggggtctcaggagtcctcctctttggctgtgtctacctccttcatctgctgcgccgacataagcaccgccctgcccctaggctccagccgtcccgcaccagcccccaggcaccgagagcacgagcatgggcaccaagccaggcctcccaggctgctcttcacgtcccttatgccactatcaacaccagctgccgcccagctactttggacacagctcacccccatggggggccgtcctggtgggcgtcactccccacccacgctgcacaccggccccagggccctgccgcctgggcctccacacccatccctgcacgtggcagctttgtctctgttgagaatggactctacgctcaggcaggggagaggcctcctcacactggtcccggcctcactcttttccctgaccctcgggggcccagggccatggaaggacccttaggagttcgatgagagagaccatgaggccactgggctttccccctcccaggcctcctgggtgtcatccccttactttaattcttgggcctccaataagtgtcccataggtgtctggccaggcccacctgctgcggatgtggtctgtgtgcgtgtgtgggcacaggtgtgagtgtgtgagtgacagttaccccatttcagtcatttcctgctgcaactaagtcagcaacacagtttc

SEQ ID NO: 278738 - DNA, 777 bp, Homo sapiens
ccaggggcccagcagcagcacaagccagcttcctcccctccggcctcagtcctcttacctctccaggctcgtccaagatcgacatccatcccttcttgaagttgagcagatcgggctgtggggagatgaggagggagagatggggtctccctatgtttcccaggttggtttcaaactcctgagctcaagtgatccgctcacctcggcctccaaaaatgctgggattataggtgtgagccaatgtgcccggccaaccaatgtgtgggcgtgcacccgttgctcaggttcccagaacgctgggccgtttgttagatgctcttttcctgcagataaagaaatggaggcccagggagctgaagttctttcccagcatttgctgccaggagtctctccaccatgaggaatgaggccaaggttaagtccatctaactctagaaactggccttctggcaccccgggctgagttttctcaccctacccttgcacctcactcaggcagtcagtccttgggagagtgaatgaacacgcaggagacctcacctaccaccagggtcctggtccagtgccctgggcacctaacagcaccagcctcctccaggcttttctggcccctgcgactcctcctagtacccgcaacacagtgaccagaccacttccctgctcaaagttcttccacacatcaccaatgctgacagatcagtgctacattcctcttctaggcagtcaggaaccatcacaacctggctcctgcctgtcatcctggccttccagattctc

SEQ ID NO: 278739 - DNA, 949 bp, Homo sapiens
attaatcgagccggtacccggcgccggggagcgaagttctttcccatgcatttgtgcaggagtctctccaccatgaggaatgaggccaaggttaagtccatctaactctagaaactggccttctggctccccgggaggctcggcgccgtgatttggcggggaccggggcaaagcacccagtactaacgactcagcgggtcccactcgccaagagtcgattttcgtcctcaccacagacttgggagggaggtcttattttgctaatgagaaaacggaggctcagaggggtgagccgatttgcccgaggtcacacaggaagaggcggaattcctagcgagtaagctggacacaaagtgagttcttggatggcagggtctctcccaaatgcccactcctcacaaatgggtcttttttggtttggggtttttcaggtgtgggcgtgcacccgttgctcaggttcccagaacgctgggccgtttgttagatgctcttttcctgcagataaagaaatggaggcccagggagctgaagttctttcccagcatttgctgccaggagtctctccaccatgaggaatgaggccaaggttaagtccatctaactctagaaactggccttctggcaccccgggctgagttttctcaccctacccttgcacctcactcaggcagtcagtccttgggagagtgaatgaacacgcaggagacctcacctaccaccagggtcctggtccagtgccctgggcacctaacagcaccagcctcctccaggcttttctggcccctgcgactcctcctagtacccgcaacacagtgaccagaccacttccctgctcaaagttcttccacacatcaccaatgctgacagatcagtgctacattcctcttctaggcagtcaggaaccatcacaacctggctcctgcctgtcatcctggccttccagattctc

SEQ ID NO: 278740 - DNA, 417 bp, Homo sapiens
ccaggggcccagcagcagcacaagccagcttcctcccctccggcctcagtcctcttacctctccaggctcgtccaagatcgacatccatcccttcttgaagttgagcagatcgggctgtggggagatgaggagggagagatggggtctccctatgtttcccaggttggtttcaaactcctgagctcaagtgatccgctcacctcggcctccaaaaatgctgggattataggtgtgagccaatgtgcccggccaaccaatgtgagtttttaaactggcagggaaacctgtccccagggtcaaaaggtccgatcatctaaatctcccacgatgccccttcatacagggctcttcaggcccagctacctcttcttcacctgctagaagctcagtttctccttccgcctttcgggagtact

SEQ ID NO: 278741 - DNA, 479 bp, Homo sapiens
ccaggggcccagcagcagcacaagccagcttcctcccctccggcctcagtcctcttacctctccaggctcgtccaagatcgacatccatcccttcttgaagttgagcagatcgggctgtggggagatgaggagggagagatggggtctccctatgtttcccaggttggtttcaaactcctgagctcaagtgatccgctcacctcggcctccaaaaatgctgggattataggtgtgagccaatgtgcccggccaaccaattccatctccacctgacaaggccctataatcacaggaggacacctccctcaggaaggctgctgccaccagcagggatgtgctgtccatcttccaagcaccccacacgctgcttccggcagccttacccttgctcagcacgtgctgcccccaggacaggcaactgtgaaagaaagctggaacggacctggatacaaattctggcttagcctgggactcactg

SEQ ID NO: 278742 - DNA, 1341 bp, Homo sapiens
ggcacgaggggtcgacccctccgggatgggggccagggcagcctccgcggctatcccgggagtcctgctccgacaccacctccacaggggaagccgctcggagagacgcagggacccaggcaagggatgcgggcaaacgcgccaagggttcggcagaggggcgtgaccgccagttggccgggctgagcgaggcgccagagggaagcctgcaaggtacgtctgcgagagccgggtgcgggcgcggcaggggaaaaggggggcgctggctctcttaccgccaggtccggattgcggctgtccctgtgtgacacggctcggatgacccccgctcgccagcttcgccagccgcgtccgctctcccagcgctccgaacgtgcctcgtcgccgaccgccacacacaggaaccgcttacccaccagctctgcccgcgtctctaccgccatagctgtcgctgccgaagcggccgctgcctcctccagtgcgagggaaccgatgaaacctcactcttaccggccgctcatgctgaggagagcggaccgggacacagcagcggacccgaaagagcgcagactcgggacgaaccggccgctctgccccggacacagcgacctcgggccctccccgcaaacactcctttggactcccagattcgcagccttgtgctgcagcgccacacaagaaaactgaaacaaaacccaacgcggccgtcgaagaccccgaggcagcccagccgccgccaccgcgccgcggccagtactgctccgtctccctccccgggcagcggcggcgcgcagcgcgtctccttccgccggcgcgggcggggcagcagccgcgggagggtcggcggaaccaccgcagacggaaagtagtgcccggccctgcggaggcggcagcggccactgggtccgtccagatccagaggcggcggcggcggcggcagcgggagacgaaaaaatgaagagggccgcgggaaagtaggcgacagctattcaaagcttttgggggtctacctttgtattcgttgctccctcagaggtggaggtgaggggaaagtgaagtgtagtggttccactctgatcacaaaataaactcctgggttgacgcctcacccgcggtttgatgttcagagcacacagcgcccgccgcctgagttagcctgaattagcagtcccgcagtaacagcagcagagcaggacaacacttctactgaaaactaagccccaaagtcacagcagaaccaaccgttcatgacttcaagggaaaacgagggggaaaatgtgatcctttcattcttctcatttgtggtgatactaattacatgtttaagctattcacagattt

SEQ ID NO: 278743 - DNA, 1227 bp, Homo sapiens
ggcacgagggaaagcgcctcttccccgtccctctcctacctccgccaggcaggaagagagctttctccttagagccgtgacttaggggtgcccagccccaggcaccttgagccccatcctcctgcgatgccccctcggagtgtggctcttcgggctccatcttaatgtgcagtgactcctgagcgtcccctgaaggtaccgcctcccccagcttagaaggcatttcctgatgaggatgtccacgatctggaacctagaaaggacagccccatcagcacccagatgagtgggagagacacccagggccacatggcagtgcgctccggcagcgtcggaaaccaacatgcaagacgcagcttgaaggactgtccttgctgcattcatccagctcaccccagcaaggacgggcggcaagaggaggaatattcaccaagccgcctccacagtgccggtgggcgtggtgcccaagggcagctaccccttctcagctccagcctcacactgacctcagcagtgtagactgctgtctattagtgtatgaagaaaccaagtgtagtggcttgaatagtgtcctctaagaatccgtgtcctccctggacctcagaatgggaccttattggggaaaagggtctttatacagaataggagaggacacagagacacagagaaggaagcagagactggagggatgcccacaccaaggacaccaggagcccccaaggagttggaagagacggagtttcgctcttcttcccatgctggagtgcaatggcgcaatctcggctcaccccaacctccgcctcctgggttcaggcgattctcctgcctcagcctcctgattacctgggattacaggcatgtgccaccacacctggctagttttgtgtttttagtagagatggggtttctccatgtcggtcaggctggtctggaactcctgacctcaggtgatccgcccacctcagcctcctaaaatgctgggattacaggcgtgagccaccgcgcccagcctataaaattgattctttaaaaaaaattagaacatttaccgatgctggacccaccttccccaccttcagggtccactttctaggtggccacagtgcctgcttggcccctgtagcatttgagtttgcaactctgcttttggagttaaacatgttttaggagtcctgggattctgattgatgctattgtcaatttgatgaaagaaaaattactcctggg

SEQ ID NO: 278744 - DNA, 867 bp, Homo sapiens
ggcagtgggggccccctcccccgggaagggagtctccacagcctgcacggggcgggcgggggagttgggtggagactgggagtagggaagacaggaagtccctcccagatcccattccccatgcagccgcagccctacagcgttcccggttttgagggttccgggtgtggagtctcgagcctgggttgcacctgctcttggccgggaggtgactcccagagccgcaatgccagctcatgaggatggctttacccaggacgcgttcatgatgccagcaaggcagagccaccaaaacagaaaaatggaagatgcattttgtggaaagattgtgttatttgaaatttcaaagcgagcactgcagttgtcctcacagacggagtttcgctcttcttcccatgctggagtgcaatggcgcaatctcggctcaccccaacctccgcctcctgggttcaggcgattctcctgcctcagcctcctgattacctgggattacaggcatgtgccaccacacctggctagttttgtgtttttagtagagatggggtttctccatgtcggtcaggctggtctggaactcctgacctcaggtgatccgcccacctcagcctcctaaaatgctgggattacaggcgtgagccaccgcgcccagcctataaaattgattctttaaaaaaaattagaacatttaccgatgctggacccaccttccccaccttcagggtccactttctaggtggccacagtgcctgcttggcccctgtagcatttgagtttgcaactctgcttttggagttaaacatgttttaggagtcctgggattctgattgatgctattgtcaatttgatgaaagaaaaattactcctggg

SEQ ID NO: 278745 - DNA, 1195 bp, Homo sapiens
cacctgacccggggcacccagacatggactgccttgaaggctgtctcttttctctctgcctgaccctgagtgtcaaggagcagtactccaagcccaggctttaagcccaggacctctttcccctccctgccccccttaccttccacctactcacctgtgcagccccgggaggagggaatggggtgggagcccaggggctccgctgcctcaccaggtatccatcagttctgccaggtctggctttggccaagacccaaacacaccacagggatggcacaggatgttggggcagggagatgagcaggtggggctcaggaagaggagaggcaaaggaataagaaaggaaaaggaggaaaaagagaaaaaggcaagatggggcaggggcaagggagagatggggaggtataggagacagacagaaaaaggaaagagaaagcaaagaaaaagagaaagaactacaaggcaaaaaagcatctagaaaaatgagggagaaaagggagaaagacaccctgacacagccctttctttcagctgccccatccctgtggtccaaggtagaaatgagaaacaaatccttgctgtggtgagtgggcacttgctgttggccaggtctctgtctgctacctgggtcccgatctgaactgggcgtgggaagcaaagcagccatgggggcaggagacctccctcagaaggtgtgagggttcaggcccctgtaggattgtgggggtgagggtccatgccccacctctgttgcccccaagttctctcctgatggcccctctgcgactgtgcctgtcttaggttgttccttccctgaggaatcttacccgtctctggctaaccagccatccaccggggccaaacagggtgacgtgcagtgtgtgagtgagggagaggcagcgcccccgagggggtcagttctctgtctccttggtagcctatgcccccgtggcctccacgcccagcacctgccttgggattccctcgcctgctggcggggccccagctctggtcacatcttggggaacccaggtttcttcttcagggagagcccagctcatagcactgggcaagagagacagattgcatgccaccagcccctaggaggcctcaacctcagcatggacagcaacagcctgggcaagtggatcctgagaaaagggtccctcttggcgcaagggcaagaggggccatc

SEQ ID NO: 278746 - DNA, 911 bp, Homo sapiens
tcactctttatattaaaaagtgcagaacacgaaatacaacatcactctttatattaaaaagtaaggaggaaaaagagaaaaaggcaagatggggcaggggcaagggagagatggggaggtataggagacagacagaaaaaggaaagagaaagcaaagaaaaagagaaagaactacaaggcaaaaaagcatctagaaaaatgagggagaaaagggagaaagacaccctgacacagccctttctttcagctgccccatccctgtggtccaaggtagaaatgagaaacaaatccttgctgtggtgagtgggcacttgctgttggccaggtctctgtctgctacctgggtcccgatctgaactgggcgtgggaagcaaagcagccatgggggcaggagacctccctcagaaggtgtgagggttcaggcccctgtaggattgtgggggtgagggtccatgccccacctctgttgcccccaagttctctcctgatggcccctctgcgactgtgcctgtcttaggttgttccttccctgaggaatcttacccgtctctggctaaccagccatccaccggggccaaacagggtgacgtgcagtgtgtgagtgagggagaggcagcgcccccgagggggtcagttctctgtctccttggtagcctatgcccccgtggcctccacgcccagcacctgccttgggattccctcgcctgctggcggggccccagctctggtcacatcttggggaacccaggtttcttcttcagggagagcccagctcatagcactgggcaagagagacagattgcatgccaccagcccctaggaggcctcaacctcagcatggacagcaacagcctgggcaagtggatcctgagaaaagggtccctcttggcgcaagggcaagaggggccatc

SEQ ID NO: 278747 - DNA, 876 bp, Homo sapiens
acgaacttcgagactcggtacacaaggcgtctggaaaaagagaaaaaggcaagatggggcaggggcaagggagagatggggaggtataggagacagacagaaaaaggaaagagaaagcaaagaaaaagagaaagaactacaaggcaaaaaagcatctagaaaaatgagggagaaaagggagaaagacaccctgacacagccctttctttcagctgccccatccctgtggtccaaggtagaaatgagaaacaaatccttgctgtggtgagtgggcacttgctgttggccaggtctctgtctgctacctgggtcccgatctgaactgggcgtgggaagcaaagcagccatgggggcaggagacctccctcagaaggtgtgagggttcaggcccctgtaggattgtgggggtgagggtccatgccccacctctgttgcccccaagttctctcctgatggcccctctgcgactgtgcctgtcttaggttgttccttccctgaggaatcttacccgtctctggctaaccagccatccaccggggccaaacagggtgacgtgcagtgtgtgagtgagggagaggcagcgcccccgagggggtcagttctctgtctccttggtagcctatgcccccgtggcctccacgcccagcacctgccttgggattccctcgcctgctggcggggccccagctctggtcacatcttggggaacccaggtttcttcttcagggagagcccagctcatagcactgggcaagagagacagattgcatgccaccagcccctaggaggcctcaacctcagcatggacagcaacagcctgggcaagtggatcctgagaaaagggtccctcttggcgcaagggcaagaggggccatc

SEQ ID NO: 278748 - DNA, 2848 bp, Homo sapiens
ccaaacacttcccactaagccctacctctgaacactgcagcaatgagggattaaggttccaacacgtgaacttttgagggacacacttaaatcataacaggtagttatttcctgaggattaaagcagtttcacagacagatgaagaagaactttttcttctattacttagtaatcgaccaggagacctattctttgaaagagaatattctttggttccagtacacatggtgggggcgggaatccatgaactaaaatgggctaatgacagtgatggcagacctaagattctttttccctccaaagccatccccaaatcccttaagacctatacttccaagcctcacctgtctgtgtctctttgcagtggcagtgaccctggacccagacacagcacatcccaaactcatcctttctgaggaccaaagatgtgtaaggcttggagacagacggcagcctgtacctgacaacccccagagatttgatttcgttgtcagcatcctaggctctgagtacttcacgactggctgccactactgggaggtgtatgtgggagacaagaccaaatggattcttggagtatgtagtgagtcagtgagcaggaaggggaaggttactgcctcacctgccaatggacactggcttctgcgacagagtcgtgggaatgagtatgaagctctcacatccccgcagacctccttccgccttaaagagcctccacggtgtgtggggattttcctggactatgaagcaggagtcatctctttctacaatgtgaccaacaagtcccacatctttactttcacccacaatttctctggcccccttcgccctttctttgaaccttgccttcatgatggaggaaaaaacacagcacctctagtcatttgttcagaactacacaaatcagaggaatcaattgtccccaggccagaagggaaaggccatgctaatggagatgtgtccctcaaggtgaactcttctttactacccccgaaggccccagagctgaaggatataatcctgtccttgccccctgaccttggcccagcccttcaggagctcaaggctccttctttttagggatatgccacattacctgctcccatcaccatccagcccagcaccctggacttcagtcgcctggcccaaccccatgattatggaacgtctcttcaccttaacccaaatccagacccttttgtggtttctatttgtaccacttttctcccaggcctcagttctgaagcttacctttcttctaaggaattgaagctcccagtgacctggagggaggattcctggaaaccaaacaatcagtttaggtgcaggtggagatgttgaatatgtgttaccaagatacagcacaggttcagggaaaagagttcgctactccaggggttatttagaagacactttctctgcctcatcctgccctcaagctttagtcaagaagttatggcccccagtccctgacttcttacttatcccattgaggactgcctttctctctctcagttctggcctctgccccccaaagtcagctctctaaaagcaagcatgttttagaccactcactctttccctctttcttcaggaatgaattgggaaaggctgatgagtaaaacataccatccttttctattttcttgatgctgtttacaacatagtttggtgatatccagagctaatgtacatgctttcaaaagctaatctgcctgttgatgataactaggtacagcgactttaaatacagttgctataatcctgaaaagccccaggagcacatcagggagctgggaaacacagttgcagagaactcagctgtatgttgccctctgaccttggcccagaccttcagaggctcagtctgttgagtctgttgtgactgtcttatgaatcaatctgttgtgccaaccctttctgagattcagagaggtccagctagaaaaagtggcagttttaaccaccaacgtagaagcttttttttccccacaagaccattgtactgcaatacttgactatttgtgtagcaaacagcctcttaggttggagagtattgatttcaaataggaagttggtagactaggtgtgaggatgaaataatgaccttgatttttgggtgtgtattgcagaagcctcgtcgctttcaagtcacatcatatatgcgatctggcctaaccatggagatattggttatcagtttgcagatgaatacacagttctatccaacagaaactgtatctttctgtttgtcagaagttctccgttagttcctgtattagtcaaggttttccagagaaacagaatcaatatatattggggcaggggggcggtggttattataaggaattggctcacgtgattatggaggcggttaaatcccaagatctgcaggataagtcagcaagatggagtcccatgagagctgatggtttagttccagtctgatggcagcaggcttgacgccaaggaagagatgatgtttaattcaagtccgaaggcaaggaaaaagctgatggtcctgtccaaaggctattaggcaggaagaattctcttagggcagagttagctcttttgttctattcaggccttcaactgattcagcaaggcccgcccacatttgggaggacagtctgcattactcagtctactgatttgaatgttaatgtcattgagaaacaccctcacaggaacactcagaataatgtttgaccaaatagctgggcatcttgtgacccagttaagtggatacataagattaactatcacagtgactcagtggaattttttgtttgcttttgtacagttttaaaataaaagtttggtatttgtgttttgaaaaaaaat

SEQ ID NO: 278749 - DNA, 2851 bp, Homo sapiens
ccaaacacttcccactaagccctacctctgaacactgcagcaatgagggattaaggttccaacacgtgaacttttgagggacacacttaaatcataacaggtagttatttcctgaggattaaagcagtttcacagacagatgaagaagaactttttcttctattacttagtaatcgaccaggagacctattctttgaaagagaatattctttggttccagtacacatggtgggggcgggaatccatgaactaaaatgggctaatgacagtgatggcagacctaagattctttttccctccaaagccatccccaaatcccttaagacctatacttccaagcctcacctgtctgtgtctctttgcagtggcagtgaccctggacccagacacagcacatcccaaactcatcctttctgaggaccaaagatgtgtaaggcttggagacagacggcagcctgtacctgacaacccccagagatttgatttcgttgtcagcatcctaggctctgagtacttcacgactggctgccactactgggaggtgtatgtgggagacaagaccaaatggattcttggagtatgtagtgagtcagtgagcaggaaggggaaggttactgcctcacctgccaatggacactggcttctgcgacagagtcgtgggaatgagtatgaagctctcacatccccgcagacctccttccgccttaaagagcctccacggtgtgtggggattttcctggactatgaagcaggagtcatctctttctacaatgtgaccaacaagtcccacatctttactttcacccacaatttctctggcccccttcgccctttctttgaaccttgccttcatgatggaggaaaaaacacagcacctctagtcatttgttcagaactacacaaatcagaggaatcaattgtccccaggccagaagggaaaggccatgctaatggagatgtgtccctcaaggtgaactcttctttactacccccgaaggccccagagctgaaggatataatcctgtccttgccccctgaccttggcccagcccttcaggagctcaaggctccttctttttagggatatgccacattacctgctcccatcaccatccagcccagcaccctggacttcagtcgcctggcccaaccccatgattatggaacgtctcttcaccttaacccaaatccagacccttttgtggtttctatttgtaccacttttctcccaggcctcagttctgaagcttacctttcttctaaggaattgaagctcccagtgacctggagggaggattcctggaaaccaaacaatcagtttaggtgcaggtggagatgttgaatatgtgttaccaagatacagcacaggttcagggaaaagagttcgctactccaggggttatttagaagacactttctctgcctcatcctgccctcaagctttagtcaagaagttatggcccccagtccctgacttcttacttatcccattgaggactgcctttctctctctcagttctggcctctgccccccaaagtcagctctctaaaagcaagcatgttttagaccactcactctttccctctttcttcaggaatgaattgggaaaggctgatgagtaaaacataccatccttttctattttcttgatgctgtttacaacatagtttggtgatatccagagctaatgtacatgctttcaaaagctaatctgcctgttgatgataactaggtacagcgactttaaatacagttgctataatcctgaaaagccccaggagcacatcagggagctgggaaacacagttgcagagaactcagctgtatgttgccctctgaccttggcccagaccttcagaggctcagtctgttgagtctgttgtgactgtcttatgaatcaatctgttgtgccaaccctttctgagattcagagaggtccagctagaaaaagtggcagttttaaccaccaacgtagaagcttttttttccccacaagaccattgtactgcaatacttgactatttgtgtagcaaacagcctcttaggttggagagtattgatttcaaataggaagttggtagactaggtgtgaggatgaaataatgaccttgatttttgggtgtgtattgcagaagcctcgtcgctttcaagtcacatcatatatgcgatctggcctaaccatggagatattggttatcagtttgcagatgaatacacagttctatccaacagaaactgtatctttctgtttgtcagaagttctccgttagttcctgtattagtcaaggttttccagagaaacagaatcaatatatattggggcaggggggcggtggttattataaggaattggctcacgtgattatggaggcggttaaatcccaagatctgcaggataagtcagcaagatggagtcccatgagagctgatggtttagttccagtctgatggcagcaggcttgacgccaaggaagagatgatgtttaattcaagtccgaaggcaaggaaaaagctgatggtcctgtccaaaggctattaggcaggaagaattctcttagggcagagttagctcttttgttctattcaggccttcaactgattcagcaaggcccgcccacatttgggaggacagtctgcattactcagtctactgatttgaatgttaatgtcattgagaaacaccctcacaggaacactcagaataatgtttgaccaaatagctgggcatcttgtgacccagttaagtggatacataagattaactatcacagtgactcagtggaattttttgtttgcttttgtacagttttaaaataaaaaattccactgagtcactgtgattggtcgacg

SEQ ID NO: 278750 - DNA, 4152 bp, Homo sapiens
  misc_feature (158)..(158): n is a, c, g, or t
gcgcttgcggaggattgcgttgacgagactcttatttattgtcaccaacctgtggtggaatttgcagttgcacattggatctgattcgccccgccccgaatgacgcctgcccggaggcagtgaaagtacagccgcgccgccccaagtcagcccggacncataaatcagcacgcggccggagaaccccgcaatctctgcgcccacaaaatacaccgacgatgcccgatctactttaagggctgaaacccacgggcctgagagactataagagcgttccctaccgccatggaacaacggggacagaacgccccggccgcttcgggggcccggaaaaggcacggcccaggacccagggaggcgcggggagccaggcctgggctccgggtccccaagacccttgtgctcgttgtcgccgcggtcctgctgttggtctcagctgagtctgctctgatcacccaacaagacctagctccccagcagagagcggccccacaacaaaagaggtccagcccctcagagggattgtgtccacctggacaccatatctcagaagacggtagagattgcatctcctgcaaatatggacaggactatagcactcactggaatgacctccttttctgcttgcgctgcaccaggtgtgattcaggtgaagtggagctaagtccctgcaccacgaccagaaacacagtgtgtcagtgcgaagaaggcaccttccgggaagaagattctcctgagatgtgccggaagtgccgcacagggtgtcccagagggatggtcaaggtcggtgattgtacaccctggagtgacatcgaatgtgtccacaaagaatcaggtacaaagcacagtggggaagccccagctgtggaggagacggtgacctccagcccagggactcctgcctctccctgttctctctcaggcatcatcataggagtcacagttgcagccgtagtcttgattgtggctgtgtttgtttgcaagtctttactgtggaagaaagtccttccttacctgaaaggcatctgctcaggtggtggtggggaccctgagcgtgtggacagaagctcacaacgacctggggctgaggacaatgtcctcaatgagatcgtgagtatcttgcagcccacccaggtccctgagcaggaaatggaagtccaggagccagcagagccaacaggtgtcaacatgttgtcccccggggagtcagagcatctgctggaaccggcagaagctgaaaggtctcagaggaggaggctgctggttccagcaaatgaaggtgatcccactgagactctgagacagtgcttcgatgactttgcagacttggtgccctttgactcctgggagccgctcatgaggaagttgggcctcatggacaatgagataaaggtggctaaagctgaggcagcgggccacagggacaccttgtacacgatgctgataaagtgggtcaacaaaaccgggcgagatgcctctgtccacaccctgctggatgccttggagacgctgggagagagacttgccaagcagaagattgaggaccacttgttgagctctggaaagttcatgtatctagaaggtaatgcagactctgccatgtcctaagtgtgattctcttcaggaagtgagaccttccctggtttaccttttttctggaaaaagcccaactggactccagtcagtaggaaagtgccacaattgtcacatgaccggtactggaagaaactctcccatccaacatcacccagtggatggaacatcctgtaacttttcactgcacttggcattatttttataagctgaatgtgataataaggacactatggaaatgtctggatcattccgtttgtgcgtactttgagatttggtttgggatgtcattgttttcacagcacttttttatcctaatgtaaatgctttatttatttatttgggctacattgtaagatccatctacacagtcgttgtccgacttcacttgatactatatgatatgaaccttttttgggtggggggtgcggggcagttcactctgtctcccaggctggagtgcaatggtgcaatcttggctcactatagccttgacctctcaggctcaagcgattctcccacctcagccatccaaatagctgggaccacaggtgtgcaccaccacgcccggctaattttttgtattttgtctagatataggggctctctatgttgctcagggtggtctcgaattcctggactcaagcagtctgcccacctcagactcccaaagcggtggaattagaggcgtgagcccccatgcttggccttacctttctacttttataattctgtatgttattattttatgaacatgaagaaactttagtaaatgtacttgtttacatagttatgtgaatagattagataaacataaaaggaggagacatacaatgggggaagaagaagaagtcccctgtaagatgtcactgtctgggttccagccctccctcagatgtactttggcttcaatgattggcaacttctacaggggccagtcttttgaactggacaaccttacaagtatatgagtattatttataggtagttgtttacatatgagtcgggaccaaagagaactggatccacgtgaagtcctgtgtgtggctggtccctacctgggcagtctcatttgcacccatagcccccatctatggacaggctgggacagaggcagatgggttagatcacacataacaatagggtctatgtcatatcccaagtgaacttgagccctgtttgggctcaggagatagaagacaaaatctgtctcccacgtctgccatggcatcaagggggaagagtagatggtgcttgagaatggtgtgaaatggttgccatctcaggagtagatggcccggctcacttctggttatctgtcaccctgagcccatgagctgccttttagggtacagattgcctacttgaggaccttggccgctctgtaagcatctgactcatctcagaaatgtcaattcttaaacactgtggcaacaggacctagaatggctgacgcattaaggttttcttcttgtgtcctgttctattattgttttaagacctcagtaaccatttcagcctctttccagcaaacccttctccatagtatttcagtcatggaaggatcatttatgcaggtagtcattccaggagtttttggtcttttctgtctcaaggcattgtgtgttttgttccgggactggtttgggtgggacaaagttagaattgcctgaagatcacacattcagactgttgtgtctgtggagttttaggagtggggggtgacctttctggtctttgcacttccatcctctcccacttccatctggcatcccacgcgttgtcccctgcacttctggaaggcacagggtgctgctgcctcctggtctttgcctttgctgggccttctgtgcaggacgctcagcctcagggctcagaaggtgccagtccggtcccaggtcccttgtcccttccacagaggccttcctagaagatgcatctagagtgtcagccttatcagtgtttaagatttttcttttatttttaatttttttgagacagaatctcactctctcgcccaggctggagtgcaacggtacgatcttggctcagtgcaacctccgcctcctgggttcaagcgattctcgtgcctcagcctccggagtagctgggattgcaggcacccgccaccacgcctggctaatttttgtatttttagtagagacggggtttcaccatgttggtcaggctggtctcgaactcctgacctcaggtgatccaccttggcctccgaaagtgctgggattacaggcgtgagccaccagccaggccaagctattcttttaaagtaagcttcctgacgacatgaaataattgggggttttgttgtttagttacattaggctttgctatatccccaggccaaatagcatgtgacacaggacagccatagtatagtgtgtcactcgtggttggtgtcctttcatgcttctgccctgtcaaaggtccctatttgaaatgtgttataatacaaacaaggaagcacattgtgtacaaaatacttatgtatttatgaatccatgaccaaattaaatatgaaaccttatataaaaaaaggtg

SEQ ID NO: 278751 - DNA, 4065 bp, Homo sapiens
  misc_feature (158)..(158): n is a, c, g, or t
gcgcttgcggaggattgcgttgacgagactcttatttattgtcaccaacctgtggtggaatttgcagttgcacattggatctgattcgccccgccccgaatgacgcctgcccggaggcagtgaaagtacagccgcgccgccccaagtcagcccggacncataaatcagcacgcggccggagaaccccgcaatctctgcgcccacaaaatacaccgacgatgcccgatctactttaagggctgaaacccacgggcctgagagactataagagcgttccctaccgccatggaacaacggggacagaacgccccggccgcttcgggggcccggaaaaggcacggcccaggacccagggaggcgcggggagccaggcctgggctccgggtccccaagacccttgtgctcgttgtcgccgcggtcctgctgttggtctcagctgagtctgctctgatcacccaacaagacctagctccccagcagagagcggccccacaacaaaagaggtccagcccctcagagggattgtgtccacctggacaccatatctcagaagacggtagagattgcatctcctgcaaatatggacaggactatagcactcactggaatgacctccttttctgcttgcgctgcaccaggtgtgattcaggtgaagtggagctaagtccctgcaccacgaccagaaacacagtgtgtcagtgcgaagaaggcaccttccgggaagaagattctcctgagatgtgccggaagtgccgcacagggtgtcccagagggatggtcaaggtcggtgattgtacaccctggagtgacatcgaatgtgtccacaaagaatcaggcatcatcataggagtcacagttgcagccgtagtcttgattgtggctgtgtttgtttgcaagtctttactgtggaagaaagtccttccttacctgaaaggcatctgctcaggtggtggtggggaccctgagcgtgtggacagaagctcacaacgacctggggctgaggacaatgtcctcaatgagatcgtgagtatcttgcagcccacccaggtccctgagcaggaaatggaagtccaggagccagcagagccaacaggtgtcaacatgttgtcccccggggagtcagagcatctgctggaaccggcagaagctgaaaggtctcagaggaggaggctgctggttccagcaaatgaaggtgatcccactgagactctgagacagtgcttcgatgactttgcagacttggtgccctttgactcctgggagccgctcatgaggaagttgggcctcatggacaatgagataaaggtggctaaagctgaggcagcgggccacagggacaccttgtacacgatgctgataaagtgggtcaacaaaaccgggcgagatgcctctgtccacaccctgctggatgccttggagacgctgggagagagacttgccaagcagaagattgaggaccacttgttgagctctggaaagttcatgtatctagaaggtaatgcagactctgccatgtcctaagtgtgattctcttcaggaagtgagaccttccctggtttaccttttttctggaaaaagcccaactggactccagtcagtaggaaagtgccacaattgtcacatgaccggtactggaagaaactctcccatccaacatcacccagtggatggaacatcctgtaacttttcactgcacttggcattatttttataagctgaatgtgataataaggacactatggaaatgtctggatcattccgtttgtgcgtactttgagatttggtttgggatgtcattgttttcacagcacttttttatcctaatgtaaatgctttatttatttatttgggctacattgtaagatccatctacacagtcgttgtccgacttcacttgatactatatgatatgaaccttttttgggtggggggtgcggggcagttcactctgtctcccaggctggagtgcaatggtgcaatcttggctcactatagccttgacctctcaggctcaagcgattctcccacctcagccatccaaatagctgggaccacaggtgtgcaccaccacgcccggctaattttttgtattttgtctagatataggggctctctatgttgctcagggtggtctcgaattcctggactcaagcagtctgcccacctcagactcccaaagcggtggaattagaggcgtgagcccccatgcttggccttacctttctacttttataattctgtatgttattattttatgaacatgaagaaactttagtaaatgtacttgtttacatagttatgtgaatagattagataaacataaaaggaggagacatacaatgggggaagaagaagaagtcccctgtaagatgtcactgtctgggttccagccctccctcagatgtactttggcttcaatgattggcaacttctacaggggccagtcttttgaactggacaaccttacaagtatatgagtattatttataggtagttgtttacatatgagtcgggaccaaagagaactggatccacgtgaagtcctgtgtgtggctggtccctacctgggcagtctcatttgcacccatagcccccatctatggacaggctgggacagaggcagatgggttagatcacacataacaatagggtctatgtcatatcccaagtgaacttgagccctgtttgggctcaggagatagaagacaaaatctgtctcccacgtctgccatggcatcaagggggaagagtagatggtgcttgagaatggtgtgaaatggttgccatctcaggagtagatggcccggctcacttctggttatctgtcaccctgagcccatgagctgccttttagggtacagattgcctacttgaggaccttggccgctctgtaagcatctgactcatctcagaaatgtcaattcttaaacactgtggcaacaggacctagaatggctgacgcattaaggttttcttcttgtgtcctgttctattattgttttaagacctcagtaaccatttcagcctctttccagcaaacccttctccatagtatttcagtcatggaaggatcatttatgcaggtagtcattccaggagtttttggtcttttctgtctcaaggcattgtgtgttttgttccgggactggtttgggtgggacaaagttagaattgcctgaagatcacacattcagactgttgtgtctgtggagttttaggagtggggggtgacctttctggtctttgcacttccatcctctcccacttccatctggcatcccacgcgttgtcccctgcacttctggaaggcacagggtgctgctgcctcctggtctttgcctttgctgggccttctgtgcaggacgctcagcctcagggctcagaaggtgccagtccggtcccaggtcccttgtcccttccacagaggccttcctagaagatgcatctagagtgtcagccttatcagtgtttaagatttttcttttatttttaatttttttgagacagaatctcactctctcgcccaggctggagtgcaacggtacgatcttggctcagtgcaacctccgcctcctgggttcaagcgattctcgtgcctcagcctccggagtagctgggattgcaggcacccgccaccacgcctggctaatttttgtatttttagtagagacggggtttcaccatgttggtcaggctggtctcgaactcctgacctcaggtgatccaccttggcctccgaaagtgctgggattacaggcgtgagccaccagccaggccaagctattcttttaaagtaagcttcctgacgacatgaaataattgggggttttgttgtttagttacattaggctttgctatatccccaggccaaatagcatgtgacacaggacagccatagtatagtgtgtcactcgtggttggtgtcctttcatgcttctgccctgtcaaaggtccctatttgaaatgtgttataatacaaacaaggaagcacattgtgtacaaaatacttatgtatttatgaatccatgaccaaattaaatatgaaaccttatataaaaaaaggtg

SEQ ID NO: 278752 - DNA, 4179 bp, Homo sapiens
  misc_feature (158)..(158): n is a, c, g, or t
gcgcttgcggaggattgcgttgacgagactcttatttattgtcaccaacctgtggtggaatttgcagttgcacattggatctgattcgccccgccccgaatgacgcctgcccggaggcagtgaaagtacagccgcgccgccccaagtcagcccggacncataaatcagcacgcggccggagaaccccgcaatctctgcgcccacaaaatacaccgacgatgcccgatctactttaagggctgaaacccacgggcctgagagactataagagcgttccctaccgccatggaacaacggggacagaacgccccggccgcttcgggggcccggaaaaggcacggcccaggacccagggaggcgcggggagccaggcctgggctccgggtccccaagacccttgtgctcgttgtcgccgcggtcctgctgttggtctcagctgagtctgctctgatcacccaacaagacctagctccccagcagagagcggccccacaacaaaagaggtccagcccctcagagggattgtgtccacctggacaccatatctcagaagacggtagagattgcatctcctgcaaatatggacaggactatagcactcactggaatgacctccttttctgcttgcgctgcaccaggtgtgattcaggtgaagtggagctaagtccctgcaccacgaccagaaacacagtgtgtcagtgcgaagaaggcaccttccgggaagaagattctcctgagatgtgccggaagtgccgcacagggtgtcccagagggatggtcaaggtcggtgattgtacaccctggagtgacatcgaatgtgtccacaaagaatcaggcatcatcataggagtcacagttgcagccgtagtcttgattgtggctgtgtttgtttgcaagtctttactgtggaagaaagtccttccttacctgaaaggcatctgctcaggtggtggtggggaccctgagcgtgtggacagaagctcacaacgacctggggctgaggacaatgtcctcaatgagatcgtgagtatcttgcagcccacccaggtccctgagcaggaaatggaagtccaggagccagcagagccaacaggtgtcaacatgttgtcccccggggagtcagagcatctgctggaaccggcagaagctgaaaggtctcagaggaggaggctgctggttccagcaaatgaaggtgatcccactgagactctgagacagtgcttcgatgactttgcagacttggtgccctttgactcctgggagccgctcatgaggaagttgggcctcatggacaatgagataaaggtggctaaagctgaggcagcgggccacagggacaccttgtacacgatgctgataaagtgggtcaacaaaaccgggcgagatgcctctgtccacaccctgctggatgccttggagacgctgggagagagacttgccaagcagaagattgaggaccacttgttgagctctggaaagttcatgtatctagaaggtaatgcagactctgccatgtcctaagtgtgattctcttcaggaagtgagaccttccctggtttaccttttttctggaaaaagcccaactggactccagtcagtaggaaagtgccacaattgtcacatgaccggtactggaagaaactctcccatccaacatcacccagtggatggaacatcctgtaacttttcactgcacttggcattatttttataagctgaatgtgataataaggacactatggaaatgtctggatcattccgtttgtgcgtactttgagatttggtttgggatgtcattgttttcacagcacttttttatcctaatgtaaatgctttatttatttatttgggctacattgtaagatccatctacacagtcgttgtccgacttcacttgatactatatgatatgaaccttttttgggtggggggtgcggggcagttcactctgtctcccaggctggagtgcaatggtgcaatcttggctcactatagccttgacctctcaggctcaagcgattctcccacctcagccatccaaatagctgggaccacaggtgtgcaccaccacgcccggctaattttttgtattttgtctagatataggggctctctatgttgctcagggtggtctcgaattcctggactcaagcagtctgcccacctcagactcccaaagcggtggaattagaggcgtgagcccccatgcttggccttacctttctacttttataattctgtatgttattattttatgaacatgaagaaactttagtaaatgtacttgtttacatagttatgtgaatagattagataaacataaaaggaggagacatacaatgggggaagaagaagaagtcccctgtaagatgtcactgtctgggttccagccctccctcagatgtactttggcttcaatgattggcaacttctacaggggccagtcttttgaactggacaaccttacaagtatatgagtattatttataggtagttgtttacatatgagtcgggaccaaagagaactggatccacgtgaagtcctgtgtgtggctggtccctacctgggcagtctcatttgcacccatagcccccatctatggacaggctgggacagaggcagatgggttagatcacacataacaatagggtctatgtcatatcccaagtgaacttgagccctgtttgggctcaggagatagaagacaaaatctgtctcccacgtctgccatggcatcaagggggaagagtagatggtgcttgagaatggtgtgaaatggttgccatctcaggagtagatggcccggctcacttctggttatctgtcaccctgagcccatgagctgccttttagggtacagattgcctacttgaggaccttggccgctctgtaagcatctgactcatctcagaaatgtcaattcttaaacactgtggcaacaggacctagaatggctgacgcattaaggttttcttcttgtgtcctgttctattattgttttaagacctcagtaaccatttcagcctctttccagcaaacccttctccatagtatttcagtcatggaaggatcatttatgcaggtagtcattccaggagtttttggtcttttctgtctcaaggcattgtgtgttttgttccgggactggtttgggtgggacaaagttagaattgcctgaagatcacacattcagactgttgtgtctgtggagttttaggagtggggggtgacctttctggtctttgcacttccatcctctcccacttccatctggcatcccacgcgttgtcccctgcacttctggaaggcacagggtgctgctgcctcctggtctttgcctttgctgggccttctgtgcaggacgctcagcctcagggctcagaaggtgccagtccggtcccaggtcccttgtcccttccacagaggccttcctagaagatgcatctagagtgtcagccttatcagtgtttaagatttttcttttatttttaatttttttgagacagaatctcactctctcgcccaggctggagtgcaacggtacgatcttggctcagtgcaacctccgcctcctgggttcaagcgattctcgtgcctcagcctccggagtagctgggattgcaggcacccgccaccacgcctggctaatttttgtatttttagtagagacggggtttcaccatgttggtcaggctggtctcgaactcctgacctcaggtgatccaccttggcctccgaaagtgctgggattacaggcgtgagccaccagccaggccaagctattcttttaaagtaagcttcctgacgacatgaaataattgggggttttgttgtttagttacattaggctttgctatatccccaggccaaatagcatgtgacacaggacagccatagtatagtgtgtcactcgtggttggtgtcctttcatgcttctgccctgtcaaaggtccctatttgaaatgtgttataatacaaccaggagccttggtcacatactttggtttgatcctgacaattattgaactttttaaaaaaaaagggccgctagaacccaggccactaccgtccttttgtaaggccaagggataaaaacggcggacacccgaacgcatggctgggacctgtgggttggcacccaaacgattttcgctttcgtactatctcacggactcatc

SEQ ID NO: 278753 - DNA, 3638 bp, Homo sapiens
  misc_feature (158)..(158): n is a, c, g, or t
gcgcttgcggaggattgcgttgacgagactcttatttattgtcaccaacctgtggtggaatttgcagttgcacattggatctgattcgccccgccccgaatgacgcctgcccggaggcagtgaaagtacagccgcgccgccccaagtcagcccggacncataaatcagcacgcggccggagaaccccgcaatctctgcgcccacaaaatacaccgacgatgcccgatctactttaagggctgaaacccacgggcctgagagactataagagcgttccctaccgccatggaacaacggggacagaacgccccggccgcttcgggggcccggaaaaggcacggcccaggacccagggaggcgcggggagccaggcctgggctccgggtccccaagacccttgtgctcgttgtcgccgcggtcctgctgttggtctcagctgagtctgctctgatcacccaacaagacctagctccccagcagagagcggccccacaacaaaagaggtccagcccctcagagggattgtgtccacctggacaccatatctcagaagacggtagagattgcatctcctgcaaatatggacaggactatagcactcactggaatgacctccttttctgcttgcgctgcaccaggtgtgattcaggtgaagtggagctaagtccctgcaccacgaccagaaacacagtgtgtcagtgcgaagaaggcaccttccgggaagaagattctcctgagatgtgccggaagtgccgcacagggtgtcccagagggatggtcaaggtcggtgattgtacaccctggagtgacatcgaatgtgtccacaaagaatcaggcatcatcataggagtcacagttgcagccgtagtcttgattgtggctgtgtttgtttgcaagtctttactgtggaagaaagtccttccttacctgaaaggcatctgctcaggtggtggtggggaccctgagcgtgtggacagaagctcacaacgacctggggctgaggacaatgtcctcaatgagatcgtgagtatcttgcagcccacccaggtccctgagcaggaaatggaagtccaggagccagcagagccaacaggtgtcaacatgttgtcccccggggagtcagagcatctgctggaaccggcagaagctgaaaggtctcagaggaggaggctgctggttccagcaaatgaaggtgatcccactgagactctgagacagtgcttcgatgactttgcagacttggtgccctttgactcctgggagccgctcatgaggaagttgggcctcatggacaatgagataaaggtggctaaagctgaggcagcgggccacagggacaccttgtacacgatgctgataaagtgggtcaacaaaaccgggcgagatgcctctgtccacaccctgctggatgccttggagacgctgggagagagacttgccaagcagaagattgaggaccacttgttgagctctggaaagttcatgtatctagaaggtaatgcagactctgccatgtcctaagtgtgattctcttcaggaagtgagaccttccctggtttaccttttttctggaaaaagcccaactggactccagtcagtaggaaagtgccacaattgtcacatgaccggtactggaagaaactctcccatccaacatcacccagtggatggaacatcctgtaacttttcactgcacttggcattatttttataagctgaatgtgataataaggacactatggaaatgtctggatcattccgtttgtgcgtactttgagatttggtttgggatgtcattgttttcacagcacttttttatcctaatgtaaatgctttatttatttatttgggctacattgtaagatccatctacacagtcgttgtccgacttcacttgatactatatgatatgaaccttttttgggtggggggtgcggggcagttcactctgtctcccaggctggagtgcaatggtgcaatcttggctcactatagccttgacctctcaggctcaagcgattctcccacctcagccatccaaatagctgggaccacaggtgtgcaccaccacgcccggctaattttttgtattttgtctagatataggggctctctatgttgctcagggtggtctcgaattcctggactcaagcagtctgcccacctcagactcccaaagcggtggaattagaggcgtgagcccccatgcttggccttacctttctacttttataattctgtatgttattattttatgaacatgaagaaactttagtaaatgtacttgtttacatagttatgtgaatagattagataaacataaaaggaggagacatacaatgggggaagaagaagaagtcccctgtaagatgtcactgtctgggttccagccctccctcagatgtactttggcttcaatgattggcaacttctacaggggccagtcttttgaactggacaaccttacaagtatatgagtattatttataggtagttgtttacatatgagtcgggaccaaagagaactggatccacgtgaagtcctgtgtgtggctggtccctacctgggcagtctcatttgcacccatagcccccatctatggacaggctgggacagaggcagatgggttagatcacacataacaatagggtctatgtcatatcccaagtgaacttgagccctgtttgggctcaggagatagaagacaaaatctgtctcccacgtctgccatggcatcaagggggaagagtagatggtgcttgagaatggtgtgaaatggttgccatctcaggagtagatggcccggctcacttctggttatctgtcaccctgagcccatgagctgccttttagggtacagattgcctacttgaggaccttggccgctctgtaagcatctgactcatctcagaaatgtcaattcttaaacactgtggcaacaggacctagaatggctgacgcattaaggttttcttcttgtgtcctgttctattattgttttaagacctcagtaaccatttcagcctctttccagcaaacccttctccatagtatttcagtcatggaaggatcatttatgcaggtagtcattccaggagtttttggtcttttctgtctcaaggcattgtgtgttttgttccgggactggtttgggtgggacaaagttagaattgcctgaagatcacacattcagactgttgtgtctgtggagttttaggagtggggggtgacctttctggtctttgcacttccatcctctcccacttccatctggcatcccacgcgttgtcccctgcacttctggaaggcacagggtgctgctgcctcctggtctttgcctttgctgggccttctgtgcaggacgctcagcctcagggctcagaaggtgccagtccggtcccaggtcccttgtcccttccacagaggccttcctagaagatgcatctagagtgtcagccttatcagtgtttaagatttttcttttatttttaatttttttgagacagaatctcactctctcgcccaggctggagtgcaacggtacgataatcacttgaacccgggaggcagaggttgcggtgagccgagatcgtgccattgcactccagcctgggcaacaagagtgaaactccgtctc

SEQ ID NO: 278754 - DNA, 2508 bp, Homo sapiens
  misc_feature (158)..(158): n is a, c, g, or t
gcgcttgcggaggattgcgttgacgagactcttatttattgtcaccaacctgtggtggaatttgcagttgcacattggatctgattcgccccgccccgaatgacgcctgcccggaggcagtgaaagtacagccgcgccgccccaagtcagcccggacncataaatcagcacgcggccggagaaccccgcaatctctgcgcccacaaaatacaccgacgatgcccgatctactttaagggctgaaacccacgggcctgagagactataagagcgttccctaccgccatggaacaacggggacagaacgccccggccgcttcgggggcccggaaaaggcacggcccaggacccagggaggcgcggggagccaggcctgggctccgggtccccaagacccttgtgctcgttgtcgccgcggtcctgctgttggtctcagctgagtctgctctgatcacccaacaagacctagctccccagcagagagcggccccacaacaaaagaggtccagcccctcagagggattgtgtccacctggacaccatatctcagaagacggtagagattgcatctcctgcaaatatggacaggactatagcactcactggaatgacctccttttctgcttgcgctgcaccaggtgtgattcaggtgaagtggagctaagtccctgcaccacgaccagaaacacagtgtgtcagtgcgaagaaggcaccttccgggaagaagattctcctgagatgtgccggaagtgccgcacagggtgtcccagagggatggtcaaggtcggtgattgtacaccctggagtgacatcgaatgtgtccacaaagaatcaggcatcatcataggagtcacagttgcagccgtagtcttgattgtggctgtgtttgtttgcaagtctttactgtggaagaaagtccttccttacctgaaaggcatctgctcaggtggtggtggggaccctgagcgtgtggacagaagctcacaacgacctggggctgaggacaatgtcctcaatgagatcgtgagtatcttgcagcccacccaggtccctgagcaggaaatggaagtccaggagccagcagagccaacaggtgtcaacatgttgtcccccggggagtcagagcatctgctggaaccggcagaagctgaaaggtctcagaggaggaggctgctggttccagcaaatgaaggtgatcccactgagactctgagacagtgcttcgatgactttgcagacttggtgccctttgactcctgggagccgctcatgaggaagttgggcctcatggacaatgagataaaggtggctaaagctgaggcagcgggccacagggacaccttgtacacgatgctgataaagtgggtcaacaaaaccgggcgagatgcctctgtccacaccctgctggatgccttggagacgctgggagagagacttgccaagcagaagattgaggaccacttgttgagctctggaaagttcatgtatctagaaggtaatgcagactctgccatgtcctaagtgtgattctcttcaggaagtgagaccttccctggtttaccttttttctggaaaaagcccaactggactccagtcagtaggaaagtgccacaattgtcacatgaccggtactggaagaaactctcccatccaacatcacccagtggatggaacatcctgtaacttttcactgcacttggcattatttttataagctgaatgtgataataaggacactatggaaatgtctggatcattccgtttgtgcgtactttgagatttggtttgggatgtcattgttttcacagcacttttttatcctaatgtaaatgctttatttatttatttgggctacattgtaagatccatctacacagtcgttgtccgacttcacttgatactatatgatatgaaccttttttgggtggggggtgcggggcagttcactctgtctcccaggctggagtgcaatggtgcaatcttggctcactatagccttgacctctcaggctcaagcgattctcccacctcagccatccaaatagctgggaccacaggtgtgcaccaccacgcccggctaattttttgtattttgtctagatataggggctctctatgttgctcagggtggtctcgaattcctggactcaagcagtctgcccacctcagactcccaaagcggtggaattagagttacaggcgtgagccaccagccaggccaagctattcttttaaagtaagcttcctgacgacatgaaataattgggggttttgttgtttagttacattaggctttgctatatccccaggccaaatagcatgtgacacaggacagccatagtatagtgtgtcactcgtggttggtgtcctttcatgcttctgccctgtcaaaggtccctatttgaaatgtgttataatacaaacaaggaagcacattgtgtacaaaatacttatgtatttatgaatccatgaccaaattaaatatgaaaccttatataaaaaaaggtg

SEQ ID NO: 278755 - DNA, 1981 bp, Homo sapiens
  misc_feature (158)..(158): n is a, c, g, or t
gcgcttgcggaggattgcgttgacgagactcttatttattgtcaccaacctgtggtggaatttgcagttgcacattggatctgattcgccccgccccgaatgacgcctgcccggaggcagtgaaagtacagccgcgccgccccaagtcagcccggacncataaatcagcacgcggccggagaaccccgcaatctctgcgcccacaaaatacaccgacgatgcccgatctactttaagggctgaaacccacgggcctgagagactataagagcgttccctaccgccatggaacaacggggacagaacgccccggccgcttcgggggcccggaaaaggcacggcccaggacccagggaggcgcggggagccaggcctgggctccgggtccccaagacccttgtgctcgttgtcgccgcggtcctgctgttggtctcagctgagtctgctctgatcacccaacaagacctagctccccagcagagagcggccccacaacaaaagaggtccagcccctcagagggattgtgtccacctggacaccatatctcagaagacggtagagattgcatctcctgcaaatatggacaggactatagcactcactggaatgacctccttttctgcttgcgctgcaccaggtgtgattcaggtgaagtggagctaagtccctgcaccacgaccagaaacacagtgtgtcagtgcgaagaaggcaccttccgggaagaagattctcctgagatgtgccggaagtgccgcacagggtgtcccagagggatggtcaaggtcggtgattgtacaccctggagtgacatcgaatgtgtccacaaagaatcaggcatcatcataggagtcacagttgcagccgtagtcttgattgtggctgtgtttgtttgcaagtctttactgtggaagaaagtccttccttacctgaaaggcatctgctcaggtggtggtggggaccctgagcgtgtggacagaagctcacaacgacctggggctgaggacaatgtcctcaatgagatcgtgagtatcttgcagcccacccaggtccctgagcaggaaatggaagtccaggagccagcagagccaacaggtgtcaacatgttgtcccccggggagtcagagcatctgctggaaccggcagaagctgaaaggtctcagaggaggaggctgctggttccagcaaatgaaggtgatcccactgagactctgagacagtgcttcgatgactttgcagacttggtgccctttgactcctgggagccgctcatgaggaagttgggcctcatggacaatgagataaaggtggctaaagctgaggcagcgggccacagggacaccttgtacacgatgctgataaagtgggtcaacaaaaccgggcgagatgcctctgtccacaccctgctggatgccttggagacgctgggagagagacttgccaagcagaagattgaggaccacttgttgagctctggaaagttcatgtatctagaaggtaatgcagactctgccatgtcctaagtgtgattctcttcaggaagtgagaccttccctggtttaccttttttctggaaaaagcccaactggactccagtcagtaggaaagtgccacaattgtcacatgaccggtactggaagaaactctcccatccaacatcacccagtggatggaacatcctgtaacttttcactgcacttggcattatttttataagctgaatgtgataataaggacactatggaaatgtctggatcattccgtttgtgcgtactttgagatttggtttgggatgtcattgttttcacagcacttttttatcctaatgtaaatgctttatttatttatttgggctacattgtaagatccatctacacagtcgttgtccgacttcacttgatactatatgatatgaacctttttgagcaggggtggccgtgtagcagtggtgccgtgtagcaggggtgccgtgaagatcctgga

SEQ ID NO: 278756 - DNA, 3272 bp, Homo sapiens
tgatcgagctcggcactgattattcgtgtcacaaagaatcaggcatcatcataggagtcacagttgcagccgtagtcttgattgtggctgtgtttgtttgcaagtctttactgtggaagaaagtccttccttacctgaaaggcatctgctcaggtggtggtggggaccctgagcgtgtggacagaagctcacaacgacctggggctgaggacaatgtcctcaatgagatcgtgagtatcttgcagcccacccaggtccctgagcaggaaatggaagtccaggagccagcagagccaacaggtgtcaacatgttgtcccccggggagtcagagcatctgctggaaccggcagaagctgaaaggtctcagaggaggaggctgctggttccagcaaatgaaggtgatcccactgagactctgagacagtgcttcgatgactttgcagacttggtgccctttgactcctgggagccgctcatgaggaagttgggcctcatggacaatgagataaaggtggctaaagctgaggcagcgggccacagggacaccttgtacacgatgctgataaagtgggtcaacaaaaccgggcgagatgcctctgtccacaccctgctggatgccttggagacgctgggagagagacttgccaagcagaagattgaggaccacttgttgagctctggaaagttcatgtatctagaaggtaatgcagactctgccatgtcctaagtgtgattctcttcaggaagtgagaccttccctggtttaccttttttctggaaaaagcccaactggactccagtcagtaggaaagtgccacaattgtcacatgaccggtactggaagaaactctcccatccaacatcacccagtggatggaacatcctgtaacttttcactgcacttggcattatttttataagctgaatgtgataataaggacactatggaaatgtctggatcattccgtttgtgcgtactttgagatttggtttgggatgtcattgttttcacagcacttttttatcctaatgtaaatgctttatttatttatttgggctacattgtaagatccatctacacagtcgttgtccgacttcacttgatactatatgatatgaaccttttttgggtggggggtgcggggcagttcactctgtctcccaggctggagtgcaatggtgcaatcttggctcactatagccttgacctctcaggctcaagcgattctcccacctcagccatccaaatagctgggaccacaggtgtgcaccaccacgcccggctaattttttgtattttgtctagatataggggctctctatgttgctcagggtggtctcgaattcctggactcaagcagtctgcccacctcagactcccaaagcggtggaattagaggcgtgagcccccatgcttggccttacctttctacttttataattctgtatgttattattttatgaacatgaagaaactttagtaaatgtacttgtttacatagttatgtgaatagattagataaacataaaaggaggagacatacaatgggggaagaagaagaagtcccctgtaagatgtcactgtctgggttccagccctccctcagatgtactttggcttcaatgattggcaacttctacaggggccagtcttttgaactggacaaccttacaagtatatgagtattatttataggtagttgtttacatatgagtcgggaccaaagagaactggatccacgtgaagtcctgtgtgtggctggtccctacctgggcagtctcatttgcacccatagcccccatctatggacaggctgggacagaggcagatgggttagatcacacataacaatagggtctatgtcatatcccaagtgaacttgagccctgtttgggctcaggagatagaagacaaaatctgtctcccacgtctgccatggcatcaagggggaagagtagatggtgcttgagaatggtgtgaaatggttgccatctcaggagtagatggcccggctcacttctggttatctgtcaccctgagcccatgagctgccttttagggtacagattgcctacttgaggaccttggccgctctgtaagcatctgactcatctcagaaatgtcaattcttaaacactgtggcaacaggacctagaatggctgacgcattaaggttttcttcttgtgtcctgttctattattgttttaagacctcagtaaccatttcagcctctttccagcaaacccttctccatagtatttcagtcatggaaggatcatttatgcaggtagtcattccaggagtttttggtcttttctgtctcaaggcattgtgtgttttgttccgggactggtttgggtgggacaaagttagaattgcctgaagatcacacattcagactgttgtgtctgtggagttttaggagtggggggtgacctttctggtctttgcacttccatcctctcccacttccatctggcatcccacgcgttgtcccctgcacttctggaaggcacagggtgctgctgcctcctggtctttgcctttgctgggccttctgtgcaggacgctcagcctcagggctcagaaggtgccagtccggtcccaggtcccttgtcccttccacagaggccttcctagaagatgcatctagagtgtcagccttatcagtgtttaagatttttcttttatttttaatttttttgagacagaatctcactctctcgcccaggctggagtgcaacggtacgatcttggctcagtgcaacctccgcctcctgggttcaagcgattctcgtgcctcagcctccggagtagctgggattgcaggcacccgccaccacgcctggctaatttttgtatttttagtagagacggggtttcaccatgttggtcaggctggtctcgaactcctgacctcaggtgatccaccttggcctccgaaagtgctgggattacaggcgtgagccaccagccaggccaagctattcttttaaagtaagcttcctgacgacatgaaataattgggggttttgttgtttagttacattaggctttgctatatccccaggccaaatagcatgtgacacaggacagccatagtatagtgtgtcactcgtggttggtgtcctttcatgcttctgccctgtcaaaggtccctatttgaaatgtgttataatacaaacaaggaagcacattgtgtacaaaatacttatgtatttatgaatccatgaccaaattaaatatgaaaccttatataaaaaaaggtg

SEQ ID NO: 278757 - DNA, 2684 bp, Homo sapiens
gactcttgaggatccccaccggcctggatgccttggagacgctgggagagagacttgccaagcagaagattgaggaccacttgttgagctctggaaagttcatgtatctagaaggtaatgcagactctgccatgtcctaagtgtgattctcttcaggaagtgagaccttccctggtttaccttttttctggaaaaagcccaactggactccagtcagtaggaaagtgccacaattgtcacatgaccggtactggaagaaactctcccatccaacatcacccagtggatggaacatcctgtaacttttcactgcacttggcattatttttataagctgaatgtgataataaggacactatggaaatgtctggatcattccgtttgtgcgtactttgagatttggtttgggatgtcattgttttcacagcacttttttatcctaatgtaaatgctttatttatttatttgggctacattgtaagatccatctacacagtcgttgtccgacttcacttgatactatatgatatgaaccttttttgggtggggggtgcggggcagttcactctgtctcccaggctggagtgcaatggtgcaatcttggctcactatagccttgacctctcaggctcaagcgattctcccacctcagccatccaaatagctgggaccacaggtgtgcaccaccacgcccggctaattttttgtattttgtctagatataggggctctctatgttgctcagggtggtctcgaattcctggactcaagcagtctgcccacctcagactcccaaagcggtggaattagaggcgtgagcccccatgcttggccttacctttctacttttataattctgtatgttattattttatgaacatgaagaaactttagtaaatgtacttgtttacatagttatgtgaatagattagataaacataaaaggaggagacatacaatgggggaagaagaagaagtcccctgtaagatgtcactgtctgggttccagccctccctcagatgtactttggcttcaatgattggcaacttctacaggggccagtcttttgaactggacaaccttacaagtatatgagtattatttataggtagttgtttacatatgagtcgggaccaaagagaactggatccacgtgaagtcctgtgtgtggctggtccctacctgggcagtctcatttgcacccatagcccccatctatggacaggctgggacagaggcagatgggttagatcacacataacaatagggtctatgtcatatcccaagtgaacttgagccctgtttgggctcaggagatagaagacaaaatctgtctcccacgtctgccatggcatcaagggggaagagtagatggtgcttgagaatggtgtgaaatggttgccatctcaggagtagatggcccggctcacttctggttatctgtcaccctgagcccatgagctgccttttagggtacagattgcctacttgaggaccttggccgctctgtaagcatctgactcatctcagaaatgtcaattcttaaacactgtggcaacaggacctagaatggctgacgcattaaggttttcttcttgtgtcctgttctattattgttttaagacctcagtaaccatttcagcctctttccagcaaacccttctccatagtatttcagtcatggaaggatcatttatgcaggtagtcattccaggagtttttggtcttttctgtctcaaggcattgtgtgttttgttccgggactggtttgggtgggacaaagttagaattgcctgaagatcacacattcagactgttgtgtctgtggagttttaggagtggggggtgacctttctggtctttgcacttccatcctctcccacttccatctggcatcccacgcgttgtcccctgcacttctggaaggcacagggtgctgctgcctcctggtctttgcctttgctgggccttctgtgcaggacgctcagcctcagggctcagaaggtgccagtccggtcccaggtcccttgtcccttccacagaggccttcctagaagatgcatctagagtgtcagccttatcagtgtttaagatttttcttttatttttaatttttttgagacagaatctcactctctcgcccaggctggagtgcaacggtacgatcttggctcagtgcaacctccgcctcctgggttcaagcgattctcgtgcctcagcctccggagtagctgggattgcaggcacccgccaccacgcctggctaatttttgtatttttagtagagacggggtttcaccatgttggtcaggctggtctcgaactcctgacctcaggtgatccaccttggcctccgaaagtgctgggattacaggcgtgagccaccagccaggccaagctattcttttaaagtaagcttcctgacgacatgaaataattgggggttttgttgtttagttacattaggctttgctatatccccaggccaaatagcatgtgacacaggacagccatagtatagtgtgtcactcgtggttggtgtcctttcatgcttctgccctgtcaaaggtccctatttgaaatgtgttataatacaaacaaggaagcacattgtgtacaaaatacttatgtatttatgaatccatgaccaaattaaatatgaaaccttatataaaaaaaggtg

SEQ ID NO: 278758 - DNA, 1655 bp, Homo sapiens
gagtcatttcaaccggggtaaagttcttatgaacggcagcacccctacacggtttacatcttattacttgatgccctagcttgctagcgttatcaatcgcgaccacatagtcctggttctaccttaagtccttttgttaaaattttttctccataagaggggtctcatttgcacccatagcccccatctatggacaggctgggacagaggcagatgggttagatcacacataacaatagggtctatgtcatatcccaagtgaacttgagccctgtttgggctcaggagatagaagacaaaatctgtctcccacgtctgccatggcatcaagggggaagagtagatggtgcttgagaatggtgtgaaatggttgccatctcaggagtagatggcccggctcacttctggttatctgtcaccctgagcccatgagctgccttttagggtacagattgcctacttgaggaccttggccgctctgtaagcatctgactcatctcagaaatgtcaattcttaaacactgtggcaacaggacctagaatggctgacgcattaaggttttcttcttgtgtcctgttctattattgttttaagacctcagtaaccatttcagcctctttccagcaaacccttctccatagtatttcagtcatggaaggatcatttatgcaggtagtcattccaggagtttttggtcttttctgtctcaaggcattgtgtgttttgttccgggactggtttgggtgggacaaagttagaattgcctgaagatcacacattcagactgttgtgtctgtggagttttaggagtggggggtgacctttctggtctttgcacttccatcctctcccacttccatctggcatcccacgcgttgtcccctgcacttctggaaggcacagggtgctgctgcctcctggtctttgcctttgctgggccttctgtgcaggacgctcagcctcagggctcagaaggtgccagtccggtcccaggtcccttgtcccttccacagaggccttcctagaagatgcatctagagtgtcagccttatcagtgtttaagatttttcttttatttttaatttttttgagacagaatctcactctctcgcccaggctggagtgcaacggtacgatcttggctcagtgcaacctccgcctcctgggttcaagcgattctcgtgcctcagcctccggagtagctgggattgcaggcacccgccaccacgcctggctaatttttgtatttttagtagagacggggtttcaccatgttggtcaggctggtctcgaactcctgacctcaggtgatccaccttggcctccgaaagtgctgggattacaggcgtgagccaccagccaggccaagctattcttttaaagtaagcttcctgacgacatgaaataattgggggttttgttgtttagttacattaggctttgctatatccccaggccaaatagcatgtgacacaggacagccatagtatagtgtgtcactcgtggttggtgtcctttcatgcttctgccctgtcaaaggtccctatttgaaatgtgttataatacaaacaaggaagcacattgtgtacaaaatacttatgtatttatgaatccatgaccaaattaaatatgaaaccttatataaaaaaaggtg

SEQ ID NO: 278759 - DNA, 1415 bp, Homo sapiens
gacccacgcgtccgcggacgcgtggggagccctgtttgggctcaggagatagaagacaaaatctgtctcccacgtctgccatggcatcaagggggaagagtagatggtgcttgagaatggtgtgaaatggttgccatctcaggagtagatggcccggctcacttctggttatctgtcaccctgagcccatgagctgccttttagggtacagattgcctacttgaggaccttggccgctctgtaagcatctgactcatctcagaaatgtcaattcttaaacactgtggcaacaggacctagaatggctgacgcattaaggttttcttcttgtgtcctgttctattattgttttaagacctcagtaaccatttcagcctctttccagcaaacccttctccatagtatttcagtcatggaaggatcatttatgcaggtagtcattccaggagtttttggtcttttctgtctcaaggcattgtgtgttttgttccgggactggtttgggtgggacaaagttagaattgcctgaagatcacacattcagactgttgtgtctgtggagttttaggagtggggggtgacctttctggtctttgcacttccatcctctcccacttccatctggcatcccacgcgttgtcccctgcacttctggaaggcacagggtgctgctgcctcctggtctttgcctttgctgggccttctgtgcaggacgctcagcctcagggctcagaaggtgccagtccggtcccaggtcccttgtcccttccacagaggccttcctagaagatgcatctagagtgtcagccttatcagtgtttaagatttttcttttatttttaatttttttgagacagaatctcactctctcgcccaggctggagtgcaacggtacgatcttggctcagtgcaacctccgcctcctgggttcaagcgattctcgtgcctcagcctccggagtagctgggattgcaggcacccgccaccacgcctggctaatttttgtatttttagtagagacggggtttcaccatgttggtcaggctggtctcgaactcctgacctcaggtgatccaccttggcctccgaaagtgctgggattacaggcgtgagccaccagccaggccaagctattcttttaaagtaagcttcctgacgacatgaaataattgggggttttgttgtttagttacattaggctttgctatatccccaggccaaatagcatgtgacacaggacagccatagtatagtgtgtcactcgtggttggtgtcctttcatgcttctgccctgtcaaaggtccctatttgaaatgtgttataatacaaacaaggaagcacattgtgtacaaaatacttatgtatttatgaatccatgaccaaattaaatatgaaaccttatataaaaaaaggtg

SEQ ID NO: 278760 - DNA, 1344 bp, Homo sapiens
aggctgaatggaggctgaatggagaggctgaatggacagaggtgaatggtgtgaaatggttgccatctcaggagtagatggcccggctcacttctggttatctgtcaccctgagcccatgagctgccttttagggtacagattgcctacttgaggaccttggccgctctgtaagcatctgactcatctcagaaatgtcaattcttaaacactgtggcaacaggacctagaatggctgacgcattaaggttttcttcttgtgtcctgttctattattgttttaagacctcagtaaccatttcagcctctttccagcaaacccttctccatagtatttcagtcatggaaggatcatttatgcaggtagtcattccaggagtttttggtcttttctgtctcaaggcattgtgtgttttgttccgggactggtttgggtgggacaaagttagaattgcctgaagatcacacattcagactgttgtgtctgtggagttttaggagtggggggtgacctttctggtctttgcacttccatcctctcccacttccatctggcatcccacgcgttgtcccctgcacttctggaaggcacagggtgctgctgcctcctggtctttgcctttgctgggccttctgtgcaggacgctcagcctcagggctcagaaggtgccagtccggtcccaggtcccttgtcccttccacagaggccttcctagaagatgcatctagagtgtcagccttatcagtgtttaagatttttcttttatttttaatttttttgagacagaatctcactctctcgcccaggctggagtgcaacggtacgatcttggctcagtgcaacctccgcctcctgggttcaagcgattctcgtgcctcagcctccggagtagctgggattgcaggcacccgccaccacgcctggctaatttttgtatttttagtagagacggggtttcaccatgttggtcaggctggtctcgaactcctgacctcaggtgatccaccttggcctccgaaagtgctgggattacaggcgtgagccaccagccaggccaagctattcttttaaagtaagcttcctgacgacatgaaataattgggggttttgttgtttagttacattaggctttgctatatccccaggccaaatagcatgtgacacaggacagccatagtatagtgtgtcactcgtggttggtgtcctttcatgcttctgccctgtcaaaggtccctatttgaaatgtgttataatacaaacaaggaagcacattgtgtacaaaatacttatgtatttatgaatccatgaccaaattaaatatgaaaccttatataaaaaaaggtg

SEQ ID NO: 278761 - DNA, 1025 bp, Homo sapiens
cggacgcgtgggcgaccacgcgtccggtcttttctgtctcaaggcattgtgtgttttgttccgggactggtttgggtgggacaaagttagaattgcctgaagatcacacattcagactgttgtgtctgtggagttttaggagtggggggtgacctttctggtctttgcacttccatcctctcccacttccatctggcatcccacgcgttgtcccctgcacttctggaaggcacagggtgctgctgcctcctggtctttgcctttgctgggccttctgtgcaggacgctcagcctcagggctcagaaggtgccagtccggtcccaggtcccttgtcccttccacagaggccttcctagaagatgcatctagagtgtcagccttatcagtgtttaagatttttcttttatttttaatttttttgagacagaatctcactctctcgcccaggctggagtgcaacggtacgatcttggctcagtgcaacctccgcctcctgggttcaagcgattctcgtgcctcagcctccggagtagctgggattgcaggcacccgccaccacgcctggctaatttttgtatttttagtagagacggggtttcaccatgttggtcaggctggtctcgaactcctgacctcaggtgatccaccttggcctccgaaagtgctgggattacaggcgtgagccaccagccaggccaagctattcttttaaagtaagcttcctgacgacatgaaataattgggggttttgttgtttcttcctgacgacatgaaataattgggggttttgttgtttagttacattaggctttgctatatccccaggccaaatagcatgtgacacaggacagccatagtatagtgtgtcactcgtggttggtgtcctttcatgcttctgccctgtcaaaggtccctatttgaaatgtgttataatacaaacaaggaagcacattgtgtacaaaatacttatgtatttatgaatccatgaccaaattaaatatgaaaccttatataaaaaaaggtg

SEQ ID NO: 278762 - DNA, 2000 bp, Homo sapiens
  misc_feature (158)..(158): n is a, c, g, or t
gcgcttgcggaggattgcgttgacgagactcttatttattgtcaccaacctgtggtggaatttgcagttgcacattggatctgattcgccccgccccgaatgacgcctgcccggaggcagtgaaagtacagccgcgccgccccaagtcagcccggacncataaatcagcacgcggccggagaaccccgcaatctctgcgcccacaaaatacaccgacgatgcccgatctactttaagggctgaaacccacgggcctgagagactataagagcgttccctaccgccatggaacaacggggacagaacgccccggccgcttcgggggcccggaaaaggcacggcccaggacccagggaggcgcggggagccaggcctgggctccgggtccccaagacccttgtgctcgttgtcgccgcggtcctgctgttggtctcagctgagtctgctctgatcacccaacaagacctagctccccagcagagagcggccccacaacaaaagaggtccagcccctcagagggattgtgtccacctggacaccatatctcagaagacggtagagattgcatctcctgcaaatatggacaggactatagcactcactggaatgacctccttttctgcttgcgctgcaccaggtgtgattcaggtgaagtggagctaagtccctgcaccacgaccagaaacacagtgtgtcagtgcgaagaaggcaccttccgggaagaagattctcctgagatgtgccggaagtgccgcacagggtgtcccagagggatggtcaaggtcggtgattgtacaccctggagtgacatcgaatgtgtccacaaagaatcaggtacaaagcacagtggggaagccccagctgtggaggagacggtgacctccagcccagggactcctgcctctccctgttctctctcaggcatcatcataggagtcacagttgcagccgtagtcttgattgtggctgtgtttgtttgcaagtctttactgtggaagaaagtccttccttacctgaaaggcatctgctcaggtggtggtggggaccctgagcgtgtggacagaagctcacaacgacctggggctgaggacaatgtcctcaatgagatcgtgagtatcttgcagcccacccaggtccctgagcaggaaatggaagtccaggagccagcagagccaacaggtgtcaacatgttgtcccccggggagtcagagcatctgctggaaccggcagaagctgaaaggtctcagaggaggaggctgctggttccagcaaatgaaggtgatcccactgagactctgagacagtgcttcgatgactttgcagacttggtgccctttgactcctgggagccgctcatgaggaagttgggcctcatggacaatgagataaaggtggctaaagctgaggcagcgggccacagggacaccttgtacacgatgctgataaagtgggtcaacaaaaccgggcgagatgcctctgtccacaccctgctggatgccttggagacgctgggagagagacttgccaagcagaagattgaggaccacttgttgagctctggaaagttcatgtatctagaaggtaatgcagactctgccatgtcctaagtgtgattctcttcaggaagtgagaccttccctggtttaccttttttctggaaaaagcccaactggactccagtcagtaggaaagtgccacaattgtcacatgaccggtactggaagaaactctcccatccaacatcacccagtggatggaacatcctgtaacttttcactgcacttggcattatttttataagctgaatgtgataataaggacactatggaaatgtctggatcattccgtttgtgcgtactttgagatttggtttgggatgtcattgttttcacagcacttttttatcctaatgtaaatgctttatttatttatttgggctacattgtaagatccagcaggtcgtctcgtttcaagatctgtttaaactagttagctaggc

SEQ ID NO: 278763 - DNA, 3942 bp, Homo sapiens
  misc_feature (158)..(158): n is a, c, g, or t
gcgcttgcggaggattgcgttgacgagactcttatttattgtcaccaacctgtggtggaatttgcagttgcacattggatctgattcgccccgccccgaatgacgcctgcccggaggcagtgaaagtacagccgcgccgccccaagtcagcccggacncataaatcagcacgcggccggagaaccccgcaatctctgcgcccacaaaatacaccgacgatgcccgatctactttaagggctgaaacccacgggcctgagagactataagagcgttccctaccgccatggaacaacggggacagaacgccccggccgcttcgggggcccggaaaaggcacggcccaggacccagggaggcgcggggagccaggcctgggctccgggtccccaagacccttgtgctcgttgtcgccgcggtcctgctgttggtctcagctgagtctgctctgatcacccaacaagacctagctccccagcagagagcggccccacaacaaaagaggtccagcccctcagagggattgtgtccacctggacaccatatctcagaagacggtagagattgcatctcctgcaaatatggacaggactatagcactcactggaatgacctccttttctgcttgcgctgcaccaggtgtgattcaggtgaagtggagctaagtccctgcaccacgaccagaaacacagtgtgtcagtgcgaagaaggcaccttccgggaagaagattctcctgagatgtgccggaagtgccgcacagggtgtcccagagggatggtcaaggtcggtgattgtacaccctggagtgacatcgaatgtgtccacaaagaatcaggcatcatcataggagtcacagttgcagccgtagtcttgattgtggctgtgtttgtttgcaagtctttactgtggaagaaagtccttccttacctgaaaggcatctgctcaggtggtggtggggaccctgagcgtgtggacagaagctcacaacgacctggggctgaggacaatgtcctcaatgagatcgtgagtatcttgcagcccacccaggtccctgagcaggaaatggaagtccaggagccagcagagccaacaggtgtcaacatgttgtcccccggggagtcagagcatctgctggaaccggcagaagctgaaaggtctcagaggaggaggctgctggttccagcaaatgaaggtgatcccactgagactctgagacagtgcttcgatgactttgcagacttggtgccctttgactcctgggagccgctcatgaggaagttgggcctcatggacaatgagataaaggtggctaaagctgaggcagcgggccacagggacaccttgtacacgatgctgataaagtgggtcaacaaaaccgggcgagatgcctctgtccacaccctgctggatgccttggagacgctgggagagagacttgccaagcagaagattgaggaccacttgttgagctctggaaagttcatgtatctagaaggtaatgcagactctgccatgtcctaagtgtgattctcttcaggaagtgagaccttccctggtttaccttttttctggaaaaagcccaactggactccagtcagtaggaaagtgccacaattgtcacatgaccggtactggaagaaactctcccatccaacatcacccagtggatggaacatcctgtaacttttcactgcacttggcattatttttataagctgaatgtgataataaggacactatggaaatgtctggatcattccgtttgtgcgtactttgagatttggtttgggatgtcattgttttcacagcacttttttatcctaatgtaaatgctttatttatttatttgggctacattgtaagatccatctacacagtcgttgtccgacttcacttgatactatatgatatgaaccttttttgggtggggggtgcggggcagttcactctgtctcccaggctggagtgcaatggtgcaatcttggctcactatagccttgacctctcaggctcaagcgattctcccacctcagccatccaaatagctgggaccacaggtgtgcaccaccacgcccggctaattttttgtattttgtctagatataggggctctctatgttgctcagggtggtctcgaattcctggactcaagcagtctgcccacctcagactcccaaagcggtggaattagaggcgtgagcccccatgcttggccttacctttctacttttataattctgtatgttattattttatgaacatgaagaaactttagtaaatgtacttgtttacatagttatgtgaatagattagataaacataaaaggaggagacatacaatgggggaagaagaagaagtcccctgtaagatgtcactgtctgggttccagccctccctcagatgtactttggcttcaatgattggcaacttctacaggggccagtcttttgaactggacaaccttacaagtatatgagtattatttataggtagttgtttacatatgagtcgggaccaaagagaactggatccacgtgaagtcctgtgtgtggctggtccctacctgggcagtctcatttgcacccatagcccccatctatggacaggctgggacagaggcagatgggttagatcacacataacaatagggtctatgtcatatcccaagtgaacttgagccctgtttgggctcaggagatagaagacaaaatctgtctcccacgtctgccatggcatcaagggggaagagtagatggtgcttgagaatggtgtgaaatggttgccatctcaggagtagatggcccggctcacttctggttatctgtcaccctgagcccatgagctgccttttagggtacagattgcctacttgaggaccttggccgctctgtaagcatctgactcatctcagaaatgtcaattcttaaacactgtggcaacaggacctagaatggctgacgcattaaggttttcttcttgtgtcctgttctattattgttttaagacctcagtaaccatttcagcctctttccagcaaacccttctccatagtatttcagtcatggaaggatcatttatgcaggtagtcattccaggagtttttggtcttttctgtctcaaggcattgtgtgttttgttccgggactggtttgggtgggacaaagttagaattgcctgaagatcacacattcagactgttgtgtctgtggagttttaggagtggggggtgacctttctggtctttgcacttccatcctctcccacttccatctggcatcccacgcgttgtcccttccacagaggccttcctagaagatgcatctagagtgtcagccttatcagtgtttaagatttttcttttatttttaatttttttgagacagaatctcactctctcgcccaggctggagtgcaacggtacgatcttggctcagtgcaacctccgcctcctgggttcaagcgattctcgtgcctcagcctccggagtagctgggattgcaggcacccgccaccacgcctggctaatttttgtatttttagtagagacggggtttcaccatgttggtcaggctggtctcgaactcctgacctcaggtgatccaccttggcctccgaaagtgctgggattacaggcgtgagccaccagccaggccaagctattcttttaaagtaagcttcctgacgacatgaaataattgggggttttgttgtttagttacattaggctttgctatatccccaggccaaatagcatgtgacacaggacagccatagtatagtgtgtcactcgtggttggtgtcctttcatgcttctgccctgtcaaaggtccctatttgaaatgtgttataatacaaacaaggaagcacattgtgtacaaaatacttatgtatttatgaatccatgaccaaattaaatatgaaaccttatataaaaaaaggtg

SEQ ID NO: 278764 - DNA, 3928 bp, Homo sapiens
  misc_feature (158)..(158): n is a, c, g, or t
gcgcttgcggaggattgcgttgacgagactcttatttattgtcaccaacctgtggtggaatttgcagttgcacattggatctgattcgccccgccccgaatgacgcctgcccggaggcagtgaaagtacagccgcgccgccccaagtcagcccggacncataaatcagcacgcggccggagaaccccgcaatctctgcgcccacaaaatacaccgacgatgcccgatctactttaagggctgaaacccacgggcctgagagactataagagcgttccctaccgccatggaacaacggggacagaacgccccggccgcttcgggggcccggaaaaggcacggcccaggacccagggaggcgcggggagccaggcctgggctccgggtccccaagacccttgtgctcgttgtcgccgcggtcctgctgttggtctcagctgagtctgctctgatcacccaacaagacctagctccccagcagagagcggccccacaacaaaagaggtccagcccctcagagggattgtgtccacctggacaccatatctcagaagacggtagagattgcatctcctgcaaatatggacaggactatagcactcactggaatgacctccttttctgcttgcgctgcaccaggtgtgattcaggtgaagtggagctaagtccctgcaccacgaccagaaacacagtgtgtcagtgcgaagaaggcaccttccgggaagaagattctcctgagatgtgccggaagtgccgcacagggtgtcccagagggatggtcaaggtcggtgattgtacaccctggagtgacatcgaatgtgtccacaaagaatcaggcatcatcataggagtcacagttgcagccgtagtcttgattgtggctgtgtttgtttgcaagtctttactgtggaagaaagtccttccttacctgaaaggcatctgctcaggtggtggtggggaccctgagcgtgtggacagaagctcacaacgacctggggctgaggacaatgtcctcaatgagatcgtgagtatcttgcagcccacccaggtccctgagcaggaaatggaagtccaggagccagcagagccaacaggtgtcaacatgttgtcccccggggagtcagagcatctgctggaaccggcagaagctgaaaggtctcagaggaggaggctgctggttccagcaaatgaaggtgatcccactgagactctgagacagtgcttcgatgactttgcagacttggtgccctttgactcctgggagccgctcatgaggaagttgggcctcatggacaatgagataaaggtggctaaagctgaggcagcgggccacagggacaccttgtacacgatgctgataaagtgggtcaacaaaaccgggcgagatgcctctgtccacaccctgctggatgccttggagacgctgggagagagacttgccaagcagaagattgaggaccacttgttgagctctggaaagttcatgtatctagaaggtaatgcagactctgccatgtcctaagtgtgattctcttcaggaagtgagaccttccctggtttaccttttttctggaaaaagcccaactggactccagtcagtaggaaagtgccacaattgtcacatgaccggtactggaagaaactctcccatccaacatcacccagtggatggaacatcctgtaacttttcactgcacttggcattatttttataagctgaatgtgataataaggacactatggaaatgtctggatcattccgtttgtgcgtactttgagatttggtttgggatgtcattgttttcacagcacttttttatcctaatgtaaatgctttatttatttatttgggctacattgtaagatccatctacacagtcgttgtccgacttcacttgatactatatgatatgaaccttttttgggtggggggtgcggggcagttcactctgtctcccaggctggagtgcaatggtgcaatcttggctcactatagccttgacctctcaggctcaagcgattctcccacctcagccatccaaatagctgggaccacaggtgtgcaccaccacgcccggctaattttttgtattttgtctagatataggggctctctatgttgctcagggtggtctcgaattcctggactcaagcagtctgcccacctcagactcccaaagcggtggaattagaggcgtgagcccccatgcttggccttacctttctacttttataattctgtatgttattattttatgaacatgaagaaactttagtaaatgtacttgtttacatagttatgtgaatagattagataaacataaaaggaggagacatacaatgggggaagaagaagaagtcccctgtaagatgtcactgtctgggttccagccctccctcagatgtactttggcttcaatgattggcaacttctacaggggccagtcttttgaactggacaaccttacaagtatatgagtattatttataggtagttgtttacatatgagtcgggaccaaagagaactggatccacgtgaagtcctgtgtgtggctggtccctacctgggcagtctcatttgcacccatagcccccatctatggacaggctgggacagaggcagatgggttagatcacacataacaatagggtctatgtcatatcccaagtgaacttgagccctgtttgggctcaggagatagaagacaaaatctgtctcccacgtctgccatggcatcaagggggaagagtagatggtgcttgagaatggtgtgaaatggttgccatctcaggagtagatggcccggctcacttctggttatctgtcaccctgagcccatgagctgccttttagggtacagattgcctacttgaggaccttggccgctctgtaagcatctgactcatctcagaaatgtcaattcttaaacactgtggcaacaggacctagaatggctgacgcattaaggttttcttcttgtgtcctgttctattattgttttaagacctcagtaaccatttcagcctctttccagcaaacccttctccatagtatttcagtcatggaaggatcatttatgcaggtagtcattccaggagtttttggtcttttctgtctcaaggcattgtgtgttttgttccgggactggtttgggtgggacaaagttagaattgcctgaagatcacacattcagactgttgtgtctgtggagttttaggagtggggggtgacctttctggtctttgcacttccatcctctcccacttccatctggcatcccacgcgttgtcccctgcacttctggaaggcacagggtgctgctgcctcctggtctttgcctttgctgggccttctgtgcaggacgctcagcctcagggctcagaaggtgccagtccggtcccaggtcccttgtcccttccacagaggccttcctagaagatgcatctagagtgtcagccttatcagtgtttaagatttttcttttatttttaatttttttgagacagaatctcactctctcgcccaggctggagtgcaacggtacgatcttggctcagtgcaacctccgcctcctgggttcaagcgattctcgtgcctcagcctccggagtagttacaggcgtgagccaccagccaggccaagctattcttttaaagtaagcttcctgacgacatgaaataattgggggttttgttgtttagttacattaggctttgctatatccccaggccaaatagcatgtgacacaggacagccatagtatagtgtgtcactcgtggttggtgtcctttcatgcttctgccctgtcaaaggtccctatttgaaatgtgttataatacaaacaaggaagcacattgtgtacaaaatacttatgtatttatgaatccatgaccaaattaaatatgaaaccttatataaaaaaaggtg

SEQ ID NO: 278765 - DNA, 3505 bp, Homo sapiens
  misc_feature (158)..(158): n is a, c, g, or t
gcgcttgcggaggattgcgttgacgagactcttatttattgtcaccaacctgtggtggaatttgcagttgcacattggatctgattcgccccgccccgaatgacgcctgcccggaggcagtgaaagtacagccgcgccgccccaagtcagcccggacncataaatcagcacgcggccggagaaccccgcaatctctgcgcccacaaaatacaccgacgatgcccgatctactttaagggctgaaacccacgggcctgagagactataagagcgttccctaccgccatggaacaacggggacagaacgccccggccgcttcgggggcccggaaaaggcacggcccaggacccagggaggcgcggggagccaggcctgggctccgggtccccaagacccttgtgctcgttgtcgccgcggtcctgctgttggtctcagctgagtctgctctgatcacccaacaagacctagctccccagcagagagcggccccacaacaaaagaggtccagcccctcagagggattgtgtccacctggacaccatatctcagaagacggtagagattgcatctcctgcaaatatggacaggactatagcactcactggaatgacctccttttctgcttgcgctgcaccaggtgtgattcaggtgaagtggagctaagtccctgcaccacgaccagaaacacagtgtgtcagtgcgaagaaggcaccttccgggaagaagattctcctgagatgtgccggaagtgccgcacagggtgtcccagagggatggtcaaggtcggtgattgtacaccctggagtgacatcgaatgtgtccacaaagaatcaggcatcatcataggagtcacagttgcagccgtagtcttgattgtggctgtgtttgtttgcaagtctttactgtggaagaaagtccttccttacctgaaaggcatctgctcaggtggtggtggggaccctgagcgtgtggacagaagctcacaacgacctggggctgaggacaatgtcctcaatgagatcgtgagtatcttgcagcccacccaggtccctgagcaggaaatggaagtccaggagccagcagagccaacaggtgtcaacatgttgtcccccggggagtcagagcatctgctggaaccggcagaagctgaaaggtctcagaggaggaggctgctggttccagcaaatgaaggtgatcccactgagactctgagacagtgcttcgatgactttgcagacttggtgccctttgactcctgggagccgctcatgaggaagttgggcctcatggacaatgagataaaggtggctaaagctgaggcagcgggccacagggacaccttgtacacgatgctgataaagtgggtcaacaaaaccgggcgagatgcctctgtccacaccctgctggatgccttggagacgctgggagagagacttgccaagcagaagattgaggaccacttgttgagctctggaaagttcatgtatctagaaggtaatgcagactctgccatgtcctaagtgtgattctcttcaggaagtgagaccttccctggtttaccttttttctggaaaaagcccaactggactccagtcagtaggaaagtgccacaattgtcacatgaccggtactggaagaaactctcccatccaacatcacccagtggatggaacatcctgtaacttttcactgcacttggcattatttttataagctgaatgtgataataaggacactatggaaatgtctggatcattccgtttgtgcgtactttgagatttggtttgggatgtcattgttttcacagcacttttttatcctaatgtaaatgctttatttatttatttgggctacattgtaagatccatctacacagtcgttgtccgacttcacttgatactatatgatatgaaccttttttgggtggggggtgcggggcagttcactctgtctcccaggctggagtgcaatggtgcaatcttggctcactatagccttgacctctcaggctcaagcgattctcccacctcagccatccaaatagctgggaccacaggtgtgcaccaccacgcccggctaattttttgtattttgtctagatataggggctctctatgttgctcagggtggtctcgaattcctggactcaagcagtctgcccacctcagactcccaaagcggtggaattagaggcgtgagcccccatgcttggccttacctttctacttttataattctgtatgttattattttatgaacatgaagaaactttagtaaatgtacttgtttacatagttatgtgaatagattagataaacataaaaggaggagacatacaatgggggaagaagaagaagtcccctgtaagatgtcactgtctgggttccagccctccctcagatgtactttggcttcaatgattggcaacttctacaggggccagtcttttgaactggacaaccttacaagtatatgagtattatttataggtagttgtttacatatgagtcgggaccaaagagaactggatccacgtgaagtcctgtgtgtggctggtccctacctgggcagtctcatttgcacccatagcccccatctatggacaggctgggacagaggcagatgggttagatcacacataacaatagggtctatgtcatatcccaagtgaacttgagccctgtttgggctcaggagatagaagacaaaatctgtctcccacgtctgccatggcatcaagggggaagagtagatggtgcttgagaatggtgtgaaatggttgccatctcaggagtagatggcccggctcacttctggttatctgtcaccctgagcccatgagctgccttttagggtacagattgcctacttgaggaccttggccgctctgtaagcatctgactcatctcagaaatgtcaattcttaaacactgtggcaacaggacctagaatggctgacgcattaaggttttcttcttgtgtcctgttctattattgttttaagacctcagtaaccatttcagcctctttccagcaaacccttctccatagtatttcagtcatggaaggatcatttatgcaggtagtcattccaggagtttttggtcttttctgtctcaaggcattgtgtgttttgttccgggactggtttgggtgggacaaagttagaattgcctgaagatcacacattcagactgttgtgtctgtggagttttaggagtggggggtgacctttctggtctttgcacttccatcctctcccacttccatctggcatcccacgcgttgtcccctgcacttctggaaggcacagggtgctgctgcctcctggtctttgcctttgctgggccttctgtgcaggacgctcagcctcagggctcagaaggtgccagtccggtcccaggtcccttgtcccttccacagaggccttcctagaagatgcatctagagtgtcagcctgagcaacaagagcgaaactctgtctcaaaaaaaagaaaaattata

SEQ ID NO: 278766 - DNA, 3959 bp, Homo sapiens
  misc_feature (158)..(158): n is a, c, g, or t
gcgcttgcggaggattgcgttgacgagactcttatttattgtcaccaacctgtggtggaatttgcagttgcacattggatctgattcgccccgccccgaatgacgcctgcccggaggcagtgaaagtacagccgcgccgccccaagtcagcccggacncataaatcagcacgcggccggagaaccccgcaatctctgcgcccacaaaatacaccgacgatgcccgatctactttaagggctgaaacccacgggcctgagagactataagagcgttccctaccgccatggaacaacggggacagaacgccccggccgcttcgggggcccggaaaaggcacggcccaggacccagggaggcgcggggagccaggcctgggctccgggtccccaagacccttgtgctcgttgtcgccgcggtcctgctgttggacaccatatctcagaagacggtagagattgcatctcctgcaaatatggacaggactatagcactcactggaatgacctccttttctgcttgcgctgcaccaggtgtgattcaggtgaagtggagctaagtccctgcaccacgaccagaaacacagtgtgtcagtgcgaagaaggcaccttccgggaagaagattctcctgagatgtgccggaagtgccgcacagggtgtcccagagggatggtcaaggtcggtgattgtacaccctggagtgacatcgaatgtgtccacaaagaatcaggcatcatcataggagtcacagttgcagccgtagtcttgattgtggctgtgtttgtttgcaagtctttactgtggaagaaagtccttccttacctgaaaggcatctgctcaggtggtggtggggaccctgagcgtgtggacagaagctcacaacgacctggggctgaggacaatgtcctcaatgagatcgtgagtatcttgcagcccacccaggtccctgagcaggaaatggaagtccaggagccagcagagccaacaggtgtcaacatgttgtcccccggggagtcagagcatctgctggaaccggcagaagctgaaaggtctcagaggaggaggctgctggttccagcaaatgaaggtgatcccactgagactctgagacagtgcttcgatgactttgcagacttggtgccctttgactcctgggagccgctcatgaggaagttgggcctcatggacaatgagataaaggtggctaaagctgaggcagcgggccacagggacaccttgtacacgatgctgataaagtgggtcaacaaaaccgggcgagatgcctctgtccacaccctgctggatgccttggagacgctgggagagagacttgccaagcagaagattgaggaccacttgttgagctctggaaagttcatgtatctagaaggtaatgcagactctgccatgtcctaagtgtgattctcttcaggaagtgagaccttccctggtttaccttttttctggaaaaagcccaactggactccagtcagtaggaaagtgccacaattgtcacatgaccggtactggaagaaactctcccatccaacatcacccagtggatggaacatcctgtaacttttcactgcacttggcattatttttataagctgaatgtgataataaggacactatggaaatgtctggatcattccgtttgtgcgtactttgagatttggtttgggatgtcattgttttcacagcacttttttatcctaatgtaaatgctttatttatttatttgggctacattgtaagatccatctacacagtcgttgtccgacttcacttgatactatatgatatgaaccttttttgggtggggggtgcggggcagttcactctgtctcccaggctggagtgcaatggtgcaatcttggctcactatagccttgacctctcaggctcaagcgattctcccacctcagccatccaaatagctgggaccacaggtgtgcaccaccacgcccggctaattttttgtattttgtctagatataggggctctctatgttgctcagggtggtctcgaattcctggactcaagcagtctgcccacctcagactcccaaagcggtggaattagaggcgtgagcccccatgcttggccttacctttctacttttataattctgtatgttattattttatgaacatgaagaaactttagtaaatgtacttgtttacatagttatgtgaatagattagataaacataaaaggaggagacatacaatgggggaagaagaagaagtcccctgtaagatgtcactgtctgggttccagccctccctcagatgtactttggcttcaatgattggcaacttctacaggggccagtcttttgaactggacaaccttacaagtatatgagtattatttataggtagttgtttacatatgagtcgggaccaaagagaactggatccacgtgaagtcctgtgtgtggctggtccctacctgggcagtctcatttgcacccatagcccccatctatggacaggctgggacagaggcagatgggttagatcacacataacaatagggtctatgtcatatcccaagtgaacttgagccctgtttgggctcaggagatagaagacaaaatctgtctcccacgtctgccatggcatcaagggggaagagtagatggtgcttgagaatggtgtgaaatggttgccatctcaggagtagatggcccggctcacttctggttatctgtcaccctgagcccatgagctgccttttagggtacagattgcctacttgaggaccttggccgctctgtaagcatctgactcatctcagaaatgtcaattcttaaacactgtggcaacaggacctagaatggctgacgcattaaggttttcttcttgtgtcctgttctattattgttttaagacctcagtaaccatttcagcctctttccagcaaacccttctccatagtatttcagtcatggaaggatcatttatgcaggtagtcattccaggagtttttggtcttttctgtctcaaggcattgtgtgttttgttccgggactggtttgggtgggacaaagttagaattgcctgaagatcacacattcagactgttgtgtctgtggagttttaggagtggggggtgacctttctggtctttgcacttccatcctctcccacttccatctggcatcccacgcgttgtcccctgcacttctggaaggcacagggtgctgctgcctcctggtctttgcctttgctgggccttctgtgcaggacgctcagcctcagggctcagaaggtgccagtccggtcccaggtcccttgtcccttccacagaggccttcctagaagatgcatctagagtgtcagccttatcagtgtttaagatttttcttttatttttaatttttttgagacagaatctcactctctcgcccaggctggagtgcaacggtacgatcttggctcagtgcaacctccgcctcctgggttcaagcgattctcgtgcctcagcctccggagtagctgggattgcaggcacccgccaccacgcctggctaatttttgtatttttagtagagacggggtttcaccatgttggtcaggctggtctcgaactcctgacctcaggtgatccaccttggcctccgaaagtgctgggattacaggcgtgagccaccagccaggccaagctattcttttaaagtaagcttcctgacgacatgaaataattgggggttttgttgtttagttacattaggctttgctatatccccaggccaaatagcatgtgacacaggacagccatagtatagtgtgtcactcgtggttggtgtcctttcatgcttctgccctgtcaaaggtccctatttgaaatgtgttataatacaaacaaggaagcacattgtgtacaaaatacttatgtatttatgaatccatgaccaaattaaatatgaaaccttatataaaaaaaggtg

SEQ ID NO: 278767 - DNA, 3888 bp, Homo sapiens
  misc_feature (158)..(158): n is a, c, g, or t
gcgcttgcggaggattgcgttgacgagactcttatttattgtcaccaacctgtggtggaatttgcagttgcacattggatctgattcgccccgccccgaatgacgcctgcccggaggcagtgaaagtacagccgcgccgccccaagtcagcccggacncataaatcagcacgcggccggagaaccccgcaatctctgcgcccacaaaatacaccgacgatgcccgatctactttaagggctgaaacccacgggcctgagagactataagagcgttccctaccgccatggaacaacggggacagaacgccccggccgcttcgggggcccggaaaaggcacggcccaggacccagggaggcgcggggagccaggcctgggctccgggtccccaagacccttgtgctcgttgtcgccgcggtcctgctgttggtctcagctgagtctgctctgatcacccaacaagacctagctccccagcagagagcggccccacaacaaaagaggtccagcccctcagagggattgtgtccacctggacaccatatctcagaagacggtagagattgcatctcctgcaaatatggacaggactatagcactcactggaatgacctccttttctgcttgcgctgcaccaggtgtgattcaggtgaagtggagctaagtccctgcaccacgaccagaaacacagtgtgtcagtgcgaagaaggcaccttccgggaagaagattctcctgagatgtgccggaagtgccgcacagggtgtcccagagggatggtcaaggtcggtgattgtacaccctggagtgacatcgaatgtgtccacaaagaatcaggtacaaagcacagtggggaagccccagctgtggaggagacggtgacctccagcccagggactcctgcctctccctgttctctctcaggcatcatcataggagtcacagttgcagccgtagtcttgattgtggctgtgtttgtttgcaagtctttactgtggaagaaagtccttccttacctgaaaggcatctgctcaggtggtggtggggaccctgagcgtgtggacagaagctcacaacgacctggggctgaggacaatgtcctcaatgagatcgtgagtatcttgcagcccacccaggtccctgagcaggaaatggaagtccaggagccagcagagccaacaggtaagtgggtcaacaaaaccgggcgagatgcctctgtccacaccctgctggatgccttggagacgctgggagagagacttgccaagcagaagattgaggaccacttgttgagctctggaaagttcatgtatctagaaggtaatgcagactctgccatgtcctaagtgtgattctcttcaggaagtgagaccttccctggtttaccttttttctggaaaaagcccaactggactccagtcagtaggaaagtgccacaattgtcacatgaccggtactggaagaaactctcccatccaacatcacccagtggatggaacatcctgtaacttttcactgcacttggcattatttttataagctgaatgtgataataaggacactatggaaatgtctggatcattccgtttgtgcgtactttgagatttggtttgggatgtcattgttttcacagcacttttttatcctaatgtaaatgctttatttatttatttgggctacattgtaagatccatctacacagtcgttgtccgacttcacttgatactatatgatatgaaccttttttgggtggggggtgcggggcagttcactctgtctcccaggctggagtgcaatggtgcaatcttggctcactatagccttgacctctcaggctcaagcgattctcccacctcagccatccaaatagctgggaccacaggtgtgcaccaccacgcccggctaattttttgtattttgtctagatataggggctctctatgttgctcagggtggtctcgaattcctggactcaagcagtctgcccacctcagactcccaaagcggtggaattagaggcgtgagcccccatgcttggccttacctttctacttttataattctgtatgttattattttatgaacatgaagaaactttagtaaatgtacttgtttacatagttatgtgaatagattagataaacataaaaggaggagacatacaatgggggaagaagaagaagtcccctgtaagatgtcactgtctgggttccagccctccctcagatgtactttggcttcaatgattggcaacttctacaggggccagtcttttgaactggacaaccttacaagtatatgagtattatttataggtagttgtttacatatgagtcgggaccaaagagaactggatccacgtgaagtcctgtgtgtggctggtccctacctgggcagtctcatttgcacccatagcccccatctatggacaggctgggacagaggcagatgggttagatcacacataacaatagggtctatgtcatatcccaagtgaacttgagccctgtttgggctcaggagatagaagacaaaatctgtctcccacgtctgccatggcatcaagggggaagagtagatggtgcttgagaatggtgtgaaatggttgccatctcaggagtagatggcccggctcacttctggttatctgtcaccctgagcccatgagctgccttttagggtacagattgcctacttgaggaccttggccgctctgtaagcatctgactcatctcagaaatgtcaattcttaaacactgtggcaacaggacctagaatggctgacgcattaaggttttcttcttgtgtcctgttctattattgttttaagacctcagtaaccatttcagcctctttccagcaaacccttctccatagtatttcagtcatggaaggatcatttatgcaggtagtcattccaggagtttttggtcttttctgtctcaaggcattgtgtgttttgttccgggactggtttgggtgggacaaagttagaattgcctgaagatcacacattcagactgttgtgtctgtggagttttaggagtggggggtgacctttctggtctttgcacttccatcctctcccacttccatctggcatcccacgcgttgtcccctgcacttctggaaggcacagggtgctgctgcctcctggtctttgcctttgctgggccttctgtgcaggacgctcagcctcagggctcagaaggtgccagtccggtcccaggtcccttgtcccttccacagaggccttcctagaagatgcatctagagtgtcagccttatcagtgtttaagatttttcttttatttttaatttttttgagacagaatctcactctctcgcccaggctggagtgcaacggtacgatcttggctcagtgcaacctccgcctcctgggttcaagcgattctcgtgcctcagcctccggagtagctgggattgcaggcacccgccaccacgcctggctaatttttgtatttttagtagagacggggtttcaccatgttggtcaggctggtctcgaactcctgacctcaggtgatccaccttggcctccgaaagtgctgggattacaggcgtgagccaccagccaggccaagctattcttttaaagtaagcttcctgacgacatgaaataattgggggttttgttgtttagttacattaggctttgctatatccccaggccaaatagcatgtgacacaggacagccatagtatagtgtgtcactcgtggttggtgtcctttcatgcttctgccctgtcaaaggtccctatttgaaatgtgttataatacaaacaaggaagcacattgtgtacaaaatacttatgtatttatgaatccatgaccaaattaaatatgaaaccttatataaaaaaaggtg

SEQ ID NO: 278768 - DNA, 4107 bp, Homo sapiens
  misc_feature (158)..(158): n is a, c, g, or t
gcgcttgcggaggattgcgttgacgagactcttatttattgtcaccaacctgtggtggaatttgcagttgcacattggatctgattcgccccgccccgaatgacgcctgcccggaggcagtgaaagtacagccgcgccgccccaagtcagcccggacncataaatcagcacgcggccggagaaccccgcaatctctgcgcccacaaaatacaccgacgatgcccgatctactttaagggctgaaacccacgggcctgagagactataagagcgttccctaccgccatggaacaacggggacagaacgccccggccgcttcgggggcccggaaaaggcacggcccaggacccagggaggcgcggggagccaggcctgggctccgggtccccaagacccttgtgctcgttgtcgccgcggtcctgctgttggtctcagctgagtctgctctgatcacccaacaagacctagctccccagcagagagcggccccacaacaaaagaggtccagcccctcagagggattgtgtccacctggacaccatatctcagaagacggtagagattgcatctcctgcaaatatggacaggactatagcactcactggaatgacctccttttctgcttgcgctgcaccaggtgtgattcaggtgaagtggagctaagtccctgcaccacgaccagaaacacagtgtgtcagtgcgaagaaggcaccttccgggaagaagattctcctgagatgtgccggaagtgccgcacagggtgtcccagagggatggtcaaggtcggtgattgtacaccctggagtgacatcgaatgtgtccacaaagaatcaggtacaaagcacagtggggaagccccagctgtggaggagacggtgacctccagcccagggactcctgcctctccctgttctctctcaggcatcatcataggagtcacagttgcagccgtagtcttgattgtggctgtgtttgtttgcaagtctttactgtggaagaaagtccttccttacctgaaaggcatctgctcaggtggtggtggggaccctgagcgtgtggacagaagctcacaacgacctggggctgaggacaatgtcctcaatgagatcgtgagtatcttgcagcccacccaggtccctgagcaggaaatggaagtccaggagccagcagagccaacaggtgtcaacatgttgtcccccggggagtcagagcatctgctggaaccggcagaagctgaaaggtctcagaggaggaggctgctggttccagcaaatgaaggtgatcccactgagactctgagacagtgcttcgatgactttgcagacttggtgccctttgactcctgggagccgctcatgaggaagttgggcctcatggacaatgagataaaggtggctaaagctgaggcagcgggccacagggacaccttgtacacgatgctgatactggatgccttggagacgctgggagagagacttgccaagcagaagattgaggaccacttgttgagctctggaaagttcatgtatctagaaggtaatgcagactctgccatgtcctaagtgtgattctcttcaggaagtgagaccttccctggtttaccttttttctggaaaaagcccaactggactccagtcagtaggaaagtgccacaattgtcacatgaccggtactggaagaaactctcccatccaacatcacccagtggatggaacatcctgtaacttttcactgcacttggcattatttttataagctgaatgtgataataaggacactatggaaatgtctggatcattccgtttgtgcgtactttgagatttggtttgggatgtcattgttttcacagcacttttttatcctaatgtaaatgctttatttatttatttgggctacattgtaagatccatctacacagtcgttgtccgacttcacttgatactatatgatatgaaccttttttgggtggggggtgcggggcagttcactctgtctcccaggctggagtgcaatggtgcaatcttggctcactatagccttgacctctcaggctcaagcgattctcccacctcagccatccaaatagctgggaccacaggtgtgcaccaccacgcccggctaattttttgtattttgtctagatataggggctctctatgttgctcagggtggtctcgaattcctggactcaagcagtctgcccacctcagactcccaaagcggtggaattagaggcgtgagcccccatgcttggccttacctttctacttttataattctgtatgttattattttatgaacatgaagaaactttagtaaatgtacttgtttacatagttatgtgaatagattagataaacataaaaggaggagacatacaatgggggaagaagaagaagtcccctgtaagatgtcactgtctgggttccagccctccctcagatgtactttggcttcaatgattggcaacttctacaggggccagtcttttgaactggacaaccttacaagtatatgagtattatttataggtagttgtttacatatgagtcgggaccaaagagaactggatccacgtgaagtcctgtgtgtggctggtccctacctgggcagtctcatttgcacccatagcccccatctatggacaggctgggacagaggcagatgggttagatcacacataacaatagggtctatgtcatatcccaagtgaacttgagccctgtttgggctcaggagatagaagacaaaatctgtctcccacgtctgccatggcatcaagggggaagagtagatggtgcttgagaatggtgtgaaatggttgccatctcaggagtagatggcccggctcacttctggttatctgtcaccctgagcccatgagctgccttttagggtacagattgcctacttgaggaccttggccgctctgtaagcatctgactcatctcagaaatgtcaattcttaaacactgtggcaacaggacctagaatggctgacgcattaaggttttcttcttgtgtcctgttctattattgttttaagacctcagtaaccatttcagcctctttccagcaaacccttctccatagtatttcagtcatggaaggatcatttatgcaggtagtcattccaggagtttttggtcttttctgtctcaaggcattgtgtgttttgttccgggactggtttgggtgggacaaagttagaattgcctgaagatcacacattcagactgttgtgtctgtggagttttaggagtggggggtgacctttctggtctttgcacttccatcctctcccacttccatctggcatcccacgcgttgtcccctgcacttctggaaggcacagggtgctgctgcctcctggtctttgcctttgctgggccttctgtgcaggacgctcagcctcagggctcagaaggtgccagtccggtcccaggtcccttgtcccttccacagaggccttcctagaagatgcatctagagtgtcagccttatcagtgtttaagatttttcttttatttttaatttttttgagacagaatctcactctctcgcccaggctggagtgcaacggtacgatcttggctcagtgcaacctccgcctcctgggttcaagcgattctcgtgcctcagcctccggagtagctgggattgcaggcacccgccaccacgcctggctaatttttgtatttttagtagagacggggtttcaccatgttggtcaggctggtctcgaactcctgacctcaggtgatccaccttggcctccgaaagtgctgggattacaggcgtgagccaccagccaggccaagctattcttttaaagtaagcttcctgacgacatgaaataattgggggttttgttgtttagttacattaggctttgctatatccccaggccaaatagcatgtgacacaggacagccatagtatagtgtgtcactcgtggttggtgtcctttcatgcttctgccctgtcaaaggtccctatttgaaatgtgttataatacaaacaaggaagcacattgtgtacaaaatacttatgtatttatgaatccatgaccaaattaaatatgaaaccttatataaaaaaaggtg

SEQ ID NO: 278769 - DNA, 3743 bp, Homo sapiens
  misc_feature (158)..(158): n is a, c, g, or t
gcgcttgcggaggattgcgttgacgagactcttatttattgtcaccaacctgtggtggaatttgcagttgcacattggatctgattcgccccgccccgaatgacgcctgcccggaggcagtgaaagtacagccgcgccgccccaagtcagcccggacncataaatcagcacgcggccggagaaccccgcaatctctgcgcccacaaaatacaccgacgatgcccgatctactttaagggctgaaacccacgggcctgagagactataagagcgttccctaccgccatggaacaacggggacagaacgccccggccgcttcgggggcccggaaaaggcacggcccaggacccagggaggcgcggggagccaggcctgggctccgggtccccaagacccttgtgctcgttgtcgccgcggtcctgctgttggtctcagctgagtctgctctgatcacccaacaagacctagctccccagcagagagcggccccacaacaaaagaggtccagcccctcagagggattgtgtccacctggacaccatatctcagaagacggtagagattgcatctcctgcaaatatggacaggactatagcactcactggaatgacctccttttctgcttgcgctgcaccaggtgtgattcaggtgaagtggagctaagtccctgcaccacgaccagaaacacagtgtgtcagtgcgaagaaggcaccttccgggaagaagattctcctgagatgtgccggaagtgccgcacagggtgtcccagagggatggtcaaggtcggtgattgtacaccctggagtgacatcgaatgtgtccacaaagaatcaggtacaaagcacagtggggaagccccagctgtggaggagacggtgacctccagcccagggactcctgcctctccctgttctctctcaggcatcatcataggagtcacagttgcagccgtagtcttgattgtggctgtgtttgtttgcaagtctttactgtggaagaaagtccttccttacctgaaaggcatctgctcaggtggtggtggggaccctgagcgtgtggacagaagctcacaacgacctggggctgaggacaatgtcctcaatgagatcgtgagtatcttgcagcccacccaggtccctgagcaggaaatggaaagttcatgtatctagaaggtaatgcagactctgccatgtcctaagtgtgattctcttcaggaagtgagaccttccctggtttaccttttttctggaaaaagcccaactggactccagtcagtaggaaagtgccacaattgtcacatgaccggtactggaagaaactctcccatccaacatcacccagtggatggaacatcctgtaacttttcactgcacttggcattatttttataagctgaatgtgataataaggacactatggaaatgtctggatcattccgtttgtgcgtactttgagatttggtttgggatgtcattgttttcacagcacttttttatcctaatgtaaatgctttatttatttatttgggctacattgtaagatccatctacacagtcgttgtccgacttcacttgatactatatgatatgaaccttttttgggtggggggtgcggggcagttcactctgtctcccaggctggagtgcaatggtgcaatcttggctcactatagccttgacctctcaggctcaagcgattctcccacctcagccatccaaatagctgggaccacaggtgtgcaccaccacgcccggctaattttttgtattttgtctagatataggggctctctatgttgctcagggtggtctcgaattcctggactcaagcagtctgcccacctcagactcccaaagcggtggaattagaggcgtgagcccccatgcttggccttacctttctacttttataattctgtatgttattattttatgaacatgaagaaactttagtaaatgtacttgtttacatagttatgtgaatagattagataaacataaaaggaggagacatacaatgggggaagaagaagaagtcccctgtaagatgtcactgtctgggttccagccctccctcagatgtactttggcttcaatgattggcaacttctacaggggccagtcttttgaactggacaaccttacaagtatatgagtattatttataggtagttgtttacatatgagtcgggaccaaagagaactggatccacgtgaagtcctgtgtgtggctggtccctacctgggcagtctcatttgcacccatagcccccatctatggacaggctgggacagaggcagatgggttagatcacacataacaatagggtctatgtcatatcccaagtgaacttgagccctgtttgggctcaggagatagaagacaaaatctgtctcccacgtctgccatggcatcaagggggaagagtagatggtgcttgagaatggtgtgaaatggttgccatctcaggagtagatggcccggctcacttctggttatctgtcaccctgagcccatgagctgccttttagggtacagattgcctacttgaggaccttggccgctctgtaagcatctgactcatctcagaaatgtcaattcttaaacactgtggcaacaggacctagaatggctgacgcattaaggttttcttcttgtgtcctgttctattattgttttaagacctcagtaaccatttcagcctctttccagcaaacccttctccatagtatttcagtcatggaaggatcatttatgcaggtagtcattccaggagtttttggtcttttctgtctcaaggcattgtgtgttttgttccgggactggtttgggtgggacaaagttagaattgcctgaagatcacacattcagactgttgtgtctgtggagttttaggagtggggggtgacctttctggtctttgcacttccatcctctcccacttccatctggcatcccacgcgttgtcccctgcacttctggaaggcacagggtgctgctgcctcctggtctttgcctttgctgggccttctgtgcaggacgctcagcctcagggctcagaaggtgccagtccggtcccaggtcccttgtcccttccacagaggccttcctagaagatgcatctagagtgtcagccttatcagtgtttaagatttttcttttatttttaatttttttgagacagaatctcactctctcgcccaggctggagtgcaacggtacgatcttggctcagtgcaacctccgcctcctgggttcaagcgattctcgtgcctcagcctccggagtagctgggattgcaggcacccgccaccacgcctggctaatttttgtatttttagtagagacggggtttcaccatgttggtcaggctggtctcgaactcctgacctcaggtgatccaccttggcctccgaaagtgctgggattacaggcgtgagccaccagccaggccaagctattcttttaaagtaagcttcctgacgacatgaaataattgggggttttgttgtttagttacattaggctttgctatatccccaggccaaatagcatgtgacacaggacagccatagtatagtgtgtcactcgtggttggtgtcctttcatgcttctgccctgtcaaaggtccctatttgaaatgtgttataatacaaacaaggaagcacattgtgtacaaaatacttatgtatttatgaatccatgaccaaattaaatatgaaaccttatataaaaaaaggtg

SEQ ID NO: 278770 - DNA, 481 bp, Homo sapiens
gaccttgccaggggcagtccatgaaagttgaatatgatctccttgaaacttagcctcgaggtctacaattttaccaggtgagaacacctgagaatgattaccattaggaggcactcctgatacagtaaacgaccctccagagaaattgattaagaaaacttagagaacataaaataatagacctacctctgcaatacctggtattcgaagacgggcagaccgaatatttagttcaccttcttgaaaatctgagccaactggactccaagtgccacgagaacagagattgggtctggtccccagcttcagtgcctccaaggcagaaactcaagagacgttgttgaactgtcagcctttacatttatgcattactattgaaggcctggaataaatggatcgtgttttacctgttatcttgctcatctctattactgcttcatcagcagctcttcccaaagcaataaaatgaacaatggcccca

SEQ ID NO: 278771 - DNA, 344 bp, Homo sapiens
gctgccttgtgaagaaggtgacacttcccctttcgcaatgattgtaagacctccccacccatgcagaactgaggtgataactggaagagagcagaaagggagcatctgggatactgccaactggactccaagtgccacgagaacagagattgggtctggtccccagcttcagtgcctccaaggcagaaactcaagagacgttgttgaactgtcagcctttacatttatgcattactattgaaggcctggaataaatggatcgtgttttacctgttatcttgctcatctctattactgcttcatcagcagctcttcccaaagcaataaaatgaacaatggcccca

SEQ ID NO: 278772 - DNA, 2220 bp, Homo sapiens
agcgggcttccttccggtcgttaacgcccacgggctcgcgcggcgccgcctcctgggctcagttaccgcggacgccagtgccgggctccaggagacgcagggcgacgccacacgccggggtggccgactgggtcagcgcgggctgcgcctcctcgccatgggccccctctcggcgcggctgctaatgcagcgcgggcgccccaagagcgaccggctggggaagatccggagtctggacctgtcaggattggagctgctttccgagcacctggaccccaaactcctgtgccgcctgacgcagctgcaggagcttgacctgtctaacaaccacctggagacgctgccggacaacctgggcctgtcccacctgcgtgtcctccgctgcgccaacaaccagctgggggatgttactgccttgtgccagttccccaagctcgaggaactcagcctggagggcaaccccttcctgacggtcaatgacaacctgaaagtctcctttctcctgcccacgctccgtaaggtcaatggcaaggatgcgtcctcaacttactctcaggtggagaacctgaatcgggagctgaccagcagggtcacagctcactgggagaagttcatggccacactgggtcctgaagaggaggctgagaaggcccaggcggactttgtgaagtcggctgtcagggatgtccgctacgggcccgagtccctcagcgagttcacccagtggcgggtgcggatgatctctgaggagctggtggccgccagtaggacccaggtgcaaaaggctaacagcccagagaagcccccagaagctggagctgcccacaagcccagggccagactggcggccttgaaacggccagacgacgtcccactcagcctctctcccagcaagcgggcgtgtgcctccccgtcggcccaggtggagggcagccctgtggcaggctccgatggcagccagcctgctgtgaagctggagcccctgcacttcctgcagtgccacagcaagaacaacagcccccaggacctcgagacccagctgtgggcctgtgccttcgagccggcctgggaggagggggccacatcccagaccgtggccacgtgcggcggggaggctgtgtgcgtaattgattgccagacgggcatcgtgctccacaagtacaaggcacccggcgaggagttcttttctgtggcctggaccgctctgatggtggtcacacaggctggccacaagaagcgctggagtgtgctggcggctgcaggcctacggggcctggtccggctgctgcacgtgcgtgccggcttctgctgcggggtcatccgagcccacaagaaggccatcgccaccctgtgcttcagccccgcccacgagacccatctcttcacggcctcctatgacaagcggatcatcctctgggacatcggggtgcccaaccaggactacgaattccaggccagccagctgctcacactggacaccacctctatccccctgcgcctctgccctgtcgcctcctgcccggacgcccgcctgctggccggctgcgagggcggctgctgctgctgggacgtgcggctggaccagccccaaaagaggagggtgtgtgaagtggaattcgtcttctctgagggctccgaggcatctggacggagagtggatgggctggcatttgtgaatgaggacatcgtggcctccaaggggagcggcctgggcaccatctgcctgtggagctggaggcagacgtgggggggccggggcagccagtccacagtggcagtggtggtcctggcgcggctgcaatggtcgtccaccgagttggcctacttctcgctcagcgcctgccctgataaggggattgtgctctgtggggatgaggagggcaacgtgtggctctacgacgtcagcaacatcctgaagcagccacccctgctgccggcagccctgcaggcccccacacagatcctgaagtggccccagccctgggcccttggccaggtggtgaccaagaccatggtgaacacagtggtggccaatgcctccttcacctacctcaccgccctgacggactccaacatcgtagccatctgggggaggatgtagcctcacaccatcgcaaaggaccagggacacagctaactaacttattcagctttgggccgatgggggtgggggggggtctttcagtgaatatttttattaaactctactgtggacaagaa

SEQ ID NO: 278773 - DNA, 1224 bp, Homo sapiens
  misc_feature (982)..(982): n is a, c, g, or t
agcgggcttccttccggtcgttaacgcccacgggctcgcgcggcgccgcctcctgggctcagttaccgcggacgccagtgccgggctccaggagacgcagggcgacgccacacgccggggtggccgactgggtcagcgcgggctgcgcctcctcgccatgggccccctctcggcgcggctgctaatgcagcgcgggcgccccaagagcgaccggctggggaagatccggagtctggagtaagagccgggcagcggcctgtcaggattggagctgctttccgagcacctggaccccaaactcctgtgccgcctgacgcagctgcaggagcttgacctgtctaacaaccacctggagacgctgccggacaacctgggcctgtcccacctgcgtgtcctccgctgcgccaacaaccagctgggggatgttactgccttgtgccagttccccaagctcgaggaactcagcctggagggcaaccccttcctgacggtcaatgacaacctgaaagtctcctttctcctgcccacgctccgtaaggtcaatggcaaggatgcgtcctcaacttactctcaggtggagaacctgaatcgggagctgaccagcagggtcacagctcactgggagaagttcatggccacactgggtcctgaagaggaggctgagaaggcccaggcggactttgtgaagtcggctgtcagggatgtccgctacgggcccgagtccctcagcgagttcacccagtggcgggtgcggatgatctctgaggagctggtggccgccagtaggacccaggtgcaaaaggctaacagcccagagaagcccccagaagctggagctgcccacaagcccagggccagactggcggccttgaaacggccagacgacgtcccactcagcctctctcccagcaagcgggcgtgtgcctccccgtcggcccaggtggagggcagccctgtggcaggctccgatggcagccagctntgtgagttggagccctgcactcctgcagtgcaaaagcagacaaaggcccagactcgaaacagtgggctggctcgaccggctggagggggcatccagacggcactcgcgggagtgtgcgaagtgcccagctcgtcactcagccggaggttcggcgacatgagggacgggcaaacgatgggggaggcgcactactgagtgagcacaaagaacgcaatcaatggcgaaccccctccgggggcggc

SEQ ID NO: 278774 - DNA, 2753 bp, Homo sapiens
agcgggcttccttccggtcgttaacgcccacgggctcgcgcggcgccgcctcctgggctcagttaccgcggacgccagtgccgggctccaggagacgcagggcgacgccacacgccggggtggccgactgggtcagcgcgggctgcgcctcctcgccatgggccccctctcggcgcggctgctaatgcagcgcgggcgccccaagagcgaccggctggggaagatccggagtctggacctgtcaggattggagctgctttccgagcacctggaccccaaactcctgtgccgcctgacgcagctgcaggagcttgacctgtctaacaaccacctggagacgctgccggacaacctgggcctgtcccacctgcgtgtcctccgctgcgccaacaaccagctgggggatgttactgccttgtgccagttccccaagctcgaggaactcagcctggagggcaaccccttcctgacggtcaatgacaacctgaaagtctcctttctcctgcccacgctccgtaaggtcaatggcaaggatgcgtcctcaacttactctcaggtggagaacctgaatcgggagctgaccagcagggtcacagctcactgggagaagttcatggccacactgggtcctgaagaggaggctgagaaggcccaggcggactttgtgaagtcggctgtcagggatgtccgctacgggcccgagtccctcagcgagttcacccagtggcgggtgcggatgatctctgaggagctggtggccgccagtaggacccaggtgcaaaaggctaacagcccagagaagcccccagaagctggagctgcccacaagcccagggccagactggcggccttgaaacggccagacgacgtcccactcagcctctctcccagcaagcgggcgtgtgcctccccgtcggcccaggtggagggcagccctgtggcaggctccgatggcagccagcctgctgtgaagctggagcccctgcacttcctgcagtgccacagcaagaacaacagcccccaggacctcgagacccagctgtgggcctgtgccttcgagccggcctgggaggagggggccacatcccagaccgtggccacgtgcggcggggaggctgtgtgcgtaattgattgccagacgggcatcgtgctccacaagtacaaggcacccggcgaggagttcttttctgtggcctggaccgctctgatggtggtcacacaggctggccacaagaagcgctggagtgtgctggcggctgcaggcctacggggcctggtccggctgctgcacgtgcgtgccggcttctgctgcggggtcatccgagcccacaagaaggccatcgccaccctgtgcttcagccccgcccacgagacccatctcttcacggcctcctatgacaagcggatcatcctctgggacatcggggtgcccaaccaggactacgaattccaggccagccagctgctcacactggacaccacctctatccccctgcgcctctgccctgtcgcctcctgcccggacgcccgcctgctggccggctgcgagggcggctgctgctgctgggacgtgcggctggaccagccccaaaagaggagggtgtgtgaagtggaattcgtcttctctgagggctccgaggcatctggacggagagtggatgggctggcatttgtgaatgaggacatcgtggcctccaaggggagcggcctgggcaccatctgcctgtggagctggaggcagacgtgggggggccggggcagccagtccacagtggcagtggtggtcctggcgcggctgcaatggtcgtccaccgagttggcctacttctcgctcagcgcctgccctgataaggggattgtgctctgtggggatgaggagggcaacgtgtggctctacgacgtcagcaacatcctgaagcagccacccctgctgccggcagccctgcaggcccccacacagatcctgaagtggccccagccctgggcccttggccaggtggtgaccaagaccatggtgaacacagtggtggccaatgcctccttcacctacctcaccgccctgacggactccaacatcgtagccatctgggggaggatgtagcctcacaccatcgcaaaggaccagggacacagctaactaacttattcagctttgggccgatgggggtgggggggggtctttcagtgaatatttttattaaactctactgtggacaagaaaaacacacagccagaaaccccgagaactacacaccaaccaaccggcggggcgcctccacaaatacccccgagcggggccagatatgacccccccccgaccttcccttctcacagaggtggccacataagggcagcacgcacataacacacgtcgcacacagcccccgccagctcacaccacaggtgcgggacggggaaacaccgaagagacggcggaaacttggacggaggagacccacagcgagggggggccacctaggtggcaaacgccaccacagacaagtaagcgcggcggggaacatacaccttcaccgtcgtcaggtggatgaccagaccgcatggcgcgcggtgagcatgcgcaacggcattgtcttcgacaattcacgcccgcagacaaggcggcacagcagacgacgcaccaccacgaaaccgcgcacgacacaccgcaagcgggcagcggacacgaccgagcgcgagcgaacccacgccatcaggcgtcagcaacgtcgctcacacgagccgcaacgctgcac

SEQ ID NO: 278775 - DNA, 2274 bp, Homo sapiens
agcgggcttccttccggtcgttaacgcccacgggctcgcgcggcgccgcctcctgggctcagttaccgcggacgccagtgccgggctccaggagacgcagggcgacgccacacgccggggtggccgactgggtcagcgcgggctgcgcctcctcgccatgggccccctctcggcgcggctgctaatgcagcgcgggcgccccaagagcgaccggctggggaagatccggagtctggacctgtcaggattggagctgctttccgagcacctggaccccaaactcctgtgccgcctgacgcagctgcaggagcttgacctgtctaacaaccacctggagacgctgccggacaacctgggcctgtcccacctgcgtgtcctccgctgcgccaacaaccagctgggggatgttactgccttgtgccagttccccaagctcgaggaactcagcctggagggcaaccccttcctgacggtcaatgacaacctgaaagtctcctttctcctgcccacgctccgtaaggtcaatggcaaggatgcgtcctcaacttactctcaggtggagaacctgaatcgggagctgaccagcagggtcacagctcactgggagaagttcatggccacactgggtcctgaagaggaggctgagaaggcccaggcggactttgtgaagtcggctgtcagggatgtccgctacgggcccgagtccctcagcgagttcacccagtggcgggtgcggatgatctctgaggagctggtggccgccagtaggacccaggtgcaaaaggctaacagcccagagaagcccccagaagctggagctgcccacaagcccagggccagactggcggccttgaaacggccagacgacgtcccactcagcctctctcccagcaagcgggcgtgtgcctccccgtcggcccaggtggagggcagccctgtggcaggctccgatggcagccagcctgctgtgaagctggagcccctgcacttcctgcagtgccacagcaagaacaacagcccccaggacctcgagacccagctgtgggcctgtgccttcgagccggcctgggaggagggggccacatcccagaccgtggccacgtgcggcggggaggctgtgtgcgtaattgattgccagacgggcatcgtgctccacaagtacaaggcacccggcgaggagttcttttctgtggcctggaccgctctgatggtggtcacacaggctggccacaagaagcgctggagtgtgctggcggctgcaggcctacggggcctggtccggctgctgcacgtgcgtgccggcttctgctgcggggtcatccgagcccacaagaaggccatcgccaccctgtgcttcagccccgcccacgagacccatctcttcacggcctcctatgacaagcggatcatcctctgggacatcggggtgcccaaccaggactacgaattccaggccagccagctgctcacactggacaccacctctatccccctgcgcctctgccctgtcgcctcctgcccggacgcccgcctgctggccggctgcgagggcggctgctgctgctgggacgtgcggctggaccagccccaaaagaggagggtgtgtgaagtggaattcgtcttctctgagggctccgaggcatctggacggagagtggatgggctggcatttgtgaatgaggacatcgtggcctccaaggggagcggcctgggcaccatctgcctgtggagctggaggcagacgtgggggggccggggcagccagtccacagtggcagtggtggtcctggcgcggctgcaatggtcgtccaccgagttggcctacttctcgctcagcgcctgccctgataaggggattgtgctctgtggggatgaggagggcaacgtgtggctctacgacgtcagcaacatcctgaagcagccacccctgctgccggcagccctgcaggcccccacacagatcctgaagtggccccagccctgggcccttggccaggtggtgaccaagaccatggtgaacacagtggtggccaatgcctccttcacctacctcaccgccctgacggactccaacatcgtagccatctgggggaggatgtagcctcacaccatcgcaaaggaccagggacacagctaactaacttattcagctttgggccgatgggggtgggggggggtctttcagtgaatatttttattaaactctactgtggacaagaaaacagaaacatgacaacacaaagaaataccaaaaagatggaatcataacacacg

SEQ ID NO: 278776 - DNA, 2296 bp, Homo sapiens
agcgggcttccttccggtcgttaacgcccacgggctcgcgcggcgccgcctcctgggctcagttaccgcggacgccagtgccgggctccaggagacgcagggcgacgccacacgccggggtggccgactgggtcagcgcgggctgcgcctcctcgccatgggccccctctcggcgcggctgctaatgcagcgcgggcgccccaagagcgaccggctggggaagatccggagtctggacctgtcaggattggagctgctttccgagcacctggaccccaaactcctgtgccgcctgacgcagctgcaggagcttgacctgtctaacaaccacctggagacgctgccggacaacctgggcctgtcccacctgcgtgtcctccgctgcgccaacaaccagctgggggatgttactgccttgtgccagttccccaagctcgaggaactcagcctggagggcaaccccttcctgacggtcaatgacaacctgaaagtctcctttctcctgcccacgctccgtaaggtcaatggcaaggatgcgtcctcaacttactctcaggtggagaacctgaatcgggagctgaccagcagggtcacagctcactgggagaagttcatggccacactgggtcctgaagaggaggctgagaaggcccaggcggactttgtgaagtcggctgtcagggatgtccgctacgggcccgagtccctcagcgagttcacccagtggcgggtgcggatgatctctgaggagctggtggccgccagtaggacccaggtgcaaaaggctaacagcccagagaagcccccagaagctggagctgcccacaagcccagggccagactggcggccttgaaacggccagacgacgtcccactcagcctctctcccagcaagcgggcgtgtgcctccccgtcggcccaggtggagggcagccctgtggcaggctccgatggcagccagcctgctgtgaagctggagcccctgcacttcctgcagtgccacagcaagaacaacagcccccaggacctcgagacccagctgtgggcctgtgccttcgagccggcctgggaggagggggccacatcccagaccgtggccacgtgcggcggggaggctgtgtgcgtaattgattgccagacgggcatcgtgctccacaagtacaaggcacccggcgaggagttcttttctgtggcctggaccgctctgatggtggtcacacaggctggccacaagaagcgctggagtgtgctggcggctgcaggcctacggggcctggtccggctgctgcacgtgcgtgccggcttctgctgcggggtcatccgagcccacaagaaggccatcgccaccctgtgcttcagccccgcccacgagacccatctcttcacggcctcctatgacaagcggatcatcctctgggacatcggggtgcccaaccaggactacgaattccaggccagccagctgctcacactggacaccacctctatccccctgcgcctctgccctgtcgcctcctgcccggacgcccgcctgctggccggctgcgagggcggctgctgctgctgggacgtgcggctggaccagccccaaaagaggagggtgtgtgaagtggaattcgtcttctctgagggctccgaggcatctggacggagagtggatgggctggcatttgtgaatgaggacatcgtggcctccaaggggagcggcctgggcaccatctgcctgtggagctggaggcagacgtgggggggccggggcagccagtccacagtggcagtggtggtcctggcgcggctgcaatggtcgtccaccgagttggcctacttctcgctcagcgcctgccctgataaggggattgtgctctgtggggatgaggagggcaacgtgtggctctacgacgtcagcaacatcctgaagcagccacccctgctgccggcagccctgcaggcccccacacagccctcccctctctccccaccagatcctgaagtggccccagccctgggcccttggccaggtggtgaccaagaccatggtgaacacagtggtggccaatgcctccttcacctacctcaccgccctgacggactccaacatcgtagccatctgggggaggatgtagcctcacaccatcgcaaaggaccagggacacagctaactaacttattcagctttgggccgatgggggtgggggggggtctttcagtgaatatttttattaaactctactgtggacaagaaaacagaaacatgacaacacaaagaaataccaaaaagatggaatcataacacacg

SEQ ID NO: 278777 - DNA, 1934 bp, Homo sapiens
agcgggcttccttccggtcgttaacgcccacgggctcgcgcggcgccgcctcctgggctcagttaccgcggacgccagtgccgggctccaggagacgcagggcgacgccacacgccggggtggccgactgggtcagcgcgggctgcgcctcctcgccatgggccccctctcggcgcggctgctaatgcagcgcgggcgccccaagagcgaccggctggggaagatccggagtctggacctgtcaggattggagctgctttccgagcacctggaccccaaactcctgtgccgcctgacgcagctgcaggagcttgacctgtctaacaaccacctggagacgctgccggacaacctgggcctgtcccacctgcgtgtcctccgctgcgccaacaaccagctgggggatgttactgccttgtgccagttccccaagctcgaggaactcagcctggagggcaaccccttcctgacggtcaatgacaacctgaaagtctcctttctcctgcccacgctccgtaaggtcaatggcaaggatgcgtcctcaacttactctcaggtggagaacctgaatcgggagctgaccagcagggtcacagctcactgggagaagttcatggccacactgggtcctgaagaggaggctgagaaggcccaggcggactttgtgaagtcggctgtcagggatgtccgctacgggcccgagtccctcagcgagttcacccagtggcgggtgcggatgatctctgaggagctggtggccgccagtaggacccaggtgcaaaaggctaacagcccagagaagcccccagaagctggagctgcccacaagcccagggccagactggcggccttgaaacggccagacgacgtcccactcagcctctctcccagcaagcgggcgtgtgcctccccgtcggcccaggtggagggcagccctgtggcaggctccgatggcagccagcctgctgtgaagctggagcccctgcacttcctgcagtgccacagcaagaacaacagcccccaggacctcgagacccagctgtgggcctgtgccttcgagccggcctgggaggagggggccacatcccagaccgtggccacgtgcggcggggaggctgtgtgcgtaattgattgccagacgggcatcgtgctccacaagtacaaggcacccggcgaggagttcttttctgtggcctggaccgctctgatggtggtcacacaggctggccacaagaagcgctggagtgtgctggcggctgcaggcctacggggcctggtccggctgctgcacgtgcgtgccggcttctgctgcggggtcatccgagcccacaagaaggccatcgccaccctgtgcttcagccccgcccacgagacccatctcttcacggcctcctatgacaagcggatcatcctctgggacatcggggtgcccaaccaggactacgaattccaggccagccagctgctcacactggacaccacctctatccccctgcgcctctgccctgtcgcctcctgcccggacgcccgcctgctggccggctgcgagggcggctgctgctgctgggacgtgcggctggaccagccccaaaagaggagctggacggagagtggatgggctggcatttgtgaatgaggacatcgtggcctccaaggggagcggcctgggcaccatctgcctgtggagctggaggcagacgtgggggggccggggcagccagtccacagtggcagtggtggtcctggcgcggctgcaatggtcgtccaccgagttggcctacttctcgctcagcgcctgccctgataaggggattgtgctctgtggggatgaggagggcaacgtgtggctctacgacgtcagcaacatcctgaagcagccacccctgctgccggcagccctgcaggcccccacacaggtactgcccggctcaccc

SEQ ID NO: 278778 - DNA, 2161 bp, Homo sapiens
tgcaggctggtactgccccgggttatgggatggagacgcagggcgacgccacacgccggggtggccgactgggtcagcgcgggctgcgcctcctcgccatgggccccctctcggcgcggctgctaatgcagcgcgggcgccccaagagcgaccggctggggaagatccggagtctggacctgtcaggattggagctgctttccgagcacctggaccccaaactcctgtgccgcctgacgcagctgcaggagcttgacctgtctaacaaccacctggagacgctgccggacaacctgggcctgtcccacctgcgtgtcctccgctgcgccaacaaccagctgggggatgttactgccttgtgccagttccccaagctcgaggaactcagcctggagggcaaccccttcctgacggtcaatgacaacctgaaagtctcctttctcctgcccacgctccgtaaggtcaatggcaaggatgcgtcctcaacttactctcaggtggagaacctgaatcgggagctgaccagcagggtcacagctcactgggagaagttcatggccacactgggtcctgaagaggaggctgagaaggcccaggcggactttgtgaagtcggctgtcagggatgtccgctacgggcccgagtccctcagcgagttcacccagtggcgggtgcggatgatctctgaggagctggtggccgccagtaggacccaggtgcaaaaggctaacagcccagagaagcccccagaagctggagctgcccacaagcccagggccagactggcggccttgaaacggccagacgacgtcccactcagcctctctcccagcaagcgggcgtgtgcctccccgtcggcccaggtggagggcagccctgtggcaggctccgatggcagccagcctgctgtgaagctggagcccctgcacttcctgcagtgccacagcaagaacaacagcccccaggacctcgagacccagctgtgggcctgtgccttcgagccggcctgggaggagggggccacatcccagaccgtggccacgtgcggcggggaggctgtgtgcgtaattgattgccagacgggcatcgtgctccacaagtacaaggcacccggcgaggagttcttttctgtggcctggaccgctctgatggtggtcacacaggctggccacaagaagcgctggagtgtgctggcggctgcaggcctacggggcctggtccggctgctgcacgtgcgtgccggcttctgctgcggggtcatccgagcccacaagaaggccatcgccaccctgtgcttcagccccgcccacgagacccatctcttcacggcctcctatgacaagcggatcatcctctgggacatcggggtgcccaaccaggactacgaattccaggccagccagctgctcacactggacaccacctctatccccctgcgcctctgccctgtcgcctcctgcccggacgcccgcctgctggccggctgcgagggcggctgctgctgctgggacgtgcggctggaccagccccaaaagaggagggtgtgtgaagtggaattcgtcttctctgagggctccgaggcatctggacggagagtggatgggctggcatttgtgaatgaggacatcgtggcctccaaggggagcggcctgggcaccatctgcctgtggagctggaggcagacgtgggggggccggggcagccagtccacagtggcagtggtggtcctggcgcggctgcaatggtcgtccaccgagttggcctacttctcgctcagcgcctgccctgataaggggattgtgctctgtggggatgaggagggcaacgtgtggctctacgacgtcagcaacatcctgaagcagccacccctgctgccggcagccctgcaggcccccacacagatcctgaagtggccccagccctgggcccttggccaggtggtgaccaagaccatggtgaacacagtggtggccaatgcctccttcacctacctcaccgccctgacggactccaacatcgtagccatctgggggaggatgtagcctcacaccatcgcaaaggaccagggacacagctaactaacttattcagctttgggccgatgggggtgggggggggtctttcagtgaatatttttattaaactctactgtggacaagaa

SEQ ID NO: 278779 - DNA, 1206 bp, Homo sapiens
  misc_feature (964)..(964): n is a, c, g, or t
agcgggcttccttccggtcgttaacgcccacgggctcgcgcggcgccgcctcctgggctcagttaccgcggacgccagtgccgggctccaggagacgcagggcgacgccacacgccggggtggccgactgggtcagcgcgggctgcgcctcctcgccatgggccccctctcggcgcggctgctaatgcagcgcgggcgccccaagagcgaccggctggggaagatccggagtctggacctgtcaggattggagctgctttccgagcacctggaccccaaactcctgtgccgcctgacgcagctgcaggagcttgacctgtctaacaaccacctggagacgctgccggacaacctgggcctgtcccacctgcgtgtcctccgctgcgccaacaaccagctgggggatgttactgccttgtgccagttccccaagctcgaggaactcagcctggagggcaaccccttcctgacggtcaatgacaacctgaaagtctcctttctcctgcccacgctccgtaaggtcaatggcaaggatgcgtcctcaacttactctcaggtggagaacctgaatcgggagctgaccagcagggtcacagctcactgggagaagttcatggccacactgggtcctgaagaggaggctgagaaggcccaggcggactttgtgaagtcggctgtcagggatgtccgctacgggcccgagtccctcagcgagttcacccagtggcgggtgcggatgatctctgaggagctggtggccgccagtaggacccaggtgcaaaaggctaacagcccagagaagcccccagaagctggagctgcccacaagcccagggccagactggcggccttgaaacggccagacgacgtcccactcagcctctctcccagcaagcgggcgtgtgcctccccgtcggcccaggtggagggcagccctgtggcaggctccgatggcagccagctntgtgagttggagccctgcactcctgcagtgcaaaagcagacaaaggcccagactcgaaacagtgggctggctcgaccggctggagggggcatccagacggcactcgcgggagtgtgcgaagtgcccagctcgtcactcagccggaggttcggcgacatgagggacgggcaaacgatgggggaggcgcactactgagtgagcacaaagaacgcaatcaatggcgaaccccctccgggggcggc

SEQ ID NO: 278780 - DNA, 2238 bp, Homo sapiens
agcgggcttccttccggtcgttaacgcccacgggctcgcgcggcgccgcctcctgggctcagttaccgcggacgccagtgccgggctccaggagacgcagggcgacgccacacgccggggtggccgactgggtcagcgcgggctgcgcctcctcgccatgggccccctctcggcgcggctgctaatgcagcgcgggcgccccaagagcgaccggctggggaagatccggagtctggagtaagagccgggcagcggcctgtcaggattggagctgctttccgagcacctggaccccaaactcctgtgccgcctgacgcagctgcaggagcttgacctgtctaacaaccacctggagacgctgccggacaacctgggcctgtcccacctgcgtgtcctccgctgcgccaacaaccagctgggggatgttactgccttgtgccagttccccaagctcgaggaactcagcctggagggcaaccccttcctgacggtcaatgacaacctgaaagtctcctttctcctgcccacgctccgtaaggtcaatggcaaggatgcgtcctcaacttactctcaggtggagaacctgaatcgggagctgaccagcagggtcacagctcactgggagaagttcatggccacactgggtcctgaagaggaggctgagaaggcccaggcggactttgtgaagtcggctgtcagggatgtccgctacgggcccgagtccctcagcgagttcacccagtggcgggtgcggatgatctctgaggagctggtggccgccagtaggacccaggtgcaaaaggctaacagcccagagaagcccccagaagctggagctgcccacaagcccagggccagactggcggccttgaaacggccagacgacgtcccactcagcctctctcccagcaagcgggcgtgtgcctccccgtcggcccaggtggagggcagccctgtggcaggctccgatggcagccagcctgctgtgaagctggagcccctgcacttcctgcagtgccacagcaagaacaacagcccccaggacctcgagacccagctgtgggcctgtgccttcgagccggcctgggaggagggggccacatcccagaccgtggccacgtgcggcggggaggctgtgtgcgtaattgattgccagacgggcatcgtgctccacaagtacaaggcacccggcgaggagttcttttctgtggcctggaccgctctgatggtggtcacacaggctggccacaagaagcgctggagtgtgctggcggctgcaggcctacggggcctggtccggctgctgcacgtgcgtgccggcttctgctgcggggtcatccgagcccacaagaaggccatcgccaccctgtgcttcagccccgcccacgagacccatctcttcacggcctcctatgacaagcggatcatcctctgggacatcggggtgcccaaccaggactacgaattccaggccagccagctgctcacactggacaccacctctatccccctgcgcctctgccctgtcgcctcctgcccggacgcccgcctgctggccggctgcgagggcggctgctgctgctgggacgtgcggctggaccagccccaaaagaggagggtgtgtgaagtggaattcgtcttctctgagggctccgaggcatctggacggagagtggatgggctggcatttgtgaatgaggacatcgtggcctccaaggggagcggcctgggcaccatctgcctgtggagctggaggcagacgtgggggggccggggcagccagtccacagtggcagtggtggtcctggcgcggctgcaatggtcgtccaccgagttggcctacttctcgctcagcgcctgccctgataaggggattgtgctctgtggggatgaggagggcaacgtgtggctctacgacgtcagcaacatcctgaagcagccacccctgctgccggcagccctgcaggcccccacacagatcctgaagtggccccagccctgggcccttggccaggtggtgaccaagaccatggtgaacacagtggtggccaatgcctccttcacctacctcaccgccctgacggactccaacatcgtagccatctgggggaggatgtagcctcacaccatcgcaaaggaccagggacacagctaactaacttattcagctttgggccgatgggggtgggggggggtctttcagtgaatatttttattaaactctactgtggacaagaa

SEQ ID NO: 278781 - DNA, 2029 bp, Homo sapiens
ggctggtacgcgtcggaagttagggatggaagatccggagtctggacctgtcaggattggagctgctttccgagcacctggaccccaaactcctgtgccgcctgacgcagctgcaggagcttgacctgtctaacaaccacctggagacgctgccggacaacctgggcctgtcccacctgcgtgtcctccgctgcgccaacaaccagctgggggatgttactgccttgtgccagttccccaagctcgaggaactcagcctggagggcaaccccttcctgacggtcaatgacaacctgaaagtctcctttctcctgcccacgctccgtaaggtcaatggcaaggatgcgtcctcaacttactctcaggtggagaacctgaatcgggagctgaccagcagggtcacagctcactgggagaagttcatggccacactgggtcctgaagaggaggctgagaaggcccaggcggactttgtgaagtcggctgtcagggatgtccgctacgggcccgagtccctcagcgagttcacccagtggcgggtgcggatgatctctgaggagctggtggccgccagtaggacccaggtgcaaaaggctaacagcccagagaagcccccagaagctggagctgcccacaagcccagggccagactggcggccttgaaacggccagacgacgtcccactcagcctctctcccagcaagcgggcgtgtgcctccccgtcggcccaggtggagggcagccctgtggcaggctccgatggcagccagcctgctgtgaagctggagcccctgcacttcctgcagtgccacagcaagaacaacagcccccaggacctcgagacccagctgtgggcctgtgccttcgagccggcctgggaggagggggccacatcccagaccgtggccacgtgcggcggggaggctgtgtgcgtaattgattgccagacgggcatcgtgctccacaagtacaaggcacccggcgaggagttcttttctgtggcctggaccgctctgatggtggtcacacaggctggccacaagaagcgctggagtgtgctggcggctgcaggcctacggggcctggtccggctgctgcacgtgcgtgccggcttctgctgcggggtcatccgagcccacaagaaggccatcgccaccctgtgcttcagccccgcccacgagacccatctcttcacggcctcctatgacaagcggatcatcctctgggacatcggggtgcccaaccaggactacgaattccaggccagccagctgctcacactggacaccacctctatccccctgcgcctctgccctgtcgcctcctgcccggacgcccgcctgctggccggctgcgagggcggctgctgctgctgggacgtgcggctggaccagccccaaaagaggagggtgtgtgaagtggaattcgtcttctctgagggctccgaggcatctggacggagagtggatgggctggcatttgtgaatgaggacatcgtggcctccaaggggagcggcctgggcaccatctgcctgtggagctggaggcagacgtgggggggccggggcagccagtccacagtggcagtggtggtcctggcgcggctgcaatggtcgtccaccgagttggcctacttctcgctcagcgcctgccctgataaggggattgtgctctgtggggatgaggagggcaacgtgtggctctacgacgtcagcaacatcctgaagcagccacccctgctgccggcagccctgcaggcccccacacagatcctgaagtggccccagccctgggcccttggccaggtggtgaccaagaccatggtgaacacagtggtggccaatgcctccttcacctacctcaccgccctgacggactccaacatcgtagccatctgggggaggatgtagcctcacaccatcgcaaaggaccagggacacagctaactaacttattcagctttgggccgatgggggtgggggggggtctttcagtgaatatttttattaaactctactgtggacaagaa

SEQ ID NO: 278782 - DNA, 2316 bp, Homo sapiens
agcgggcttccttccggtcgttaacgcccacgggctcgcgcggcgccgcctcctgggctcagttaccgcggacgccagtgccgggctccaggagacgcagggcgacgccacacgccggggtggccgactgggtcagcgcgggctgcgcctcctcgccatgggccccctctcggcgcggctgctaatgcagcgcgggcgccccaagagcgaccggctggggaagatccggagtctggatggtgtggagtcgggagtagtggcgcgcgcttctagtcccagctactcgagaggctgaggcgggaggatccctcagcccaggagttggaggcagctcctgtcaggattggagctgctttccgagcacctggaccccaaactcctgtgccgcctgacgcagctgcaggagcttgacctgtctaacaaccacctggagacgctgccggacaacctgggcctgtcccacctgcgtgtcctccgctgcgccaacaaccagctgggggatgttactgccttgtgccagttccccaagctcgaggaactcagcctggagggcaaccccttcctgacggtcaatgacaacctgaaagtctcctttctcctgcccacgctccgtaaggtcaatggcaaggatgcgtcctcaacttactctcaggtggagaacctgaatcgggagctgaccagcagggtcacagctcactgggagaagttcatggccacactgggtcctgaagaggaggctgagaaggcccaggcggactttgtgaagtcggctgtcagggatgtccgctacgggcccgagtccctcagcgagttcacccagtggcgggtgcggatgatctctgaggagctggtggccgccagtaggacccaggtgcaaaaggctaacagcccagagaagcccccagaagctggagctgcccacaagcccagggccagactggcggccttgaaacggccagacgacgtcccactcagcctctctcccagcaagcgggcgtgtgcctccccgtcggcccaggtggagggcagccctgtggcaggctccgatggcagccagcctgctgtgaagctggagcccctgcacttcctgcagtgccacagcaagaacaacagcccccaggacctcgagacccagctgtgggcctgtgccttcgagccggcctgggaggagggggccacatcccagaccgtggccacgtgcggcggggaggctgtgtgcgtaattgattgccagacgggcatcgtgctccacaagtacaaggcacccggcgaggagttcttttctgtggcctggaccgctctgatggtggtcacacaggctggccacaagaagcgctggagtgtgctggcggctgcaggcctacggggcctggtccggctgctgcacgtgcgtgccggcttctgctgcggggtcatccgagcccacaagaaggccatcgccaccctgtgcttcagccccgcccacgagacccatctcttcacggcctcctatgacaagcggatcatcctctgggacatcggggtgcccaaccaggactacgaattccaggccagccagctgctcacactggacaccacctctatccccctgcgcctctgccctgtcgcctcctgcccggacgcccgcctgctggccggctgcgagggcggctgctgctgctgggacgtgcggctggaccagccccaaaagaggagggtgtgtgaagtggaattcgtcttctctgagggctccgaggcatctggacggagagtggatgggctggcatttgtgaatgaggacatcgtggcctccaaggggagcggcctgggcaccatctgcctgtggagctggaggcagacgtgggggggccggggcagccagtccacagtggcagtggtggtcctggcgcggctgcaatggtcgtccaccgagttggcctacttctcgctcagcgcctgccctgataaggggattgtgctctgtggggatgaggagggcaacgtgtggctctacgacgtcagcaacatcctgaagcagccacccctgctgccggcagccctgcaggcccccacacagatcctgaagtggccccagccctgggcccttggccaggtggtgaccaagaccatggtgaacacagtggtggccaatgcctccttcacctacctcaccgccctgacggactccaacatcgtagccatctgggggaggatgtagcctcacaccatcgcaaaggaccagggacacagctaactaacttattcagctttgggccgatgggggtgggggggggtctttcagtgaatatttttattaaactctactgtggacaagaa

SEQ ID NO: 278783 - DNA, 2097 bp, Homo sapiens
agcgggcttccttccggtcgttaacgcccacgggctcgcgcggcgccgcctcctgggctcagttaccgcggacgccagtgccgggctccaggagacgcagggcgacgccacacgccggggtggccgactgggtcagcgcgggctgcgcctcctcgccatgggccccctctcggcgcggctgctaatgcagcgcgggcgccccaagagcgaccggctggggaagatccggagtctggacctgtcaggattggagctgctttccgagcacctggaccccaaactcctgtgccgcctgacgcagctgcaggagcttgacctgtctaacaaccacctggagacgctgccggacaacctgggcctgtcccacctgcgtgtcctccgctgcgccaacaaccagctgggggatgttactgccttgtgccagttccccaagctcgaggaactcagcctggagggcaaccccttcctgacggtcaatgacaacctgaaagtctcctttctcctgcccacgctccgtaaggtcaatggcaaggatgcgtcctcaacttactctcaggtggagaacctgaatcgggagctgaccagcagggtcacagctcactgggaggtgcggatgatctctgaggagctggtggccgccagtaggacccaggtgcaaaaggctaacagcccagagaagcccccagaagctggagctgcccacaagcccagggccagactggcggccttgaaacggccagacgacgtcccactcagcctctctcccagcaagcgggcgtgtgcctccccgtcggcccaggtggagggcagccctgtggcaggctccgatggcagccagcctgctgtgaagctggagcccctgcacttcctgcagtgccacagcaagaacaacagcccccaggacctcgagacccagctgtgggcctgtgccttcgagccggcctgggaggagggggccacatcccagaccgtggccacgtgcggcggggaggctgtgtgcgtaattgattgccagacgggcatcgtgctccacaagtacaaggcacccggcgaggagttcttttctgtggcctggaccgctctgatggtggtcacacaggctggccacaagaagcgctggagtgtgctggcggctgcaggcctacggggcctggtccggctgctgcacgtgcgtgccggcttctgctgcggggtcatccgagcccacaagaaggccatcgccaccctgtgcttcagccccgcccacgagacccatctcttcacggcctcctatgacaagcggatcatcctctgggacatcggggtgcccaaccaggactacgaattccaggccagccagctgctcacactggacaccacctctatccccctgcgcctctgccctgtcgcctcctgcccggacgcccgcctgctggccggctgcgagggcggctgctgctgctgggacgtgcggctggaccagccccaaaagaggagggtgtgtgaagtggaattcgtcttctctgagggctccgaggcatctggacggagagtggatgggctggcatttgtgaatgaggacatcgtggcctccaaggggagcggcctgggcaccatctgcctgtggagctggaggcagacgtgggggggccggggcagccagtccacagtggcagtggtggtcctggcgcggctgcaatggtcgtccaccgagttggcctacttctcgctcagcgcctgccctgataaggggattgtgctctgtggggatgaggagggcaacgtgtggctctacgacgtcagcaacatcctgaagcagccacccctgctgccggcagccctgcaggcccccacacagatcctgaagtggccccagccctgggcccttggccaggtggtgaccaagaccatggtgaacacagtggtggccaatgcctccttcacctacctcaccgccctgacggactccaacatcgtagccatctgggggaggatgtagcctcacaccatcgcaaaggaccagggacacagctaactaacttattcagctttgggccgatgggggtgggggggggtctttcagtgaatatttttattaaactctactgtggacaagaa

SEQ ID NO: 278784 - DNA, 544 bp, Homo sapiens
aaaagggcccgtggagctggaggcagacgtgggggggcaccatctgcctgtggagctggaggcagacgtgggggggccggggcagccagtccacagtggcagtggtggtcctggcgcggctgcaatggtcgtccaccgagttggcctacttctcgctcagcgcctgccctgataaggggattgtgctctgtggggatgaggagggcaacgtgtggctctacgacgtcagcaacatcctgaagcagccacccctgctgccggcagccctgcaggcccccacacagatcctgaagtggccccagccctgggcccttggccaggtggtgaccaagaccatggtgaacacagtggtggccaatgcctccttcacctacctcaccgccctgacggactccaacatcgtagccatctgggggaggatgtagcctcacaccatcgcaaaggaccagggacacagctaactaacttattcagctttgggccgatgggggtgggggggggtctttcagtgaatatttttattaaactctactgtggacaagaa

SEQ ID NO: 278785 - DNA, 237 bp, Homo sapiens
gtacatggtggcgggcaggcggggcaagggccgctggaaatagggccgcctggatgggtgggggatcaggagacagagcttaaaaggcgccatcaaggctgggaggaggaggctgcagggaggacctagatgggaaatgtctctgctcatccgacctctcaaaaccgggcactcaggggccacatcccagaccgtggccacgtgcggcggggaggctgtgtgcgtaattgattgcca

SEQ ID NO: 278786 - DNA, 910 bp, Homo sapiens
cacttagcgatttagcgtgaataataagaaagcatgttcgacatatgagaattccagaatctggagaaactcaacatcaagacaatctggctagtctacacagtagaacaatcaaagtaagagttgtaaagaataaaggaaaaacggagcattctaatggaatccatatgcctacattccgccatcaccatgatgatcaagcctacaggagtagcttcaaatagattccagctgtggttatattgtaaatgaagcatctaacatgtgcacaacttgcaacaaaaactccttggactttaaatctgtctttctcagtttccatgtgctgattgatctgactgatcacacaggcacccttcattcctgtagtctcacaggaagtgttgctgaggagactttgggctggtacatgagtttcttgcaatgacagatgaacagaaaacagcattaaagtggcaatttctcttggaaagaagcaaaatttatttaaaattcgttctatcacacagagcaaggagtggattgaaaattagtgtactctcgtgcaagcttgcagatcctactgaggcaagcagaaacttgtctggacaaaaacatgtttaaaacggtctatcattttgaactctggaaaagtataagagttttaactccctttaaaatggaatattaatttgaaaattatggggaaaattgcattttgtttacatgtggtgaacatgtttctagaaattgttatggtggaggtggtctgggtgagtctgaaggcctctctcatctgacctcccttcttagaaggcctcctactgtctttgccttgtctcctcccaagttggaaaatgtttacatgaattaataaacaggatgcggccgattcctctctttataaacttatatatacacccacaaataa

SEQ ID NO: 278787 - DNA, 422 bp, Homo sapiens
cttttgtctctttttctgtttctcctcgcagttcgttctatcacacagagcaaggagtggattgaaaattagtgtactctcgtgcaagcttgcagatcctactgaggcaagcagaaacttgtctggacaaaaacatgtttaaaacggtctatcattttgaactctggaaaagtataagagttttaactccctttaaaatggaatattaatttgaaaattatggggaaaattgcattttgtttacatgtggtgaacatgtttctagaaattgttatggtggaggtggtctgggtgagtctgaaggcctctctcatctgacctcccttcttagaaggcctcctactgtctttgccttgtctcctcccaagttggaaaatgtttacatgaattaataaacagatttaatcttctaaaaaaaaaaa

SEQ ID NO: 278788 - DNA, 3557 bp, Homo sapiens
agcgggcggggccgtcgcacctgcacgaggctgtggcccgagcgtcctgtggagaagccgcgaagcgcgggcgacccgggggtcgggcgggccaggtccgcgaggccgcggcggcagctgtgcaggcccggggagcagccggccgggcgagcctcggatattggatcagaaaggtacactttcagcttcaccattcgggattcaccagcacattttgtaaatgcagcttcctggggcaatgaagattacatcaagtctctttctgacagctttagggttggtgactgtgtgataattgaaaatcctctgatccaaagaaaggaaatagaaagagaagaaaaattcagccctgcaactcctagcaactgtaaactgttgctcagtgagaatcactcaacagtaaaagtttgttccagttatgaagtggacacaaagttactttctttgatacatttacctgttaaagagtctcatgattattattcactgggtgacattgttgcaaatggacacagtcttaatgggaggattattaacgtgcttgcagctgtgaaatcggttggagagccaaaatactttacaacttcagaccggagaaaaggccagaggtgtgaagttagactctatgatgaaacagagtcgtcttttgcgatgacatgttgggataatgaatccattctacttgcacagagctggatgccacgagaaacagtaatatttgcctcagatgtaagaataaattttgacaaatttcggaactgcatgacagcaactgtaatctcaaaaaccattattacaactaatccagaagctaacattctgctgaattttatacgagaaaataaagaaacgaatgttctggatgatgaaattgacagttatttcaaagaatccataaatttaagtacaatagttgatgtctacacagttgaacaattaaagggaaaagctttgaagaatgaaggaaaagctgatccttcctatggcatcctttatgcctacatttccacactcaacattgatgatgaaactacaaaagtagttcgaaatagatgttccagctgtggttatattgtaaatgaagcatctaacatgtgcacaacttgcaacaaaaactccttggactttaaatctgtctttctcagtttccatgtgctgattgatctgactgatcacacaggcacccttcattcctgtagtctcacaggaagtgttgctgaggagactttgggctgctgtaacctcagaaacgggaagctgagggaggattgcttgaccccgggagttcgaggctgcagtgagctgtgatagcactgctgcactccagcttgggcgacagagtgagaccctgtctcagcccgtgtatgccagcctcgatctcatcgttttctttaaccggtccaactccctttggcgtcccagtcaagataatatctccttcttccaaggttatgatcttagaaacatagctgatgatgtaggggatggaaaaaatcatggaggatgtctcaccctcctgtctgagttcgccgttgaccttgagccagagcttcagcttgtgagggtcagggatcttctccttgggcacgaacgcgctgaccgggcaggacgccgtgaagctcttcgccagagtccagggcagccccttcttcttgcactcgtcctgcacgtcccgggcggtcatatccaggcacagggcatagccgcccacgtagtccatggccgcagcctcggggactgcgcggcagcgcttgcccatcaccacgcccagctccagctcgtggtgcaggttgcgagtgtacgcgggcatgaggatgggcgagccctcgggcgcgtaggccgtggacggcttcaggaacagcacgggctcgctcaacaccgcgctgcgcatctccctgacgtggtccgcgtagttcctccccacgcagacgatgttctttccccactcccagaagcgggacaatggcctggatgctgccatgattcccatcaagtgcccctgtagtcacgtgggctgggccggtcagctgatgcctacggcatcccggagaggaccaactgcctcggaacgctgtcccccgcagcgacggcccgttccacctcgcgatctgccgggtacccgggcggcgtggcgctcggcctccagggatccactgtgcggtgccaaaaaagaggcggaggctcgcggcacagctctcccggcgcagctctcgggccgccgccgccgccgctcccaggcccgtctcccggcccgtggcagtcggggctcgcggagaaaacaagttgagcgcgagcgcgttgattggttggcggacggtgcgaggtggacgctgattggctgagggcagcgcgaggcgggcgctgattggctgcgacgcgccgacgccggtgttttgcagtcctgggcagctcggcagtccagcccggcccgggtcatggtggtgggccgagggctgctcggccgccgcagcctcgccgcgctgggagccgcctgcgcccgccgaggcctcggtccagccctgctgggagttttctgccacacagatttgcggaagaacctgaccgtggacgagggcaccatgaaggtagaggtgctgcctgccctgaccgacaactacatgtacctggtcattgatgatgagaccaaggaggctgccattgtggatccggtgcagccccagaaggtcgtggacgcggcgagaaagcacggggtgaaactgaccacagtgctcaccacccaccaccactgggaccatgctggcgggaatgagaaactggtcaagctggagtcgggactgaaggtgtacgggggtgacgaccgtatcggggccctgactcacaagatcactcacctgtccacactgcaggtggggtctctgaacgtcaagtgcctggcgaccccgtgccacacttcaggacacatttgttacttcgtgagcaagcccggaggctcggagccccctgccgtgttcacaggtgacaccttgtttgtggctggctgcgggaagttctatgaagggactgcggatgagatgtgtaaagctctgctggaggtcttgggccggctccccccggacacaagagtctactgtggccacgagtacaccatcaacaacctcaagtttgcacgccacgtggagcccggcaatgccgccatccgggagaagctggcctgggccaaggagaagtacagcatcggggagcccacagtgccatccaccctggcagaggagtttacctacaaccccttcatgagagtgagggagaagacggtgcagcagcacgcaggtgagacggacccggtgaccaccatgcgggccgtgcgcagggagaaggaccagttcaagatgccccgggactgaggccgccctgcaccttcagcggatttggggattaggctcttttaggtaactggctttcctgctggtccgtgcgggaaattcagtcttgatttaaccttaattttacagcccttggcttgtgttatcggacgttttaatgcatatttataagagaagtttaacaagtatttattcccataaaaaaacttccccttg

SEQ ID NO: 278789 - DNA, 1507 bp, Homo sapiens
cctagtgaggccggggttaactggccgaggcgcacgacggcccgttccacctcgcgatctgccgggtacccgggcggcgtggcgctcggcctccagggatccactgtgcggtgccaaaaaagaggcggaggctcgcggcacagctctcccggcgcagctctcgggccgccgccgccgccgctcccaggcccgtctcccggcccgtggcagtcggggctcgcggagaaaacaagttgagcgcgagcgcgttgattggttggcggacggtgcgaggtggacgctgattggctgagggcagcgcgaggcgggcgctgattggctgcgacgcgccgacgccggtgttttgcagtcctgggcagctcggcagtccagcccggcccgggtcatggtggtgggccgagggctgctcggccgccgcagcctcgccgcgctgggagccgcctgcgcccgccgaggcctcggtccagccctgctgggagttttctgccacacagatttgcggaagaacctgaccgtggacgagggcaccatgaaggtagaggtgctgcctgccctgaccgacaactacatgtacctggtcattgatgatgagaccaaggaggctgccattgtggatccggtgcagccccagaaggtcgtggacgcggcgagaaagcacggggtgaaactgaccacagtgctcaccacccaccaccactgggaccatgctggcgggaatgagaaactggtcaagctggagtcgggactgaaggtgtacgggggtgacgaccgtatcggggccctgactcacaagatcactcacctgtccacactgcaggtggggtctctgaacgtcaagtgcctggcgaccccgtgccacacttcaggacacatttgttacttcgtgagcaagcccggaggctcggagccccctgccgtgttcacaggtgacaccttgtttgtggctggctgcgggaagttctatgaagggactgcggatgagatgtgtaaagctctgctggaggtcttgggccggctccccccggacacaagagtctactgtggccacgagtacaccatcaacaacctcaagtttgcacgccacgtggagcccggcaatgccgccatccgggagaagctggcctgggccaaggagaagtacagcatcggggagcccacagtgccatccaccctggcagaggagtttacctacaaccccttcatgagagtgagggagaagacggtgcagcagcacgcaggtgagacggacccggtgaccaccatgcgggccgtgcgcagggagaaggaccagttcaagatgccccgggactgaggccgccctgcaccttcagcggatttggggattaggctcttttaggtaactggctttcctgctggtccgtgcgggaaattcagtcttgatttaaccttaattttacagcccttggcttgtgttatcggacgttttaatgcatatttataagagaagtttaacaagtatttattcccataaaaaaacttccccttg

SEQ ID NO: 278790 - DNA, 3653 bp, Homo sapiens
agcgggcggggccgtcgcacctgcacgaggctgtggcccgagcgtcctgtggagaagccgcgaagcgcgggcgacccgggggtcgggcgggccaggtccgcgaggccgcggcggcagctgtgcaggcccggggagcagccggccgggcgagcctcggatattggatcagaaaggtacactttcagcttcaccattcgggattcaccagcacattttgtaaatgcagcttcctggggcaatgaagattacatcaagtctctttctgacagctttagggttggtgactgtgtgataattgaaaatcctctgatccaaagaaaggaaatagaaagagaagaaaaattcagccctgcaactcctagcaactgtaaactgttgctcagtgagaatcactcaacagtaaaagtttgttccagttatgaagtggacacaaagttactttctttgatacatttacctgttaaagagtctcatgattattattcactgggtgacattgttgcaaatggacacagtcttaatgggaggattattaacgtgcttgcagctgtgaaatcggttggagagccaaaatactttacaacttcagaccggagaaaaggccagaggtgtgaagttagactctatgatgaaacagagtcgtcttttgcgatgacatgttgggataatgaatccattctacttgcacagagctggatgccacgagaaacagtaatatttgcctcagatgtaagaataaattttgacaaatttcggaactgcatgacagcaactgtaatctcaaaaaccattattacaactaatccagaagctaacattctgctgaattttatacgagaaaataaagaaacgaatgttctggatgatgaaattgacagttatttcaaagaatccataaatttaagtacaatagttgatgtctacacagttgaacaattaaagggaaaagctttgaagaatgaaggaaaagctgatccttcctatggcatcctttatgcctacatttccacactcaacattgatgatgaaactacaaaagtagttcgaaatagatgttccagctgtggttatattgtaaatgaagcatctaacatgtgcacaacttgcaacaaaaactccttggactttaaatctgtctttctcagtttccatgtgctgattgatctgactgatcacacaggcacccttcattcctgtagtctcacaggaagtgttgctgaggagactttgggctgctgtaacctcagaaacgggaagctgagggaggattgcttgaccccgggagttcgaggctgcagtgagctgtgatagcactgctgcactccagcttgggcgacagagtgagaccctgtctcagcccgtgtatgccagcctcgatctcatcgttttctttaaccggtccaactccctttggcgtcccagtcaagataatatctccttcttccaaggttatgatcttagaaacatagctgatgatgtaggggatggaaaaaatcatggaggatgtctcaccctcctgtctgagttcgccgttgaccttgagccagagcttcagcttgtgagggtcagggatcttctccttgggcacgaacgcgctgaccgggcaggacgccgtgaagctcttcgccagagtccagggcagccccttcttcttgcactcgtcctgcacgtcccgggcggtcatatccaggcacagggcatagccgcccacgtagtccatggccgcagcctcggggactgcgcggcagcgcttgcccatcaccacgcccagctccagctcgtggtgcaggttgcgagtgtacgcgggcatgaggatgggcgagccctcgggcgcgtaggccgtggacggcttcaggaacagcacgggctcgctcaacaccgcgctgcgcatctccctgacgtggtccgcgtagttcctccccacgcagacgatgttctttccccactcccagaagcgggacaatggcctggatgctgccatgattcccatcaagtgcccctgtagtcacgtgggctgggccggtcagctgatgcctacggcatcccggagaggaccaactgcctcggaacgctgtcccccgcagcgacggcccgttccacctcgcgatctgccgggtacccgggcggcgtggcgctcggcctccagggatccactgtgcggtgccaaaaaagaggcggaggctcgcggcacagctctcccggcgcagctctcgggccgccgccgccgccgctcccaggcccgtctcccggcccgtggcagtcggggctcgcggagaaaacaagttgagcgcgagcgcgttgattggttggcggacggtgcgaggtggacgctgattggctgagggcagcgcgaggcgggcgctgattggctgcgacgcgccgacgccggtgttttgcagtcctgggcagctcggcagtccagcccggcccgggtcatggtggtgggccgagggctgctcggccgccgcagcctcgccgcgctgggagccgcctgcgcccgccgaggcctcggtgcctaaggccgcgctgccgggctcgagcggaggcggcgcaggcgctgaggctggcgcggagcgggcgcggggccgcgggtgcggaaagcgctaggtccagccctgctgggagttttctgccacacagatttgcggaagaacctgaccgtggacgagggcaccatgaaggtagaggtgctgcctgccctgaccgacaactacatgtacctggtcattgatgatgagaccaaggaggctgccattgtggatccggtgcagccccagaaggtcgtggacgcggcgagaaagcacggggtgaaactgaccacagtgctcaccacccaccaccactgggaccatgctggcgggaatgagaaactggtcaagctggagtcgggactgaaggtgtacgggggtgacgaccgtatcggggccctgactcacaagatcactcacctgtccacactgcaggtggggtctctgaacgtcaagtgcctggcgaccccgtgccacacttcaggacacatttgttacttcgtgagcaagcccggaggctcggagccccctgccgtgttcacaggtgacaccttgtttgtggctggctgcgggaagttctatgaagggactgcggatgagatgtgtaaagctctgctggaggtcttgggccggctccccccggacacaagagtctactgtggccacgagtacaccatcaacaacctcaagtttgcacgccacgtggagcccggcaatgccgccatccgggagaagctggcctgggccaaggagaagtacagcatcggggagcccacagtgccatccaccctggcagaggagtttacctacaaccccttcatgagagtgagggagaagacggtgcagcagcacgcaggtgagacggacccggtgaccaccatgcgggccgtgcgcagggagaaggaccagttcaagatgccccgggactgaggccgccctgcaccttcagcggatttggggattaggctcttttaggtaactggctttcctgctggtccgtgcgggaaattcagtcttgatttaaccttaattttacagcccttggcttgtgttatcggacgttttaatgcatatttataagagaagtttaacaagtatttattcccataaaaaaacttccccttg

SEQ ID NO: 278791 - DNA, 1233 bp, Homo sapiens
ctagttctagcccacgcgtcgccacgcgtcgggctgctcggccgccgcagcctcgccgcgctgggagccgcctgcgcccgccgaggcctcggtgcctaaggccgcgctgccgggctcgagcggaggcggcgcaggcgctgaggctggcgcggagcgggcgcggggccgcgggtgcggaaagcgctaggtccagccctgctgggagttttctgccacacagatttgcggaagaacctgaccgtggacgagggcaccatgaaggtagaggtgctgcctgccctgaccgacaactacatgtacctggtcattgatgatgagaccaaggaggctgccattgtggatccggtgcagccccagaaggtcgtggacgcggcgagaaagcacggggtgaaactgaccacagtgctcaccacccaccaccactgggaccatgctggcgggaatgagaaactggtcaagctggagtcgggactgaaggtgtacgggggtgacgaccgtatcggggccctgactcacaagatcactcacctgtccacactgcaggtggggtctctgaacgtcaagtgcctggcgaccccgtgccacacttcaggacacatttgttacttcgtgagcaagcccggaggctcggagccccctgccgtgttcacaggtgacaccttgtttgtggctggctgcgggaagttctatgaagggactgcggatgagatgtgtaaagctctgctggaggtcttgggccggctccccccggacacaagagtctactgtggccacgagtacaccatcaacaacctcaagtttgcacgccacgtggagcccggcaatgccgccatccgggagaagctggcctgggccaaggagaagtacagcatcggggagcccacagtgccatccaccctggcagaggagtttacctacaaccccttcatgagagtgagggagaagacggtgcagcagcacgcaggtgagacggacccggtgaccaccatgcgggccgtgcgcagggagaaggaccagttcaagatgccccgggactgaggccgccctgcaccttcagcggatttggggattaggctcttttaggtaactggctttcctgctggtccgtgcgggaaattcagtcttgatttaaccttaattttacagcccttggcttgtgttatcggacgttttaatgcatatttataagagaagtttaacaagtatttattcccataaaaaaacttccccttg

SEQ ID NO: 278792 - DNA, 4080 bp, Homo sapiens
  misc_feature (4080)..(4080): n is a, c, g, or t
agcgggcggggccgtcgcacctgcacgaggctgtggcccgagcgtcctgtggagaagccgcgaagcgcgggcgacccgggggtcgggcgggccaggtccgcgaggccgcggcggcagctgtgcaggcccggggagcagccggccgggcgagcctcggatattggatcagaaaggtacactttcagcttcaccattcgggattcaccagcacattttgtaaatgcagcttcctggggcaatgaagattacatcaagtctctttctgacagctttagggttggtgactgtgtgataattgaaaatcctctgatccaaagaaaggaaatagaaagagaagaaaaattcagccctgcaactcctagcaactgtaaactgttgctcagtgagaatcactcaacagtaaaagtttgttccagttatgaagtggacacaaagttactttctttgatacatttacctgttaaagagtctcatgattattattcactgggtgacattgttgcaaatggacacagtcttaatgggaggattattaacgtgcttgcagctgtgaaatcggttggagagccaaaatactttacaacttcagaccggagaaaaggccagaggtgtgaagttagactctatgatgaaacagagtcgtcttttgcgatgacatgttgggataatgaatccattctacttgcacagagctggatgccacgagaaacagtaatatttgcctcagatgtaagaataaattttgacaaatttcggaactgcatgacagcaactgtaatctcaaaaaccattattacaactaatccagaagctaacattctgctgaattttatacgagaaaataaagaaacgaatgttctggatgatgaaattgacagttatttcaaagaatccataaatttaagtacaatagttgatgtctacacagttgaacaattaaagggaaaagctttgaagaatgaaggaaaagctgatccttcctatggcatcctttatgcctacatttccacactcaacattgatgatgaaactacaaaagtagttcgaaatagatgttccagctgtggttatattgtaaatgaagcatctaacatgtgcacaacttgcaacaaaaactccttggactttaaatctgtctttctcagtttccatgtgctgattgatctgactgatcacacaggcacccttcattcctgtagtctcacaggaagtgttgctgaggagactttgggctgctgtaacctcagaaacgggaagctgagggaggattgcttgaccccgggagttcgaggctgcagtgagctgtgatagcactgctgcactccagcttgggcgacagagtgagaccctgtctcagcccgtgtatgccagcctcgatctcatcgttttctttaaccggtccaactccctttggcgtcccagtcaagataatatctccttcttccaaggttatgatcttagaaacatagctgatgatgtaggggatggaaaaaatcatggaggatgtctcaccctcctgtctgagttcgccgttgaccttgagccagagcttcagcttgtgagggtcagggatcttctccttgggcacgaacgcgctgaccgggcaggacgccgtgaagctcttcgccagagtccagggcagccccttcttcttgcactcgtcctgcacgtcccgggcggtcatatccaggcacagggcatagccgcccacgtagtccatggccgcagcctcggggactgcgcggcagcgcttgcccatcaccacgcccagctccagctcgtggtgcaggttgcgagtgtacgcgggcatgaggatgggcgagccctcgggcgcgtaggccgtggacggcttcaggaacagcacgggctcgctcaacaccgcgctgcgcatctccctgacgtggtccgcgtagttcctccccacgcagacgatgttctttccccactcccagaagcgggacaatggcctggatgctgccatgattcccatcaagtgcccctgtagtcacgtgggctgggccggtcagctgatgcctacggcatcccggagaggaccaactgcctcggaacgctgtcccccgcagcgacggcccgttccacctcgcgatctgccgggtacccgggcggcgtggcgctcggcctccagggatccactgtgcggtgccaaaaaagaggcggaggctcgcggcacagctctcccggcgcagctctcgggccgccgccgccgccgctcccaggcccgtctcccggcccgtggcagtcggggctcgcggagaaaacaagttgagcgcgagcgcgttgattggttggcggacggtgcgaggtggacgctgattggctgagggcagcgcgaggcgggcgctgattggctgcgacgcgccgacgccggtgttttgcagtcctgggcagctcggcagtccagcccggcccgggtcatggtggtgggccgagggctgctcggccgccgcagcctcgccgcgctgggagccgcctgcgcccgccgaggcctcggtccagccctgctgggagttttctgccacacagatttgcggaagaacctgaccgtggacgagggcaccatgaaggtagaggtgctgcctgccctgaccgacaactacatgtacctggtcattgatgatgagaccaaggaggctgccattgtggatccggtgcagccccagaaggtcgtggacgcggcgagaaagcacggggtgaaactgaccacagtgctcaccacccaccaccactgggaccatgctggcgggaatgagaaactggtcaagctggagtcgggactgaaggtgtacgggggtgacgaccgtatcggggccctgactcacaagatcactcacctgtccacactgcaggtggggtctctgaacgtcaagtgcctggcgaccccgtgccacacttcaggacacatttgttacttcgtgagcaagcccggaggctcggagccccctgccgtgttcacaggtgacaccttgtttgtggctggctgcgggaagttctatgaagggactgcggatgagatgtgtaaagctctgctggaggtcttgggccggctccccccggacacaagagtctactgtggccacgagtacaccatcaacaacctcaagtttgcacgccacgtggagcccggcaatgccgccatccgggagaagctggcctgggccaaggagaagtacagcatcggggagcccacagtgccatccaccctggcagaggagtttacctacaaccccttcatgagagtgagggagaagacggtgcagcagcacgcaggtgagacggacccggtgaccaccatgcgggccgtgcgcagggagaaggaccagttcaagatgccccgggactgaggccgccctgcaccttcagcggatttggggattaggctcttttaggtaactggctttcctgctggtccgtgcgggaaattcagtcttgatttaaccttaattttacagcccttggcttgtgttatcggacgttttaatgcatatttataagagaagtttaacaagtatttattctcgtgccgaattcggcacgaggaactagtctcgagttttttttttttttttttcatgaatcatgtttggttcctgtgaaagtccctggtccagggatcctcctcctttctcttttacttctgaattctgaaattcagttagttacttttgcctttcgctcttctatcacagccaccttgaccttgggtaaaacccaaggtctttccttctggctaccttcctgcaggtccaccctgtctgccattggtcttctctgcctctgactacatctgccaccaacaacccttccctcacccctgccaggggcagacaggcttctcagcagaactgtgactgaaatcagagctgctggctggggcagtgttaactacacagaggcacatcctgacagggtttgccccagagatctaaattccatgaggagggcaccaccacctaggaagggtaatccacgttcagaaggttgctagtcttaagtacattccatgaatttttgcttcattactgaccttatttgaccttgaaggaaccttttttttttttn

SEQ ID NO: 278793 - DNA, 3845 bp, Homo sapiens
agcgggcggggccgtcgcacctgcacgaggctgtggcccgagcgtcctgtggagaagccgcgaagcgcgggcgacccgggggtcgggcgggccaggtccgcgaggccgcggcggcagctgtgcaggcccggggagcagccggccgggcgagcctcggatattggatcagaaaggtacactttcagcttcaccattcgggattcaccagcacattttgtaaatgcagcttcctggggcaatgaagattacatcaagtctctttctgacagctttagggttggtgactgtgtgataattgaaaatcctctgatccaaagaaaggaaatagaaagagaagaaaaattcagccctgcaactcctagcaactgtaaactgttgctcagtgagaatcactcaacagtaaaagtttgttccagttatgaagtggacacaaagttactttctttgatacatttacctgttaaagagtctcatgattattattcactgggtgacattgttgcaaatggacacagtcttaatgggaggattattaacgtgcttgcagctgtgaaatcggttggagagccaaaatactttacaacttcagaccggagaaaaggccagaggtgtgaagttagactctatgatgaaacagagtcgtcttttgcgatgacatgttgggataatgaatccattctacttgcacagagctggatgccacgagaaacagtaatatttgcctcagatgtaagaataaattttgacaaatttcggaactgcatgacagcaactgtaatctcaaaaaccattattacaactaatccagaagctaacattctgctgaattttatacgagaaaataaagaaacgaatgttctggatgatgaaattgacagttatttcaaagaatccataaatttaagtacaatagttgatgtctacacagttgaacaattaaagggaaaagctttgaagaatgaaggaaaagctgatccttcctatggcatcctttatgcctacatttccacactcaacattgatgatgaaactacaaaagtagttcgaaatagatgttccagctgtggttatattgtaaatgaagcatctaacatgtgcacaacttgcaacaaaaactccttggactttaaatctgtctttctcagtttccatgtgctgattgatctgactgatcacacaggcacccttcattcctgtagtctcacaggaagtgttgctgaggagactttgggctgctgtaacctcagaaacgggaagctgagggaggattgcttgaccccgggagttcgaggctgcagtgagctgtgatagcactgctgcactccagcttgggcgacagagtgagaccctgtctcagcccgtgtatgccagcctcgatctcatcgttttctttaaccggtccaactccctttggcgtcccagtcaagataatatctccttcttccaaggttatgatcttagaaacatagctgatgatgtaggggatggaaaaaatcatggaggatgtctcaccctcctgtctgagttcgccgttgaccttgagccagagcttcagcttgtgagggtcagggatcttctccttgggcacgaacgcgctgaccgggcaggacgccgtgaagctcttcgccagagtccagggcagccccttcttcttgcactcgtcctgcacgtcccgggcggtcatatccaggcacagggcatagccgcccacgtagtccatggccgcagcctcggggactgcgcggcagcgcttgcccatcaccacgcccagctccagctcgtggtgcaggttgcgagtgtacgcgggcatgaggatgggcgagccctcgggcgcgtaggccgtggacggcttcaggaacagcacgggctcgctcaacaccgcgctgcgcatctccctgacgtggtccgcgtagttcctccccacgcagacgatgttctttccccactcccagaagcgggacaatggcctggatgctgccatgattcccatcaagtgcccctgtagtcacgtgggctgggccggtcagctgatgcctacggcatcccggagaggaccaactgcctcggaacgctgtcccccgcagcgacggcccgttccacctcgcgatctgccgggtacccgggcggcgtggcgctcggcctccagggatccactgtgcggtgccaaaaaagaggcggaggctcgcggcacagctctcccggcgcagctctcgggccgccgccgccgccgctcccaggcccgtctcccggcccgtggcagtcggggctcgcggagaaaacaagttgagcgcgagcgcgttgattggttggcggacggtgcgaggtggacgctgattggctgagggcagcgcgaggcgggcgctgattggctgcgacgcgccgacgccggtgttttgcagtcctgggcagctcggcagtccagcccggcccgggtcatggtggtgggccgagggctgctcggccgccgcagcctcgccgcgctgggagccgcctgcgcccgccgaggcctcggtccagccctgctgggagttttctgccacacagatttgcggaagaacctgaccgtggacgagggcaccatgaaggtagaggtgctgcctgccctgaccgacaactacatgtacctggtcattgatgatgagaccaaggaggctgccattgtggatccggtgcagccccagaaggtcgtggacgcggcgagaaagcacggggtgaaactgaccacagtgctcaccacccaccaccactgggaccatgctggcgggaatgagaaactggtcaagctggagtcgggactgaaggtgtacgggggtgacgaccgtatcggggccctgactcacaagatcactcacctgtccacactgcaggtggggtctctgaacgtcaagtgcctggcgaccccgtgccacacttcaggacacatttgttacttcgtgagcaagcccggaggctcggagccccctgccgtgttcacaggtgacaccttgtttgtggctggctgcgggaagttctatgaagggactgcggatgagatgtgtaaagctctgctggaggtcttgggccggctccccccggacacaagagtctactgtggccacgagtacaccatcaacaacctcaagtttgcacgccacgtggagcccggcaatgccgccatccgggagaagctggcctgggccaaggagaagtacagcatcggggagcccacagtgccatccaccctggcagaggagtttacctacaaccccttcatgagagtgagggagaagacggtgcagcagcacgcaggtgagacggacccggtgaccaccatgcgggccgtgcgcagggagaaggaccagttcaagatgccccgggactgaggccgccctgcaccttcagcggatttggggattaggctcttttagaaatcagccagctaactagaaaatcggcaagagaccgaaaccagcagtggctgaggccagatgaccctgtggctgtgtgctggacaagatgctcggtctcccaggtgatggccaccgtccactcgccactggcctgagtgtagacaggtatgcacccacaggatgcagagccacagggctcggtggcattgctggaaacagtgagaaggacagggacagatgtattccaggacgtgacctagacatggcctcacctccctcgggtcctgtcctacagaaagccaggccctgtgcggcctgaagacaggcagaatgcggctcatggaggagcctgggaggccaccggccttgagctgggagaggccacggggagtggggccattgggggtggcggcagtgatgggggcctctggaactcaatgggctgaatgtgtgtgt

SEQ ID NO: 278794 - DNA, 3448 bp, Homo sapiens
agcgggcggggccgtcgcacctgcacgaggctgtggcccgagcgtcctgtggagaagccgcgaagcgcgggcgacccgggggtcgggcgggccaggtccgcgaggccgcggcggcagctgtgcaggcccggggagcagccggccgggcgagcctcggatattggatcagaaaggtacactttcagcttcaccattcgggattcaccagcacattttgtaaatgcagcttcctggggcaatgaagattacatcaagtctctttctgacagctttagggttggtgactgtgtgataattgaaaatcctctgatccaaagaaaggaaatagaaagagaagaaaaattcagccctgcaactcctagcaactgtaaactgttgctcagtgagaatcactcaacagtaaaagtttgttccagttatgaagtggacacaaagttactttctttgatacatttacctgttaaagagtctcatgattattattcactgggtgacattgttgcaaatggacacagtcttaatgggaggattattaacgtgcttgcagctgtgaaatcggttggagagccaaaatactttacaacttcagaccggagaaaaggccagaggtgtgaagttagactctatgatgaaacagagtcgtcttttgcgatgacatgttgggataatgaatccattctacttgcacagagctggatgccacgagaaacagtaatatttgcctcagatgtaagaataaattttgacaaatttcggaactgcatgacagcaactgtaatctcaaaaaccattattacaactaatccagaagctaacattctgctgaattttatacgagaaaataaagaaacgaatgttctggatgatgaaattgacagttatttcaaagaatccataaatttaagtacaatagttgatgtctacacagttgaacaattaaagggaaaagctttgaagaatgaaggaaaagctgatccttcctatggcatcctttatgcctacatttccacactcaacattgatgatgaaactacaaaagtagttcgaaatagatgttccagctgtggttatattgtaaatgaagcatctaacatgtgcacaacttgcaacaaaaactccttggactttaaatctgtctttctcagtttccatgtgctgattgatctgactgatcacacaggcacccttcattcctgtagtctcacaggaagtgttgctgaggagactttgggctgctgtaacctcagaaacgggaagctgagggaggattgcttgaccccgggagttcgaggctgcagtgagctgtgatagcactgctgcactccagcttgggcgacagagtgagaccctgtctcagcccgtgtatgccagcctcgatctcatcgttttctttaaccggtccaactccctttggcgtcccagtcaagataatatctccttcttccaaggttatgatcttagaaacatagctgatgatgtaggggatggaaaaaatcatggaggatgtctcaccctcctgtctgagttcgccgttgaccttgagccagagcttcagcttgtgagggtcagggatcttctccttgggcacgaacgcgctgaccgggcaggacgccgtgaagctcttcgccagagtccagggcagccccttcttcttgcactcgtcctgcacgtcccgggcggtcatatccaggcacagggcatagccgcccacgtagtccatggccgcagcctcggggactgcgcggcagcgcttgcccatcaccacgcccagctccagctcgtggtgcaggttgcgagtgtacgcgggcatgaggatgggcgagccctcgggcgcgtaggccgtggacggcttcaggaacagcacgggctcgctcaacaccgcgctgcgcatctccctgacgtggtccgcgtagttcctccccacgcagacgatgttctttccccactcccagaagcgggacaatggcctggatgctgccatgattcccatcaagtgcccctgtagtcacgtgggctgggccggtcagctgatgcctacggcatcccggagaggaccaactgcctcggaacgctgtcccccgcagcgacggcccgttccacctcgcgatctgccgggtacccgggcggcgtggcgctcggcctccagggatccactgtgcggtgccaaaaaagaggcggaggctcgcggcacagctctcccggcgcagctctcgggccgccgccgccgccgctcccaggcccgtctcccggcccgtggcagtcggggctcgcggagaaaacaagttgagcgcgagcgcgttgattggttggcggacggtgcgaggtggacgctgattggctgagggcagcgcgaggcgggcgctgattggctgcgacgcgccgacgccggtgttttgcagtcctgggcagctcggcagtccagcccggcccgggtcatggtggtgggccgagggctgctcggccgccgcagcctcgccgcgctgggagccgcctgcgcccgccgaggcctcggtccagccctgctgggagttttctgccacacagatttgcggaagaacctgaccgtggacgagggcaccatgaaggtagaggtgctgcctgccctgaccgacaactacatgtacctggtcattgatgatgagaccaaggaggctgccattgtggatccggtgcagccccagaaggtcgtggacgcggcgagaaagcacggggtgaaactgaccacagtgctcaccacccaccaccactgggaccatgctggcgggaatgagaaactggtcaagctggagtcgggactgaaggtgtacgggggtgacgaccgtatcggggccctgactcacaagatcactcacctgtccacactgcaggtgacaccttgtttgtggctggctgcgggaagttctatgaagggactgcggatgagatgtgtaaagctctgctggaggtcttgggccggctccccccggacacaagagtctactgtggccacgagtacaccatcaacaacctcaagtttgcacgccacgtggagcccggcaatgccgccatccgggagaagctggcctgggccaaggagaagtacagcatcggggagcccacagtgccatccaccctggcagaggagtttacctacaaccccttcatgagagtgagggagaagacggtgcagcagcacgcaggtgagacggacccggtgaccaccatgcgggccgtgcgcagggagaaggaccagttcaagatgccccgggactgaggccgccctgcaccttcagcggatttggggattaggctcttttaggtaactggctttcctgctggtccgtgcgggaaattcagtcttgatttaaccttaattttacagcccttggcttgtgttatcggacgttttaatgcatatttataagagaagtttaacaagtatttattcccataaaaaaacttccccttg

SEQ ID NO: 278795 - DNA, 3586 bp, Homo sapiens
agcgggcggggccgtcgcacctgcacgaggctgtggcccgagcgtcctgtggagaagccgcgaagcgcgggcgacccgggggtcgggcgggccaggtccgcgaggccgcggcggcagctgtgcaggcccggggagcagccggccgggcgagcctcggatattggatcagaaaggtacactttcagcttcaccattcgggattcaccagcacattttgtaaatgcagcttcctggggcaatgaagattacatcaagtctctttctgacagctttagggttggtgactgtgtgataattgaaaatcctctgatccaaagaaaggaaatagaaagagaagaaaaattcagccctgcaactcctagcaactgtaaactgttgctcagtgagaatcactcaacagtaaaagtttgttccagttatgaagtggacacaaagttactttctttgatacatttacctgttaaagagtctcatgattattattcactgggtgacattgttgcaaatggacacagtcttaatgggaggattattaacgtgcttgcagctgtgaaatcggttggagagccaaaatactttacaacttcagaccggagaaaaggccagaggtgtgaagttagactctatgatgaaacagagtcgtcttttgcgatgacatgttgggataatgaatccattctacttgcacagagctggatgccacgagaaacagtaatatttgcctcagatgtaagaataaattttgacaaatttcggaactgcatgacagcaactgtaatctcaaaaaccattattacaactaatccagaagctaacattctgctgaattttatacgagaaaataaagaaacgaatgttctggatgatgaaattgacagttatttcaaagaatccataaatttaagtacaatagttgatgtctacacagttgaacaattaaagggaaaagctttgaagaatgaaggaaaagctgatccttcctatggcatcctttatgcctacatttccacactcaacattgatgatgaaactacaaaagtagttcgaaatagatgttccagctgtggttatattgtaaatgaagcatctaacatgtgcacaacttgcaacaaaaactccttggactttaaatctgtctttctcagtttccatgtgctgattgatctgactgatcacacaggcacccttcattcctgtagtctcacaggaagtgttgctgaggagactttgggctgctgtaacctcagaaacgggaagctgagggaggattgcttgaccccgggagttcgaggctgcagtgagctgtgatagcactgctgcactccagcttgggcgacagagtgagaccctgtctcagcccgtgtatgccagcctcgatctcatcgttttctttaaccggtccaactccctttggcgtcccagtcaagataatatctccttcttccaaggttatgatcttagaaacatagctgatgatgtaggggatggaaaaaatcatggaggatgtctcaccctcctgtctgagttcgccgttgaccttgagccagagcttcagcttgtgagggtcagggatcttctccttgggcacgaacgcgctgaccgggcaggacgccgtgaagctcttcgccagagtccagggcagccccttcttcttgcactcgtcctgcacgtcccgggcggtcatatccaggcacagggcatagccgcccacgtagtccatggccgcagcctcggggactgcgcggcagcgcttgcccatcaccacgcccagctccagctcgtggtgcaggttgcgagtgtacgcgggcatgaggatgggcgagccctcgggcgcgtaggccgtggacggcttcaggaacagcacgggctcgctcaacaccgcgctgcgcatctccctgacgtggtccgcgtagttcctccccacgcagacgatgttctttccccactcccagaagcgggacaatggcctggatgctgccatgattcccatcaagtgcccctgtagtcacgtgggctgggccggtcagctgatgcctacggcatcccggagaggaccaactgcctcggaacgctgtcccccgcagcgacggcccgttccacctcgcgatctgccgggtacccgggcggcgtggcgctcggcctccagggatccactgtgcggtgccaaaaaagaggcggaggctcgcggcacagctctcccggcgcagctctcgggccgccgccgccgccgctcccaggcccgtctcccggcccgtggcagtcggggctcgcggagaaaacaagttgagcgcgagcgcgttgattggttggcggacggtgcgaggtggacgctgattggctgagggcagcgcgaggcgggcgctgattggctgcgacgcgccgacgccggtgttttgcagtcctgggcagctcggcagtccagcccggcccgggtcatggtggtgggccgagggctgctcggccgccgcagcctcgccgcgctgggagccgcctgcgcccgccgaggcctcggtccagccctgctgggagttttctgccacacagatttgcggaagaacctgaccgtggacgagggcaccatgaaggtagaggtgctgcctgccctgaccgacaactacatgtacctggtcattgatgatgagaccaaggaggctgccattgtggatccggtgcagccccagaaggtcgtggacgcggcgagaaagcacggggtgaaactgaccacagtgctcaccacccaccaccactgggaccatgctggcgggaatgagaaactggtcaagctggagtcgggactgaaggtgtacgggggtgacgaccgtatcggggccctgactcacaagatcactcacctgtccacactgcaggtggggtctctgaacgtcaagtgcctggcgaccccgtgccacacttcaggacacatttgttacttcgtgagcaagcccggaggctcggagccccctgccgtgttcacagacaccttgtttgtggctggctgcgggaaaaaaaggggtttttttttctctttcaaatttgaaaaaagggggggactgcggatgagatgtgtaaagctctgctggaggtcttgggccggctccccccggacacaagagtctactgtggccacgagtacaccatcaacaacctcaagtttgcacgccacgtggagcccggcaatgccgccatccgggagaagctggcctgggccaaggagaagtacagcatcggggagcccacagtgccatccaccctggcagaggagtttacctacaaccccttcatgagagtgagggagaagacggtgcagcagcacgcaggtgagacggacccggtgaccaccatgcgggccgtgcgcagggagaaggaccagttcaagatgccccgggactgaggccgccctgcaccttcagcggatttggggattaggctcttttaggtaactggctttcctgctggtccgtgcgggaaattcagtcttgatttaaccttaattttacagcccttggcttgtgttatcggacgttttaatgcatatttataagagaagtttaacaagtatttattcccataaaaaaacttccccttg

SEQ ID NO: 278796 - DNA, 3065 bp, Homo sapiens
agcgggcggggccgtcgcacctgcacgaggctgtggcccgagcgtcctgtggagaagccgcgaagcgcgggcgacccgggggtcgggcgggccaggtccgcgaggccgcggcggcagctgtgcaggcccggggagcagccggccgggcgagcctcggatattggatcagaaaggtacactttcagcttcaccattcgggattcaccagcacattttgtaaatgcagcttcctggggcaatgaagattacatcaagtctctttctgacagctttagggttggtgactgtgtgataattgaaaatcctctgatccaaagaaaggaaatagaaagagaagaaaaattcagccctgcaactcctagcaactgtaaactgttgctcagtgagaatcactcaacagtaaaagtttgttccagttatgaagtggacacaaagttactttctttgatacatttacctgttaaagagtctcatgattattattcactgggtgacattgttgcaaatggacacagtcttaatgggaggattattaacgtgcttgcagctgtgaaatcggttggagagccaaaatactttacaacttcagaccggagaaaaggccagaggtgtgaagttagactctatgatgaaacagagtcgtcttttgcgatgacatgttgggataatgaatccattctacttgcacagagctggatgccacgagaaacagtaatatttgcctcagatgtaagaataaattttgacaaatttcggaactgcatgacagcaactgtaatctcaaaaaccattattacaactaatccagaagctaacattctgctgaattttatacgagaaaataaagaaacgaatgttctggatgatgaaattgacagttatttcaaagaatccataaatttaagtacaatagttgatgtctacacagttgaacaattaaagggaaaagctttgaagaatgaaggaaaagctgatccttcctatggcatcctttatgcctacatttccacactcaacattgatgatgaaactacaaaagtagttcgaaatagatgttccagctgtggttatattgtaaatgaagcatctaacatgtgcacaacttgcaacaaaaactccttggactttaaatctgtctttctcagtttccatgtgctgattgatctgactgatcacacaggcacccttcattcctgtagtctcacaggaagtgttgctgaggagactttgggctgctgtaacctcagaaacgggaagctgagggaggattgcttgaccccgggagttcgaggctgcagtgagctgtgatagcactgctgcactccagcttgggcgacagagtgagaccctgtctcagcccgtgtatgccagcctcgatctcatcgttttctttaaccggtccaactccctttggcgtcccagtcaagataatatctccttcttccaaggttatgatcttagaaacatagctgatgatgtaggggatggaaaaaatcatggaggatgtctcaccctcctgtctgagttcgccgttgaccttgagccagagcttcagcttgtgagggtcagggatcttctccttgggcacgaacgcgctgaccgggcaggacgccgtgaagctcttcgccagagtccagggcagccccttcttcttgcactcgtcctgcacgtcccgggcggtcatatccaggcacagggcatagccgcccacgtagtccatggccgcagcctcggggactgcgcggcagcgcttgcccatcaccacgcccagctccagctcgtggtgcaggttgcgagtgtacgcgggcatgaggatgggcgagccctcgggcgcgtaggccgtggacggcttcaggaacagcacgggctcgctcaacaccgcgctgcgcatctccctgacgtggtccgcgtagttcctccccacgcagacgatgttctttccccactcccagaagcgggacaatggcctggatgctgccatgattcccatcaagtgcccctgtagtcacgtgggctgggccggtcagctgatgcctacggcatcccggagaggaccaactgcctcggaacgctgtcccccgcagcgacggcccgttccacctcgcgatctgccgggtacccgggcggcgtggcgctcggcctccagggatccactgtgcggtgccaaaaaagaggcggaggctcgcggcacagctctcccggcgcagctctcgggccgccgccgccgccgctcccaggcccgtctcccggcccgtggcagtcggggctcgcggagaaaacaagttgagcgcgagcgcgttgattggttggcggacggtgcgaggtggacgctgattggctgagggcagcgcgaggcgggcgctgattggctgcgacgcgccgacgccggtgttttgcagtcctgggcagctcggcagtccagcccggcccgggtcatggtggtgggccgagggctgctcggccgccgcagcctcgccgcgctgggagccgcctgcgcccgccgaggcctcggtccagccctgctgggagttttctgccacacagatttgcggaagaacctgaccgtggacgagggcaccatgaaggtagaggtgctgcctgccctgaccgacaactacatgtacctggtcattgatgatgagaccaaggaggctgccattgtggatccggtgcagccccagaaggtcgtggacgcggcgagaaagcacggggtgaaactgaccacagtgctcaccacccaccaccactgggaccatgctggcgggaatgagaaactggtcaagctggagtcgggactgaaggtgtacgggggtgacgaccgtatcggggccctgactcacaagatcactcacctgtccacactgcaggtggggtctctgaacgtcaagtgcctggcgaccccgtgccacacttcaggacacatttgttacttcgtgagcaagcccggaggctcggagccccctgccgtgttcacagaaactgaccacagtgctcaccacccaccaccactgggaccatgctggcgggaatgagaaactggtcaagctggagtcgggactgaaggc

SEQ ID NO: 278797 - DNA, 3482 bp, Homo sapiens
agcgggcggggccgtcgcacctgcacgaggctgtggcccgagcgtcctgtggagaagccgcgaagcgcgggcgacccgggggtcgggcgggccaggtccgcgaggccgcggcggcagctgtgcaggcccggggagcagccggccgggcgagcctcggatattggatcagaaaggtacactttcagcttcaccattcgggattcaccagcacattttgtaaatgcagcttcctggggcaatgaagattacatcaagtctctttctgacagctttagggttggtgactgtgtgataattgaaaatcctctgatccaaagaaaggaaatagaaagagaagaaaaattcagccctgcaactcctagcaactgtaaactgttgctcagtgagaatcactcaacagtaaaagtttgttccagttatgaagtggacacaaagttactttctttgatacatttacctgttaaagagtctcatgattattattcactgggtgacattgttgcaaatggacacagtcttaatgggaggattattaacgtgcttgcagctgtgaaatcggttggagagccaaaatactttacaacttcagaccggagaaaaggccagaggtgtgaagttagactctatgatgaaacagagtcgtcttttgcgatgacatgttgggataatgaatccattctacttgcacagagctggatgccacgagaaacagtaatatttgcctcagatgtaagaataaattttgacaaatttcggaactgcatgacagcaactgtaatctcaaaaaccattattacaactaatccagaagctaacattctgctgaattttatacgagaaaataaagaaacgaatgttctggatgatgaaattgacagttatttcaaagaatccataaatttaagtacaatagttgatgtctacacagttgaacaattaaagggaaaagctttgaagaatgaaggaaaagctgatccttcctatggcatcctttatgcctacatttccacactcaacattgatgatgaaactacaaaagtagttcgaaatagatgttccagctgtggttatattgtaaatgaagcatctaacatgtgcacaacttgcaacaaaaactccttggactttaaatctgtctttctcagtttccatgtgctgattgatctgactgatcacacaggcacccttcattcctgtagtctcacaggaagtgttgctgaggagactttgggctgctgtaacctcagaaacgggaagctgagggaggattgcttgaccccgggagttcgaggctgcagtgagctgtgatagcactgctgcactccagcttgggcgacagagtgagaccctgtctcagcccgtgtatgccagcctcgatctcatcgttttctttaaccggtccaactccctttggcgtcccagtcaagataatatctccttcttccaaggttatgatcttagaaacatagctgatgatgtaggggatggaaaaaatcatggaggatgtctcaccctcctgtctgagttcgccgttgaccttgagccagagcttcagcttgtgagggtcagggatcttctccttgggcacgaacgcgctgaccgggcaggacgccgtgaagctcttcgccagagtccagggcagccccttcttcttgcactcgtcctgcacgtcccgggcggtcatatccaggcacagggcatagccgcccacgtagtccatggccgcagcctcggggactgcgcggcagcgcttgcccatcaccacgcccagctccagctcgtggtgcaggttgcgagtgtacgcgggcatgaggatgggcgagccctcgggcgcgtaggccgtggacggcttcaggaacagcacgggctcgctcaacaccgcgctgcgcatctccctgacgtggtccgcgtagttcctccccacgcagacgatgttctttccccactcccagaagcgggacaatggcctggatgctgccatgattcccatcaagtgcccctgtagtcacgtgggctgggccggtcagctgatgcctacggcatcccggagaggaccaactgcctcggaacgctgtcccccgcagcgacggcccgttccacctcgcgatctgccgggtacccgggcggcgtggcgctcggcctccagggatccactgtgcggtgccaaaaaagaggcggaggctcgcggcacagctctcccggcgcagctctcgggccgccgccgccgccgctcccaggcccgtctcccggcccgtggcagtcggggctcgcggagaaaacaagttgagcgcgagcgcgttgattggttggcggacggtgcgaggtggacgctgattggctgagggcagcgcgaggcgggcgctgattggctgcgacgcgccgacgccggtgttttgcagtcctgggcagctcggcagtccagcccggcccgggtcatggtggtgggccgagggctgctcggccgccgcagcctcgccgcgctgggagccgcctgcgcccgccgaggcctcggtgcctaaggccgcgctgccgggctcgagcggaggcggcgcaggcgctgaggctggcgcggagcgggcgcggggccgcgggtgcggaaagcgctaggtccagccctgctgggagttttctgccacacagatttgcggaagaacctgaccgtggacgagggcaccatgaaggtagaggtgctgcctgccctgaccgacaactacatgtacctggtcattgatgatgagaccaaggaggctgccattgtggatccggtgcagccccagaaggtcgtggacgcggcgagaaagcacggggtgaaactgaccacagtgctcaccacccaccaccactggtaagtgccgcgtctcacctgggggtgtgggacctggctcacttctcgccccggtgggtttagggacatcaaggcctgtctccccccacggctctgtctgctttgtgaggacaagcccccagcagacttctgagaaagactcgggactcaccgtagcccccaaggggcaagtctggtgctcagtgactctgaggccccgagggtgaggggagaaggttacagccttaccctcaggccccaccccccggctctctcctgggccatgcgggtttgtgccctggcacgttggcctcaatgttggggaggaaatgagtctacaggtgagtggtttttaaaaaaaaaaaacaaacaaaaaaaaaaaaaaacaagcagccagccgggcacggtggctcatgcctataatcccagcactttgggaggctgaggtagttgggtcacttgaggtcaggaccagcctggccaacacggtgaaacccagtctctaccgaaaatacaaaaattaactgggcgtggtggtgggcgcctgtaatctcagctactcgggaggctgaagcaggagaatcacttgaacccgggaggcggaggttgccgtgagccaagatcgtggcattgcactccagcctgggtgacagagcga

SEQ ID NO: 278798 - DNA, 2970 bp, Homo sapiens
agcgggcggggccgtcgcacctgcacgaggctgtggcccgagcgtcctgtggagaagccgcgaagcgcgggcgacccgggggtcgggcgggccaggtccgcgaggccgcggcggcagctgtgcaggcccggggagcagccggccgggcgagcctcggatattggatcagaaaggtacactttcagcttcaccattcgggattcaccagcacattttgtaaatgcagcttcctggggcaatgaagattacatcaagtctctttctgacagctttagggttggtgactgtgtgataattgaaaatcctctgatccaaagaaaggaaatagaaagagaagaaaaattcagccctgcaactcctagcaactgtaaactgttgctcagtgagaatcactcaacagtaaaagtttgttccagttatgaagtggacacaaagttactttctttgatacatttacctgttaaagagtctcatgattattattcactgggtgacattgttgcaaatggacacagtcttaatgggaggattattaacgtgcttgcagctgtgaaatcggttggagagccaaaatactttacaacttcagaccggagaaaaggccagaggtgtgaagttagactctatgatgaaacagagtcgtcttttgcgatgacatgttgggataatgaatccattctacttgcacagagctggatgccacgagaaacagtaatatttgcctcagatgtaagaataaattttgacaaatttcggaactgcatgacagcaactgtaatctcaaaaaccattattacaactaatccagaagctaacattctgctgaattttatacgagaaaataaagaaacgaatgttctggatgatgaaattgacagttatttcaaagaatccataaatttaagtacaatagttgatgtctacacagttgaacaattaaagggaaaagctttgaagaatgaaggaaaagctgatccttcctatggcatcctttatgcctacatttccacactcaacattgatgatgaaactacaaaagtagttcgaaatagatgttccagctgtggttatattgtaaatgaagcatctaacatgtgcacaacttgcaacaaaaactccttggactttaaatctgtctttctcagtttccatgtgctgattgatctgactgatcacacaggcacccttcattcctgtagtctcacaggaagtgttgctgaggagactttgggctgctgtaacctcagaaacgggaagctgagggaggattgcttgaccccgggagttcgaggctgcagtgagctgtgatagcactgctgcactccagcttgggcgacagagtgagaccctgtctcagcccgtgtatgccagcctcgatctcatcgttttctttaaccggtccaactccctttggcgtcccagtcaagataatatctccttcttccaaggttatgatcttagaaacatagctgatgatgtaggggatggaaaaaatcatggaggatgtctcaccctcctgtctgagttcgccgttgaccttgagccagagcttcagcttgtgagggtcagggatcttctccttgggcacgaacgcgctgaccgggcaggacgccgtgaagctcttcgccagagtccagggcagccccttcttcttgcactcgtcctgcacgtcccgggcggtcatatccaggcacagggcatagccgcccacgtagtccatggccgcagcctcggggactgcgcggcagcgcttgcccatcaccacgcccagctccagctcgtggtgcaggttgcgagtgtacgcgggcatgaggatgggcgagccctcgggcgcgtaggccgtggacggcttcaggaacagcacgggctcgctcaacaccgcgctgcgcatctccctgacgtggtccgcgtagttcctccccacgcagacgatgttctttccccactcccagaagcgggacaatggcctggatgctgccatgattcccatcaagtgcccctgtagtcacgtgggctgggccggtcagctgatgcctacggcatcccggagaggaccaactgcctcggaacgctgtcccccgcagcgacggcccgttccacctcgcgatctgccgggtacccgggcggcgtggcgctcggcctccagggatccactgtgcggtgccaaaaaagaggcggaggctcgcggcacagctctcccggcgcagctctcgggccgccgccgccgccgctcccaggcccgtctcccggcccgtggcagtcggggctcgcggagaaaacaagttgagcgcgagcgcgttgattggttggcggacggtgcgaggtggacgctgattggctgagggcagcgcgaggcgggcgctgattggctgcgacgcgccgacgccggtgttttgcagtcctgggcagctcggcagtccagcccggcccgggtcatggtggtgggccgagggctgctcggccgccgcagcctcgccgcgctgggagccgcctgcgcccgccgaggcctcggtccagccctgctgggagttttctgccacacagatttgcggaagaacctgaccgtggacgagggcaccatgaaggtagaggtgctgcctgccctgaccgacaactacatgtacctggtcattgatgatgagaccaaggaggctgccattgtggatccggtgcagccccagaaggtcgtggacgcggcgagaaagcacggggtgaaactgaccacagtgctcaccacccaccaccactgggaccatgctggcgggaatgagaaactggtcaagctggacttcagcggatttggggattaggctcttttaggtaactggctttcctgctggtccgtgcgggaaattcagtcttgatttaaccttaattttacagcccttggcttgtgttatcggacgttttaatgcatatttataagagaagtttaacaagtatttattcccataaaaaaacttccccttg

SEQ ID NO: 278799 - DNA, 1712 bp, Homo sapiens
agcgggcggggccgtcgcacctgcacgaggctgtggcccgagcgtcctgtggagaagccgcgaagcgcgggcgacccgggggtcgggcgggccaggtccgcgaggccgcggcggcagctgtgcaggcccggggagcagccggccgggcgagcctcggatattggatcagaaaggtacactttcagcttcaccattcgggattcaccagcacattttgtaaatgcagcttcctggggcaatgaagattacatcaagtctctttctgacagctttagggttggtgactgtgtgataattgaaaatcctctgatccaaagaaaggaaatagaaagagaagaaaaattcagccctgcaactcctagcaactgtaaactgttgctcagtgagaatcactcaacagtaaaagtttgttccagttatgaagtggacacaaagttactttctttgatacatttacctgttaaagagtctcatgattattattcactgggtgacattgttgcaaatggacacagtcttaatgggaggattattaacgtgcttgcagctgtgaaatcggttggagagccaaaatactttacaacttcagaccggagaaaaggccagaggtgtgaagttagactctatgatgaaacagagtcgtcttttgcgatgacatgttgggataatgaatccattctacttgcacagagctggatgccacgagaaacagtaatatttgcctcagatgtaagaataaattttgacaaatttcggaactgcatgacagcaactgtaatctcaaaaaccattattacaactaatccagaagctaacattctgctgaattttatacgagaaaataaagaaacgaatgttctggatgatgaaattgacagttatttcaaagaatccataaatttaagtacaatagttgatgtctacacagttgaacaattaaagggaaaagctttgaagaatgaaggaaaagctgatccttcctatggcatcctttatgcctacatttccacactcaacattgatgatgaaactacaaaagtagttcgaaatagatgttccagctgtggttatattgtaaatgaagcatctaacatgtgcacaacttgcaacaaaaactccttggactttaaatctgtctttctcagtttccatgtgctgattgatctgactgatcacacaggcacccttcattcctgtagtctcacaggaagtgttgctgaggagactttgggctggtacatgagtttcttgcaatgacagatgaacagaaaacagcattaaagtggcaatttctcttggaaagaagcaaaatttatttaaaagttagtgcattttatagtcccatattattctatatatttattattctgtatattcaaaccataagaaaaacctagataaattcgagaatttattatttctaatgcccagttcccagatgtgcataaggattcagctatcctaaaagcaaaggaaatagccaggggttttttcatattgtataaaggagttaccaaagacatcaaagaaaatagaccaacaaagaaaatatcctttaaggttaaatccaaaacaggggaaagggctttaaaatcagagctgatgggtgcaatagtacacacctgtaatcccagctacttggtaggctgaggtgggaggatcacctgaacccaggagtttgaggccagcctgggcaacatagtgagacccct

SEQ ID NO: 278800 - DNA, 883 bp, Homo sapiens
cacttagcgatttagcgtgaataataagaaagcatgttcgacatatgagaattccagaatctggagaaactcaacatcaagacaatctggctagtctacacagtagaacaatcaaagtaagagttgtaaagaataaaggaaaaacggagcattctaatggaatccatatgcctacattccgccatcaccatgatgatcaagcctacaggagtagcttcaaatagattccagctgtggttatattgtaaatgaagcatctaacatgtgcacaacttgcaacaaaaactccttggactttaaatctgtctttctcagtttccatgtgctgattgatctgactgatcacacaggcacccttcattcctgtagtctcacaggaagtgttgctgaggagactttgggctggtacatgagtttcttgcaatgacagatgaacagaaaacagcattaaagtggcaatttctcttggaaagaagcaaaatttatttaaaattcgttctatcacacagagcaaggagtggattgaaaattagtgtactctcgtgcaagcttgcagatcctactgaggcaagcagaaacttgtctggacaaaaacatgtttaaaacggtctatcattttgaactctggaaaagtataagagttttaactccctttaaaatggaatattaatttgaaaattatggggaaaattgcattttgtttacatgtggtgaacatgtttctagaaattgttatggtggaggtggtctgggtgagtctgaaggcctctctcatctgacctcccttcttagaaggcctcctactgtctttgccttgtctcctcccaagttggaaaatgtttacatgaattaataaacagatttaatcttctaaaaaaaaaaa

SEQ ID NO: 278801 - DNA, 3544 bp, Homo sapiens
agcgggcggggccgtcgcacctgcacgaggctgtggcccgagcgtcctgtggagaagccgcgaagcgcgggcgacccgggggtcgggcgggccaggtccgcgaggccgcggcggcagctgtgcaggcccggggagcagccggccgggcgagcctcggatattggatcagaaaggtacactttcagcttcaccattcgggattcaccagcacattttgtaaatgcagcttcctggggcaatgaagattacatcaagtctctttctgacagctttagggttggtgactgtgtgataattgaaaatcctctgatccaaagaaaggaaatagaaagagaagaaaaattcagccctgcaactcctagcaactgtaaactgttgctcagtgagaatcactcaacagtaaaagtttgttccagttatgaagtggacacaaagttactttctttgatacatttacctgttaaagagtctcatgattattattcactgggtgacattgttgcaaatggacacagtcttaatgggaggattattaacgtgcttgcagctgtgaaatcggttggagagccaaaatactttacaacttcagaccggagaaaaggccagaggtgtgaagttagactctatgatgaaacagagtcgtcttttgcgatgacatgttgggataatgaatccattctacttgcacagagctggatgccacgagaaacagtaatatttgcctcagatgtaagaataaattttgacaaatttcggaactgcatgacagcaactgtaatctcaaaaaccattattacaactaatccagaagctaacattctgctgaattttatacgagaaaataaagaaacgaatgttctggatgatgaaattgacagttatttcaaagaatccataaatttaagtacaatagttgatgtctacacagttgaacaattaaagggaaaagctttgaagaatgaaggaaaagctgatccttcctatggcatcctttatgcctacatttccacactcaacattgatgatgaaactacaaaagtagttcgaaatagatgttccagctgtggttatattgtaaatgaagcatctaacatgtgcacaacttgcaacaaaaactccttggactttaaatctgtctttctcagtttccatgtgctgattgatctgactgatcacacaggcacccttcattcctgtagtctcacaggaagtgttgctgaggagactttgggctgctgtaacctcagaaacgggaagctgagggaggattgcttgaccccgggagttcgaggctgcagtgagctgtgatagcactgctgcactccagcttgggcgacagagtgagaccctgtctcagcccgtgtatgccagcctcgatctcatcgttttctttaaccggtccaactccctttggcgtcccagtcaagataatatctccttcttccaaggttatgatcttagaaacatagctgatgatgtaggggatggaaaaaatcatggaggatgtctcaccctcctgtctgagttcgccgttgaccttgagccagagcttcagcttgtgagggtcagggatcttctccttgggcacgaacgcgctgaccgggcaggacgccgtgaagctcttcgccagagtccagggcagccccttcttcttgcactcgtcctgcacgtcccgggcggtcatatccaggcacagggcatagccgcccacgtagtccatggccgcagcctcggggactgcgcggcagcgcttgcccatcaccacgcccagctccagctcgtggtgcaggttgcgagtgtacgcgggcatgaggatgggcgagccctcgggcgcgtaggccgtggacggcttcaggaacagcacgggctcgctcaacaccgcgctgcgcatctccctgacgtggtccgcgtagttcctccccacgcagacgatgttctttccccactcccagaagcgggacaatggcctggatgctgccatgattcccatcaagtgcccctgtagtcacgtgggctgggccggtcagctgatgcctacggcatcccggagaggaccaactgcctcggaacgctgtcccccgcagcgacggcccgttccacctcgcgatctgccgggtacccgggcggcgtggcgctcggcctccagggatccactgtgcggtgccaaaaaagaggcggaggctcgcggcacagctctcccggcgcagctctcgggccgccgccgccgccgctcccaggcccgtctcccggcccgtggcagtcggggctcgcggagaaaacaagttgagcgcgagcgcgttgattggttggcggacggtgcgaggtggacgctgattggctgagggcagcgcgaggcgggcgctgattggctgcgacgcgccgacgccggtgttttgcagtcctgggcagctcggcagtccagcccggcccgggtcatggtggtgggccgagggctgctcggccgccgcagcctcgccgcgctgggagccgcctgcgcccgccgaggcctcggtgcctaaggccgcgctgccgggctcgagcggaggcggcgcaggcgctgaggctggcgcggagcgggcgcggggccgcgggtgcggaaagcgctaggtccagccctgctgggagttttctgccacacagatttgcggaagaacctgaccgtggacgagggcaccatgaaggtagaggtgctgcctgccctgaccgacaactacatgtacctggtcattgatgatgagaccaaggaggctgccattgtggatccggtgcagccccagaaggtcgtggacgcggcgagaaagcacggggtgaaactgaccacagtgctcaccacccaccaccactgggaccatgctggcgggaatgagaaactggtcaagctggagtcgggactgaaggtgtacgggggtgacgaccgtatcggggccctgactcacaagatcactcacctgtccacactgcaggtgacaccttgtttgtggctggctgcgggaagttctatgaagggactgcggatgagatgtgtaaagctctgctggaggtcttgggccggctccccccggacacaagagtctactgtggccacgagtacaccatcaacaacctcaagtttgcacgccacgtggagcccggcaatgccgccatccgggagaagctggcctgggccaaggagaagtacagcatcggggagcccacagtgccatccaccctggcagaggagtttacctacaaccccttcatgagagtgagggagaagacggtgcagcagcacgcaggtgagacggacccggtgaccaccatgcgggccgtgcgcagggagaaggaccagttcaagatgccccgggactgaggccgccctgcaccttcagcggatttggggattaggctcttttaggtaactggctttcctgctggtccgtgcgggaaattcagtcttgatttaaccttaattttacagcccttggcttgtgttatcggacgttttaatgcatatttataagagaagtttaacaagtatttattcccataaaaaaacttccccttg

SEQ ID NO: 278802 - DNA, 1318 bp, Homo sapiens
agcggatgcgggctctgtgcacgcggtcgggagctccagcctgcgccagcgtcgatgtctgcctggcgcggcaggtgctgctcgctccgactctacctcgcggccgcttcaaggcgcctgcgcttgcttaagcctcagtaccctagggtgggccgtcctggtgtcgagctgagggcgcgcaggctctgacgtggttgcgcgagacgtgggtctgttgacaaggcgcgtagtgtgtccattcacgtgtggtcgacctgtggctggcagcaggagcagatttgcggaagaacctgaccgtggacgagggcaccatgaaggtagaggtgctgcctgccctgaccgacaactacatgtacctggtcattgatgatgagaccaaggaggctgccattgtggatccggtgcagccccagaaggtcgtggacgcggcgagaaagcacggggtgaaactgaccacagtgctcaccacccaccaccactgggaccatgctggcgggaatgagaaactggtcaagctggagtcgggactgaaggtgtacgggggtgacgaccgtatcggggccctgactcacaagatcactcacctgtccacactgcaggtggggtctctgaacgtcaagtgcctggcgaccccgtgccacacttcaggacacatttgttacttcgtgagcaagcccggaggctcggagccccctgccgtgttcacagacaccttgtttgtggctggctgcgggaaaaaaaggggtttttttttctctttcaaatttgaaaaaagggggggactgcggatgagatgtgtaaagctctgctggaggtcttgggccggctccccccggacacaagagtctactgtggccacgagtacaccatcaacaacctcaagtttgcacgccacgtggagcccggcaatgccgccatccgggagaagctggcctgggccaaggagaagtacagcatcggggagcccacagtgccatccaccctggcagaggagtttacctacaaccccttcatgagagtgagggagaagacggtgcagcagcacgcaggtgagacggacccggtgaccaccatgcgggccgtgcgcagggagaaggaccagttcaagatgccccgggactgaggccgccctgcaccttcagcggatttggggattaggctcttttaggtaactggctttcctgctggtccgtgcgggaaattcagtcttgatttaaccttaattttacagcccttggcttgtgttatcggacgttttaatgcatatttataagagaagtttaacaagtatttattcccataaaaaaacttccccttg

SEQ ID NO: 278803 - DNA, 3386 bp, Homo sapiens
agcgggcggggccgtcgcacctgcacgaggctgtggcccgagcgtcctgtggagaagccgcgaagcgcgggcgacccgggggtcgggcgggccaggtccgcgaggccgcggcggcagctgtgcaggcccggggagcagccggccgggcgagcctcggatattggatcagaaaggtacactttcagcttcaccattcgggattcaccagcacattttgtaaatgcagcttcctggggcaatgaagattacatcaagtctctttctgacagctttagggttggtgactgtgtgataattgaaaatcctctgatccaaagaaaggaaatagaaagagaagaaaaattcagccctgcaactcctagcaactgtaaactgttgctcagtgagaatcactcaacagtaaaagtttgttccagttatgaagtggacacaaagttactttctttgatacatttacctgttaaagagtctcatgattattattcactgggtgacattgttgcaaatggacacagtcttaatgggaggattattaacgtgcttgcagctgtgaaatcggttggagagccaaaatactttacaacttcagaccggagaaaaggccagaggtgtgaagttagactctatgatgaaacagagtcgtcttttgcgatgacatgttgggataatgaatccattctacttgcacagagctggatgccacgagaaacagtaatatttgcctcagatgtaagaataaattttgacaaatttcggaactgcatgacagcaactgtaatctcaaaaaccattattacaactaatccagaagctaacattctgctgaattttatacgagaaaataaagaaacgaatgttctggatgatgaaattgacagttatttcaaagaatccataaatttaagtacaatagttgatgtctacacagttgaacaattaaagggaaaagctttgaagaatgaaggaaaagctgatccttcctatggcatcctttatgcctacatttccacactcaacattgatgatgaaactacaaaagtagttcgaaatagatgttccagctgtggttatattgtaaatgaagcatctaacatgtgcacaacttgcaacaaaaactccttggactttaaatctgtctttctcagtttccatgtgctgattgatctgactgatcacacaggcacccttcattcctgtagtctcacaggaagtgttgctgaggagactttgggctgctgtaacctcagaaacgggaagctgagggaggattgcttgaccccgggagttcgaggctgcagtgagctgtgatagcactgctgcactccagcttgggcgacagagtgagaccctgtctcagcccgtgtatgccagcctcgatctcatcgttttctttaaccggtccaactccctttggcgtcccagtcaagataatatctccttcttccaaggttatgatcttagaaacatagctgatgatgtaggggatggaaaaaatcatggaggatgtctcaccctcctgtctgagttcgccgttgaccttgagccagagcttcagcttgtgagggtcagggatcttctccttgggcacgaacgcgctgaccgggcaggacgccgtgaagctcttcgccagagtccagggcagccccttcttcttgcactcgtcctgcacgtcccgggcggtcatatccaggcacagggcatagccgcccacgtagtccatggccgcagcctcggggactgcgcggcagcgcttgcccatcaccacgcccagctccagctcgtggtgcaggttgcgagtgtacgcgggcatgaggatgggcgagccctcgggcgcgtaggccgtggacggcttcaggaacagcacgggctcgctcaacaccgcgctgcgcatctccctgacgtggtccgcgtagttcctccccacgcagacgatgttctttccccactcccagaagcgggacaatggcctggatgctgccatgattcccatcaagtgcccctgtagtcacgtgggctgggccggtcagctgatgcctacggcatcccggagaggaccaactgcctcggaacgctgtcccccgcagcgacggcccgttccacctcgcgatctgccgggtacccgggcggcgtggcgctcggcctccagggatccactgtgcggtgccaaaaaagaggcggaggctcgcggcacagctctcccggcgcagctctcgggccgccgccgccgccgctcccaggcccgtctcccggcccgtggcagtcggggctcgcggagaaaacaagttgagcgcgagcgcgttgattggttggcggacggtgcgaggtggacgctgattggctgagggcagcgcgaggcgggcgctgattggctgcgacgcgccgacgccggtgttttgcagtcctgggcagctcggcagtccagcccggcccgggtcatggtggtgggccgagggctgctcggccgccgcagcctcgccgcgctgggagccgcctgcgcccgccgaggcctcggtccagccctgctgggagttttctgccacacagatttgcggaagaacctgaccgtggacgagggcaccatgaaggtagaggtgctgcctgccctgaccgacaactacatgtacctggtcattgatgatgagaccaaggaggctgccattgtggatccggtgcagccccagaaggtcgtggacgcggcgagaaagcacggggtgaaactgaccacagtgctcaccacccaccaccactggtaagtgccgcgtctcacctgggggtgtgggacctggctcacttctcgccccggtgggtttagggacatcaaggcctgtctccccccacggctctgtctgctttgtgaggacaagcccccagcagacttctgagaaagactcgggactcaccgtagcccccaaggggcaagtctggtgctcagtgactctgaggccccgagggtgaggggagaaggttacagccttaccctcaggccccaccccccggctctctcctgggccatgcgggtttgtgccctggcacgttggcctcaatgttggggaggaaatgagtctacaggtgagtggtttttaaaaaaaaaaaacaaacaaaaaaaaaaaaaaacaagcagccagccgggcacggtggctcatgcctataatcccagcactttgggaggctgaggtagttgggtcacttgaggtcaggaccagcctggccaacacggtgaaacccagtctctaccgaaaatacaaaaattaactgggcgtggtggtgggcgcctgtaatctcagctactcgggaggctgaagcaggagaatcacttgaacccgggaggcggaggttgccgtgagccaagatcgtggcattgcactccagcctgggtgacagagcga

SEQ ID NO: 278804 - DNA, 1713 bp, Homo sapiens
agcgggcggggccgtcgcacctgcacgaggctgtggcccgagcgtcctgtggagaagccgcgaagcgcgggcgacccgggggtcgggcgggccaggtccgcgaggccgcggcggcagctgtgcaggcccggggagcagccggccgggcgagcctcggatattggatcagaaaggtacactttcagcttcaccattcgggattcaccagcacattttgtaaatgcagcttcctggggcaatgaagattacatcaagtctctttctgacagctttagggttggtgactgtgtgataattgaaaatcctctgatccaaagaaaggaaatagaaagagaagaaaaattcagccctgcaactcctagcaactgtaaactgttgctcagtgagaatcactcaacagtaaaagtttgttccagttatgaagtggacacaaagttactttctttgatacatttacctgttaaagagtctcatgattattattcactgggtgacattgttgcaaatggacacagtcttaatgggaggattattaacgtgcttgcagctgtgaaatcggttggagagccaaaatactttacaacttcagaccggagaaaaggccagaggtgtgaagttagactctatgatgaaacagagtcgtcttttgcgatgacatgttgggataatgaatccattctacttgcacagagctggatgccacgagaaacagtaatatttgcctcagatgtaagaataaattttgacaaatttcggaactgcatgacagcaactgtaatctcaaaaaccattattacaactaatccagaagctaacattctgctgaattttatacgagaaaataaagaaacgaatgttctggatgatgaaattgacagttatttcaaagaatccataaatttaagtacaatagttgatgtctacacagttgaacaattaaagggaaaagctttgaagaatgaaggaaaagctgatccttcctatggcatcctttatgcctacatttccacactcaacattgatgatgaaactacaaaagtagttcgaaatagatgttccagctgtggttatattgtaaatgaagcatctaacatgtgcacaacttgcaacaaaaactccttggactttaaatctgtctttctcagtttccatgtgctgattgatctgactgatcacacaggcacccttcattcctgtagtctcacaggaagtgttgctgaggagactttgggctggtacatgagtttcttgcaatgacagatgaacagaaaacagcattaaagtggcaatttctcttggaaagaagcaaaatttatttaaaattcgttctatcacacagagcaaggagtggattgaaaattagtgtactctcgtgcaagcttgcagatcctactgaggcaagcagaaacttgtctggacaaaaacatgtttaaaacggtctatcattttgaactctggaaaagtataagagttttaactccctttaaaatggaatattaatttgaaaattatggggaaaattgcattttgtttacatgtggtgaacatgtttctagaaattgttatggtggaggtggtctgggtgagtctgaaggcctctctcatctgacctcccttcttagaaggcctcctactgtctttgccttgtctcctcccaagttggaaaatgtttacatgaattaataaacagatttaatcttctaaaaaaaaaaa

SEQ ID NO: 278805 - DNA, 3659 bp, Homo sapiens
atttccttctagaagccaggagcaaaggacagacctctccctggtataaggaggaagagattgagaagaggaattctccagagtctattaactatactacatcaacgcctccaagatactatggtacccatcccaggggaagtggggctacaagaacagtataaatatctcctattggcataataaatggtgtaccccaagaatatgccaagggatgttttgtagagattttgagactaaggagatttggaaattgtgtggctattagcagtttcattcataatgaaatttataatcccttaaaaaacttggaggaagataattgcaggaagaacaccttgaataagcagaactcagctgtgagatcaggagcaagaggagcacattggaagaatttcgaaaaagggcaccttttctaatttttaatacttggctgggttaatctaaaactatgtcagaagaagtggcatgataacaagatcctgagactcaagagaaaagggagattgagtgggaatgcctctagttcccacggctcctcctgtgaacagcacagctacacggcccggctgattcattcagagggcgggactcaccaggccctacgtggagaaatgccattggcccatagtttatctttcactttcctgccctgagcgtgagcaagaatttcctgcggttcctctaggaaaattcctttgtgcagatcaggcccgtggattggtgagtgaatcctaaccacgtcttccctggcctgtcttcactcttctccccagaatcaccacttctgcactggtgtctgaaggtgtattgagtgattttgtggagggcagaagtaggaagtctttgggacaaaactgtatttaccttgggatctgtgaacaagaggaacctcagcagccaggacaggcaggagcagtggaatagctactatggcttctggaatcctggttaatgtaaaggaggaggtgacctgccccatctgcctggaactcctgacacaacccctgagcctggactgcggccacagcttctgccaagcatgcctcactgcaaaccacaagaagtccatgctagacaaaggagagagtagctgccctgtgtgccggatcagttaccagcctgagaacatacggcctaatcggcatgtagccaacatagtggagaagctcagggaggtcaagttgagcccagaggggcagaaagttgatcattgtgcacgccatggagagaaacttctactcttctgtcaggaggacgggaaggtcatttgctggctttgtgagcggtctcaggagcaccgtggtcaccacacgttcctcacagaggaggttgcccgggagtaccaagtgaagctccaggcagctctggagatgctgaggcagaagcagcaggaagctgaagagttggaagctgacatcagagaagagaaagcttcctggaagactcaaatacagtatgacaaaaccaacgtcttggcagattttgagcaactgagagacatcctggactgggaggagagcaatgagctgcaaaacctggagaaggaggaggaagacattctgaaaagccttacgaactctgaaactgagatggtgcagcagacccagtccctgagagagctcatctcagatctggagcatcggctgcaggggtcagtgatggagctgcttcaggtgtggatggcgtcataaaaaggacggagaacgtgaccttgaagaagccagaaacttttccaaaaaatcaaaggagagtgtttcgagctcctgatctgaaaggaatgctagaagtgtttagagagctgacagatgtccgacgctactgggttgatgtgacagtggctccaaacaacatttcatgtgctgtcatttctgaagataagagacaagtgagctctccgaaaccacagataatatatggggcacgagggacaagataccagacatttgtgaatttcaattattgtactggcatcctgggctctcaaagtatcacatcagggaaacattactgggaggtagacgtgtccaagaaaactgcttggatcctgggggtatgtgctggcttccaacctgatgcaatgtgtaatattgaaaaaaatgaaaattatcaacctaaatacggctactgggttatagggttagaggaaggagttaaatgtagtgctttccaggatagttccttccatactccttctgttcctttcattgtgcccctctctgtgattatttgtcctgatcgtgttggagttttcctagactatgaggcttgcactgtctcattcttcaatatcacaaaccatggatttctcatctataagttttctcactgttctttttctcagcctgtatttccatatttaaatcctagaaaatgtggagtccccatgactctgtgctcaccaagctcttgaaccttcttacacactcagccccttctgtacagcacctcttgtccaggtgcatctcatacacctgaactcatttgcatcattttaaccatcttttccttgctgtctcccttctttctatttgaacgtccttcactcatcagtaaaatgtaataattgccttgtgccatattgtccccaatattttattgacatttgatagcaatttttttcatcattttccgtactcctaaggaaaactgacctatacctcataaaatgagaccgctatttaggtattacttctgccagatatttatcacccaattgcctctgacactgactaagaagatgaagaaaagcttttcaacagcctttctatatcatcgtgtgataattgttcaccaatgaatgagtccttagccctgtgtcagtttaccctcgatgcccttatttgtgagttaaagagaaaatatcataaatggtatactcttaagtatagaggttttgtatctagaggatctcagttcaactcctgtctctccatataccagcagtgtaactgtgaataacatacttaaatggctgtgcttatttccttttcttttcttttttctttttttttttttttgagatgaagttttgctcttgttccccaggctggagtgcaatggcacgatctcggttcactgcaacctccacctctcagattcaagcaattctcctgcctcagcctcccaagtagctgggattacaggtgcccaccaccacccctggctaaatttgtattttcagtagagacggggtttccccatgttggttaggctcgtctagaacctctgacctcaggtgatccacccgcctcggcctcccaaagtgctgggattacaggcgtgagccacggcgcccagcctgtgcttattttcttaaaataatttttgtattaaaaacttcacattaaataagtgctaatgttttattgcatagtagggtgactagagttaacaataacctattgcatatattttgaaatagctagaagagaggattttgaaagttctcaacacaaagaaatgacacatatttgaggtgatggatatgctaattaccctggttcggttattacgcaatgtatacatgtatcaaaacatcacactgtaccacataaatatgtatatttattatttgtcaattaaaagcaaaataaaacaaaaaaccttcatctaatactttggatcattgtgaaaaaataaattcctgaagtataaag

SEQ ID NO: 278806 - DNA, 3637 bp, Homo sapiens
atttccttctagaagccaggagcaaaggacagacctctccctggtataaggaggaagagattgagaagaggaattctccagagtctattaactatactacatcaacgcctccaagatactatggtacccatcccaggggaagtggggctacaagaacagtataaatatctcctattggcataataaatggtgtaccccaagaatatgccaagggatgttttgtagagattttgagactaaggagatttggaaattgtgtggctattagcagtttcattcataatgaaatttataatcccttaaaaaacttggaggaagataattgcaggaagaacaccttgaataagcagaactcagctgtgagatcaggagcaagaggagcacattggaagaatttcgaaaaagggcaccttttctaatttttaatacttggctgggttaatctaaaactatgtcagaagaagtggcatgataacaagatcctgagactcaagagaaaagggagattgagtgggaatgcctctagttcccacggctcctcctgtgaacagcacagctacacggcccggctgattcattcagagggcgggactcaccaggccctacgtggagaaatgccattggcccatagtttatctttcactttcctgccctgagcgtgagcaagaatttcctgcggttcctctaggaaaattcctttgtgcagatcaggcccgtggattggtgagtgaatcctaaccacgtcttccctggcctgtcttcactcttctccccagaatcaccacttctgcactggtgtctgaaggtgtattgagtgattttgtggagggcagaagtaggaagtctttgggacaaaactgtatttaccttgggatctgtgaacaagaggaacctcagcagccaggacaggcaggagcagtggaatagctactatggcttctggaatcctggttaatgtaaaggaggaggtgacctgccccatctgcctggaactcctgacacaacccctgagcctggactgcggccacagcttctgccaagcatgcctcactgcaaaccacaagaagtccatgctagacaaaggagagagtagctgccctgtgtgccggatcagttaccagcctgagaacatacggcctaatcggcatgtagccaacatagtggagaagctcagggaggtcaagttgagcccagaggggcagaaagttgatcattgtgcacgccatggagagaaacttctactcttctgtcaggaggacgggaaggtcatttgctggctttgtgagcggtctcaggagcaccgtggtcaccacacgttcctcacagaggaggttgcccgggagtaccaagtgaagctccaggcagctctggagatgctgaggcagaagcagcaggaagctgaagagttggaagctgacatcagagaagagaaagcttcctggaagactcaaatacagtatgacaaaaccaacgtcttggcagattttgagcaactgagagacatcctggactgggaggagagcaatgagctgcaaaacctggagaaggaggaggaagacattctgaaaagccttacgaactctgaaactgagatggtgcagcagacccagtccctgagagagctcatctcagatctggagcatcggctgcaggggtcagtgatggagctgcttcaggacggagaacgtgaccttgaagaagccagaaacttttccaaaaaatcaaaggagagtgtttcgagctcctgatctgaaaggaatgctagaagtgtttagagagctgacagatgtccgacgctactgggttgatgtgacagtggctccaaacaacatttcatgtgctgtcatttctgaagataagagacaagtgagctctccgaaaccacagataatatatggggcacgagggacaagataccagacatttgtgaatttcaattattgtactggcatcctgggctctcaaagtatcacatcagggaaacattactgggaggtagacgtgtccaagaaaactgcttggatcctgggggtatgtgctggcttccaacctgatgcaatgtgtaatattgaaaaaaatgaaaattatcaacctaaatacggctactgggttatagggttagaggaaggagttaaatgtagtgctttccaggatagttccttccatactccttctgttcctttcattgtgcccctctctgtgattatttgtcctgatcgtgttggagttttcctagactatgaggcttgcactgtctcattcttcaatatcacaaaccatggatttctcatctataagttttctcactgttctttttctcagcctgtatttccatatttaaatcctagaaaatgtggagtccccatgactctgtgctcaccaagctcttgaaccttcttacacactcagccccttctgtacagcacctcttgtccaggtgcatctcatacacctgaactcatttgcatcattttaaccatcttttccttgctgtctcccttctttctatttgaacgtccttcactcatcagtaaaatgtaataattgccttgtgccatattgtccccaatattttattgacatttgatagcaatttttttcatcattttccgtactcctaaggaaaactgacctatacctcataaaatgagaccgctatttaggtattacttctgccagatatttatcacccaattgcctctgacactgactaagaagatgaagaaaagcttttcaacagcctttctatatcatcgtgtgataattgttcaccaatgaatgagtccttagccctgtgtcagtttaccctcgatgcccttatttgtgagttaaagagaaaatatcataaatggtatactcttaagtatagaggttttgtatctagaggatctcagttcaactcctgtctctccatataccagcagtgtaactgtgaataacatacttaaatggctgtgcttatttccttttcttttcttttttctttttttttttttttgagatgaagttttgctcttgttccccaggctggagtgcaatggcacgatctcggttcactgcaacctccacctctcagattcaagcaattctcctgcctcagcctcccaagtagctgggattacaggtgcccaccaccacccctggctaaatttgtattttcagtagagacggggtttccccatgttggttaggctcgtctagaacctctgacctcaggtgatccacccgcctcggcctcccaaagtgctgggattacaggcgtgagccacggcgcccagcctgtgcttattttcttaaaataatttttgtattaaaaacttcacattaaataagtgctaatgttttattgcatagtagggtgactagagttaacaataacctattgcatatattttgaaatagctagaagagaggattttgaaagttctcaacacaaagaaatgacacatatttgaggtgatggatatgctaattaccctggttcggttattacgcaatgtatacatgtatcaaaacatcacactgtaccacataaatatgtatatttattatttgtcaattaaaagcaaaataaaacaaaaaaccttcatctaatactttggatcattgtgaaaaaataaattcctgaagtataaag

SEQ ID NO: 278807 - DNA, 2437 bp, Homo sapiens
atttccttctagaagccaggagcaaaggacagacctctccctggtataaggaggaagagattgagaagaggaattctccagagtctattaactatactacatcaacgcctccaagatactatggtacccatcccaggggaagtggggctacaagaacagtataaatatctcctattggcataataaatggtgtaccccaagaatatgccaagggatgttttgtagagattttgagactaaggagatttggaaattgtgtggctattagcagtttcattcataatgaaatttataatcccttaaaaaacttggaggaagataattgcaggaagaacaccttgaataagcagaactcagctgtgagatcaggagcaagaggagcacattggaagaatttcgaaaaagggcaccttttctaatttttaatacttggctgggttaatctaaaactatgtcagaagaagtggcatgataacaagatcctgagactcaagagaaaagggagattgagtgggaatgcctctagttcccacggctcctcctgtgaacagcacagctacacggcccggctgattcattcagagggcgggactcaccaggccctacgtggagaaatgccattggcccatagtttatctttcactttcctgccctgagcgtgagcaagaatttcctgcggttcctctaggaaaattcctttgtgcagatcaggcccgtggattggtgagtgaatcctaaccacgtcttccctggcctgtcttcactcttctccccagaatcaccacttctgcactggtgtctgaaggtgtattgagtgattttgtggagggcagaagtaggaagtctttgggacaaaactgtatttaccttgggatctgtgaacaagaggaacctcagcagccaggacaggcaggagcagtggaatagctactatggcttctggaatcctggttaatgtaaaggaggaggtgacctgccccatctgcctggaactcctgacacaacccctgagcctggactgcggccacagcttctgccaagcatgcctcactgcaaaccacaagaagtccatgctagacaaaggagagagtagctgccctgtgtgccggatcagttaccagcctgagaacatacggcctaatcggcatgtagccaacatagtggagaagctcagggaggtcaagttgagcccagaggggcagaaagttgatcattgtgcacgccatggagagaaacttctactcttctgtcaggaggacgggaaggtcatttgctggctttgtgagcggtctcaggagcaccgtggtcaccacacgttcctcacagaggaggttgcccgggagtaccaagtgaagctccaggcagctctggagatgctgaggcagaagcagcaggaagctgaagagttggaagctgacatcagagaagagaaagcttcctggaagactcaaatacagtatgacaaaaccaacgtcttggcagattttgagcaactgagagacatcctggactgggaggagagcaatgagctgcaaaacctggagaaggaggaggaagacattctgaaaagccttacgaactctgaaactgagatggtgcagcagacccagtccctgagagagctcatctcagatctggagcatcggctgcaggggtcagtgatggagctgcttcaggtgtggatggcgtcataaaaaggacggagaacgtgaccttgaagaagccagaaacttttccaaaaaatcaaaggagagtgtttcgagctcctgatctgaaaggaatgctagaagtgtttagagagctgacagatgtccgacgctactggggctggagtgcaatggcacgatctcggttcactgcaacctccacctctcagattcaagcaattctcctgcctcagcctcccaagtagctgggattacaggtgcccaccaccacccctggctaaatttgtattttcagtagagacggggtttccccatgttggttaggctcgtctagaacctctgacctcaggtgatccacccgcctcggcctcccaaagtgctgggattacaggcgtgagccacggcgcccagcctgtgcttattttcttaaaataatttttgtattaaaaacttcacattaaataagtgctaatgttttattgcatagtagggtgactagagttaacaataacctattgcatatattttgaaatagctagaagagaggattttgaaagttctcaacacaaagaaatgacacatatttgaggtgatggatatgctaattaccctggttcggttattacgcaatgtatacatgtatcaaaacatcacactgtaccacataaatatgtatatttattatttgtcaattaaaagcaaaataaaacaaaaaaccttcatctaatactttggatcattgtgaaaaaataaattcctgaagtataaag

SEQ ID NO: 278808 - DNA, 3141 bp, Homo sapiens
atttccttctagaagccaggagcaaaggacagacctctccctggtataaggaggaagagattgagaagaggaattctccagagtctattaactatactacatcaacgcctccaagatactatggtacccatcccaggggaagtggggctacaagaacagtataaatatctcctattggcataataaatggtgtaccccaagaatatgccaagggatgttttgtagagattttgagactaaggagatttggaaattgtgtggctattagcagtttcattcataatgaaatttataatcccttaaaaaacttggaggaagataattgcaggaagaacaccttgaataagcagaactcagctgtgagatcaggagcaagaggagcacattggaagaatttcgaaaaagggcaccttttctaatttttaatacttggctgggttaatctaaaactatgtcagaagaagtggcatgataacaagatcctgagactcaagagaaaagggagattgagtgggaatgcctctagttcccacggctcctcctgtgaacagcacagctacacggcccggctgattcattcagagggcgggactcaccaggccctacgtggagaaatgccattggcccatagtttatctttcactttcctgccctgagcgtgagcaagaatttcctgcggttcctctaggaaaattcctttgtgcagatcaggcccgtggattggtgagtgaatcctaaccacgtcttccctggcctgtcttcactcttctccccagaatcaccacttctgcactggtgtctgaaggtgtattgagtgattttgtggagggcagaagtaggaagtctttgggacaaaactgtatttaccttgggatctgtgaacaagaggaacctcagcagccaggacaggcaggagcagtggaatagctactatggcttctggaatcctggttaatgtaaaggaggaggtgacctgccccatctgcctggaactcctgacacaacccctgagcctggactgcggccacagcttctgccaagcatgcctcactgcaaaccacaagaagtccatgctagacaaaggagagagtagctgccctgtgtgccggatcagttaccagcctgagaacatacggcctaatcggcatgtagccaacatagtggagaagctcagggaggtcaagttgagcccagaggggcagaaagttgatcattgtgcacgccatggagagaaacttctactcttctgtcaggaggacgggaaggtcatttgctggctttgtgagcggtctcaggagcaccgtggtcaccacacgttcctcacagaggaggttgcccgggagtaccaagtgaagctccaggcagctctggagatgctgaggcagaagcagcaggaagctgaagagttggaagctgacatcagagaagagaaagcttcctggaagactcaaatacagtatgacaaaaccaacgtcttggcagattttgagcaactgagagacatcctggactgggaggagagcaatgagctgcaaaacctggagaaggaggaggaagacattctgaaaagccttacgaactcatacacctgaactcatttgcatcattttaaccatcttttccttgctgtctcccttctttctatttgaacgtccttcactcatcagtaaaatgtaataattgccttgtgccatattgtccccaatattttattgacatttgatagcaatttttttcatcattttccgtactcctaaggaaaactgacctatacctcataaaatgagaccgctatttaggtattacttctgccagatatttatcacccaattgcctctgacactgactaagaagatgaagaaaagcttttcaacagcctttctatatcatcgtgtgataattgttcaccaatgaatgagtccttagccctgtgtcagtttaccctcgatgcccttatttgtgagttaaagagaaaatatcataaatggtatactcttaagtatagaggttttgtatctagaggatctcagttcaactcctgtctctccatataccagcagtgtaactgtgaataacatacttaaatggctgtgcttatttccttttcttttcttttttctttttttttttttttgagatgaagttttgctcttgttccccaggctggagtgcaatggcacgatctcggttcactgcaacctccacctctcagattcaagcaattctcctgcctcagcctcccaagtagctgggattacaggtgcccaccaccacccctggctaaatttgtattttcagtagagacggggtttccccatgttggttaggctcgtctagaacctctgacctcaggtgatccacccgcctcggcctcccaaagtgctgggattacaggcgtgagccacggcgcccagcctgtgcttattttcttaaaataatttttgtattaaaaacttcacattaaataagtgctaatgttttattgcatagtagggtgactagagttaacaataacctattgcatatattttgaaatagctagaagagaggattttgaaagttctcaacacaaagaaatgacacatatttgaggtgatggatatgctaattaccctggttcggttattacgcaatgtatacatgtatcaaaacatcacactgtaccacataaatatgtatatttattatttgtcaattaaaagcaaaataaaacaaaaaaccttcatctaatactttggatcattgtgaaaaaataaattcctgaagtataaagcatctatctaagtgtctcgatctaataagtacttgttctacaaattattgaaaaacataaactctgttaatgtctcatggaacaggttgtgccttcagggaaactaggattggatttactaaattctcattttttagatctcagatactactgtcaaaatgacttcaattctgccttctatatataatacacacatatatttaggattttattgtaattctagtgttgctacatattagtctttatcaaacaaactgaattatgtgggaatcagtttattaattgtaaaaaataattataataaaattagctgatgtagttttttaaaagttaaatgagttttttgaatagcttcactcatttctagc

SEQ ID NO: 278809 - DNA, 709 bp, Homo sapiens
ctccgttctgctggaacacaaacgcgcttctcagtttctctggaggaacttggttggcgaagagcttggcgcttcttgtaaaccttgtcccgctggacaaagacttgtgaaggaacacggagtgccaccaggactccgtggccctccccgcctctctctcctttttcccttcatggcggtgaagctgtggacgcttctcttcaggaggtgagctccagatgagacgccacatcccagcggagtcccggaagggtcaccccgcaggtctaaggcccgcctgttctgtgccgtgacctgtgctaccgaagtcatctgttgctgtagggaggccagggactcagccgatgcctcaatggccaactgcagctttcccaatcttggtgagaccaaagcagttgatgaatggataaagtggataaataccttcattcaggctcttccataactgtgccattggcggttcagtccggctgatctagcaggggtattgtgcttacaataaaaatggcttggggatggttccataaagtagtagggatatagggaaccaagttacaactggcaacattaaattcactcagacaatgagggaaacagagaataaaactttacagaccaaatatgttaatgcctatgtaattgtatttgaatattgacatgtgatacccacccaccaccttaaataaacacatacaaaagaaatctgcaa

SEQ ID NO: 278810 - DNA, 370 bp, Homo sapiens
gagatttggaaattgtgtggctattagcagtttcattcataatgaaatttataatcccttaaaaaacttggaggaagataattgcaggaagaacaccttgaatgtaagttctttattgctgctctgcctgccatttatacagttaagatataggattaggcagtagaccacaacaagtggcatgtgcagactataaagcaaagacacttaaatttagctgtgattcaatgatctcctatagaaagcagcccttaggtcaatcactgggtgaacagataggagcagaatgcgctctgtggaaattaagggtttaggaccagagtctaccattttcttatgggagattccagagagtgatgacatggaggat

SEQ ID NO: 278811 - DNA, 921 bp, Homo sapiens
ttttgctcagtctataccttggacacattccttaaccacaatgcgttgataaaatttaatcagagagaccatacttcataggtgtgtcctgcgtctagaatggaatatgctatcaatcaatgcggccagtaattattcatcaccaggagaaagaaattcctggcctttactctgttggaccccagccccatgtctcaagacatcacctgcgcgccgtggcaggtctccctgctgtaggcacctgaatcacaggaactaaaggtagggagaaaaagaaggacagatgggcaaaaatctgtgccattgaagaggaaacctaagaccgccgaagaggagaactgcgttgttagactcctggcagactcgagagcccgagactaaccaaaccggtcaccagggccccgcggcgtaggctgcgggctgttctccttagcttccggtagtctccccgcagctgaggtccgggccgggtcagggcgctagctggttaccatggacacggccagcggacgcacaccaatcagaagactgcgttccttgcccctttaaatacacacagcccaaagcaatttactccgttctgctggaacacaaacgcgcttctcagtttctctggaggaacttggttggcgaagagcttggcgcttcttgtaaaccttgtcccgctggacaaagacttgtgaaggaacacggagtgccaccaggactccgtggccctccccgcctctctctcctttttcccttcatggcggtgaagctgtggacgcttctcttcaggaggtgagctccagatgagacgccacatcccagcggagtcccggaagggtcaccccggtaagtgaaaggcaatggaagggcaccgtggatcaataaggcccagaggcgagacaaagagggcaaaaatcttctttattgagctct

SEQ ID NO: 278812 - DNA, 4287 bp, Homo sapiens
atttccttctagaagccaggagcaaaggacagacctctccctggtataaggaggaagagattgagaagaggaattctccagagtctattaactatactacatcaacgcctccaagatactatggtacccatcccaggggaagtggggctacaagaacagtataaatatctcctattggcataataaatggtgtaccccaagaatatgccaagggatgttttgtagagattttgagactaaggagatttggaaattgtgtggctattagcagtttcattcataatgaaatttataatcccttaaaaaacttggaggaagataattgcaggaagaacaccttgaataagcagaactcagctgtgagatcaggagcaagaggagcacattggaagaatttcgaaaaagggcaccttttctaatttttaatacttggctgggttaatctaaaactatgtcagaagaagtggcatgataacaagatcctgagactcaagagaaaagggagattgagtgggaatgcctctagttcccacggctcctcctgtgaacagcacagctacacggcccggctgattcattcagagggcgggactcaccaggccctacgtggagaaatgccattggcccatagtttatctttcactttcctgccctgagcgtgagcaagaatttcctgcggttcctctaggaaaattcctttgtgcagatcaggcccgtggattggtgagtgaatcctaaccacgtcttccctggcctgtcttcactcttctccccagaatcaccacttctgcactggtgtctgaaggtgtattgagtgattttgtggagggcagaagtaggaagtctttgggacaaaactgtatttaccttgggatctgtgaacaagaggaacctcagcagccaggacaggcaggagcagtggaatagctactatggcttctggaatcctggttaatgtaaaggaggaggtgacctgccccatctgcctggaactcctgacacaacccctgagcctggactgcggccacagcttctgccaagcatgcctcactgcaaaccacaagaagtccatgctagacaaaggagagagtagctgccctgtgtgccggatcagttaccagcctgagaacatacggcctaatcggcatgtagccaacatagtggagaagctcagggaggtcaagttgagcccagaggggcagaaagttgatcattgtgcacgccatggagagaaacttctactcttctgtcaggaggacgggaaggtcatttgctggctttgtgagcggtctcaggagcaccgtggtcaccacacgttcctcacagaggaggttgcccgggagtaccaagtgaagctccaggcagctctggagatgctgaggcagaagcagcaggaagctgaagagttggaagctgacatcagagaagagaaagcttcctggaagactcaaatacagtatgacaaaaccaacgtcttggcagattttgagcaactgagagacatcctggactgggaggagagcaatgagctgcaaaacctggagaaggaggaggaagacattctgaaaagccttacgaactctgaaactgagatggtgcagcagacccagtccctgagagagctcatctcagatctggagcatcggctgcaggggtcagtgatggagctgcttcaggtgtggatggcgtcataaaaaggacggagaacgtgaccttgaagaagccagaaacttttccaaaaaatcaaaggagagtgtttcgagctcctgatctgaaaggaatgctagaagtgtttagagagctgacagatgtccgacgctactggggtaaggagaagtcacattatcataagccaccctgcggcttatcattattattatctttatcttttagaattttatgttctctattaggctcatgttttaagatttatgattctccttccaagacacacataacttacccctccttataacttctaaacaaggttcctcccagttttctctcaagtctttatcaagatttctctcatatcacaaataaagttacattatatcccttagctgacctgttaatttttctacagttgatgtgacagtggctccaaacaacatttcatgtgctgtcatttctgaagataagagacaagtgagctctccgaaaccacagataatatatggggcacgagggacaagataccagacatttgtgaatttcaattattgtactggcatcctgggctctcaaagtatcacatcagggaaacattactgggaggtagacgtgtccaagaaaactgcttggatcctgggggtatgtgctggcttccaacctgatgcaatgtgtaatattgaaaaaaatgaaaattatcaacctaaatacggctactgggttatagggttagaggaaggagttaaatgtagtgctttccaggatagttccttccatactccttctgttcctttcattgtgcccctctctgtgattatttgtcctgatcgtgttggagttttcctagactatgaggcttgcactgtctcattcttcaatatcacaaaccatggatttctcatctataagttttctcactgttctttttctcagcctgtatttccatatttaaatcctagaaaatgtggagtccccatgactctgtgctcaccaagctcttgaaccttcttacacactcagccccttctgtacagcacctcttgtccaggtgcatctcatacacctgaactcatttgcatcattttaaccatcttttccttgctgtctcccttctttctatttgaacgtccttcactcatcagtaaaatgtaataattgccttgtgccatattgtccccaatattttattgacatttgatagcaatttttttcatcattttccgtactcctaaggaaaactgacctatacctcataaaatgagaccgctatttaggtattacttctgccagatatttatcacccaattgcctctgacactgactaagaagatgaagaaaagcttttcaacagcctttctatatcatcgtgtgataattgttcaccaatgaatgagtccttagccctgtgtcagtttaccctcgatgcccttatttgtgagttaaagagaaaatatcataaatggtatactcttaagtatagaggttttgtatctagaggatctcagttcaactcctgtctctccatataccagcagtgtaactgtgaataacatacttaaatggctgtgcttatttccttttcttttcttttttctttttttttttttttgagatgaagttttgctcttgttccccaggctggagtgcaatggcacgatctcggttcactgcaacctccacctctcagattcaagcaattctcctgcctcagcctcccaagtagctgggattacaggtgcccaccaccacccctggctaaatttgtattttcagtagagacggggtttccccatgttggttaggctcgtctagaacctctgacctcaggtgatccacccgcctcggcctcccaaagtgctgggattacaggcgtgagccacggcgcccagcctgtgcttattttcttaaaataatttttgtattaaaaacttcacattaaataagtgctaatgttttattgcatagtagggtgactagagttaacaataacctattgcatatattttgaaatagctagaagagaggattttgaaagttctcaacacaaagaaatgacacatatttgaggtgatggatatgctaattaccctggttcggttattacgcaatgtatacatgtatcaaaacatcacactgtaccacataaatatgtatatttattatttgtcaattaaaagcaaaataaaacaaaaaaccttcatctaatactttggatcattgtgaaaaaataaattcctgaagtataaagcatctatctaagtgtctcgatctaataagtacttgttctacaaattattgaaaaacataaactctgttaatgtctcatggaacaggttgtgccttcagggaaactaggattggatttactaaattctcattttttagatctcagatactactgtcaaaatgacttcaattctgccttctatatataatacacacatatatttaggattttattgtaattctagtgttgctacatattagtctttatcaaacaaactgaattatgtgggaatcagtttattaattgtaaaaaataattataataaaattagctgatgtagttttttaaaagttaaatgagttttttgaatagcttcactcatttctagc

SEQ ID NO: 278813 - DNA, 3511 bp, Homo sapiens
atttccttctagaagccaggagcaaaggacagacctctccctggtataaggaggaagagattgagaagaggaattctccagagtctattaactatactacatcaacgcctccaagatactatggtacccatcccaggggaagtggggctacaagaacagtataaatatctcctattggcataataaatggtgtaccccaagaatatgccaagggatgttttgtagagattttgagactaaggagatttggaaattgtgtggctattagcagtttcattcataatgaaatttataatcccttaaaaaacttggaggaagataattgcaggaagaacaccttgaataagcagaactcagctgtgagatcaggagcaagaggagcacattggaagaatttcgaaaaagggcaccttttctaatttttaatacttggctgggttaatctaaaactatgtcagaagaagtggcatgataacaagatcctgagactcaagagaaaagggagattgagtgggaatgcctctagttcccacggctcctcctgtgaacagcacagctacacggcccggctgattcattcagagggcgggactcaccaggccctacgtggagaaatgccattggcccatagtttatctttcactttcctgccctgagcgtgagcaagaatttcctgcggttcctctaggaaaattcctttgtgcagatcaggcccgtggattgggatctgtgaacaagaggaacctcagcagccaggacaggcaggagcagtggaatagctactatggcttctggaatcctggttaatgtaaaggaggaggtgacctgccccatctgcctggaactcctgacacaacccctgagcctggactgcggccacagcttctgccaagcatgcctcactgcaaaccacaagaagtccatgctagacaaaggagagagtagctgccctgtgtgccggatcagttaccagcctgagaacatacggcctaatcggcatgtagccaacatagtggagaagctcagggaggtcaagttgagcccagaggggcagaaagttgatcattgtgcacgccatggagagaaacttctactcttctgtcaggaggacgggaaggtcatttgctggctttgtgagcggtctcaggagcaccgtggtcaccacacgttcctcacagaggaggttgcccgggagtaccaagtgaagctccaggcagctctggagatgctgaggcagaagcagcaggaagctgaagagttggaagctgacatcagagaagagaaagcttcctggaagactcaaatacagtatgacaaaaccaacgtcttggcagattttgagcaactgagagacatcctggactgggaggagagcaatgagctgcaaaacctggagaaggaggaggaagacattctgaaaagccttacgaactctgaaactgagatggtgcagcagacccagtccctgagagagctcatctcagatctggagcatcggctgcaggggtcagtgatggagctgcttcaggtgtggatggcgtcataaaaaggacggagaacgtgaccttgaagaagccagaaacttttccaaaaaatcaaaggagagtgtttcgagctcctgatctgaaaggaatgctagaagtgtttagagagctgacagatgtccgacgctactgggttgatgtgacagtggctccaaacaacatttcatgtgctgtcatttctgaagataagagacaagtgagctctccgaaaccacagataatatatggggcacgagggacaagataccagacatttgtgaatttcaattattgtactggcatcctgggctctcaaagtatcacatcagggaaacattactgggaggtagacgtgtccaagaaaactgcttggatcctgggggtatgtgctggcttccaacctgatgcaatgtgtaatattgaaaaaaatgaaaattatcaacctaaatacggctactgggttatagggttagaggaaggagttaaatgtagtgctttccaggatagttccttccatactccttctgttcctttcattgtgcccctctctgtgattatttgtcctgatcgtgttggagttttcctagactatgaggcttgcactgtctcattcttcaatatcacaaaccatggatttctcatctataagttttctcactgttctttttctcagcctgtatttccatatttaaatcctagaaaatgtggagtccccatgactctgtgctcaccaagctcttgaaccttcttacacactcagccccttctgtacagcacctcttgtccaggtgcatctcatacacctgaactcatttgcatcattttaaccatcttttccttgctgtctcccttctttctatttgaacgtccttcactcatcagtaaaatgtaataattgccttgtgccatattgtccccaatattttattgacatttgatagcaatttttttcatcattttccgtactcctaaggaaaactgacctatacctcataaaatgagaccgctatttaggtattacttctgccagatatttatcacccaattgcctctgacactgactaagaagatgaagaaaagcttttcaacagcctttctatatcatcgtgtgataattgttcaccaatgaatgagtccttagccctgtgtcagtttaccctcgatgcccttatttgtgagttaaagagaaaatatcataaatggtatactcttaagtatagaggttttgtatctagaggatctcagttcaactcctgtctctccatataccagcagtgtaactgtgaataacatacttaaatggctgtgcttatttccttttcttttcttttttctttttttttttttttgagatgaagttttgctcttgttccccaggctggagtgcaatggcacgatctcggttcactgcaacctccacctctcagattcaagcaattctcctgcctcagcctcccaagtagctgggattacaggtgcccaccaccacccctggctaaatttgtattttcagtagagacggggtttccccatgttggttaggctcgtctagaacctctgacctcaggtgatccacccgcctcggcctcccaaagtgctgggattacaggcgtgagccacggcgcccagcctgtgcttattttcttaaaataatttttgtattaaaaacttcacattaaataagtgctaatgttttattgcatagtagggtgactagagttaacaataacctattgcatatattttgaaatagctagaagagaggattttgaaagttctcaacacaaagaaatgacacatatttgaggtgatggatatgctaattaccctggttcggttattacgcaatgtatacatgtatcaaaacatcacactgtaccacataaatatgtatatttattatttgtcaattaaaagcaaaataaaacaaaaaaccttcatctaatactttggatcattgtgaaaaaataaattcctgaagtataaag

SEQ ID NO: 278814 - DNA, 3154 bp, Homo sapiens
ctccgttctgctggaacacaaacgcgcttctcagtttctctggaggaacttggttggcgaagagcttggcgcttcttgtaaaccttgtcccgctggacaaagacttgtgaaggaacacggagtgccaccaggactccgtggccctccccgcctctctctcctttttcccttcatggcggtgaagctgtggacgcttctcttcaggaggtgagctccagatgagacgccacatcccagcggagtcccggaagggtcaccccgcaggtctaaggcccgcctgttctgtgccgtgacctgtgctaccgaagtcatctgttgctgtagggaggccagggactcagccgatgcctcaatggccaactgcagggatctgtgaacaagaggaacctcagcagccaggacaggcaggagcagtggaatagctactatggcttctggaatcctggttaatgtaaaggaggaggtgacctgccccatctgcctggaactcctgacacaacccctgagcctggactgcggccacagcttctgccaagcatgcctcactgcaaaccacaagaagtccatgctagacaaaggagagagtagctgccctgtgtgccggatcagttaccagcctgagaacatacggcctaatcggcatgtagccaacatagtggagaagctcagggaggtcaagttgagcccagaggggcagaaagttgatcattgtgcacgccatggagagaaacttctactcttctgtcaggaggacgggaaggtcatttgctggctttgtgagcggtctcaggagcaccgtggtcaccacacgttcctcacagaggaggttgcccgggagtaccaagtgaagctccaggcagctctggagatgctgaggcagaagcagcaggaagctgaagagttggaagctgacatcagagaagagaaagcttcctggaagactcaaatacagtatgacaaaaccaacgtcttggcagattttgagcaactgagagacatcctggactgggaggagagcaatgagctgcaaaacctggagaaggaggaggaagacattctgaaaagccttacgaactctgaaactgagatggtgcagcagacccagtccctgagagagctcatctcagatctggagcatcggctgcaggggtcagtgatggagctgcttcaggtgtggatggcgtcataaaaaggacggagaacgtgaccttgaagaagccagaaacttttccaaaaaatcaaaggagagtgtttcgagctcctgatctgaaaggaatgctagaagtgtttagagagctgacagatgtccgacgctactgggttgatgtgacagtggctccaaacaacatttcatgtgctgtcatttctgaagataagagacaagtgagctctccgaaaccacagataatatatggggcacgagggacaagataccagacatttgtgaatttcaattattgtactggcatcctgggctctcaaagtatcacatcagggaaacattactgggaggtagacgtgtccaagaaaactgcttggatcctgggggtatgtgctggcttccaacctgatgcaatgtgtaatattgaaaaaaatgaaaattatcaacctaaatacggctactgggttatagggttagaggaaggagttaaatgtagtgctttccaggatagttccttccatactccttctgttcctttcattgtgcccctctctgtgattatttgtcctgatcgtgttggagttttcctagactatgaggcttgcactgtctcattcttcaatatcacaaaccatggatttctcatctataagttttctcactgttctttttctcagcctgtatttccatatttaaatcctagaaaatgtggagtccccatgactctgtgctcaccaagctcttgaaccttcttacacactcagccccttctgtacagcacctcttgtccaggtgcatctcatacacctgaactcatttgcatcattttaaccatcttttccttgctgtctcccttctttctatttgaacgtccttcactcatcagtaaaatgtaataattgccttgtgccatattgtccccaatattttattgacatttgatagcaatttttttcatcattttccgtactcctaaggaaaactgacctatacctcataaaatgagaccgctatttaggtattacttctgccagatatttatcacccaattgcctctgacactgactaagaagatgaagaaaagcttttcaacagcctttctatatcatcgtgtgataattgttcaccaatgaatgagtccttagccctgtgtcagtttaccctcgatgcccttatttgtgagttaaagagaaaatatcataaatggtatactcttaagtatagaggttttgtatctagaggatctcagttcaactcctgtctctccatataccagcagtgtaactgtgaataacatacttaaatggctgtgcttatttccttttcttttcttttttctttttttttttttttgagatgaagttttgctcttgttccccaggctggagtgcaatggcacgatctcggttcactgcaacctccacctctcagattcaagcaattctcctgcctcagcctcccaagtagctgggattacaggtgcccaccaccacccctggctaaatttgtattttcagtagagacggggtttccccatgttggttaggctcgtctagaacctctgacctcaggtgatccacccgcctcggcctcccaaagtgctgggattacaggcgtgagccacggcgcccagcctgtgcttattttcttaaaataatttttgtattaaaaacttcacattaaataagtgctaatgttttattgcatagtagggtgactagagttaacaataacctattgcatatattttgaaatagctagaagagaggattttgaaagttctcaacacaaagaaatgacacatatttgaggtgatggatatgctaattaccctggttcggttattacgcaatgtatacatgtatcaaaacatcacactgtaccacataaatatgtatatttattatttgtcaattaaaagcaaaataaaacaaaaaaccttcatctaatactttggatcattgtgaaaaaataaattcctgaagtataaag

SEQ ID NO: 278815 - DNA, 4460 bp, Homo sapiens
atttccttctagaagccaggagcaaaggacagacctctccctggtataaggaggaagagattgagaagaggaattctccagagtctattaactatactacatcaacgcctccaagatactatggtacccatcccaggggaagtggggctacaagaacagtataaatatctcctattggcataataaatggtgtaccccaagaatatgccaagggatgttttgtagagattttgagactaaggagatttggaaattgtgtggctattagcagtttcattcataatgaaatttataatcccttaaaaaacttggaggaagataattgcaggaagaacaccttgaataagcagaactcagctgtgagatcaggagcaagaggagcacattggaagaatttcgaaaaagggcaccttttctaatttttaatacttggctgggttaatctaaaactatgtcagaagaagtggcatgataacaagatcctgagactcaagagaaaagggagattgagtgggaatgcctctagttcccacggctcctcctgtgaacagcacagctacacggcccggctgattcattcagagggcgggactcaccaggccctacgtggagaaatgccattggcccatagtttatctttcactttcctgccctgagcgtgagcaagaatttcctgcggttcctctaggaaaattcctttgtgcagatcaggcccgtggattggtgagtgaatcctaaccacgtcttccctggcctgtcttcactcttctccccagaatcaccacttctgcactggtgtctgaaggtgtattgagtgattttgtggagggcagaagtaggaagtctttgggacaaaactgtatttaccttgggatctgtgaacaagaggaacctcagcagccaggacaggcaggagcagtggaatagctactatggcttctggaatcctggttaatgtaaaggaggaggtgacctgccccatctgcctggaactcctgacacaacccctgagcctggactgcggccacagcttctgccaagcatgcctcactgcaaaccacaagaagtccatgctagacaaaggagagagtagctgccctgtgtgccggatcagttaccagcctgagaacatacggcctaatcggcatgtagccaacatagtggagaagctcagggaggtcaagttgagcccagaggggcagaaagttgatcattgtgcacgccatggagagaaacttctactcttctgtcaggaggacgggaaggtcatttgctggctttgtgagcggtctcaggagcaccgtggtcaccacacgttcctcacagaggaggttgcccgggagtaccaagtgaagctccaggcagctctggagatgctgaggcagaagcagcaggaagctgaagagttggaagctgacatcagagaagagaaagcttcctggaagactcaaatacagtatgacaaaaccaacgtcttggcagattttgagcaactgagagacatcctggactgggaggagagcaatgagctgcaaaacctggagaaggaggaggaagacattctgaaaagccttacgaactctgaaactgagatggtgcagcagacccagtccctgagagagctcatctcagatctggagcatcggctgcaggggtcagtgatggagctgcttcaggtaaaaagtggaaagaagcgacggagaacgtgaccttgaagaagccagaaacttttccaaaaaatcaaaggagagtgtttcgagctcctgatctgaaaggaatgctagaagtgtttagagagctgacagatgtccgacgctactgggttgatgtgacagtggctccaaacaacatttcatgtgctgtcatttctgaagataagagacaagtgagctctccgaaaccacagataatatatggggcacgagggacaagataccagacatttgtgaatttcaattattgtactggcatcctgggctctcaaagtatcacatcagggaaacattactgggaggtagacgtgtccaagaaaactgcttggatcctgggggtatgtgctggcttccaacctgatgcaatgtgtaatattgaaaaaaaaagatttatgattctccttccaagacacacataacttacccctccttataacttctaaacaaggttcctcccagttttctctcaagtctttatcaagatttctctcatatcacaaataaagttacattatatcccttagctgacctgttaatttttctacagttgatgtgacagtggctccaaacaacatttcatgtgctgtcatttctgaagataagagacaagtgagctctccgaaaccacagataatatatggggcacgagggacaagataccagacatttgtgaatttcaattattgtactggcatcctgggctctcaaagtatcacatcagggaaacattactgggaggtagacgtgtccaagaaaactgcttggatcctgggggtatgtgctggcttccaacctgatgcaatgtgtaatattgaaaaaaatgaaaattatcaacctaaatacggctactgggttatagggttagaggaaggagttaaatgtagtgctttccaggatagttccttccatactccttctgttcctttcattgtgcccctctctgtgattatttgtcctgatcgtgttggagttttcctagactatgaggcttgcactgtctcattcttcaatatcacaaaccatggatttctcatctataagttttctcactgttctttttctcagcctgtatttccatatttaaatcctagaaaatgtggagtccccatgactctgtgctcaccaagctcttgaaccttcttacacactcagccccttctgtacagcacctcttgtccaggtgcatctcatacacctgaactcatttgcatcattttaaccatcttttccttgctgtctcccttctttctatttgaacgtccttcactcatcagtaaaatgtaataattgccttgtgccatattgtccccaatattttattgacatttgatagcaatttttttcatcattttccgtactcctaaggaaaactgacctatacctcataaaatgagaccgctatttaggtattacttctgccagatatttatcacccaattgcctctgacactgactaagaagatgaagaaaagcttttcaacagcctttctatatcatcgtgtgataattgttcaccaatgaatgagtccttagccctgtgtcagtttaccctcgatgcccttatttgtgagttaaagagaaaatatcataaatggtatactcttaagtatagaggttttgtatctagaggatctcagttcaactcctgtctctccatataccagcagtgtaactgtgaataacatacttaaatggctgtgcttatttccttttcttttcttttttctttttttttttttttgagatgaagttttgctcttgttccccaggctggagtgcaatggcacgatctcggttcactgcaacctccacctctcagattcaagcaattctcctgcctcagcctcccaagtagctgggattacaggtgcccaccaccacccctggctaaatttgtattttcagtagagacggggtttccccatgttggttaggctcgtctagaacctctgacctcaggtgatccacccgcctcggcctcccaaagtgctgggattacaggcgtgagccacggcgcccagcctgtgcttattttcttaaaataatttttgtattaaaaacttcacattaaataagtgctaatgttttattgcatagtagggtgactagagttaacaataacctattgcatatattttgaaatagctagaagagaggattttgaaagttctcaacacaaagaaatgacacatatttgaggtgatggatatgctaattaccctggttcggttattacgcaatgtatacatgtatcaaaacatcacactgtaccacataaatatgtatatttattatttgtcaattaaaagcaaaataaaacaaaaaaccttcatctaatactttggatcattgtgaaaaaataaattcctgaagtataaagcatctatctaagtgtctcgatctaataagtacttgttctacaaattattgaaaaacataaactctgttaatgtctcatggaacaggttgtgccttcagggaaactaggattggatttactaaattctcattttttagatctcagatactactgtcaaaatgacttcaattctgccttctatatataatacacacatatatttaggattttattgtaattctagtgttgctacatattagtctttatcaaacaaactgaattatgtgggaatcagtttattaattgtaaaaaataattataataaaattagctgatgtagttttttaaaagttaaatgagttttttgaatagcttcactcatttctagc

SEQ ID NO: 278816 - DNA, 1934 bp, Homo sapiens
atttccttctagaagccaggagcaaaggacagacctctccctggtataaggaggaagagattgagaagaggaattctccagagtctattaactatactacatcaacgcctccaagatactatggtacccatcccaggggaagtggggctacaagaacagtataaatatctcctattggcataataaatggtgtaccccaagaatatgccaagggatgttttgtagagattttgagactaaggagatttggaaattgtgtggctattagcagtttcattcataatgaaatttataatcccttaaaaaacttggaggaagataattgcaggaagaacaccttgaataagcagaactcagctgtgagatcaggagcaagaggagcacattggaagaatttcgaaaaagggcaccttttctaatttttaatacttggctgggttaatctaaaactatgtcagaagaagtggcatgataacaagatcctgagactcaagagaaaagggagattgagtgggaatgcctctagttcccacggctcctcctgtgaacagcacagctacacggcccggctgattcattcagagggcgggactcaccaggccctacgtggagaaatgccattggcccatagtttatctttcactttcctgccctgagcgtgagcaagaatttcctgcggttcctctaggaaaattcctttgtgcagatcaggcccgtggattggtgagtgaatcctaaccacgtcttccctggcctgtcttcactcttctccccagaatcaccacttctgcactggtgtctgaaggtgtattgagtgattttgtggagggcagaagtaggaagtctttgggacaaaactgtatttaccttgggatctgtgaacaagaggaacctcagcagccaggacaggcaggagcagtggaatagctactatggcttctggaatcctggttaatgtaaaggaggaggtgacctgccccatctgcctggaactcctgacacaacccctgagcctggactgcggccacagcttctgccaagcatgcctcactgcaaaccacaagaagtccatgctagacaaaggagagagtagctgccctgtgtgccggatcagttaccagcctgagaacatacggcctaatcggcatgtagccaacatagtggagaagctcagggaggtcaagttgagcccagaggggcagaaagttgatcattgtgcacgccatggagagaaacttctactcttctgtcaggaggacgggaaggtcatttgctggctttgtgagcggtctcaggagcaccgtggtcaccacacgttcctcacagaggaggttgcccgggagtaccaagtgaagctccaggcagctctggagatgctgaggcagaagcagcaggaagctgaagagttggaagctgacatcagagaagagaaagcttcctggaagactcaaatacagtatgacaaaaccaacgtcttggcagattttgagcaactgagagacatcctggactgggaggagagcaatgagctgcaaaacctggagaaggaggaggaagacattctgaaaagccttacgaactctgaaactgagatggtgcagcagacccagtccctgagagagctcatctcagatctggagcatcggctgcaggggtcagtgatggagctgcttcaggtaaaaagtggaaagaagcctgagcactgagattaaagaaaagtgaaggctatttccttctctgcgttgctgtgctttttctaatattaaccatgttctctgcaggaccgcttttctgaatccattgctgaagttataagaataattgaatgtagaagtagcaagagataatcccatttttattaatttatccagagcagtagaaaaatttgacgtagtggagatgatcattagctctagtcatgttgatacggttcc

SEQ ID NO: 278817 - DNA, 470 bp, Homo sapiens
tgggcaggagaaagatctacttaaaaaagaagcaaacaaacaaacaatcaacacttattactgggaaaacaaccaataactatggacagcaaagacagaccccgcgcattcccggaaactactaaatcggagttcacaacgcgcgcacctataagcattttgagcgggaactgcattttaaccccggccaaggagagattccaggaagcgcctgggccccgaggctgaacagtgaagctcatgggtactatctgagggtgcaaccaagcagggggtcaataacaagggtcctccaccaccctgcactcctggaataacccagcgcctgtaatctgagcaacagtttccaaagaccttctctgcagcccgagcctgacgggtatccagggtaaccgcgagggggcggagcttcgggttaggtcccggcgaggttcttcccgcagccaataacgagccgtaaatccccagcc

SEQ ID NO: 278818 - DNA, 467 bp, Homo sapiens
  misc_feature (53)..(53): n is a, c, g, or t
tacgatatttataaggaggcagggggtaaaagatagtagaagatgatgtccangagaggcagcactcgggggaagcagcaccaaggcaggcatcgtcattctgcatatgcaggccttgactggcagcagagctcactgtcctgatgggtacgtcagtagcacacagaaggcctctgcccaccatttctctcttcagcgaacaccttctcaaacatctcatgcttaaacctgccctccaccaggaagctttgcttgaccccaaagtcggccttgcctctctcctggggctcccacagctggagaacatgacctcttgtgaccttttggacctggagctacctcaccaccaggagtgccccgcggaggtaggactgattgtttaccatctgtgcagggcccaggacaatccctgcatgtgccagatgtgcagaaaatacttgctaatggaataaaggaatgagtcccca

SEQ ID NO: 278819 - DNA, 446 bp, Homo sapiens
tatgcctggtgctaccctccccatgaccccaaaaacgagagccatgagacaatgccaccttagccatttcccttgagagaaatgaaggaggaacagacataaggcagagccacctgaggtttttagaatctatatctcacatactgaactagtgtttaatggctctgagaataaaaccaaaccaaatcttccttccacttgagtttccaacataaggacaccttactctctgcacttctccttgaccaggaggcagcactcgggggaagcagcaccaaggcaggcatcgtcattctgcatatgcaggccttgactggcagcagagctcactgtcctgatgggtacgtcagtagcacacagaaggtaaggctcaccgagcacaggccatgaatctcctctgctcgactggatgttctcatactcttggctgggaacatgacctctgc

SEQ ID NO: 278820 - DNA, 557 bp, Homo sapiens
  misc_feature (53)..(53): n is a, c, g, or t
tacgatatttataaggaggcagggggtaaaagatagtagaagatgatgtccangagaggcagcactcgggggaagcagcaccaaggcaggcatcgtcattctgcatatgcaggccttgactggcagcagagctcactgtcctgatgggtacgtcagtagcacacagaaggcctctgcccaccatttctctcttcagcgaacaccttctcaaacatctcatgcttaaacctgccctccaccaggaagctttgcttgaccccaaagtcggccttgcctctctcctggggctcccacagctggagaacatgacctcttgtgaccttttggacctggagctacctcaccaccaggagtgccccgcggaggtaggactgattgtttaccatctgtgcagggcccaggacaatccctgcatgtgccagatgtgcagaaaatacttgctaatggaataaaggaatgagtccccaaaaaaagaaaaaaaagtggcgctcgtgggcctcatccggtggatcttctgcgggcggttcccgttaagggggggggaatgcaggatgccg

SEQ ID NO: 278821 - DNA, 3210 bp, Homo sapiens
gaacaaaccaacatttgagccaggaataactagagaggaacaatggggttattcagaggttttgttttcctcttagttctgtgcctgctgcaccagtcaaatacttccttcattaagctgaataataatggctttgaagatattgtcattgttatagatcctagtgtgccagaagatgaaaaaataattgaacaaatagaggatatggtgactacagcttctacgtacctgtttgaagccacagaaaaaagattttttttcaaaaatgtatctatattaattcctgagaattggaaggaaaatcctcagtacaaaaggccaaaacatgaaaaccataaacatgctgatgttatagttgcaccacctacactcccaggtagagatgaaccatacaccaagcagttcacagaatgtggagagaaaggcgaatacattcacttcacccctgaccttctacttggaaaaaaacaaaatgaatatggaccaccaggcaaactgtttgtccatgagtgggctcacctccggtggggagtgtttgatgagtacaatgaagatcagcctttctaccgtgctaagtcaaaaaaaatcgaagcaacaaggtgttccgcaggtatctctggtagaaatagagtttataagtgtcaaggaggcagctgtcttagtagagcatgcagaattgattctacaacaaaactgtatggaaaagattgtcaattctttcctgataaagtacaaacagaaaaagcatccataatgtttatgcaaagtattgattctgttgttgaattttgtaacgaaaaaacccataatcaagaagctccaagcctacaaaacataaagtgcaattttagaagtacatgggaggtgattagcaattctgaggattttaaaaacaccatacccatggtgacaccacctcctccacctgtcttctcattgctgaagatccgtcaaagaattgtgtgcttagttcttgataagtctggaagcatggggggtaaggaccgcctaaatcgaatgaatcaagcagcaaaacatttcctgctgcagactgttgaaaatggatcctgggtggggatggttcactttgatagtactgccactattgtaaataagctaatccaaataaaaagcagtgatgaaagaaacacactcatggcaggattacctacatatcctctgggaggaacttccatctgctctggaattaaatatgcatttcaggtgattggagagctacattcccaactcgatggatccgaagtactgctgctgactgatggggaggataacactgcaagttcttgtattgatgaagtgaaacaaagtggggccattgttcattttattgctttgggaagagctgctgatgaagcagtaatagagatgagcaagataacaggaggaagtcatttttatgtttcagatgaagctcagaacaatggcctcattgatgcttttggggctcttacatcaggaaatactgatctctcccagaagtcccttcagctcgaaagtaagggattaacactgaatagtaatgcctggatgaacgacactgtcataattgatagtacagtgggaaaggacacgttctttctcatcacatggaacagtctgcctcccagtatttctctctgggatcccagtggaacaataatggaaaatttcacagtggatgcaacttccaaaatggcctatctcagtattccaggaactgcaaaggtgggcacttgggcatacaatcttcaagccaaagcgaacccagaaacattaactattacagtaacttctcgagcagcaaattcttctgtgcctccaatcacagtgaatgctaaaatgaataaggacgtaaacagtttccccagcccaatgattgtttacgcagaaattctacaaggatatgtacctgttcttggagccaatgtgactgctttcattgaatcacagaatggacatacagaagttttggaacttttggataatggtgcaggcgctgattctttcaagaatgatggagtctactccaggtattttacagcatatacagaaaatggcagatatagcttaaaagttcgggctcatggaggagcaaacactgccaggctaaaattacggcctccactgaatagagccgcgtacataccaggctgggtagtgaacggggaaattgaagcaaacccgccaagacctgaaattgatgaggatactcagaccaccttggaggatttcagccgaacagcatccggaggtgcatttgtggtatcacaagtcccaagccttcccttgcctgaccaatacccaccaagtcaaatcacagaccttgatgccacagttcatgaggataagattattcttacatggacagcaccaggagataattttgatgttggaaaagttcaacgttatatcataagaataagtgcaagtattcttgatctaagagacagttttgatgatgctcttcaagtaaatactactgatctgtcaccaaaggaggccaactccaaggaaagctttgcatttaaaccagaaaatatctcagaagaaaatgcaacccacatatttattgccattaaaagtatagataaaagcaatttgacatcaaaagtatccaacattgcacaagtaactttgtttatccctcaagcaaatcctgatgacattgatcctactcctactcctactcctactcctgataaaagtcataattctggagttaatatttctacgctggtattgtctgtgattgggtctgttgtaattgttaactttattttaagtaccaccatttgaaccttaacgaagaaaaaaatcttcaagtagacctagaagagagttttaaaaaacaaaacaatgtaagtaaaggatatttctgaatcttaaaattcatcccatgtgtgatcataaactcataaaaataattttaagatgtcggaaaaggatactttgattaaataaaaacactcatggatatgtaaaaactgtcaagattaaaatttaatagtttcatttatttgttattttatttgtaagaaatagtgatgaacaaagatcctttttcatactgatacctggttgtatattatttgatgcaacagttttctgaaatgatatttcaaattgcatcaagaaattaaaatcatctatctgagtagtcaaaatacaagtaaaggagagcaaataaacaacatttggaaaaaaatgaat

SEQ ID NO: 278822 - DNA, 445 bp, Homo sapiens
gaacaaaccaacatttgagccaggaataactagagaggaacaatggggttattcagaggttttgttttcctcttagttctgtgcctgctgcaccagtcaaatacttccttcattaagctgaataataatggctttgaagatattgtcattgttatagatcctagtgtgccagaagatgaaaaaataattgaacaaatagaggtaagaacaaaatggaatatctttcattaatttttagttttttactattatttttaattgacatataattgtacatatttatggcatacaaagtagtatttctatacatgtatacaatttgtaaagatcaaatcagggtaattagcatattcagcaactcaaacatttatctttgcattgtgtcgggaacattataattattctcttctagctactttgaaatacacaacagattatcagtaac

SEQ ID NO: 278823 - DNA, 945 bp, Homo sapiens
  misc_feature (848)..(848): n is a, c, g, or t
  misc_feature (863)..(863): n is a, c, g, or t
  misc_feature (868)..(868): n is a, c, g, or t
  misc_feature (871)..(871): n is a, c, g, or t
  misc_feature (893)..(893): n is a, c, g, or t
  misc_feature (903)..(903): n is a, c, g, or t
agcatactgagggtttactaatttgtaatcactgactttttcaaatgttgaagtggattcttaatgcatctagctttaaatgcaagagactttataaactgaaggcttgtctgtcagaaggtagtccagtcaaagaaaacataacactaattaatgtcacatactgtgattatacctttggtatctggttgacctgagtttcccaggttgagatgttattgtcatttagtctagacaggattttccaaagcctggtcccaccgaattcctttaaataaatactacctgcagctgggagttaaaaaaattcatgtttaactttccccaaggattgttgattgaaaattctttattttaaaatagaggttatctcttctattctgcataactttgtttattttctctgtaaattttttctcatttcccatttgtctatttgatctaggaacatctgttggtaactgtgctctgaattatgtttgcaggtgattggagagctacattcccaactcgatggatccgaagtactgctgctgactgatggggaggataacactgcaagttcttgtattgatgaagtgaaacaaagtggggccattgttcattttattgctttgggaagagctgctgatgaagcagtaatagagatgagcaagataacaggtaaaacacgatccatttattccaggccttcaatagtaatgcataaatgtaaaggctgacagttcaacaacgtctcttgagtttctgccttggaggcactgaagctggggaccagacccaatctctgttctcgtggcacttggagtgccagttggcttgtatgaatggtagacccctggagtttncacaaagcacatgtntgctnctnctcccgcatggctgtttataanccagataacnggcctaaggacttgcctctccttcccgtgcgtgcccccggtc

SEQ ID NO: 278824 - DNA, 797 bp, Homo sapiens
aggaccaggactaaggatattatgatgttgatggtgatggctacaatggctgaattcgatgtatttgtgatcttatgactggctgagggcaaggaaagatgacagacactgacgaggaaatgggagattgcgagtcccagtgtgtgataaggataacgatggctatatttatattgctgaagttcgtcatgtgatgggacagccggaccccccaagtaactttgtttatccctcaagcaaatcctgatgacattgatcctactcctactcctactcctactcctgataaaagtcataattctggagttaatatttctacgctggtattgtctgtgattgggtctgttgtaattgttaactttattttaagtaccaccatttgaaccttaacgaagaaaaaaatcttcaagtagacctagaagagagttttaaaaaacaaaacaatgtaagtaaaggatatttctgaatcttaaaattcatcccatgtgtgatcataaactcataaaaataattttaagatgtcggaaaaggatactttgattaaataaaaacactcatggatatgtaaaaactgtcaagattaaaatttaatagtttcatttatttgttattttatttgtaagaaatagtgatgaacaaagatcctttttcatactgatacctggttgtatattatttgatgcaacagttttctgaaatgatatttcaaattgcatcaagaaattaaaatcatctatctgagtagtcaaaatacaagtaaaggagagcaaataaacaacatttggaaaaaaatgaat

SEQ ID NO: 278825 - DNA, 1596 bp, Homo sapiens
gaacaaaccaacatttgagccaggaataactagagaggaacaatggggttattcagaggttttgttttcctcttagttctgtgcctgctgcaccagtcaaatacttccttcattaagctgaataataatggctttgaagatattgtcattgttatagatcctagtgtgccagaagatgaaaaaataattgaacaaatagaggatatggtgactacagcttctacgtacctgtttgaagccacagaaaaaagattttttttcaaaaatgtatctatattaattcctgagaattggaaggaaaatcctcagtacaaaaggccaaaacatgaaaaccataaacatgctgatgttatagttgcaccacctacactcccaggtagagatgaaccatacaccaagcagttcacagaatgtggagagaaaggcgaatacattcacttcacccctgaccttctacttggaaaaaaacaaaatgaatatggaccaccaggcaaactgtttgtccatgagtgggctcacctccggtggggagtgtttgatgagtacaatgaagatcagcctttctaccgtgctaagtcaaaaaaaatcgaagcaacaaggtgttccgcaggtatctctggtagaaatagagtttataagtgtcaaggaggcagctgtcttagtagagcatgcagaattgattctacaacaaaactgtatggaaaagattgtcaattctttcctgataaagtacaaacagaaaaagcatccataatgtttatgcaaagtattgattctgttgttgaattttgtaacgaaaaaacccataatcaagaagctccaagcctacaaaacataaagtgcaattttagaagtacatgggaggtgattagcaattctgaggattttaaaaacaccatacccatggtgacaccacctcctccacctgtcttctcattgctgaagatccgtcaaagaattgtgtgcttagttcttgataagtctggaagcatggggggtaaggaccgcctaaatcgaatgaatcaagcagcaaaacatttcctgctgcagactgttgaaaatggatcctgggtggggatggttcactttgatagtactgccactattgtaaataagctaatccaaataaaaagcagtgatgaaagaaacacactcatggcaggattacctacatatcctctgggaggaacttccatctgctctggaattaaatatgcatttcaggtgattggagagctacattcccaactcgatggatccgaagtactgctgctgactgatggggaggataacactgcaagttcttgtattgatgaagtgaaacaaagtggggccattgttcattttattgctttgggaagagctgctgatgaagcagtaatagagatgagcaagataacaggtaaaacacgatccatttattccaggccttcaatagtaatgcataaatgtaaaggctgacagttcaacaacgtctcttgagtttctgccttggaggcactgaagctggggaccagacccaatctctgttctaagggcactggatgttaccatgagctcttgtttttttttttcttcaactcatcttcactttca

SEQ ID NO: 278826 - DNA, 402 bp, Homo sapiens
  misc_feature (1)..(3): n is a, c, g, or t
  misc_feature (12)..(14): n is a, c, g, or t
  misc_feature (305)..(305): n is a, c, g, or t
  misc_feature (320)..(320): n is a, c, g, or t
  misc_feature (325)..(325): n is a, c, g, or t
  misc_feature (328)..(328): n is a, c, g, or t
  misc_feature (350)..(350): n is a, c, g, or t
  misc_feature (360)..(360): n is a, c, g, or t
nnnaaaattttnnnttccggccgcagaactccaccgctgaggccaatggggccattgttcattttattgctttgggaagagctgctgatgaagcagtaatagagatgagcaagataacaggtaaaacacgatccatttattccaggccttcaatagtaatgcataaatgtaaaggctgacagttcaacaacgtctcttgagtttctgccttggaggcactgaagctggggaccagacccaatctctgttctcgtggcacttggagtgccagttggcttgtatgaatggtagacccctggagtttncacaaagcacatgtntgctnctnctcccgcatggctgtttataanccagataacnggcctaaggacttgcctctccttcccgtgcgtgcccccggtc

SEQ ID NO: 278827 - DNA, 118 bp, Homo sapiens
caaagaattgtgtgcttagttcttgataagtctggaagcatgggggtaagatcactttttctggatatagggatgtaggatatttgaagatccgagaacacactgaactctgtctgca

SEQ ID NO: 278828 - DNA, 1080 bp, Homo sapiens
ggtggaccgaattgttggcgagcgggtgtgaacggggaaattgaagcaaacccgccaagacctgaaattgatgaggatactcagaccaccttggaggatttcagccgaacagcatccggaggtgcatttgtggtatcacaagtcccaagccttcccttgcctgaccaatacccaccaagtcaaatcacagaccttgatgccacagttcatgaggataagattattcttacatggacagcaccaggagataattttgatgttggaaaagttcaacgttatatcataagaataagtgcaagtattcttgatctaagagacagttttgatgatgctcttcaagtaaatactactgatctgtcaccaaaggaggccaactccaaggaaagctttgcatttaaaccagaaaatatctcagaagaaaatgcaacccacatatttattgccattaaaagtatagataaaagcaatttgacatcaaaagtatccaacattgcacaagtaactttgtttatccctcaagcaaatcctgatgacattgatcctactcctactcctactcctactcctgataaaagtcataattctggagttaatatttctacgctggtattgtctgtgattgggtctgttgtaattgttaactttattttaagtaccaccatttgaaccttaacgaagaaaaaaatcttcaagtagacctagaagagagttttaaaaaacaaaacaatgtaagtaaaggatatttctgaatcttaaaattcatcccatgtgtgatcataaactcataaaaataattttaagatgtcggaaaaggatactttgattaaataaaaacactcatggatatgtaaaaactgtcaagattaaaatttaatagtttcatttatttgttattttatttgtaagaaatagtgatgaacaaagatcctttttcatactgatacctggttgtatattatttgatgcaacagttttctgaaatgatatttcaaattgcatcaagaaattaaaatcatctatctgagtagtcaaaatacaagtaaaggagagcaaataaacaacatttggaaaaaaatgaat

SEQ ID NO: 278829 - DNA, 1099 bp, Homo sapiens
aatgagcggtgcgcggcgcgccgcgcccggaaccagcaacgcggcaaaggggtcctgcacgtacccgcgcgcggccagggaacgcttgctgagggcgctgctgtcgttggtgttctgtaccgcgcctgcccgacgctcacggctccgggggcccatggccagaagagactcaggaatggcagtctgtcacggttgtgagccgccccttggttagcacacacctcacggacctcggtagggggaaaaaaaccacccatgctcctggacttccccttccgccggcacttgtgcgtcacttccgggaagagcgcatctcgccaaccagaattgaggagggtgtagccagtgctaagttcgcttgcggctgacctttctttggaatgtcgtggaagcaaatactgcacatgcgtgttggtcctgtgagggaaaccagctagtggagagggagaggttgaaggaacagaaaaatgagaagacaactcactggaggctgaagtgggaggatcgcttgagtctggaagcttgagactgcagcaagctgtgatcgtgacactgcactccagcctgggcaacaaagtaagatcctgtctcaaaagaaaaaaaaaaaaaggtgaagctgaacccagatctacacatacagctaatcttaccaaaatgtgtggaagtaaagcaatctgaaggaaattcagtaccatacaatttactgactgaaatacatcatatggctcatactaagaataagagtggagaagaatcattttttcctgctaaaatgatagaggcagaagagcaacagccttgcaagacagacttctattctgaattggccaaaagtggaacttcatgcccacttgaatggatccattagttctcataccatgaagaaattaatagcccagaagccagatcttaaaatccacgatcagatgactgtgattgacaagggaaagaaaagaacttgtggaagaatgtttccagatgtttcaaactattcatcagcttactagtagccctgaagatatctaatggtcacaaaagatgtcataaaagaatttgcagatgacggcgtcaagtacctggaactaaggagcacacccag

SEQ ID NO: 278830 - DNA, 1240 bp, Homo sapiens
aatgagcggtgcgcggcgcgccgcgcccggaaccagcaacgcggcaaaggggtcctgcacgtacccgcgcgcggccagggaacgcttgctgagggcgctgctgtcgttggtgttctgtaccgcgcctgcccgacgctcacggctccgggggcccatggccagaagagactcaggaatggcagtctgtcacggttgtgagccgccccttggttagcacacacctcacggacctcggtagggggaaaaaaaccacccatgctcctggacttccccttccgccggcacttgtgcgtcacttccgggaagagcgcatctcgccaaccagaattgaggagggtgtagccagtgctaagttcgcttgcggctgacctttctttggaatgtcgtgagttccatttgtcccagaatacggtccgctaccgctgtgacatgagtgttagggaaggcgggttgtcacgtttctacaagccttccagtcaaaagggaaaccttgcctaagtccttgtagttgagaaatctctaagaggtggaagcaaatactgcacatgcgtgttggtcctgtgagggaaaccagctagtggagagggagaggttgaaggaacagaaaaatgagaagacaactcactggaggctgaagtgggaggatcgcttgagtctggaagcttgagactgcagcaagctgtgatcgtgacactgcactccagcctgggcaacaaagtaagatcctgtctcaaaagaaaaaaaaaaaaaggtgaagctgaacccagatctacacatacagctaatcttaccaaaatgtgtggaagtaaagcaatctgaaggaaattcagtaccatacaatttactgactgaaatacatcatatggctcatactaagaataagagtggagaagaatcattttttcctgctaaaatgatagaggcagaagagcaacagccttgcaagacagacttctattctgaattggccaaaagtggaacttcatgcccacttgaatggatccattagttctcataccatgaagaaattaatagcccagaagccagatcttaaaatccacgatcagatgactgtgattgacaagggaaagaaaagaacttgtggaagaatgtttccagatgtttcaaactattcatcagcttactagtagccctgaagatatctaatggtcacaaaagatgtcataaaagaatttgcagatgacggcgtcaagtacctggaactaaggagcacacccag

SEQ ID NO: 278831 - DNA, 1139 bp, Homo sapiens
aatgagcggtgcgcggcgcgccgcgcccggaaccagcaacgcggcaaaggggtcctgcacgtacccgcgcgcggccagggaacgcttgctgagggcgctgctgtcgttggtgttctgtaccgcgcctgcccgacgctcacggctccgggggcccatggccagaagagactcaggaatggcagtctgtcacggttgtgagccgccccttggttagcacacacctcacggacctcggtagggggaaaaaaaccacccatgctcctggacttccccttccgccggcacttgtgcgtcacttccgggaagagcgcatctcgccaaccagaattgaggagggtgtagccagtgctaagttcgcttgcggctgacctttctttggaatgtcgtgagttccatttgtcccagaatacggtccgctaccgctgtgacatgagtgttagggaaggcgggttgtcacgtttctacaagccttccagtcaaaagggaaaccttgcctaagtccttgtagttgagaaatctctaagaggaggctgaagtgggaggatcgcttgagtctggaagcttgagactgcagcaagctgtgatcgtgacactgcactccagcctgggcaacaaagtaagatcctgtctcaaaagaaaaaaaaaaaaaggtgaagctgaacccagatctacacatacagctaatcttaccaaaatgtgtggaagtaaagcaatctgaaggaaattcagtaccatacaatttactgactgaaatacatcatatggctcatactaagaataagagtggagaagaatcattttttcctgctaaaatgatagaggcagaagagcaacagccttgcaagacagacttctattctgaattggccaaaagtggaacttcatgcccacttgaatggatccattagttctcataccatgaagaaattaatagcccagaagccagatcttaaaatccacgatcagatgactgtgattgacaagggaaagaaaagaacttgtggaagaatgtttccagatgtttcaaactattcatcagcttactagtagccctgaagatatctaatggtcacaaaagatgtcataaaagaatttgcagatgacggcgtcaagtacctggaactaaggagcacacccag

SEQ ID NO: 278832 - DNA, 998 bp, Homo sapiens
aatgagcggtgcgcggcgcgccgcgcccggaaccagcaacgcggcaaaggggtcctgcacgtacccgcgcgcggccagggaacgcttgctgagggcgctgctgtcgttggtgttctgtaccgcgcctgcccgacgctcacggctccgggggcccatggccagaagagactcaggaatggcagtctgtcacggttgtgagccgccccttggttagcacacacctcacggacctcggtagggggaaaaaaaccacccatgctcctggacttccccttccgccggcacttgtgcgtcacttccgggaagagcgcatctcgccaaccagaattgaggagggtgtagccagtgctaagttcgcttgcggctgacctttctttggaatgtcgaggctgaagtgggaggatcgcttgagtctggaagcttgagactgcagcaagctgtgatcgtgacactgcactccagcctgggcaacaaagtaagatcctgtctcaaaagaaaaaaaaaaaaaggtgaagctgaacccagatctacacatacagctaatcttaccaaaatgtgtggaagtaaagcaatctgaaggaaattcagtaccatacaatttactgactgaaatacatcatatggctcatactaagaataagagtggagaagaatcattttttcctgctaaaatgatagaggcagaagagcaacagccttgcaagacagacttctattctgaattggccaaaagtggaacttcatgcccacttgaatggatccattagttctcataccatgaagaaattaatagcccagaagccagatcttaaaatccacgatcagatgactgtgattgacaagggaaagaaaagaacttgtggaagaatgtttccagatgtttcaaactattcatcagcttactagtagccctgaagatatctaatggtcacaaaagatgtcataaaagaatttgcagatgacggcgtcaagtacctggaactaaggagcacacccag

SEQ ID NO: 278833 - DNA, 1327 bp, Homo sapiens
gaaagtgtcaacatgtttattgctaatataagcatttaatgtcaaagaaatgaaggtaattttacaaactcagtttttgtaagtacatgaagtttctatttgattatgtggttttatatcacattcgttcaaatgcatttctctcccttagagggactattccaacatcactcctttggaattatttcagtcatccttaacatgtgactttaccaaagaccttgaagctaaacaaacaagcaaaacaaaatttcaatgactcttagatgaatggaataagaaatagtcatcacatgtcaattagggatgttcatctccaaccaagacactgtcaaaatgtttcttctgatacagcagttataagtcagagccttcaaaaaacaagggcagaacaagagtacaataaaagaagcatctgcaacttaagcctcccacagtcctaagcctgatatgcgcaaagcaaagcctctttcccgcaaactaaattccatccatttgagctttcagagatcgatgcccaagagctatcattaatatatacagcatattgactctagttgcatcaattatgcctgaagagtttaatacccatccaagtccaaaggtggaagaatacatacactggtatggtaataggcaagagcaggctgtaaaagcaaaggctggctgtgctagtgcagccctgtgggaagttttcttccacagaggctgagtagaacagtcctgctaaagaaaccagtggaataagaacagtcaacgtaggaagagacagaaacattcttctcttccacttattacctgccactgtgttttaaaaggtatatggtattaagaaaagttggctgttgcgtttttttaatttttttaaattatgaactagcgctgctccacttcttcttgcttcttactttgacgtgtcatcctagctgcctgtggtatcatattagggatcccatcaatgattggataagctattcccaactcttcattaatcaattcgtttgttgatgcttcatatctgagcggcttcttggagagcgggcacaccaggaactccagcagcgccggatcgaagtcgcggggcggctcctcagtcttcttgccccggtcggccaaaggccgcgaccccgacgcgtgcaggcacctacgggcgaccgcggacggcggcgcgcgcgttccccgcagcgctgaggcgagcctgcagcgtgctccactcagcatggtctggcagccggagaccaggcctcaccgcagcctcgccacccgtggccgagctcccggcttcccgttcgtccaggccagccgggcaggccccgccccctccgct

SEQ ID NO: 278834 - DNA, 1273 bp, Homo sapiens
gaaagtgtcaacatgtttattgctaatataagcatttaatgtcaaagaaatgaaggtaattttacaaactcagtttttgtaagtacatgaagtttctatttgattatgtggttttatatcacattcgttcaaatgcatttctctcccttagagggactattccaacatcactcctttggaattatttcagtcatccttaacatgtgactttaccaaagaccttgaagctaaacaaacaagcaaaacaaaatttcaatgactcttagatgaatggaataagaaatagtcatcacatgtcaattagggatgttcatctccaaccaagacactgtcaaaatgtttcttctgatacagcagttataagtcagagccttcaaaaaacaagggcagaacaagagtacaataacaaagcctctttcccgcaaactaaattccatccatttgagctttcagagatcgatgcccaagagctatcattaatatatacagcatattgactctagttgcatcaattatgcctgaagagtttaatacccatccaagtccaaaggtggaagaatacatacactggtatggtaataggcaagagcaggctgtaaaagcaaaggctggctgtgctagtgcagccctgtgggaagttttcttccacagaggctgagtagaacagtcctgctaaagaaaccagtggaataagaacagtcaacgtaggaagagacagaaacattcttctcttccacttattacctgccactgtgttttaaaaggtatatggtattaagaaaagttggctgttgcgtttttttaatttttttaaattatgaactagcgctgctccacttcttcttgcttcttactttgacgtgtcatcctagctgcctgtggtatcatattagggatcccatcaatgattggataagctattcccaactcttcattaatcaattcgtttgttgatgcttcatatctgagcggcttcttggagagcgggcacaccaggaactccagcagcgccggatcgaagtcgcggggcggctcctcagtcttcttgccccggtcggccaaaggccgcgaccccgacgcgtgcaggcacctacgggcgaccgcggacggcggcgcgcgcgttccccgcagcgctgaggcgagcctgcagcgtgctccactcagcatggtctggcagccggagaccaggcctcaccgcagcctcgccacccgtggccgagctcccggcttcccgttcgtccaggccagccgggcaggccccgccccctccgct

SEQ ID NO: 278835 - DNA, 1272 bp, Homo sapiens
gaaagtgtcaacatgtttattgctaatataagcatttaatgtcaaagaaatgaaggtaattttacaaactcagtttttgtaagtacatgaagtttctatttgattatgtggttttatatcacattcgttcaaatgcatttctctcccttagagggactattccaacatcactcctttggaattatttcagtcatccttaacatgtgactttaccaaagaccttgaagctaaacaaacaagcaaaacaaaatttcaatgactcttagatgaatggaataagaaatagtcatcacatgtcaattagggatgttcatctccaaccaagacactgtcaaaatgtttcttctgatacagcagttataagtcagagccttcaaaaaacaagggcagaacaagagtacaataaaagaagcatctgcaacttaagcctcccacagtcctaagcctgatatgcgcaaagcaaagcctctttcccgcaaactaaattccatccatttgagctttcagagatcgatgcccaagagctatcattaatatatacagcatattgactctagttgcatcaattatgcctgaagagtttaatacccatccaagtccaaaggtggaagaatacatacactggtatggtaataggcaagcttccacagaggctgagtagaacagtcctgctaaagaaaccagtggaataagaacagtcaacgtaggaagagacagaaacattcttctcttccacttattacctgccactgtgttttaaaaggtatatggtattaagaaaagttggctgttgcgtttttttaatttttttaaattatgaactagcgctgctccacttcttcttgcttcttactttgacgtgtcatcctagctgcctgtggtatcatattagggatcccatcaatgattggataagctattcccaactcttcattaatcaattcgtttgttgatgcttcatatctgagcggcttcttggagagcgggcacaccaggaactccagcagcgccggatcgaagtcgcggggcggctcctcagtcttcttgccccggtcggccaaaggccgcgaccccgacgcgtgcaggcacctacgggcgaccgcggacggcggcgcgcgcgttccccgcagcgctgaggcgagcctgcagcgtgctccactcagcatggtctggcagccggagaccaggcctcaccgcagcctcgccacccgtggccgagctcccggcttcccgttcgtccaggccagccgggcaggccccgccccctccgct

SEQ ID NO: 278836 - DNA, 835 bp, Homo sapiens
cggctctggagggtgcccttttcgcgccgagcccggctcctctttcctgtcggccccgcctcctccccatcgcctggcaacgggacaccggtctggagctaccggattttttccgaccccgccccctcctgcagatcagcgtccccagcggccccccagggcggggcggttacgcccgacgggaacgcccctccccctagaaggtggtggccgcttccacgcgtatgacagggctcgcccctgagtaagggtgggcggatcccagccccgtcgccagaagcttcaagggggctgtcccagggagcatctcccctcatcattacagggtgggagggtccagccagcctgggtgtcttggtgcctgtaacctccccgcctggtcctccgaccgcctggctctcaggaggagttaacttcctgctgcgagtcgaggatggagttacatagtccctgccctgcatctgagatgagcacccatttttggtcaagtcatttatacggagctgtctttcattccaaagagtaacacgcttccctgcagataagagttggagtcagccggtctggaaactgctgaacaccctccaagaaatactgggagtgctggacccttgacccctatgcctccaccgaaccactgacctaaaataaattacaattacagatctttcgacctgtttggtcttacttagaagtaatcccaaaggcctgaggtcacagagatgctaaatgtgaggtttagagaactgtaattaatcatctgcaggaccgaaaaagtgtacattgagcgttttctctttacacgttaaatgaataatgatggatttctattaat

SEQ ID NO: 278837 - DNA, 682 bp, Homo sapiens
aacaactcgagggcggaggccagggaactgccgcccggctttacgtaacttgacccacaggcgggcggcggcaggtggctgcacccggcgagcaaggtgctcgaagccccgagaacgcaggacgccgctcgggcagcgagacggccgggaagcacgagaggccggggagcggcggcggcggcctccttacctttccagatgcccagagagagctgggacgtgtccaagtccaccacatagtcccccaagaaccggttcaacacgtccacgaccaccgactcgaaaaccatgttcctcagccgtggtgggcacggcagccggcccgtgcgctcctcctcccgccgccttccccacgcccctccctcgagagtaacacgcttccctgcagataagagttggagtcagccggtctggaaactgctgaacaccctccaagaaatactgggagtgctggacccttgacccctatgcctccaccgaaccactgacctaaaataaattacaattacagatctttcgacctgtttggtcttacttagaagtaatcccaaaggcctgaggtcacagagatgctaaatgtgaggtttagagaactgtaattaatcatctgcaggaccgaaaaagtgtacattgagcgttttctctttacacgttaaatgaataatgatggatttctattaat

SEQ ID NO: 278838 - DNA, 2687 bp, Homo sapiens
accggcaccggagcgcgccgggtcctcgccgggtcccagccccgcgcgtcggcccagcccagccgggaccccccgcgacatgcgcgtcccagccctgcgctgagcaggcggcaatgtggggactcggggcccggggccccgaccgggggctgctgctggcgctggcgctgggcgggctggcgcgggccgggggcgtcgaggtggagcccggcggcgcgcacggcgagagcgggggcttccaggtggtcaccttcgagtgggcccacgtgcaggatccctacgtcatcgcgctctggatcctcgtggccagcttggccaagatcgggttccacctgtcccacaaggtcaccagcgtggttcccgagagcgccctgctcatcgtgctgggcctggtgctgggcggcatcgtctgggcggccgaccacatcgcgtccttcacactgacgcccaccgtcttcttcttctacctgctgccccccatcgtgctggacgccggctacttcatgcccaaccgcctcttcttcggcaacctggggaccatcctgttgtacgccgtcgtgggtaccgtgtggaacgcggccaccaccgggctgtccctctacggcgtcttcctcagtgggctcatgggcgacctgcagattgggctgctggacttcctcctgtttggcagcctcatggcggctgtggacccggtggccgtcctggccgtgtttgaggaggtccatgtcaacgaggtcctgttcatcatcgtcttcggggagtcgctgctgaacgacgcagtcaccgtggttctgtacaatgtgtttgaatctttcgtggcgctgggaggtgacaacgtgactggcgtggactgcgtgaagggcatagtgtccttcttcgtggtgagcctggggggcacgctggtgggggtggtcttcgccttcctgctgtcgctggtgacgcgcttcaccaagcatgtgcgtatcatcgagcccggcttcgtgttcatcatctcctacctgtcctacctgacgtccgagatgctgtcgctgtcggccatcctcgccatcaccttctgtggcatctgctgtcagaagtatgtgaaggccaacatctcggagcagtcggccaccaccgtgcgctacaccatgaagatgctggccagcagcgccgagaccatcatcttcatgttcctgggtatctcggccgtgaacccgttcatctggacctggaacacggccttcgtgctcctgacgctggtcttcatctccgtgtaccgggccatcggtgtggtcctgcagacctggcttctgaaccgctaccgcatggtgcagctggagcccattgaccaggtggtcctgtcctacgggggcctgcgcggggccgtggcctttgccctggtggtgcttctggatggagacaaggtcaaggagaagaacctgttcgtcagcaccaccatcatcgtagtgttcttcaccgtcatcttccagggcctgaccatcaagcctctggtgcagtggctgaaggtgaagaggagcgagcaccgggaacctcggctcaacgagaagctgcacggccgcgctttcgaccacatcctctcggccatcgaggacatatccggacagatcgggcacaattatctcagagacaagtggtcccacttcgacaggaagttcctcagcagggtcctcatgagacggtcggcccagaagtctcgagaccggatcctgaatgtcttccacgagctgaacctgaaggatgccatcagctacgtggctgagggagagcgccgcgggtccctggccttcatccgctcccccagcaccgacaacgtggtcaacgtggacttcacgccacgatcgtccaccgtggaggcctctgtctcctacctcctgagagaaaatgtcagcgctgtctgcctggacatgcagtctctggagcagcgacggcggagcatccgggacgcggaggacatggtcacgcaccacacgctacagcagtacctgtacaagccgcggcaggagtacaagcatctgtacagccgacacgagctcacgcccacggaggacgagaaacaggaccgggaaatcttccacaggaccatgcggaagcgcctggagtccttcaagtcgaccaagctggggctcaaccagaacaagaaggcagccaagctgtacaagcgggagcgtgcccagaagcggagaaacagcagcatccccaatgggaagctgcccatggagagccctgcgcagaatttcaccatcaaggagaaagacttggaactttcagacaccgaggagccccccaactatgatgaggagatgagtggggggatcgagttcctggctagtgtcaccaaggacacagcgtccgactcccctgcaggaattgacaaccctgtgttttctccggacgaggccctggaccgcagcctcctggccaggctgccgccctggctgtctcccggggagacggtggtcccctcgcagagggcccgcacgcagattccctactctcccggcaccttccgccgcctgatgcccttccgcctcagcagcaagtccgtggactccttcctgcaggcagacggccccgaggagcggccccccgccgccctccccgagtccacacacatgtgacaccggctccgacacgccgctaaccggccgctcgtccccgcgccacggtccgcccaccgccgccgccgc

SEQ ID NO: 278839 - DNA, 1434 bp, Homo sapiens
  misc_feature (1209)..(1209): n is a, c, g, or t
  misc_feature (1264)..(1264): n is a, c, g, or t
accggcaccggagcgcgccgggtcctcgccgggtcccagccccgcgcgtcggcccagcccagccgggaccccccgcgacatgcgcgtcccagccctgcgctgagcaggcggcaatgtggggactcggggcccggggccccgaccgggggctgctgctggcgctggcgctgggcgggctggcgcgggccgggggcgtcgaggtggagcccggcggcgcgcacggcgagagcgggggcttccaggtggtcaccttcgagtgggcccacgtgcaggatccctacgtcatcgcgctctggatcctcgtggccagcttggccaagatcgggttccacctgtcccacaaggtcaccagcgtggttcccgagagcgccctgctcatcgtgctgggcctggtgctgggcggcatcgtctgggcggccgaccacatcgcgtccttcacactgacgcccaccgtccttcctgctgtcgctggtgacgcgcttcaccaagcatgtgcgtatcatcgagcccggcttcgtgttcatcatctcctacctgtcctacctgacgtccgagatgctgtcgctgtcggccatcctcgccatcaccttctgtggcatctgctgtcagaagtatgtgaaggccaacatctcggagcagtcggccaccaccgtgcgctacaccatgaagatgctggccagcagcgccgagaccatcatcttcatgttcctgggtatctcggccgtgaacccgttcatctggacctggaacacggccttcgtgctcctgacgctggtcttcatctccgtgtaccgggccatcggtgtggtcctgcagacctggcttctgaaccgctaccgcatggtgcagctggagcccattgaccaggtggtcctgtcctacgggggcctgcgcggggccgtggcctttgccctggtggtgcttctggatggagacaaggtcaaggagaagaacctgttcgtcagcaccaccatcatcgtagtgttcttcaccgtcatcttccagggcctgaccatcaagcctctggtgcagtggctgaaggtgaagaggagcgagcaccgggaacctcggctcaacgagaagctgcacggccgcgctttcgaccacatcctctcggccatcgaggacatatccggacagatcgggcacaattatctcagagacaaggctcaagcctgtaatcccagcactttgggagactgaggtggncagctcacttgaggtcaggagtttgagaccagcctagccaacatggtgaaacccngtctctactaaaaatacaaacattagccaggggtggtggcgtgggcctgtaatcccagctactcaggaggctaaggcacaagaatcgcttgaacccgggaggtggaggctgcggtgagccgagattgcgccattacattccagcctggtgacagagcgagacttcgtccc

SEQ ID NO: 278840 - DNA, 1115 bp, Homo sapiens
gtgcagatgctggggtccccgagtcttacagccagggctttggagagggaccagtaaggaaagggacccacttcagacaggaggccaggaaggcctcgtggggagtcagcctaagccccgaggggagaaggggctggccagatggcagatgtccccgtgccccagccgggtgcccaccgtgggaaggcgaggggcacgcaggaggcagccagggccagatgcccgccgtgggaaggcgaggggcgcgcaagagaccccaccctgagggagcctgtatggctcagcgctggtccccacgcaggagagaaaatgtcagcgctgtctgcctggacatgcagtctctggagcagcgacggcggagcatccgggacgcggaggacatggtcacgcaccacacgctacagcagtacctgtacaagccgcggcaggagtacaagcatctgtacagccgacacgagctcacgcccacggaggacgagaaacaggaccgggaaatcttccacaggaccatgcggaagcgcctggagtccttcaagtcgaccaagctggggctcaaccagaacaagaaggcagccaagctgtacaagcgggagcgtgcccagaagcggagaaacagcagcatccccaatgggaagctgcccatggagagccctgcgcagaatttcaccatcaaggagaaagacttggaactttcagacaccgaggagccccccaactatgatgaggagatgagtggggggatcgagttcctggctagtgtcaccaaggacacagcgtccgactcccctgcaggaattgacaaccctgtgttttctccggacgaggccctggaccgcagcctcctggccaggctgccgccctggctgtctcccggggagacggtggtcccctcgcagagggcccgcacgcagattccctactctcccggcaccttccgccgcctgatgcccttccgcctcagcagcaagtccgtggactccttcctgcaggcagacggccccgaggagcggccccccgccgccctccccgagtccacacacatgtgacaccggctccgacacgccgctaaccggccgctcgtccccgcgccacggtccgcccaccgccgccgccgc

SEQ ID NO: 278841 - DNA, 484 bp, Homo sapiens
gcggccgcgcggacgcacctgcggggtcacccgggcgtcagccccgcgccccccgcggcccgtggccctccccgcagggacggggccgaacgtggccgcccaggggaggcagtaaaatcagcctccagccaagtgtgtttgctcaggtcctaaactctgagtccgcagactgagatgacgccccggattttgtgggcagcgctgcaacttaccctctccgaaagcccgggagtaggggagcggctcctccggcccccagccctcggcgctcccagtcacctctccgaaatgactggaggtccagttgagcggtgactgtcggtgcttctgagtggcaaccttggtgacttcctctctaccgccgttatgtttctctctttgatagcctttaaaaaatattgaaaatgtgagactgataatgattgagaaacaaatattttatgcaattaaaactgaaattatgaataaaatgtttcttactgtt

SEQ ID NO: 278842 - DNA, 521 bp, Homo sapiens
gcggccgcgcggacgcacctgcggggtcacccgggcgtcagccccgcgccccccgcggcccgtggccctccccgcagggacggggccgaacgtggccgcccaggggaggcagtaaaatcagcctccagccaagtgtgtttgctcaggtaaaccctgcttgttagggatgtgaaacaaactatcaggggtgcggcctgcaagccgggcttgctctctcccttcctttcacatgttaacctctggctgtggcttcacctgacagtgattaagcacaggcctcctgggcgggaccacccacgggtgtgatgacgccaaacccaccggcgaggggcctcctggggacgcggtgtctgggagaagccaagcaagagtccgctgttatcttggcttgggatatttattttcaacacatttaaatcacagttctctagatctgcagcaaaataaccattgaagagcaaatacaacgttttaccaatgaaagagtaaaactttttaacacctcactaggaactgtctct

SEQ ID NO: 278843 - DNA, 314 bp, Homo sapiens
ctaaacttgaaaaatatgcaggaagcatgtctgccatttactctagagggagacattatctgtatctttgaagactgtaagtaagcctgtcctttgctccacggctctgagagtctaccttccaacattctttaaaagtttcggattatgaaataaaatgctgttcatccactgaagaacagacccttgcttcctgcactatcttcaaaagtttaggtcggaggagcttcctttttcagacaatacatctttgatgatcgaaaacaacaacaacctgatacagttccttgcagttctaaaagcccaatagtcca

SEQ ID NO: 278844 - DNA, 181 bp, Homo sapiens
ctaaacttgaaaaatatgcaggaagcatgtctgccatttactctagagggagacattatctgtatctttgaagactgtaagtaagcctgtcctttgctccacggctctgagagtctaccttccaacattctttaaaaggtaagttggctgggcatggtggctcacgcctataatcccagca

SEQ ID NO: 278845 - DNA, 807 bp, Homo sapiens
ctaaacttgaaaaatatgcaggaagcatgtctgccatttactctagagggagacattatctgtatctttgaagactgtaagtaagcctgtcctttgctccacggctctgagagtctaccttccaacattctttaaaagtttcggattatgaaataaaatgctgttcatccactgaagaacagacccttgcttcctgcactatcttcaaaagtttaggtcggaggaggtaaaattttaaaaactgatttgttctccttgggatacagtgagatgtggaattcgttaggaatgataattattaatagaaaagatcaaaagaaggaaagaaacgttaatagtgtttataagcattgtgaactttcaacaaagctgaaacgttacgatttcaagatgaaaaaacggctttggggaagggaaatccacctcgagaatgaagacaagtgcggagcgaatagaatttcaggggagatgaaaaggggattgggaaaaacgtgggatctggtaacaaaaaggggggtttgttcttgaagggcgttctgcggggcgggcgttaagaggggtgcgtgcgtgcgcctgggtgaagtttgtactcagggctgcgataatcgaggtgacaaagttgtggaagtagaattcggaggtccgggagcaggaaggggaaggaatgtggggatttccaggctgggctgacaagttccgggcgctgctctcagggggaagggaggtctcctcgagtgccagatagcccgtccgaaaccaccgacactctaactccagctacgcgacccagcacccggcccctcctca

SEQ ID NO: 278846 - DNA, 423 bp, Homo sapiens
gatttacataatcttctaacatcttcctgggttcccagctatacactgaaaaaaagcagttgctgagtctaccaacagccttgtcatgtgagacaaggtgaattacataactgcatcataatctacttactacttcttatgggttgaattgtgtcctgaagaaaaatatgctaaagtcctcgcacctggtacctgtgaatgtgaccttacatatatctatagcacttggccctctacctcacacaagtgaaaacttcactccagatttgaatcccagtggtttctggatcagatccccctctccaggaaaatcctgttaacggttcttctgggtcacccaaccaatttgaatggccactttccttctacagaagtaagaaatttctattaaatcttaaattaaaaattttatgcatcaaggat

SEQ ID NO: 278847 - DNA, 637 bp, Homo sapiens
gatttacataatcttctaacatcttcctgggttcccagctatacactgaaaaaaagcagttgctgagtctaccaacagccttgtcatgtgagacaaggtgaattacataactgcatcataatctacttactacttcttatgggttgaattgtgtcctgaagaaaaatatgctaaagtcctcgcacctggtacctgtgaatgtgaccttacatatatctatagcacttggccctctacctcacacaaggtaagcattcgaaaaatggttgaaaggaaggagcttagaaaggaataaatttcaggtgaaatggtgaccaactcaagttgtgatcgaagttttacagagcaacagctctcaaccactaagccatggcactggtacagaactaccaattatgaagtacagacaattgccataagcaacattaaggatcgaggtttaggaggaattttccttgttttttaaaataaacataaaatagaactaattcaaggtaatccctataataatgacacccttactcactcacattctgatgctttcttgaatgtcagtgggagaagtagcattagagtaacataccagaattgcatccaaccctggaatactcacaaaagagcattttgtgggaaaaac

SEQ ID NO: 278848 - DNA, 2162 bp, Homo sapiens
gaattccgggtctcaaatagggattggtttaaatgatctggagacagcaccaaagcaaataataaactaaaaaatgtccagtcattaaactgttaaaatgaaattcaggtttccaaagtactttagaaatcatgtaatccaggctggggaagatggcggtggctggggcggtgtccggggagccgctggtgcactggtgcacccagcagttgcggaagactttcggcctggatgtcagcgaggagatcattcagtacgttttgtcaattgagagtgctgaagagatacgagaatatgttactgatctcctccagggaaatgaaggcaaaaaaggtcaattcatagaagaacttataaccaaatggcaaaagaatgatcaggagttgatttcggatcctttgcagcagtgcttcaaaaaagatgaaattttagatgggcagaaatcaggcgaccatctaaagcggggtaggaagaaagggagaaacagacaggaagttcctgcatttactgaacctgacacgactgcagaggttaaaacaccttttgatttggccaaggcacaagagaacagcaactccgtaaagaagaagacaaagtttgtcaatttatacacaagagagggacaggacaggcttgcagtcctgctccctggtcgtcacccttgtgattgcctgggccagaagcacaagctcatcaataactgtctgatctgtgggcgcattgtctgtgaacaagaaggctcaggcccttgcttattctgtggcactctggtgtgtactcatgaggaacaagatattttacagcgtgactcaaacaagagccagaaactgctaaagaaactcatgtcaggagtggagaattctggaaaggtggacatctctaccaaggaccttcttcctcatcaagaattgcgaattaagtctggtctggagaaggctatcaagcataaagacaaactgttagagtttgacagaactagtattcgaaggacccaagtcattgatgatgagtcagattactttgccagtgattctaaccaatggttgtccaaacttgagcgggaaaccttgcagaagcgagaggaggagctgagagaacttcgacacgcctctcgactttctaagaaggtcaccattgactttgcaggaaggaagatcctggaagaagaaaattcactagcagagtatcatagcagactagatgagacaatacaggccattgccaatggaaccttgaaccagccactgaccaaattggatagatcttctgaagagcctttgggagttctggtaaatcccaacatgtaccagtcccctccccagtgggttgaccacacaggtgcagcctcacagaagaaggctttccgttcttcaggatttggactagagttcaactcatttcagcaccagttgcgaatccaggatcaagaatttcaggaaggctttgatggtggctggtgcctctctgtacatcagccctgggcttctctgcttgtcagagggattaaaagggtggagggcagatcctggtacaccccccacagaggacgactttggatagcagccacagctaaaaaaccctcccctcaagaagtctcagaactccaggctacatatcgtcttcttcgtgggaaagatgtggaatttcctaatgactatccgtcaggttgtcttctgggctgtgtggacctaattgactgcttgtcccagaagcaatttaaggagcagtttccagacatcagtcaagaatctgattctccatttgttttcatctgcaaaaatcctcaggaaatggttgtgaagtttcctattaaaggaaatccaaaaatctggaaattggattccaagatccatcaaggagcaaagaaggggttaatgaagcagaataaagctgtctgacccaggagaaaaggaactatacagcatagtggagttttgtgtactaaaattgctatctactggtcctttggaattgaagtagtagaaacctaaaggcttggcgtcaggcttgaatatctcagaacttaaactcttaccaaaatctgtatatttttcttaaggagtgggattcctactttatgtaatggggtcgaaatctttgaacacattatttataaaaacctgtttaaaaattctaatctaagtcttttgacatttttctta

SEQ ID NO: 278849 - DNA, 650 bp, Homo sapiens
tttaatgaagttgttcccactataggaaatcagagatggcaggcaatagactgtataatgctgtactaaggattgtagaaaggtgaaggtttgttcttgcttgttgagcataatcctctttacctgtgaaatggaaagtagtatcatcagaatgttgaggtgaaatctgggacatcttctgttctccttaaattcaaaagctgtcccaactatcctgaccttttattttatattcaacagtttccagacatcagtcaagaatctgattctccatttgttttcatctgcaaaaatcctcaggaaatggttgtgaagtttcctattaaaggaaatccaaaaatctggaaattggattccaagatccatcaaggagcaaagaaggggttaatgaagcagaataaagctgtctgacccaggagaaaaggaactatacagcatagtggagttttgtgtactaaaattgctatctactggtcctttggaattgaagtagtagaaacctaaaggcttggcgtcaggcttgaatatctcagaacttaaactcttaccaaaatctgtatatttttcttaaggagtgggattcctactttatgtaatggggtcgaaatctttgaacacattatttataaaaacctgtttaaaaattctaa

SEQ ID NO: 278850 - DNA, 454 bp, Homo sapiens
ttttggtctctctgttctgtccaaatgagacaagcatttccagttgtccagaactcagccagtaatctgattctccatttgttttcatctgcaaaaatcctcaggaaatggttgtgaagtttcctattaaaggaaatccaaaaatctggaaattggattccaagatccatcaaggagcaaagaaggggttaatgaagcagaataaagctgtctgacccaggagaaaaggaactatacagcatagtggagttttgtgtactaaaattgctatctactggtcctttggaattgaagtagtagaaacctaaaggcttggcgtcaggcttgaatatctcagaacttaaactcttaccaaaatctgtatatttttcttaaggagtgggattcctactttatgtaatggggtcgaaatctttgaacacattatttataaaaacctgtttaaaaattctaa

SEQ ID NO: 278851 - DNA, 462 bp, Homo sapiens
acagaatgaaactctgaagtttggaagtgtctgagtcctgaagtaagataattgaatgtgacaggaacacagtaaccagaagacctgggaggctgcaaaagatttgcattgcaaatacaaaaataaataatgagacttatttttctcccttacagggaaattggattccaagatccatcaaggagcaaagaaggggttaatgaagcagaataaagctgtctgacccaggagaaaaggaactatacagcatagtggagttttgtgtactaaaattgctatctactggtcctttggaattgaagtagtagaaacctaaaggcttggcgtcaggcttgaatatctcagaacttaaactcttaccaaaatctgtatatttttcttaaggagtgggattcctactttatgtaatggggtcgaaatctttgaacacattatttataaaaacctgtttaaaaattctaa

SEQ ID NO: 278852 - DNA, 360 bp, Homo sapiens
gtgtgtttgttgatgatttaatattattttagatttccgggagttacgtcaggggaaattggattccaagatccatcaaggagcaaagaaggggttaatgaagcagaataaagctgtctgacccaggagaaaaggaactatacagcatagtggagttttgtgtactaaaattgctatctactggtcctttggaattgaagtagtagaaacctaaaggcttggcgtcaggcttgaatatctcagaacttaaactcttaccaaaatctgtatatttttcttaaggagtgggattcctactttatgtaatggggtcgaaatctttgaacacattatttataaaaacctgtttaaaaattctaa

SEQ ID NO: 278853 - DNA, 917 bp, Homo sapiens
ggatcaggtgaaaagcagtcaagagttgagagagatgacttgtcgctattctgatggaggagaaattagtggacagagttcatcctcaagtgaaaagtattgtgagagaaaagtgtttttgacaaaagatactgctcttgagaaggcatcatctatagacctcttggttcaactggataatttgctataggatttgttatatattatgggatattccaggaaactagaatttatatccttcccactaaatttctatttgtttaagggtggagggcagatcctggtacaccccccacagaggacgactttggatagcagccacagctaaaaaaccctcccctcaagaagtctcagaactccaggctacatatcgtcttcttcgtgggaaagaggtaacagccgcatattctcctttcaattttactttatggagagaagtcattgacgttcatcttctttcacttccttctttctttggctttttctttgttaaaagagacttttaatctttgtatatgtttgtttgtttagtggtaaatcattgacagcgttcaaagcattaatctgtcaaaacagtgcaaataaaaatatcaatttccaacacaagaaatcaactagtcttaatttttttatctgagaaaatcatcttctttactctaaaggtaaaatgactagtgtaaactctgagatccttacattgggaagaacaaccacaaataggaattttcattgagagtggcctaaatagacacctactattggatttgtacaaatcaaagttgattgatttaagcaacgtattttgggaatcaccccaagaatactaactttggatccttaaaaagacttctgacctttgggcatcctgtttttcctttgtgttatccagctcatacagttgttttgagggtagaata

SEQ ID NO: 278854 - DNA, 2678 bp, Homo sapiens
cctgtagtcccagctacttgggaggctgaggcaggagaatggcatgaacccgggaggcggagcttgcagtgagccgagatcacgccactgcactcaagcctgggcgacagtgcgagactccgtctcaaaataaataaattaaattaattaattaattaaaaaattaaaacccccaccagagcaaaaacttacagcgcttacaataccttccacgtgctgttttattttacataaaaccatgacgattaaaaagctggcctctcagccttccgggtattggtttgttttccccctaaactgtcgtttttataggcacttgcactgtcttcttagcagaattgccaatggccttcctcgagtcctacgtttagcgattggcaagaatcatgcactgacagagctcgactccggagggcacaaggaagtagacaacaaagcaggaagaagcaggaggcgcacagatgagcgggatctgcactggaggcggtgcgaccttgcggggcggtgcaagctggcggaacccgcgtgagagaggttggtgttgcgaagggaactagtccggtgcaggacgtggggcttttgcagctcagctggttccggctggggaagatggcggtggctggggcggtgtccggggagccgctggtgcactggtgcacccagcagttgcggaagactttcggcctggatgtcagcgaggagatcattcagtgagaacagttcgggtccaagcggggaaggagctctgggatgtgcactgcctgagcgaaccgggaagcggggaggactgaaaagtacgttttgtcaattgagagtgctgaagagatacgagaatatgttactgatctcctccagggaaatgaaggcaaaaaaggtcaattcatagaagaacttataaccaaatggcaaaagaatgatcaggagttgatttcggatcctttgcagcagtgcttcaaaaaagatgaaattttagatgggcagaaatcaggcgaccatctaaagcggggtaggaagaaagggagaaacagacaggaagttcctgcatttactgaacctgacacgactgcagaggttaaaacaccttttgatttggccaaggcacaagagaacagcaactccgtaaagaagaagacaaagtttgtcaatttatacacaagagagggacaggacaggcttgcagtcctgctccctggtcgtcacccttgtgattgcctgggccagaagcacaagctcatcaataactgtctgatctgtgggcgcattgtctgtgaacaagaaggctcaggcccttgcttattctgtggcactctggtgtgtactcatgaggaacaagatattttacagcgtgactcaaacaagagccagaaactgctaaagaaactcatgtcaggagtggagaattctggaaaggtggacatctctaccaaggaccttcttcctcatcaagaattgcgaattaagtctggtctggagaaggctatcaagcataaagacaaactgttagagtttgacagaactagtattcgaaggacccaagtcattgatgatgagtcagattactttgccagtgattctaaccaatggttgtccaaacttgagcgggaaaccttgcagaagcgagaggaggagctgagagaacttcgacacgcctctcgactttctaagaaggtcaccattgactttgcaggaaggaagatcctggaagaagaaaattcactagcagagtatcatagcagactagatgagacaatacaggccattgccaatggaaccttgaaccagccactgaccaaattggatagatcttctgaagagcctttgggagttctggtaaatcccaacatgtaccagtcccctccccagtgggttgaccacacaggtgcagcctcacagaagaaggctttccgttcttcaggatttggactagagttcaactcatttcagcaccagttgcgaatccaggatcaagaatttcaggaaggctttgatggtggctggtgcctctctgtacatcagccctgggcttctctgcttgtcagagggattaaaagggtggagggcagatcctggtacaccccccacagaggacgactttggatagcagccacagctaaaaaaccctcccctcaagaagtctcagaactccaggctacatatcgtcttcttcgtgggaaagatgtggaatttcctaatgactatccgtcaggttgtcttctgggctgtgtggacctaattgactgcttgtcccagaagcaatttaaggagcagtttccagacatcagtcaagaatctgattctccatttgttttcatctgcaaaaatcctcaggaaatggttgtgaagtttcctattaaaggaaatccaaaaatctggaaattggattccaagatccatcaaggagcaaagaaggggttaatgaagcagaataaagctgtctgacccaggagaaaaggaactatacagcatagtggagttttgtgtactaaaattgctatctactggtcctttggaattgaagtagtagaaacctaaaggcttggcgtcaggcttgaatatctcagaacttaaactcttaccaaaatctgtatatttttcttaaggagtgggattcctactttatgtaatggggtcgaaatctttgaacacattatttataaaaacctgtttaaaaattctaa

SEQ ID NO: 278855 - DNA, 3127 bp, Homo sapiens
  misc_feature (3104)..(3104): n is a, c, g, or t
cctgtagtcccagctacttgggaggctgaggcaggagaatggcatgaacccgggaggcggagcttgcagtgagccgagatcacgccactgcactcaagcctgggcgacagtgcgagactccgtctcaaaataaataaattaaattaattaattaattaaaaaattaaaacccccaccagagcaaaaacttacagcgcttacaataccttccacgtgctgttttattttacataaaaccatgacgattaaaaagctggcctctcagccttccgggtattggtttgttttccccctaaactgtcgtttttataggcacttgcactgtcttcttagcagaattgccaatggccttcctcgagtcctacgtttagcgattggcaagaatcatgcactgacagagctcgactccggagggcacaaggaagtagacaacaaagcaggaagaagcaggaggcgcacagatgagcgggatctgcactggaggcggtgcgaccttgcggggcggtgcaagctggcggaacccgcgtgagagaggttggtgttgcgaagggaactagtccggtgcaggacgtggggcttttgcagctcagctggttccggctggggaagatggcggtggctggggcggtgtccggggagccgctggtgcactggtgcacccagcagttgcggaagactttcggcctggatgtcagcgaggagatcattcagtacgttttgtcaattgagagtgctgaagagatacgagaatatgttactgatctcctccagggaaatgaaggcaaaaaaggtcaattcatagaagaacttataaccaaatggcaaaagaatgatcaggagttgatttcggatcctttgcagcagtgcttcaaaaaagatgaaattttagatgggcagaaatcaggcgaccatctaaagcggggtaggaagaaagggagaaacagacaggaagttcctgcatttactgaacctgacacgactgcagaggttaaaacaccttttgatttggccaaggcacaagagaacagcaactccgtaaagaagaagacaaagtttgtcaatttatacacaagagagggacaggacaggcttgcagtcctgctccctggtcgtcacccttgtgattgcctgggccagaagcacaagctcatcaataactgtctgatctgtgggcgcattgtctgtgaacaagaaggctcaggcccttgcttattctgtggcactctggtgtgtactcatgaggaacaagatattttacagcgtgactcaaacaagagccagaaactgctaaagaaactcatgtcaggagtggagaattctggaaaggtggacatctctaccaaggaccttcttcctcatcaagaattgcgaattaagtctggtctggagaaggctatcaagcataaagacaaactgttagagtttgacagaactagtattcgaaggacccaagtcattgatgatgagtcagattactttgccagtgattctaaccaatggttgtccaaacttgagcgggaaaccttgcagaagcgagaggaggagctgagagaacttcgacacgcctctcgactttctaagaaggtcaccattgactttgcaggaaggaagatcctggaagaagaaaattcactagcagagtatcatagcagactagatgagacaatacaggccattgccaatggaaccttgaaccagccactgaccaaattggatagatcttctgaagagcctttgggagttctggtaaatcccaacatgtaccagtcccctccccagtgggttgaccacacaggtgcagcctcacagaagaaggctttccgttcttcaggatttggactagagttcaactcatttcagcaccagttgcgaatccaggatcaagaatttcaggaaggctttgatggtggctggtgcctctctgtacatcagccctgggcttctctgcttgtcagagggattaaaagggtggagggcagatcctggtacaccccccacagaggacgactttggatagcagccacagctaaaaaaccctcccctcaagaagtctcagaactccaggctacatatcgtcttcttcgtgggaaagatgtggaatttcctaatgactatccgtcaggttgtcttctgggctgtgtggacctaattgactgcttgtcccagaagcaatttaaggagcagtttccagacatcagtcaagaatctgattctccatttgttttcatctgcaaaaatcctcaggaaatggttgtgaagtttcctattaaaggaaatccaaaaatctggaaattggattccaagatccatcaaggagcaaagaaggggttaatgaagcagaataaagctgtctgacccaggagaaaaggaactatacagcatagtggagttttgtgtactaaaattgctatctactggtcctttggaattgaagtagtagaaacctaaaggcttggcgtcaggcttgaatatctcagaacttaaactcttaccaaaatctgtatatttttcttaaggagtgggattcctactttatgtaatggggtcgaaatctttgaacacattatttataaaaacctgtttaaaaattctaaactaagagaacacttgaactgtctatggtttagacctgcaccccataaagtgggaattagatctgctctatcgaactggaagaaggaattatgaaagaattttcggctttgagagggttacagggggagccttgtgtgagctcttctttgtggggggggaatattaccacccctcgaaaaagtaaattcctgggggttttagagttgggacgtagttttacttttcctaggggggataagtgtttttatagcgatacgtgggaccccgagaaaaaactagtttataataagcgcttctaaataggaaaaacctgaagaaggggccgtgtagagtgtttctcatcctctccctccccaaaagaagatatataatatctcttctcctgtatgacgttgaacaccctatgtgctatattagcaccggggtgctgctataaatgactcttcgagttattgattagactaaacgcataaatataaataactctcctttctgcttctgaatagtanagtttattatttcacaccgtatg

SEQ ID NO: 278856 - DNA, 2464 bp, Homo sapiens
cctgtagtcccagctacttgggaggctgaggcaggagaatggcatgaacccgggaggcggagcttgcagtgagccgagatcacgccactgcactcaagcctgggcgacagtgcgagactccgtctcaaaataaataaattaaattaattaattaattaaaaaattaaaacccccaccagagcaaaaacttacagcgcttacaataccttccacgtgctgttttattttacataaaaccatgacgattaaaaagctggcctctcagccttccgggtattggtttgttttccccctaaactgtcgtttttataggcacttgcactgtcttcttagcagaattgccaatggccttcctcgagtcctacgtttagcgattggcaagaatcatgcactgacagagctcgactccggagggcacaaggaagtagacaacaaagcaggaagaagcaggaggcgcacagatgagcgggatctgcactggaggcggtgcgaccttgcggggcggtgcaagctggcggaacccgcgtgagagaggttggtgttgcgaagggaactagtccggtgcaggacgtggggcttttgcagctcagctggttccggctggggaagatggcggtggctggggcggtgtccggggagccgctggtgcactggtgcacccagcagttgcggaagactttcggcctggatgtcagcgaggagatcattcagtacgttttgtcaattgagagtgctgaagagatacgagaatatgttactgatctcctccagggaaatgaaggcaaaaaaggtcaattcatagaagaacttataaccaaatggcaaaagaatgatcaggagttgatttcggatcctttgcagcagtgcttcaaaaaagatgaaattttagatgggcagaaatcaggcgaccatctaaagcggggtaggaagaaagggagaaacagacaggaagttcctgcatttactgaacctgacacgactgcagaggttaaaacaccttttgatttggccaaggcacaagagaacagcaactccgtaaagaagaagacaaagtttgtcaatttatacacaagagagggacaggacaggcttgcagtcctgctccctggtcgtcacccttgtgattgcctgggccagaagcacaagctcatcaataactgtctgatctgtgggcgcattgtctgtgaacaagaaggctcaggcccttgcttattctgtggcactctggtgtgtactcatgaggaacaagatattttacagcgtgactcaaacaagagccagaaactgctaaagaaactcatgtcagtattcgaaggacccaagtcattgatgatgagtcagattactttgccagtgattctaaccaatggttgtccaaacttgagcgggaaaccttgcagaagcgagaggaggagctgagagaacttcgacacgcctctcgactttctaagaaggtcaccattgactttgcaggaaggaagatcctggaagaagaaaattcactagcagagtatcatagcagactagatgagacaatacaggccattgccaatggaaccttgaaccagccactgaccaaattggatagatcttctgaagagcctttgggagttctggtaaatcccaacatgtaccagtcccctccccagtgggttgaccacacaggtgcagcctcacagaagaaggctttccgttcttcaggatttggactagagttcaactcatttcagcaccagttgcgaatccaggatcaagaatttcaggaaggctttgatggtggctggtgcctctctgtacatcagccctgggcttctctgcttgtcagagggattaaaagggtggagggcagatcctggtacaccccccacagaggacgactttggatagcagccacagctaaaaaaccctcccctcaagaagtctcagaactccaggctacatatcgtcttcttcgtgggaaagatgtggaatttcctaatgactatccgtcaggttgtcttctgggctgtgtggacctaattgactgcttgtcccagaagcaatttaaggagcagtttccagacatcagtcaagaatctgattctccatttgttttcatctgcaaaaatcctcaggaaatggttgtgaagtttcctattaaaggaaatccaaaaatctggaaattggattccaagatccatcaaggagcaaagaaggggttaatgaagcagaataaagctgtctgacccaggagaaaaggaactatacagcatagtggagttttgtgtactaaaattgctatctactggtcctttggaattgaagtagtagaaacctaaaggcttggcgtcaggcttgaatatctcagaacttaaactcttaccaaaatctgtatatttttcttaaggagtgggattcctactttatgtaatggggtcgaaatctttgaacacattatttataaaaacctgtttaaaaattctaa

SEQ ID NO: 278857 - DNA, 2227 bp, Homo sapiens
cctgtagtcccagctacttgggaggctgaggcaggagaatggcatgaacccgggaggcggagcttgcagtgagccgagatcacgccactgcactcaagcctgggcgacagtgcgagactccgtctcaaaataaataaattaaattaattaattaattaaaaaattaaaacccccaccagagcaaaaacttacagcgcttacaataccttccacgtgctgttttattttacataaaaccatgacgattaaaaagctggcctctcagccttccgggtattggtttgttttccccctaaactgtcgtttttataggcacttgcactgtcttcttagcagaattgccaatggccttcctcgagtcctacgtttagcgattggcaagaatcatgcactgacagagctcgactccggagggcacaaggaagtagacaacaaagcaggaagaagcaggaggcgcacagatgagcgggatctgcactggaggcggtgcgaccttgcggggcggtgcaagctggcggaacccgcgtgagagagggaaatgaaggcaaaaaaggtcaattcatagaagaacttataaccaaatggcaaaagaatgatcaggagttgatttcggatcctttgcagcagtgcttcaaaaaagatgaaattttagatgggcagaaatcaggcgaccatctaaagcggggtaggaagaaagggagaaacagacaggaagttcctgcatttactgaacctgacacgactgcagaggttaaaacaccttttgatttggccaaggcacaagagaacagcaactccgtaaagaagaagacaaagtttgtcaatttatacacaagagagggacaggacaggcttgcagtcctgctccctggtcgtcacccttgtgattgcctgggccagaagcacaagctcatcaataactgtctgatctgtgggcgcattgtctgtgaacaagaaggctcaggcccttgcttattctgtggcactctggtgtgtactcatgaggaacaagatattttacagcgtgactcaaacaagagccagaaactgctaaagaaactcatgtcagtattcgaaggacccaagtcattgatgatgagtcagattactttgccagtgattctaaccaatggttgtccaaacttgagcgggaaaccttgcagaagcgagaggaggagctgagagaacttcgacacgcctctcgactttctaagaaggtcaccattgactttgcaggaaggaagatcctggaagaagaaaattcactagcagagtatcatagcagactagatgagacaatacaggccattgccaatggaaccttgaaccagccactgaccaaattggatagatcttctgaagagcctttgggagttctggtaaatcccaacatgtaccagtcccctccccagtgggttgaccacacaggtgcagcctcacagaagaaggctttccgttcttcaggatttggactagagttcaactcatttcagcaccagttgcgaatccaggatcaagaatttcaggaaggctttgatggtggctggtgcctctctgtacatcagccctgggcttctctgcttgtcagagggattaaaagggtggagggcagatcctggtacaccccccacagaggacgactttggatagcagccacagctaaaaaaccctcccctcaagaagtctcagaactccaggctacatatcgtcttcttcgtgggaaagatgtggaatttcctaatgactatccgtcaggttgtcttctgggctgtgtggacctaattgactgcttgtcccagaagcaatttaaggagcagtttccagacatcagtcaagaatctgattctccatttgttttcatctgcaaaaatcctcaggaaatggttgtgaagtttcctattaaaggaaatccaaaaatctggaaattggattccaagatccatcaaggagcaaagaaggggttaatgaagcagaataaagctgtctgacccaggagaaaaggaactatacagcatagtggagttttgtgtactaaaattgctatctactggtcctttggaattgaagtagtagaaacctaaaggcttggcgtcaggcttgaatatctcagaacttaaactcttaccaaaatctgtatatttttcttaaggagtgggattcctactttatgtaatggggtcgaaatctttgaacacattatttataaaaacctgtttaaaaattctaa

SEQ ID NO: 278858 - DNA, 2619 bp, Homo sapiens
cctgtagtcccagctacttgggaggctgaggcaggagaatggcatgaacccgggaggcggagcttgcagtgagccgagatcacgccactgcactcaagcctgggcgacagtgcgagactccgtctcaaaataaataaattaaattaattaattaattaaaaaattaaaacccccaccagagcaaaaacttacagcgcttacaataccttccacgtgctgttttattttacataaaaccatgacgattaaaaagctggcctctcagccttccgggtattggtttgttttccccctaaactgtcgtttttataggcacttgcactgtcttcttagcagaattgccaatggccttcctcgagtcctacgtttagcgattggcaagaatcatgcactgacagagctcgactccggagggcacaaggaagtagacaacaaagcaggaagaagcaggaggcgcacagatgagcgggatctgcactggaggcggtgcgaccttgcggggcggtgcaagctggcggaacccgcgtgagagaggttggtgttgcgaagggaactagtccggtgcaggacgtggggcttttgcagctcagctggttccggctggggaagatggcggtggctggggcggtgtccggggagccgctggtgcactggtgcacccagcagttgcggaagactttcggcctggatgtcagcgaggagatcattcagtacgttttgtcaattgagagtgctgaagagatacgagaatatgttactgatctcctccagggaaatgaaggcaaaaaaggtcaattcatagaagaacttataaccaaatggcaaaagaatgatcaggagttgatttcggatcctttgcagcagtgcttcaaaaaagatgaaattttagatgggcagaaatcaggcgaccatctaaagcggggtaggaagaaagggagaaacagacaggaagttcctgcatttactgaacctgacacgactgcagaggttaaaacaccttttgatttggccaaggcacaagagaacagcaactccgtaaagaagaagacaaagtttgtcaatttatacacaagagagggacaggacaggcttgcagtcctgctccctggtcgtcacccttgtgattgcctgggccagaagcacaagctcatcaataactgtctgatctgtgggcgcattgtctgtgaacaagaaggctcaggcccttgcttattctgtggcactctggtgtgtactcatgaggaacaagatattttacagcgtgactcaaacaagagccagaaactgctaaagaaactcatgtcaggagtggagaattctggaaaggtggacatctctaccaaggaccttcttcctcatcaagaattgcgaattaagtctggtctggagaaggctatcaagcataaagacaaactgttagagtttgacagaactagtattcgaaggacccaagtcattgatgatgagtcagattactttgccagtgattctaaccaatggttgtccaaacttgagcgggaaaccttgcagaagcgagaggaggagctgagagaacttcgacacgcctctcgactttctaagaaggtcaccattgactttgcaggaaggaagatcctggaagaagaaaattcactagcagagtatcatagcagactagatgagacaatacaggccattgccaatggaaccttgaaccagccactgaccaaattggatagatcttctgaagagcctttgggagttctggtaaatcccaacatgtaccagtcccctccccagtgggttgaccacacaggtgcagcctcacagaagaaggctttccgttcttcaggatttggactagagttcaactcatttcagcaccagttgcgaatccaggatcaagaatttcaggaaggctttgatggtggctggtgcctctctgtacatcagccctgggcttctctgcttgtcagagggattaaaagggtggagggcagatcctggtacaccccccacagaggacgactttggatagcagccacagctaaaaaaccctcccctcaagaagtctcagaactccaggctacatatcgtcttcttcgtgggaaagaggtaacagccgcatattctcctttcaattttactttatggagagaagtcattgacgttcatcttctttcacttccttctttctttggctttttctttgttaaaagagacttttaatctttgtatatgtttgtttgtttagtggtaaatcattgacagcgttcaaagcattaatctgtcaaaacagtgcaaataaaaatatcaatttccaacacaagaaatcaactagtcttaatttttttatctgagaaaatcatcttctttactctaaaggtaaaatgactagtgtaaactctgagatccttacattgggaagaacaaccacaaataggaattttcattgagagtggcctaaatagacacctactattggatttgtacaaatcaaagttgattgatttaagcaacgtattttgggaatcaccccaagaatactaactttggatccttaaaaagacttctgacctttgggcatcctgtttttcctttgtgttatccagctcatacagttgttttgagggtagaata

SEQ ID NO: 278859 - DNA, 892 bp, Homo sapiens
ggatcaggtgaaaagcagtcaagagttgagagagatgacttgtcgctattctgatggaggagaaattagtggacagagttcatcctcaagtgaaaagtattgtgagagaaaagtgtttttgacaaaagatactgctcttgagaaggcatcatctatagacctcttggttcaactggataatttgctataggatttgttatatattatgggatattccaggaaactagaatttatatccttcccactaaatttctatttgtttaagggtggagggcagatcctggtacaccccccacagaggacgactttggatagcagccacagctaaaaaaccctcccctcaagaagtctcagaactccaggctacatatcgtcttcttcgtgggaaagatgtggaatttcctaatgactatccgtcaggttgtcttctgggctgtgtggacctaattgactgcttgtcccagaagcaatttaaggagcagtttccagacatcagtcaagaatctgattctccatttgttttcatctgcaaaaatcctcaggaaatggttgtgaagtttcctattaaaggaaatccaaaaatctggaaattggattccaagatccatcaaggagcaaagaaggggttaatgaagcagaataaagctgtctgacccaggagaaaaggaactatacagcatagtggagttttgtgtactaaaattgctatctactggtcctttggaattgaagtagtagaaacctaaaggcttggcgtcaggcttgaatatctcagaacttaaactcttaccaaaatctgtatatttttcttaaggagtgggattcctactttatgtaatggggtcgaaatctttgaacacattatttataaaaacctgtttaaaaattctaa

SEQ ID NO: 278860 - DNA, 492 bp, Homo sapiens
caaggagatctctgaatctcctgactcttggttgtttgtgataaaagagcattccgttctgattcttctgggaggatttcagtttccagacatcagtcaagaatctgattctccatttgttttcatctgcaaaaatcctcaggaaatggttgtgaagtttcctattaaaggaaatccaaaaatctggaaattggattccaagatccatcaaggagcaaagaaggggttaatgaagcagaataaagctgtctgacccaggagaaaaggaactatacagcatagtggagttttgtgtactaaaattgctatctactggtcctttggaattgaagtagtagaaacctaaaggcttggcgtcaggcttgaatatctcagaacttaaactcttaccaaaatctgtatatttttcttaaggagtgggattcctactttatgtaatggggtcgaaatctttgaacacattatttataaaaacctgtttaaaaattctaa

SEQ ID NO: 278861 - DNA, 855 bp, Homo sapiens
ggatcaggtgaaaagcagtcaagagttgagagagatgacttgtcgctattctgatggaggagaaattagtggacagagttcatcctcaagtgaaaagtattgtgagagaaaagtgtttttgacaaaagatactgctcttgagaaggcatcatctatagacctcttggttcaactggataatttgctataggatttgttatatattatgggatattccaggaaactagaatttatatccttcccactaaatttctatttgtttaagggtggagggcagatcctggtacaccccccacagaggacgactttggatagcagccacagctaaaggtaacagccgcatattctcctttcaattttactttatggagagaagtcattgacgttcatcttctttcacttccttctttctttggctttttctttgttaaaagagacttttaatctttgtatatgtttgtttgtttagtggtaaatcattgacagcgttcaaagcattaatctgtcaaaacagtgcaaataaaaatatcaatttccaacacaagaaatcaactagtcttaatttttttatctgagaaaatcatcttctttactctaaaggtaaaatgactagtgtaaactctgagatccttacattgggaagaacaaccacaaataggaattttcattgagagtggcctaaatagacacctactattggatttgtacaaatcaaagttgattgatttaagcaacgtattttgggaatcaccccaagaatactaactttggatccttaaaaagacttctgacctttgggcatcctgtttttcctttgtgttatccagctcatacagttgttttgagggtagaata

SEQ ID NO: 278862 - DNA, 601 bp, Homo sapiens
ggtgttgcgaagggaactagtccggtgcaggacgtggggcttttgcagctcagctggttccggctggggaagatggcggtggctggggcggtgtccggggagccgctggtgcactggtgcacccagcagttgcggaagactttcggcctggatgtcagcgaggagatcattcagtgagaacagttcgggtccaagcggggaaggagctctgggatgtgcactgcctgagcgaaccgggaagcggggaggactgaaaagttaagagagaaatgtgataaaggggctgcagtctgtagtctgtaggcgtcgaattttggcctccacctttgtagtttagtttctggaatagggtgtccggctccacagtctgccggtcgggcttttttcctgggaagacgcccaatctgtaataattagaaatgcaaggctgtcccaggagccagtttcctttctagagagaaggggcaggtcaaactgtatttcctaactttgaaccccttactcttttatttatttattattattgttgttattattgagacggagtctctgtcgcccaggctggcgtgcggtggcgcgatcttggctcactgcaacctcc

SEQ ID NO: 278863 - DNA, 2594 bp, Homo sapiens
cctgtagtcccagctacttgggaggctgaggcaggagaatggcatgaacccgggaggcggagcttgcagtgagccgagatcacgccactgcactcaagcctgggcgacagtgcgagactccgtctcaaaataaataaattaaattaattaattaattaaaaaattaaaacccccaccagagcaaaaacttacagcgcttacaataccttccacgtgctgttttattttacataaaaccatgacgattaaaaagctggcctctcagccttccgggtattggtttgttttccccctaaactgtcgtttttataggcacttgcactgtcttcttagcagaattgccaatggccttcctcgagtcctacgtttagcgattggcaagaatcatgcactgacagagctcgactccggagggcacaaggaagtagacaacaaagcaggaagaagcaggaggcgcacagatgagcgggatctgcactggaggcggtgcgaccttgcggggcggtgcaagctggcggaacccgcgtgagagaggttggtgttgcgaagggaactagtccggtgcaggacgtggggcttttgcagctcagctggttccggctggggaagatggcggtggctggggcggtgtccggggagccgctggtgcactggtgcacccagcagttgcggaagactttcggcctggatgtcagcgaggagatcattcagtacgttttgtcaattgagagtgctgaagagatacgagaatatgttactgatctcctccagggaaatgaaggcaaaaaaggtcaattcatagaagaacttataaccaaatggcaaaagaatgatcaggagttgatttcggatcctttgcagcagtgcttcaaaaaagatgaaattttagatgggcagaaatcaggcgaccatctaaagcggggtaggaagaaagggagaaacagacaggaagttcctgcatttactgaacctgacacgactgcagaggttaaaacaccttttgatttggccaaggcacaagagaacagcaactccgtaaagaagaagacaaagtttgtcaatttatacacaagagagggacaggacaggcttgcagtcctgctccctggtcgtcacccttgtgattgcctgggccagaagcacaagctcatcaataactgtctgatctgtgggcgcattgtctgtgaacaagaaggctcaggcccttgcttattctgtggcactctggtgtgtactcatgaggaacaagatattttacagcgtgactcaaacaagagccagaaactgctaaagaaactcatgtcaggagtggagaattctggaaaggtggacatctctaccaaggaccttcttcctcatcaagaattgcgaattaagtctggtctggagaaggctatcaagcataaagacaaactgttagagtttgacagaactagtattcgaaggacccaagtcattgatgatgagtcagattactttgccagtgattctaaccaatggttgtccaaacttgagcgggaaaccttgcagaagcgagaggaggagctgagagaacttcgacacgcctctcgactttctaagaaggtcaccattgactttgcaggaaggaagatcctggaagaagaaaattcactagcagagtatcatagcagactagatgagacaatacaggccattgccaatggaaccttgaaccagccactgaccaaattggatagatcttctgaagagcctttgggagttctggtaaatcccaacatgtaccagtcccctccccagtgggttgaccacacaggtgcagcctcacagaagaaggctttccgttcttcaggatttggactagagttcaactcatttcagcaccagttgcgaatccaggatcaagaatttcaggaaggctttgatggtggctggtgcctctctgtacatcagccctgggcttctctgcttgtcagagggattaaaagggtggagggcagatcctggtacaccccccacagaggacgactttggatagcagccacagctaaaaaaccctcccctcaagaagtctcagaactccaggctacatatcgtcttcttcgtgggaaagatgtggaatttcctaatgactatccgtcaggttgtcttctgggctgtgtggacctaattgactgcttgtcccagaagcaatttaaggagcagtttccagacatcagtcaagaatctgattctccatttgttttcatctgcaaaaatcctcaggaaatggttgtgaagtttcctattaaaggaaatccaaaaatctggaaattggattccaagatccatcaaggagcaaagaaggggttaatgaagcagaataaagctgtctgacccaggagaaaaggaactatacagcatagtggagttttgtgtactaaaattgctatctactggtcctttggaattgaagtagtagaaacctaaaggcttggcgtcaggcttgaatatctcagaacttaaactcttaccaaaatctgtatatttttcttaaggagtgggattcctactttatgtaatggggtcgaaatctttgaacacattatttataaaaacctgtttaaaaattctaa

SEQ ID NO: 278864 - DNA, 2076 bp, Homo sapiens
gaattccgggtctcaaatagggattggtttaaatgatctggagacagcaccaaagcaaataataaactaaaaaatgtccagtcattaaactgttaaaatgaaattcaggtttccaaagtactttagaaatcatgtaatccaggctggggaagatggcggtggctggggcggtgtccggggagccgctggtgcactggtgcacccagcagttgcggaagactttcggcctggatgtcagcgaggagatcattcaggaaatgaaggcaaaaaaggtcaattcatagaagaacttataaccaaatggcaaaagaatgatcaggagttgatttcggatcctttgcagcagtgcttcaaaaaagatgaaattttagatgggcagaaatcaggcgaccatctaaagcggggtaggaagaaagggagaaacagacaggaagttcctgcatttactgaacctgacacgactgcagaggttaaaacaccttttgatttggccaaggcacaagagaacagcaactccgtaaagaagaagacaaagtttgtcaatttatacacaagagagggacaggacaggcttgcagtcctgctccctggtcgtcacccttgtgattgcctgggccagaagcacaagctcatcaataactgtctgatctgtgggcgcattgtctgtgaacaagaaggctcaggcccttgcttattctgtggcactctggtgtgtactcatgaggaacaagatattttacagcgtgactcaaacaagagccagaaactgctaaagaaactcatgtcaggagtggagaattctggaaaggtggacatctctaccaaggaccttcttcctcatcaagaattgcgaattaagtctggtctggagaaggctatcaagcataaagacaaactgttagagtttgacagaactagtattcgaaggacccaagtcattgatgatgagtcagattactttgccagtgattctaaccaatggttgtccaaacttgagcgggaaaccttgcagaagcgagaggaggagctgagagaacttcgacacgcctctcgactttctaagaaggtcaccattgactttgcaggaaggaagatcctggaagaagaaaattcactagcagagtatcatagcagactagatgagacaatacaggccattgccaatggaaccttgaaccagccactgaccaaattggatagatcttctgaagagcctttgggagttctggtaaatcccaacatgtaccagtcccctccccagtgggttgaccacacaggtgcagcctcacagaagaaggctttccgttcttcaggatttggactagagttcaactcatttcagcaccagttgcgaatccaggatcaagaatttcaggaaggctttgatggtggctggtgcctctctgtacatcagccctgggcttctctgcttgtcagagggattaaaagggtggagggcagatcctggtacaccccccacagaggacgactttggatagcagccacagctaaaaaaccctcccctcaagaagtctcagaactccaggctacatatcgtcttcttcgtgggaaagatgtggaatttcctaatgactatccgtcaggttgtcttctgggctgtgtggacctaattgactgcttgtcccagaagcaatttaaggagcagtttccagacatcagtcaagaatctgattctccatttgttttcatctgcaaaaatcctcaggaaatggttgtgaagtttcctattaaaggaaatccaaaaatctggaaattggattccaagatccatcaaggagcaaagaaggggttaatgaagcagaataaagctgtctgacccaggagaaaaggaactatacagcatagtggagttttgtgtactaaaattgctatctactggtcctttggaattgaagtagtagaaacctaaaggcttggcgtcaggcttgaatatctcagaacttaaactcttaccaaaatctgtatatttttcttaaggagtgggattcctactttatgtaatggggtcgaaatctttgaacacattatttataaaaacctgtttaaaaattctaa

SEQ ID NO: 278865 - DNA, 2624 bp, Homo sapiens
cctgtagtcccagctacttgggaggctgaggcaggagaatggcatgaacccgggaggcggagcttgcagtgagccgagatcacgccactgcactcaagcctgggcgacagtgcgagactccgtctcaaaataaataaattaaattaattaattaattaaaaaattaaaacccccaccagagcaaaaacttacagcgcttacaataccttccacgtgctgttttattttacataaaaccatgacgattaaaaagctggcctctcagccttccgggtattggtttgttttccccctaaactgtcgtttttataggcacttgcactgtcttcttagcagaattgccaatggccttcctcgagtcctacgtttagcgattggcaagaatcatgcactgacagagctcgactccggagggcacaaggaagtagacaacaaagcaggaagaagcaggaggcgcacagatgagcgggatctgcactggaggcggtgcgaccttgcggggcggtgcaagctggcggaacccgcgtgagagaggttggtgttgcgaagggaactagtccggtgcaggacgtggggcttttgcagctcagctggttccggctggggaagatggcggtggctggggcggtgtccggggagccgctggtgcactggtgcacccagcagttgcggaagactttcggcctggatgtcagcgaggagatcattcagtgagaacagttcgggtccaagcggggaaggagctctgggatgtgcactgcctgagcgaaccgggaagcggggaggactgaaaagtacgttttgtcaattgagagtgctgaagagatacgagaatatgttactgatctcctccagggaaatgaaggcaaaaaaggtcaattcatagaagaacttataaccaaatggcaaaagaatgatcaggagttgatttcggatcctttgcagcagtgcttcaaaaaagatgaaattttagatgggcagaaatcaggcgaccatctaaagcggggtaggaagaaagggagaaacagacaggaagttcctgcatttactgaacctgacacgactgcagaggttaagacaaagtttgtcaatttatacacaagagagggacaggacaggcttgcagtcctgctccctggtcgtcacccttgtgattgcctgggccagaagcacaagctcatcaataactgtctgatctgtgggcgcattgtctgtgaacaagaaggctcaggcccttgcttattctgtggcactctggtgtgtactcatgaggaacaagatattttacagcgtgactcaaacaagagccagaaactgctaaagaaactcatgtcaggagtggagaattctggaaaggtggacatctctaccaaggaccttcttcctcatcaagaattgcgaattaagtctggtctggagaaggctatcaagcataaagacaaactgttagagtttgacagaactagtattcgaaggacccaagtcattgatgatgagtcagattactttgccagtgattctaaccaatggttgtccaaacttgagcgggaaaccttgcagaagcgagaggaggagctgagagaacttcgacacgcctctcgactttctaagaaggtcaccattgactttgcaggaaggaagatcctggaagaagaaaattcactagcagagtatcatagcagactagatgagacaatacaggccattgccaatggaaccttgaaccagccactgaccaaattggatagatcttctgaagagcctttgggagttctggtaaatcccaacatgtaccagtcccctccccagtgggttgaccacacaggtgcagcctcacagaagaaggctttccgttcttcaggatttggactagagttcaactcatttcagcaccagttgcgaatccaggatcaagaatttcaggaaggctttgatggtggctggtgcctctctgtacatcagccctgggcttctctgcttgtcagagggattaaaagggtggagggcagatcctggtacaccccccacagaggacgactttggatagcagccacagctaaaaaaccctcccctcaagaagtctcagaactccaggctacatatcgtcttcttcgtgggaaagatgtggaatttcctaatgactatccgtcaggttgtcttctgggctgtgtggacctaattgactgcttgtcccagaagcaatttaaggagcagtttccagacatcagtcaagaatctgattctccatttgttttcatctgcaaaaatcctcaggaaatggttgtgaagtttcctattaaaggaaatccaaaaatctggaaattggattccaagatccatcaaggagcaaagaaggggttaatgaagcagaataaagctgtctgacccaggagaaaaggaactatacagcatagtggagttttgtgtactaaaattgctatctactggtcctttggaattgaagtagtagaaacctaaaggcttggcgtcaggcttgaatatctcagaacttaaactcttaccaaaatctgtatatttttcttaaggagtgggattcctactttatgtaatggggtcgaaatctttgaacacattatttataaaaacctgtttaaaaattctaa

SEQ ID NO: 278866 - DNA, 2376 bp, Homo sapiens
cctgtagtcccagctacttgggaggctgaggcaggagaatggcatgaacccgggaggcggagcttgcagtgagccgagatcacgccactgcactcaagcctgggcgacagtgcgagactccgtctcaaaataaataaattaaattaattaattaattaaaaaattaaaacccccaccagagcaaaaacttacagcgcttacaataccttccacgtgctgttttattttacataaaaccatgacgattaaaaagctggcctctcagccttccgggtattggtttgttttccccctaaactgtcgtttttataggcacttgcactgtcttcttagcagaattgccaatggccttcctcgagtcctacgtttagcgattggcaagaatcatgcactgacagagctcgactccggagggcacaaggaagtagacaacaaagcaggaagaagcaggaggcgcacagatgagcgggatctgcactggaggcggtgcgaccttgcggggcggtgcaagctggcggaacccgcgtgagagaggttggtgttgcgaagggaactagtccggtgcaggacgtggggcttttgcagctcagctggttccggctggggaagatggcggtggctggggcggtgtccggggagccgctggtgcactggtgcacccagcagttgcggaagactttcggcctggatgtcagcgaggagatcattcagtacgttttgtcaattgagagtgctgaagagatacgagaatatgttactgatctcctccagggaaatgaaggcaaaaaaggtcaattcatagaagaacttataaccaaatggcaaaagaatgatcaggagttgatttcggatcctttgcagcagtgcttcaaaaaagatgaaattttagatgggcagaaatcaggcgaccatctaaagcggggtaggaagaaagggagaaacagacaggaagttcctgcatttactgaacctgacacgactgcagaggttaaaacaccttttgatttggccaaggcacaagagaacagcaactccgtaaagaagaagacaaagtttgtcaatttatacacaagagagggacaggacaggcttgcagtcctgctccctggtcgtcacccttgtgattgcctgggccagaagcacaagctcatcaataactgtctgatctgtgggcgcattgtctgtgaacaagaaggctcaggcccttgcttattctgtggcactctggtgtgtactcatgaggaacaagatattttacagcgtgactcaaacaagagccagaaactgctaaagaaactcatgtcaggagtggagaattctggaaaggtggacatctctaccaaggaccttcttcctcatcaagaattgcgaattaagtctggtctggagaaggctatcaagcataaagacaaactgttagagtttgacagaactagtattcgaaggacccaagtcattgatgatgagtcagattactttgccagtgattctaaccaatggttgtccaaacttgagcgggaaaccttgcagaagcgagaggaggagctgagagaacttcgacacgcctctcgactttctaagaaggtcaccattgactttgcaggaaggaagatcctggaagaagaaaattcactagcagagtatcatagcagactagatgagacaatacaggccattgccaatggaaccttgaaccagccactgaccaaattggatagatcttctgaagagcctttgggagttctggtaaatcccaacatgtaccagtcccctccccagtgggttgaccacacaggtgcagcctcacagaagaaggctttccgttcttcaggatttggactagagttcaactcatttcagcaccagttgcgaatccaggatcaagaatttcaggaaggctttgatggtggctggtgcctctctgtacatcagccctgggcttctctgcttgtcagagggattaaaagggtggagggcagatcctggtacaccccccacagaggacgactttggatagcagccacagctaaaaaaccctcccctcaagaagtctcagaactccaggctacatatcgtcttcttcgtgggaaagaggtaacagccgcatattctcctttcaattttactttatggagagaagtcattgacgttcatcttctttcacttccttcttcttggttttctgtaaagaaatttatctggtatgtggggagggaatcatgaagggtcaagctatctgcaacggggataatatattcccaaaaaaaaggggggtaattctcgggcataggcctggaaggcaagaggtaaagggggaagaggagaatggtggcacgggggacaaacgctatttgtgtgtaggatgagaaacaacag

SEQ ID NO: 278867 - DNA, 2492 bp, Homo sapiens
cctgtagtcccagctacttgggaggctgaggcaggagaatggcatgaacccgggaggcggagcttgcagtgagccgagatcacgccactgcactcaagcctgggcgacagtgcgagactccgtctcaaaataaataaattaaattaattaattaattaaaaaattaaaacccccaccagagcaaaaacttacagcgcttacaataccttccacgtgctgttttattttacataaaaccatgacgattaaaaagctggcctctcagccttccgggtattggtttgttttccccctaaactgtcgtttttataggcacttgcactgtcttcttagcagaattgccaatggccttcctcgagtcctacgtttagcgattggcaagaatcatgcactgacagagctcgactccggagggcacaaggaagtagacaacaaagcaggaagaagcaggaggcgcacagatgagcgggatctgcactggaggcggtgcgaccttgcggggcggtgcaagctggcggaacccgcgtgagagaggttggtgttgcgaagggaactagtccggtgcaggacgtggggcttttgcagctcagctggttccggctggggaagatggcggtggctggggcggtgtccggggagccgctggtgcactggtgcacccagcagttgcggaagactttcggcctggatgtcagcgaggagatcattcagtacgttttgtcaattgagagtgctgaagagatacgagaatatgttactgatctcctccagggaaatgaaggcaaaaaaggtcaattcatagaagaacttataaccaaatggcaaaagaatgatcaggagttgatttcggatcctttgcagcagtgcttcaaaaaagatgaaattttagatgggcagaaatcaggcgaccatctaaagcggggtaggaagaaagggagaaacagacaggaagttcctgcatttactgaacctgacacgactgcagaggttaaaacaccttttgatttggccaaggcacaagagaacagcaactccgtaaagaagaagacaaagtttgtcaatttatacacaagagagggacaggacaggcttgcagtcctgctccctggtcgtcacccttgtgattgcctgggccagaagcacaagctcatcaataactgtctgatctgtgggcgcattgtctgtgaacaagaaggctcaggcccttgcttattctgtggcactctggtgtgtactcatgaggaacaagatattttacagcgtgactcaaacaagagccagaaactgctaaagaaactcatgtcaggagtggagaattctggaaaggtggacatctctaccaaggaccttcttcctcatcaagaattgcgaattaagtctggtctggagaaggctatcaagcataaagacaaactgttagagtttgacagaactagtattcgaaggacccaagtcattgatgatgagtcagattactttgccagtgattctaaccaatggttgtccaaacttgagcgggaaaccttgcagaagcgagaggaggagctgagagaacttcgacacgcctctcgactttctaagaaggtcaccattgactttgcaggaaggaagatcctggaagaagaaaattcactagcagagtatcatagcagtgggttgaccacacaggtgcagcctcacagaagaaggctttccgttcttcaggatttggactagagttcaactcatttcagcaccagttgcgaatccaggatcaagaatttcaggaaggctttgatggtggctggtgcctctctgtacatcagccctgggcttctctgcttgtcagagggattaaaagggtggagggcagatcctggtacaccccccacagaggacgactttggatagcagccacagctaaaaaaccctcccctcaagaagtctcagaactccaggctacatatcgtcttcttcgtgggaaagaggtaacagccgcatattctcctttcaattttactttatggagagaagtcattgacgttcatcttctttcacttccttctttctttggctttttctttgttaaaagagacttttaatctttgtatatgtttgtttgtttagtggtaaatcattgacagcgttcaaagcattaatctgtcaaaacagtgcaaataaaaatatcaatttccaacacaagaaatcaactagtcttaatttttttatctgagaaaatcatcttctttactctaaaggtaaaatgactagtgtaaactctgagatccttacattgggaagaacaaccacaaataggaattttcattgagagtggcctaaatagacacctactattggatttgtacaaatcaaagttgattgatttaagcaacgtattttgggaatcaccccaagaatactaactttggatccttaaaaagacttctgacctttgggcatcctgtttttcctttgtgttatccagctcatacagttgttttgagggtagaata

SEQ ID NO: 278868 - DNA, 453 bp, Homo sapiens
gacaccggatacgagctccgtataaattcaaatgacttctagttttccagacatcagtcaagaatctgattctccatttgttttcatctgcaaaaatcctcaggaaatggttgtgaagtttcctattaaaggaaatccaaaaatctggaaattggattccaagatccatcaaggagcaaagaaggggttaatgaagcagaataaagctgtctgacccaggagaaaaggaactatacagcatagtggagttttgtgtactaaaattgctatctactggtcctttggaattgaagtagtagaaacctaaaggcttggcgtcaggcttgaatatctcagaacttaaactcttaccaaaatctgtatatttttcttaaggagtgggattcctactttatgtaatggggtcgaaatctttgaacacattatttataaaaacctgtttaaaaattctaa

SEQ ID NO: 278869 - DNA, 1778 bp, Homo sapiens
ttaaccataataatcggaaggctttatagaaccctaaaatatccaactatcattcaatttaaaatttatcacacaaaaaatgagttttatagaatgcttcaaaaaaagccattaaaataaccaaaactaaaaccaagagtttgtaggaaaataccaatatgcaaacattccaaaaggagagcctttattttgccagccaaggtggtattatttgctttaaaaaaaaaatcaatgtaacattggttgtcttttgagaaagttccttgctgggattcttttgctggaaaattctcatgctgagggtaaacaactttggtttgctttttagtgcctgagatctgaaggcagaaggaagattcaaatagaaagaataatggcccattcaacagctgactcctacagacattctgactaagatgcctgttgcaattcccctgagcaacttaataactgtgttttcaaggttaaactcaagaaccaatcagttatctgtaaatgaatatccaacttttctgaaaggaaaaaggtaacatgttaatataaacagcaaatacatacatcatttataaaactgcctcagatcaattaacaagataaacatacttaaaaaaaattcttgccttttgttttaatgggccatagcaaatactatctctgtataatgatcagtaaagagctgtcaaatagataaaaagactcacaatattgaatgttaaaacaaaccctaaatgaagaaaacattaaataatgctattaggtagtattccttatttccatttttattaaatctgagaactcaacagggttaatcatcaaatgaaaaacatgatttttaaaaagggaataatgaagcaaacattttaatctgtcttaattttaagaacccataatttacatatacagtgtgtttaagcaattttcgtatttgtactacagcaaaaaatgattttacttaccagaagtattgtcatactccaaatggtatccgtgaataaagatttaaaaaaataaaaaataaagtccagcttttttctcatggtcattacacaaaacagttttttatacagttgttttaaattatgaaagggaaaccagagaacagcaagtggaacttaaattttaatactcaaacatatttttatacctcaccacttttcttgaagtggatggtttcaatccactttcatggtttgctgacgtgcattttccctcagtgcaacattactaaaaagcttgtgtgtggaccacactatggcaatgacgtgagattttataaaccatcaccatcgtgttagccttattcacattaatgttttttattaggttctaaaatagcccatttatttttttttcctaaaatattagggttttttccattcattattatatcctatagctctagaagtgtgactccaggattatgctattgaggacataaggcactctctttactttcttgtcagttttgaaaacttctgggaacagattttaatgaatctatttaatgtaatagaatgtttacattccatccaatttacctttatacctagaccttaaggttttattcagctgagtatggaaatgtgtaatatctatttatgtaaataagtagtaaactatggctgagcaattgtgtatttgagtaaattttatagtattcaaacccatggaatagtctttgataaaaataactatccattaaaatgttaccgactatatagtaggatagctctaaattactaaaattgtatataatttattaaatttgacaaacactg

SEQ ID NO: 278870 - DNA, 858 bp, Homo sapiens
ttctcaacttcccttcaatgggaagcattatggaatttcagcagtagtgatgaatcaaattattgaattaaatttcttcttaagaagtaaaaactcagaatgtaccatcttgtttcctttcagtttattaaatggcatcataaagatgactttgctaagttaatagagttaaaaatttttttaatataagccaaaatattaactttaatgaaacattgacttggcaaatgaatttcctataaattatcattggtcagaatgctgttttgtttaataatattacgcaacataaaccataggtgttattagaagtggagaactgcctttttcatctggggcttttaaggacttgctataaatgattattttttaaatgctttataaatcttcatggtttttctatttctgatacactcagctatagttaataccagagtatcctaccaggagtaatatttggaatatttaaatctagtaaaagaagaaagttgtacttcctggctgggagtattaggagatgggagtagagattcacttttaagttcttgaaaatatatgcattctcctaaatattaacaaaaatgatttggggaaatgacatggcttgattgttctgtttaaatttgtactgtggcttatgttacacatgttcatgttcacctctcattcacctgttttatatggtttaaaattctctttaacaaaattcagaaaattcacctgaaacgtattttgacctaaaagaaacatatttttgtatcagtattgaattttggacagtgcccccatataaggaagttactgttttaaaataaagcaaactaactgttttattttccttggaaaaaaaaaaattcc

SEQ ID NO: 278871 - DNA, 832 bp, Homo sapiens
agcggactaggaagagacttgtgccacccggggcaagaacatcagagatccagtgacagcccagcgacctccgggatcaattgcaatgggaggtgtgttttatggaccatgtgctgctatgtatgcctgaagaagtacttgaaatgcaaatttggggagactttgccatataaatgcttggctggattaagcgcctaattaggatggtttttcaacaagttggagtaagcatgcaatcggtactttggtctaggaagccatatggttcgtctcgaagtatcgtaaggaaaattggtactaatttgtctctgattcagtgtccaagagttcagtttcagattaacagccatgcaacagaatggagtcccagccacccaggagaggatgcagtggcgtcttttgctgatgttggatgggtagccaaagaagaaggagagtgttcagcaagactaaggacagaggtcagatcaaggccaccccttcaggatgaccttcttttctttgagaaggccccaagcagacagatttccttaccagacttgtctcaagaagagcctcagctgaagaccccagcgctggcaaatgaggaagcactgcagaagatttgcgctctcgaaaatgaacttgctgctctcagagctcagattgccaaaattgtgacccagcaggagcagcaaaatctcactgcaggtgacttagattctaccacatttggtaccatacaacgcaaaaagtaaaccagaacagaaaaggaatgacggaaaggggtcaaagaaagcaaggagggagcagaggaagagaaagagaaaaagaaaagagaagaaagaaaaga

SEQ ID NO: 278872 - DNA, 571 bp, Homo sapiens
tggaatataaaagagagattttatttaaaaaaaaagaaaaactttagaaggaaaaagactcgttaaagtcagaacctgctggacaagaaggcctatggcaaatcctactgaagataaatttataagccttaagagaataaggactatgacaaaaacaatccaaaccacaataattcatggtaggaaatattgtggcatctacataataaaatggttgaggtccttcttttgttaattttgaggcctataattgctccttaactggtcaggtatcttagatatcagctggctcacaggagaatgtatcttcataatataaacccaaacgttgcttataataaactgtacatataaaaaatcttaaaagaaaagttcaatattgcaatatagatgtctaatttctaggtaaatttagtaaacagaatatgttcaacatggagaaaatcacactccagaaataagttaaaaatatttcaacatctaaaaaaaaattcagcagcacccacagatacagcacatagaagaaattaaaaaattatgaatagttttaataaataacactaatatcata

SEQ ID NO: 278873 - DNA, 608 bp, Homo sapiens
aaaagctgcatgcaagataccaactgaggattataataccaagacagacacttcaatttcagattgagctgaaataaaaagaataaaagaaaagactcgttaaagtcagaacctgctggacaagaaggcctatggcaaatcctactgaagataaatttataagccttaagagaataaggactatgacaaaaacaatccaaaccacaataattcatggtaggaaatattgtggcatctacataataaaatggttgaggtccttcttttgttaattttgaggcctataattgctccttaactggtcaggtatcttagatatcagctggctcacaggagaatgtatcttcataatataaacccaaacgttgcttataataaactgtacatataaaaaatcttaaaagaaaagttcaatattgcaatatagatgtctaatttctaggtaaatttagtaaacagaatatgttcaacatggagaaaatcacactccagaaataagttaaaaatatttcaacatctaaaaaaaaattcagcagcacccacagatacagcacatagaagaaattaaaaaattatgaatagttttaataaataacactaatatcata

SEQ ID NO: 278874 - DNA, 2707 bp, Homo sapiens
agcggactaggaagagacttgtgccacccggggcaagaacatcagagatccagtgacagcccagcgacctccgggatcaattgcaatgggaggtgtgttttatggaccatgtgctgctatgtatgcctgaagaagtacttgaaatgcaaatttggggagactttgccatataaatgcttggctggattaagcgcctaattaggatggtttttcaacaagttggagtaagcatgcaatcggtactttggtctaggaagccatatggttcgtctcgaagtatcgtaaggaaaattggtactaatttgtctctgattcagtgtccaagagttcagtttcagattaacagccatgcaacagaatggagtcccagccacccaggagaggatgcagtggcgtcttttgctgatgttggatgggtagccaaagaagaaggagagtgttcagcaagactaaggacagaggtcagatcaaggccaccccttcaggatgaccttcttttctttgagaaggccccaagcagacagatttccttaccagacttgtctcaagaagagcctcagctgaagaccccagcgctggcaaatgaggaagcactgcagaagatttgcgctctcgaaaatgaacttgctgctctcagagctcagattgccaaaattgtgacccagcaggagcagcaaaatctcactgcaggtgacttagattctaccacatttggtaccataccaccacaccctccacctcccccaccgcccctgcctccccctgcactggggctccaccaaagtacatctgctgttgatctgattaaagaacgaagagagaaaagagccaatgctggaaagactttggttaagaacaatccaaagaaacctgaaatgccaaatatgctagagatccttaaagagatgaacagtgtaaaacttcggtcagtgaagaggtcagagcaagatgtgaagcccaagccagtggatgctactgaccctgctgccctcatagcagaggctctgaaaaagaaatttgcttatcggtatcgaagtgatagccaagatgaagttgaaaaaggaattccaaagtctgaatcagaggccacctcagagagagtgttgtttgggccacacatgttgaagccaacaggaaaaatgaaggctttaattgaaaatgtatcagactcctaatagacaatgagctgcgaaaagactcctggttcccctgttgatttgtgagggccaagtttgctagtagaaatcgacactgtttagtaaatacctctttagtattcagtggtcttcttttcaggctaattagtggattaagcaataatgaaagcactaagtttggttttgcttttgtgagatggtcagctttggtgctctccacaacatgtgtgttctgacatgtttctaatatgtggccagggcgttcagatttccagttttgaaaacaattgtatagatttcacaacacaaaaaggacatttgtggatgttactgcacattttaaattcttaacactaatttatctgtataagtgttttatatgcatatttttggacataaacagtttatgtaaaattagtaatgaatgatggcaacgagggcactgttatcttcgtttgttttcaatgatcatttagcattcaatgatggaacagctggtataacataagttgttggcatgaaatatttgagattggaaacttcttgccttgaacagaacttatatcttagattctctctcacattttcttggagctggggtttgaataggaaccagatgatgttcactgctgaaattccataatgcttcccattgaagggaagttgagaaccaggaaagctgctttcacgtcattgccatccagtactgacagggaagaaagatgtagttttccagtagtgatgaatcaaattattgaattaaatttcttcttaagaagtaaaaactcagaatgtaccatcttgtttcctttcagtttattaaatggcatcataaagatgactttgctaagttaatagagttaaaaatttttttaatataagccaaaatattaactttaatgaaacattgacttggcaaatgaatttcctataaattatcattggtcagaatgctgttttgtttaataatattacgcaacataaaccataggtgttattagaagtggagaactgcctttttcatctggggcttttaaggacttgctataaatgattattttttaaatgctttataaatcttcatggtttttctatttctgatacactcagctatagttaataccagagtatcctaccaggagtaatatttggaatatttaaatctagtaaaagaagaaagttgtacttcctggctgggagtattaggagatgggagtagagattcacttttaagttcttgaaaatatatgcattctcctaaatattaacaaaaatgatttggggaaatgacatggcttgattgttctgtttaaatttgtactgtggcttatgttacacatgttcatgttcacctctcattcacctgttttatatggtttaaaattctctttaacaaaattcagaaaattcacctgaaacgtattttgacctaaaagaaacatatttttgtatcagtattgaattttggacagtgcccccatataaggaagttactgttttaaaataaagcaaactaactgttttattttccttggaaaaaaaaaaattcc

SEQ ID NO: 278875 - DNA, 2772 bp, Homo sapiens
ccgactgtgactctcagcagccggcttgcggagcggttgccgcgtcctctgccgagcttcttgtgcccgcctccgagcctgaggaaacagctgattgatcagcctggctcaggcttggggcggggattggctgattggcagcaacgccattcgggacagccaagctagaagcctgaggagccggagagggtgctggctgccgcgcggccgagtgtgttttatggaccatgtgctgctatgtatgcctgaagaagtacttgaaatgcaaatttggggagactttgccatataaatgcttggctggattaagcgcctaattaggatggtttttcaacaagttggagtaagcatgcaatcggtactttggtctaggaagccatatggttcgtctcgaagtatcgtaaggaaaattggtactaatttgtctctgattcagtgtccaagagttcagtttcagattaacagccatgcaacagaatggagtcccagccacccaggagaggatgcagtggcgtcttttgctgatgttggatgggtagccaaagaagaaggagagtgttcagcaagactaaggacagaggtcagatcaaggccaccccttcaggatgaccttcttttctttgagaaggccccaagcagacagatttccttaccagacttgtctcaagaagagcctcagctgaagaccccagcgctggcaaatgaggaagcactgcagaagatttgcgctctcgaaaatgaacttgctgctctcagagctcagattgccaaaattgtgacccagcaggagcagcaaaatctcactgcaggtgacttagattctaccacatttggtaccataccaccacaccctccacctcccccaccgcccctgcctccccctgcactggggctccaccaaagtacatctgctgttgatctgattaaagaacgaagagagaaaagagccaatgctggaaagactttggttaagaacaatccaaagaaacctgaaatgccaaatatgctagagatccttaaagagatgaacagtgtaaaacttcggtcagtgaagaggtcagagcaagatgtgaagcccaagccagtggatgctactgaccctgctgccctcatagcagaggctctgaaaaagaaatttgcttatcggtatcgaagtgatagccaagatgaagttgaaaaaggaattccaaagtctgaatcagaggccacctcagagagagtgttgtttgggccacacatgttgaagccaacaggaaaaatgaaggctttaattgaaaatgtatcagactcctaatagacaatgagctgcgaaaagactcctggttcccctgttgatttgtgagggccaagtttgctagtagaaatcgacactgtttagtaaatacctctttagtattcagtggtcttcttttcaggctaattagtggattaagcaataatgaaagcactaagtttggttttgcttttgtgagatggtcagctttggtgctctccacaacatgtgtgttctgacatgtttctaatatgtggccagggcgttcagatttccagttttgaaaacaattgtatagatttcacaacacaaaaaggacatttgtggatgttactgcacattttaaattcttaacactaatttatctgtataagtgttttatatgcatatttttggacataaacagtttatgtatgatcatttagcattcaatgatggaacagctggtataacataagttgttggcatgaaatatttgagattggaaacttcttgccttgaacagaacttatatcttagattctctctcacattttcttggagctggggtttgaataggaaccagatgatgttcactgctgaaattccataatgcttcccattgaagggaagttgagaaccaggaaagctgctttcacgtcattgccatccagtactgacagggaagaaagatgtagttttccagtagtgatgaatcaaattattgaattaaatttcttcttaagaagtaaaaactcagaatgtaccatcttgtttcctttcagtttattaaatggcatcataaagatgactttgctaagttaatagagttaaaaatttttttaatataagccaaaatattaactttaatgaaacattgacttggcaaatgaatttcctataaattatcattggtcagaatgctgttttgtttaataatattacgcaacataaaccataggtgttattagaagtggagaactgcctttttcatctggggcttttaaggacttgctataaatgattattttttaaatgctttataaatcttcatggtttttctatttctgatacactcagctatagttaataccagagtatcctaccaggagtaatatttggaatatttaaatctagtaaaagaagaaagttgtacttcctggctgggagtattaggagatgggagtagagattcacttttaagttcttgaaaatatatgcattctcctaaatattaacaaaaatgatttggggaaatgacatggcttgattgttctgtttaaatttgtactgtggcttatgttacacatgttcatgttcacctctcattcacctgttttatatggtttaaaattctctttaacaaaattcagaaaattcacctgaaacgtattttgacctaaaagaaacatatttttgtatcagtattgaattttggacagtgcccccatataaggaagttactgttttaaaataaagcaaactaactgttttattttccttggaaaaaaaaaaattcc

SEQ ID NO: 278876 - DNA, 2416 bp, Homo sapiens
ccgactgtgactctcagcagccggcttgcggagcggttgccgcgtcctctgccgagcttcttgtgcccgcctccgagcctgaggaaacagctgattgatcagcctggctcaggcttggggcggggattggctgattggcagcaacgccattcgggacagccaagctagaagcctgaggagccggagagggtgctggctgccgcgcggccgagtgtgttttatggaccatgtgctgctatgtatgcctgaagaagtacttgaaatgcaaatttggggagactttgccatataaatgcttggctggattaagcgcctaattaggatggtttttcaacaagttggagtaagcatgcaatcggtactttggtctaggaagccatatggttcgtctcgaagtatcgtaaggaaaattggtactaatttgtctctgattcagtgtccaagagttcagtttcagattaacagccatgcaacagaatggagtcccagccacccaggagaggatgcagtggcgtcttttgctgatgttggatgggtagccaaagaagaaggagagtgttcagcaagactaaggacagaggtcagatcaaggccaccccttcaggatgaccttcttttctttgagaaggccccaagcagacagatttccttaccagacttgtctcaagaagagcctcagctgaagaccccagcgctggcaaatgaggaagcactgcagaagatttgcgctctcgaaaatgaacttgctgctctcagagctcagattgccaaaattgtgacccagcaggagcagcaaaatctcactgcaggtgacttagattctaccacatttggtaccataccaccacaccctccacctcccccaccgcccctgcctccccctgcactggggctccaccaaagtacatctgctgttgatctgattaaagaacgaagagagaaaagagccaatgctggaaagactttggttaagaacaatccaaagaaacctgaaatgccaaatatgctagagatccttaaagagatgaacagtgtaaaacttcggtcagtgaagaggtcagagcaagatgtgaagcccaagccagtggatgctactgaccctgctgccctcatagcagaggctctgaaaaagaaatttgcttatcggtatcgaagtgatagccaagatgaagttgaaaaaggaattccaaagtctgaatcagaggccacctcagagagagtgttgtttgggccacacatgttgaagccaacaggaaaaatgaaggctttaattgaaaatgtatcagactcctaatagacaatgagctgcgaaaagactcctggttcccctgttgatttgtgagggccaagtttgctagtagaaatcgacactgtttagtaaatacctctttagtattcagtggtcttcttttcaggctaattagtggattaagcaataatgaaagcactaagtttggttttgcttttgtgagatggtcagctttggtgctctccacaacatgtgtgttctgacatgtttctaatatgtggccagggcgttcagatttccagttttgaaaacaattgtatagatttcacaacacaaaaaggacatttgtggatgttactgcacattttaaattcttaacactaatttatctgtataagtgttttatatgcatatttttggacataaacagtttatgtaaaattagtaatgaatgatggcaacgagggcactgttatcttcgtttgttttcaatgatcatttagcattcaatgatggaacagctggtataacataagttgttggcatgaaatatttgagattggaaacttcttgccttgaacagaacttatatcttagattctctctcacattttcttggagctggggtttgaataggaaccagatgatgttcactgctgaaattccataatgcttcccattgaagggaagttgagaaccaggaaagctgctttcacgtcattgccatccagtactgacagggaagaaagatgtagttttccagtagtgatgaatcaaattattgaattaaatttcttcttaagaagtaaaaactcagaatgtaccatcttgtttcctttcagtttattaaatggcatcataaagatgactttgctaagttaatagagttaaaaatttttttaatataagccaaaatattaactttaatgaaacattgacttggcaaatgaatttcctataaattatcattggtcagaatgctgttttatatggtttaaaattctctttaacaaaattcagaaaattcacctgaaacgtattttgacctaaaagaaacatatttttgtatcagtattgaattttggacagtgcccccatataaggaagttactgttttaaaataaagcaaactaactgttttattttccttggaaaaaaaaaaattcc

SEQ ID NO: 278877 - DNA, 2660 bp, Homo sapiens
ccgactgtgactctcagcagccggcttgcggagcggttgccgcgtcctctgccgagcttcttgtgcccgcctccgagcctgaggaaacagctgattgatcagcctggctcaggcttggggcggggattggctgattggcagcaacgccattcgggacagccaagctagaagcctgaggagccggagagggtgctggctgccgcgcggccgagtgtgttttatggaccatgtgctgctatgtatgcctgaagaagtacttgaaatgcaaatttggggagactttgccatataaatgcttggctggattaagcgcctaattaggatggtttttcaacaagttggagtaagcatgcaatcggtactttggtctaggaagccatatggttcgtctcgaagtatcgtaaggaaaattggtactaatttgtctctgattcagtgtccaagagttcagtttcagattaacagccatgcaacagaatggagtcccagccacccaggagaggatgcagtggcgtcttttgctgatgttggatgggtagccaaagaagaaggagagtgttcagcaagactaaggacagaggtcagatcaaggccaccccttcaggatgaccttcttttctttgagaaggccccaagcagacagatttccttaccagacttgtctcaagaagagcctcagctgaagaccccagcgctggcaaatgaggaagcactgcagaagatttgcgctctcgaaaatgaacttgtgttgatctgattaaagaacgaagagagaaaagagccaatgctggaaagactttggttaagaacaatccaaagaaacctgaaatgccaaatatgctagagatccttaaagagatgaacagtgtaaaacttcggtcagtgaagaggtcagagcaagatgtgaagcccaagccagtggatgctactgaccctgctgccctcatagcagaggctctgaaaaagaaatttgcttatcggtatcgaagtgatagccaagatgaagttgaaaaaggaattccaaagtctgaatcagaggccacctcagagagagtgttgtttgggccacacatgttgaagccaacaggaaaaatgaaggctttaattgaaaatgtatcagactcctaatagacaatgagctgcgaaaagactcctggttcccctgttgatttgtgagggccaagtttgctagtagaaatcgacactgtttagtaaatacctctttagtattcagtggtcttcttttcaggctaattagtggattaagcaataatgaaagcactaagtttggttttgcttttgtgagatggtcagctttggtgctctccacaacatgtgtgttctgacatgtttctaatatgtggccagggcgttcagatttccagttttgaaaacaattgtatagatttcacaacacaaaaaggacatttgtggatgttactgcacattttaaattcttaacactaatttatctgtataagtgttttatatgcatatttttggacataaacagtttatgtaaaattagtaatgaatgatggcaacgagggcactgttatcttcgtttgttttcaatgatcatttagcattcaatgatggaacagctggtataacataagttgttggcatgaaatatttgagattggaaacttcttgccttgaacagaacttatatcttagattctctctcacattttcttggagctggggtttgaataggaaccagatgatgttcactgctgaaattccataatgcttcccattgaagggaagttgagaaccaggaaagctgctttcacgtcattgccatccagtactgacagggaagaaagatgtagttttccagtagtgatgaatcaaattattgaattaaatttcttcttaagaagtaaaaactcagaatgtaccatcttgtttcctttcagtttattaaatggcatcataaagatgactttgctaagttaatagagttaaaaatttttttaatataagccaaaatattaactttaatgaaacattgacttggcaaatgaatttcctataaattatcattggtcagaatgctgttttgtttaataatattacgcaacataaaccataggtgttattagaagtggagaactgcctttttcatctggggcttttaaggacttgctataaatgattattttttaaatgctttataaatcttcatggtttttctatttctgatacactcagctatagttaataccagagtatcctaccaggagtaatatttggaatatttaaatctagtaaaagaagaaagttgtacttcctggctgggagtattaggagatgggagtagagattcacttttaagttcttgaaaatatatgcattctcctaaatattaacaaaaatgatttggggaaatgacatggcttgattgttctgtttaaatttgtactgtggcttatgttacacatgttcatgttcacctctcattcacctgttttatatggtttaaaattctctttaacaaaattcagaaaattcacctgaaacgtattttgacctaaaagaaacatatttttgtatcagtattgaattttggacagtgcccccatataaggaagttactgttttaaaataaagcaaactaactgttttattttccttggaaaaaaaaaaattcc

SEQ ID NO: 278878 - DNA, 2777 bp, Homo sapiens
ccgactgtgactctcagcagccggcttgcggagcggttgccgcgtcctctgccgagcttcttgtgcccgcctccgagcctgaggaaacagctgattgatcagcctggctcaggcttggggcggggattggctgattggcagcaacgccattcgggacagccaagctagaagcctgaggagccggagagggtgctggctgccgcgcggccgagtgtgttttatggaccatgtgctgctatgtatgcctgaagaagtacttgaaatgcaaatttggggagactttgccatataaatgcttggctggattaagcgcctaattaggatggtttttcaacaagttggagtaagcatgcaatcggtactttggtctaggaagccatatggttcgtctcgaagtatcgtaaggaaaattggtactaatttgtctctgattcagtgtccaagagttcagtttcagattaacagccatgcaacagaatggagtcccagccacccaggagaggatgcagtggcgtcttttgctgatgttggatgggtagccaaagaagaaggagagtgttcagcaagactaaggacagaggtcagatcaaggccaccccttcaggatgaccttcttttctttgagaaggccccaagcagacagatttccttaccagacttgtctcaagaagagcctcagctgaagaccccagcgctggcaaatgaggaagcactgcagaagatttgcgctctcgaaaatgaacttgctgctctcagagctcagattgccaaaattgtgacccagcaggagcagcaaaatctcactgcaggtgacttagattctaccacatttggtaccataccaccacaccctccacctcccccaccgcccctgcctccccctgcactggggctccaccaaagtacatctgctgttgatctgattaaagaacgaagagagaaaagagccaatgctggaaagactttggttaagaacaatccaaagaaacctgaaatgccaaatatgctagagatccttaaagagatgaacagtgtaaaacttcggtcagtgaagaggtcagagcaagatgtgaagcccaagccagtggatgctactgaccctgctgccctcatagcagaggctctgaaaaagaaatttgcttatcggtatcgaagtgatagccaagatgaagttgaaaaaggaattccaaagtctgaatcagaggccacctcagagagagtgttgtcccttccagctggctttattcagccccacgtgtccaagcattgtctgggatagccttgtattggaaaacctggcccattctgtaaataaaggctccactagtgcctgagatctgaaggcagaaggaagattcaaatagaaagaataatggcccattcaacagctgactcctacagacattctgactaagatgcctgttgcaattcccctgagcaacttaataactgtgttttcaaggttaaactcaagaaccaatcagttatctgtaaatgaatatccaacttttctgaaaggaaaaaggtaacatgttaatataaacagcaaatacatacatcatttataaaactgcctcagatcaattaacaagataaacatacttaaaaaaaattcttgccttttgttttaatgggccatagcaaatactatctctgtataatgatcagtaaagagctgtcaaatagataaaaagactcacaatattgaatgttaaaacaaaccctaaatgaagaaaacattaaataatgctattaggtagtattccttatttccatttttattaaatctgagaactcaacagggttaatcatcaaatgaaaaacatgatttttaaaaagggaataatgaagcaaacattttaatctgtcttaattttaagaacccataatttacatatacagtgtgtttaagcaattttcgtatttgtactacagcaaaaaatgattttacttaccagaagtattgtcatactccaaatggtatccgtgaataaagatttaaaaaaataaaaaataaagtccagcttttttctcatggtcattacacaaaacagttttttatacagttgttttaaattatgaaagggaaaccagagaacagcaagtggaacttaaattttaatactcaaacatatttttatacctcaccacttttcttgaagtggatggtttcaatccactttcatggtttgctgacgtgcattttccctcagtgcaacattactaaaaagcttgtgtgtggaccacactatggcaatgacgtgagattttataaaccatcaccatcgtgttagccttattcacattaatgttttttattaggttctaaaatagcccatttatttttttttcctaaaatattagggttttttccattcattattatatcctatagctctagaagtgtgactccaggattatgctattgaggacataaggcactctctttactttcttgtcagttttgaaaacttctgggaacagattttaatgaatctatttaatgtaatagaatgtttacattccatccaatttacctttatacctagaccttaaggttttattcagctgagtatggaaatgtgtaatatctatttatgtaaataagtagtaaactatggctgagcaattgtgtatttgagtaaattttatagtattcaaacccatggaatagtctttgataaaaataactatccattaaaatgttaccgactatatagtaggatagctctaaattactaaaattgtatataatttattaaatttgacaaacactg

SEQ ID NO: 278879 - DNA, 1846 bp, Homo sapiens
ccgactgtgactctcagcagccggcttgcggagcggttgccgcgtcctctgccgagcttcttgtgcccgcctccgagcctgaggaaacagctgattgatcagcctggctcaggcttggggcggggattggctgattggcagcaacgccattcgggacagccaagctagaagcctgaggagccggagagggtgctggctgccgcgcggccgagtgtgttttatggaccatgtgctgctatgtatgcctgaagaagtacttgaaatgcaaatttggggagactttgccatataaatgcttggctggattaagcgcctaattaggatggtttttcaacaagttggagtaagcatgcaatcggtactttggtctaggaagccatatggttcgtctcgaagtatcgtaaggaaaattggtactaatttgtctctgattcagtgtccaagagttcagtttcagattaacagccatgcaacagaatggagtcccagccacccaggagaggatgcagtggcgtcttttgctgatgttggatgggtagccaaagaagaaggagagtgttcagcaagactaaggacagaggtcagatcaaggccaccccttcaggatgaccttcttttctttgagaaggccccaagcagacagatttccttaccagacttgtctcaagaagagcctcagctgaagaccccagcgctggcaaatgaggaagcactgcagaagatttgcgctctcgaaaatgaacttgctgctctcagagctcagattgccaaaattgtgacccagcaggagcagcaaaatctcactgcaggtgacttagattctaccacatttggtaccataccaccacaccctccacctcccccaccgcccctgcctccccctgcactggggctccaccaaagtacatctgctgttgatctgattaaagaacgaagagagaaaagagccaatgctggaaagactttggttaagaacaatccaaagaaacctgaaatgccaaatatgctagagatccttaaagagatgaacagtgtaaaacttcggtcagtgaagaggtcagagcaagatgtgaagcccaagccagtggatgctactgaccctgctgccctcatagcagaggctctgaaaaagaaatttgcttatcggtatcgaagtgatagccaagatgaagttgaaaaaggaattccaaagtctgaatcagaggccacctcagagagagtgttgtcccttccagctggctttattcagccccacgtgtccaagcattgtctgggatagccttgtattggaaaacctggcccattctgtaaataaaggctccactagaaaagactcgttaaagtcagaacctgctggacaagaaggcctatggcaaatcctactgaagataaatttataagccttaagagaataaggactatgacaaaaacaatccaaaccacaataattcatggtaggaaatattgtggcatctacataataaaatggttgaggtccttcttttgttaattttgaggcctataattgctccttaactggtcaggtatcttagatatcagctggctcacaggagaatgtatcttcataatataaacccaaacgttgcttataataaactgtacatataaaaaatcttaaaagaaaagttcaatattgcaatatagatgtctaatttctaggtaaatttagtaaacagaatatgttcaacatggagaaaatcacactccagaaataagttaaaaatatttcaacatctaaaaaaaaattcagcagcacccacagatacagcacatagaagaaattaaaaaattatgaatagttttaataaataacactaatatcata

SEQ ID NO: 278880 - DNA, 1440 bp, Homo sapiens
ccgactgtgactctcagcagccggcttgcggagcggttgccgcgtcctctgccgagcttcttgtgcccgcctccgagcctgaggaaacagctgattgatcagcctggctcaggcttggggcggggattggctgattggcagcaacgccattcgggacagccaagctagaagcctgaggagccggagagggtgctggctgccgcgcggccgagtgtgttttatggaccatgtgctgctatgtatgcctgaagaagtacttgaaatgcaaatttggggagactttgccatataaatgcttggctggattaagcgcctaattaggatggtttttcaacaagttggagtaagcatgcaatcggtactttggtctaggaagccatatggttcgtctcgaagtatcgtaaggaaaattggtactaatttgtctctgattcagtgtccaagagttcagtttcagattaacagccatgcaacagaatggagtcccagccacccaggagaggatgcagtggcgtcttttgctgatgttggatgggtagccaaagaagaaggagagtgttcagcaagactaaggacagaggtcagatcaaggccaccccttcaggatgaccttcttttctttgagaaggccccaagcagacagatttccttaccagacttgtctcaagaagagcctcagctgaagaccccagcgctggcaaatgaggaagcactgcagaagatttgcgctctcgaaaatgaacttgctgctctcagagctcagattgccaaaattgtgacccagcaggagcagcaaaatctcactgcaggtgacttagattctaccacatttggtaccataccaccacaccctccacctcccccaccgcccctgcctccccctgcactggggctccaccaaagtacatctgctgttgatctgattaaagaacgaagagagaaaagagccaatgctggaaagactttggttaagaacaatccaaagaaacctgaaatgccaaatatgctagagatccttaaagagatgaacagtgtaaaacttcggtcagtgaagaggtcagagcaagatgtgaagcccaagccagtggatgctactgaccctgctgccctcatagcagaggctctgaaaaagaaatttgcttatcggtatcgaagtgatagccaagatgaagttgaaaaaggaattccaaagtctgaatcagaggccacctcagagagagtgttgtcccttccagctggctttattcagccccacgtgtccaagcattgtctgggatagccttgtattggaaaacctggcccattctgtaaataaaggctccactagactgaagtgtgaaattgtacacccatgacaagtggatccctgtattacttcatggagcagaatagaatatctccaccctactacatgccagcaaaataaaatgttttcttata

SEQ ID NO: 278881 - DNA, 951 bp, Homo sapiens
ccgactgtgactctcagcagccggcttgcggagcggttgccgcgtcctctgccgagcttcttgtgcccgcctccgagcctgaggaaacagctgattgatcagcctggctcaggcttggggcggggattggctgattggcagcaacgccattcgggacagccaagctagaagcctgaggagccggagagggtgctggctgccgcgcggccgagtgtgttttatggaccatgtgctgctatgtatgcctgaagaagtacttgaaatgcaaatttggggagactttgccatataaatgcttggctggattaagcgcctaattaggatggtttttcaacaagttggagtaagcatgcaatcggtactttggtctaggaagccatatggttcgtctcgaagtatcgtaaggaaaattggtactaatttgtctctgattcagtgtccaagagttcagtttcagattaacagccatgcaacagaatggagtcccagccacccaggagaggatgcagtggcgtcttttgctgatgttggatgggtagccaaagaagaaggagagtgttcagcaagactaaggacagaggtcagatcaaggccaccccttcaggatgaccttcttttctttgagaaggccccaagcagacagatttccttaccagacttgtctcaagaagagcctcagctgaagaccccagcgctggcaaatgaggaagcactgcagaagatttgcgctctcgaaaatgaacttgctgctctcagagctcagattgccaaaattgtgacccagcaggagcagcaaaatctcactgcaggtgacttagattctaccacatttggtaccatacaacgcaaaaagtaaaccagaacagaaaaggaatgacggaaaggggtcaaagaaagcaaggagggagcagaggaagagaaagagaaaaagaaaagagaagaaagaaaaga

SEQ ID NO: 278882 - DNA, 625 bp, Homo sapiens
aagcctgtaacaatttgaacttcttccaccagctccttagctgattgcctaagtttctaaatttgataggaatttgtttagatgtgaggtttagcattgtttcttgtgtttaatgtgtttctgtgctcaactgattttcttcttttgcctcttcataccctttcagaaaaagactcgttaaagtcagaacctgctggacaagaaggcctatggcaaatcctactgaagataaatttataagccttaagagaataaggactatgacaaaaacaatccaaaccacaataattcatggtaggaaatattgtggcatctacataataaaatggttgaggtccttcttttgttaattttgaggcctataattgctccttaactggtcaggtatcttagatatcagctggctcacaggagaatgtatcttcataatataaacccaaacgttgcttataataaactgtacatataaaaaatcttaaaagaaaagttcaatattgcaatatagatgtctaatttctaggtaaatttagtaaacagaatatgttcaacatggagaaaatcacactccagaaataagttaaaaatatttcaacatctaaaaaaaaattcagcagcacccacagat

SEQ ID NO: 278883 - DNA, 2826 bp, Homo sapiens
ccgactgtgactctcagcagccggcttgcggagcggttgccgcgtcctctgccgagcttcttgtgcccgcctccgagcctgaggaaacagctgattgatcagcctggctcaggcttggggcggggattggctgattggcagcaacgccattcgggacagccaagctagaagcctgaggagccggagagggtgctggctgccgcgcggccgagtgtgttttatggaccatgtgctgctatgtatgcctgaagaagtacttgaaatgcaaatttggggagactttgccatataaatgcttggctggattaagcgcctaattaggatggtttttcaacaagttggagtaagcatgcaatcggtactttggtctaggaagccatatggttcgtctcgaagtatcgtaaggaaaattggtactaatttgtctctgattcagtgtccaagagttcagtttcagattaacagccatgcaacagaatggagtcccagccacccaggagaggatgcagtggcgtcttttgctgatgttggatgggtagccaaagaagaaggagagtgttcagcaagactaaggacagaggtcagatcaaggccaccccttcaggatgaccttcttttctttgagaaggccccaagcagacagatttccttaccagacttgtctcaagaagagcctcagctgaagaccccagcgctggcaaatgaggaagcactgcagaagatttgcgctctcgaaaatgaacttgctgctctcagagctcagattgccaaaattgtgacccagcaggagcagcaaaatctcactgcaggtgacttagattctaccacatttggtaccataccaccacaccctccacctcccccaccgcccctgcctccccctgcactggggctccaccaaagtacatctgctgttgatctgattaaagaacgaagagagaaaagagccaatgctggaaagactttggttaagaacaatccaaagaaacctgaaatgccaaatatgctagagatccttaaagagatgaacagtgtaaaacttcggtcagtgaagaggtcagagcaagatgtgaagcccaagccagtggatgctactgaccctgctgccctcatagcagaggctctgaaaaagaaatttgcttatcggtatcgaagtgatagccaagatgaagttgaaaaaggaattccaaagtctgaatcagaggccacctcagagagagtgttgtttgggccacacatgttgaagccaacaggaaaaatgaaggctttaattgaaaatgtatcagactcctaatagacaatgagctgcgaaaagactcctggttcccctgttgatttgtgagggccaagtttgctagtagaaatcgacactgtttagtaaatacctctttagtattcagtggtcttcttttcaggctaattagtggattaagcaataatgaaagcactaagtttggttttgcttttgtgagatggtcagctttggtgctctccacaacatgtgtgttctgacatgtttctaatatgtggccagggcgttcagatttccagttttgaaaacaattgtatagatttcacaacacaaaaaggacatttgtggatgttactgcacattttaaattcttaacactaatttatctgtataagtgttttatatgcatatttttggacataaacagtttatgtaaaattagtaatgaatgatggcaacgagggcactgttatcttcgtttgttttcaatgatcatttagcattcaatgatggaacagctggtataacataagttgttggcatgaaatatttgagattggaaacttcttgccttgaacagaacttatatcttagattctctctcacattttcttggagctggggtttgaataggaaccagatgatgttcactgctgaaattccataatgcttcccattgaagggaagttgagaaccaggaaagctgctttcacgtcattgccatccagtactgacagggaagaaagatgtagttttccagtagtgatgaatcaaattattgaattaaatttcttcttaagaagtaaaaactcagaatgtaccatcttgtttcctttcagtttattaaatggcatcataaagatgactttgctaagttaatagagttaaaaatttttttaatataagccaaaatattaactttaatgaaacattgacttggcaaatgaatttcctataaattatcattggtcagaatgctgttttgtttaataatattacgcaacataaaccataggtgttattagaagtggagaactgcctttttcatctggggcttttaaggacttgctataaatgattattttttaaatgctttataaatcttcatggtttttctatttctgatacactcagctatagttaataccagagtatcctaccaggagtaatatttggaatatttaaatctagtaaaagaagaaagttgtacttcctggctgggagtattaggagatgggagtagagattcacttttaagttcttgaaaatatatgcattctcctaaatattaacaaaaatgatttggggaaatgacatggcttgattgttctgtttaaatttgtactgtggcttatgttacacatgttcatgttcacctctcattcacctgttttatatggtttaaaattctctttaacaaaattcagaaaattcacctgaaacgtattttgacctaaaagaaacatatttttgtatcagtattgaattttggacagtgcccccatataaggaagttactgttttaaaataaagcaaactaactgttttattttccttggaaaaaaaaaaattcc

SEQ ID NO: 278884 - DNA, 2772 bp, Homo sapiens
ccgactgtgactctcagcagccggcttgcggagcggttgccgcgtcctctgccgagcttcttgtgcccgcctccgagcctgaggaaacagctgattgatcagcctggctcaggcttggggcggggattggctgattggcagcaacgccattcgggacagccaagctagaagcctgaggagccggagagggtgctggctgccgcgcggccgagtgtgttttatggaccatgtgctgctatgtatgcctgaagaagtacttgaaatgcaaatttggggagactttgccatataaatgcttggctggattaagcgcctaattaggatggtttttcaacaagttggagtaagcatgcaatcggtactttggtctaggaagccatatggttcgtctcgaagtatcgtaaggaaaattggtactaatttgtctctgattcagtgtccaagagttcagtttcagattaacagccatgcaacagaatggagtcccagccacccaggagaggatgcagtggcgtcttttgctgatgttggatgggtagccaaagaagaaggagagtgttcagcaagactaaggacagaggtcagatcaaggccaccccttcaggatgaccttcttttctttgagaaggccccaagcagacagatttccttaccagacttgtctcaagaagagcctcagctgaagaccccagcgctggcaaatgaggaagcactgcagaagatttgcgctctcgaaaatgaacttgctgctctcagagctcagattgccaaaattgtgacccagcaggagcagcaaaatctcactgcaggtgacttagattctaccacatttggtaccataccaccacaccctccacctcccccaccgcccctgcctccccctgcactggggctccaccaaagtacatctgctgttgatctgattaaagaacgaagagagaaaagagccaatgctggaaagactttggttaagaacaatccaaagaaacctgaaatgccaaatatgctagagatccttaaagagatgaacagtgtaaaacttcggtcagtgaagaggtcagagcaagatgtgaagcccaagccagtggatgctactgaccctgctgccctcatagcagaggctctgaaaaagaaatttgcttatcggtatcgaagtgatagccaagatgaagttgaaaaaggaattccaaagtctgaatcagaggccacctcagagagagtgttgtttgggccacacatgttgaagccaacaggaaaaatgaaggctttaattgaaaatgtatcagactcctaatagacaatgagctgcgaaaagactcctggttcccctgttgatttgtgagggccaagtttgctagtagaaatcgacactgtttagtaaatacctctttagtattcagtggtcttcttttcaggctaattagtggattaagcaataatgaaagcactaagtttggttttgcttttgtgagatggtcagctttggtgctctccacaacatgtgtgttctgacatgtttctaatatgtggccagggcgttcagatttccagttttgacattttaaattcttaacactaatttatctgtataagtgttttatatgcatatttttggacataaacagtttatgtaaaattagtaatgaatgatggcaacgagggcactgttatcttcgtttgttttcaatgatcatttagcattcaatgatggaacagctggtataacataagttgttggcatgaaatatttgagattggaaacttcttgccttgaacagaacttatatcttagattctctctcacattttcttggagctggggtttgaataggaaccagatgatgttcactgctgaaattccataatgcttcccattgaagggaagttgagaaccaggaaagctgctttcacgtcattgccatccagtactgacagggaagaaagatgtagttttccagtagtgatgaatcaaattattgaattaaatttcttcttaagaagtaaaaactcagaatgtaccatcttgtttcctttcagtttattaaatggcatcataaagatgactttgctaagttaatagagttaaaaatttttttaatataagccaaaatattaactttaatgaaacattgacttggcaaatgaatttcctataaattatcattggtcagaatgctgttttgtttaataatattacgcaacataaaccataggtgttattagaagtggagaactgcctttttcatctggggcttttaaggacttgctataaatgattattttttaaatgctttataaatcttcatggtttttctatttctgatacactcagctatagttaataccagagtatcctaccaggagtaatatttggaatatttaaatctagtaaaagaagaaagttgtacttcctggctgggagtattaggagatgggagtagagattcacttttaagttcttgaaaatatatgcattctcctaaatattaacaaaaatgatttggggaaatgacatggcttgattgttctgtttaaatttgtactgtggcttatgttacacatgttcatgttcacctctcattcacctgttttatatggtttaaaattctctttaacaaaattcagaaaattcacctgaaacgtattttgacctaaaagaaacatatttttgtatcagtattgaattttggacagtgcccccatataaggaagttactgttttaaaataaagcaaactaactgttttattttccttggaaaaaaaaaaattcc

SEQ ID NO: 278885 - DNA, 2860 bp, Homo sapiens
ccgactgtgactctcagcagccggcttgcggagcggttgccgcgtcctctgccgagcttcttgtgcccgcctccgagcctgaggaaacagctgattgatcagcctggctcaggcttggggcggggattggctgattggcagcaacgccattcgggacagccaagctagaagcctgaggagccggagagggtgctggctgccgcgcggccgagtgtgttttatggaccatgtgctgctatgtatgcctgaagaagtacttgaaatgcaaatttggggagactttgccatataaatgcttggctggattaagcgcctaattaggatggtttttcaacaagttggagtaagcatgcaatcggtactttggtctaggaagccatatggttcgtctcgaagtatcgtaaggaaaattggtactaatttgtctctgattcagtgtccaagagttcagtttcagctgtagtaggacaggaccttgctgggaaccttcaattaacagccatgcaacagaatggagtcccagccacccaggagaggatgcagtggcgtcttttgctgatgttggatgggtagccaaagaagaaggagagtgttcagcaagactaaggacagaggtcagatcaaggccaccccttcaggatgaccttcttttctttgagaaggccccaagcagacagatttccttaccagacttgtctcaagaagagcctcagctgaagaccccagcgctggcaaatgaggaagcactgcagaagatttgcgctctcgaaaatgaacttgctgctctcagagctcagattgccaaaattgtgacccagcaggagcagcaaaatctcactgcaggtgacttagattctaccacatttggtaccataccaccacaccctccacctcccccaccgcccctgcctccccctgcactggggctccaccaaagtacatctgctgttgatctgattaaagaacgaagagagaaaagagccaatgctggaaagactttggttaagaacaatccaaagaaacctgaaatgccaaatatgctagagatccttaaagagatgaacagtgtaaaacttcggtcagtgaagaggtcagagcaagatgtgaagcccaagccagtggatgctactgaccctgctgccctcatagcagaggctctgaaaaagaaatttgcttatcggtatcgaagtgatagccaagatgaagttgaaaaaggaattccaaagtctgaatcagaggccacctcagagagagtgttgtttgggccacacatgttgaagccaacaggaaaaatgaaggctttaattgaaaatgtatcagactcctaatagacaatgagctgcgaaaagactcctggttcccctgttgatttgtgagggccaagtttgctagtagaaatcgacactgtttagtaaatacctctttagtattcagtggtcttcttttcaggctaattagtggattaagcaataatgaaagcactaagtttggttttgcttttgtgagatggtcagctttggtgctctccacaacatgtgtgttctgacatgtttctaatatgtggccagggcgttcagatttccagttttgaaaacaattgtatagatttcacaacacaaaaaggacatttgtggatgttactgcacattttaaattcttaacactaatttatctgtataagtgttttatatgcatatttttggacataaacagtttatgtaaaattagtaatgaatgatggcaacgagggcactgttatcttcgtttgttttcaatgatcatttagcattcaatgatggaacagctggtataacataagttgttggcatgaaatatttgagattggaaacttcttgccttgaacagaacttatatcttagattctctctcacattttcttggagctggggtttgaataggaaccagatgatgttcactgctgaaattccataatgcttcccattgaagggaagttgagaaccaggaaagctgctttcacgtcattgccatccagtactgacagggaagaaagatgtagttttccagtagtgatgaatcaaattattgaattaaatttcttcttaagaagtaaaaactcagaatgtaccatcttgtttcctttcagtttattaaatggcatcataaagatgactttgctaagttaatagagttaaaaatttttttaatataagccaaaatattaactttaatgaaacattgacttggcaaatgaatttcctataaattatcattggtcagaatgctgttttgtttaataatattacgcaacataaaccataggtgttattagaagtggagaactgcctttttcatctggggcttttaaggacttgctataaatgattattttttaaatgctttataaatcttcatggtttttctatttctgatacactcagctatagttaataccagagtatcctaccaggagtaatatttggaatatttaaatctagtaaaagaagaaagttgtacttcctggctgggagtattaggagatgggagtagagattcacttttaagttcttgaaaatatatgcattctcctaaatattaacaaaaatgatttggggaaatgacatggcttgattgttctgtttaaatttgtactgtggcttatgttacacatgttcatgttcacctctcattcacctgttttatatggtttaaaattctctttaacaaaattcagaaaattcacctgaaacgtattttgacctaaaagaaacatatttttgtatcagtattgaattttggacagtgcccccatataaggaagttactgttttaaaataaagcaaactaactgttttattttccttggaaaaaaaaaaattcc

SEQ ID NO: 278886 - DNA, 2441 bp, Homo sapiens
ccgactgtgactctcagcagccggcttgcggagcggttgccgcgtcctctgccgagcttcttgtgcccgcctccgagcctgaggaaacagctgattgatcagcctggctcaggcttggggcggggattggctgattggcagcaacgccattcgggacagccaagctagaagcctgaggagccggagagggtgctggctgccgcgcggccgagtgtgttttatggaccatgtgctgctatgtatgcctgaagaagtacttgaaatgcaaatttggggagactttgccatataaatgcttggctggattaagcgcctaattaggatggtttttcaacaagttggagtaagcatgcaatcggtactttggtctaggaagccatatggttcgtctcgaagtatcgtaaggaaaattggtactaatttgtctctgattcagtgtccaagagttcagtttcagattaacagccatgcaacagaatggagtcccagcctccccctgcactggggctccaccaaagtacatctgctgttgatctgattaaagaacgaagagagaaaagagccaatgctggaaagactttggttaagaacaatccaaagaaacctgaaatgccaaatatgctagagatccttaaagagatgaacagtgtaaaacttcggtcagtgaagaggtcagagcaagatgtgaagcccaagccagtggatgctactgaccctgctgccctcatagcagaggctctgaaaaagaaatttgcttatcggtatcgaagtgatagccaagatgaagttgaaaaaggaattccaaagtctgaatcagaggccacctcagagagagtgttgtttgggccacacatgttgaagccaacaggaaaaatgaaggctttaattgaaaatgtatcagactcctaatagacaatgagctgcgaaaagactcctggttcccctgttgatttgtgagggccaagtttgctagtagaaatcgacactgtttagtaaatacctctttagtattcagtggtcttcttttcaggctaattagtggattaagcaataatgaaagcactaagtttggttttgcttttgtgagatggtcagctttggtgctctccacaacatgtgtgttctgacatgtttctaatatgtggccagggcgttcagatttccagttttgaaaacaattgtatagatttcacaacacaaaaaggacatttgtggatgttactgcacattttaaattcttaacactaatttatctgtataagtgttttatatgcatatttttggacataaacagtttatgtaaaattagtaatgaatgatggcaacgagggcactgttatcttcgtttgttttcaatgatcatttagcattcaatgatggaacagctggtataacataagttgttggcatgaaatatttgagattggaaacttcttgccttgaacagaacttatatcttagattctctctcacattttcttggagctggggtttgaataggaaccagatgatgttcactgctgaaattccataatgcttcccattgaagggaagttgagaaccaggaaagctgctttcacgtcattgccatccagtactgacagggaagaaagatgtagttttccagtagtgatgaatcaaattattgaattaaatttcttcttaagaagtaaaaactcagaatgtaccatcttgtttcctttcagtttattaaatggcatcataaagatgactttgctaagttaatagagttaaaaatttttttaatataagccaaaatattaactttaatgaaacattgacttggcaaatgaatttcctataaattatcattggtcagaatgctgttttgtttaataatattacgcaacataaaccataggtgttattagaagtggagaactgcctttttcatctggggcttttaaggacttgctataaatgattattttttaaatgctttataaatcttcatggtttttctatttctgatacactcagctatagttaataccagagtatcctaccaggagtaatatttggaatatttaaatctagtaaaagaagaaagttgtacttcctggctgggagtattaggagatgggagtagagattcacttttaagttcttgaaaatatatgcattctcctaaatattaacaaaaatgatttggggaaatgacatggcttgattgttctgtttaaatttgtactgtggcttatgttacacatgttcatgttcacctctcattcacctgttttatatggtttaaaattctctttaacaaaattcagaaaattcacctgaaacgtattttgacctaaaagaaacatatttttgtatcagtattgaattttggacagtgcccccatataaggaagttactgttttaaaataaagcaaactaactgttttattttccttggaaaaaaaaaaattcc

SEQ ID NO: 278887 - DNA, 1744 bp, Homo sapiens
ccgactgtgactctcagcagccggcttgcggagcggttgccgcgtcctctgccgagcttcttgtgcccgcctccgagcctgaggaaacagctgattgatcagcctggctcaggcttggggcggggattggctgattggcagcaacgccattcgggacagccaagctagaagcctgaggagccggagagggtgctggctgccgcgcggccgagtgtgttttatggaccatgtgctgctatgtatgcctgaagaagtacttgaaatgcaaatttggggagactttgccatataaatgcttggctggattaagcgcctaattaggatggtttttcaacaagttggagtaagcatgcaatcggtactttggtctaggaagccatatggttcgtctcgaagtatcgtaaggaaaattggtactaatttgtctctgattcagtgtccaagagttcagtttcagattaacagccatgcaacagaatggagtcccagccacccaggagaggatgcagtggcgtcttttgctgatgttggatgggtagccaaagaagaaggagagtgttcagcaagactaaggacagaggtcagatcaaggccaccccttcaggatgaccttcttttctttgagaaggccccaagcagacagatttccttaccagacttgtctcaagaagagcctcagctgaagaccccagcgctggcaaatgaggaagcactgcagaagatttgcgctctcgaaaatgaacttgctgctctcagagctcagattgccaaaattgtgacccagcaggagcagcaaaatctcactgcaggtgacttagattctaccacatttggtaccataccaccacaccctccacctcccccaccgcccctgcctccccctgcactggggctccaccaaagtacatctgctgttgatctgattaaagaacgaagagagaaaagagccaatgctggaaagactttggttaagaacaatccaaagaaacctgaaatgccaaatatgctagagatccttaaagagatgaacagtgtaaaacttcggtcagtgaagaggtcagagcaagatgtgaagcccaagccagtggatgctactgaccctgctgccctcatagcagaggctctgaaaaagaaatttgcttatcggtatcgaagtgatagccaagatgaagttgaaaaaggaattccaaagtctgaatcagaggccacctcagagagagtgttgaaaagactcgttaaagtcagaacctgctggacaagaaggcctatggcaaatcctactgaagataaatttataagccttaagagaataaggactatgacaaaaacaatccaaaccacaataattcatggtaggaaatattgtggcatctacataataaaatggttgaggtccttcttttgttaattttgaggcctataattgctccttaactggtcaggtatcttagatatcagctggctcacaggagaatgtatcttcataatataaacccaaacgttgcttataataaactgtacatataaaaaatcttaaaagaaaagttcaatattgcaatatagatgtctaatttctaggtaaatttagtaaacagaatatgttcaacatggagaaaatcacactccagaaataagttaaaaatatttcaacatctaaaaaaaaattcagcagcacccacagatacagcacatagaagaaattaaaaaattatgaatagttttaataaataacactaatatcata

SEQ ID NO: 278888 - DNA, 1540 bp, Homo sapiens
ccgactgtgactctcagcagccggcttgcggagcggttgccgcgtcctctgccgagcttcttgtgcccgcctccgagcctgaggaaacagctgattgatcagcctggctcaggcttggggcggggattggctgattggcagcaacgccattcgggacagccaagctagaagcctgaggagccggagagggtgctggctgccgcgcggccgagtgtgttttatggaccatgtgctgctatgtatgcctgaagaagtacttgaaatgcaaatttggggagactttgccatataaatgcttggctggattaagcgcctaattaggatggtttttcaacaagttggagtaagcatgcaatcggtactttggtctaggaagccatatggttcgtctcgaagtatcgtaaggaaaattggtactaatttgtctctgattcagtgtccaagagttcagtttcagattaacagccatgcaacagaatggagtcccagccacccaggagaggatgcagtggcgtcttttgctgatgttggatgggtagccaaagaagaaggagagtgttcagcaagactaaggacagaggtcagatcaaggccaccccttcaggatgaccttcttttctttgagaaggccccaagcagacagatttccttaccagacttgtctcaagaagagcctcagctgaagaccccagcgctggcaaatgaggaagcactgcagaagatttgcgctctcgaaaatgaacttgctgctctcagagctcagattgccaaaattgtgacccagcaggagcagcaaaatctcactgcaggtgacttagattctaccacatttggtaccataccaccacaccctccacctcccccaccgcccctgcctccccctgcactggggctccaccaaagtacatctgctgttgatctgattaaagaacgaagagagaaaagagccaatgctggaaagactttggttaagaacaatccaaagaaacctgaaatgccaaatatgctagagatccttaaagagatgaacagtgtaaaacttcggtcagtgaagaggtcagagcaagatgtgaagcccaagccagtggatgctactgaccctgctgccctcatagcagaggctctgaaaaagaaatttgcttatcggtatcgaagtgatagccaagatgaagttgaaaaaggaattccaaagtctgaatcagaggccacctcagagagagtgttgtcccttccagctggctttattcagccccacgtgtccaagcattgtctgggatagccttgtattggaaaacctggcccattctgtaaataaaggctccactaggtaagtcataaaaccttgagaaaataggagaaaaagttattaacatatatgctgaaactctatctttaaaacatcatctatacaacattaaccttcctacatcctactccagtattacccagatcttattcttcaaaagattcctgtgtatgtgtaggtgacagagtctgtaatgtacatatccactttgaagaactgatttcttaagtaact

SEQ ID NO: 278889 - DNA, 3097 bp, Homo sapiens
ggcacgagggccagctgctgtagaagaggggaggaaacaagccagtgcaaggggagcaaaagagaaaaggagccaggctgggcttcctgatcccacagcatcgcagagctcgggaggcacagctcacagacacaggaaacacaggactgctattctgctctcctgcccacggtgatctggtgccagctggtggaacagtgggtgatggcgtccctgctgcaagaccagctgaccactgatcaggacttgctgctgatgcaggaaggcatgccgatgcgcaaggtgaggtccaaaagctggaagaagctaagatacttcagacttcagaatgacggcatgacagtctggcatgcacggcaggccaggggcagtgccaagcccagcttctcaatctctgatgtggagacaatacgtaatggccatgattccgagttgctgcgtagcctggcagaggagctccccctggagcagggcttcaccattgtcttccatggccgccgctccaacctggacctgatggccaacagtgttgaggaggcccagatatggatgcgagggctccagctgttggtggatcttgtcaccagcatggaccatcaggagcgcctggaccaatggctgagcgattggtttcaacgtggagacaaaaatcaggatggtaagatgagtttccaagaagttcagcggttattgcacctaatgaatgtggaaatggaccaagaatatgccttcagtctttttcaggcagcagacacgtcccagtctggaaccctggaaggagaagaattcgtacagttctataaggcattgactaaacgtgctgaggtgcaggaactgtttgaaagtttttcagctgatgggcagaagctgactctgctggaatttttggatttcctccaagaggagcagaaggagagagactgcacctctgagcttgctctggaactcattgaccgctatgaaccttcagacagtggcaaactgcggcatgtgctgagtatggatggcttcctcagctacctctgctctaaggatggagacatcttcaacccagcctgcctccccatctatcaggatatgactcaacccctgaaccactacttcatctgctcttctcataacacctacctagtgggggaccagctttgcggccagagcagcgtcgagggatatatacgggccctgaagcgggggtgccgctgcgtggaggtggatgtatgggatggacctagcggggaacctgtcgtttaccacggacacaccctgacctcccgcatcctgttcaaagatgtcgtggccacagtagcacagtatgccttccagacatcagactacccagtcatcttgtccctggagacccactgcagctgggagcagcagcagaccatggcccgtcatctgactgagatcctgggggagcagctgctgagcaccaccttggatggggtgctgcccactcagctgccctcgcctgaggagcttcggaggaagatcctggtgaaggggaagaagttaacacttgaggaagacctggaatatgaggaagaggaagcagaacctgagttggaagagtcagaattggcgctggagtcccagtttgagactgagcctgagccccaggagcagaaccttcagaataaggacaaaaagaagaaatccaagcccatcttgtgtccagccctctcttccctggttatctacttgaagtctgtctcattccgcagcttcacacattcaaaggagcactaccacttctacgagatatcatctttctctgaaaccaaggccaagcgcctcatcaaggaggctggcaatgagtttgtgcagcacaatacttggcagttaagccgtgtgtatcccagcggcctgaggacagactcttccaactacaacccccaggaactctggaatgcaggctgccagatggtggccatgaatatgcagactgcagggcttgaaatggacatctgtgatgggcatttccgccagaatggcggctgtggctatgtgctgaagccagacttcctgcgtgatatccagagttctttccaccctgagaagcccatcagccctttcaaagcccagactctcttaatccaggtgatcagcggtcagcaactccccaaagtggacaagaccaaagaggggtccattgtggatccactggtgaaagtgcagatctttggcgttcgtctagacacagcacggcaggagaccaactatgtggagaacaatggttttaatccatactgggggcagacactatgtttccgggtgctggtgcctgaacttgccatgctgcgttttgtggtaatggattatgactggaaatcccgaaatgactttattggtcagtacaccctgccttggacctgcatgcaacaaggttaccgccacattcacctgctgtccaaagatggcatcagcctccgcccagcttccatctttgtgtatatctgcatccaggaaggcctggagggggatgagtcctgaggtgggcatttcacgggaagggttggtatgctggctttagacggggagaaacatctggaaggatgctcgagagaacaaatggaggtggtgaaaatcaagctttggattgtgcattcctaggcacaaaattacctcattcttcctaacaagcaatctgggacctgattttccaccttttttctcttttcttcccttcctttgttttcataagcctttggtatctttcctgcccttttcctttgtgtactctatactggagttcccttcttcctcttgctgtaggctcaatcccataccgacatctacaactaatctttcccatcaactctgtgtgaaggcaggttgcaactagaaattcagaggggcttggaatagagaaacctaaagaagcatcatcccctccatccccaacttcctcaaagcccaaagccaagggaaggataaatcaaggctcaaggcttccccagcaaagattagggaaagagacttgaccccaggactgtactacgactcttaagagaacactgcacagcactcaaagtcccccactggactgcttcctccttagccccactggtataaatacatctctctccaatttggc

SEQ ID NO: 278890 - DNA, 3287 bp, Homo sapiens
ggcacgagggccagctgctgtagaagaggggaggaaacaagccagtgcaaggggagcaaaagagaaaaggagccaggctgggcttcctgatcccacagcatcgcagagctcgggaggcacagctcacagacacaggaaacacaggactgctattctgctctcctgcccacggtgatctggtgccagctggtggaacagtgggtgatggcgtccctgctgcaagaccagctgaccactgatcaggacttgctgctgatgcaggaaggcatgccgatgcgcaagtctcaatctctgatgtggagacaatacgtaatggccatgattccgagttgctgcgtagcctggcagaggagctccccctggagcagggcttcaccattgtcttccatggccgccgctccaacctggacctgatggccaacagtgttgaggaggcccagatatggatgcgagggctccagctgttggtggatcttgtcaccagcatggaccatcaggagcgcctggaccagtatcggcaggatggagtcagggtgggggtgagggatcacgctatccctgaaggagccagatgcaacaggtttaggaaaggcagcagacacgtcccagtctggaaccctggaaggagaagaattcgtacagttctataaggcattgactaaacgtgctgaggtgcaggaactgtttgaaagtttttcagctgatgggcagaagctgactctgctggaatttttggatttcctccaagaggagcagaaggagagagactgcacctctgagcttgctctggaactcattgaccgctatgaaccttcagacagtggcaaactgcggcatgtgctgagtatggatggcttcctcagctacctctgctctaaggatggagacatcttcaacccagcctgcctccccatctatcaggatatgactcaacccctgaaccactacttcatctgctcttctcataacacctacctagtgggggaccagctttgcggccagagcagcgtcgagggatatatacgggccctgaagcgggggtgccgctgcgtggaggtggatgtatgggatggacctagcggggaacctgtcgtttaccacggacacaccctgacctcccgcatcctgttcaaagatgtcgtggccacagtagcacagtatgccttccagacatcagactacccagtcatcttgtccctggagacccactgcagctgggagcagcagcagaccatggcccgtcatctgactgagatcctgggggagcagctgctgagcaccaccttggatggggtgctgcccactcagctgccctcgcctgaggagcttcggaggaagatcctggtgaaggggaagaagttaacacttgaggaagacctggaatatgaggaagaggaagcagaacctgagttggaagagtcagaattggcgctggagtcccagtttgagactgagcctgagccccaggagcagaaccttcagaataaggacaaaaagaagaaatccaagcccatcttgtgtccagccctctcttccctggttatctacttgaagtctgtctcattccgcagcttcacacattcaaaggagcactaccacttctacgagatatcatctttctctgaaaccaaggccaagcgcctcatcaaggaggctggtcaggaccaaaatggagggatggggagggaagtgggatggataggttcaggcctgatggactggcaggtaagtcccaagaaaaaagacaaggtagctaaggagagatgaaggagttcagaaactccttagagcagacaagggcagaggagttatgaatagtggctcaagggtctaggggcaggaaagctggtctggatggacagagtagagaggcacagtgaaactttctggagccagcttcagatgctggagagaagggtgaagagtaggcagggtccttgggactagggaagtgggagattccaccccacttccatctccctctctatacccttttacaggcaatgagtttgtgcagcacaatacttggcagttaagccgtgtgtatcccagcggcctgaggacagactcttccaactacaacccccaggaactctggaatgcaggctgccagatggtggccatgaatatgcagactgcagggcttgaaatggacatctgtgatgggcatttccgccagaatggcggctgtggctatgtgctgaagccagacttcctgcgtgatatccagagttctttccaccctgagaagcccatcagccctttcaaagcccagactctcttaatccaggtgatcagcggtcagcaactccccaaagtggacaagaccaaagaggggtccattgtggatccactggtgaaagtgcagatctttggcgttcgtctagacacagcacggcaggagaccaactatgtggagaacaatggttttaatccatactgggggcagacactatgtttccgggtgctggtgcctgaacttgccatgctgcgttttgtggtaatggattatgactggaaatcccgaaatgactttattggtcagtacaccctgccttggacctgcatgcaacaaggttaccgccacattcacctgctgtccaaagatggcatcagcctccgcccagcttccatctttgtgtatatctgcatccaggaaggcctggagggggatgagtcctgaggtgggcatttcacgggaagggttggtatgctggctttagacggggagaaacatctggaaggatgctcgagagaacaaatggaggtggtgaaaatcaagctttggattgtgcattcctaggcacaaaattacctcattcttcctaacaagcaatctgggacctgattttccaccttttttctcttttcttcccttcctttgttttcataagcctttggtatctttcctgcccttttcctttgtgtactctatactggagttcccttcttcctcttgctgtaggctcaatcccataccgacatctacaactaatctttcccatcaactctgtgtgaaggcaggttgcaactagaaattcagaggggcttggaatagagaaacctaaagaagcatcatcccctccatccccaacttcctcaaagcccaaagccaagggaaggataaatcaaggctcaaggcttccccagcaaagattagggaaagagacttgaccccaggactgtactacgactcttaagagaacactgcacagcactcaaagtcccccactggactgcttcctccttagccccactggtataaatacatctctctccaatttggc

SEQ ID NO: 278891 - DNA, 3676 bp, Homo sapiens
ggcacgagggccagctgctgtagaagaggggaggaaacaagccagtgcaaggggagcaaaagagaaaaggagccaggctgggcttcctgatcccacagcatcgcagagctcgggaggcacagctcacagacacaggaaacacaggactgctattctgctctcctgcccacggtgatctggtgccagctggtggaacagtgggtgatggcgtccctgctgcaagaccagctgaccactgatcaggacttgctgctgatgcaggaaggcatgccgatgcgcaaggtgaggtccaaaagctggaagaagctaagatacttcagacttcagaatgacggcatgacagtctggcatgcacggcaggccaggggcagtgccaagcccagcttctcaatctctgatgtggagacaatacgtaatggccatgattccgagttgctgcgtagcctggcagaggagctccccctggagcagggcttcaccattgtcttccatggccgccgctccaacctggacctgatggccaacagtgttgaggaggcccagatatggatgcgagggctccagctgttggtggatcttgtcaccagcatggaccatcaggagcgcctggaccaatggctgagcgattggtttcaacgtggagacaaaaatcaggatggtaagatgagtttccaagaagttcagcggttattgcacctaatgaatgtggaaatggaccaagaatatgccttcagtctttttcaggcagcagacacgtcccagtctggaaccctggaaggagaagaattcgtacagttctataaggcattgactaaacgtgctgaggtgcaggaactgtttgaaagtttttcagctgatgggcagaagctgactctgctggaatttttggatttcctccaagaggagcagaaggagagagactgcacctctgagcttgctctggaactcattgaccgctatgaaccttcagacagtggcaaactgcggcatgtgctgagtatggatggcttcctcagctacctctgctctaaggatggagacatcttcaacccagcctgcctccccatctatcaggatatgactcaacccctgaaccactacttcatctgctcttctcataacacctacctagtgggggaccagctttgcggccagagcagcgtcgagggatatatacgggccctgaagcgggggtgccgctgcgtggaggtggatgtatgggatggacctagcggggaacctgtcgtttaccacggacacaccctgacctcccgcatcctgttcaaagatgtcgtggccacagtagcacagtatgccttccagacatcagactacccagtcatcttgtccctggagacccactgcagctgggagcagcagcagaccatggcccgtcatctgactgagatcctgggggagcagctgctgagcaccaccttggatggggtgctgcccactcagctgccctcgcctgaggagcttcggaggaagatcctggtgaaggggaagaagttaacacttgaggaagacctggaatatgaggaagaggaagcagaacctgagttggaagagtcagaattggcgctggagtcccagtttgagactgagcctgagccccaggagcagaaccttcagaataaggacaaaaagaagaaatccaagcccatcttgtgtccagccctctcttccctggttatctacttgaagtctgtctcattccgcagcttcacacattcaaaggagcactaccacttctacgagatatcatctttctctgaaaccaaggccaagcgcctcatcaaggaggctggtcaggaccaaaatggagggatggggagggaagtgggatggataggttcaggcctgatggactggcaggtaagtcccaagaaaaaagacaaggtagctaaggagagatgaaggagttcagaaactccttagagcagacaagggcagaggagttatgaatagtggctcaagggtctaggggcaggaaagctggtctggatggacagagtagagaggcacagtgaaactttctggagccagcttcagatgctggagagaagggtgaagagtaggcagggtccttgggactagggaagtgggagattccaccccacttccatctccctctctatacccttttacaggcaatgagtttgtgcagcacaatacttggcagttaagccgtgtgtatcccagcggcctgaggacagactcttccaactacaacccccaggaactctggaatgcaggctgccagatgggtgaggaggcagcagggactgggaagagggagtggaggagcagcaggtgggaaataagttctctagtgatggtagggttggggaatgctcaagaaaattgctaggctgagaaatgctatcagtggatattaccagcaggtaccgtgcacccagtacctatcttcttaactccctgaaagaggggctggaaggcctccatggtgaatcttgctcttcttttctcctggggccctcagtggccatgaatatgcagactgcagggcttgaaatggacatctgtgatgggcatttccgccagaatggcggctgtggctatgtgctgaagccagacttcctgcgtgatatccagagttctttccaccctgagaagcccatcagccctttcaaagcccagactctcttaatccaggtgatcagcggtcagcaactccccaaagtggacaagaccaaagaggggtccattgtggatccactggtgaaagtgcagatctttggcgttcgtctagacacagcacggcaggagaccaactatgtggagaacaatggttttaatccatactgggggcagacactatgtttccgggtgctggtgcctgaacttgccatgctgcgttttgtggtaatggattatgactggaaatcccgaaatgactttattggtcagtacaccctgccttggacctgcatgcaacaaggttaccgccacattcacctgctgtccaaagatggcatcagcctccgcccagcttccatctttgtgtatatctgcatccaggaaggcctggagggggatgagtcctgaggtgggcatttcacgggaagggttggtatgctggctttagacggggagaaacatctggaaggatgctcgagagaacaaatggaggtggtgaaaatcaagctttggattgtgcattcctaggcacaaaattacctcattcttcctaacaagcaatctgggacctgattttccaccttttttctcttttcttcccttcctttgttttcataagcctttggtatctttcctgcccttttcctttgtgtactctatactggagttcccttcttcctcttgctgtaggctcaatcccataccgacatctacaactaatctttcccatcaactctgtgtgaaggcaggttgcaactagaaattcagaggggcttggaatagagaaacctaaagaagcatcatcccctccatccccaacttcctcaaagcccaaagccaagggaaggataaatcaaggctcaaggcttccccagcaaagattagggaaagagacttgaccccaggactgtactacgactcttaagagaacactgcacagcactcaaagtcccccactggactgcttcctccttagccccactggtataaatacatctctctccaatttggc

SEQ ID NO: 278892 - DNA, 3754 bp, Homo sapiens
ggcacgagggccagctgctgtagaagaggggaggaaacaagccagtgcaaggggagcaaaagagaaaaggagccaggctgggcttcctgatcccacagcatcgcagagctcgggaggcacagctcacagacacaggaaacacaggactgctattctgctctcctgcccacggtgatctggtgccagctggtggaacagtgggtgatggcgtccctgctgcaagaccagctgaccactgatcaggacttgctgctgatgcaggaaggcatgccgatgcgcaaggtgaggtccaaaagctggaagaagctaagatacttcagacttcagaatgacggcatgacagtctggcatgcacggcaggccaggggcagtgccaagcccagcttctcaatctctgatgtggagacaatacgtaatggccatgattccgagttgctgcgtagcctggcagaggagctccccctggagcagggcttcaccattgtcttccatggccgccgctccaacctggacctgatggccaacagtgttgaggaggcccagatatggatgcgagggctccagctgttggtggatcttgtcaccagcatggaccatcaggagcgcctggaccaatggctgagcgattggtttcaacgtggagacaaaaatcaggatggtaagatgagtttccaagaagttcagcggttattgcacctaatgaatgtggaaatggaccaagaatatgccttcagtctttttcaggcagcagacacgtcccagtctggaaccctggaaggagaagaattcgtacagttctataaggcattgactaaacgtgctgaggtgcaggaactgtttgaaagtttttcagctgatgggcagaagctgactctgctggaatttttggatttcctccaagaggagcagaaggagagagactgcacctctgagcttgctctggaactcattgaccgctatgaaccttcagacagtggcaaactgcggcatgtgctgagtatggatggcttcctcagctacctctgctctaaggatggagacatcttcaacccagcctgcctccccatctatcaggatatgactcaacccctgaaccactacttcatctgctcttctcataacacctacctagtgggggaccagctttgcggccagagcagcgtcgagggatatatacgggccctgaagcgggggtgccgctgcgtggaggtggatgtatgggatggacctagcggggaacctgtcgtttaccacggacacaccctgacctcccgcatcctgttcaaagatgtcgtggccacagtagcacagtatgccttccagacatcagactacccagtcatcttgtccctggagacccactgcagctgggagcagcagcagaccatggcccgtcatctgactgagatcctgggggagcagctgctgagcaccaccttggatggggtgctgcccactcagctgccctcgcctgaggagcttcggaggaagatcctggtgaaggggaagaagttaacacttgaggaagacctggaatatgaggaagaggaagcagaacctgagttggaagagtcagaattggcgctggagtcccagtttgagactgagcctgagccccaggagcagaaccttcagaataaggacaaaaagaagaaatccaagcccatcttgtgtccagccctctcttccctggttatctacttgaagtctgtctcattccgcagcttcacacattcaaaggagcactaccacttctacgagatatcatctttctctgaaaccaaggccaagcgcctcatcaaggaggctggtcaggaccaaaatggagggatggggagggaagtgggatggataggttcaggcctgatggactggcaggtaagtcccaagaaaaaagacaaggtagctaaggagagatgaaggagttcagaaactccttagagcagacaagggcagaggagttatgaatagtggctcaagggtctaggggcaggaaagctggtctggatggacagagtagagaggcacagtgaaactttctggagccagcttcagatgctggagagaagggtgaagagtaggcagggtccttgggactagggaagtgggagattccaccccacttccatctccctctctatacccttttacaggcaatgagtttgtgcagcacaatacttggcagttaagccgtgtgtatcccagcggcctgaggacagactcttccaactacaacccccaggaactctggaatgcaggctgccagatgggtgaggaggcagcagggactgggaagagggagtggaggagcagcaggtgggaaataagttctctagtgatggtagggttggggaatgctcaagaaaattgctaggctgagaaatgctatcagtggatattaccagcaggtaccgtgcacccagtacctatcttcttaactccctgaaagaggggctggaaggcctccatggtgaatcttgctcttcttttctcctggggccctcagtggccatgaatatgcagactgcagggcttgaaatggacatctgtgatgggcatttccgccagaatggcggctgtggctatgtgctgaagccagacttcctgcgtgatatccagagttctttccaccctgagaagcccatcagccctttcaaagcccagactctcttaatccaggtgatcagcggtcagcaactccccaaagtggacaagaccaaagaggggtccattgtggatccactggtgaaagtgcagatctttggcgttcgtctagacacagcacggcaggagaccaactatgtggagaacaatggttttaatccatactgggggcagacactatgtttccgggtgctggtgcctgaacttgccatgctgcgttttgtggtaatggattatgactggaaatcccgaaatgactttattggtcagtacaccctgccttggacctgcatgcaacaaggtgagccagcccctttgacccctggccaataccccagctctggctgccttcctaatgctgtcctcctgccccttccaggttaccgccacattcacctgctgtccaaagatggcatcagcctccgcccagcttccatctttgtgtatatctgcatccaggaaggcctggagggggatgagtcctgaggtgggcatttcacgggaagggttggtatgctggctttagacggggagaaacatctggaaggatgctcgagagaacaaatggaggtggtgaaaatcaagctttggattgtgcattcctaggcacaaaattacctcattcttcctaacaagcaatctgggacctgattttccaccttttttctcttttcttcccttcctttgttttcataagcctttggtatctttcctgcccttttcctttgtgtactctatactggagttcccttcttcctcttgctgtaggctcaatcccataccgacatctacaactaatctttcccatcaactctgtgtgaaggcaggttgcaactagaaattcagaggggcttggaatagagaaacctaaagaagcatcatcccctccatccccaacttcctcaaagcccaaagccaagggaaggataaatcaaggctcaaggcttccccagcaaagattagggaaagagacttgaccccaggactgtactacgactcttaagagaacactgcacagcactcaaagtcccccactggactgcttcctccttagccccactggtataaatacatctctctccaatttggc

SEQ ID NO: 278893 - DNA, 3845 bp, Homo sapiens
ggcacgagggccagctgctgtagaagaggggaggaaacaagccagtgcaaggggagcaaaagagaaaaggagccaggctgggcttcctgatcccacagcatcgcagagctcgggaggcacagctcacagacacaggaaacacaggactgctattctgctctcctgcccacggtgatctggtgccagctggtggaacagtgggtgatggcgtccctgctgcaagaccagctgaccactgatcaggacttgctgctgatgcaggaaggcatgccgatgcgcaaggtgaggtccaaaagctggaagaagctaagatacttcagacttcagaatgacggcatgacagtctggcatgcacggcaggccaggggcagtgccaagcccagcttctcaatctctgatgtggagacaatacgtaatggccatgattccgagttgctgcgtagcctggcagaggagctccccctggagcagggcttcaccattgtcttccatggccgccgctccaacctggacctgatggccaacagtgttgaggaggcccagatatggatgcgagggctccagctgttggtggatcttgtcaccagcatggaccatcaggagcgcctggaccaatggctgagcgattggtttcaacgtggagacaaaaatcaggatggtaagatgagtttccaagaagttcagcggttattgcacctaatgaatgtggaaatggaccaagaatatgccttcagtctttttcaggcagcagacacgtcccagtctggaaccctggaaggagaagaattcgtacagttctataaggcattgactaaacgtgctgaggtgcaggaactgtttgaaagtttttcagctgatgggcagaagctgactctgctggaatttttggatttcctccaagaggagcagaaggagagagactgcacctctgagcttgctctggaactcattgaccgctatgaaccttcagacagtggcaaactgcggcatgtgctgagtatggatggcttcctcagctacctctgctctaaggatggagacatcttcaacccagcctgcctccccatctatcaggatatgactcaacccctgaaccactacttcatctgctcttctcataacacctacctagtgggggaccagctttgcggccagagcagcgtcgagggatatatacgggccctgaagcgggggtgccgctgcgtggaggtggatgtatgggatggacctagcggggaacctgtcgtttaccacggacacaccctgacctcccgcatcctgttcaaagatgtcgtggccacagtagcacagtatgccttccagacatcagactacccagtcatcttgtccctggagacccactgcagctgggagcagcagcagaccatggcccgtcatctgactgagatcctgggggagcagctgctgagcaccaccttggatggggtgctgcccactcagctgccctcgcctgaggagcttcggaggaagatcctggtgaaggggaagaagttaacacttgaggaagacctggaatatgaggaagaggaagcagaacctgagttggaagagtcagaattggcgctggagtcccagtttgagactgagcctgagccccaggagcagaaccttcagaataaggacaaaaagaagaaatccaagcccatcttgtgtccagccctctcttccctggttatctacttgaagtctgtctcattccgcagcttcacacattcaaaggagcactaccacttctacgagatatcatctttctctgaaaccaaggccaagcgcctcatcaaggaggctggtcaggaccaaaatggagggatggggagggaagtgggatggataggttcaggcctgatggactggcaggtaagtcccaagaaaaaagacaaggtagctaaggagagatgaaggagttcagaaactccttagagcagacaagggcagaggagttatgaatagtggctcaagggtctaggggcaggaaagctggtctggatggacagagtagagaggcacagtgaaactttctggagccagcttcagatgctggagagaagggtgaagagtaggcagggtccttgggactagggaagtgggagattccaccccacttccatctccctctctatacccttttacaggcaatgagtttgtgcagcacaatacttggcagttaagccgtgtgtatcccagcggcctgaggacagactcttccaactacaacccccaggaactctggaatgcaggctgccagatgggtgaggaggcagcagggactgggaagagggagtggaggagcagcaggtgggaaataagttctctagtgatggtagggttggggaatgctcaagaaaattgctaggctgagaaatgctatcagtggatattaccagcaggtaccgtgcacccagtacctatcttcttaactccctgaaagaggggctggaaggcctccatggtgaatcttgctcttcttttctcctggggccctcagtggccatgaatatgcagactgcagggcttgaaatggacatctgtgatgggcatttccgccagaatggcggctgtggctatgtgctgaagccagacttcctgcgtgatatccagagttctttccaccctgagaagcccatcagccctttcaaagcccagactctcttaatccaggtgatcagcggtcagcaactccccaaagtggacaagaccaaagaggggtccattgtggatccactggtgaaagtgcagatctttggcgttcgtctagacacagcacggcaggagaccaactatgtggagaacaatggttttaatccatactgggggcagacactatgtttccgggtgctggtgcctgaacttgccatgctgcgttttgtggtaatggattatgactggaaatcccgaaatgactttattggtcagtacaccctgccttggacctgcatgcaacaaggttaccgccacattcacctgctgtccaaagatggcatcagcctccgcccagcttccatctttgtgtatatctgcatccaggaaggcctggagggggatgagtcctgaggtgggcatttcacgggaagggttggtatgctggctttagacggggagaaacatctggaaggatgctcgagagaacaaatggaggtggtgaaaatcaagctttggattgtgcattcctaggcacaaaattacctcattcttcctaacaagcaatctgggacctgattttccaccttttttctcttttcttcccttcctttgttttcataagcctttggtatctttcctgcccttttcctttgtgtactctatactggagttcccttcttcctcttgctgtaggctcaatcccataccgacatctacaactaatctttcccatcaactctgtgtgaaggcaggttgcaactagaaattcagaggggcttggaatagagaaacctaaagaagcatcatcccctccatccccaacttcctcaaagcccaaagccaagggaaggataaatcaaggctcaaggcttccccagcaaagattagggaaagagacttgaccccaggactgtactacgactcttaagagaacactgcacagcactcaaagtcccccactggactgcttcctccttagccccactggtataaatacatctctctccaatttggcttcaatatggtctgtcattgttgggcaagaaggggaggtacaagggttgtggggacatctgggtagtcaggtgagacaaggaaaaggtagagaaagaggttcccaggagacctcttgcatgtgctacataggaaggacacagagtatggcttttaagaatcagggcaaa

SEQ ID NO: 278894 - DNA, 2372 bp, Homo sapiens
tctgtttaaatataataataaatttaaaacctgtcacccaggatataacatagagcaaacacaagcccagaggttgacactgatcccagcagtacatgcagaccgcctttattcccattcccacccccaggttgtgacgtgcccgctgttttgtccgtctatctgttgtcagattgtggcccaggctcctatttccaagcctgagtcccttctcttgtcccggcaggtgaggcaggagggagaatacagtggggaggcagtgggcagaggtttaggttggatggccattatcttcttctctctcagactgctgagggttcaattccatcttcttttccaccttctccagaaatccaagcccatcttgtgtccagccctctcttccctggttatctacttgaagtctgtctcattccgcagcttcacacattcaaaggagcactaccacttctacgagatatcatctttctctgaaaccaaggccaagcgcctcatcaaggaggctggtcaggaccaaaatggagggatggggagggaagtgggatggataggttcaggcctgatggactggcaggtaagtcccaagaaaaaagacaaggtagctaaggagagatgaaggagttcagaaactccttagagcagacaagggcagaggagttatgaatagtggctcaagggtctaggggcaggaaagctggtctggatggacagagtagagaggcacagtgaaactttctggagccagcttcagatgctggagagaagggtgaagagtaggcagggtccttgggactagggaagtgggagattccaccccacttccatctccctctctatacccttttacaggcaatgagtttgtgcagcacaatacttggcagttaagccgtgtgtatcccagcggcctgaggacagactcttccaactacaacccccaggaactctggaatgcaggctgccagatgggtgaggaggcagcagggactgggaagagggagtggaggagcagcaggtgggaaataagttctctagtgatggtagggttggggaatgctcaagaaaattgctaggctgagaaatgctatcagtggatattaccagcaggtaccgtgcacccagtacctatcttcttaactccctgaaagaggggctggaaggcctccatggtgaatcttgctcttcttttctcctggggccctcagtggccatgaatatgcagactgcagggcttgaaatggacatctgtgatgggcatttccgccagaatggcggctgtggctatgtgctgaagccagacttcctgcgtgatatccagagttctttccaccctgagaagcccatcagccctttcaaagcccagactctcttaatccaggtgatcagcggtcagcaactccccaaagtggacaagaccaaagaggggtccattgtggatccactggtgaaagtgcagatctttggcgttcgtctagacacagcacggcaggagaccaactatgtggagaacaatggttttaatccatactgggggcagacactatgtttccgggtgctggtgcctgaacttgccatgctgcgttttgtggtaatggattatgactggaaatcccgaaatgactttattggtcagtacaccctgccttggacctgcatgcaacaaggttaccgccacattcacctgctgtccaaagatggcatcagcctccgcccagcttccatctttgtgtatatctgcatccaggaaggcctggagggggatgagtcctgaggtgggcatttcacgggaagggttggtatgctggctttagacggggagaaacatctggaaggatgctcgagagaacaaatggaggtggtgaaaatcaagctttggattgtgcattcctaggcacaaaattacctcattcttcctaacaagcaatctgggacctgattttccaccttttttctcttttcttcccttcctttgttttcataagcctttggtatctttcctgcccttttcctttgtgtactctatactggagttcccttcttcctcttgctgtaggctcaatcccataccgacatctacaactaatctttcccatcaactctgtgtgaaggcaggttgcaactagaaattcagaggggcttggaatagagaaacctaaagaagcatcatcccctccatccccaacttcctcaaagcccaaagccaagggaaggataaatcaaggctcaaggcttccccagcaaagattagggaaagagacttgaccccaggactgtactacgactcttaagagaacactgcacagcactcaaagtcccccactggactgcttcctccttagccccactggtataaatacatctctctccaatttggc

SEQ ID NO: 278895 - DNA, 3165 bp, Homo sapiens
ggcacgagggccagctgctgtagaagaggggaggaaacaagccagtgcaaggggagcaaaagagaaaaggagccaggctgggcttcctgatcccacagcatcgcagagctcgggaggcacagctcacagacacaggaaacacaggactgctattctgctctcctgcccacggtgatctggtgccagctggtggaacagtgggtgatggcgtccctgctgcaagaccagctgaccactgatcaggacttgctgctgatgcaggaaggcatgccgatgcgcaaggtgaggtccaaaagctggaagaagctaagatacttcagacttcagaatgacggcatgacagtctggcatgcacggcaggccaggggcagtgccaagcccagcttctcaatctctgatgtggagacaatacgtaatggccatgattccgagttgctgcgtagcctggcagaggagctccccctggagcagggcttcaccattgtcttccatggccgccgctccaacctggacctgatggccaacagtgttgaggaggcccagatatggatgcgagggctccagctgttggtggatcttgtcaccagcatggaccatcaggagcgcctggaccaatggctgagcgattggtttcaacgtggagacaaaaatcaggatggtaagatgagtttccaagaagttcagcggttattgcacctaatgaatgtggaaatggaccaagaatatgccttcagtctttttcaggcagcagacacgtcccagtctggaaccctggaaggagaagaattcgtacagttctataaggcattgactaaacgtgctgaggtgcaggaactgtttgaaagtttttcagctgatgggcagaagctgactctgctggaatttttggatttcctccaagaggagcagaaggagagagactgcacctctgagcttgctctggaactcattgaccgctatgaaccttcagacagtggcaaactgcggcatgtgctgagtatggatggcttcctcagctacctctgctctaaggatggagacatcttcaacccagcctgcctccccatctatcaggatatgactcaacccctgaaccactacttcatctgctcttctcataacacctacctagtgggggaccagctttgcggccagagcagcgtcgagggatatatacgggccctgaagcgggggtgccgctgcgtggaggtggatgtatgggatggacctagcggggaacctgtcgtttaccacggacacaccctgacctcccgcatcctgttcaaagatgtcgtggccacagtagcacagtatgccttccagacatcagactacccagtcatcttgtccctggagacccactgcagctgggagcagcagcagaccatggcccgtcatctgactgagatcctgggggagcagctgctgagcaccaccttggatggggtgctgcccactcagctgccctcgcctgaggagcttcggaggaagatcctggtgaaggggaagaagttaacacttgaggaagacctggaatatgaggaagaggaagcagaacctgagttggaagagtcagaattggcgctggagtcccagtttgagactgagcctgagccccaggagcagaaccttcagaataaggacaaaaagaagaaatccaagcccatcttgtgtccagccctctcttccctggttatctacttgaagtctgtctcattccgcagcttcacacattcaaaggagcactaccacttctacgagatatcatctttctctgaaaccaaggccaagcgcctcatcaaggaggctggtcaggaccaaaatggagggatggggagggaagtgggatggataggttcaggcctgatggactggcaggcaatgagtttgtgcagcacaatacttggcagttaagccgtgtgtatcccagcggcctgaggacagactcttccaactacaacccccaggaactctggaatgcaggctgccagatggtggccatgaatatgcagactgcagggcttgaaatggacatctgtgatgggcatttccgccagaatggcggctgtggctatgtgctgaagccagacttcctgcgtgatatccagagttctttccaccctgagaagcccatcagccctttcaaagcccagactctcttaatccaggtgatcagcggtcagcaactccccaaagtggacaagaccaaagaggggtccattgtggatccactggtgaaagtgcagatctttggcgttcgtctagacacagcacggcaggagaccaactatgtggagaacaatggttttaatccatactgggggcagacactatgtttccgggtgctggtgcctgaacttgccatgctgcgttttgtggtaatggattatgactggaaatcccgaaatgactttattggtcagtacaccctgccttggacctgcatgcaacaaggttaccgccacattcacctgctgtccaaagatggcatcagcctccgcccagcttccatctttgtgtatatctgcatccaggaaggcctggagggggatgagtcctgaggtgggcatttcacgggaagggttggtatgctggctttagacggggagaaacatctggaaggatgctcgagagaacaaatggaggtggtgaaaatcaagctttggattgtgcattcctaggcacaaaattacctcattcttcctaacaagcaatctgggacctgattttccaccttttttctcttttcttcccttcctttgttttcataagcctttggtatctttcctgcccttttcctttgtgtactctatactggagttcccttcttcctcttgctgtaggctcaatcccataccgacatctacaactaatctttcccatcaactctgtgtgaaggcaggttgcaactagaaattcagaggggcttggaatagagaaacctaaagaagcatcatcccctccatccccaacttcctcaaagcccaaagccaagggaaggataaatcaaggctcaaggcttccccagcaaagattagggaaagagacttgaccccaggactgtactacgactcttaagagaacactgcacagcactcaaagtcccccactggactgcttcctccttagccccactggtataaatacatctctctccaatttggc

SEQ ID NO: 278896 - DNA, 3505 bp, Homo sapiens
ggcacgagggccagctgctgtagaagaggggaggaaacaagccagtgcaaggggagcaaaagagaaaaggagccaggctgggcttcctgatcccacagcatcgcagagctcgggaggcacagctcacagacacaggaaacacaggactgctattctgctctcctgcccacggtgatctggtgccagctggtggaacagtgggtgatggcgtccctgctgcaagaccagctgaccactgatcaggacttgctgctgatgcaggaaggcatgccgatgcgcaaggtgaggtccaaaagctggaagaagctaagatacttcagacttcagaatgacggcatgacagtctggcatgcacggcaggccaggggcagtgccaagcccagcttctcaatctctgatgtggagacaatacgtaatggccatgattccgagttgctgcgtagcctggcagaggagctccccctggagcagggcttcaccattgtcttccatggccgccgctccaacctggacctgatggccaacagtgttgaggaggcccagatatggatgcgagggctccagctgttggtggatcttgtcaccagcatggaccatcaggagcgcctggaccaatggctgagcgattggtttcaacgtggagacaaaaatcaggatggtaagatgagtttccaagaagttcagcggttattgcacctaatgaatgtggaaatggaccaagaatatgccttcagtctttttcaggcagcagacacgtcccagtctggaaccctggaaggagaagaattcgtacagttctataaggcattgactaaacgtgctgaggtgcaggaactgtttgaaagtttttcagctgatgggcagaagctgactctgctggaatttttggatttcctccaagaggagcagaaggagagagactgcacctctgagcttgctctggaactcattgaccgctatgaaccttcagacagtggcaaactgcggcatgtgctgagtatggatggcttcctcagctacctctgctctaaggatggagacatcttcaacccagcctgcctccccatctatcaggatatgactcaacccctgaaccactacttcatctgctcttctcataacacctacctagtgggggaccagctttgcggccagagcagcgtcgagggatatatacgggccctgaagcgggggtgccgctgcgtggaggtggatgtatgggatggacctagcggggaacctgtcgtttaccacggacacaccctgacctcccgcatcctgttcaaagatgtcgtggccacagtagcacagtatgccttccagacatcagactacccagtcatcttgtccctggagacccactgcagctgggagcagcagcagaccatggcccgtcatctgactgagatcctgggggagcagctgctgagcaccaccttggatggggtgctgcccactcagctgccctcgcctgaggagcttcggaggaagatcctggtgaaggggaagaagttaacacttgaggaagacctggaatatgaggaagaggaagcagaacctgagttggaagagtcagaattggcgctggagtcccagtttgagactgagcctgagccccaggagcagaaccttcagaataaggacaaaaagaagaaatccaagcccatcttgtgtccagccctctcttccctggttatctacttgaagtctgtctcattccgcagcttcacacattcaaaggagcactaccacttctacgagatatcatctttctctgaaaccaaggccaagcgcctcatcaaggaggctggtcaggaccaaaatggagggatggggagggaagtgggatggataggttcaggcctgatggactggcaggtaagtcccaagaaaaaagacaaggtagctaaggagagatgaaggagttcagaaactccttagagcagacaagggcagaggagttatgaatagtggctcaagggtctaggggcaggaaagctggtctggatggacagagtagagaggcacagtgaaactttctggagccagcttcagatgctggagagaagggtgaagagtaggcagggtccttgggactagggaagtgggagattccaccccacttccatctccctctctatacccttttacaggcaatgagtttgtgcagcacaatacttggcagttaagccgtgtgtatcccagcggcctgaggacagactcttccaactacaacccccaggaactctggaatgcaggctgccagatgggtgaggaggcagcagggactgggaagagggagtggaggagcagcaggtgggaaataagttctctagtgatggtagggttggggaatgctcaagaaaattgctaggctgagaaatgctatcagtggatattaccagcaggtaccgtgcacccagtacctatcttcttaactccctgaaagaggggctggaaggcctccatggtgaatcttgctcttcttttctcctggggccctcagtggccatgaatatgcagactgcagggcttgaaatggacatctgtgatgggcatttccgccagaatggcggctgtggctatgtgctgaagccagacttcctgcgtgatatccagagttctttccaccctgagaagcccatcagccctttcaaagcccagactctcttaatccaggtgatcagcggtcagcaactccccaaagtggacaagaccaaagaggggtccattgtggatccactggtgaaagtgcagatctttggcgttcgtctagacacagcacggcaggagaccaactatgtggagaacaatggttttaatccatactgggggcagacactatgtttccgggtgctggtgcctgaacttgccatgctgcgttttgtggtaatggattatgactggaaatcccgaaatgactttattggtcagtacaccctgccttggacctgcatgcaacaaggttaccgccacattcacctgctgtccaaagatggcatcagcctccgcccagcttccatctttgtgtatatctgcatccaggaaggcctggagggggatgagtcctgaggttgcaactagaaattcagaggggcttggaatagagaaacctaaagaagcatcatcccctccatccccaacttcctcaaagcccaaagccaagggaaggataaatcaaggctcaaggcttccccagcaaagattagggaaagagacttgaccccaggactgtactacgactcttaagagaacactgcacagcactcaaagtcccccactggactgcttcctccttagccccactggtataaatacatctctctccaatttggcttcaatatggtctgtcattgttgggcaagaaggggaggtacaagggttgtggggacatctgggtagtcaggtgagacaaggaaaaggtagagaaagaggttcccaggagacctcttgcatgtgctacataggaaggacacagagtatggcttttaagaatcagggcaaa

SEQ ID NO: 278897 - DNA, 1171 bp, Homo sapiens
caaaccaaaaagcttcttctcccctggggttgggagtagggtcgggtggggctgggctgagcaggaacttgtgagattccagagccctgactacaggtgatcagcggtcagcaactccccaaagtggacaagaccaaagaggggtccattgtggatccactggtgaaagtgcagatctttggcgttcgtctagacacagcacggcaggagaccaactatgtggagaacaatggttttaatccatactgggggcagacactatgtttccgggtgctggtgcctgaacttgccatgctgcgttttgtggtaatggattatgactggaaatcccgaaatgactttattggtcagtacaccctgccttggacctgcatgcaacaaggtgagccagcccctttgacccctggccaataccccagctctggctgccttcctaatgctgtcctcctgccccttccaggttaccgccacattcacctgctgtccaaagatggcatcagcctccgcccagcttccatctttgtgtatatctgcatccaggaaggcctggagggggatgagtcctgaggtgggcatttcacgggaagggttggtatgctggctttagacggggagaaacatctggaaggatgctcgagagaacaaatggaggtggtgaaaatcaagctttggattgtgcattcctaggcacaaaattacctcattcttcctaacaagcaatctgggacctgattttccaccttttttctcttttcttcccttcctttgttttcataagcctttggtatctttcctgcccttttcctttgtgtactctatactggagttcccttcttcctcttgctgtaggctcaatcccataccgacatctacaactaatctttcccatcaactctgtgtgaaggcaggttgcaactagaaattcagaggggcttggaatagagaaacctaaagaagcatcatcccctccatccccaacttcctcaaagcccaaagccaagggaaggataaatcaaggctcaaggcttccccagcaaagattagggaaagagacttgaccccaggactgtactacgactcttaagagaacactgcacagcactcaaagtcccccactggactgcttcctccttagccccactggtataaatacatctctctccaatttggc

SEQ ID NO: 278898 - DNA, 1093 bp, Homo sapiens
caaaccaaaaagcttcttctcccctggggttgggagtagggtcgggtggggctgggctgagcaggaacttgtgagattccagagccctgactacaggtgatcagcggtcagcaactccccaaagtggacaagaccaaagaggggtccattgtggatccactggtgaaagtgcagatctttggcgttcgtctagacacagcacggcaggagaccaactatgtggagaacaatggttttaatccatactgggggcagacactatgtttccgggtgctggtgcctgaacttgccatgctgcgttttgtggtaatggattatgactggaaatcccgaaatgactttattggtcagtacaccctgccttggacctgcatgcaacaaggttaccgccacattcacctgctgtccaaagatggcatcagcctccgcccagcttccatctttgtgtatatctgcatccaggaaggcctggagggggatgagtcctgaggtgggcatttcacgggaagggttggtatgctggctttagacggggagaaacatctggaaggatgctcgagagaacaaatggaggtggtgaaaatcaagctttggattgtgcattcctaggcacaaaattacctcattcttcctaacaagcaatctgggacctgattttccaccttttttctcttttcttcccttcctttgttttcataagcctttggtatctttcctgcccttttcctttgtgtactctatactggagttcccttcttcctcttgctgtaggctcaatcccataccgacatctacaactaatctttcccatcaactctgtgtgaaggcaggttgcaactagaaattcagaggggcttggaatagagaaacctaaagaagcatcatcccctccatccccaacttcctcaaagcccaaagccaagggaaggataaatcaaggctcaaggcttccccagcaaagattagggaaagagacttgaccccaggactgtactacgactcttaagagaacactgcacagcactcaaagtcccccactggactgcttcctccttagccccactggtataaatacatctctctccaatttggc

SEQ ID NO: 278899 - DNA, 2637 bp, Homo sapiens
  misc_feature (2632)..(2634): n is a, c, g, or t
ggcacgagggccagctgctgtagaagaggggaggaaacaagccagtgcaaggggagcaaaagagaaaaggagccaggctgggcttcctgatcccacagcatcgcagagctcgggaggcacagctcacagacacaggaaacacaggactgctattctgctctcctgcccacggtgatctggtgccagctggtggaacagtgggtgatggcgtccctgctgcaagaccagctgaccactgatcaggacttgctgctgatgcaggaaggcatgccgatgcgcaaggtgaggtccaaaagctggaagaagctaagatacttcagacttcagaatgacggcatgacagtctggcatgcacggcaggccaggggcagtgccaagcccagcttctcaatctctgatgtggagacaatacgtaatggccatgattccgagttgctgcgtagcctggcagaggagctccccctggagcagggcttcaccattgtcttccatggccgccgctccaacctggacctgatggccaacagtgttgaggaggcccagatatggatgcgagggctccagctgttggtggatcttgtcaccagcatggaccatcaggagcgcctggaccaatggctgagcgattggtttcaacgtggagacaaaaatcaggatggtaagatgagtttccaagaagttcagcggttattgcacctaatgaatgtggaaatggaccaagaatatgccttcagtctttttcaggcagcagacacgtcccagtctggaaccctggaaggagaagaattcgtacagttctataaggcattgactaaacgtgctgaggtgcaggaactgtttgaaagtttttcagctgatgggcagaagctgactctgctggaatttttggatttcctccaagaggagcagaaggagagagactgcacctctgagcttgctctggaactcattgaccgctatgaaccttcagacagtggcaaactgcggcatgtgctgagtatggatggcttcctcagctacctctgctctaaggatggagacatcttcaacccagcctgcctccccatctatcaggatatgactcaacccctgaaccactacttcatctgctcttctcataacacctacctagtgggggaccagctttgcggccagagcagcgtcgagggatatatacgggccctgaagcgggggtgccgctgcgtggaggtggatgtatgggatggacctagcggggaacctgtcgtttaccacggacacaccctgacctcccgcatcctgttcaaagatgtcgtggccacagtagcacagtatgccttccagacatcagactacccagtcatcttgtccctggagacccactgcagctgggagcagcagcagaccatggcccgtcatctgactgagatcctgggggagcagctgctgagcaccaccttggatggggtgctgcccactcagctgccctcgcctgaggagcttcggaggaagatcctggtgaaggggaagaagttaacacttgaggaagacctggaatatgaggaagaggaagcagaacctgagttggaagagtcagaattggcgctggagtcccagtttgagactgagcctgagccccaggagcagaaccttcagaataaggacaaaaagaagaaatccaagcccatcttgtgtccagccctctcttccctggttatctacttgaagtctgtctcattccgcagcttcacacattcaaaggagcactaccacttctacgagatatcatctttctctgaaaccaaggccaagcgcctcatcaaggaggctggtcaggaccaaaatggagggatggggagggaagtgggatggataggttcaggcctgatggactggcaggtaagtcccaagaaaaaagacaaggtagctaaggagagatgaaggagttcagaaactccttagagcagacaagggcagaggagttatgaatagtggctcaagggtctaggggcaggaaagctggtctggatggacagagtagagaggcacagtgaaactttctggagccagcttcagatgctggagagaagggtgaagagtaggcagggtccttgggactagggaagtgggagattccaccccacttccatctccctctctatacccttttacaggcaatgagtttgtgcagcacaatacttggcagttaagccgtgtgtatcccagcggcctgaggacagactcttccaactacaacccccaggaactctggaatgcaggctgccagatggtggccatgaatatgcagactgcagggcttgaaatggacatctgtgatgggcatttccgccagaatggcggctgtggctatgtgctgaagccagacttcctgcgtgatatccagagttctttccaccctgagaagcccatcagccctttcaaagcccagactctcttaatccaggtgatcagcggtcagcaactccccaaagtggacaagaccaaagaggggtccattgtggatccactggtgaaagtgcagatctttggcgttcgtctagacacagcacggcaggagaccaactatgtggagaacaatggttttaatccatactgggggcagacgtctatgggccctgtggttgagggcaannnaaa

SEQ ID NO: 278900 - DNA, 412 bp, Homo sapiens
gtgctggggaggtgggggtaggagcatgattagttttccttctagtctgtcttccattaagtatagcatctgttattgcatgtccccacatgggaggcagtgtggaacagtacaaagaatcctggctcttcacttaaaagctccagtgacctgggcaaattacttgcttactctgagcctttttccttacctgtaaaatgctgattgccatctagattaaatgagaacacaagaaaagcaacccagtcaagaaaactgtcataatgtcttcttatttctttctgtccaccaactcaggttttaatccatactgggggcagacactatgtttccgggtgctggtgcctgaacttgccatgctgcgttttgtggtaatggattatgactggaaatcccgaaatgactttattgg

SEQ ID NO: 278901 - DNA, 584 bp, Homo sapiens
aaaatttaaaaaaaaatttttttaattaaaaagataacatttcccattaaaagtttcattcactctcccctaaacctctcttgcaggcagcagacacgtcccagtctggaaccctggaaggagaagaattcgtacagttctataaggcattgactaaacgtgctgaggtgcaggaactgtttgaaagtttttcagctgatgggcagaagctgactctgctggaatttttggatttcctccaagaggagcagaaggagagagactgcacctctgagcttgctctggaactcattgaccgctatgaaccttcagacagtggtaagagaaatcaggtggagaggcaccagacataggggttggagagagggacatgattacaaggtccagagacaagcagccatctgcctgagagaaggttgagtctatccctatcctgacccctgcccaatcatctcatttaaccactcctcccaaaggagggcaggcatttcctgttcagacaagacaggggtttcctctgaggtgctagacctctcaggaggaagaagattccatggctcctcattcctccattatgctcatgt

SEQ ID NO: 278902 - DNA, 3057 bp, Homo sapiens
ggcacgagggccagctgctgtagaagaggggaggaaacaagccagtgcaaggggagcaaaagagaaaaggagccaggctgggcttcctgatcccacagcatcgcagagctcgggaggcacagctcacagacacaggaaacacaggactgctattctgctctcctgcccacggtgatctggtgccagctggtggaacagtgggtgatggcgtccctgctgcaagaccagctgaccactgatcaggacttgctgctgatgcaggaaggcatgccgatgcgcaaggtgaggtccaaaagctggaagaagctaagatacttcagacttcagaatgacggcatgacagtctggcatgcacggcaggccaggggcagtgccaagcccagcttctcaatctctgatgtggagacaatacgtaatggccatgattccgagttgctgcgtagcctggcagaggagctccccctggagcagggcttcaccattgtcttccatggccgccgctccaacctggacctgatggccaacagtgttgaggaggcccagatatggatgcgagggctccagctgttggtggatcttgtcaccagcatggaccatcaggagcgcctggaccaatggctgagcgattggtttcaacgtggagacaaaaatcaggatggtaagatgagtttccaagaagttcagcggttattgcacctaatgaatgtggaaatggaccaagaatatgccttcagtctttttcaggcagcagacacgtcccagtctggaaccctggaaggagaagaattcgtacagttctataaggcattgactaaacgtgctgaggtgcaggaactgtttgaaagtttttcagctgatgggcagaagctgactctgctggaatttttggatttcctccaagaggagcagaaggagagagactgcacctctgagcttgctctggaactcattgaccgctatgaaccttcagacagtggcaaactgcggcatgtgctgagtatggatggcttcctcagctacctctgctctaaggatggagacatcttcaacccagcctgcctccccatctatcaggatatgactcaacccctgaaccactacttcatctgctcttctcataacacctacctagtgggggaccagctttgcggccagagcagcgtcgagggatatatacgggccctgaagcgggggtgccgctgcgtggaggtggatgtatgggatggacctagcggggaacctgtcgtttaccacggacacaccctgacctcccgcatcctgttcaaagatgtcgtggccacagtagcacagtatgccttccagacatcagactacccagtcatcttgtccctggagacccactgcagctgggagcagcagcagaccatggcccgtcatctgactgagatcctgggggagcagctgctgagcaccaccttggatggggtgctgcccactcagctgccctcgcctgaggagcttcggaggaagatcctggtgaaggggaagaagttaacacttgaggaagacctggaatatgaggaagaggaagcagaacctgagttggaagagtcagaattggcgctggagtcccagtttgagactgagcctgagccccaggagcagaaccttcagaataaggacaaaaagaagaaatccaagcccatcttgtgtccagccctctcttccctggttatctacttgaagtctgtctcattccgcagcttcacacattcaaaggagcactaccacttctacgagatatcatctttctctgaaaccaaggccaagcgcctcatcaaggaggctggtcaggaccaaaatggagggatggggagggaagtgggatggataggttcaggcctgatggactggcaggtaagtcccaagaaaaaagacaaggtagctaaggagagatgaaggagttcagaaactccttagagcagacaagggcagaggagttatgaatagtggctcaagggtctaggggcaggaaagctggtctggatggacagagtagagaggcacagtgaaactttctggagccagcttcagatgctggagagaagggtgaagagtaggcagggtccttgggactagggaagtgggagattccaccccacttccatctccctctctatacccttttacaggcaatgagtttgtgcagcacaatacttggcagttaagccgtgtgtatcccagcggcctgaggacagactcttccaactacaacccccaggaactctggaatgcaggctgccagatgggtgaggaggcagcagggactgggaagagggagtggaggagcagcaggtgggaaataagttctctagtgatggtagggttggggaatgctcaagaaaattgctaggctgagaaatgctatcagtggatattaccagcaggtaccgtgcacccagtacctatcttcttaactccctgaaagaggggctggaaggcctccatggtgaatcttgctcttcttttctcctggggccctcagtggccatgaatatgcagactgcagggcttgaaatggacatctgtgatgggcatttccgccagaatggcggctgtggctatgtgctgaagccagacttcctgcgtgatatccagagttctttccaccctgagaagcccatcagccctttcaaagcccagactctcttaatccaggtacagtggaaataaactgttgggaagaaactgagataactgggatagaagtgagggaagaggtggctaggcctgaccggaatgtagaggccggatagcctattaacagtgtctagttttagcttttggagccagctgcctagcttcaaaccacaacttcctaattgggtaatgttgggcaagttccttaacctctccatacctcagtctgctcacctgcaaaataggggtaacactaccacctgcctcacagggttataaggagtataacagttaatataaagttcttacaattcctggcacacaggaagtgctataaaagaggctggctgggagcgatagcttacacctgtaatcccagcgctttggaggccaagg

SEQ ID NO: 278903 - DNA, 2048 bp, Homo sapiens
ggcacgagggccagctgctgtagaagaggggaggaaacaagccagtgcaaggggagcaaaagagaaaaggagccaggctgggcttcctgatcccacagcatcgcagagctcgggaggcacagctcacagacacaggaaacacaggactgctattctgctctcctgcccacggtgatctggtgccagctggtggaacagtgggtgatggcgtccctgctgcaagaccagctgaccactgatcaggacttgctgctgatgcaggaaggcatgccgatgcgcaaggtgaggtccaaaagctggaagaagctaagatacttcagacttcagaatgacggcatgacagtctggcatgcacggcaggccaggggcagtgccaagcccagcttctcaatctctgatgtggagacaatacgtaatggccatgattccgagttgctgcgtagcctggcagaggagctccccctggagcagggcttcaccattgtcttccatggccgccgctccaacctggacctgatggccaacagtgttgaggaggcccagatatggatgcgagggctccagctgttggtggatcttgtcaccagcatggaccatcaggagcgcctggaccaatggctgagcgattggtttcaacgtggagacaaaaatcaggatggtaagatgagtttccaagaagttcagcggttattgcacctaatgaatgtggaaatggaccaagaatatgccttcagtctttttcaggcagcagacacgtcccagtctggaaccctggaaggagaagaattcgtacagttctataaggcattgactaaacgtgctgaggtgcaggaactgtttgaaagtttttcagctgatgggcagaagctgactctgctggaatttttggatttcctccaagaggagcagaaggagagagactgcacctctgagcttgctctggaactcattgaccgctatgaaccttcagacagtggcaaactgcggcatgtgctgagtatggatggcttcctcagctacctctgctctaaggatggagacatcttcaacccagcctgcctccccatctatcaggatatgactcaacccctgaaccactacttcatctgctcttctcataacacctacctagtgggggaccagctttgcggccagagcagcgtcgagggatatatacgggccctgaagcgggggtgccgctgcgtggaggtggatgtatgggatggacctagcggggaacctgtcgtttaccacggacacaccctgacctcccgcatcctgttcaaagatgtcgtggccacagtagcacagtatgccttccagacatcagactacccagtcatcttgtccctggagacccactgcagctgggagcagcagcagaccatggcccgtcatctgactgagatcctgggggagcagctgctgagcaccaccttggatggggtgctgcccactcagctgccctcgcctgaggagcttcggaggaagatcctggtgaaggggaagaagttaacacttgaggaagacctggaatatgaggaagaggaagcagaacctgagttggaagagtcagaattggcgctggagtcccagtttgagactgagcctgagccccaggagcagaaccttcagaataaggacaaaaagaaggtaagccaggagtggtctttctgctgtggtatttagtcaacttatgcaagctgaaggcctgttcatgaagactagagccgtgcaagatgcagggccaaggagcaatgacccttcctcccaatgaaggagatttaagaccgcatacatggcatcaatatatattatatactgccatatgtaggtatgttgcagtggctttccaacttctttgggccacatctttttttttaaaatgaaatcttacgcaaaatagataaacgcagaaccatcctagttgaagcacccatttggctctctcctgggtgccctagtgactcctgagacatttttgtacttcttggtcttcttaaaggccagcttgaaaaccagtgatgagcgggtgtgtgtttgtatgt

SEQ ID NO: 278904 - DNA, 817 bp, Homo sapiens
gcacgccctcctcccctccagctcaccgagcgatctcccttccttccttccagtacttcctcctggttgttctcctgaggaggaaaagaaggggtgactctccacatccttgcagcctcacctcatcatccctgcctgctgcctggccacacctggtcactcaaggcctccttcagtgccctggtctcagctgcctcagtaggctagtggagcacagccaggggaggacaggaggagggtattctctggagacaggtgtgcccccctactgacagaccctgctcagcagaacagaagcccttcagcgaatgagacctaccctctgcggaaggctggttaggaagcatccatgtctacttcagcgtctcacctccctgtcacaaacagatcaccacagttttcctccagcctcatgctgtcgtccccctagaggaatgtgggtacatggaatgttctccacctccatgcatgtccagtgacgttttggatcagcgtgtcagggacgctgtcaggcgtgcctgcttgcactcatccagccctggctggacgtgattctacgagcagagcaagaccagcatgttctgtcctccagttatcacagcagttactctggcaacctgcaggccctccctgaggtgtctgacggctgaagtcagggtccagtgggatggaatgaaggatgggcaccctggaagacagcccatggaggggcctttgggtcccctgctgccctgggcacctgcgaagagagaagctgagccaccctgcctgaggcagtaggcagtaagagctgaagggagcaggaggttagggccca

SEQ ID NO: 278905 - DNA, 181 bp, Homo sapiens
ctactactactactactactactaaattcgcggccgcgtcgacgctgcgagaagacgacagaaggggttctgggcctagttgtcctccctctggagccccgtcctgtggtctgcctcagtttcccctcctaatacatatggctgttttccacctcgataatataacacgagtttgggcccg

SEQ ID NO: 278906 - DNA, 190 bp, Homo sapiens
tcaagcttctaacgatgtacggggacatgctgtgagacctcctggaacactggcatctctgagcctccagaaggggttctgggcctagttgtcctccctctggagccccgtcctgtggtctgcctcagtttcccctcctaatacatatggctgttttccacctcgataatataacacgagtttgggcccg

SEQ ID NO: 278907 - DNA, 150 bp, Homo sapiens
tactactatacgggggcgattagacgacagaaggggttctgggcctagttgtcctccctctggagccccgtcctgtggtctgcctcagtttcccctcctaatacatatggctgttttccacctcgataatataacacgagtttgggcccg

SEQ ID NO: 278908 - DNA, 188 bp, Homo sapiens
tactactatacgggggcgattagacgacagaaggggttctgggcctagttgtcctccctctggagccccgtcctgtggtctgcctcagtttcccctcctaatacatatggctgttttccacctcgataatataacacgagtttgggcccgaaaaaaaatacaaacccggaaattcaaagtcgtatcga

SEQ ID NO: 278909 - DNA, 1557 bp, Homo sapiens
ggcggagctcggggccgggactctcagcctatcaagtgtctgtaattaattaaccaactgagatccagttcaggggtgaaagttcttcaggtacgaggagggcattgttgtcagtctggaccgagcccgcagagcccctcctcggcgtcctggtcccggccgtgcccgcggtgtcccgggaggaaggggcgggccgggggtcgggaggagtcacgtgccccctcccgccccaggtcgtcctctcagcatgggggtcccgcggcctcagccctgggcgctggggctcctgctctttctccttcctgggagcctgggcgcagaaagccacctctccctcctgtaccaccttaccgcggtgtcctcgcctgccccggggactcctgccttctgggtgtccggctggctgggcccgcagcagtacctgagctacaatagcctgcggggcgaggcggagccctgtggagcttgggtctgggaaaaccaggtgtcctggtattgggagaaagagaccacagatctgaggatcaaggagaagctctttctggaagctttcaaagctttggggggaaaaggtccctacactctgcagggcctgctgggctgtgaactgggccctgacaacacctcggtgcccaccgccaagttcgccctgaacggcgaggagttcatgaatttcgacctcaagcagggcacctggggtggggactggcccgaggccctggctatcagtcagcggtggcagcagcaggacaaggcggccaacaaggagctcaccttcctgctattctcctgcccgcaccgcctgcgggagcacctggagaggggccgcggaaacctggagtggaaggagcccccctccatgcgcctgaaggcccgacccagcagccctggcttttccgtgcttacctgcagcgccttctccttctaccctccggagctgcaacttcggttcctgcggaatgggctggccgctggcaccggccagggtgacttcggccccaacagtgacggatccttccacgcctcgtcgtcactaacagtcaaaagtggcgatgagcaccactactgctgcattgtgcagcacgcggggctggcgcagcccctcagggtggagctggaatctccagccaagtcctccgtgctcgtggtgggaatcgtcatcggtgtcttgctactcacggcagcggctgtaggaggagctctgttgtggagaaggatgaggagtgggctgccagccccttggatctcccttcgtggagacgacaccggggtcctcctgcccaccccaggggaggcccaggatgctgatttgaaggatgtaaatgtgattccagccaccgcctgaccatccgccattccgactgctaaaagcgaatgtagtcaggcccctttcatgctgtgagacctcctggaacactggcatctctgagcctccagaaggggttctgggcctagttgtcctccctctggagccccgtcctgtggtctgcctcagtttcccctcctaatacatatggctgttttccacctcgataatataacacgagtttgggcccg

SEQ ID NO: 278910 - DNA, 1504 bp, Homo sapiens
tatgcggctgtacggtcggaattttgggattcttcaggtacgaggagggcattgttgtcagtctggaccgagcccgcagagcccctcctcggcgtcctggtcccggccgtgcccgcggtgtcccgggaggaaggggcgggccgggggtcgggaggagtcacgtgccccctcccgccccaggtcgtcctctcagcatgggggtcccgcggcctcagccctgggcgctggggctcctgctctttctccttcctgggagcctgggcgcagaaagccacctctccctcctgtaccaccttaccgcggtgtcctcgcctgccccggggactcctgccttctgggtgtccggctggctgggcccgcagcagtacctgagctacaatagcctgcggggcgaggcggagccctgtggagcttgggtctgggaaaaccaggtgtcctggtattgggagaaagagaccacagatctgaggatcaaggagaagctctttctggaagctttcaaagctttggggggaaaaggtccctacactctgcagggcctgctgggctgtgaactgggccctgacaacacctcggtgcccaccgccaagttcgccctgaacggcgaggagttcatgaatttcgacctcaagcagggcacctggggtggggactggcccgaggccctggctatcagtcagcggtggcagcagcaggacaaggcggccaacaaggagctcaccttcctgctattctcctgcccgcaccgcctgcgggagcacctggagaggggccgcggaaacctggagtggaaggagcccccctccatgcgcctgaaggcccgacccagcagccctggcttttccgtgcttacctgcagcgccttctccttctaccctccggagctgcaacttcggttcctgcggaatgggctggccgctggcaccggccagggtgacttcggccccaacagtgacggatccttccacgcctcgtcgtcactaacagtcaaaagtggcgatgagcaccactactgctgcattgtgcagcacgcggggctggcgcagcccctcagggtggagctggaatctccagccaagtcctccgtgctcgtggtgggaatcgtcatcggtgtcttgctactcacggcagcggctgtaggaggagctctgttgtggagaaggatgaggagtgggctgccagccccttggatctcccttcgtggagacgacaccggggtcctcctgcccaccccaggggaggcccaggatgctgatttgaaggatgtaaatgtgattccagccaccgcctgaccatccgccattccgactgctaaaagcgaatgtagtcaggcccctttcatgctgtgagacctcctggaacactggcatctctgagcctccagaaggggttctgggcctagttgtcctccctctggagccccgtcctgtggtctgcctcagtttcccctcctaatacatatggctgttttccacctcgataatataacacgagtttgggcccg

SEQ ID NO: 278911 - DNA, 1921 bp, Homo sapiens
ggcggagctcggggccgggactctcagcctatcaagtgtctgtaattaattaaccaactgagatccagttcaggggtgaaagttcttcaggtacgaggagggcattgttgtcagtctggaccgagcccgcagagcccctcctcggcgtcctggtcccggccgtgcccgcggtgtcccgggaggaaggggcgggccgggggtcgggaggagtcacgtgccccctcccgccccaggtcgtcctctcagcatgggggtcccgcggcctcagccctgggcgctggggctcctgctctttctccttcctgggagcctgggcgcagaaagccacctctccctcctgtaccaccttaccgcggtgtcctcgcctgccccggggactcctgccttctgggtgtccggctggctgggcccgcagcagtacctgagctacaatagcctgcggggcgaggcggagccctgtggagcttgggtctgggaaaaccaggtgtcctggtattgggagaaagagaccacagatctgaggatcaaggagaagctctttctggaagctttcaaagctttggggggaaaaggtccctacactctgcagggcctgctgggctgtgaactgggccctgacaacacctcggtgcccaccgccaagttcgccctgaacggcgaggagttcatgaatttcgacctcaagcagggcacctggggtggggactggcccgaggccctggctatcagtcagcggtggcagcagcaggacaaggcggccaacaaggagctcaccttcctgctattctcctgcccgcaccgcctgcgggagcacctggagaggggccgcggaaacctggagtggaaggagcccccctccatgcgcctgaaggcccgacccagcagccctggcttttccgtgcttacctgcagcgccttctccttctaccctccggagctgcaacttcggttcctgcggaatgggctggccgctggcaccggccagggtgacttcggccccaacagtgacggatccttccacgcctcgtcgtcactaacagtcaaaagtggcgatgagcaccactactgctgcattgtgcagcacgcggggctggcgcagcccctcagggtggagctggaatctccagccaagtcctccgtgctcgtggtgggaatcgtcatcggtgtcttgctactcacggcagcggctgtaggaggagctctgttgtggagaaggatgaggagtgggctgccagccccttggatctcccttcgtggagacgacaccggggtcctcctgcccaccccaggggaggcccaggatgctgatttgaaggatgtaaatgtgattccagccaccgcctgaccatccgccattccgactgctaaaagcgaatgtagtcaggcccctttcatgctgtgagacctcctggaacactggcatctctgagcctccagaaggggttctgggcctagttgtcctccctctggagccccgtcctgtggtctgcctcagtttcccctcctaatacatatggctgttttccacctcgataatataacacgagtttgggcccgaaaaaaaaaagtgttctcatcatttttcaggcaggggaggtaagggaataagtcgggggactgaatggcggctgggcctcggatctctcctacaggtaacatgctgccacaggggaacctgccagttttatacatcaggtcatgtattttctttttctttttcttttttcttttttttagacggagtcttgctctgttgctcagtccggagtcctgtggcgcgatctcggctcactgtaaccggctccgcctccctgggttcacgccattctcctgcctcaggctcccgagtagctgggactacaggcgcctgccaccatgcctggctaattttttgtatttttagtacagacggggtttcacc

SEQ ID NO: 278912 - DNA, 2237 bp, Homo sapiens
ggcggagctcggggccgggactctcagcctatcaagtgtctgtaattaattaaccaactgagatccagttcaggggtgaaagttcttcaggtacgaggagggcattgttgtcagtctggaccgagcccgcagagcccctcctcggcgtcctggtcccggccgtgcccgcggtgtcccgggaggaaggggcgggccgggggtcgggaggagtcacgtgccccctcccgccccaggtcgtcctctcagcatgggggtcccgcggcctcagccctgggcgctggggctcctgctctttctccttcctgggagcctgggcgcagaaagccacctctccctcctgtaccaccttaccgcggtgtcctcgcctgccccggggactcctgccttctgggtgtccggctggctgggcccgcagcagtacctgagctacaatagcctgcggggcgaggcggagccctgtggagcttgggtctgggaaaaccaggtgtcctggtattgggagaaagagaccacagatctgaggatcaaggagaagctctttctggaagctttcaaagctttggggggaaaaggtccctacactctgcagggcctgctgggctgtgaactgggccctgacaacacctcggtgcccaccgccaagttcgccctgaacggcgaggagttcatgaatttcgacctcaagcagggcacctggggtggggactggcccgaggccctggctatcagtcagcggtggcagcagcaggacaaggcggccaacaaggagctcaccttcctgctattctcctgcccgcaccgcctgcgggagcacctggagaggggccgcggaaacctggagtggaaggagcccccctccatgcgcctgaaggcccgacccagcagccctggcttttccgtgcttacctgcagcgccttctccttctaccctccggagctgcaacttcggttcctgcggaatgggctggccgctggcaccggccagggtgacttcggccccaacagtgacggatccttccacgcctcgtcgtcactaacagtcaaaagtggcgatgagcaccactactgctgcattgtgcagcacgcggggctggcgcagcccctcagggtggagctgggtgaggtcccgccaggtggtgatgctcctggtttcccgttgccttgtctcactgctgcgccggtccttcctgagtctgaccttcctccccactgctgccacctccttgaatctgactgccttgaacctcacgcctgtcagtgcccccaaaacctgatggcttgtccttcccaaggccaactgccttccgtctcctgctgcttctggcctcactgagtctgaagagctgttaactaccatggccagtcctccctgagtctgaccatcttccatcctgctgctgctgctgctgctgctgcgggtcttcctggaatctgaccattcgttgtctgctatgcccgtcctcaccaagactgactgcctgctgctttgctactgcccgggcccatgagactgacttcccactgctctgcctgcctctccccactgcactggcacagccccgccttgccgctgctgatccattgccggtgtgaccgcggccgctcgtgctgtagctggttcttacgtccaacctgggggcagtctgcccagatcgcctgcctggcctcgcctctgcccatcagacacttggtgctggaatctccgaggctgggagggactgggagcgccccagttctgtgtcctgactgggtggggtggaggggctgctccacatctcacagcgttctctggctgcagaatctccagccaagtcctccgtgctcgtggtgggaatcgtcatcggtgtcttgctactcacggcagcggctgtaggaggagctctgttgtggagaaggatgaggagtgggctgccagccccttggatctcccttcgtggagacgacaccggggtcctcctgcccaccccaggggaggcccaggatgctgatttgaaggatgtaaatgtgattccagccaccgcctgaccatccgccattccgactgctaaaagcgaatgtagtcaggcccctttcatgctgtgagacctcctggaacactggcatctctgagcctccagaaggggttctgggcctagttgtcctccctctggagccccgtcctgtggtctgcctcagtttcccctcctaatacatatggctgttttccacctcgataatataacacgagtttgggcccg

SEQ ID NO: 278913 - DNA, 1265 bp, Homo sapiens
tcggaagtgaaacgcagctgaagggaacaaagccacctctccctcctgtaccaccttaccgcggtgtcctcgcctgccccggggactcctgccttctgggtgtccggctggctgggcccgcagcagtacctgagctacaatagcctgcggggcgaggcggagccctgtggagcttgggtctgggaaaaccaggtgtcctggtattgggagaaagagaccacagatctgaggatcaaggagaagctctttctggaagctttcaaagctttggggggaaaaggtccctacactctgcagggcctgctgggctgtgaactgggccctgacaacacctcggtgcccaccgccaagttcgccctgaacggcgaggagttcatgaatttcgacctcaagcagggcacctggggtggggactggcccgaggccctggctatcagtcagcggtggcagcagcaggacaaggcggccaacaaggagctcaccttcctgctattctcctgcccgcaccgcctgcgggagcacctggagaggggccgcggaaacctggagtggaaggagcccccctccatgcgcctgaaggcccgacccagcagccctggcttttccgtgcttacctgcagcgccttctccttctaccctccggagctgcaacttcggttcctgcggaatgggctggccgctggcaccggccagggtgacttcggccccaacagtgacggatccttccacgcctcgtcgtcactaacagtcaaaagtggcgatgagcaccactactgctgcattgtgcagcacgcggggctggcgcagcccctcagggtggagctggaatctccagccaagtcctccgtgctcgtggtgggaatcgtcatcggtgtcttgctactcacggcagcggctgtaggaggagctctgttgtggagaaggatgaggagtgggctgccagccccttggatctcccttcgtggagacgacaccggggtcctcctgcccaccccaggggaggcccaggatgctgatttgaaggatgtaaatgtgattccagccaccgcctgaccatccgccattccgactgctaaaagcgaatgtagtcaggcccctttcatgctgtgagacctcctggaacactggcatctctgagcctccagaaggggttctgggcctagttgtcctccctctggagccccgtcctgtggtctgcctcagtttcccctcctaatacatatggctgttttccacctcgataatataacacgagtttgggcccg

SEQ ID NO: 278914 - DNA, 1644 bp, Homo sapiens
tttaacgacgcagtgattctcgagcatgttggcctaccggtatcaagtgtctgtaattaattaaccaactgagatccagttcaggggtgaaagttcttcaggtacgaggagggcattgttgtcagtctggaccgagcccgcagagcccctcctcggcgtcctggtcccggccgtgcccgcggtgtcccgggaggaaggggcgggccgggggtcgggaggagtcacgtgccccctcccgccccaggtcgtcctctcagcatgggggtcccgcggcctcagccctgggcgctggggctcctgctctttctccttcctgggagcctgggcgcagaaagccacctctccctcctgtaccaccttaccgcggtgtcctcgcctgccccggggactcctgccttctgggtgtccggctggctgggcccgcagcagtacctgagctacaatagcctgcggggcgaggcggagccctgtggagcttgggtctgggaaaaccaggtgtcctggtattgggagaaagagaccacagatctgaggatcaaggagaagctctttctggaagctttcaaagctttggggggaaaagtgagattccggtctggaggggcaaggggccgggtccatgctccggggccccgcttacctgtgtttgggcgccccaggtccctacactctgcagggcctgctgggctgtgaactgggccctgacaacacctcggtgcccaccgccaagttcgccctgaacggcgaggagttcatgaatttcgacctcaagcagggcacctggggtggggactggcccgaggccctggctatcagtcagcggtggcagcagcaggacaaggcggccaacaaggagctcaccttcctgctattctcctgcccgcaccgcctgcgggagcacctggagaggggccgcggaaacctggagtggaaggagcccccctccatgcgcctgaaggcccgacccagcagccctggcttttccgtgcttacctgcagcgccttctccttctaccctccggagctgcaacttcggttcctgcggaatgggctggccgctggcaccggccagggtgacttcggccccaacagtgacggatccttccacgcctcgtcgtcactaacagtcaaaagtggcgatgagcaccactactgctgcattgtgcagcacgcggggctggcgcagcccctcagggtggagctggaatctccagccaagtcctccgtgctcgtggtgggaatcgtcatcggtgtcttgctactcacggcagcggctgtaggaggagctctgttgtggagaaggatgaggagtgggctgccagccccttggatctcccttcgtggagacgacaccggggtcctcctgcccaccccaggggaggcccaggatgctgatttgaaggatgtaaatgtgattccagccaccgcctgaccatccgccattccgactgctaaaagcgaatgtagtcaggcccctttcatgctgtgagacctcctggaacactggcatctctgagcctccagaaggggttctgggcctagttgtcctccctctggagccccgtcctgtggtctgcctcagtttcccctcctaatacatatggctgttttccacctcgataatataacacgagtttgggcccg

SEQ ID NO: 278915 - DNA, 1090 bp, Homo sapiens
tcggtaccttttcccccaaagctttgaaagcttccacaaagagcttctcttgatctctagatctgtggtctctttctcccaataccaggacacctggttttcccagtccctacactctgcagggcctgctgggctgtgaactgggccctgacaacacctcggtgcccaccgccaagttcgccctgaacggcgaggagttcatgaatttcgacctcaagcagggcacctggggtggggactggcccgaggccctggctatcagtcagcggtggcagcagcaggacaaggcggccaacaaggagctcaccttcctgctattctcctgcccgcaccgcctgcgggagcacctggagaggggccgcggaaacctggagtggaaggagcccccctccatgcgcctgaaggcccgacccagcagccctggcttttccgtgcttacctgcagcgccttctccttctaccctccggagctgcaacttcggttcctgcggaatgggctggccgctggcaccggccagggtgacttcggccccaacagtgacggatccttccacgcctcgtcgtcactaacagtcaaaagtggcgatgagcaccactactgctgcattgtgcagcacgcggggctggcgcagcccctcagggtggagctggaatctccagccaagtcctccgtgctcgtggtgggaatcgtcatcggtgtcttgctactcacggcagcggctgtaggaggagctctgttgtggagaaggatgaggagtgggctgccagccccttggatctcccttcgtggagacgacaccggggtcctcctgcccaccccaggggaggcccaggatgctgatttgaaggatgtaaatgtgattccagccaccgcctgaccatccgccattccgactgctaaaagcgaatgtagtcaggcccctttcatgctgtgagacctcctggaacactggcatctctgagcctccagaaggggttctgggcctagttgtcctccctctggagccccgtcctgtggtctgcctcagtttcccctcctaatacatatggctgttttccacctcgataatataacacgagtttgggcccg

SEQ ID NO: 278916 - DNA, 1033 bp, Homo sapiens
acagtatcctggctgtaagctttcacatgctcgtgtagagggaataaggtccctacactctgcagggcctgctgggctgtgaactgggccctgacaacacctcggtgcccaccgccaagttcgccctgaacggcgaggagttcatgaatttcgacctcaagcagggcacctggggtggggactggcccgaggccctggctatcagtcagcggtggcagcagcaggacaaggcggccaacaaggagctcaccttcctgctattctcctgcccgcaccgcctgcgggagcacctggagaggggccgcggaaacctggagtggaaggagcccccctccatgcgcctgaaggcccgacccagcagccctggcttttccgtgcttacctgcagcgccttctccttctaccctccggagctgcaacttcggttcctgcggaatgggctggccgctggcaccggccagggtgacttcggccccaacagtgacggatccttccacgcctcgtcgtcactaacagtcaaaagtggcgatgagcaccactactgctgcattgtgcagcacgcggggctggcgcagcccctcagggtggagctggaatctccagccaagtcctccgtgctcgtggtgggaatcgtcatcggtgtcttgctactcacggcagcggctgtaggaggagctctgttgtggagaaggatgaggagtgggctgccagccccttggatctcccttcgtggagacgacaccggggtcctcctgcccaccccaggggaggcccaggatgctgatttgaaggatgtaaatgtgattccagccaccgcctgaccatccgccattccgactgctaaaagcgaatgtagtcaggcccctttcatgctgtgagacctcctggaacactggcatctctgagcctccagaaggggttctgggcctagttgtcctccctctggagccccgtcctgtggtctgcctcagtttcccctcctaatacatatggctgttttccacctcgataatataacacgagtttgggcccg

SEQ ID NO: 278917 - DNA, 2689 bp, Homo sapiens
gaaggatattaaagagcacctgcaggaattttttaaggggatgccgggggaagggcttgaaggaggaactaaggaggcttccagaagattttgattaacagcgagcgctagggaaggccacggggatacagaggggtaggaggaggatccagagacctccaagttgtggactccggaggcatcgagttcctttcccagttttgtcaagaattccctgagcggcagacaccctcaaagtaaaaaacgggaaccacagagaaggaaaaagaagaaccacaagcgttttgagaaacaaacaggctgggcctagggcctggggtgtgccctgcaactggggggtggggctggatgttcttggagtcagggagcagcagcctcccacaggatgtgagagaggaactggggtctccagtcacgggagccaggagccggccagggccgcaggcaggaagggagcgaggctgaagggaacgtcgtcctctcagcatgggggtcccgcggcctcagccctgggcgctggggctcctgctctttctccttcctgggagcctgggcgcagaaagccacctctccctcctgtaccaccttaccgcggtgtcctcgcctgccccggggactcctgccttctgggtgtccggctggctgggcccgcagcagtacctgagctacaatagcctgcggggcgaggcggagccctgtggagcttgggtctgggaaaaccaggtgtcctggtattgggagaaagagaccacagatctgaggatcaaggagaagctctttctggaagctttcaaagctttggggggaaaaggtccctacactctgcagggcctgctgggctgtgaactgggccctgacaacacctcggtgcccaccgccaagttcgccctgaacggcgaggagttcatgaatttcgacctcaagcagggcacctggggtggggactggcccgaggccctggctatcagtcagcggtggcagcagcaggacaaggcggccaacaaggagctcaccttcctgctattctcctgcccgcaccgcctgcgggagcacctggagaggggccgcggaaacctggagtggaaggacacggtgtctcactatgttgcccaggctggtcttgaactcctaggctccagcgattctcctgctttggtctcctgagtagctgagattacaggcacttgcactgttgcctagactggagtgcagtagcgggattagagttcactgcagcctcaacctcccaagctcaagcgatcctcccaccttacccttcctgaatggatggggccacaggagcccccctccatgcgcctgaaggcccgacccagcagccctggcttttccgtgcttacctgcagcgccttctccttctaccctccggagctgcaacttcggttcctgcggaatgggctggccgctggcaccggccagggtgacttcggccccaacagtgacggatccttccacgcctcgtcgtcactaacagtcaaaagtggcgatgagcaccactactgctgcattgtgcagcacgcggggctggcgcagcccctcagggtggagctgggtgaggtcccgccaggtggtgatgctcctggtttcccgttgccttgtctcactgctgcgccggtccttcctgagtctgaccttcctccccactgctgccacctccttgaatctgactgccttgaacctcacgcctgtcagtgcccccaaaacctgatggcttgtccttcccaaggccaactgccttccgtctcctgctgcttctggcctcactgagtctgaagagctgttaactaccatggccagtcctccctgagtctgaccatcttccatcctgctgctgctgctgctgctgctgcgggtcttcctggaatctgaccattcgttgtctgctatgcccgtcctcaccaagactgactgcctgctgctttgctactgcccgggcccatgagactgacttcccactgctctgcctgcctctccccactgcactggcacagccccgccttgccgctgctgatccattgccggtgtgaccgcggccgctcgtgctgtagctggttcttacgtccaacctgggggcagtctgcccagatcgcctgcctggcctcgcctctgcccatcagacacttggtgctggaatctccgaggctgggagggactgggagcgccccagttctgtgtcctgactgggtggggtggaggggctgctccacatctcacagcgttctctggctgcagaatctccagccaagtcctccgtgctcgtggtgggaatcgtcatcggtgtcttgctactcacggcagcggctgtaggaggagctctgttgtggagaaggatgaggagtgggctgccagccccttggatctcccttcgtggagacgacaccggggtcctcctgcccaccccaggggaggcccaggatgctgatttgaaggatgtaaatgtgattccagccaccgcctgaccatccgccattccgactgctaaaagcgaatgtagtcaggcccctttcatgctgtgagacctcctggaacactggcatctctgagcctccagaaggggttctgggcctagttgtcctccctctggagccccgtcctgtggtctgcctcagtttcccctcctaatacatatggctgttttccacctcgataatataacacgagtttgggcccg

SEQ ID NO: 278918 - DNA, 1517 bp, Homo sapiens
tttaacgacgcagtgattctcgagcatgttggcctaccggtatcaagtgtctgtaattaattaaccaactgagatccagttcaggggtgaaagttcttcaggtacgaggagggcattgttgtcagtctggaccgagcccgcagagcccctcctcggcgtcctggtcccggccgtgcccgcggtgtcccgggaggaaggggcgggccgggggtcgggaggagtcacgtgccccctcccgccccaggtcgtcctctcagcatgggggtcccgcggcctcagccctgggcgctggggctcctgctctttctccttcctgggagcctgggcgcagaaagccacctctccctcctgtaccaccttaccgcggtgtcctcgcctgccccggggactcctgccttctgggtgtccggctggctgggcccgcagcagtacctgagctacaatagcctgcggggcgaggcggagccctgtggagcttgggtctgggaaaaccaggtgtcctggtattgggagaaagagaccacagatctgaggatcaaggagaagctctttctggaagctttcaaagctttggggggaaaagcctcggtgcccaccgccaagttcgccctgaacggcgaggagttcatgaatttcgacctcaagcagggcacctggggtggggactggcccgaggccctggctatcagtcagcggtggcagcagcaggacaaggcggccaacaaggagctcaccttcctgctattctcctgcccgcaccgcctgcgggagcacctggagaggggccgcggaaacctggagtggaaggagcccccctccatgcgcctgaaggcccgacccagcagccctggcttttccgtgcttacctgcagcgccttctccttctaccctccggagctgcaacttcggttcctgcggaatgggctggccgctggcaccggccagggtgacttcggccccaacagtgacggatccttccacgcctcgtcgtcactaacagtcaaaagtggcgatgagcaccactactgctgcattgtgcagcacgcggggctggcgcagcccctcagggtggagctggaatctccagccaagtcctccgtgctcgtggtgggaatcgtcatcggtgtcttgctactcacggcagcggctgtaggaggagctctgttgtggagaaggatgaggagtgggctgccagccccttggatctcccttcgtggagacgacaccggggtcctcctgcccaccccaggggaggcccaggatgctgatttgaaggatgtaaatgtgattccagccaccgcctgaccatccgccattccgactgctaaaagcgaatgtagtcaggcccctttcatgctgtgagacctcctggaacactggcatctctgagcctccagaaggggttctgggcctagttgtcctccctctggagccccgtcctgtggtctgcctcagtttcccctcctaatacatatggctgttttccacctcgataatataacacgagtttgggcccg

SEQ ID NO: 278919 - DNA, 1341 bp, Homo sapiens
tttaacgacgcagtgattctcgagcatgttggcctaccggtatcaagtgtctgtaattaattaaccaactgagatccagttcaggggtgaaagttcttcaggtacgaggagggcattgttgtcagtctggaccgagcccgcagagcccctcctcggcgtcctggtcccggccgtgcccgcggtgtcccgggaggaaggggcgggccgggggtcgggaggagtcacgtgccccctcccgccccaggtcgtcctctcagcatgggggtcccgcggcctcagccctgggcgctggggctcctgctctttctccttcctgggagcctgggcgcagaaagccacctctccctcctgtaccaccttaccgcggtgtcctcgcctgccccggggactcctgccttctgggtgtccggctggctgggcccgcagcagtacctgagctacaatagcctgcggggcgaggcggagccctgtggagcttgggtctgggaaaaccaggtgtcctggtattgggagaaagagaccacagatctgaggatcaaggagaagctctttctggaagctttcaaagctttggggggaaaagcgcctgcgggagcacctggagaggggccgcggaaacctggagtggaaggagcccccctccatgcgcctgaaggcccgacccagcagccctggcttttccgtgcttacctgcagcgccttctccttctaccctccggagctgcaacttcggttcctgcggaatgggctggccgctggcaccggccagggtgacttcggccccaacagtgacggatccttccacgcctcgtcgtcactaacagtcaaaagtggcgatgagcaccactactgctgcattgtgcagcacgcggggctggcgcagcccctcagggtggagctggaatctccagccaagtcctccgtgctcgtggtgggaatcgtcatcggtgtcttgctactcacggcagcggctgtaggaggagctctgttgtggagaaggatgaggagtgggctgccagccccttggatctcccttcgtggagacgacaccggggtcctcctgcccaccccaggggaggcccaggatgctgatttgaaggatgtaaatgtgattccagccaccgcctgaccatccgccattccgactgctaaaagcgaatgtagtcaggcccctttcatgctgtgagacctcctggaacactggcatctctgagcctccagaaggggttctgggcctagttgtcctccctctggagccccgtcctgtggtctgcctcagtttcccctcctaatacatatggctgttttccacctcgataatataacacgagtttgggcccg

SEQ ID NO: 278920 - DNA, 1597 bp, Homo sapiens
ggcggagctcggggccgggactctcagcctatcaagtgtctgtaattaattaaccaactgagatccagttcaggggtgaaagttcttcaggtacgaggagggcattgttgtcagtctggaccgagcccgcagagcccctcctcggcgtcctggtcccggccgtgcccgcggtgtcccgggaggaaggggcgggccgggggtcgggaggagtcacgtgccccctcccgccccaggtcgtcctctcagcatgggggtcccgcggcctcagccctgggcgctggggctcctgctctttctccttcctgggagcctgggcgcagaaagccacctctccctcctgtaccaccttaccgcggtgtcctcgcctgccccggggactcctgccttctgggtgtccggctggctgggcccgcagcagtacctgagctacaatagcctgcggggcgaggcggagccctgtggagcttgggtctgggaaaaccaggtgtcctggtattgggagaaagagaccacagatctgaggatcaaggagaagctctttctggaagctttcaaagctttggggggaaaaggtccctacactctgcagggcctgctgggctgtgaactgggccctgacaacacctcggtgcccaccgccaagttcgccctgaacggcgaggagttcatgaatttcgacctcaagcagggcacctggggtggggactggcccgaggccctggctatcagtcagcggtggcagcagcaggacaaggcggccaacaaggagctcaccttcctgctattctcctgcccgcaccgcctgcgggagcacctggagaggggccgcggaaacctggagtggaaggagcccccctccatgcgcctgaaggcccgacccagcagccctggcttttccgtgcttacctgcagcgccttctccttctaccctccggagctgcaacttcggttcctgcggaatgggctggccgctggcaccggccagggtgacttcggccccaacagtgacggatccttccacgcctcgtcgtcactaacagtcaaaagtggcgatgagcaccactactgctgcattgtgcagcacgcggggctggcgcagcccctcagggtggagctggaatctccagccaagtcctccgtgctcgtggtgggaatcgtcatcggtgtcttgctactcacggcagcggctgtaggaggagctctgttgtggagaaggatgaggagtgggctgccagccccttggatctcccttcgtggagacgacaccggggtcctcctgcccaccccaggggaggcccaggatgctgatttgaaggatgtaaatgtgattccagccaccgcctgaccatccgccattccgactgctaaaagcgaatgtagtcaggcccctttcatgctgtgagacctcctggaacactggcatctctgagcctccagaaggggttctgggcctagttgtcctccctctggagccccgtcctgtggtctgcctcagtttcccctcctaatacatatggctgttttccacctcgataatataacacgagtttgggcccgaaaaaaaaagtgtcgtctaaaaaaaaagtcgtatcgatgt

SEQ ID NO: 278921 - DNA, 1533 bp, Homo sapiens
ggcggagctcggggccgggactctcagcctatcaagtgtctgtaattaattaaccaactgagatccagttcaggggtgaaagttcttcaggtacgaggagggcattgttgtcagtctggaccgagcccgcagagcccctcctcggcgtcctggtcccggccgtgcccgcggtgtcccgggaggaaggggcgggccgggggtcgggaggagtcacgtgccccctcccgccccaggtcgtcctctcagcatgggggtcccgcggcctcagccctgggcgctggggctcctgctctttctccttcctgggagcctgggcgcagaaagccacctctccctcctgtaccaccttaccgcggtgtcctcgcctgccccggggactcctgccttctgggtgtccggctggctgggcccgcagcagtacctgagctacaatagcctgcggggcgaggcggagccctgtggagcttgggtctgggaaaaccaggtgtcctggtattgggagaaagagaccacagatctgaggatcaaggagaagctctttctggaagctttcaaagctttggggggaaaaggtccctacactctgcagggcctgctgggctgtgaactgggccctgacaacacctcggtgcccaccgccaagttcgccctgaacggcgaggagttcatgaatttcgacctcaagcagggcacctggggtggggactggcccgaggccctggctatcagtcagcggtggcagcagcaggacaaggcggccaacaaggagctcaccttcctgctattctcctgcccgcaccgcctgcgggagcacctggagaggggccgcggaaacctggagtggaaggagcccccctccatgcgcctgaaggcccgacccagcagccctggcttttccgtgcttacctgcagcgccttctccttctaccctccggagctgcaacttcggttcctgcggaatgggctggccgctggcaccggccagggtgacttcggccccaacagtgacggatccttccacgcctcgtcgtcactaacagtcaaaagtggcgatgagcaccactactgctgcattgtgcagcacgcggggctggcgcagcccctcagggtggagctggaatctccagccaagtcctccgtgctcgtggtgggaatcgtcatcggtgtcttgctactcacggcagcggctgtaggaggagctctgttgtggagaaggatgaggagtgggctgccagccccttggatctcccttcgtggagacgacaccggggtcctcctgcccaccccaggggaggcccaggatgctgatttgaaggatgtaaatgtgattccagccaccgcctgaccatccgccattccgactgctaaaagcgaatgtagtcaggcccctttcatgctgtgagacctcctggaacactggcatctctgagcctccagaaggggttctgggcctagttgtcctccctctggagccccgtcctgtggtctgcctcagtttcccctcgaccgtgctgtgccacatcctctgatgtt

SEQ ID NO: 278922 - DNA, 1806 bp, Homo sapiens
ggcggagctcggggccgggactctcagcctatcaagtgtctgtaattaattaaccaactgagatccagttcaggggtgaaagttcttcaggtacgaggagggcattgttgtcagtctggaccgagcccgcagagcccctcctcggcgtcctggtcccggccgtgcccgcggtgtcccgggaggaaggggcgggccgggggtcgggaggagtcacgtgccccctcccgccccaggtcgtcctctcagcatgggggtcccgcggcctcagccctgggcgctggggctcctgctctttctccttcctgggagcctgggcgcagaaagccacctctccctcctgtaccaccttaccgcggtgtcctcgcctgccccggggactcctgccttctgggtgtccggctggctgggcccgcagcagtacctgagctacaatagcctgcggggcgaggcggagccctgtggagcttgggtctgggaaaaccaggtgtcctggtattgggagaaagagaccacagatctgaggatcaaggagaagctctttctggaagctttcaaagctttggggggaaaaggtccctacactctgcagggcctgctgggctgtgaactgggccctgacaacacctcggtgcccaccgccaagttcgccctgaacggcgaggagttcatgaatttcgacctcaagcagggcacctggggtggggactggcccgaggccctggctatcagtcagcggtggcagcagcaggacaaggcggccaacaaggagctcaccttcctgctattctcctgcccgcaccgcctgcgggagcacctggagaggggccgcggaaacctggagtggaaggacacggtgtctcactatgttgcccaggctggtcttgaactcctaggctccagcgattctcctgctttggtctcctgagtagctgagattacaggcacttgcactgttgcctagactggagtgcagtagcgggattagagttcactgcagcctcaacctcccaagctcaagcgatcctcccaccttacccttcctgaatggatggggccacaggagcccccctccatgcgcctgaaggcccgacccagcagccctggcttttccgtgcttacctgcagcgccttctccttctaccctccggagctgcaacttcggttcctgcggaatgggctggccgctggcaccggccagggtgacttcggccccaacagtgacggatccttccacgcctcgtcgtcactaacagtcaaaagtggcgatgagcaccactactgctgcattgtgcagcacgcggggctggcgcagcccctcagggtggagctggaatctccagccaagtcctccgtgctcgtggtgggaatcgtcatcggtgtcttgctactcacggcagcggctgtaggaggagctctgttgtggagaaggatgaggagtgggctgccagctctgttgtggagaaggatgaggagtgggctgccagccccttggatctcccttcgtggagacgacaccggggtcctcctgcccaccccaggggaggcccaggatgctgatttgaaggatgtaaatgtgattccagccaccgcctgaccatccgccattccgactgctaaaagcgaatgtagtcaggcccctttcatgctgtgagacctcctggaacactggcatctctgagcctccagaaggggttctgggcctagttgtcctccctctggagccccgtcctgtggtctgcctcagtttcccctcctaatacatatggctgttttccacctcgataatataacacgagtttgggcccg

SEQ ID NO: 278923 - DNA, 770 bp, Homo sapiens
tttaacgacgcagtgattctcgagcatgttggcctaccggtatcaagtgtctgtaattaattaaccaactgagatccagttcaggggtgaaagttcttcaggtacgaggagggcattgttgtcagtctggaccgagcccgcagagcccctcctcggcgtcctggtcccggccgtgcccgcggtgtcccgggaggaaggggcgggccgggggtcgggaggagtcacgtgccccctcccgccccaggtcgtcctctcagcatgggggtcccgcggcctcagccctgggcgctggggctcctgctctttctccttcctgggagcctgggcgcagaatctccagccaagtcctccgtgctcgtggtgggaatcgtcatcggtgtcttgctactcacggcagcggctgtaggaggagctctgttgtggagaaggatgaggagtgggctgccagccccttggatctcccttcgtggagacgacaccggggtcctcctgcccaccccaggggaggcccaggatgctgatttgaaggatgtaaatgtgattccagccaccgcctgaccatccgccattccgactgctaaaagcgaatgtagtcaggcccctttcatgctgtgagacctcctggaacactggcatctctgagcctccagaaggggttctgggcctagttgtcctccctctggagccccgtcctgtggtctgcctcagtttcccctcctaatacatatggctgttttccacctcgataatataacacgagtttgggcccg

SEQ ID NO: 278924 - DNA, 653 bp, Homo sapiens
tttaacgacgcagtgattctcgagcatgttggcctaccggtatcaagtgtctgtaattaattaaccaactgagatccagttcaggggtgaaagttcttcaggtacgaggagggcattgttgtcagtctggaccgagcccgcagagcccctcctcggcgtcctggtcccggccgtgcccgcggtgtcccgggaggaaggggcgggccgggggtcgggaggagtcacgtgccccctcccgccccaggtcgtcctctcagcatgggggtcccgcggcctcagccctgggcgctggggctcctgctctttctccttcctgggagcctgggcgcagccccttggatctcccttcgtggagacgacaccggggtcctcctgcccaccccaggggaggcccaggatgctgatttgaaggatgtaaatgtgattccagccaccgcctgaccatccgccattccgactgctaaaagcgaatgtagtcaggcccctttcatgctgtgagacctcctggaacactggcatctctgagcctccagaaggggttctgggcctagttgtcctccctctggagccccgtcctgtggtctgcctcagtttcccctcctaatacatatggctgttttccacctcgataatataacacgagtttgggcccg

SEQ ID NO: 278925 - DNA, 314 bp, Homo sapiens
ctactactactactactactactaaattcgcggccgcgtcgcccaggggaggcccaggatgctgatttgaaggatgtaaatgtgattccagccaccgcctgaccatccgccattccgactgctaaaagcgaatgtagtcaggcccctttcatgctgtgagacctcctggaacactggcatctctgagcctccagaaggggttctgggcctagttgtcctccctctggagccccgtcctgtggtctgcctcagtttcccctcctaatacatatggctgttttccacctcgataatataacacgagtttgggcccg

SEQ ID NO: 278926 - DNA, 1341 bp, Homo sapiens
  misc_feature (1236)..(1236): n is a, c, g, or t
  misc_feature (1241)..(1241): n is a, c, g, or t
  misc_feature (1251)..(1251): n is a, c, g, or t
  misc_feature (1257)..(1257): n is a, c, g, or t
  misc_feature (1259)..(1259): n is a, c, g, or t
  misc_feature (1262)..(1263): n is a, c, g, or t
  misc_feature (1279)..(1279): n is a, c, g, or t
  misc_feature (1305)..(1305): n is a, c, g, or t
ggcggagctcggggccgggactctcagcctatcaagtgtctgtaattaattaaccaactgagatccagttcaggggtgaaagttcttcaggtacgaggagggcattgttgtcagtctggaccgagcccgcagagcccctcctcggcgtcctggtcccggccgtgcccgcggtgtcccgggaggaaggggcgggccgggggtcgggaggagtcacgtgccccctcccgccccaggtcgtcctctcagcatgggggtcccgcggcctcagccctgggcgctggggctcctgctctttctccttcctgggagcctgggcgcagaaagccacctctccctcctgtaccaccttaccgcggtgtcctcgcctgccccggggactcctgccttctgggtgtccggctggctgggcccgcagcagtacctgagctacaatagcctgcggggcgaggcggagccctgtggagcttgggtctgggaaaaccaggtgtcctggtattgggagaaagagaccacagatctgaggatcaaggagaagctctttctggaagctttcaaagctttggggggaaaaggtccctacactctgcagggcctgctgggctgtgaactgggccctgacaacacctcggtgcccaccgccaagttcgccctgaacggcgaggagttcatgaatttcgacctcaagcagggcacctggggtggggactggcccgaggccctggctatcagtcagcggtggcagcagcaggacaaggcggccaacaaggagctcaccttcctgctattctcctgcccgcaccgcctgcgggagcacctggagaggggccgcggaaacctggagtggaaggagcccccctccatgcgcctgaaggcccgacccagcagccctggcttttccgtgcttacctgcagcgccttctccttctaccctccggagctgcaacttcggttcctgcggaatgggctggccgctggcaccggccagggtgacttcggccccaacagtgacggatccttccacgcctcgtcgtcactaacagtcaaaagtggcgatgagcaccactactgctgcattgtgcagcacgcggggctggcgcagcccctcagggtggagctggaatctccagccaagtcctccgtgctcgtggtgggaatcgtcatcggtgtcttgctactcacggcagcggctgtaggaggagctctgttgtggagaaggatgaggagtgggctgccagntgcancccttggatntccttntnganngaaacggggtctctgnccacccagggaggccagatgtgattnaagatgtaattgatcaccacgctgacatcgcattcg

SEQ ID NO: 278927 - DNA, 1420 bp, Homo sapiens
ggcggagctcggggccgggactctcagcctatcaagtgtctgtaattaattaaccaactgagatccagttcaggggtgaaagttcttcaggtacgaggagggcattgttgtcagtctggaccgagcccgcagagcccctcctcggcgtcctggtcccggccgtgcccgcggtgtcccgggaggaaggggcgggccgggggtcgggaggagtcacgtgccccctcccgccccaggtcgtcctctcagcatgggggtcccgcggcctcagccctgggcgctggggctcctgctctttctccttcctgggagcctgggcgcagaaagccacctctccctcctgtaccaccttaccgcggtgtcctcgcctgccccggggactcctgccttctgggtgtccggctggctgggcccgcagcagtacctgagctacaatagcctgcggggcgaggcggagccctgtggagcttgggtctgggaaaaccaggtgtcctggtattgggagaaagagaccacagatctgaggatcaaggagaagctctttctggaagctttcaaagctttggggggaaaaggtccctacactctgcagggcctgctgggctgtgaactgggccctgacaacacctcggtgcccaccgccaagttcgccctgaacggcgaggagttcatgaatttcgacctcaagcagggcacctggggtggggactggcccgaggccctggctatcagtcagcggtggcagcagcaggacaaggcggccaacaaggagctcaccttcctgctattctcctgcccgcaccgcctgcgggagcacctggagaggggccgcggaaacctggagtggaaggagcccccctccatgcgcctgaaggcccgacccagcagccctggcttttccgtgcttacctgcagcgccttctccttctaccctccggagctgcaacttcggttcctgcggaatgggctggccgctggcaccggccagggtgacttcggccccaacagtgacggatccttccacgcctcgtcgtcactaacagtcaaaagtggcgatgagcaccactactgctgcattgtgcagcacgcggggctggcgcagcccctcagggtggagctgggtgaggtcccgccaggtggtgatgctcctggtttcccgttgccttgtctcactgctgcgccggtccttcctgagtctgaccttcctccccactgctgccacctccttgaatctgactgccttgaacctcacgcctgtcagtgcccccaaaacctgatggcttgtccttcccaaggccaactgccttccgtctcctgctgcttctggcctcactgagtctgaagagctgttaactaccatggccagtcctccctgagtctgaccatctccaatcaactactgccaaaacgccgtcccaaagca

SEQ ID NO: 278928 - DNA, 678 bp, Homo sapiens
tttaacgacgcagtgattctcgagcatgttggcctaccggtatcaagtgtctgtaattaattaaccaactgagatccagttcaggggtgaaagttcttcaggtacgaggagggcattgttgtcagtctggaccgagcccgcagagcccctcctcggcgtcctggtcccggccgtgcccgcggtgtcccgggaggaaggggcgggccgggggtcgggaggagtcacgtgccccctcccgccccaggtcgtcctctcagcatgggggtcccgcggcctcagccctgggcgctggggctcctgctctttctccttcctgggagcctgggcgcaggtgagggccgctccgggtcagggccctgctgcaggcgggcggcgggaggcggccccaggcaggcaggggcgaagccagcgggacccgagttccccgcgagcccctggcgctgccttctccgctcaattaactttctcaacgtctcctgctgggcctgaggctgggaaccacctgtcgcctcttgtgtctgtttccctctctctctctgggtctctgtccccctctctttctgggtctcttgtctctctctctctctctctctctgggtctctgtccccacaagtgcaaaggttgagccgcccaaggaaaaattcaaacagccacaagtagaacattgtgacccacgc

SEQ ID NO: 278929 - DNA, 452 bp, Homo sapiens
  misc_feature (262)..(262): n is a, c, g, or t
  misc_feature (274)..(274): n is a, c, g, or t
ctactactactactactactactaaattcgcggccgcgtcgacgctgcgagaagacgacagaaggggttctgggcctagttgtcctccctctggagccccgtcctgtggtctgcctcagtttcccctcctaatacatatggctgttttccacctcgataatataacacgagtttgggcccgaaaaaaaaagaagaaaaaaaaaaaaagtcgtatcggatgtcagccgacatgatgatggaatgtcgcccggggaattcgganccggtcctggangggcgaccagcttcctttgggaggagtcgattaaacgctggggcgaacaatgggcaaaactgtttcctcgtggggaaaaaatttggtattcgctcaccaatccacaccacataccaccccggaattaaaagggggaaacccgggggggctaaagggggggagctactcaccttttttg

SEQ ID NO: 278930 - DNA, 422 bp, Homo sapiens
ctactactactactactactactaaattcgcggccgcgtcgacgctgcgagaagacgacaggcagcccctcagggtggagctggaatctccagccaagtcctccgtgctcgtggtgggaatcgtcatcggtgtcttgctactcacggcagcggctgtaggaggagctctgttgtggagaaggatgaggagtgggctgccagccccttggatctcccttcgtggagacgacaccggggtcctcctgcccaccccaggggaggcccaggatgctgatttgaaggatgtaaatgtgattccagccaccgcctgaccatccgccattccgactgctaaaagcgaatgtagtcaggcccctttcatgctgtgagacctcctggaggctcagagatgccagtgttccagggtcgacgcggccgcgaat

SEQ ID NO: 278931 - DNA, 1568 bp, Homo sapiens
tttaacgacgcagtgattctcgagcatgttggcctaccggtatcaagtgtctgtaattaattaaccaactgagatccagttcaggggtgaaagttcttcaggtacgaggagggcattgttgtcagtctggaccgagcccgcagagcccctcctcggcgtcctggtcccggccgtgcccgcggtgtcccgggaggaaggggcgggccgggggtcgggaggagtcacgtgccccctcccgccccaggtcgtcctctcagcatgggggtcccgcggcctcagccctgggcgctggggctcctgctctttctccttcctgggagcctgggcgcagaaagccacctctccctcctgtaccaccttaccgcggtgtcctcgcctgccccggggactcctgccttctgggtgtccggctggctgggcccgcagcagtacctgagctacaatagcctgcggggcgaggcggagccctgtggagcttgggtctgggaaaaccaggtgtcctggtattgggagaaagagaccacagatctgaggatcaaggagaagctctttctggaagctttcaaagctttggggggaaaaggtccctacactctgcagggcctgctgggctgtgaactgggccctgacaacacctcggtgcccaccgccaagttcgccctgaacggcgaggagttcatgaatttcgacctcaagcagggcacctggggtggggactggcccgaggccctggctatcagtcagcggtggcagcagcaggacaaggcggccaacaaggagctcaccttcctgctattctcctgcccgcaccgcctgcgggagcacctggagaggggccgcggaaacctggagtggaaggagcccccctccatgcgcctgaaggcccgacccagcagccctggcttttccgtgcttacctgcagcgccttctccttctaccctccggagctgcaacttcggttcctgcggaatgggctggccgctggcaccggccagggtgacttcggccccaacagtgacggatccttccacgcctcgtcgtcactaacagtcaaaagtggcgatgagcaccactactgctgcattgtgcagcacgcggggctggcgcagcccctcagggtggagctggaatctccagccaagtcctccgtgctcgtggtgggaatcgtcatcggtgtcttgctactcacggcagcggctgtaggaggagctctgttgtggagaaggatgaggagtgggctgccagccccttggatctcccttcgtggagacgacaccggggtcctcctgcccaccccaggggaggcccaggatgctgatttgaaggatgtaaatgtgattccagccaccgcctgaccatccgccattccgactgctaaaagcgaatgtagtcaggcccctttcatgctgtgagacctcctggaacactggcatctctgagcctccagaaggggttctgggcctagttgtcctccctctggagccccgtcctgtggtctgcctcagtttcccctcctaatacatatggctgttttccacctcgataatataacacgagtttgggcccg

SEQ ID NO: 278932 - DNA, 1796 bp, Homo sapiens
gaaggatattaaagagcacctgcaggaattttttaaggggatgccgggggaagggcttgaaggaggaactaaggaggcttccagaagattttgattaacagcgagcgctagggaaggccacggggatacagaggggtaggaggaggatccagagacctccaagttgtggactccggaggcatcgagttcctttcccagttttgtcaagaattccctgagcggcagacaccctcaaagtaaaaaacgggaaccacagagaaggaaaaagaagaaccacaagcgttttgagaaacaaacaggctgggcctagggcctggggtgtgccctgcaactggggggtggggctggatgttcttggagtcagggagcagcagcctcccacaggatgtgagagaggaactggggtctccagtcacgggagccaggagccggccagggccgcaggcaggaagggagcgaggctgaagggaacgtcgtcctctcagcatgggggtcccgcggcctcagccctgggcgctggggctcctgctctttctccttcctgggagcctgggcgcagaaagccacctctccctcctgtaccaccttaccgcggtgtcctcgcctgccccggggactcctgccttctgggtgtccggctggctgggcccgcagcagtacctgagctacaatagcctgcggggcgaggcggagccctgtggagcttgggtctgggaaaaccaggtgtcctggtattgggagaaagagaccacagatctgaggatcaaggagaagctctttctggaagctttcaaagctttggggggaaaaggtccctacactctgcagggcctgctgggctgtgaactgggccctgacaacacctcggtgcccaccgccaagttcgccctgaacggcgaggagttcatgaatttcgacctcaagcagggcacctggggtggggactggcccgaggccctggctatcagtcagcggtggcagcagcaggacaaggcggccaacaaggagctcaccttcctgctattctcctgcccgcaccgcctgcgggagcacctggagaggggccgcggaaacctggagtggaaggagcccccctccatgcgcctgaaggcccgacccagcagccctggcttttccgtgcttacctgcagcgccttctccttctaccctccggagctgcaacttcggttcctgcggaatgggctggccgctggcaccggccagggtgacttcggccccaacagtgacggatccttccacgcctcgtcgtcactaacagtcaaaagtggcgatgagcaccactactgctgcattgtgcagcacgcggggctggcgcagcccctcagggtggagctggaatctccagccaagtcctccgtgctcgtggtgggaatcgtcatcggtgtcttgctactcacggcagcggctgtaggaggagctctgttgtggagaaggatgaggagtgggctgccagccccttggatctcccttcgtggagacgacaccggggtcctcctgcccaccccaggggaggcccaggatgctgatttgaaggatgtaaatgtgattccagccaccgcctgaccatccgccattccgactgctaaaagcgaatgtagtcaggcccctttcatgctgtgagacctcctggaacactggcatctctgagcctccagaaggggttctgggcctagttgtcctccctctggagccccgtcctgtggtctgcctcagtttcccctcctaatacatatggctgttttccacctcgataatataacacgagtttgggcccg

SEQ ID NO: 278933 - DNA, 1709 bp, Homo sapiens
gaaggatattaaagagcacctgcaggaattttttaaggggatgccgggggaagggcttgaaggaggaactaaggaggcttccagaagattttgattaacagcgagcgctagggaaggccacggggatacagaggggtaggaggaggatccagagacctccaagttgtggactccggaggcatcgagttcctttcccagttttgtcaagaattccctgagcggcagacaccctcaaagtaaaaaacgggaaccacagagaaggaaaaagaagaaccacaagcgttttgagaaacaaacaggctgggcctagggcctggggtgtgccctgcaactggggggtggggctggatgttcttggagtcagggagcagcagcctcccacaggatgtgagagaggaactggggtctccagtcacgggagccaggagccggccagggccgcaggcaggaagggagcgaggctgaagggaacaaagccacctctccctcctgtaccaccttaccgcggtgtcctcgcctgccccggggactcctgccttctgggtgtccggctggctgggcccgcagcagtacctgagctacaatagcctgcggggcgaggcggagccctgtggagcttgggtctgggaaaaccaggtgtcctggtattgggagaaagagaccacagatctgaggatcaaggagaagctctttctggaagctttcaaagctttggggggaaaaggtccctacactctgcagggcctgctgggctgtgaactgggccctgacaacacctcggtgcccaccgccaagttcgccctgaacggcgaggagttcatgaatttcgacctcaagcagggcacctggggtggggactggcccgaggccctggctatcagtcagcggtggcagcagcaggacaaggcggccaacaaggagctcaccttcctgctattctcctgcccgcaccgcctgcgggagcacctggagaggggccgcggaaacctggagtggaaggagcccccctccatgcgcctgaaggcccgacccagcagccctggcttttccgtgcttacctgcagcgccttctccttctaccctccggagctgcaacttcggttcctgcggaatgggctggccgctggcaccggccagggtgacttcggccccaacagtgacggatccttccacgcctcgtcgtcactaacagtcaaaagtggcgatgagcaccactactgctgcattgtgcagcacgcggggctggcgcagcccctcagggtggagctggaatctccagccaagtcctccgtgctcgtggtgggaatcgtcatcggtgtcttgctactcacggcagcggctgtaggaggagctctgttgtggagaaggatgaggagtgggctgccagccccttggatctcccttcgtggagacgacaccggggtcctcctgcccaccccaggggaggcccaggatgctgatttgaaggatgtaaatgtgattccagccaccgcctgaccatccgccattccgactgctaaaagcgaatgtagtcaggcccctttcatgctgtgagacctcctggaacactggcatctctgagcctccagaaggggttctgggcctagttgtcctccctctggagccccgtcctgtggtctgcctcagtttcccctcctaatacatatggctgttttccacctcgataatataacacgagtttgggcccg

SEQ ID NO: 278934 - DNA, 1369 bp, Homo sapiens
ctgccctggctgatctagaggaccccgcccaatggcaagcctgaaaagattcttctccctccctgggtatctgtcccactgcagtctagttccccgcccgtgtgctcccttcagctctgtttctgtctgcagaaagccacctctccctcctgtaccaccttaccgcggtgtcctcgcctgccccggggactcctgccttctgggtgtccggctggctgggcccgcagcagtacctgagctacaatagcctgcggggcgaggcggagccctgtggagcttgggtctgggaaaaccaggtgtcctggtattgggagaaagagaccacagatctgaggatcaaggagaagctctttctggaagctttcaaagctttggggggaaaaggtccctacactctgcagggcctgctgggctgtgaactgggccctgacaacacctcggtgcccaccgccaagttcgccctgaacggcgaggagttcatgaatttcgacctcaagcagggcacctggggtggggactggcccgaggccctggctatcagtcagcggtggcagcagcaggacaaggcggccaacaaggagctcaccttcctgctattctcctgcccgcaccgcctgcgggagcacctggagaggggccgcggaaacctggagtggaaggagcccccctccatgcgcctgaaggcccgacccagcagccctggcttttccgtgcttacctgcagcgccttctccttctaccctccggagctgcaacttcggttcctgcggaatgggctggccgctggcaccggccagggtgacttcggccccaacagtgacggatccttccacgcctcgtcgtcactaacagtcaaaagtggcgatgagcaccactactgctgcattgtgcagcacgcggggctggcgcagcccctcagggtggagctggaatctccagccaagtcctccgtgctcgtggtgggaatcgtcatcggtgtcttgctactcacggcagcggctgtaggaggagctctgttgtggagaaggatgaggagtgggctgccagccccttggatctcccttcgtggagacgacaccggggtcctcctgcccaccccaggggaggcccaggatgctgatttgaaggatgtaaatgtgattccagccaccgcctgaccatccgccattccgactgctaaaagcgaatgtagtcaggcccctttcatgctgtgagacctcctggaacactggcatctctgagcctccagaaggggttctgggcctagttgtcctccctctggagccccgtcctgtggtctgcctcagtttcccctcctaatacatatggctgttttccacctcgataatataacacgagtttgggcccg

SEQ ID NO: 278935 - DNA, 2770 bp, Homo sapiens
ggcggagctcggggccgggactctcagcctatcaagtgtctgtaattaattaaccaactgagatccagttcaggggtgaaagttcttcaggtacgaggagggcattgttgtcagtctggaccgagcccgcagagcccctcctcggcgtcctggtcccggccgtgcccgcggtgtcccgggaggaaggggcgggccgggggtcgggaggagtcacgtgccccctcccgccccaggtcgtcctctcagcatgggggtcccgcggcctcagccctgggcgctggggctcctgctctttctccttcctgggagcctgggcgcagaaagccacctctccctcctgtaccaccttaccgcggtgtcctcgcctgccccggggactcctgccttctgggtgtccggctggctgggcccgcagcagtacctgagctacaatagcctgcggggcgaggcggagccctgtggagcttgggtctgggaaaaccaggtgtcctggtattgggagaaagagaccacagatctgaggatcaaggagaagctctttctggaagctttcaaagctttggggggaaaaggtccctacactctgcagggcctgctgggctgtgaactgggccctgacaacacctcggtgcccaccgccaagttcgccctgaacggcgaggagttcatgaatttcgacctcaagcagggcacctggggtggggactggcccgaggccctggctatcagtcagcggtggcagcagcaggacaaggcggccaacaaggagctcaccttcctgctattctcctgcccgcaccgcctgcgggagcacctggagaggggccgcggaaacctggagtggaaggaaccaaaggccagacagattttctgtgcttggatttagtctatattggaagtaccttgaggctgaaggcacgtggctgtgagcacgacacaggaagatacagatttgctgaaaagaatagtgaacataaagcagaagccagaactgctgatggccgtcagcccggtccctccattccacctgacggtgcagcaaattctgccgacttgccagagaggcagctccaggagggagaagctgctgtgctttcctgaagcagcaaatgtgttttctgctgagcaaccaaaaccaagatcccagccaagacccacgattgcccagatccaccctccctgaaaggaacttgggcagtaatgcccagtcctaggcagttgctgaaatctttgccttttattttcttttttgagctgggatcttgctctgtcgcccagactggagtggagtgcagtggcacagtcatagcgccatgtagccttggactcccaagctcaagagatcctcccgcctcagccttacaagtagctgggactatagagcccccctccatgcgcctgaaggcccgacccagcagccctggcttttccgtgcttacctgcagcgccttctccttctaccctccggagctgcaacttcggttcctgcggaatgggctggccgctggcaccggccagggtgacttcggccccaacagtgacggatccttccacgcctcgtcgtcactaacagtcaaaagtggcgatgagcaccactactgctgcattgtgcagcacgcggggctggcgcagcccctcagggtggagctgggtgaggtcccgccaggtggtgatgctcctggtttcccgttgccttgtctcactgctgcgccggtccttcctgagtctgaccttcctccccactgctgccacctccttgaatctgactgccttgaacctcacgcctgtcagtgcccccaaaacctgatggcttgtccttcccaaggccaactgccttccgtctcctgctgcttctggcctcactgagtctgaagagctgttaactaccatggccagtcctccctgagtctgaccatcttccatcctgctgctgctgctgctgctgctgcgggtcttcctggaatctgaccattcgttgtctgctatgcccgtcctcaccaagactgactgcctgctgctttgctactgcccgggcccatgagactgacttcccactgctctgcctgcctctccccactgcactggcacagccccgccttgccgctgctgatccattgccggtgtgaccgcggccgctcgtgctgtagctggttcttacgtccaacctgggggcagtctgcccagatcgcctgcctggcctcgcctctgcccatcagacacttggtgctggaatctccgaggctgggagggactgggagcgccccagttctgtgtcctgactgggtggggtggaggggctgctccacatctcacagcgttctctggctgcagaatctccagccaagtcctccgtgctcgtggtgggaatcgtcatcggtgtcttgctactcacggcagcggctgtaggaggagctctgttgtggagaaggatgaggagtgggctgccagccccttggatctcccttcgtggagacgacaccggggtcctcctgcccaccccaggggaggcccaggatgctgatttgaaggatgtaaatgtgattccagccaccgcctgaccatccgccattccgactgctaaaagcgaatgtagtcaggcccctttcatgctgtgagacctcctggaacactggcatctctgagcctccagaaggggttctgggcctagttgtcctccctctggagccccgtcctgtggtctgcctcagtttcccctcctaatacatatggctgttttccacctcgataatataacacgagtttgggcccg

SEQ ID NO: 278936 - DNA, 2364 bp, Homo sapiens
ggcggagctcggggccgggactctcagcctatcaagtgtctgtaattaattaaccaactgagatccagttcaggggtgaaagttcttcaggtacgaggagggcattgttgtcagtctggaccgagcccgcagagcccctcctcggcgtcctggtcccggccgtgcccgcggtgtcccgggaggaaggggcgggccgggggtcgggaggagtcacgtgccccctcccgccccaggtcgtcctctcagcatgggggtcccgcggcctcagccctgggcgctggggctcctgctctttctccttcctgggagcctgggcgcagaaagccacctctccctcctgtaccaccttaccgcggtgtcctcgcctgccccggggactcctgccttctgggtgtccggctggctgggcccgcagcagtacctgagctacaatagcctgcggggcgaggcggagccctgtggagcttgggtctgggaaaaccaggtgtcctggtattgggagaaagagaccacagatctgaggatcaaggagaagctctttctggaagctttcaaagctttggggggaaaaggtccctacactctgcagggcctgctgggctgtgaactgggccctgacaacacctcggtgcccaccgccaagttcgccctgaacggcgaggagttcatgaatttcgacctcaagcagggcacctggggtggggactggcccgaggccctggctatcagtcagcggtggcagcagcaggacaaggcggccaacaaggagctcaccttcctgctattctcctgcccgcaccgcctgcgggagcacctggagaggggccgcggaaacctggagtggaaggctgggatcttgctctgtcgcccagactggagtggagtgcagtggcacagtcatagcgccatgtagccttggactcccaagctcaagagatcctcccgcctcagccttacaagtagctgggactatagagcccccctccatgcgcctgaaggcccgacccagcagccctggcttttccgtgcttacctgcagcgccttctccttctaccctccggagctgcaacttcggttcctgcggaatgggctggccgctggcaccggccagggtgacttcggccccaacagtgacggatccttccacgcctcgtcgtcactaacagtcaaaagtggcgatgagcaccactactgctgcattgtgcagcacgcggggctggcgcagcccctcagggtggagctgggtgaggtcccgccaggtggtgatgctcctggtttcccgttgccttgtctcactgctgcgccggtccttcctgagtctgaccttcctccccactgctgccacctccttgaatctgactgccttgaacctcacgcctgtcagtgcccccaaaacctgatggcttgtccttcccaaggccaactgccttccgtctcctgctgcttctggcctcactgagtctgaagagctgttaactaccatggccagtcctccctgagtctgaccatcttccatcctgctgctgctgctgctgctgctgcgggtcttcctggaatctgaccattcgttgtctgctatgcccgtcctcaccaagactgactgcctgctgctttgctactgcccgggcccatgagactgacttcccactgctctgcctgcctctccccactgcactggcacagccccgccttgccgctgctgatccattgccggtgtgaccgcggccgctcgtgctgtagctggttcttacgtccaacctgggggcagtctgcccagatcgcctgcctggcctcgcctctgcccatcagacacttggtgctggaatctccgaggctgggagggactgggagcgccccagttctgtgtcctgactgggtggggtggaggggctgctccacatctcacagcgttctctggctgcagaatctccagccaagtcctccgtgctcgtggtgggaatcgtcatcggtgtcttgctactcacggcagcggctgtaggaggagctctgttgtggagaaggatgaggagtgggctgccagccccttggatctcccttcgtggagacgacaccggggtcctcctgcccaccccaggggaggcccaggatgctgatttgaaggatgtaaatgtgattccagccaccgcctgaccatccgccattccgactgctaaaagcgaatgtagtcaggcccctttcatgctgtgagacctcctggaacactggcatctctgagcctccagaaggggttctgggcctagttgtcctccctctggagccccgtcctgtggtctgcctcagtttcccctcctaatacatatggctgttttccacctcgataatataacacgagtttgggcccg

SEQ ID NO: 278937 - DNA, 2021 bp, Homo sapiens
tttaacgacgcagtgattctcgagcatgttggcctaccggtatcaagtgtctgtaattaattaaccaactgagatccagttcaggggtgaaagttcttcaggtacgaggagggcattgttgtcagtctggaccgagcccgcagagcccctcctcggcgtcctggtcccggccgtgcccgcggtgtcccgggaggaaggggcgggccgggggtcgggaggagtcacgtgccccctcccgccccaggtcgtcctctcagcatgggggtcccgcggcctcagccctgggcgctggggctcctgctctttctccttcctgggagcctgggcgcagaaagccacctctccctcctgtaccaccttaccgcggtgtcctcgcctgccccggggactcctgccttctgggtgtccggctggctgggcccgcagcagtacctgagctacaatagcctgcggggcgaggcggagccctgtggagcttgggtctgggaaaaccaggtgtcctggtattgggagaaagagaccacagatctgaggatcaaggagaagctctttctggaagctttcaaagctttggggggaaaagcgcctgcgggagcacctggagaggggccgcggaaacctggagtggaaggagcccccctccatgcgcctgaaggcccgacccagcagccctggcttttccgtgcttacctgcagcgccttctccttctaccctccggagctgcaacttcggttcctgcggaatgggctggccgctggcaccggccagggtgacttcggccccaacagtgacggatccttccacgcctcgtcgtcactaacagtcaaaagtggcgatgagcaccactactgctgcattgtgcagcacgcggggctggcgcagcccctcagggtggagctgggtgaggtcccgccaggtggtgatgctcctggtttcccgttgccttgtctcactgctgcgccggtccttcctgagtctgaccttcctccccactgctgccacctccttgaatctgactgccttgaacctcacgcctgtcagtgcccccaaaacctgatggcttgtccttcccaaggccaactgccttccgtctcctgctgcttctggcctcactgagtctgaagagctgttaactaccatggccagtcctccctgagtctgaccatcttccatcctgctgctgctgctgctgctgctgcgggtcttcctggaatctgaccattcgttgtctgctatgcccgtcctcaccaagactgactgcctgctgctttgctactgcccgggcccatgagactgacttcccactgctctgcctgcctctccccactgcactggcacagccccgccttgccgctgctgatccattgccggtgtgaccgcggccgctcgtgctgtagctggttcttacgtccaacctgggggcagtctgcccagatcgcctgcctggcctcgcctctgcccatcagacacttggtgctggaatctccgaggctgggagggactgggagcgccccagttctgtgtcctgactgggtggggtggaggggctgctccacatctcacagcgttctctggctgcagaatctccagccaagtcctccgtgctcgtggtgggaatcgtcatcggtgtcttgctactcacggcagcggctgtaggaggagctctgttgtggagaaggatgaggagtgggctgccagccccttggatctcccttcgtggagacgacaccggggtcctcctgcccaccccaggggaggcccaggatgctgatttgaaggatgtaaatgtgattccagccaccgcctgaccatccgccattccgactgctaaaagcgaatgtagtcaggcccctttcatgctgtgagacctcctggaacactggcatctctgagcctccagaaggggttctgggcctagttgtcctccctctggagccccgtcctgtggtctgcctcagtttcccctcctaatacatatggctgttttccacctcgataatataacacgagtttgggcccg

SEQ ID NO: 278938 - DNA, 2178 bp, Homo sapiens
tttaacgacgcagtgattctcgagcatgttggcctaccggtatcaagtgtctgtaattaattaaccaactgagatccagttcaggggtgaaagttcttcaggtacgaggagggcattgttgtcagtctggaccgagcccgcagagcccctcctcggcgtcctggtcccggccgtgcccgcggtgtcccgggaggaaggggcgggccgggggtcgggaggagtcacgtgccccctcccgccccaggtcgtcctctcagcatgggggtcccgcggcctcagccctgggcgctggggctcctgctctttctccttcctgggagcctgggcgcagaaagccacctctccctcctgtaccaccttaccgcggtgtcctcgcctgccccggggactcctgccttctgggtgtccggctggctgggcccgcagcagtacctgagctacaatagcctgcggggcgaggcggagccctgtggagcttgggtctgggaaaaccaggtgtcctggtattgggagaaagagaccacagatctgaggatcaaggagaagctctttctggaagctttcaaagctttggggggaaaaggtccctacactctgcagggcctgctgggctgtgaactgggccctgacaacactggggtggggactggcccgaggccctggctatcagtcagcggtggcagcagcaggacaaggcggccaacaaggagctcaccttcctgctattctcctgcccgcaccgcctgcgggagcacctggagaggggccgcggaaacctggagtggaaggagcccccctccatgcgcctgaaggcccgacccagcagccctggcttttccgtgcttacctgcagcgccttctccttctaccctccggagctgcaacttcggttcctgcggaatgggctggccgctggcaccggccagggtgacttcggccccaacagtgacggatccttccacgcctcgtcgtcactaacagtcaaaagtggcgatgagcaccactactgctgcattgtgcagcacgcggggctggcgcagcccctcagggtggagctgggtgaggtcccgccaggtggtgatgctcctggtttcccgttgccttgtctcactgctgcgccggtccttcctgagtctgaccttcctccccactgctgccacctccttgaatctgactgccttgaacctcacgcctgtcagtgcccccaaaacctgatggcttgtccttcccaaggccaactgccttccgtctcctgctgcttctggcctcactgagtctgaagagctgttaactaccatggccagtcctccctgagtctgaccatcttccatcctgctgctgctgctgctgctgctgcgggtcttcctggaatctgaccattcgttgtctgctatgcccgtcctcaccaagactgactgcctgctgctttgctactgcccgggcccatgagactgacttcccactgctctgcctgcctctccccactgcactggcacagccccgccttgccgctgctgatccattgccggtgtgaccgcggccgctcgtgctgtagctggttcttacgtccaacctgggggcagtctgcccagatcgcctgcctggcctcgcctctgcccatcagacacttggtgctggaatctccgaggctgggagggactgggagcgccccagttctgtgtcctgactgggtggggtggaggggctgctccacatctcacagcgttctctggctgcagaatctccagccaagtcctccgtgctcgtggtgggaatcgtcatcggtgtcttgctactcacggcagcggctgtaggaggagctctgttgtggagaaggatgaggagtgggctgccagccccttggatctcccttcgtggagacgacaccggggtcctcctgcccaccccaggggaggcccaggatgctgatttgaaggatgtaaatgtgattccagccaccgcctgaccatccgccattccgactgctaaaagcgaatgtagtcaggcccctttcatgctgtgagacctcctggaacactggcatctctgagcctccagaaggggttctgggcctagttgtcctccctctggagccccgtcctgtggtctgcctcagtttcccctcctaatacatatggctgttttccacctcgataatataacacgagtttgggcccg

SEQ ID NO: 278939 - DNA, 1907 bp, Homo sapiens
  misc_feature (1717)..(1717): n is a, c, g, or t
  misc_feature (1729)..(1729): n is a, c, g, or t
ggcggagctcggggccgggactctcagcctatcaagtgtctgtaattaattaaccaactgagatccagttcaggggtgaaagttcttcaggtacgaggagggcattgttgtcagtctggaccgagcccgcagagcccctcctcggcgtcctggtcccggccgtgcccgcggtgtcccgggaggaaggggcgggccgggggtcgggaggagtcacgtgccccctcccgccccaggtcgtcctctcagcatgggggtcccgcggcctcagccctgggcgctggggctcctgctctttctccttcctgggagcctgggcgcagaaagccacctctccctcctgtaccaccttaccgcggtgtcctcgcctgccccggggactcctgccttctgggtgtccggctggctgggcccgcagcagtacctgagctacaatagcctgcggggcgaggcggagccctgtggagcttgggtctgggaaaaccaggtgtcctggtattgggagaaagagaccacagatctgaggatcaaggagaagctctttctggaagctttcaaagctttggggggaaaaggtccctacactctgcagggcctgctgggctgtgaactgggccctgacaacacctcggtgcccaccgccaagttcgccctgaacggcgaggagttcatgaatttcgacctcaagcagggcacctggggtggggactggcccgaggccctggctatcagtcagcggtggcagcagcaggacaaggcggccaacaaggagctcaccttcctgctattctcctgcccgcaccgcctgcgggagcacctggagaggggccgcggaaacctggagtggaaggagcccccctccatgcgcctgaaggcccgacccagcagccctggcttttccgtgcttacctgcagcgccttctccttctaccctccggagctgcaacttcggttcctgcggaatgggctggccgctggcaccggccagggtgacttcggccccaacagtgacggatccttccacgcctcgtcgtcactaacagtcaaaagtggcgatgagcaccactactgctgcattgtgcagcacgcggggctggcgcagcccctcagggtggagctggaatctccagccaagtcctccgtgctcgtggtgggaatcgtcatcggtgtcttgctactcacggcagcggctgtaggaggagctctgttgtggagaaggatgaggagtgggctgccagccccttggatctcccttcgtggagacgacaccggggtcctcctgcccaccccaggggaggcccaggatgctgatttgaaggatgtaaatgtgattccagccaccgcctgaccatccgccattccgactgctaaaagcgaatgtagtcaggcccctttcatgctgtgagacctcctggaacactggcatctctgagcctccagaaggggttctgggcctagttgtcctccctctggagccccgtcctgtggtctgcctcagtttcccctcctaatacatatggctgttttccacctcgataatataacacgagtttgggcccgaaaaaaaaaaaaaaaaaaaccaaaaaaaaaaaaaaaaaaaaaaaaaaaaaaaaaaaaaaaaaaaaaaaaaaaaaaaaaaaaaaaaaaagaagaaaaaaaaaaaaagtcgtatcggatgtcagccgacatgatgatggaatgtcgcccggggaattcgganccggtcctggangggcgaccagcttcctttgggaggagtcgattaaacgctggggcgaacaatgggcaaaactgtttcctcgtggggaaaaaatttggtattcgctcaccaatccacaccacataccaccccggaattaaaagggggaaacccgggggggctaaagggggggagctactcaccttttttg

SEQ ID NO: 278940 - DNA, 889 bp, Homo sapiens
  misc_feature (46)..(46): n is a, c, g, or t
  misc_feature (62)..(62): n is a, c, g, or t
  misc_feature (77)..(77): n is a, c, g, or t
  misc_feature (82)..(84): n is a, c, g, or t
  misc_feature (104)..(104): n is a, c, g, or t
  misc_feature (108)..(108): n is a, c, g, or t
  misc_feature (124)..(124): n is a, c, g, or t
  misc_feature (151)..(151): n is a, c, g, or t
  misc_feature (204)..(204): n is a, c, g, or t
  misc_feature (212)..(212): n is a, c, g, or t
tgcagtcaggcggtggcacgcaggcaggagcaagggcgggccaagnaagggggctcagcctngcctgctattgctgnctgcnnncgcagcccggctggcgggangcancctggaagagggggcncgcggaaaaccctggatgtgggaaggncgccccccgctgccattggcgcgctggaagggcgccgagccgcaggcaggccnctgggctntttgccgtggctatagcctggcacgcgcgcttgctgcgcttgctagcgcctccggagctgcaacttcggttcctgcggaatgggctggccgctggcaccggccagggtgacttcggccccaacagtgacggatccttccacgcctcgtcgtcactaacagtcaaaagtggcgatgagcaccactactgctgcattgtgcagcacgcggggctggcgcagcccctcagggtggagctggaatctccagccaagtcctccgtgctcgtggtgggaatcgtcatcggtgtcttgctactcacggcagcggctgtaggaggagctctgttgtggagaaggatgaggagtgggctgccagccccttggatctcccttcgtggagacgacaccggggtcctcctgcccaccccaggggaggcccaggatgctgatttgaaggatgtaaatgtgattccagccaccgcctgaccatccgccattccgactgctaaaagcgaatgtagtcaggcccctttcatgctgtgagacctcctggaacactggcatctctgagcctccagaaggggttctgggcctagttgtcctccctctggagccccgtcctgtggtctgcctcagtttcccctcctaatacatatggctgttttccacctcgataatataacacgagtttgggcccg

SEQ ID NO: 278941 - DNA, 2743 bp, Homo sapiens
ggcggagctcggggccgggactctcagcctatcaagtgtctgtaattaattaaccaactgagatccagttcaggggtgaaagttcttcaggtacgaggagggcattgttgtcagtctggaccgagcccgcagagcccctcctcggcgtcctggtcccggccgtgcccgcggtgtcccgggaggaaggggcgggccgggggtcgggaggagtcacgtgccccctcccgccccaggtcgtcctctcagcatgggggtcccgcggcctcagccctgggcgctggggctcctgctctttctccttcctgggagcctgggcgcagaaagccacctctccctcctgtaccaccttaccgcggtgtcctcgcctgccccggggactcctgccttctgggtgtccggctggctgggcccgcagcagtacctgagctacaatagcctgcggggcgaggcggagccctgtggagcttgggtctgggaaaaccaggtgtcctggtattgggagaaagagaccacagatctgaggatcaaggagaagctctttctggaagctttcaaagctttggggggaaaaggtccctacactctgcagggcctgctgggctgtgaactgggccctgacaacacctcggtgcccaccgccaagttcgccctgaacggcgaggagttcatgaatttcgacctcaagcagggcacctggggtggggactggcccgaggccctggctatcagtcagcggtggcagcagcaggacaaggcggccaacaaggagctcaccttcctgctattctcctgcccgcaccgcctgcgggagcacctggagaggggccgcggaaacctggagtggaaggagcccccctccatgcgcctgaaggcccgacccagcagccctggcttttccgtgcttacctgcagcgccttctccttctaccctccggagctgcaacttcggttcctgcggaatgggctggccgctggcaccggccagggtgacttcggccccaacagtgacggatccttccacgcctcgtcgtcactaacagtcaaaagtggcgatgagcaccactactgctgcattgtgcagcacgcggggctggcgcagcccctcagggtggagctgggtgaggtcccgccaggtggtgatgctcctggtttcccgttgccttgtctcactgctgcgccggtccttcctgagtctgaccttcctccccactgctgccacctccttgaatctgactgccttgaacctcacgcctgtcagtgcccccaaaacctgatggcttgtccttcccaaggccaactgccttccgtctcctgctgcttctggcctcactgagtctgaagagctgttaactaccatggccagtcctccctgagtctgaccatcttccatcctgctgctgctgctgctgctgctgcgggtcttcctggaatctgaccattcgttgtctgctatgcccgtcctcaccaagactgactgcctgctgctttgctactgcccgggcccatgagactgacttcccactgctctgcctgcctctccccactgcactggcacagccccgccttgccgctgctgatccattgccggtgtgaccgcggccgctcgtgctgtagctggttcttacgtccaacctgggggcagtctgcccagatcgcctgcctggcctcgcctctgcccatcagacacttggtgctggaatctccgaggctgggagggactgggagcgccccagttctgtgtcctgactgggtggggtggaggggctgctccacatctcacagcgttctctggctgcagaatctccagccaagtcctccgtgctcgtggtgggaatcgtcatcggtgtcttgctactcacggcagcggctgtaggaggagctctgttgtggagaaggatgaggagtgggctgccagccccttggatctcccttcgtggagacgacaccggggtcctcctgcccaccccaggggaggcccaggatgctgatttgaaggatgtaaatgtgattccagccaccgcctgaccatccgccattccgactgctaaaagcgaatgtagtcaggcccctttcatgctgtgagacctcctggaacactggcatctctgagcctccagaaggggttctgggcctagttgtcctccctctggagccccgtcctgtggtctgcctcagtttcccctcctaatacatatggctgttttccacctcgataatataacacgagtttgggcccgaaaaaaaaaaaaaaaaaaaccaaaaaaaaaaaaaaaaaaaaaaaaaaaaaaaaaaaaaaaaaaaaaaaaaaaaaaaaaaaaaaaaaaagaagaaaaaaaaaaaaagagggggggggggcgaaaaaaattcaccccgaggagggaggcagcacatgttggacgcccccacgatttgttggttgagcagggaggcgccacaataatgggggggcgcttaataaagacagcagcggcagcacgccggcagagtaaaaaacacgccgcgggcgggagaggaaaaccactgactcacgggaggaatcttcgggggagagagcccacccccctgcgggcggggggcggaaacaagaggggccacacaccccccctgaaaaagtaattaacgcctgcggcgggcgaatataaaaacggcggagcgctgatagtggttgaacacccaaccaccgactaatactgccgcgatcgaaaaagggcgccgcacgacgatgattatgacaaaatttcac

SEQ ID NO: 278942 - DNA, 1651 bp, Homo sapiens
ggcggagctcggggccgggactctcagcctatcaagtgtctgtaattaattaaccaactgagatccagttcaggggtgaaagttcttcaggtacgaggagggcattgttgtcagtctggaccgagcccgcagagcccctcctcggcgtcctggtcccggccgtgcccgcggtgtcccgggaggaaggggcgggccgggggtcgggaggagtcacgtgccccctcccgccccaggtcgtcctctcagcatgggggtcccgcggcctcagccctgggcgctggggctcctgctctttctccttcctgggagcctgggcgcagaaagccacctctccctcctgtaccaccttaccgcggtgtcctcgcctgccccggggactcctgccttctgggtgtccggctggctgggcccgcagcagtacctgagctacaatagcctgcggggcgaggcggagccctgtggagcttgggtctgggaaaaccaggtgtcctggtattgggagaaagagaccacagatctgaggatcaaggagaagctctttctggaagctttcaaagctttggggggaaaaggtccctacactctgcagggcctgctgggctgtgaactgggccctgacaacacctcggtgcccaccgccaagttcgccctgaacggcgaggagttcatgaatttcgacctcaagcagggcacctggggtggggactggcccgaggccctggctatcagtcagcggtggcagcagcaggacaaggcggccaacaaggagctcaccttcctgctattctcctgcccgcaccgcctgcgggagcacctggagaggggccgcggaaacctggagtggaaggagcccccctccatgcgcctgaaggcccgacccagcagccctggcttttccgtgcttacctgcagcgccttctccttctaccctccggagctgcaacttcggttcctgcggaatgggctggccgctggcaccggccagggtgacttcggccccaacagtgacggatccttccacgcctcgtcgtcactaacagtcaaaagtggcgatgagcaccactactgctgcattgtgcagcacgcggggctggcgcagcccctcagggtggagctgggtgaggtcccgccaggtggtgatgctcctggtttcccgttgccttgtctcactgctgcgccggtccttcctgagtctgaccttcctccccactgctgccacctccttgaatctgactgccttgaacctcacgcctgtcagtgcccccaaaacctgatggcttgtccttcccaaggccaactgccttccgtctcctgctgcttctggcctcactgagtctgaagagctgttaactaccatggccagtcctccctgagtctgaccatcttccatcctgctgctgctgctgctgctgctgcgggtcttcctggaatctgaccattcgttgtctgctatgcccgtcctcaccaagactgactgcctgctgctttgctactgcccgggcccatgagactgacttcccactgctcgcccctgagttagccgcagctcgcccctgagttagcagctcgcccctgagttgcagctcgcccctgagttacagctcgccccttagttgcagctcgcccctgagttgcagctcgcccctgagtt

SEQ ID NO: 278943 - DNA, 1002 bp, Homo sapiens
  misc_feature (970)..(970): n is a, c, g, or t
  misc_feature (980)..(980): n is a, c, g, or t
  misc_feature (982)..(982): n is a, c, g, or t
ggcggagctcggggccgggactctcagcctatcaagtgtctgtaattaattaaccaactgagatccagttcaggggtgaaagttcttcaggtacgaggagggcattgttgtcagtctggaccgagcccgcagagcccctcctcggcgtcctggtcccggccgtgcccgcggtgtcccgggaggaaggggcgggccgggggtcgggaggagtcacgtgccccctcccgccccaggtcgtcctctcagcatgggggtcccgcggcctcagccctgggcgctggggctcctgctctttctccttcctgggagcctgggcgcagaaagccacctctccctcctgtaccaccttaccgcggtgtcctcgcctgccccggggactcctgccttctgggtgtccggctggctgggcccgcagcagtacctgagctacaatagcctgcggggcgaggcggagccctgtggagcttgggtctgggaaaaccaggtgtcctggtattgggagaaagagaccacagatctgaggatcaaggagaagctctttctggaagctttcaaagctttggggggaaaaggtccctacactctgcagggcctgctgggctgtgaactgggccctgacaacacctcggtgcccaccgccaagttcgccctgaacggcgaggagttcatgaatttcgacctcaagcagggcacctggggtggggactggcccgaggccctggctatcagtcagcggtggcagcagcaggacaaggcggccaacaaggagctcaccttcctgctattctcctgcccgcaccgcctgcgggagcacctggagaggggccgcggaaacctggagtggaagggcacttgcactgttgcctagactggagtgcagtagcgggattagagttcactgcagcctcaacctcccaagctcaagcgatcctcccaccttacccttcctgaatggatggggccacaggcnccctcatgcncngaagcccgaccacgatgcgc

SEQ ID NO: 278944 - DNA, 2094 bp, Homo sapiens
agggaagtggggtggctccccatggcttctcccggggctggcactgaagctggagcacaggatgtgctgacgggggtccagaggcagagtccttaacttactcagcttaagcgtggcatggagtcccaactgggaggggccctggcagcatgaaacccccacccccactctctgcgacggcccagatggagggcaggaggaacagcggttcagccctggctggggctgcaggggctggggtgtgttactcactggcacgatggagaactgcatgaagaggcagcggagtgctgtctgtccccacccttccccgcccggcctccaactggtgggaactggattttgcggctgcagaggacttccccaaattttgccacattaacagctgactgcacacctgagccccgaggtgaagcagggcctcaggtagccagggaactggttgagcagaggaaatcggagagacctttttttttgtcatgaacaggctcagtgtgaatgggggaacttcctggttctgagggaatgtgggaaaattgccctttaggctgggtgaagaagaaagcaagtggaaccctggcacccctggacttcctcctccagaggaagcggctttggttgtgggccagcgagcctgtgcgtccccagccccagggcattcaccgcttcagagaagcaaggcgacagttctgccggatgagaggatccaggctgactggaggaaggaagggctttggctcatctgggctcaggtttgggagagatggcttctcagaggaggtgatgcctcagccagtcttaaaggcaatgcggtgtgcagagggtgcttggtggttctctcctgatggccccgcagggtctgcagcctccatctggccagcagagggcgcagaaggactgcctgggcagctcggacgtgaccgcctggaagtggtgtacagcgttcctgacaacgttcccggccaaaacgggtcccgccgcccacttgtgtgcaagataactggaaaatgtctttctgtgtgctccgaggagaatgcaaaggctggtggatgtagtgcctttcctctactgctctctcagctgggggcaagaatgacaggacgtgaacatgcacacaagggcccggaactcacgacccccgacagcggtctcccccgcccccccaaccccgcgcttgcaggatttagggcactagcacagcacagtccaccccttgggactagcaccccctccgcagttctgctctctgcagcaacatagagtacaaatattgttccttttgtttcttttttccctttggatacatttttaattacaaaaatagagcttgattgttgcacctagacagatgtttgcttgcttctgggcccattgggcctcctctcagagcctggaactcccagcccccagctcctggggtgccttcctccaggtgtgtccctggcttgggctggggggacacagccccgctcctgggacgtgcaggtttaaaatgctattgggtaccatctttgatcgaattcagagtgacagacttagagcaggtcacctctcagcttctaacgaggccaagacggaggaatccccacagcactgggtttgactctgtaattaagctggtaaagtggaaaaataaaagtaggaaacctaagtggaaaccaaaccagaaagccaggcagcccgggagttctgagccctgcttccctccagctgtgcggcctcagcggctgacgcggtctctgctgctcttctataacacaggatgatggcagctacaccctctgagtggtgtcaccaaggccaatgagtcctgatggttggagtgtgggtatccgggggcctctaggtcactacccactctagccctttgctcctagtctctggggaggtggcagcataggggcatggagcagaccagactttgcctctttctgcccccaggccagttgatatgagccctgcttgaggggttcgcagggcctggggagccttcttcagcttctctttgttttcctaagatgaaaattgtgacatctgggcttgttgcgggaaatttgtaaattgtgcacagagaagaatatgaaattgcacata

SEQ ID NO: 278945 - DNA, 1036 bp, Homo sapiens
caggctcaatctcttaaggcaatcttgagctgaggggtatccatgcagcacgtgacacatgcccatgagggagcgtatttctgtcccccacacaacccgcccccccaaccccgcgcttgcaggatttagggcactagcacagcacagtccaccccttgggactagcaccccctccgcagttctgctctctgcagcaacatagagtacaaatattgttccttttgtttcttttttccctttggatacatttttaattacaaaaatagagcttgattgttgcacctagacagatgtttgcttgcttctgggcccattgggcctcctctcagagcctggaactcccagcccccagctcctggggtgccttcctccaggtgtgtccctggcttgggctggggggacacagccccgctcctgggacgtgcaggtttaaaatgctattgggtaccatctttgatcgaattcagagtgacagacttagagcaggtcacctctcagcttctaacgaggccaagacggaggaatccccacagcactgggtttgactctgtaattaagctggtaaagtggaaaaataaaagtaggaaacctaagtggaaaccaaaccagaaagccaggcagcccgggagttctgagccctgcttccctccagctgtgcggcctcagcggctgacgcggtctctgctgctcttctataacacaggatgatggcagctacaccctctgagtggtgtcaccaaggccaatgagtcctgatggttggagtgtgggtatccgggggcctctaggtcactacccactctagccctttgctcctagtctctggggaggtggcagcataggggcatggagcagaccagactttgcctctttctgcccccaggccagttgatatgagccctgcttgaggggttcgcagggcctggggagccttcttcagcttctctttgttttcctaagatgaaaattgtgacatctgggcttgttgcgggaaatttgtaaattgtgcacagagaagaatatgaaattgcacata

SEQ ID NO: 278946 - DNA, 1699 bp, Homo sapiens
agggaagtggggtggctccccatggcttctcccggggctggcactgaagctggagcacaggatgtgctgacgggggtccagaggcagagtccttaacttactcagcttaagcgtggcatggagtcccaactgggaggggccctggcagcatgaaacccccacccccactctctgcgacggcccagatggagggcaggaggaacagcggttcagccctggctggggctgcaggggctggggtgtgttactcactggcacgatggagaactgcatgaagaggcagcggagtgctgtctgtccccacccttccccgcccggcctccaactggtgggaactggattttgcggctgcagaggacttccccaaattttgccacattaacagctgactgcacacctgagccccgaggcaatgcggtgtgcagagggtgcttggtggttctctcctgatggccccgcagggtctgcagcctccatctggccagcagagggcgcagaaggactgcctgggcagctcggacgtgaccgcctggaagtggtgtacagcgttcctgacaacgttcccggccaaaacgggtcccgccgcccacttgtgtgcaagataactggaaaatgtctttctgtgtgctccgaggagaatgcaaaggctggtggatgtagtgcctttcctctactgctctctcagctgggggcaagaatgacaggacgtgaacatgcacacaagggcccggaactcacgacccccgacagcggtctcccccgcccccccaaccccgcgcttgcaggatttagggcactagcacagcacagtccaccccttgggactagcaccccctccgcagttctgctctctgcagcaacatagagtacaaatattgttccttttgtttcttttttccctttggatacatttttaattacaaaaatagagcttgattgttgcacctagacagatgtttgcttgcttctgggcccattgggcctcctctcagagcctggaactcccagcccccagctcctggggtgccttcctccaggtgtgtccctggcttgggctggggggacacagccccgctcctgggacgtgcaggtttaaaatgctattgggtaccatctttgatcgaattcagagtgacagacttagagcaggtcacctctcagcttctaacgaggccaagacggaggaatccccacagcactgggtttgactctgtaattaagctggtaaagtggaaaaataaaagtaggaaacctaagtggaaaccaaaccagaaagccaggcagcccgggagttctgagccctgcttccctccagctgtgcggcctcagcggctgacgcggtctctgctgctcttctataacacaggatgatggcagctacaccctctgagtggtgtcaccaaggccaatgagtcctgatggttggagtgtgggtatccgggggcctctaggtcactacccactctagccctttgctcctagtctctggggaggtggcagcataggggcatggagcagaccagactttgcctctttctgcccccaggccagttgatatgagccctgcttgaggggttcgcagggcctggggagccttcttcagcttctctttgttttcctaagatgaaaattgtgacatctgggcttgttgcgggaaatttgtaaattgtgcacagagaagaatatgaaattgcacata

SEQ ID NO: 278947 - DNA, 376 bp, Homo sapiens
agtgggttaagatgcaataaaagtttattctttgtgcccaacacaggcaatgcggtgtgcagagggtgcttggtggttctctcctgatggccccgcagggtctgcagcctccatctggccagcagagggcgcagaaggactgcctgggcagctcggacgtgaccgcctggaagtggtgtacagcgttcctgacaacgttcccggccaaaacgggtcccgccgcccacttgtgtgcaagataactggaaaatgtctttctgtgtgctccgaggagaatgcaaaggctggtggatgtagtgcctttcctctactgctctctcagctgggggcaagaatgacaggacgtgaacatgcacacaagggcccggaactcacg

SEQ ID NO: 278948 - DNA, 502 bp, Homo sapiens
cctttgtgccgagcaggttgatgttaaaagcaatgaggaacttcctcgcccccgtggccgtggccccccaactggggacaaaggagctgggaccaaagtcgggcgcccagtcggcctgctggagctgtgagcaagttcgctctgggaaccgcaagcaaccacataaatataacggcagagaaaaggaaaaactcgtgaacccgcacaccagtgtgactgtgacgtgggccctgcgtcgggatttccttcggggggactggcatgaccgtgacgggggttacgtgtgccctgcatgccggcgtgaccgtgacgggggttacgtgtgccctgcacgctggcgtgactgtgacctacgtccctgcctcgggatttctttccaggagcgctgggttggtgcagcctaggggtgggtatgcactttgtccagtttgtctctgtttgtttcatatcattttcttgatttagttaatttcccaaagtgaaattattctgctctagaaaa

SEQ ID NO: 278949 - DNA, 390 bp, Homo sapiens
cctgcctcggcctcccaaagtgctgggattacaggcatgagccaccgcgcccggcccactagactgggaagactgcattgtgtgttcaccttggttgaataaggctgtttggcttatttttcccttctttgtcgtcctgtgaacagatattgctggtgaattcaaagagcagttacaggcactgataccgtatgtattaaacccatctaagttaatggaaaaggagatcaatggctcaaaggtcacctgtcggggactactggagtattttaaggtaaatatgggttttagttattaaaatgtttgatttttggtaaagctgatctcactcgtaaatcaacttgaatttaaatattttgaaacttaaaaattttctgggggagatggtga

SEQ ID NO: 278950 - DNA, 3007 bp, Homo sapiens
  misc_feature (2838)..(2838): n is a, c, g, or t
  misc_feature (2863)..(2863): n is a, c, g, or t
  misc_feature (2866)..(2866): n is a, c, g, or t
  misc_feature (2870)..(2870): n is a, c, g, or t
  misc_feature (2878)..(2878): n is a, c, g, or t
  misc_feature (2883)..(2883): n is a, c, g, or t
  misc_feature (2888)..(2888): n is a, c, g, or t
  misc_feature (2890)..(2890): n is a, c, g, or t
  misc_feature (2896)..(2896): n is a, c, g, or t
  misc_feature (2898)..(2898): n is a, c, g, or t
  misc_feature (2903)..(2904): n is a, c, g, or t
  misc_feature (2940)..(2941): n is a, c, g, or t
  misc_feature (2945)..(2945): n is a, c, g, or t
  misc_feature (2963)..(2965): n is a, c, g, or t
  misc_feature (2970)..(2970): n is a, c, g, or t
  misc_feature (2986)..(2986): n is a, c, g, or t
  misc_feature (2998)..(2998): n is a, c, g, or t
  misc_feature (3003)..(3004): n is a, c, g, or t
gtcccaggcctagttaaacaccaaagctgtctctcacactggtggttccaggataaagcctcggcctggggcctggtctgcacgttaggcgccggccgcagctcgcaggaggacccgagccagcccgccccttcccgcacagcctgctgggagttgtagttcagtcgtcggagaaccacgccaagccccgccccagatgagtgcgcagtatgaggaccgctggccgggacccagtgagcgcgggactacaattcccaaaggacggtagcactcagcgccccgccaacaggtacccggcggctcgcttcgcgcacacgcggcaggcggtggcgggattctgccgcgtgcgctttcccgccccgcctcgcctagcctcgtcctgcgctcgccacgcctcgggctgtccgttgggccacgcagaccgcgctgcgctcgctccgtcgcggctccgcgtgccccaccttctggctagttttttctagagcccaggctccgcccgtttcccgcttccagggcccggttcgttcccgcccgcacccgtccctctcctctgcacccctgctgcttctgctttgaaggcggaggctccatgttgtcccctcagcgagtggcagcagctgcctcaagaggagcagatgatgccatggagagcagcaagcctggtccagtgcaggttgttttggttcagaaagatcaacattcctttgagctagatgagaaagccttggccagcatcctcttgcaggaccacatccgagatcttgatgtggtggtggtttcagtggctggtgccttccgaaagggcaagtccttcattctggattttatgctacgatacttatattctcagaaggaaagtggccattcaaattggttgggtgacccagaagaaccgttaacaggattttcctggagagggggatctgatccagaaaccactgggattcaaatctggagtgaagttttcactgtggagaagccaggtgggaagaaggttgcagttgttctgatggatacccagggggcatttgacagccagtcaactgtgaaagactgtgctaccatctttgctctaagcactatgactagttctgttcagatttataatttatctcagaacattcaagaagatgatcttcaacagctgcagctcttcacagaatacggtcgtctggcaatggatgaaattttccaaaagcctttccagacactgatgtttttggttagagattggagtttcccttatgaatatagctatggactccaaggaggaatggcatttttggataagcgtttacaggtgaaggaacatcaacatgaagaaattcagaatgttcgaaatcacattcactcatgtttctccgatgtcacctgctttctcttaccacatccaggactccaggtggccacaagccctgactttgatgggaaattaaaagatattgctggtgaattcaaagagcagttacaggcactgataccgtatgtattaaacccatctaagttaatggaaaaggagatcaatggctcaaaggtcacctgtcggggactactggagtattttaaggcatatattaaaatttatcaaggagaagatctgcctcaccccaagtccatgcttcaggccactgctgaagccaacaacttagcagctgcagcctctgccaaggacatttattataacaacatggaagaggtttgtgggggagagaaaccttatttgtctccagacattctagaggagaagcactgtgaattcaaacaacttgctctggaccattttaagaagaccaagaagatgggtgggaaggatttcagctttcgttaccagcaggagctggaggaggaaatcaaggaattatatgagaacttctgcaagcacaatggtagcaagaacgtcttcagcaccttccgaacccctgcagtgctgttcacgggcattgtagctttgtacatagcctcaggcctcactggcttcataggtcttgaggttgtagcccagttgttcaactgtatggttggactactgttaatagcactcctcacctggggctacatcaggtattctggtcaatatcgtgagctgggcggagctattgattttggtgccgcatatgtgttggagcaggcttcttctcatatcggtaattccactcaggccactgtgagggatgcagttgttggaagaccatccatggataaaaaagctcaatagcatcttaacgtgaagatcaaacaagaacacaacaagcccctactgatttctgggtttctgccacggccacaggttcatatccagaggaatggcagatctgagacgatccaggaagagctaaaacatggccctgtaataaatgagcagacctctcctgtggtttcaaattattaaacacacttccatttctcttggaagcatttcttttccttgctgttatagatgcaagcctgtgtctattttcatattactctgctttgtgcactttatggaggaggaagctagaggaaaaatggaaatgcagcttttaagttctttatgtgccacttagtgccttttaagattgattccatggttttgcacacacgatggggaggggatggaggataacctcatgaaaggtgccgttttcgggtgaaacttgacatttcttttatactttactcttttgagaaggattctttttttttttttttttttgagttggagtctcgctctgtcaccaggcttgagtgcagtggtgtgatcttggctcactgcaacctctgcctgccgggttcaagcagttctcctgcctcagcctcccaagtagctgggactacaggtgtacgccaccatacccngtctctactaaaaatacaaaaattngcngggngtgatggngggcncctgnantcccancnactcnngaggctgaggcaggagaatcgcttgaacctggaggnngagnttgcagtgagccaagatnnngccantgtactccagcctggncaacagagcganactcnntct

SEQ ID NO: 278951 - DNA, 2368 bp, Homo sapiens
gtcccaggcctagttaaacaccaaagctgtctctcacactggtggttccaggataaagcctcggcctggggcctggtctgcacgttaggcgccggccgcagctcgcaggaggacccgagccagcccgccccttcccgcacagcctgctgggagttgtagttcagtcgtcggagaaccacgccaagccccgccccagatgagtgcgcagtatgaggaccgctggccgggacccagtgagcgcgggactacaattcccaaaggacggtagcactcagcgccccgccaacaggtacccggcggctcgcttcgcgcacacgcggcaggcggtggcgggattctgccgcgtgcgctttcccgccccgcctcgcctagcctcgtcctgcgctcgccacgcctcgggctgtccgttgggccacgcagaccgcgctgcgctcgctccgtcgcggctccgcgtgccccaccttctggctagttttttctagagcccaggctccgcccgtttcccgcttccagggcccggttcgttcccgcccgcacccgtccctctcctctgcacccctgctgcttctgctttgaaggcggaggctccatgttgtcccctcagcgagtggcagcagctgcctcaagaggagcagatgatgccatggagagcagcaagcctggtccagtgcaggttgttttggttcagaaagatcaacattcctttgagctagatgagaaagccttggccagcatcctcttgcaggaccacatccgagatcttgatgtggtggtggtttcagtggctggtgccttccgaaagggcaagtccttcattctggattttatgctacgatacttatattctcagaaggaaagtggccattcaaattggttgggtgacccagaagaaccgttaacaggattttcctggagagggggatctgatccagaaaccactgggattcaaatctggagtgaagttttcactgtggagaagccaggtgggaagaaggttgcagttgttctgatggatacccagggggcatttgacagccagtcaactgtgaaagactgtgctaccatctttgctctaagcactatgactagttctgttcagatttataatttatctcagaacattcaagaagatgatcttcaacagctgcagctcttcacagaatacggtcgtctggcaatggatgaaattttccaaaagcctttccagacactgatgtttttggttagagattggagtttcccttatgaatatagctatggactccaaggaggaatggcatttttggataagcgtttacaggtgaaggaacatcaacatgaagaaattcagaatgttcgaaatcacattcactcatgtttctccgatgtcacctgctttctcttaccacatccaggactccaggtggccacaagccctgactttgatgggaaattaaaagatattgctggtgaattcaaagagcagttacaggcactgataccgtatgtattaaacccatctaagttaatggaaaaggagatcaatggctcaaaggtcacctgtcggggactactggagtattttaaggcatatattaaaatttatcaaggagaagatctgcctcaccccaagtccatgcttcaggccactgctgaagccaacaacttagcagctgcagcctctgccaaggacatttattataacaacatggaagaggtttgtgggggagagaaaccttatttgtctccagacattctagaggagaagcactgtgaattcaaacaacttgctctggaccattttaagaagaccaagaagatgggtgggaaggatttcagctttcgttaccagcaggagctggaggaggaaatcaaggaattatatgagaacttctgcaagcacaatggtagcaagaacgtcttcagcaccttccgaacccctgcagtgctgttcacgggcattgtagctttgtacatagcctcaggcctcactggcttcataggtcttgaggttgtagcccagttgttcaactgtatggttggactactgttaatagcactcctcacctggggctacatcaggtattctggtcaatatcgtgagctgggcggagctattgattttggtgccgcatatgtgttggagcaggcttcttctcatatcggtaattccactcaggccactgtgagggatgcagttgttggaagaccatccatggataaaaaagctcaatagcatcttaacgtgaagatcaaacaagaacacaacaagcccctactgatttctgggtttctgccacggccacaggttcatatccagaggaatggcagatctgagacgatccaggaagagctaaaacatggccctgtaataaatgagcagacctct

SEQ ID NO: 278952 - DNA, 2783 bp, Homo sapiens
  misc_feature (2614)..(2614): n is a, c, g, or t
  misc_feature (2639)..(2639): n is a, c, g, or t
  misc_feature (2642)..(2642): n is a, c, g, or t
  misc_feature (2646)..(2646): n is a, c, g, or t
  misc_feature (2654)..(2654): n is a, c, g, or t
  misc_feature (2659)..(2659): n is a, c, g, or t
  misc_feature (2664)..(2664): n is a, c, g, or t
  misc_feature (2666)..(2666): n is a, c, g, or t
  misc_feature (2672)..(2672): n is a, c, g, or t
  misc_feature (2674)..(2674): n is a, c, g, or t
  misc_feature (2679)..(2680): n is a, c, g, or t
  misc_feature (2716)..(2717): n is a, c, g, or t
  misc_feature (2721)..(2721): n is a, c, g, or t
  misc_feature (2739)..(2741): n is a, c, g, or t
  misc_feature (2746)..(2746): n is a, c, g, or t
  misc_feature (2762)..(2762): n is a, c, g, or t
  misc_feature (2774)..(2774): n is a, c, g, or t
  misc_feature (2779)..(2780): n is a, c, g, or t
gtcccaggcctagttaaacaccaaagctgtctctcacactggtggttccaggataaagcctcggcctggggcctggtctgcacgttaggcgccggccgcagctcgcaggaggacccgagccagcccgccccttcccgcacagcctgctgggagttgtagttcagtcgtcggagaaccacgccaagccccgccccagatgagtgcgcagtatgaggaccgctggccgggacccagtgagcgcgggactacaattcccaaaggacggtagcactcagcgccccgccaacagggcccggttcgttcccgcccgcacccgtccctctcctctgcacccctgctgcttctgctttgaaggcggaggctccatgttgtcccctcagcgagtggcagcagctgcctcaagaggagcagatgatgccatggagagcagcaagcctggtccagtgcaggttgttttggttcagaaagatcaacattcctttgagctagatgagaaagccttggccagcatcctcttgcaggaccacatccgagatcttgatgtggtggtggtttcagtggctggtgccttccgaaagggcaagtccttcattctggattttatgctacgatacttatattctcagaaggaaagtggccattcaaattggttgggtgacccagaagaaccgttaacaggattttcctggagagggggatctgatccagaaaccactgggattcaaatctggagtgaagttttcactgtggagaagccaggtgggaagaaggttgcagttgttctgatggatacccagggggcatttgacagccagtcaactgtgaaagactgtgctaccatctttgctctaagcactatgactagttctgttcagatttataatttatctcagaacattcaagaagatgatcttcaacagctgcagctcttcacagaatacggtcgtctggcaatggatgaaattttccaaaagcctttccagacactgatgtttttggttagagattggagtttcccttatgaatatagctatggactccaaggaggaatggcatttttggataagcgtttacaggtgaaggaacatcaacatgaagaaattcagaatgttcgaaatcacattcactcatgtttctccgatgtcacctgctttctcttaccacatccaggactccaggtggccacaagccctgactttgatgggaaattaaaagatattgctggtgaattcaaagagcagttacaggcactgataccgtatgtattaaacccatctaagttaatggaaaaggagatcaatggctcaaaggtcacctgtcggggactactggagtattttaaggcatatattaaaatttatcaaggagaagatctgcctcaccccaagtccatgcttcaggccactgctgaagccaacaacttagcagctgcagcctctgccaaggacatttattataacaacatggaagaggtttgtgggggagagaaaccttatttgtctccagacattctagaggagaagcactgtgaattcaaacaacttgctctggaccattttaagaagaccaagaagatgggtgggaaggatttcagctttcgttaccagcaggagctggaggaggaaatcaaggaattatatgagaacttctgcaagcacaatggtagcaagaacgtcttcagcaccttccgaacccctgcagtgctgttcacgggcattgtagctttgtacatagcctcaggcctcactggcttcataggtcttgaggttgtagcccagttgttcaactgtatggttggactactgttaatagcactcctcacctggggctacatcaggtattctggtcaatatcgtgagctgggcggagctattgattttggtgccgcatatgtgttggagcaggcttcttctcatatcggtaattccactcaggccactgtgagggatgcagttgttggaagaccatccatggataaaaaagctcaatagcatcttaacgtgaagatcaaacaagaacacaacaagcccctactgatttctgggtttctgccacggccacaggttcatatccagaggaatggcagatctgagacgatccaggaagagctaaaacatggccctgtaataaatgagcagacctctcctgtggtttcaaattattaaacacacttccatttctcttggaagcatttcttttccttgctgttatagatgcaagcctgtgtctattttcatattactctgctttgtgcactttatggaggaggaagctagaggaaaaatggaaatgcagcttttaagttctttatgtgccacttagtgccttttaagattgattccatggttttgcacacacgatggggaggggatggaggataacctcatgaaaggtgccgttttcgggtgaaacttgacatttcttttatactttactcttttgagaaggattctttttttttttttttttttgagttggagtctcgctctgtcaccaggcttgagtgcagtggtgtgatcttggctcactgcaacctctgcctgccgggttcaagcagttctcctgcctcagcctcccaagtagctgggactacaggtgtacgccaccatacccngtctctactaaaaatacaaaaattngcngggngtgatggngggcncctgnantcccancnactcnngaggctgaggcaggagaatcgcttgaacctggaggnngagnttgcagtgagccaagatnnngccantgtactccagcctggncaacagagcganactcnntct

SEQ ID NO: 278953 - DNA, 2611 bp, Homo sapiens
  misc_feature (64)..(64): n is a, c, g, or t
  misc_feature (2442)..(2442): n is a, c, g, or t
  misc_feature (2467)..(2467): n is a, c, g, or t
  misc_feature (2470)..(2470): n is a, c, g, or t
  misc_feature (2474)..(2474): n is a, c, g, or t
  misc_feature (2482)..(2482): n is a, c, g, or t
  misc_feature (2487)..(2487): n is a, c, g, or t
  misc_feature (2492)..(2492): n is a, c, g, or t
  misc_feature (2494)..(2494): n is a, c, g, or t
  misc_feature (2500)..(2500): n is a, c, g, or t
  misc_feature (2502)..(2502): n is a, c, g, or t
  misc_feature (2507)..(2508): n is a, c, g, or t
  misc_feature (2544)..(2545): n is a, c, g, or t
  misc_feature (2549)..(2549): n is a, c, g, or t
  misc_feature (2567)..(2569): n is a, c, g, or t
  misc_feature (2574)..(2574): n is a, c, g, or t
  misc_feature (2590)..(2590): n is a, c, g, or t
  misc_feature (2602)..(2602): n is a, c, g, or t
  misc_feature (2607)..(2608): n is a, c, g, or t
ctcgggctctagaaaaaactagccagaaggtggggcacgcggaccgcgacggagcgagcgcagnggctctgcgtggcccaacggacagcccaggctccgcccgtttcccgcttccagggcccggttcgttcccgcccgcacccgtccctctcctctgcacccctgctgcttctgctttgaaggcggaggctccatgttgtcccctcagcgagtggcagcagctgcctcaagaggagcagatgatgccatggagagcagcaagcctggtccagtgcaggttgttttggttcagaaagatcaacattcctttgagctagatgagaaagccttggccagcatcctcttgcaggaccacatccgagatcttgatgtggtggtggtttcagtggctggtgccttccgaaagggcaagtccttcattctggattttatgctacgatacttatattctcagaaggaaagtggccattcaaattggttgggtgacccagaagaaccgttaacaggattttcctggagagggggatctgatccagaaaccactgggattcaaatctggagtgaagttttcactgtggagaagccaggtgggaagaaggttgcagttgttctgatggatacccagggggcatttgacagccagtcaactgtgaaagactgtgctaccatctttgctctaagcactatgactagttctgttcagatttataatttatctcagaacattcaagaagatgatcttcaacagctgcagctcttcacagaatacggtcgtctggcaatggatgaaattttccaaaagcctttccagacactgatgtttttggttagagattggagtttcccttatgaatatagctatggactccaaggaggaatggcatttttggataagcgtttacaggtgaaggaacatcaacatgaagaaattcagaatgttcgaaatcacattcactcatgtttctccgatgtcacctgctttctcttaccacatccaggactccaggtggccacaagccctgactttgatgggaaattaaaagatattgctggtgaattcaaagagcagttacaggcactgataccgtatgtattaaacccatctaagttaatggaaaaggagatcaatggctcaaaggtcacctgtcggggactactggagtattttaaggcatatattaaaatttatcaaggagaagatctgcctcaccccaagtccatgcttcaggccactgctgaagccaacaacttagcagctgcagcctctgccaaggacatttattataacaacatggaagaggtttgtgggggagagaaaccttatttgtctccagacattctagaggagaagcactgtgaattcaaacaacttgctctggaccattttaagaagaccaagaagatgggtgggaaggatttcagctttcgttaccagcaggagctggaggaggaaatcaaggaattatatgagaacttctgcaagcacaatggtagcaagaacgtcttcagcaccttccgaacccctgcagtgctgttcacgggcattgtagctttgtacatagcctcaggcctcactggcttcataggtcttgaggttgtagcccagttgttcaactgtatggttggactactgttaatagcactcctcacctggggctacatcaggtattctggtcaatatcgtgagctgggcggagctattgattttggtgccgcatatgtgttggagcaggcttcttctcatatcggtaattccactcaggccactgtgagggatgcagttgttggaagaccatccatggataaaaaagctcaatagcatcttaacgtgaagatcaaacaagaacacaacaagcccctactgatttctgggtttctgccacggccacaggttcatatccagaggaatggcagatctgagacgatccaggaagagctaaaacatggccctgtaataaatgagcagacctctcctgtggtttcaaattattaaacacacttccatttctcttggaagcatttcttttccttgctgttatagatgcaagcctgtgtctattttcatattactctgctttgtgcactttatggaggaggaagctagaggaaaaatggaaatgcagcttttaagttctttatgtgccacttagtgccttttaagattgattccatggttttgcacacacgatggggaggggatggaggataacctcatgaaaggtgccgttttcgggtgaaacttgacatttcttttatactttactcttttgagaaggattctttttttttttttttttttgagttggagtctcgctctgtcaccaggcttgagtgcagtggtgtgatcttggctcactgcaacctctgcctgccgggttcaagcagttctcctgcctcagcctcccaagtagctgggactacaggtgtacgccaccatacccngtctctactaaaaatacaaaaattngcngggngtgatggngggcncctgnantcccancnactcnngaggctgaggcaggagaatcgcttgaacctggaggnngagnttgcagtgagccaagatnnngccantgtactccagcctggncaacagagcganactcnntct

SEQ ID NO: 278954 - DNA, 2022 bp, Homo sapiens
gtcccaggcctagttaaacaccaaagctgtctctcacactggtggttccaggataaagcctcggcctggggcctggtctgcacgttaggcgccggccgcagctcgcaggaggacccgagccagcccgccccttcccgcacagcctgctgggagttgtagttcagtcgtcggagaaccacgccaagccccgccccagatgagtgcgcagtatgaggaccgctggccgggacccagtgagcgcgggactacaattcccaaaggacggtagcactcagcgccccgccaacagatgatgccatggagagcagcaagcctggtccagtgcaggttgttttggttcagaaagatcaacattcctttgagctagatgagaaagccttggccagcatcctcttgcaggaccacatccgagatcttgatgtggtggtggtttcagtggctggtgccttccgaaagggcaagtccttcattctggattttatgctacgatacttatattctcagaaggaaagtggccattcaaattggttgggtgacccagaagaaccgttaacaggattttcctggagagggggatctgatccagaaaccactgggattcaaatctggagtgaagttttcactgtggagaagccaggtgggaagaaggttgcagttgttctgatggatacccagggggcatttgacagccagtcaactgtgaaagactgtgctaccatctttgctctaagcactatgactagttctgttcagatttataatttatctcagaacattcaagaagatgatcttcaacagctgcagctcttcacagaatacggtcgtctggcaatggatgaaattttccaaaagcctttccagacactgatgtttttggttagagattggagtttcccttatgaatatagctatggactccaaggaggaatggcatttttggataagcgtttacaggtgaaggaacatcaacatgaagaaattcagaatgttcgaaatcacattcactcatgtttctccgatgtcacctgctttctcttaccacatccaggactccaggtggccacaagccctgactttgatgggaaattaaaagatattgctggtgaattcaaagagcagttacaggcactgataccgtatgtattaaacccatctaagttaatggaaaaggagatcaatggctcaaaggtcacctgtcggggactactggagtattttaaggcatatattaaaatttatcaaggagaagatctgcctcaccccaagtccatgcttcaggccactgctgaagccaacaacttagcagctgcagcctctgccaaggacatttattataacaacatggaagaggtttgtgggggagagaaaccttatttgtctccagacattctagaggagaagcactgtgaattcaaacaacttgctctggaccattttaagaagaccaagaagatgggtgggaaggatttcagctttcgttaccagcaggagctggaggaggaaatcaaggaattatatgagaacttctgcaagcacaatggtagcaagaacgtcttcagcaccttccgaacccctgcagtgctgttcacgggcattgtagctttgtacatagcctcaggcctcactggcttcataggtcttgaggttgtagcccagttgttcaactgtatggttggactactgttaatagcactcctcacctggggctacatcaggtattctggtcaatatcgtgagctgggcggagctattgattttggtgccgcatatgtgttggagcaggcttcttctcatatcggtaattccactcaggccactgtgagggatgcagttgttggaagaccatccatggataaaaaagctcaatagcatcttaacgtgaagatcaaacaagaacacaacaagcccctactgatttctgggtttctgccacggccacaggttcatatccagaggaatggcagatctgagacgatccaggaagagctaaaacatggccctgtaataaatgagcagacctct

SEQ ID NO: 278955 - DNA, 440 bp, Homo sapiens
gccacagagcagatgttcccctggctctcttgggagttagctgctgccacagcctctctgtatccctgcattttcattcaactgctttctgtaacatgccgatgatggagacaggtttttgaaagtttaaggacttactttcttgttgctgtgttgtattttattaacttatatgttgaataaatggacttttgcaggcttcttctcatatcggtaattccactcaggccactgtgagggatgcagttgttggaagaccatccatggataaaaaagctcaatagcatcttaacgtgaagatcaaacaagaacacaacaagcccctactgatttctgggtttctgccacggccacaggttcatatccagaggaatggcagatctgagacgatccaggaagagctaaaacatggccctgtaataaatgagcagacctctcct

SEQ ID NO: 278956 - DNA, 887 bp, Homo sapiens
gtcccaggcctagttaaacaccaaagctgtctctcacactggtggttccaggataaagcctcggcctggggcctggtctgcacgttaggcgccggccgcagctcgcaggaggacccgagccagcccgccccttcccgcacagcctgctgggagttgtagttcagtcgtcggagaaccacgccaagccccgccccagatgagtgcgcagtatgaggaccgctggccgggacccagtgagcgcgggactacaattcccaaaggacggtagcactcagcgccccgccaacaggtacccggcggctcgcttcgcgcacacgcggcaggcggtggcgggattctgccgcgtgcgctttcccgccccgcctcgcctagcctcgtcctgcgctcgccacgcctcgggctgtccgttgggccacgcagaccgcgctgcgctcgctccgtcgcggctccgcgtgccccaccttctggctagttttttctagagcccaggctccgcccgtttcccgcttccagggcccggttcgttcccgcccgcacccgtccctctcctctgcacccctgctgcttctgctttgaaggcggaggctccatgttgtcccctcagcgagtggcagcagctgcctcaagaggagcagtgtaatgtgtgtgctgttgaaatgaccgtttcacttgcgaaatcgaagagcaaaaaggaaaagaacagtgaagaatttttaaatgagtctcagttctcaaattcaaatacgaagcaatggaacgttttgtcagtcttagaataacggaccaaaaatgtacgatttcacatattggcttacttttggagatttaagaagcataacctacggagtactaatccctgtcaagaatttagcattgcaacataggta

SEQ ID NO: 278957 - DNA, 2411 bp, Homo sapiens
gtcccaggcctagttaaacaccaaagctgtctctcacactggtggttccaggataaagcctcggcctggggcctggtctgcacgttaggcgccggccgcagctcgcaggaggacccgagccagcccgccccttcccgcacagcctgctgggagttgtagttcagtcgtcggagaaccacgccaagccccgccccagatgagtgcgcagtatgaggaccgctggccgggacccagtgagcgcgggactacaattcccaaaggacggtagcactcagcgccccgccaacaggtacccggcggctcgcttcgcgcacacgcggcaggcggtggcgggattctgccgcgtgcgctttcccgccccgcctcgcctagcctcgtcctgcgctcgccacgcctcgggctgtccgttgggccacgcagaccgcgctgcgctcgctccgtcgcggctccgcgtgccccaccttctggctagttttttctagagcccaggctccgcccgtttcccgcttccagggcccggttcgttcccgcccgcacccgtccctctcctctgcacccctgctgcttctgctttgaaggcggaggctccatgttgtcccctcagcgagtggcagcagctgcctcaagaggagcagatgatgccatggagagcagcaagcctggtccagtgcaggttgttttggttcagaaagatcaacattcctttgagctagatgagaaagccttggccagcatcctcttgcaggaccacatccgagatcttgatgtggtggtggtttcagtggctggtgccttccgaaagggcaagtccttcattctggattttatgctacgatacttatattctcagaaggaaagtggccattcaaattggttgggtgacccagaagaaccgttaacaggattttcctggagagggggatctgatccagaaaccactgggattcaaatctggagtgaagttttcactgtggagaagccaggtgggaagaaggttgcagttgttctgatggatacccagggggcatttgacagccagtcaactgtgaaagactgtgctaccatctttgctctaagcactatgactagttctgttcagatttataatttatctcagaacattcaagaagatgatcttcaacagctgcagctcttcacagaatacggtcgtctggcaatggatgaaattttccaaaagcctttccagacactgatgtttttggttagagattggagtttcccttatgaatatagctatggactccaaggaggaatggcatttttggataagcgtttacaggtgaaggaacatcaacatgaagaaattcagaatgttcgaaatcacattcactcatgtttctccgatgtcacctgctttctcttaccacatccaggactccaggtggccacaagccctgactttgatgggaaattaaaagatattgctggtgaattcaaagagcagttacaggcactgataccgtatgtattaaacccatctaagttaatggaaaaggagatcaatggctcaaaggtcacctgtcggggactactggagtattttaaggcatatattaaaatttatcaaggagaagatctgcctcaccccaagtccatgcttcaggccactgctgaagccaacaacttagcagctgcagcctctgccaaggacatttattataacaacatggaagaggtttgtgggggagagaaaccttatttgtctccagacattctagaggagaagcactgtgaattcaaacaacttgctctggaccattttaagaagaccaagaagatgggtgggaaggatttcagctttcgttaccagcaggagctggaggaggaaatcaaggaattatatgagaacttctgcaagcacaatggtagcaagaacgtcttcagcaccttccgaacccctgcagtgctgttcacgggcattgtagctttgtacatagcctcaggcctcactggcttcataggtcttgaggttgtagcccagttgttcaactgtatggttggactactgttaatagcactcctcacctggggctacatcaggtattctggtcaatatcgtgagctgggcggagctattgattttggtgccgcatatgtgttggagcaggcttcttctcatatcggtaattccactcaggccactgtgagggatgcagttgttggaagaccatccatggataaaaaagctcaatagcatcttaacgtgaagatcaaacaagaacacaacaagcccctactgatttctgggtttctgccacggccacaggttcatatccagaggaatggcagatctgagacgatccaggaagagctaaaacatggccctgtaataaatgagcagacctctcctgtggtttcaaattattaaacacacttccatttctcttgga

SEQ ID NO: 278958 - DNA, 2184 bp, Homo sapiens
gtcccaggcctagttaaacaccaaagctgtctctcacactggtggttccaggataaagcctcggcctggggcctggtctgcacgttaggcgccggccgcagctcgcaggaggacccgagccagcccgccccttcccgcacagcctgctgggagttgtagttcagtcgtcggagaaccacgccaagccccgccccagatgagtgcgcagtatgaggaccgctggccgggacccagtgagcgcgggactacaattcccaaaggacggtagcactcagcgccccgccaacaggtacccggcggctcgcttcgcgcacacgcggcaggcggtggcgggattctgccgcgtgcgctttcccgccccgcctcgcctagcctcgtcctgcgctcgccacgcctcgggctgtccgttgggccacgcagaccgcgctgcgctcgctccgtcgcggctccgcgtgccccaccttctggctagttttttctagagcccaggctccgcccgtttcccgcttccagggcccggttcgttcccgcccgcacccgtccctctcctctgcacccctgctgcttctgctttgaaggcggaggctccatgttgtcccctcagcgagtggcagcagctgcctcaagaggagcagatgatgccatggagagcagcaagcctggtccagtgcaggttgttttggttcagaaagatcaacattcctttgagctagatgagaaagccttggccagcatcctcttgcaggaccacatccgagatcttgatgtggtggtggtttcagtggctggtgccttccgaaagggcaagtccttcattctggattttatgctacgatacttatattctcagaaggaaagtggccattcaaattggttgggtgacccagaagaaccgttaacaggattttcctggagagggggatctgatccagaaaccactgggattcaaatctggagtgaagttttcactgtggagaagccaggtgggaagaaggttgcagttgttctgatggatacccagggggcatttgacagccagtcaactgtgaaagactgtgctaccatctttgctctaagcactatgactagttctgttcagatttataatttatctcagaacattcaagaagatgatcttcaacagctgcagctcttcacagaatacggtcgtctggcaatggatgaaattttccaaaagcctttccagacactgatgtttttggttagagattggagtttcccttatgaatatagctatggactccaaggaggaatggcatttttggataagcgtttacaggtgaaggaacatcaacatgaagaaattcagaatgttcgaaatcacattcactcatgtttctccgatgtcacctgctttctcttaccacatccaggactccaggtggccacaagccctgactttgatgggaaattaaaagatattgctggtgaattcaaagagcagttacaggcactgataccgtatgtattaaacccatctaagttaatggaaaaggagatcaatggctcaaaggtcacctgtcggggactactggagtattttaaggcatatattaaaatttatcaaggagaagatctgcctcaccccaagtccatgcttcaggccactgctgaagccaacaacttagcagctgcagcctctgccaaggacatttattataacaacatggaagaggtttgtgggggagagaaaccttatttgtctccagacattctagaggagaagcactgtgaattcaaacaacttgctctggaccattttaagaagaccaagaagatgggtgggaaggatttcagctttcgttaccagcaggagctggaggaggaaatcaaggaattatatgagaacttctgcaagcacaatggtagcaagaacgtcttcagcaccttccgaacccctgcagtgctgttcacgggcattgtagctttgtacatagcctcaggcctcactggcttcataggtcttgaggttgtagcccagttgttcaactgtatggttggactactgttaatagcactcctcacctggggctacatcaggtattctggtcaatatcgtgagctgggcggagctattgattttggtgccgcatatgtgttggagcaggcttcttctccatatgcggtatttaacctcacgcgccctctggagggttggagtgt

SEQ ID NO: 278959 - DNA, 1583 bp, Homo sapiens
tgggtgcggggcactttttatttcactgcgaagcctgtgaggactggacgcgaggacggggctttgtagaatgctcgctggtggtagctgttgttcctctcttgttttttcgagacgcctttttgtcaacataactgtaaagatgcccaagaatattttcagatatttacagcaatccatcaacagtcagacgaagggggggcagccaaagtgggggggagtaagaccttttttttgctgtaatttgactcgaccttccagtggtttgtgccttttttcttttgacttgtttgtggatggaatgtttacagacatttctaattactgctttaattaaataaattggatcaaaggccgttcgaggtatttttgttttgccgtttgtcgctcagaattggcattttgagaggtgattgatactgctaacaattttctagtactctagtttgtttcaagaagagattttgggtagacgtaatcttcaccctttcaaattatataacaatacgaacattattttttatactgatcataatttccagatttggggagggggtgatcgtggcaggaaaagttgtatgtttgttagttgcatatggtgatttttgatttttcaatgctggtagggtaagtaaggaggtctctgtaccatggctcgtacaaagcagactgcccgcaaatcgaccggtggtaaagcacccaggaagcaactggctacaaaagccgctcgcaagagtgcgccctctactggaggggtgaagaaacctcatcgttacaggcctggtactgtggcgctccgtgaaattagacgttatcagaagtccactgaacttctgattcgcaaacttcccttccagcgtctggtgcgagaaattgctcaggactttaaaacagatctgcgcttccagagcgcagctatcggtgctttgcaggaggcaagtgaggcctatctggttggcctttttgaagacaccaacctgtgtgctatccatgccaaacgtgtaacaattatgccaaaagacatccagctagcacgccgcatacgtggagaacgtgcttaagaatccactatgatgggaaacatttcattctcaaaaaaaaaaaaaaaatttctcttcttcctgttattggtagttctgaacgttagatattttttttccatggggtcaaaaggtacctaagtatatgattgcgagtggaaaaataggggacagaaatcaggtattggcagtttttccattttcatttgtgtgtgaatttttaatataaatgcggagacgtaaagcattaatgcaagttaaaatgtttcagtgaacaagtttcagcggttcaactttataataattataaataaacctgttaaatttttctggacaatgccagcatttggatttttttaaaacaagtaaatttcttattgatggcaactaaatggtgtttgtagcatttttatcatacagtagattccatccattcactatacttttctaactgagttgtcctacatgcaagtacatgtttttaatgttgtctgtcttctgtgctgttcctgtaagtttgctattaaaatacattaaactata

SEQ ID NO: 278960 - DNA, 378 bp, Homo sapiens
ttctagagtatcccccttgctggcgcagagcagctagccagaagagaggggggtaagtaaggaggtctctgtaccatggctcgtacaaagcagactgcccgcaaatcgaccggtggtaaagcacccaggaagcaactggctacaaaagccgctcgcaagagtgcgccctctactggaggggtgaagaaacctcatcgttacaggcctggtactgtggcgctccgtgaaattagacgttatcagaagtccactgaacttctgattcgcaaacttcccttccagcgtctggtgcgagaaattgctcaggactttaaaacagatctgcgcttccagagcgcagctatcggtgctttgcagggtaaaatggtgggtgggaag

SEQ ID NO: 278961 - DNA, 915 bp, Homo sapiens
atagcctcggtgtcagccatctttcaattgtgttcgcagccgccgccgcgccgccgtcgctctccaacgccagcgccgcctctcgctcgccgagctccagccgaaggagaaggggggtaagtaaggaggtctctgtaccatggctcgtacaaagcagactgcccgcaaatcgaccggtggtaaagcacccaggaagcaactggctacaaaagccgctcgcaagagtgcgccctctactggaggggtgaagaaacctcatcgttacaggcctggtactgtggcgctccgtgaaattagacgttatcagaagtccactgaacttctgattcgcaaacttcccttccagcgtctggtgcgagaaattgctcaggactttaaaacagatctgcgcttccagagcgcagctatcggtgctttgcaggaggcaagtgaggcctatctggttggcctttttgaagacaccaacctgtgtgctatccatgccaaacgtgtaacaattatgccaaaagacatccagctagcacgccgcatacgtggagaacgtgcttaagaatccactatgatgggaaacatttcattctcaaaaaaaaaaaaaaaatttctcttcttcctgttattggtagttctgaacgttagatattttttttccatggggtcaaaaggtacctaagtatatgattgcgagtggaaaaataggggacagaaatcaggtattggcagtttttccattttcatttgtgtgtgaatttttaatataaatgcggagacgtaaagcattaatgcaagttaaaatgtttcagtgaacaagtttcagcggttcaactttataataattataaataaacctgttaaatttttctggacaatgccagcatttggatttttttaaaacaagtaaatttcttattgatggca

SEQ ID NO: 278962 - DNA, 865 bp, Homo sapiens
atagcctcggtgtcagccatctttcaattgtgttcgcagccgccgccgcgccgccgtcgctctccaacgccagcgccgcctctcgctcgccgagctccagccgaaggagaaggggggtaagtaaggaggtctctgtaccatggctcgtacaaagcagactgcccgcaaatcgaccggtggtaaagcacccaggaagcaactggctacaaaagccgctcgcaagagtgcgccctctactggaggggtgaagaaacctcatcgttacaggcctggtactgtggcgctccgtgaaattagacgttatcagaagtccactgaacttctgattcgcaaacttcccttccagcgtctggtgcgagaaattgctcaggactttaaaacagatctgcgcttccagagcgcagctatcggtgctttgcaggaggcaagtgaggcctatctggttggcctttttgaagacaccaacctgtgtgctatccatgccaaacgtgtaacaattatgccaaaagacatccagctagcacgccgcatacgtggagaacgtgcttaagaatccactatgatgggaaacatttcattctcaaaaaaaaaaaaaaaatttctcttcttcctgttattggtagttctgaacgttagatattttttttccatggggtcaaaaggtacctaagtatatgattgcgagtggaaaaataggggacagaaatcaggtattggcagtttttccattttcatttgtgtgtgaatttttaatataaatgcggagacgtaaagcattaatgcaagttaaaatgtttcagtgaacaagtttcagcggttcaactttataataattataaataaacctgttaaatttttctggaca

SEQ ID NO: 278963 - DNA, 766 bp, Homo sapiens
atagcctcggtgtcagccatctttcaattgtgttcgcagccgccgccgcgccgccgtcgctctccaacgccagcgccgcctctcgctcgccgagctccagccgaaggagaaggggggtaagtaaggaggtctctgtaccatggctcgtacaaagcagactgcccgcaaatcgaccggtggtaaagcacccaggaagcaactggctacaaaagccgctcgcaagagtgcgccctctactggaggggtgaagaaacctcatcgttacaggcctggtactgtggcgctccgtgaaattagacgttatcagaagtccactgaacttctgattcgcaaacttcccttccagcgtctggtgcgagaaattgctcaggactttaaaacagatctgcgcttccagagcgcagctatcggtgctttgcaggaggcaagtgaggcctatctggttggcctttttgaagacaccaacctgtgtgctatccatgccaaacgtgtaacaattatgccaaaagacatccagctagcacgccgcatacgtggagaacgtgcttaagaatccactatgatgggaaacatttcattctcaaaaaaaaaaaaaaaatttctcttcttcctgttattggtagttctgaacgttagatattttttttccatggggtcaaaaggtacctaagtatatgattgcgagtggaaaaataggggacagaaatcaggtattggcagtttttccattttcattcgtagaaagtgaccgggatcctctagatca

SEQ ID NO: 278964 - DNA, 1565 bp, Homo sapiens
gcctggacgaggacaaggaaggggagcgcaggtagccggcccggggcagcgggtgcagacctgctggggactcggtgttgaggttctcgtcgtccgagtcagcaaagacctcggccagctcctggtccgacatgtcggtgagctcagtgaggtccaggaggtcgaagtggacctcggccagctcctggtccgacatgtcggtgagctcagtgaggtccaggaggtcgaagtggacctccagagaggagacgctgctcagaggctgcctcctctccgtgacctgcaggagccccggtgctggtactgggatgcccccgacctcctcctccacaggcgtgtggccattgtcccctgtcccctgggctgggacgcccagcgcagcctgcggcacctcagcctccttaacgatctttggcggccgcgcccgctggcgtcctcttgttctcttccaggtacttgcgtgtggggcgccgactgtgtgcgggcgcccctcggggctggcgaggggcacaggaggggcctgactcgcgctgggtaatgaccccgccgtcgctctccaacgccagcgccgcctctcgctcgccgagctccagccgaaggagaaggggggtaagtaaggaggtctctgtaccatggctcgtacaaagcagactgcccgcaaatcgaccggtggtaaagcacccaggaagcaactggctacaaaagccgctcgcaagagtgcgccctctactggaggggtgaagaaacctcatcgttacaggcctggtactgtggcgctccgtgaaattagacgttatcagaagtccactgaacttctgattcgcaaacttcccttccagcgtctggtgcgagaaattgctcaggactttaaaacagatctgcgcttccagagcgcagctatcggtgctttgcaggaggcaagtgaggcctatctggttggcctttttgaagacaccaacctgtgtgctatccatgccaaacgtgtaacaattatgccaaaagacatccagctagcacgccgcatacgtggagaacgtgcttaagaatccactatgatgggaaacatttcattctcaaaaaaaaaaaaaaaatttctcttcttcctgttattggtagttctgaacgttagatattttttttccatggggtcaaaaggtacctaagtatatgattgcgagtggaaaaataggggacagaaatcaggtattggcagtttttccattttcatttgtgtgtgaatttttaatataaatgcggagacgtaaagcattaatgcaagttaaaatgtttcagtgaacaagtttcagcggttcaactttataataattataaataaacctgttaaatttttctggacaatgccagcatttggatttttttaaaacaagtaaatttcttattgatggcaactaaatggtgtttgtagcatttttatcatacagtagattccatccattcactatacttttctaactgagttgtcctacatgcaagtacatgtttttaatgttgtctgtcttctgtgctgttcctgtaagtttgctattaaaatacattaaactata

SEQ ID NO: 278965 - DNA, 1066 bp, Homo sapiens
aatcccgggtcgactactactactaaattcgcggctgctcgaccccgccgtcgctctccaacgccagcgccgcctctcgctcgccgagctccagccgaaggagaaggggggtaagtaaggaggtctctgtaccatggctcgtacaaagcagactgcccgcaaatcgaccggtggtaaagcacccaggaagcaactggctacaaaagccgctcgcaagagtgcgccctctactggaggggtgaagaaacctcatcgttacaggcctggtactgtggcgctccgtgaaattagacgttatcagaagtccactgaacttctgattcgcaaacttcccttccagcgtctggtgcgagaaattgctcaggactttaaaacagatctgcgcttccagagcgcagctatcggtgctttgcaggaggcaagtgaggcctatctggttggcctttttgaagacaccaacctgtgtgctatccatgccaaacgtgtaacaattatgccaaaagacatccagctagcacgccgcatacgtggagaacgtgcttaagaatccactatgatgggaaacatttcattctcaaaaaaaaaaaaaaaatttctcttcttcctgttattggtagttctgaacgttagatattttttttccatggggtcaaaaggtacctaagtatatgattgcgagtggaaaaataggggacagaaatcaggtattggcagtttttccattttcatttgtgtgtgaatttttaatataaatgcggagacgtaaagcattaatgcaagttaaaatgtttcagtgaacaagtttcagcggttcaactttataataattataaataaacctgttaaatttttctggacaatgccagcatttggatttttttaaaacaagtaaatttcttattgatggcaactaaatggtgtttgtagcatttttatcatacagtagattccatccattcactatacttttctaactgagttgtcctacatgcaagtacatgtttttaatgttgtctgtcttctgtgctgttcctgtaagtttgctattaaaatacattaaactata

SEQ ID NO: 278966 - DNA, 770 bp, Homo sapiens
atagcctcggtgtcagccatctttcaattgtgttcgcagccgccgccgcgccgccgtcgctctccaacgccagcgccgcctctcgctcgccgagctccagccgaaggagaaggggggtaagtaaggaggtctctgtaccatggctcgtacaaagcagactgcccgcaaatcgaccggtggtaaagcacccaggaagcaactggctacaaaagccgctcgcaagagtgcgccctctactggaggggtgaagaaacctcatcgttacaggcctggtactgtggcgctccgtgaaattagacgttatcagaagtccactgaacttctgattcgcaaacttcccttccagcgtctggtgcgagaaattgctcaggactttaaaacagatctgcgcttccagagcgcagctatcggtgctttgcaggaggcaagtgaggcctatctggttggcctttttgaagacaccaacctgtgtgctatccatgccaaacgtgtaacaattatgccaaaagacatccagctagcacgccgcatacgtggagaacgtgcttaagaatccactatgatgggaaacatttcattctcaaaaaaaaaaaaaaaggcttatctcctcagataagcaggaattatgggatgaaaccttggacctgtcaaaaagactgagtgagaacgaaattatatgtaatgctctgcaaagacagaaagagagatgggaaggagcaaatgatcttttgaagagggagacagcagattgtcagttacatggtctggat

SEQ ID NO: 278967 - DNA, 735 bp, Homo sapiens
atagcctcggtgtcagccatctttcaattgtgttcgcagccgccgccgcgccgccgtcgctctccaacgccagcgccgcctctcgctcgccgagctccagccgaaggagaaggggggtaagtaaggaggtctctgtaccatggctcgtacaaagcagactgcccgcaaatcgaccggtggtaaagcacccaggaagcaactggctacaaaagccgctcgcaagagtgcgccctctactggaggggtgaagaaacctcatcgttacaggcctggtactgtggcgctccgtgaaattagacgttatcagaagtccactgaacttctgattcgcaaacttcccttccagcgtctggtgcgagaaattgctcaggactttaaaacagatctgcgcttccagagcgcagctatcggtgctttgcaggaggcaagtgaggcctatctggttggcctttttgaagacaccaacctgtgtgctatccatgccaaacgtgtaacaattatgccaaaagacatccagctagcacgccgcatacgtggagaacgtgcttaagaatccactatgatgggaaacatttcattctcaaaaaaaaaaaaaaacaaaaaacaaaaaaaaaaaccccgcgggccctcttaatgcgggggggggaaaacgggtgttctgtgaagggcccctggggccaaaggtgttttccctggccccccgtttctttgtttcacaaggtgggaaccttccgg

SEQ ID NO: 278968 - DNA, 1025 bp, Homo sapiens
tgagaatgaaatgtttcccatcatagtggattcttaagcacgttctccacgtatgcggcgtgctagctggtaagtaaggaggtctctgtaccatggctcgtacaaagcagactgcccgcaaatcgaccggtggtaaagcacccaggaagcaactggctacaaaagccgctcgcaagagtgcgccctctactggaggggtgaagaaacctcatcgttacaggcctggtactgtggcgctccgtgaaattagacgttatcagaagtccactgaacttctgattcgcaaacttcccttccagcgtctggtgcgagaaattgctcaggactttaaaacagatctgcgcttccagagcgcagctatcggtgctttgcaggaggcaagtgaggcctatctggttggcctttttgaagacaccaacctgtgtgctatccatgccaaacgtgtaacaattatgccaaaagacatccagctagcacgccgcatacgtggagaacgtgcttaagaatccactatgatgggaaacatttcattctcaaaaaaaaaaaaaaaatttctcttcttcctgttattggtagttctgaacgttagatattttttttccatggggtcaaaaggtacctaagtatatgattgcgagtggaaaaataggggacagaaatcaggtattggcagtttttccattttcatttgtgtgtgaatttttaatataaatgcggagacgtaaagcattaatgcaagttaaaatgtttcagtgaacaagtttcagcggttcaactttataataattataaataaacctgttaaatttttctggacaatgccagcatttggatttttttaaaacaagtaaatttcttattgatggcaactaaatggtgtttgtagcatttttatcatacagtagattccatccattcactatacttttctaactgagttgtcctacatgcaagtacatgtttttaatgttgtctgtcttctgtgctgttcctgtaagtttgctattaaaatacattaaactata

SEQ ID NO: 278969 - DNA, 1041 bp, Homo sapiens
gatacgttttgcgattgtttccattttgttctggtcggggagccgagttggttcctgctcgaggcgctgggagcgaggcgggcaggtaagtaaggaggtctctgtaccatggctcgtacaaagcagactgcccgcaaatcgaccggtggtaaagcacccaggaagcaactggctacaaaagccgctcgcaagagtgcgccctctactggaggggtgaagaaacctcatcgttacaggcctggtactgtggcgctccgtgaaattagacgttatcagaagtccactgaacttctgattcgcaaacttcccttccagcgtctggtgcgagaaattgctcaggactttaaaacagatctgcgcttccagagcgcagctatcggtgctttgcaggaggcaagtgaggcctatctggttggcctttttgaagacaccaacctgtgtgctatccatgccaaacgtgtaacaattatgccaaaagacatccagctagcacgccgcatacgtggagaacgtgcttaagaatccactatgatgggaaacatttcattctcaaaaaaaaaaaaaaaatttctcttcttcctgttattggtagttctgaacgttagatattttttttccatggggtcaaaaggtacctaagtatatgattgcgagtggaaaaataggggacagaaatcaggtattggcagtttttccattttcatttgtgtgtgaatttttaatataaatgcggagacgtaaagcattaatgcaagttaaaatgtttcagtgaacaagtttcagcggttcaactttataataattataaataaacctgttaaatttttctggacaatgccagcatttggatttttttaaaacaagtaaatttcttattgatggcaactaaatggtgtttgtagcatttttatcatacagtagattccatccattcactatacttttctaactgagttgtcctacatgcaagtacatgtttttaatgttgtctgtcttctgtgctgttcctgtaagtttgctattaaaatacattaaactata

SEQ ID NO: 278970 - DNA, 935 bp, Homo sapiens
ggggtgatctagaggatccctctgcccgcaaatcgaccggtggtaaagcacccaggaagcaactggctacaaaagccgctcgcaagagtgcgccctctactggaggggtgaagaaacctcatcgttacaggcctggtactgtggcgctccgtgaaattagacgttatcagaagtccactgaacttctgattcgcaaacttcccttccagcgtctggtgcgagaaattgctcaggactttaaaacagatctgcgcttccagagcgcagctatcggtgctttgcaggaggcaagtgaggcctatctggttggcctttttgaagacaccaacctgtgtgctatccatgccaaacgtgtaacaattatgccaaaagacatccagctagcacgccgcatacgtggagaacgtgcttaagaatccactatgatgggaaacatttcattctcaaaaaaaaaaaaaaaatttctcttcttcctgttattggtagttctgaacgttagatattttttttccatggggtcaaaaggtacctaagtatatgattgcgagtggaaaaataggggacagaaatcaggtattggcagtttttccattttcatttgtgtgtgaatttttaatataaatgcggagacgtaaagcattaatgcaagttaaaatgtttcagtgaacaagtttcagcggttcaactttataataattataaataaacctgttaaatttttctggacaatgccagcatttggatttttttaaaacaagtaaatttcttattgatggcaactaaatggtgtttgtagcatttttatcatacagtagattccatccattcactatacttttctaactgagttgtcctacatgcaagtacatgtttttaatgttgtctgtcttctgtgctgttcctgtaagtttgctattaaaatacattaaactata

SEQ ID NO: 278971 - DNA, 981 bp, Homo sapiens
tcccacctcagcctcctgagtagctgagactacaagcatgtgccaccatacccagttaattaaattttttttttagagacagggtcttgctgtgttgccccggctggtctggctacaaaagccgctcgcaagagtgcgccctctactggaggggtgaagaaacctcatcgttacaggcctggtactgtggcgctccgtgaaattagacgttatcagaagtccactgaacttctgattcgcaaacttcccttccagcgtctggtgcgagaaattgctcaggactttaaaacagatctgcgcttccagagcgcagctatcggtgctttgcaggaggcaagtgaggcctatctggttggcctttttgaagacaccaacctgtgtgctatccatgccaaacgtgtaacaattatgccaaaagacatccagctagcacgccgcatacgtggagaacgtgcttaagaatccactatgatgggaaacatttcattctcaaaaaaaaaaaaaaaatttctcttcttcctgttattggtagttctgaacgttagatattttttttccatggggtcaaaaggtacctaagtatatgattgcgagtggaaaaataggggacagaaatcaggtattggcagtttttccattttcatttgtgtgtgaatttttaatataaatgcggagacgtaaagcattaatgcaagttaaaatgtttcagtgaacaagtttcagcggttcaactttataataattataaataaacctgttaaatttttctggacaatgccagcatttggatttttttaaaacaagtaaatttcttattgatggcaactaaatggtgtttgtagcatttttatcatacagtagattccatccattcactatacttttctaactgagttgtcctacatgcaagtacatgtttttaatgttgtctgtcttctgtgctgttcctgtaagtttgctattaaaatacattaaactata

SEQ ID NO: 278972 - DNA, 898 bp, Homo sapiens
tgagaatgaaatgtttcccatcatagtggctacaaaagccgctcgcaagagtgcgccctctactggaggggtgaagaaacctcatcgttacaggcctggtactgtggcgctccgtgaaattagacgttatcagaagtccactgaacttctgattcgcaaacttcccttccagcgtctggtgcgagaaattgctcaggactttaaaacagatctgcgcttccagagcgcagctatcggtgctttgcaggaggcaagtgaggcctatctggttggcctttttgaagacaccaacctgtgtgctatccatgccaaacgtgtaacaattatgccaaaagacatccagctagcacgccgcatacgtggagaacgtgcttaagaatccactatgatgggaaacatttcattctcaaaaaaaaaaaaaaaatttctcttcttcctgttattggtagttctgaacgttagatattttttttccatggggtcaaaaggtacctaagtatatgattgcgagtggaaaaataggggacagaaatcaggtattggcagtttttccattttcatttgtgtgtgaatttttaatataaatgcggagacgtaaagcattaatgcaagttaaaatgtttcagtgaacaagtttcagcggttcaactttataataattataaataaacctgttaaatttttctggacaatgccagcatttggatttttttaaaacaagtaaatttcttattgatggcaactaaatggtgtttgtagcatttttatcatacagtagattccatccattcactatacttttctaactgagttgtcctacatgcaagtacatgtttttaatgttgtctgtcttctgtgctgttcctgtaagtttgctattaaaatacattaaactata

SEQ ID NO: 278973 - DNA, 831 bp, Homo sapiens
ctattaaccaggcttatctgtttcacgcctggtactgtggcgctccgtgaaattagacgttatcagaagtccactgaacttctgattcgcaaacttcccttccagcgtctggtgcgagaaattgctcaggactttaaaacagatctgcgcttccagagcgcagctatcggtgctttgcaggaggcaagtgaggcctatctggttggcctttttgaagacaccaacctgtgtgctatccatgccaaacgtgtaacaattatgccaaaagacatccagctagcacgccgcatacgtggagaacgtgcttaagaatccactatgatgggaaacatttcattctcaaaaaaaaaaaaaaaatttctcttcttcctgttattggtagttctgaacgttagatattttttttccatggggtcaaaaggtacctaagtatatgattgcgagtggaaaaataggggacagaaatcaggtattggcagtttttccattttcatttgtgtgtgaatttttaatataaatgcggagacgtaaagcattaatgcaagttaaaatgtttcagtgaacaagtttcagcggttcaactttataataattataaataaacctgttaaatttttctggacaatgccagcatttggatttttttaaaacaagtaaatttcttattgatggcaactaaatggtgtttgtagcatttttatcatacagtagattccatccattcactatacttttctaactgagttgtcctacatgcaagtacatgtttttaatgttgtctgtcttctgtgctgttcctgtaagtttgctattaaaatacattaaactata

SEQ ID NO: 278974 - DNA, 1051 bp, Homo sapiens
atagcctcggtgtcagccatctttcaattgtgttcgcagccgccgccgcgccgccgtcgctctccaacgccagcgccgcctctcgctcgccgagctccagccgaaggagaaggggggtaagtaaggaggtctctgtaccatggctcgtacaaagcagactgcccgcaaatcgaccggtggtaaagcacccaggaagcaactggctacaaaagccgctcgcaagagtgcgccctctactggaggggtgaagaaacctcatcgttacaggcctggtactgtggcgctccgtgaaattagacgttatcagaagtccactgaacttctgattcgcaaacttcccttccagcgtctggtgcgagaaattgctcaggacttgaggcaagtgaggcctatctggttggcctttttgaagacaccaacctgtgtgctatccatgccaaacgtgtaacaattatgccaaaagacatccagctagcacgccgcatacgtggagaacgtgcttaagaatccactatgatgggaaacatttcattctcaaaaaaaaaaaaaaaatttctcttcttcctgttattggtagttctgaacgttagatattttttttccatggggtcaaaaggtacctaagtatatgattgcgagtggaaaaataggggacagaaatcaggtattggcagtttttccattttcatttgtgtgtgaatttttaatataaatgcggagacgtaaagcattaatgcaagttaaaatgtttcagtgaacaagtttcagcggttcaactttataataattataaataaacctgttaaatttttctggacaatgccagcatttggatttttttaaaacaagtaaatttcttattgatggcaactaaatggtgtttgtagcatttttatcatacagtagattccatccattcactatacttttctaactgagttgtcctacatgcaagtacatgtttttaatgttgtctgtcttctgtgctgttcctgtaagtttgctattaaaatacattaaactataaaaaaacaaaaaaaactcgaggcgg

SEQ ID NO: 278975 - DNA, 1672 bp, Homo sapiens
ccgagctactcgggaggctgaggcaggagaatgacatgaacctgggaggtggagcttgcagtgagctgagatcttgccactgcactccagcctgggcaacaaagagagactccgtctcaaaataaataaataaggaactgccgggcgcggtggctcacgcctataatcccagcactttgggaggccaaggtgggtggatcacgaggtcaggagttcgagaccagcctgaccaacatggtgaaaccccttctctactaaaaatacaaaaaagtagccaggcatggtggcgcatacctgtagtcccagctactcgggaggctgaggcaggagaatcgcttgaatccgggaggtggaggttgcagtgagccgagatcgcgctactgcactccagcctgggcgacagagtaagactccatctcagaaagaaagaaaaatacggaactaacttgtgatatgttctggaatcaaaagtactcttatgataaaacaggtatgaaagggaacatagatgagaagcatgtgataaaaaccacttgttcaccatgttatactactggacaaggcagaggttcacatactgtgtgaatgggattcagagtgaggaggagactaggctgggatggggtatttggattggacatgattgcgtttataagaatgagagtgttaaattggatttcttgctttatttgtgacatttcagtttattagaaatcatgttaccattagaaaaattgaagtttcctagtaacaaagtaatttgatttgtgtaacttgataaaagatttactgacttaagcttttgttttttttcataagctgcttttgagctttgtccccacaggttgtaaaatgtaagcatttggtaaaattgtcagcatcttgcccagtcatttttttaaagggttcaaaaacctttttgttttaattcgtatagttgggtcttaactattggaaataacatcatcagtaattttttcttcattccttttgcaggaggcaagtgaggcctatctggttggcctttttgaagacaccaacctgtgtgctatccatgccaaacgtgtaacaattatgccaaaagacatccagctagcacgccgcatacgtggagaacgtgcttaagaatccactatgatgggaaacatttcattctcaaaaaaaaaaaaaaaatttctcttcttcctgttattggtagttctgaacgttagatattttttttccatggggtcaaaaggtacctaagtatatgattgcgagtggaaaaataggggacagaaatcaggtattggcagtttttccattttcatttgtgtgtgaatttttaatataaatgcggagacgtaaagcattaatgcaagttaaaatgtttcagtgaacaagtttcagcggttcaactttataataattataaataaacctgttaaatttttctggacaatgccagcatttggatttttttaaaacaagtaaatttcttattgatggcaactaaatggtgtttgtagcatttttatcatacagtagattccatccattcactatacttttctaactgagttgtcctacatgcaagtacatgtttttaatgttgtctgtcttctgtgctgttcctgtaagtttgctattaaaatacattaaactataaaaaaacaaaaaaaactcgaggcgg

SEQ ID NO: 278976 - DNA, 1150 bp, Homo sapiens
tgggtgcggggcactttttatttcactgcgaagcctgtgaggactggacgcgaggacggggctttgtagaatgctcgctggtggtagctgttgttcctctcttgttttttcgagacgcctttttgtcaacataactgtaaagatgcccaagaatattttcagatatttacagcaatccatcaacagtcagacgaagggggggcagccaaagtgggggggagtaagaccttttttttgctgtaatttgactcgaccttccagtggtttgtgccttttttcttttgacttgtttgtggatggaatgtttacagacatttctaattactgctttaattaaataaattggatcaaaggccgttcgaggtatttttgttttgccgtttgtcgctcagaattggcattttgagaggtgattgatactgctaacaattttctagtactctagtttgtttcaagaagagattttgggtagacgtaatcttcaccctttcaaattatataacaatacgaacattattttttatactgatcataatttccagatttggggagggggtgatcgtggcaggaaaagttgtatgtttgttagttgcatatggtgatttttgatttttcaatgctggtagggtaagtaaggaggtctctgtaccatggctcgtacaaagcagactgcccgcaaatcgaccggtggtaaagcacccaggaagcaactggctacaaaagccgctcgcaagagtgcgccctctactggaggggtgaagaaacctcatcgttacaggtattaaaaaacaggaaaaaaatgggacaaagtctctcttgtatgtatccatataatttaacaaaaagatggataacaggaaaactttttgctttagagaaactttttttttcatttgaacacttaactactgcttaaataaatgtactgtatgatcatttatatataaagttaagtattaggttttattgaaaacgtttaactttgaagccataatcttacctggaggtctaaggagacctcgtatatcactgataatgttaatgggatatattgacattttagttaactattagtaattctttaaaaatagttaagtgttgctttcttgaatacacttttgaggttatctttcctagtttttggcaaaat

SEQ ID NO: 278977 - DNA, 481 bp, Homo sapiens
  misc_feature (419)..(419): n is a, c, g, or t
  misc_feature (465)..(465): n is a, c, g, or t
  misc_feature (472)..(472): n is a, c, g, or t
atagcctcggtgtcagccatctttcaattgtgttcgcagccgccgccgcgccgccgtcgctctccaacgccagcgccgcctctcgctcgccgagctccagccgaaggagaaggggggtaagtaaggaggtctctgtaccatggctcgtacaaagcagactgcccgcaaatcgaccggtggtaaagcacccaggaagcaactggctacaaaagccgctcgcaagagtgcgccctctactggaggggtgaagaaacctcatcgttacaggcctggtactgtggcgctccgtgaaattagacgttatcagaagtccactgaacttctgattcgcaaacttcccttccagcgtctggtgactccagagggattcagcactcggagcatgccttccgacgcgcggagccatggcagccctgctntgctgctgctgctgctgctgctgctgttgctgccagtcggcccaanccctctngtggtgact

SEQ ID NO: 278978 - DNA, 1072 bp, Homo sapiens
atagcctcggtgtcagccatctttcaattgtgttcgcagccgccgccgcgccgccgtcgctctccaacgccagcgccgcctctcgctcgccgagctccagccgaaggagaaggggggtaagtaaggaggtctctgtaccatggctcgtacaaagcagactgcccgcaaatcgaccggtggtaaagcacccaggaagcaactggctacaaaagccgctcgcaagagtgcgccctctactggaggggtgaagaaacctcatcgttacaggcctggtactgtggcgctccgtgaaattagacgttatcagaagtccactgaacttctgattcgcaaacttcccttccagcgtctggtgcgagaaattgctcaggactttaaaacagatctgcgcttccagagcgcagctatcggtgctttgcaggaggcaagtgaggcctatctggttggcctttttgaagacaccaacctgtgtgctatccatgccaaacgtgtaacaattatgccaaaagacatccagctagcacgccgcatacgtggagaacgtgcttaagaatccactatgatgggaaacatttcattctcaaaaaaaaaaaaaaaatttctcttcttcctgttattggtagttctgaacgttagatattttttttccatggggtcaaaaggtacctaagtatatgattgcgagtggaaaaataggggacagaaatcaggtattggcagtttttccattttcatttgtgtgtgaatttttaatataaatgcggagacgtaaagcattaatgcaagttaaaatgtttcagtgaacaagtttcagcggttcaactttataataattataaataaacctgttaaatttttctggacaatgccagcatttggatttttttaaaacaagtaaatttcttattgatggcaactaaatggtgtttgtagcatttttatcatacagtagattccatccattcactatacttttctaactgagttgtcctacatgcaagtacatgtttttaatgttgtctgtcttctgtgctgttcctgtaagtttgctattaaaatacattaaactata

SEQ ID NO: 278979 - DNA, 834 bp, Homo sapiens
gatacgttttgcgattgtttccattttgttctggtcggggagccgagttggttcctgctcgaggcgctgggagcgaggcgggcaggtaagtaaggaggtctctgtaccatggctcgtacaaagcagactgcccgcaaatcgaccggtggtaaagcacccaggaagcaactggctacaaaagccgctcgcaagagtgcgccctctactggaggggtgaagaaacctcatcgttacaggcctggtactgtggcgctccgtgaaattagacgttatcagaagtccactgaacttctgattcgcaaacttcccttccagcgtctggtgcgagaaattgctcaggactttaaaacagatctgcgcttccagagcgcagctatcggtgctttgcaggaggcaagtgaggcctatctggttggcctttttgaagacaccaacctgtgtgctatccatgccaaacgtgtaacaattatgccaaaagacatccagctagcacgccgcatacgtggagaacgtgcttaagaatccactatgatgggaaacatttcattctcaaaaaaaaaaaaaaaatttctcttcttcctgttattggtagttctgaacgttagatattttttttccatggggtcaaaaggtacctaagtatatgattgcgagtggaaaaataggggacagaaatcaggtattggcagtttttccattttcatttgtgtgtgaatttttaatataaatgcggagacgtaaagcattaatgcaagttaaaatgtttcagtgaacaagtttcagcggttcaactttataataattataaataaacctgttaaatttttctggaca

SEQ ID NO: 278980 - DNA, 657 bp, Homo sapiens
  misc_feature (23)..(23): n is a, c, g, or t
  misc_feature (35)..(35): n is a, c, g, or t
gagggggaaccatcggctaggtncagcctgggtgntgggtaagtaaggaggtctctgtaccatggctcgtacaaagcagactgcccgcaaatcgaccggtggtaaagcacccaggaagcaactggctacaaaagccgctcgcaagagtgcgccctctactggaggggtgaagaaacctcatcgttacaggcctggtactgtggcgctccgtgaaattagacgttatcagaagtccactgaacttctgattcgcaaacttcccttccagcgtctggtgcgagaaattgctcaggactttaaaacagatctgcgcttccagagcgcagctatcggtgctttgcaggaggcaagtgaggcctatctggttggcctttttgaagacaccaacctgtgtgctatccatgccaaacgtgtaacaattatgccaaaagacatccagctagcacgccgcatacgtggagaacgtgcttaagaatccactatgatgggaaacatttcattctcaaaaaaaaaaaaaaacaaaaaacaaaaaaaaaaaccccgcgggccctcttaatgcgggggggggaaaacgggtgttctgtgaagggcccctggggccaaaggtgttttccctggccccccgtttctttgtttcacaaggtgggaaccttccgg

SEQ ID NO: 278981 - DNA, 665 bp, Homo sapiens
  misc_feature (26)..(26): n is a, c, g, or t
  misc_feature (34)..(34): n is a, c, g, or t
  misc_feature (42)..(42): n is a, c, g, or t
gggggcttatgaagaataacccaggncccccccnggaggtanggatatcgtcgaccacggcgctcgcgcctggtactgtggcgctccgtgaaattagacgttatcagaagtccactgaacttctgattcgcaaacttcccttccagcgtctggtgcgagaaattgctcaggactttaaaacagatctgcgcttccagagcgcagctatcggtgctttgcaggaggcaagtgaggcctatctggttggcctttttgaagacaccaacctgtgtgctatccatgccaaacgtgtaacaattatgccaaaagacatccagctagcacgccgcatacgtggagaacgtgcttaagaatccactatgatgggaaacatttcattctcaaaaaaaaaaaaaaaatttctcttcttcctgttattggtagttctgaacgttagatattttttttccatggggtcaaaaggtacctaagtatatgattgcgagtggaaaaataggggacagaaatcaggtattggcagtttttccattttcatttgtgtgtgaatttttaatataaatgcggagacgtaaagcattaatgcaagttaaaatgtttcagtgaacaagtttcagcggttcaactttataataattataaataaacctgttaaatttttctggaca

SEQ ID NO: 278982 - DNA, 1097 bp, Homo sapiens
atagcctcggtgtcagccatctttcaattgtgttcgcagccgccgccgcgccgccgtcgctctccaacgccagcgccgcctctcgctcgccgagctccagccgaaggagaaggggggtaagtaaggaggtctctgtaccatggctcgtacaaagcagactgcccgcaaatcgaccggtggtaaagcacccaggaagcaactggctacaaaagccgctcgcaagagtgcgccctctactggaggggtgaagaaacctcatcgttacaggcctggtactgtggcgctccgtgaaattagacgttatcagaagtccactgaacttctgattcgcaaacttcccttccagcgtctggtgcgagaaattgctcaggactttaaaacagatctgcgcttccagagcgcagctatcggtgctttgcaggaggcaagtgaggcctatctggttggcctttttgaagacaccaacctgtgtgctatccatgccaaacgtgtaacaattatgccaaaagacatccagctagcacgccgcatacgtggagaacgtgcttaagaatccactatgatgggaaacatttcattctcaaaaaaaaaaaaaaaatttctcttcttcctgttattggtagttctgaacgttagatattttttttccatggggtcaaaaggtacctaagtatatgattgcgagtggaaaaataggggacagaaatcaggtattggcagtttttccattttcatttgtgtgtgaatttttaatataaatgcggagacgtaaagcattaatgcaagttaaaatgtttcagtgaacaagtttcagcggttcaactttataataattataaataaacctgttaaatttttctggacaatgccagcatttggatttttttaaaacaagtaaatttcttattgatggcaactaaatggtgtttgtagcatttttatcatacagtagattccatccattcactatacttttctaactgagttgtcctacatgcaagtacatgtttttaatgttgtctgtcttctgtgctgttcctgtaagtttgctattaaaatacattaaactataaaaaaacaaaaaaaactcgaggcgg

SEQ ID NO: 278983 - DNA, 1372 bp, Homo sapiens
atagcctcggtgtcagccatctttcaattgtgttcgcagccgccgccgcgccgccgtcgctctccaacgccagcgccgcctctcgctcgccgagctccagccgaaggagaaggggggtaagtaaggaggtctctgtaccatggctcgtacaaagcagactgcccgcaaatcgaccggtggtaaagcacccaggaagcaactggctacaaaagccgctcgcaagagtgcgccctctactggaggggtgaagaaacctcatcgttacaggcctggtactgtggcgctccgtgaaattagacgttatcagaagtccactgaacttctgattcgcaaacttcccttccagcgtctggtgcgagaaattgctcaggactttaaaacagatctgcgcttccagagcgcagctatcggtgctttgcaggaggcaagtgaggcctatctggttggcctttttgaagacaccaacctgtgtgctatccatgccaaacgtgtaacaattatgccaaaagacatccagctagcacgccgcatacgtggagaacgtgcttaagaatccactatgatgggaaacatttcattctcaaaaaaaaaaaaaaaatttctcttcttcctgttattggtagttctgaacgttagatattttttttccatggggtcaaaaggtacctaagtatatgattgcgagtggaaaaataggggacagaaatcaggtattggcagtttttccattttcatttgtgtgtgaatttttaatataaatgcggagacgtaaagcattaatgcaagttaaaatgtttcagtgaacaagtttcagcggttcaactttataataattataaataaacctgttaaatttttctggacaatgccagcatttggatttttttaaaacaagtaaatttcttattgatggcaactaaatggtgtttgtagcatttttatcatacagtagattccatccattcactatacttttctaactgagttgtcctacatgcaagtacatgtttttaatgttgtctgtcttctgtgctgttcctgtaagtttgctattaaaatacattaaactatactttacttataacaacaaaaagggggcggcaaaaatcctcggggccagcttaacggtaccaggttcttgaaaagggggccaaagggagcggtataataggtaagaacggcgcggttaacacgtctagtgggaactgtcttggacttggacggaccttttgtgggtgccatttgcatcccaaggataacgcaggaattactacggatgttaacgctttggtgaattgtggtattacaccgtgatataaactaaaagagtataacaagccttatcaaaaacacgaaaaaatagaaaattata

SEQ ID NO: 278984 - DNA, 1076 bp, Homo sapiens
tcatcgctgttccagcagcgatgactcgagcgggggttcgcagccgccgccgcgccgccgtcgctctccaacgccagcgccgcctctcgctcgccgagctccagccgaaggagaaggggggtaagtaaggaggtctctgtaccatggctcgtacaaagcagactgcccgcaaatcgaccggtggtaaagcacccaggaagcaactggctacaaaagccgctcgcaagagtgcgccctctactggaggggtgaagaaacctcatcgttacaggcctggtactgtggcgctccgtgaaattagacgttatcagaagtccactgaacttctgattcgcaaacttcccttccagcgtctggtgcgagaaattgctcaggactttaaaacagatctgcgcttccagagcgcagctatcggtgctttgcaggaggcaagtgaggcctatctggttggcctttttgaagacaccaacctgtgtgctatccatgccaaacgtgtaacaattatgccaaaagacatccagctagcacgccgcatacgtggagaacgtgcttaagaatccactatgatgggaaacatttcattctcaaaaaaaaaaaaaaaatttctcttcttcctgttattggtagttctgaacgttagatattttttttccatggggtcaaaaggtacctaagtatatgattgcgagtggaaaaataggggacagaaatcaggtattggcagtttttccattttcatttgtgtgtgaatttttaatataaatgcggagacgtaaagcattaatgcaagttaaaatgtttcagtgaacaagtttcagcggttcaactttataataattataaataaacctgttaaatttttctggacaatgccagcatttggatttttttaaaacaagtaaatttcttattgatggcaactaaatggtgtttgtagcatttttatcatacagtagattccatccattcactatacttttctaactgagttgtcctacatgcaagtacatgtttttaatgttgtctgtcttctgtgctgttcctgtaagtttgctattaaaatacattaaactata

SEQ ID NO: 278985 - DNA, 1043 bp, Homo sapiens
atagcctcggtgtcagccatctttcaattgtgttcgcagccgccgccgcgccgccgtcgctctccaacgccagcgccgcctctcgctcgccgagctccagccgaaggagaaggggggtaagtaaggaggtctctgtaccatggctcgtacaaagcagactgcccgcaaatcgaccggtggtaaagcacccaggaagcaactggctacaaaagccgctcgcaagagtgcgccctctactggaggggtgaagaaacctcatcgttacaggcctggtactgtggcgctccgtgaaattagacgttatcagaagtccactgaacttctgattcgcaaacttcccttccagcgtctggtgcgagaaattgctcaggactttaaaacagatctgcgcttccagagcgcagctatcggtgctttgcaggaggcaagtgaggcctatctggttggcctttttgaagacaccaacctgtgtgctatccatgccaaacgtgtaacaattatgccaaaagacatccagctagcacgccgcatacgtggagaacgtgcttaagaatccactatgatgggaaacatttcattctcaaaaaaaaaaaaaaaatttctcttcttcctgttattggtagttctgaacgttagatattttttttccatggggtcaaaaggtacctaagtatatgattgcgagtggaaaaataggggacagaaatcaggtattggcagtttttccattttcatttgtgtgtgaatttttaatataaatgcggagacgtaaagcattaatgcaagttaaaatgtttcagtgaacaagtttcagcggttcaactttataataattataaataaacctgttaaatttttctggacaatgccagcatttggattttttttcatacagtagattccatccattcactatacttttctaactgagttgtcctacatgcaagtacatgtttttaatgttgtctgtcttctgtgctgttcctgtaagtttgctattaaaatacattaaactataaaaaaacaaaaaaaactcgaggcgg

SEQ ID NO: 278986 - DNA, 1085 bp, Homo sapiens
gcggccgcccccggggagcccggcgggcgccggcgcgcccccccccacccccaccccacgtctccgccgtcgctctccaacgccagcgccgcctctcgctcgccgagctccagccgaaggagaaggggggtaagtaaggaggtctctgtaccatggctcgtacaaagcagactgcccgcaaatcgaccggtggtaaagcacccaggaagcaactggctacaaaagccgctcgcaagagtgcgccctctactggaggggtgaagaaacctcatcgttacaggcctggtactgtggcgctccgtgaaattagacgttatcagaagtccactgaacttctgattcgcaaacttcccttccagcgtctggtgcgagaaattgctcaggactttaaaacagatctgcgcttccagagcgcagctatcggtgctttgcaggaggcaagtgaggcctatctggttggcctttttgaagacaccaacctgtgtgctatccatgccaaacgtgtaacaattatgccaaaagacatccagctagcacgccgcatacgtggagaacgtgcttaagaatccactatgatgggaaacatttcattctcaaaaaaaaaaaaaaaatttctcttcttcctgttattggtagttctgaacgttagatattttttttccatggggtcaaaaggtacctaagtatatgattgcgagtggaaaaataggggacagaaatcaggtattggcagtttttccattttcatttgtgtgtgaatttttaatataaatgcggagacgtaaagcattaatgcaagttaaaatgtttcagtgaacaagtttcagcggttcaactttataataattataaataaacctgttaaatttttctggacaatgccagcatttggatttttttaaaacaagtaaatttcttattgatggcaactaaatggtgtttgtagcatttttatcatacagtagattccatccattcactatacttttctaactgagttgtcctacatgcaagtacatgtttttaatgttgtctgtcttctgtgctgttcctgtaagtttgctattaaaatacattaaactata

SEQ ID NO: 278987 - DNA, 635 bp, Homo sapiens
atagcctcggtgtcagccatctttcaattgtgttcgcagccgccgccgcgccgccgtcgctctccaacgccagcgccgcctctcgctcgccgagctccagccgaaggagaaggggggtaagtaaggaggtctctgtaccatggctcgtacaaagcagactgcccgcaaatcgaccggtggtaaagcacccaggaagcaactggctacaaaagccgctcgcaagagtgcgccctctactggaggggtgaagaaacctcatcgttacaggcctggtactgtggcgctccgtgaaattagacgttatcagaagtccactgaacttctgattcgcaaacttcccttccagcgtctggtgcgagaaattgctcaggactttaaaacagatctgcgcttccagagcgcagctatcggtgctttgcaggaggcaagtgaggcctatctggttggcctttttgaagacaccaacctgtgtgctatccatgccaaacgtgtaacaattatgccaaaagacatccagctagcacgccgcatacgtggagaacgtgcttaagaatccactatgatgggaaacatttcattctcaaaaaaaaaaaaaaagagaaataactcgagactagttctctctctctctctcc

SEQ ID NO: 278988 - DNA, 988 bp, Homo sapiens
tatgagggctgctagaagacgacagaaggggggtaagtaaggaggtctctgtaccatggctcgtacaaagcagactgcccgcaaatcgaccggtggtaaagcacccaggaagcaactggctacaaaagccgctcgcaagagtgcgccctctactggaggggtgaagaaacctcatcgttacaggcctggtactgtggcgctccgtgaaattagacgttatcagaagtccactgaacttctgattcgcaaacttcccttccagcgtctggtgcgagaaattgctcaggactttaaaacagatctgcgcttccagagcgcagctatcggtgctttgcaggaggcaagtgaggcctatctggttggcctttttgaagacaccaacctgtgtgctatccatgccaaacgtgtaacaattatgccaaaagacatccagctagcacgccgcatacgtggagaacgtgcttaagaatccactatgatgggaaacatttcattctcaaaaaaaaaaaaaaaatttctcttcttcctgttattggtagttctgaacgttagatattttttttccatggggtcaaaaggtacctaagtatatgattgcgagtggaaaaataggggacagaaatcaggtattggcagtttttccattttcatttgtgtgtgaatttttaatataaatgcggagacgtaaagcattaatgcaagttaaaatgtttcagtgaacaagtttcagcggttcaactttataataattataaataaacctgttaaatttttctggacaatgccagcatttggatttttttaaaacaagtaaatttcttattgatggcaactaaatggtgtttgtagcatttttatcatacagtagattccatccattcactatacttttctaactgagttgtcctacatgcaagtacatgtttttaatgttgtctgtcttctgtgctgttcctgtaagtttgctattaaaatacattaaactata

SEQ ID NO: 278989 - DNA, 1008 bp, Homo sapiens
ttctagagtatcccccttgctggcgcagagcagctagccagaagagaggggggtaagtaaggaggtctctgtaccatggctcgtacaaagcagactgcccgcaaatcgaccggtggtaaagcacccaggaagcaactggctacaaaagccgctcgcaagagtgcgccctctactggaggggtgaagaaacctcatcgttacaggcctggtactgtggcgctccgtgaaattagacgttatcagaagtccactgaacttctgattcgcaaacttcccttccagcgtctggtgcgagaaattgctcaggactttaaaacagatctgcgcttccagagcgcagctatcggtgctttgcaggaggcaagtgaggcctatctggttggcctttttgaagacaccaacctgtgtgctatccatgccaaacgtgtaacaattatgccaaaagacatccagctagcacgccgcatacgtggagaacgtgcttaagaatccactatgatgggaaacatttcattctcaaaaaaaaaaaaaaaatttctcttcttcctgttattggtagttctgaacgttagatattttttttccatggggtcaaaaggtacctaagtatatgattgcgagtggaaaaataggggacagaaatcaggtattggcagtttttccattttcatttgtgtgtgaatttttaatataaatgcggagacgtaaagcattaatgcaagttaaaatgtttcagtgaacaagtttcagcggttcaactttataataattataaataaacctgttaaatttttctggacaatgccagcatttggatttttttaaaacaagtaaatttcttattgatggcaactaaatggtgtttgtagcatttttatcatacagtagattccatccattcactatacttttctaactgagttgtcctacatgcaagtacatgtttttaatgttgtctgtcttctgtgctgttcctgtaagtttgctattaaaatacattaaactata

SEQ ID NO: 278990 - DNA, 1073 bp, Homo sapiens
tgagaatgaaatgtttcccatcatagtggattcttaagcacgttctccacgtatgcggcgtgctagctggatgtcttttggcataattgttacacgtttggcatggatagcacacaggttggtgtcttcaaaaggccaaccagataggcctcacttgccctgcccgcaaatcgaccggtggtaaagcacccaggaagcaactggctacaaaagccgctcgcaagagtgcgccctctactggaggggtgaagaaacctcatcgttacaggcctggtactgtggcgctccgtgaaattagacgttatcagaagtccactgaacttctgattcgcaaacttcccttccagcgtctggtgcgagaaattgctcaggactttaaaacagatctgcgcttccagagcgcagctatcggtgctttgcaggaggcaagtgaggcctatctggttggcctttttgaagacaccaacctgtgtgctatccatgccaaacgtgtaacaattatgccaaaagacatccagctagcacgccgcatacgtggagaacgtgcttaagaatccactatgatgggaaacatttcattctcaaaaaaaaaaaaaaaatttctcttcttcctgttattggtagttctgaacgttagatattttttttccatggggtcaaaaggtacctaagtatatgattgcgagtggaaaaataggggacagaaatcaggtattggcagtttttccattttcatttgtgtgtgaatttttaatataaatgcggagacgtaaagcattaatgcaagttaaaatgtttcagtgaacaagtttcagcggttcaactttataataattataaataaacctgttaaatttttctggacaatgccagcatttggatttttttaaaacaagtaaatttcttattgatggcaactaaatggtgtttgtagcatttttatcatacagtagattccatccattcactatacttttctaactgagttgtcctacatgcaagtacatgtttttaatgttgtctgtcttctgtgctgttcctgtaagtttgctattaaaatacattaaactata

SEQ ID NO: 278991 - DNA, 917 bp, Homo sapiens
atttgtaatgtacaggatgggcttttttaaacgggtccggccacctcaagaagaacaagaaagggagcagcttcaacctcatgaaaatggtgaagaaacctcatcgttacaggcctggtactgtggcgctccgtgaaattagacgttatcagaagtccactgaacttctgattcgcaaacttcccttccagcgtctggtgcgagaaattgctcaggactttaaaacagatctgcgcttccagagcgcagctatcggtgctttgcaggaggcaagtgaggcctatctggttggcctttttgaagacaccaacctgtgtgctatccatgccaaacgtgtaacaattatgccaaaagacatccagctagcacgccgcatacgtggagaacgtgcttaagaatccactatgatgggaaacatttcattctcaaaaaaaaaaaaaaaatttctcttcttcctgttattggtagttctgaacgttagatattttttttccatggggtcaaaaggtacctaagtatatgattgcgagtggaaaaataggggacagaaatcaggtattggcagtttttccattttcatttgtgtgtgaatttttaatataaatgcggagacgtaaagcattaatgcaagttaaaatgtttcagtgaacaagtttcagcggttcaactttataataattataaataaacctgttaaatttttctggacaatgccagcatttggatttttttaaaacaagtaaatttcttattgatggcaactaaatggtgtttgtagcatttttatcatacagtagattccatccattcactatacttttctaactgagttgtcctacatgcaagtacatgtttttaatgttgtctgtcttctgtgctgttcctgtaagtttgctattaaaatacattaaactata

SEQ ID NO: 278992 - DNA, 1060 bp, Homo sapiens
atagcctcggtgtcagccatctttcaattgtgttcgcagccgccgccgcgccgccgtcgctctccaacgccagcgccgcctctcgctcgccgagctccagccgaaggagaaggggggtaagtaaggaggtctctgtaccatggctcgtacaaagcagactgcccgcaaatcgaccggtggtaaagcacccaggaagcaactggctacaaaagccgctcgcaagagtgcgccctctactggaggggtgaagaaacctcatcgttacaggcctggtactgtggcgctccgtgaaattagacgttatcagaagtccactgaacttctgattcgcaaacttcccttccagcgtctggtgcgagaaattgctcaggactttaaaacagatctgcgcttccagagcgcagctatcggtgctttgcagacaccaacctgtgtgctatccatgccaaacgtgtaacaattatgccaaaagacatccagctagcacgccgcatacgtggagaacgtgcttaagaatccactatgatgggaaacatttcattctcaaaaaaaaaaaaaaaatttctcttcttcctgttattggtagttctgaacgttagatattttttttccatggggtcaaaaggtacctaagtatatgattgcgagtggaaaaataggggacagaaatcaggtattggcagtttttccattttcatttgtgtgtgaatttttaatataaatgcggagacgtaaagcattaatgcaagttaaaatgtttcagtgaacaagtttcagcggttcaactttataataattataaataaacctgttaaatttttctggacaatgccagcatttggatttttttaaaacaagtaaatttcttattgatggcaactaaatggtgtttgtagcatttttatcatacagtagattccatccattcactatacttttctaactgagttgtcctacatgcaagtacatgtttttaatgttgtctgtcttctgtgctgttcctgtaagtttgctattaaaatacattaaactataaaaaaacaaaaaaaactcgaggcgg

SEQ ID NO: 278993 - DNA, 3471 bp, Homo sapiens
acgccaccactggaacccgggggaagatggcggcagccgttctgagtgggccctctgcgggctccgcggctggggttcctggcgggaccgggggtctctcggcagtgagctcgggcccgcggctccgcctgctgctgctggagagtgtttctggtttgctgcaacctcgaacggggtctgccgttgctccggtgcatcccccaaaccgctcggccccacatttgcccgggctcatgtgcctattgcggctgcatgggtcggtgggcggggcccagaacctttcagctcttggggcattggtgagtctcagtaatgcacgtctcagttccatcaaaactcggtttgagggcctgtgtctgctgtccctgctggtaggggagagccccacagagctattccagcagcactgtgtgtcttggcttcggagcattcagcaggtgttacagacccaggacccgcctgccacaatggagctggccgtggctgtcctgagggacctcctccgatatgcagcccagctgcctgcactgttccgggacatctccatgaaccacctccctggccttctcacctccctgctgggcctcaggccagagtgtgagcagtcagcattggaaggaatgaaggcttgtatgacctatttccctcgggcttgtggttctctcaaaggcaagctggcctcattttttctgtctagggtggatgccttgagccctcagctccaacagttggcctgtgagtgttattcccggctgccctctttaggggctggcttttcccaaggcctgaagcacaccgagagctgggagcaggagctacacagtctgctggcctcactgcacaccctgctgggggccctgtacgagggagcagagactgctcctgtgcagaatgaaggccctggggtggagatgctgctgtcctcagaagatggtgatgcccatgtccttctccagcttcggcagaggttttcgggactggcccgctgcctagggctcatgctcagctctgagtttggagctcccgtgtccgtccctgtgcaggaaatcctggatttcatctgccggaccctcagcgtcagtagcaagaatattagcttgcatggagatggtcccctgcggctgctgctgctgccctctatccaccttgaggccttggacctgctgtctgcactcatcctcgcgtgtggaagccggctcttgcgctttgggatcctgatcggccgcctgcttccccaggtcctcaattcctggagcatcggtagagattccctctctccaggccaggagaggccttacagcacggttcggaccaaggtgtatgcgatattagagctgtgggtgcaggtttgtggggcctcggcgggaatgcttcagggaggagcctctggagaggccctgctcacccacctgctcagcgacatctccccgccagctgatgcccttaagctgcgtagcccgcgggggagccctgatgggagtttgcagactgggaagcctagcgcccccaagaagctaaagctggatgtgggggaagctatggccccgccaagccaccggaaaggggatagcaatgccaacagcgacgtgtgtgcggctgcactcagaggcctcagccggaccatcctcatgtgtgggcctctcatcaaggaggagactcacaggagactgcatgacctggtcctccccctggtcatgggtgtacagcagggtgaggtcctaggcagctccccgtacacgagctcccgctgccgccgtgaactctactgcctgctgctggcgctgctgctggccccgtctcctcgctgcccacctcctcttgcctgtgccctgcaagccttctccctcggccagcgagaagatagccttgaggtctcctctttctgctcagaagcactggtgacctgtgctgctctgacccacccccgggttcctcccctgcagcccatgggccccacctgccccacacctgctccagttccccctcctgaggccccatcgcccttcagggccccaccgttccatcctccgggccccatgccctcagtgggctccatgccctcagcaggccccatgccttcagcaggccccatgccctcagcaggccctgtgccctcggcacgccctggacctcccaccacagccaaccacctaggcctttctgtcccaggcctagtgtctgtccctccccggcttcttcctggccctgagaaccaccgggcaggctcaaatgaggaccccatccttgcccctagtgggactcccccacctactatacccccagatgaaacttttggggggagagtgcccagaccagcctttgtccactatgacaaggaggaggcatctgatgtggagatctccttggaaagtgactctgatgacagcgtggtgatcgtgcccgaggggcttccccccctgccacccccaccaccctcaggtgccacaccaccccctatagcccccactgggccaccaacagcctcccctcctgtgccagcgaaggaggagcctgaagaacttcctgcagccccagggcctctcccgccacccccacctccgccgccgcctgttcctggtcctgtgacgctccctccaccccagttggtccctgaagggactcctggtgggggaggacccccagccctggaagaggatttgacagttattaatatcaacagcagtgatgaagaggaggaggaagaggaagaagaggaagaagaagaagaggaagaagaggaagaggaggaagactttgaggaagaggaagaggatgaagaggaatattttgaagaggaagaagaggaggaagaagagtttgaggaagaatttgaggaagaagaaggtgagttagaggaagaagaagaagaggaggatgaggaggaggaagaagaactggaagaggtggaagacctggagtttggcacagcaggaggggaggtagaagaaggtgcacctccacccccaaccctgcctccagctctgcctccccctgagtctcccccaaaggtgcagccagaacccgaacccgaacccgggctgcttttggaagtggaggagccagggacggaggaggagcgtggggctgacacagctcccaccctggcccctgaagcgctcccctcccagggagaggtggagagggaaggggaaagccctgcggcagggccccctccccaggagcttgttgaagaagagccctctgctcccccaaccctgttggaagaggagactgaggatgggagtgacaaggtgcagcccccaccagagacacctgcagaagaagagatggagacagagacagaggccgaagctctccaggaaaaggagcaggatgacacagctgccatgctggccgacttcatcgattgtccccctgatgatgagaagccaccacctcccacagagcctgactcctagccatcttctgcaccccactctttgtttccaataaagttatgtccttagatag

SEQ ID NO: 278994 - DNA, 3930 bp, Homo sapiens
  misc_feature (1405)..(1405): n is a, c, g, or t
acgccaccactggaacccgggggaagatggcggcagccgttctgagtgggccctctgcgggctccgcggctggggttcctggcgggaccgggggtctctcggcagtgagctcgggcccgcggctccgcctgctgctgctggagagtgtttctggtttgctgcaacctcgaacggggtctgccgttgctccggtgcatcccccaaaccgctcggccccacatttgcccgggctcatgtgcctattgcggctgcatgggtcggtgggcggggcccagaacctttcagctcttggggcattggtgagtctcagtaatgcacgtctcagttccatcaaaactcggtttgagggcctgtgtctgctgtccctgctggtaggggagagccccacagagctattccagcagcactgtgtgtcttggcttcggagcattcagcaggtgttacagacccaggacccgcctgccacaatggagctggccgtggctgtcctgagggacctcctccgatatgcagcccagctgcctgcactgttccgggacatctccatgaaccacctccctggccttctcacctccctgctgggcctcaggccagagtgtgagcagtcagcattggaaggaatgaaggcttgtatgacctatttccctcgggcttgtggttctctcaaaggcaagctggcctcattttttctgtctagggtggatgccttgagccctcagctccaacagttggcctgtgagtgttattcccggctgccctctttaggggctggcttttcccaaggcctgaagcacaccgagagctgggagcaggagctacacagtctgctggcctcactgcacaccctgctgggggccctgtacgagggagcagagactgctcctgtgcagaatgaaggccctggggtggagatgctgctgtcctcagaagatggtgatgcccatgtccttctccagcttcggcagaggttttcgggactggcccgctgcctagggctcatgctcagctctgagtttggagctcccgtgtccgtccctgtgcaggaaatcctggatttcatctgccggaccctcagcgtcagtagcaagaatattgtaagtgggatttgtcatctcttcagagcccttgctcaggataccaggcaaccaggaaagtactggggacctgagtctccccaaacagtgtcatcctggagtcgtcccagagagcttctacttttgtccaaataacatcacttcctatgtgtcgtgacacaggagcacagtgtcagagtgtagcaaatgcttccttgggggagggtgaatttggggatcagctgagtcattgctgagaggcccagccatccttcttaccttccatccagggtctattttagaggataggggtttgattttgttgggagagntgagatcaggggttgggtttcttacctatgtgtacatatgtaaatggtcattccctgtttctgtctctctctggctctcactttcttcctccactctttatctctgccccttttttctccagagcttgcatggagatggtcccctgcggctgctgctgctgccctctatccaccttgaggccttggacctgctgtctgcactcatcctcgcgtgtggaagccggctcttgcgctttgggatcctgatcggccgcctgcttccccaggtcctcaattcctggagcatcggtagagattccctctctccaggccaggagaggccttacagcacggttcggaccaaggtgtatgcgatattagagctgtgggtgcaggtttgtggggcctcggcgggaatgcttcagggaggagcctctggagaggccctgctcacccacctgctcagcgacatctccccgccagctgatgcccttaagctgcgtagcccgcgggggagccctgatgggagtttgcagactgggaagcctagcgcccccaagaagctaaagctggatgtgggggaagctatggccccgccaagccaccggaaaggggatagcaatgccaacagcgacgtgtgtgcggctgcactcagaggcctcagccggaccatcctcatgtgtgggcctctcatcaaggaggagactcacaggagactgcatgacctggtcctccccctggtcatgggtgtacagcagggtgaggtcctaggcagctccccgtacacgagctcccgctgccgccgtgaactctactgcctgctgctggcgctgctgctggccccgtctcctcgctgcccacctcctcttgcctgtgccctgcaagccttctccctcggccagcgagaagatagccttgaggtctcctctttctgctcagaagcactggtgacctgtgctgctctgacccacccccgggttcctcccctgcagcccatgggccccacctgccccacacctgctccagttccccctcctgaggccccatcgcccttcagggccccaccgttccatcctccgggccccatgccctcagtgggctccatgccctcagcaggccccatgccttcagcaggccccatgccctcagcaggccctgtgccctcggcacgccctggacctcccaccacagccaaccacctaggcctttctgtcccaggcctagtgtctgtccctccccggcttcttcctggccctgagaaccaccgggcaggctcaaatgaggaccccatccttgcccctagtgggactcccccacctactatacccccagatgaaacttttggggggagagtgcccagaccagcctttgtccactatgacaaggaggaggcatctgatgtggagatctccttggaaagtgactctgatgacagcgtggtgatcgtgcccgaggggcttccccccctgccacccccaccaccctcaggtgccacaccaccccctatagcccccactgggccaccaacagcctcccctcctgtgccagcgaaggaggagcctgaagaacttcctgcagccccagggcctctcccgccacccccacctccgccgccgcctgttcctggtcctgtgacgctccctccaccccagttggtccctgaagggactcctggtgggggaggacccccagccctggaagaggatttgacagttattaatatcaacagcagtgatgaagaggaggaggaagaggagaagaggaagaagaagaagaagaagaagaagaggaagaagaagaagaggaagaagaggaagaggaggaagactttgaggaagaggaagaggatgaagaggaatattttgaagaggaagaagaggaggaagaagagtttgaggaagaatttgaggaagaagaaggtgagttagaggaagaagaagaagaggaggatgaggaggaggaagaagaactggaagaggtggaagacctggagtttggcacagcaggaggggaggtagaagaaggtgcacctccacccccaaccctgcctccagctctgcctccccctgagtctcccccaaaggtgcagccagaacccgaacccgaacccgggctgcttttggaagtggaggagccagggacggaggaggagcgtggggctgacacagctcccaccctggcccctgaagcgctcccctcccagggagaggtggagagggaaggggaaagccctgcggcagggccccctccccaggagcttgttgaagaagagccctctgctcccccaaccctgttggaagaggagactgaggatgggagtgacaaggtgcagcccccaccagagacacctgcagaagaagagatggagacagagacagaggccgaagctctccaggaaaaggagcaggatgacacagctgccatgctggccgacttcatcgattgtccccctgatgatgagaagccaccacctcccacagagcctgactcctagccatcttctgcaccccactctttgtttccaataaagttatgtccttagatag

SEQ ID NO: 278995 - DNA, 3241 bp, Homo sapiens
acgccaccactggaacccgggggaagatggcggcagccgttctgagtgggccctctgcgggctccgcggctggggttcctggcgggaccgggggtctctcggcagtgagctcgggcccgcggctccgcctgctgctgctggagagtgtttctggtttgctgcaacctcgaacggggtctgccgttgctccggtgcatcccccaaaccgctcggccccacatttgcccgggctcatgtgcctattgcggctgcatgggtcggtgggcggggcccagaacctttcagctcttggggcattggtgagtctcagtaatgcacgtctcagttccatcaaaactcggtttgagggcctgtgtctgctgtccctgctggtaggggagagccccacagagctattccagcagcactgtgtgtcttggcttcggagcattcagcaggtgttacagacccaggacccgcctgccacaatggagctggccgtggctgtcctgagggacctcctccgatatgcagcccagctgcctgcactgttccgggacatctccatgaaccacctccctggccttctcacctccctgctgggcctcaggccagagtgtgagcagtcagcattggaaggaatgaaggcttgtatgacctatttccctcgggcttgtggttctctcaaaggcaagctggcctcattttttctgtctagggtggatgccttgagccctcagctccaacagttggcctgtgagtgttattcccggctgccctctttaggggctggcttttcccaaggcctgaagcacaccgagagctgggagcaggagctacacagtctgctggcctcactgcacaccctgctgggggccctgtacgagggagcagagactgctcctgtgcagaatgaaggccctggggtggagatgctgctgtcctcagaagatggtgatgcccatgtccttctccagcttcggcagaggttttcgggactggcccgctgcctagggctcatgctcagctctgagtttggagctcccgtgtccgtccctgtgcaggaaatcctggatttcatctgccggaccctcagcgtcagtagcaagaatattagcttgcatggagatggtcccctgcggctgctgctgctgccctctatccaccttgaggccttggacctgctgtctgcactcatcctcgcgtgtggaagccggctcttgcgctttgggatcctgatcggccgcctgcttccccaggtcctcaattcctggagcatcggtagagattccctctctccaggccaggagaggccttacagcacggttcggaccaaggtgtatgcgatattagagctgtgggtgcaggtttgtggggcctcggcgggaatgcttcagggaggagcctctggagaggccctgctcacccacctgctcagcgacatctccccgccagctgatgcccttaagctgcgtagcccgcgggggagccctgatgggagtttgcagactgggaagcctagcgcccccaagaagctaaagctggatgtgggggaagctatggccccgccaagccacctcctcttgcctgtgccctgcaagccttctccctcggccagcgagaagatagccttgaggtctcctctttctgctcagaagcactggtgacctgtgctgctctgacccacccccgggttcctcccctgcagcccatgggccccacctgccccacacctgctccagttccccctcctgaggccccatcgcccttcagggccccaccgttccatcctccgggccccatgccctcagtgggctccatgccctcagcaggccccatgccttcagcaggccccatgccctcagcaggccctgtgccctcggcacgccctggacctcccaccacagccaaccacctaggcctttctgtcccaggcctagtgtctgtccctccccggcttcttcctggccctgagaaccaccgggcaggctcaaatgaggaccccatccttgcccctagtgggactcccccacctactatacccccagatgaaacttttggggggagagtgcccagaccagcctttgtccactatgacaaggaggaggcatctgatgtggagatctccttggaaagtgactctgatgacagcgtggtgatcgtgcccgaggggcttccccccctgccacccccaccaccctcaggtgccacaccaccccctatagcccccactgggccaccaacagcctcccctcctgtgccagcgaaggaggagcctgaagaacttcctgcagccccagggcctctcccgccacccccacctccgccgccgcctgttcctggtcctgtgacgctccctccaccccagttggtccctgaagggactcctggtgggggaggacccccagccctggaagaggatttgacagttattaatatcaacagcagtgatgaagaggaggaggaagaggagaagaggaagaagaagaagaagaagaagaagaggaagaagaagaagaggaagaagaggaagaggaggaagactttgaggaagaggaagaggatgaagaggaatattttgaagaggaagaagaggaggaagaagagtttgaggaagaatttgaggaagaagaaggtgagttagaggaagaagaagaagaggaggatgaggaggaggaagaagaactggaagaggtggaagacctggagtttggcacagcaggaggggaggtagaagaaggtgcacctccacccccaaccctgcctccagctctgcctccccctgagtctcccccaaaggtgcagccagaacccgaacccgaacccgggctgcttttggaagtggaggagccagggacggaggaggagcgtggggctgacacagctcccaccctggcccctgaagcgctcccctcccagggagaggtggagagggaaggggaaagccctgcggcagggccccctccccaggagcttgttgaagaagagccctctgctcccccaaccctgttggaagaggagactgaggatgggagtgacaaggtgcagcccccaccagagacacctgcagaagaagagatggagacagagacagaggccgaagctctccaggaaaaggagcaggatgacacagctgccatgctggccgacttcatcgattgtccccctgatgatgagaagccaccacctcccacagagcctgactcctagccatcttctgcaccccactctttgtttccaataaagttatgtccttagatag

SEQ ID NO: 278996 - DNA, 584 bp, Homo sapiens
agctcacttgatttgaaccctaccttttccagctcccagatgtcctattccaccctgggattacctctgctcccttctttctttgcttcttccacctcattccaagtatttcaggagttggaaaccacagtggatctggggatgaagtcttgctgtagcctagtgagaataaaagagcagtcactttctctgaagtctagcctccgcccacttaacatgactctcttctttctttgaaggtttgagggcctgtgtctgctgtccctgctggtaggggagagccccacagagctattccagcagcactgtgtgtcttggcttcggagcattcagcaggtgttacagacccaggacccgcctgccacaatggagctggccgtggctgtcctgagggacctcctccgatatgcagcccagctgcctgcactgttccgggacatctccatgaaccacctccctggccttctcacctccctgctgggcctcaggccagaggtgagatgtctccctggacccttccccatggccccccgcagtcctcaccttcacacactgtttaattgtttgatggaagtgattgggga

SEQ ID NO: 278997 - DNA, 3320 bp, Homo sapiens
acgccaccactggaacccgggggaagatggcggcagccgttctgagtgggccctctgcgggctccgcggctggggttcctggcgggaccgggggtctctcggcagtgagctcgggcccgcggctccgcctgctgctgctggagagtgtttctggtttgctgcaacctcgaacggggtctgccgttgctccggtgcatcccccaaaccgctcggccccacatttgcccgggctcatgtgcctattgcggctgcatgggtcggtgggcggggcccagaacctttcagctcttggggcattggtgagtctcagtaatgcacgtctcagttccatcaaaactcggtttgagggcctgtgtctgctgtccctgctggtaggggagagccccacagagctattccagcagcactgtgtgtcttggcttcggagcattcagcaggtgttacagacccaggacccgcctgccacaatggagctggccgtggctgtcctgagggacctcctccgatatgcagcccagctgcctgcactgttccgggacatctccatgaaccacctccctggccttctcacctccctgctgggcctcaggccagagtgtgagcagtcagcattggaaggaatgaaggcttgtatgacctatttccctcgggcttgtggttctctcaaaggcaagctggcctcattttttctgtctagggtggatgccttgagccctcagctccaacagctcctgtgcagaatgaaggccctggggtggagatgctgctgtcctcagaagatggtgatgcccatgtccttctccagcttcggcagaggttttcgggactggcccgctgcctagggctcatgctcagctctgagtttggagctcccgtgtccgtccctgtgcaggaaatcctggatttcatctgccggaccctcagcgtcagtagcaagaatattagcttgcatggagatggtcccctgcggctgctgctgctgccctctatccaccttgaggccttggacctgctgtctgcactcatcctcgcgtgtggaagccggctcttgcgctttgggatcctgatcggccgcctgcttccccaggtcctcaattcctggagcatcggtagagattccctctctccaggccaggagaggccttacagcacggttcggaccaaggtgtatgcgatattagagctgtgggtgcaggtttgtggggcctcggcgggaatgcttcagggaggagcctctggagaggccctgctcacccacctgctcagcgacatctccccgccagctgatgcccttaagctgcgtagcccgcgggggagccctgatgggagtttgcagactgggaagcctagcgcccccaagaagctaaagctggatgtgggggaagctatggccccgccaagccaccggaaaggggatagcaatgccaacagcgacgtgtgtgcggctgcactcagaggcctcagccggaccatcctcatgtgtgggcctctcatcaaggaggagactcacaggagactgcatgacctggtcctccccctggtcatgggtgtacagcagggtgaggtcctaggcagctccccgtacacgagctcccgctgccgccgtgaactctactgcctgctgctggcgctgctgctggccccgtctcctcgctgcccacctcctcttgcctgtgccctgcaagccttctccctcggccagcgagaagatagccttgaggtctcctctttctgctcagaagcactggtgacctgtgctgctctgacccacccccgggttcctcccctgcagcccatgggccccacctgccccacacctgctccagttccccctcctgaggccccatcgcccttcagggccccaccgttccatcctccgggccccatgccctcagtgggctccatgccctcagcaggccccatgccttcagcaggccccatgccctcagcaggccctgtgccctcggcacgccctggacctcccaccacagccaaccacctaggcctttctgtcccaggcctagtgtctgtccctccccggcttcttcctggccctgagaaccaccgggcaggctcaaatgaggaccccatccttgcccctagtgggactcccccacctactatacccccagatgaaacttttggggggagagtgcccagaccagcctttgtccactatgacaaggaggaggcatctgatgtggagatctccttggaaagtgactctgatgacagcgtggtgatcgtgcccgaggggcttccccccctgccacccccaccaccctcaggtgccacaccaccccctatagcccccactgggccaccaacagcctcccctcctgtgccagcgaaggaggagcctgaagaacttcctgcagccccagggcctctcccgccacccccacctccgccgccgcctgttcctggtcctgtgacgctccctccaccccagttggtccctgaagggactcctggtgggggaggacccccagccctggaagaggatttgacagttattaatatcaacagcagtgatgaagaggaggaggaagaggaagaagaggaagaagaagaagaggaagaagaggaagaggaggaagactttgaggaagaggaagaggatgaagaggaatattttgaagaggaagaagaggaggaagaagagtttgaggaagaatttgaggaagaagaaggtgagttagaggaagaagaagaagaggaggatgaggaggaggaagaagaactggaagaggtggaagacctggagtttggcacagcaggaggggaggtagaagaaggtgcacctccacccccaaccctgcctccagctctgcctccccctgagtctcccccaaaggtgcagccagaacccgaacccgaacccgggctgcttttggaagtggaggagccagggacggaggaggagcgtggggctgacacagctcccaccctggcccctgaagcgctcccctcccagggagaggtggagagggaaggggaaagccctgcggcagggccccctccccaggagcttgttgaagaagagccctctgctcccccaaccctgttggaagaggagactgaggatgggagtgacaaggtgcagcccccaccagagacacctgcagaagaagagatggagacagagacagaggccgaagctctccaggaaaaggagcaggatgacacagctgccatgctggccgacttcatcgattgtccccctgatgatgagaagccaccacctcccacagagcctgactcctagccatcttctgcaccccactctttgtttccaataaagttatgtccttagatag

SEQ ID NO: 278998 - DNA, 3158 bp, Homo sapiens
atttacactcagttccatcaaaactcggtttgagggcctgtgtctgctgtccctgctggtaggggagagccccacagagctattccagcagcactgtgtgtcttggcttcggagcattcagcaggtgttacagacccaggacccgcctgccacaatggagctggccgtggctgtcctgagggacctcctccgatatgcagcccagctgcctgcactgttccgggacatctccatgaaccacctccctggccttctcacctccctgctgggcctcaggccagagtgtgagcagtcagcattggaaggaatgaaggcttgtatgacctatttccctcgggcttgtggttctctcaaaggcaagctggcctcattttttctgtctagggtggatgccttgagccctcagctccaacagttggcctgtgagtgttattcccggctgccctctttaggggctggcttttcccaaggcctgaagcacaccgagagctgggagcaggagctacacagtctgctggcctcactgcacaccctgctgggggccctgtacgagggagcagagactgctcctgtgcagaatgaaggccctggggtggagatgctgctgtcctcagaagatggtgatgcccatgtccttctccagcttcggcagaggttttcgggactggcccgctgcctagggctcatgctcagctctgagtttggagctcccgtgtccgtccctgtgcaggaaatcctggatttcatctgccggaccctcagcgtcagtagcaagaatattagcttgcatggagatggtcccctgcggctgctgctgctgccctctatccaccttgaggccttggacctgctgtctgcactcatcctcgcgtgtggaagccggctcttgcgctttgggatcctgatcggccgcctgcttccccaggtcctcaattcctggagcatcggtagagattccctctctccaggccaggagaggccttacagcacggttcggaccaaggtgtatgcgatattagagctgtgggtgcaggtttgtggggcctcggcgggaatgcttcagggaggagcctctggagaggccctgctcacccacctgctcagcgacatctccccgccagctgatgcccttaagctgcgtagcccgcgggggagccctgatgggagtttgcagactgggaagcctagcgcccccaagaagctaaagctggatgtgggggaagctatggccccgccaagccaccggaaaggggatagcaatgccaacagcgacgtgtgtgcggctgcactcagaggcctcagccggaccatcctcatgtgtgggcctctcatcaaggaggagactcacaggagactgcatgacctggtcctccccctggtcatgggtgtacagcagggtgaggtcctaggcagctccccgtacacgagctcccgctgccgccgtgaactctactgcctgctgctggcgctgctgctggccccgtctcctcgctgcccacctcctcttgcctgtgccctgcaagccttctccctcggccagcgagaagatagccttgaggtctcctctttctgctcagaagcactggtgacctgtgctgctctgacccacccccgggttcctcccctgcagcccatgggccccacctgccccacacctgctccagttccccctcctgaggccccatcgcccttcagggccccaccgttccatcctccgggccccatgccctcagtgggctccatgccctcagcaggccccatgccttcagcaggccccatgccctcagcaggccctgtgccctcggcacgccctggacctcccaccacagccaaccacctaggcctttctgtcccaggcctagtgtctgtccctccccggcttcttcctggccctgagaaccaccgggcaggctcaaatgaggaccccatccttgcccctagtgggactcccccacctactatacccccagatgaaacttttggggggagagtgcccagaccagcctttgtccactatgacaaggaggaggcatctgatgtggagatctccttggaaagtgactctgatgacagcgtggtgatcgtgcccgaggggcttccccccctgccacccccaccaccctcaggtgccacaccaccccctatagcccccactgggccaccaacagcctcccctcctgtgccagcgaaggaggagcctgaagaacttcctgcagccccagggcctctcccgccacccccacctccgccgccgcctgttcctggtcctgtgacgctccctccaccccagttggtccctgaagggactcctggtgggggaggacccccagccctggaagaggatttgacagttattaatatcaacagcagtgatgaagaggaggaggaagaggaagaagaggaagaagaagaagaggaagaagaggaagaggaggaagactttgaggaagaggaagaggatgaagaggaatattttgaagaggaagaagaggaggaagaagagtttgaggaagaatttgaggaagaagaaggtgagttagaggaagaagaagaagaggaggatgaggaggaggaagaagaactggaagaggtggaagacctggagtttggcacagcaggaggggaggtagaagaaggtgcacctccacccccaaccctgcctccagctctgcctccccctgagtctcccccaaaggtgcagccagaacccgaacccgaacccgggctgcttttggaagtggaggagccagggacggaggaggagcgtggggctgacacagctcccaccctggcccctgaagcgctcccctcccagggagaggtggagagggaaggggaaagccctgcggcagggccccctccccaggagcttgttgaagaagagccctctgctcccccaaccctgttggaagaggagactgaggatgggagtgacaaggtgcagcccccaccagagacacctgcagaagaagagatggagacagagacagaggccgaagctctccaggaaaaggagcaggatgacacagctgccatgctggccgacttcatcgattgtccccctgatgatgagaagccaccacctcccacagagcctgactcctagccatcttctgcaccccactctttgtttccaataaagttatgtccttagatag

SEQ ID NO: 278999 - DNA, 3430 bp, Homo sapiens
acgccaccactggaacccgggggaagatggcggcagccgttctgagtgggccctctgcgggctccgcggctggggttcctggcgggaccgggggtctctcggcagtgagctcgggcccgcggctccgcctgctgctgctggagagtgtttctggtttgctgcaacctcgaacggggtctgccgttgctccggtgcatcccccaaaccgctcggccccacatttgcccgggctcatgtgcctattgcggctgcatgggtcggtgggcggggcccagaacctttcagctcttggggcattggtttgagggcctgtgtctgctgtccctgctggtaggggagagccccacagagctattccagcagcactgtgtgtcttggcttcggagcattcagcaggtgttacagacccaggacccgcctgccacaatggagctggccgtggctgtcctgagggacctcctccgatatgcagcccagctgcctgcactgttccgggacatctccatgaaccacctccctggccttctcacctccctgctgggcctcaggccagagtgtgagcagtcagcattggaaggaatgaaggcttgtatgacctatttccctcgggcttgtggttctctcaaaggcaagctggcctcattttttctgtctagggtggatgccttgagccctcagctccaacagttggcctgtgagtgttattcccggctgccctctttaggggctggcttttcccaaggcctgaagcacaccgagagctgggagcaggagctacacagtctgctggcctcactgcacaccctgctgggggccctgtacgagggagcagagactgctcctgtgcagaatgaaggccctggggtggagatgctgctgtcctcagaagatggtgatgcccatgtccttctccagcttcggcagaggttttcgggactggcccgctgcctagggctcatgctcagctctgagtttggagctcccgtgtccgtccctgtgcaggaaatcctggatttcatctgccggaccctcagcgtcagtagcaagaatattagcttgcatggagatggtcccctgcggctgctgctgctgccctctatccaccttgaggccttggacctgctgtctgcactcatcctcgcgtgtggaagccggctcttgcgctttgggatcctgatcggccgcctgcttccccaggtcctcaattcctggagcatcggtagagattccctctctccaggccaggagaggccttacagcacggttcggaccaaggtgtatgcgatattagagctgtgggtgcaggtttgtggggcctcggcgggaatgcttcagggaggagcctctggagaggccctgctcacccacctgctcagcgacatctccccgccagctgatgcccttaagctgcgtagcccgcgggggagccctgatgggagtttgcagactgggaagcctagcgcccccaagaagctaaagctggatgtgggggaagctatggccccgccaagccaccggaaaggggatagcaatgccaacagcgacgtgtgtgcggctgcactcagaggcctcagccggaccatcctcatgtgtgggcctctcatcaaggaggagactcacaggagactgcatgacctggtcctccccctggtcatgggtgtacagcagggtgaggtcctaggcagctccccgtacacgagctcccgctgccgccgtgaactctactgcctgctgctggcgctgctgctggccccgtctcctcgctgcccacctcctcttgcctgtgccctgcaagccttctccctcggccagcgagaagatagccttgaggtctcctctttctgctcagaagcactggtgacctgtgctgctctgacccacccccgggttcctcccctgcagcccatgggccccacctgccccacacctgctccagttccccctcctgaggccccatcgcccttcagggccccaccgttccatcctccgggccccatgccctcagtgggctccatgccctcagcaggccccatgccttcagcaggccccatgccctcagcaggccctgtgccctcggcacgccctggacctcccaccacagccaaccacctaggcctttctgtcccaggcctagtgtctgtccctccccggcttcttcctggccctgagaaccaccgggcaggctcaaatgaggaccccatccttgcccctagtgggactcccccacctactatacccccagatgaaacttttggggggagagtgcccagaccagcctttgtccactatgacaaggaggaggcatctgatgtggagatctccttggaaagtgactctgatgacagcgtggtgatcgtgcccgaggggcttccccccctgccacccccaccaccctcaggtgccacaccaccccctatagcccccactgggccaccaacagcctcccctcctgtgccagcgaaggaggagcctgaagaacttcctgcagccccagggcctctcccgccacccccacctccgccgccgcctgttcctggtcctgtgacgctccctccaccccagttggtccctgaagggactcctggtgggggaggacccccagccctggaagaggatttgacagttattaatatcaacagcagtgatgaagaggaggaggaagaggaagaagaggaagaagaagaagaggaagaagaggaagaggaggaagactttgaggaagaggaagaggatgaagaggaatattttgaagaggaagaagaggaggaagaagagtttgaggaagaatttgaggaagaagaaggtgagttagaggaagaagaagaagaggaggatgaggaggaggaagaagaactggaagaggtggaagacctggagtttggcacagcaggaggggaggtagaagaaggtgcacctccacccccaaccctgcctccagctctgcctccccctgagtctcccccaaaggtgcagccagaacccgaacccgaacccgggctgcttttggaagtggaggagccagggacggaggaggagcgtggggctgacacagctcccaccctggcccctgaagcgctcccctcccagggagaggtggagagggaaggggaaagccctgcggcagggccccctccccaggagcttgttgaagaagagccctctgctcccccaaccctgttggaagaggagactgaggatgggagtgacaaggtgcagcccccaccagagacacctgcagaagaagagatggagacagagacagaggccgaagctctccaggaaaaggagcaggatgacacagctgccatgctggccgacttcatcgattgtccccctgatgatgagaagccaccacctcccacagagcctgactcctagccatcttctgcaccccactctttgtttccaataaagttatgtccttagatag

SEQ ID NO: 279000 - DNA, 4331 bp, Homo sapiens
  misc_feature (3513)..(3513): n is a, c, g, or t
  misc_feature (3517)..(3517): n is a, c, g, or t
  misc_feature (3529)..(3529): n is a, c, g, or t
acgccaccactggaacccgggggaagatggcggcagccgttctgagtgggccctctgcgggctccgcggctggggttcctggcgggaccgggggtctctcggcagtgagctcgggcccgcggctccgcctgctgctgctggagagtgtttctggtttgctgcaacctcgaacggggtctgccgttgctccggtgcatcccccaaaccgctcggccccacatttgcccgggctcatgtgcctattgcggctgcatgggtcggtgggcggggcccagaacctttcagctcttggggcattggtgagtctcagtaatgcacgtctcagttccatcaaaactcggtttgagggcctgtgtctgctgtccctgctggtaggggagagccccacagagctattccagcagcactgtgtgtcttggcttcggagcattcagcaggtgttacagacccaggacccgcctgccacaatggagctggccgtggctgtcctgagggacctcctccgatatgcagcccagctgcctgcactgttccgggacatctccatgaaccacctccctggccttctcacctccctgctgggcctcaggccagagtgtgagcagtcagcattggaaggaatgaaggcttgtatgacctatttccctcgggcttgtggttctctcaaaggcaagctggcctcattttttctgtctagggtggatgccttgagccctcagctccaacagttggcctgtgagtgttattcccggctgccctctttaggggctggcttttcccaaggcctgaagcacaccgagagctgggagcaggagctacacagtctgctggcctcactgcacaccctgctgggggccctgtacgagggagcagagactgctcctgtgcagaatgaaggccctggggtggagatgctgctgtcctcagaagatggtgatgcccatgtccttctccagcttcggcagaggttttcgggactggcccgctgcctagggctcatgctcagctctgagtttggagctcccgtgtccgtccctgtgcaggaaatcctggatttcatctgccggaccctcagcgtcagtagcaagaatattagcttgcatggagatggtcccctgcggctgctgctgctgccctctatccaccttgaggccttggacctgctgtctgcactcatcctcgcgtgtggaagccggctcttgcgctttgggatcctgatcggccgcctgcttccccaggtcctcaattcctggagcatcggtagagattccctctctccaggccaggagaggccttacagcacggttcggaccaaggtgtatgcgatattagagctgtgggtgcaggtttgtggggcctcggcgggaatgcttcagggaggagcctctggagaggccctgctcacccacctgctcagcgacatctccccgccagctgatgcccttaagctgcgtagcccgcgggggagccctgatgggagtttgcagactgggaagcctagcgcccccaagaagctaaagctggatgtgggggaagctatggccccgccaagccaccggaaaggggatagcaatgccaacagcgacgtgtgtgcggctgcactcagaggcctcagccggaccatcctcatgtgtgggcctctcatcaaggaggagactcacaggagactgcatgacctggtcctccccctggtcatgggtgtacagcagggtgaggtcctaggcagctccccgtacacgagctcccgctgccgccgtgaactctactgcctgctgctggcgctgctgctggccccgtctcctcgctgcccacctcctcttgcctgtgccctgcaagccttctccctcggccagcgagaagatagccttgaggtctcctctttctgctcagaagcactggtgacctgtgctgctctgacccacccccgggttcctcccctgcagcccatgggccccacctgccccacacctgctccagttccccctcctgaggccccatcgcccttcagggccccaccgttccatcctccgggccccatgccctcagtgggctccatgccctcagcaggccccatgccttcagcaggccccatgccctcagcaggccctgtgccctcggcacgccctggacctcccaccacagccaaccacctaggcctttctgtcccaggcctagtgtctgtccctccccggcttcttcctggccctgagaaccaccgggcaggctcaaatgaggaccccatccttgcccctagtgggactcccccacctactatacccccagatgaaacttttggggggagagtgcccagaccagcctttgtccactatgacaaggaggaggcatctgatgtggagatctccttggaaagtgactctgatgacagcgtggtgatcgtgcccgaggggcttccccccctgccacccccaccaccctcaggtgccacaccaccccctatagcccccactgggccaccaacagcctcccctcctgtgccagcgaaggaggagcctgaagaacttcctgcagccccagggcctctcccgccacccccacctccgccgccgcctgttcctggtcctgtgacgctccctccaccccagttggtccctgaagggactcctggtgggggaggacccccagccctggaagaggatttgacagttattaatatcaacagcagtgatgaagaggaggaggaagaggaagaagaggaagaagaagaagaggaagaagaggaagaggaggaagactttgaggaagaggaagaggatgaagaggaatattttgaagaggaagaagaggaggaagaagagtttgaggaagaatttgaggaagaagaaggtgagttagaggaagaagaagaagaggaggatgaggaggaggaagaagaactggaagaggtggaagacctggagtttggcacagcaggaggggaggtagaagaaggtgcacctccacccccaaccctgcctccagctctgcctccccctgagtctcccccaaaggtgcagccagaacccgaacccgaacccgggctgcttttggaagtggaggagccagggacggaggaggagcgtggggctgacacagctcccaccctggcccctgaagcgctcccctcccagggagaggtggagagggaaggggaaagccctgcggcagggccccctccccaggagcttgttgaagaagagccctctgctcccccaaccctgttggaagaggagactgaggatgggagtgacaaggtgcagcccccaccagagacacctgcagaagaagagatggagacagagacagaggccgaagctctccaggaaaaggagcaggatgacacagctgccatgctggccgacttcatcgattgtccccctgatgatgagaagccaccacctcccacagagcctgactcctagccatcttctgcaccccactctttgtttccaataaagttatgtccttagatagaagaaaaaaaaaaaaaaaaaaaaaaaacacacaaaaaaaaanaaanaaaaaaaaaagngggggggggccaaaaattcccccggggggagcgccagaaatttagtccgacgtcacacccagtgttttttctggtaacaaaaggggcgccccccataaggaggagcgcgcgtatataataaacgcactaaggagacgagaggacggggcgatattaacacaagcggctggtagaagcgggacaacacgggaagcatggaagcaactattcgggagagagcagagccgccttacatcagcgggggaggggaggagacacaacttattgtgggggcacaaccctctcccctccacagaggagtaattatacagacacccccagaggggagagaaattataaaaaatcttttaaaacggcgggtgacttaccaaggggggttatacacccatacagcgagaatataaccagcccgcgtcgcgaagaagaaaaaatggttggggatcaagcagggagatatcgtgtactcagggcgacaacagtatttttcaccccccgggagcagcgcctgccgttctacaacccaccctagcacaagaggagggagaaacatgaaagaagaacgccaccgagcagaagaaacgaacgaggcagcaacgcacgaggagggacaggacaacgaggaccggagaggataccaaggaatgaggggcaaggaaggaggagaggagcagggaacgagaacagaaaaagagtcagaagaagagacacaaaaaaagacaagcgaaaggaagaaaagagaacggagagaagagcgagacccaaaactccaccgacacacgaatgcacacgaaccacaaaggaa

SEQ ID NO: 279001 - DNA, 3630 bp, Homo sapiens
acgccaccactggaacccgggggaagatggcggcagccgttctgagtgggccctctgcgggctccgcggctggggttcctggcgggaccgggggtctctcggcagtgagctcgggcccgcggctccgcctgctgctgctggagagtgtttctggtttgctgcaacctcgaacggggtctgccgttgctccggtgcatcccccaaaccgctcggccccacatttgcccgggctcatgtgcctattgcggctgcatgggtcggtgggcggggcccagaacctttcagctcttggggcattggtgagtctcagtaatgcacgtctcagttccatcaaaactcggtttgagggcctgtgtctgctgtccctgctggtaggggagagccccacagagctattccagcagcactgtgtgtcttggcttcggagcattcagcaggtgttacagacccaggacccgcctgccacaatggagctggccgtggctgtcctgagggacctcctccgatatgcagcccagctgcctgcactgttccgggacatctccatgaaccacctccctggccttctcacctccctgctgggcctcaggccagagtgtgagcagtcagcattggaaggaatgaaggcttgtatgacctatttccctcgggcttgtggttctctcaaaggcaagctggcctcattttttctgtctagggtggatgccttgagccctcagctccaacagttggcctgtgagtgttattcccggctgccctctttaggggctggcttttcccaaggcctgaagcacaccgagagctgggagcaggagctacacagtctgctggcctcactgcacaccctgctgggggccctgtacgagggagcagagactgctcctgtgcagaatgaaggccctggggtggagatgctgctgtcctcagaagatggtgatgcccatgtccttctccagcttcggcagaggttttcgggactggcccgctgcctagggctcatgctcagctctgagtttggagctcccgtgtccgtccctgtgcaggaaatcctggatttcatctgccggaccctcagcgtcagtagcaagaatattagcttgcatggagatggtcccctgcggctgctgctgctgccctctatccaccttgaggccttggacctgctgtctgcactcatcctcgcgtgtggaagccggctcttgcgctttgggatcctgatcggccgcctgcttccccaggtcctcaattcctggagcatcggtagagattccctctctccaggccaggagaggccttacagcacggttcggaccaaggtgtatgcgatattagagctgtgggtgcaggtttgtggggcctcggcgggaatgcttcagggaggagcctctggagaggccctgctcacccacctgctcagcgacatctccccgccagctgatgcccttaagctgcgtagcccgcgggggagccctgatgggagtttgcagactgggaagcctagcgcccccaagaagctaaagctggatgtgggggaagctatggccccgccaagccaccggaaaggggatagcaatgccaacagcgacgtgtgtgcggctgcactcagaggcctcagccggaccatcctcatgtgtgggcctctcatcaaggaggagactcacaggagactgcatgacctggtcctccccctggtcatgggtgtacagcagggtgaggtcctaggcagctccccgtacacgagctcccgctgccgccgtgaactctactgcctgctgctggcgctgctgctggccccgtctcctcgctgcccacctcctcttgcctgtgccctgcaagccttctccctcggccagcgagaagatagccttgaggtctcctctttctgctcagaagcactggtgacctgtgctgctctgacccacccccgggttcctcccctgcagcccatgggccccacctgccccacacctgctccagttccccctcctgaggccccatcgcccttcagggccccaccgttccatcctccgggccccatgccctcagtgggctccatgccctcagcaggccccatgccttcagcaggccccatgccctcagcaggccctgtgccctcggcacgccctggacctcccaccacagccaaccacctaggcctttctgtcccaggcctagtgtctgtccctccccggcttcttcctggccctgagaaccaccgggcaggctcaaatgaggaccccatccttgcccctagtgggactcccccacctactatacccccagatgaaacttttggggggagagtgcccagaccagcctttgtccactatgacaaggaggaggcatctgatgtggagatctccttggaaagtgactctgatgacagcgtggtgatcgtgcccgaggggcttccccccctgccacccccaccaccctcaggtgccacaccaccccctatagcccccactgggccaccaacagcctcccctcctgtgccagcgaaggaggagcctgaagaacttcctgcagccccagggcctctcccgccacccccacctccgccgccgcctgttcctggtcctgtgacgctccctccaccccagttggtccctgaagggactcctggtgggggaggacccccagccctggaagaggatttgacagttattaatatcaacagcagtgatgaagaggaggaggaagaggaagaagaggaagaagaagaagaggaagaagaggaagaggaggaagactttgaggaagaggaagaggatgaagaggaatattttgaagaggaagaagaggaggaagaagagtttgaggaagaatttgaggaagaagaaggtgagttagaggaagaagaagaagaggaggatgaggaggaggaagaagaactggaagaggtggaagacctggagtttggcacagcaggaggggaggtagaagaaggtgcacctccacccccaaccctgcctccagctctgcctccccctgagtctcccccaaaggtgcagccagaacccgaacccgaacccgggctgcttttggaagtggaggagccagggacggaggaggagcgtggggctgacacagctcccaccctggcccctgaagcgctcccctcccagggagaggtggagagggaaggggaaagccctgcggcagggccccctccccaggagcttgttgaagaagagccctctgctcccccaaccctgttggaagaggagactgaggatgggagtgacaaggtgcagcccccaccagagacacctgcagaagaagagatggagacagagacagaggccgaagctctccaggaaaaggtgagaggccaggcagggaaggttccttgggcgagaaggtggggctggcgggagaaggggtggcagctgcttctcttaggagaggtttgcccagcctgaaccattcttctgtgtatgtgtgtgtgactattctgaatcttgtatctttgtgcctaaaaggagcaggatgacacagctgccatgctggccgacttcatcgattgtccccctgatgatgagaagccaccacctcccacagagcctgactcctagccatcttctgcaccccactctttgtttccaataaagttatgtccttagatag

SEQ ID NO: 279002 - DNA, 2982 bp, Homo sapiens
acgccaccactggaacccgggggaagatggcggcagccgttctgagtgggccctctgcgggctccgcggctggggttcctggcgggaccgggggtctctcggcagtgagctcgggcccgcggctccgcctgctgctgctggagagtgtttctggtttgctgcaacctcgaacggggtctgccgttgctccggtgcatcccccaaaccgctcggccccacatttgcccgggctcatgtgcctattgcggctgcatgggtcggtgggcggggcccagaacctttcagctcttggggcattggtgagtctcagtaatgcacgtctcagttccatcaaaactcggtttgagggcctgtgtctgctgtccctgctggtaggggagagccccacagagctattccagcagcactgtgtgtcttggcttcggagcattcagcaggtgttacagacccaggacccgcctgccacaatggagctggccgtggctgtcctgagggacctcctccgatatgcagcccagctgcctgcactgttccgggacatctccatgaaccacctccctggccttctcacctccctgctgggcctcaggccagagtgtgagcagtcagcattggaaggaatgaaggcttgtatgacctatttccctcgggcttgtggttctctcaaaggcaagctggcctcattttttctgtctagggtggatgccttgagccctcagctccaacagttggcctgtgagtgttattcccggctgccctctttaggggctggcttttcccaaggcctgaagcacaccgagagctgggagcaggagctacacagtctgctggcctcactgcacaccctgctgggggccctgtacgagggagcagagactgctcctgtgcagaatgaaggccctggggtggagatgctgctgtcctcagaagatggtgatgcccatgtccttctccagcttcggcagaggttttcgggactggcccgctgcctagggctcatgctcagctctgagtttggagctcccgtgtccgtccctgtgcaggaaatcctggatttcatctgccggaccctcagcgtcagtagcaagaatattagcttgcatggagatggtcccctgcggctgctgctgctgccctctatccaccttgaggccttggacctgctgtctgcactcatcctcgcgtgtggaagccggctcttgcgctttgggatcctgatcggccgcctgcttccccaggtcctcaattcctggagcatcggtagagattccctctctccaggccaggagaggccttacagcacggttcggaccaaggtgtatgcgatattagagctgtgggtgcaggtttgtggggcctcggcgggaatgcttcagggaggagcctctggagaggccctgctcacccacctgctcagcgacatctccccgccagctgatgcccttaagctgcgtagcccgcgggggagccctgatgggagtttgcagactgggaagcctagcgcccccaagaagctaaagctggatgtgggggaagctatggccccgccaagccaccggaaaggggatagcaatgccaacagcgacgtgtgtgcggctgcactcagaggcctcagccggaccatcctcatgtgtgggcctctcatcaaggaggagactcacaggagactgcatgacctggtcctccccctggtcatgggtgtacagcagggtgaggtcctaggcagctccccgtacacgagctcccgctgccgccgtgaactctactgcctgctgctggcgctgctgctggccccgtctcctcgctgcccacctcctcttgcctgtgccctgcaagccttctccctcggccagcgagaagatagccttgaggtctcctctttctgctcagaagcactggtgacctgtgctgctctgacccacccccgggttcctcccctgcagcccatgggccccacctgccccacacctgctccagttccccctcctgaggccccatcgcccttcagggccccaccgttccatcctccgggccccatgccctcagtgggctccatgccctcagcaggccccatgccttcagcaggccccatgccctcagcaggccctgtgccctcggcacgccctggacctcccaccacagccaaccacctaggcctttctgtcccaggcctagtgtctgtccctccccggcttcttcctggccctgagaaccaccgggcaggctcaaatgaggaccccatccttgcccctagtgggactcccccacctactatacccccagatgaaacttttggggggagagtgcccagaccagcctttgtccactatgacaaggaggaggcatctgatgtggagatctccttggaaagtgactctgatgacagcgtggtgatcgtgcccgaggggcttccccccctgccacccccaccaccctcaggtgccacaccaccccctatagcccccactgggccaccaacagcctcccctcctgtgccagcgaaggaggagcctgaagaacttcctgcagccccagggcctctcccgccacccccacctccgccgccgcctgttcctggtcctgtgacgctccctccaccccagttggtccctgaagggactcctggtgggggaggacccccagccctggaagaggatttgacagttattaatatcaacagcagtgatgaagaggaggaggaagaggaagaagaggaagaagaagaagaggaagaagaggaagaggaggaagactttgaggaagaggaagaggatgaagaggaatattttgaagaggagatggagacagagacagaggccgaagctctccaggaaaaggagcaggatgacacagctgccatgctggccgacttcatcgattgtccccctgatgatgagaagccaccacctcccacagagcctgactcctagccatcttctgcaccccactctttgtttccaataaagttatgtccttagatag

SEQ ID NO: 279003 - DNA, 1901 bp, Homo sapiens
gcgtttctagaggatcccttcgatgtgggactcagatggcctcagccggaccatcctcatgtgtgggcctctcatcaaggaggagactcacaggagactgcatgacctggtcctccccctggtcatgggtgtacagcagggtgaggtcctaggcagctccccgtacacgagctcccgctgccgccgtgaactctactgcctgctgctggcgctgctgctggccccgtctcctcgctgcccacctcctcttgcctgtgccctgcaagccttctccctcggccagcgagaagatagccttgaggtctcctctttctgctcagaagcactggtgacctgtgctgctctgacccacccccgggttcctcccctgcagcccatgggccccacctgccccacacctgctccagttccccctcctgaggccccatcgcccttcagggccccaccgttccatcctccgggccccatgccctcagtgggctccatgccctcagcaggccccatgccttcagcaggccccatgccctcagcaggccctgtgccctcggcacgccctggacctcccaccacagccaaccacctaggcctttctgtcccaggcctagtgtctgtccctccccggcttcttcctggccctgagaaccaccgggcaggctcaaatgaggaccccatccttgcccctagtgggactcccccacctactatacccccagatgaaacttttggggggagagtgcccagaccagcctttgtccactatgacaaggaggaggcatctgatgtggagatctccttggaaagtgactctgatgacagcgtggtgatcgtgcccgaggggcttccccccctgccacccccaccaccctcaggtgccacaccaccccctatagcccccactgggccaccaacagcctcccctcctgtgccagcgaaggaggagcctgaagaacttcctgcagccccagggcctctcccgccacccccacctccgccgccgcctgttcctggtcctgtgacgctccctccaccccagttggtccctgaagggactcctggtgggggaggacccccagccctggaagaggatttgacagttattaatatcaacagcagtgatgaagaggaggaggaagaggaagaagaggaagaagaagaagaggaagaagaggaagaggaggaagactttgaggaagaggaagaggatgaagaggaatattttgaagaggaagaagaggaggaagaagagtttgaggaagaatttgaggaagaagaaggtgagttagaggaagaagaagaagaggaggatgaggaggaggaagaagaactggaagaggtggaagacctggagtttggcacagcaggaggggaggtagaagaaggtgcacctccacccccaaccctgcctccagctctgcctccccctgagtctcccccaaaggtgcagccagaacccgaacccgaacccgggctgcttttggaagtggaggagccagggacggaggaggagcgtggggctgacacagctcccaccctggcccctgaagcgctcccctcccagggagaggtggagagggaaggggaaagccctgcggcagggccccctccccaggagcttgttgaagaagagccctctgctcccccaaccctgttggaagaggagactgaggatgggagtgacaaggtgcagcccccaccagagacacctgcagaagaagagatggagacagagacagaggccgaagctctccaggaaaaggagcaggatgacacagctgccatgctggccgacttcatcgattgtccccctgatgatgagaagccaccacctcccacagagcctgactcctagccatcttctgcaccccactctttgtttccaataaagttatgtccttagatag

SEQ ID NO: 279004 - DNA, 1333 bp, Homo sapiens
  misc_feature (112)..(112): n is a, c, g, or t
caaggtaggaggccttggttgccgaattccgcacgaggatgaagaggaatattttgaagaggaagaagaggagaagaagagtttgaggaagaacttcctgcagccccagggnctctcccgcctcccccacctactatacccccagatgaaacttttggggggagagtgcccagaccagcctttgtccactatgacaaggaggaggcatctgatgtggagatctccttggaaagtgactctgatgacagcgtggtgatcgtgcccgaggggcttccccccctgccacccccaccaccctcaggtgccacaccaccccctatagcccccactgggccaccaacagcctcccctcctgtgccagcgaaggaggagcctgaagaacttcctgcagccccagggcctctcccgccacccccacctccgccgccgcctgttcctggtcctgtgacgctccctccaccccagttggtccctgaagggactcctggtgggggaggacccccagccctggaagaggatttgacagttattaatatcaacagcagtgatgaagaggaggaggaagaggaagaagaggaagaagaagaagaggaagaagaggaagaggaggaagactttgaggaagaggaagaggatgaagaggaatattttgaagaggaagaagaggaggaagaagagtttgaggaagaatttgaggaagaagaaggtgagttagaggaagaagaagaagaggaggatgaggaggaggaagaagaactggaagaggtggaagacctggagtttggcacagcaggaggggaggtagaagaaggtgcacctccacccccaaccctgcctccagctctgcctccccctgagtctcccccaaaggtgcagccagaacccgaacccgaacccgggctgcttttggaagtggaggagccagggacggaggaggagcgtggggctgacacagctcccaccctggcccctgaagcgctcccctcccagggagaggtggagagggaaggggaaagccctgcggcagggccccctccccaggagcttgttgaagaagagccctctgctcccccaaccctgttggaagaggagactgaggatgggagtgacaaggtgcagcccccaccagagacacctgcagaagaagagatggagacagagacagaggccgaagctctccaggaaaaggagcaggatgacacagctgccatgctggccgacttcatcgattgtccccctgatgatgagaagccaccacctcccacagagcctgactcctagccatcttctgcaccccactctttgtttccaataaagttatgtccttagatag

SEQ ID NO: 279005 - DNA, 2146 bp, Homo sapiens
acgccaccactggaacccgggggaagatggcggcagccgttctgagtgggccctctgcgggctccgcggctggggttcctggcgggaccgggggtctctcggcagtgagctcgggcccgcggctccgcctgctgctgctggagagtgtttctggtttgctgcaacctcgaacggggtctgccgttgctccggtgcatcccccaaaccgctcggccccacatttgcccgggctcatgtgcctattgcggctgcatgggtcggtgggcggggcccagaacctttcagctcttggggcattggtgagtctcagtaatgcacgtctcagttccatcaaaactcggtttgagggcctgtgtctgctgtccctgctggtaggggagagccccacagagctattccagcagcactgtgtgtcttggcttcggagcattcagcaggtgttacagacccaggacccgcctgccacaatggagctggccgtggctgtcctgagggacctcctccgatatgcagcccagctgcctgcactgttccgggacatctccatgaaccacctccctggccttctcacctccctgctgggcctcaggccagagtgtgagcagtcagcattggaaggaatgaaggcttgtatgacctatttccctcgggcttgtggttctctcaaaggcaagctggcctcattttttctgtctagggtggatgccttgagccctcagctccaacagttggcctgtgagtgttattcccggctgccctctttaggggctggcttttcccaaggcctgaagcacaccgagagctgggagcaggagctacacagtctgctggcctcactgcacaccctgctgggggccctgtacgagggagcagagactgctcctgtgcagaatgaaggccctggggtggagatgctgctgtcctcagaagatggtgatgcccatgtccttctccagcttcggcagaggttttcgggactggcccgctgcctagggctcatgctcagctctgagtttggagctcccgtgtccgtccctgtgcaggaaatcctggatttcatctgccggaccctcagcgtcagtagcaagaatattagcttgcatggagatggtcccctgcggctgctgctgctgccctctatccaccttgaggccttggacctgctgtctgcactcatcctcgcgtgtggaagccggctcttgcgctttgggatcctgatcggccgcctgcttccccaggtcctcaattcctggagcatcggtagagattccctctctccaggccaggagaggccttacagcacggttcggaccaaggtgtatgcgatattagagctgtgggtgcaggtttgtggggcctcggcgggaatgcttcagggaggagcctctggagaggccctgctcacccacctgctcagcgacatctccccgccagctgatgcccttaagctgcgtagcccgcgggggagccctgatgggagtttgcagactgggaagcctagcgcccccaagaagctaaagctggatgtgggggaagctatggccccgccaagccaccggaaaggggatagcaatgccaacagcgacgtgtgtgcggctgcactcagaggcctcagccggaccatcctcatgtgtgggcctctcatcaaggaggagactcacaggagactgcatgacctggtcctccccctggtcatgggtgtacagcagggtgaggtcctaggcagctccccgtacacgagctcccgctgccgccgtgaactctactgcctgctgctggcgctgctgctggccccgtctcctcgctgcccacctcctcttgcctgtgccctgcaagccttctccctcggccagcgagaagatagccttgaggtctcctctttctgctcagaagcaggaagaggagactgaggatgggagtgacaaggtgcagcccccaccagagacacctgcagaagaagagatggagacagagacagaggccgaagctctccaggaaaaggagcaggatgacacagctgccatgctggccgacttcatcgattgtccccctgatgatgagaagccaccacctcccacagagcctgactcctagccatcttctgcaccccactctttgtttccaataaagttatgtccttagatag

SEQ ID NO: 279006 - DNA, 1616 bp, Homo sapiens
acgccaccactggaacccgggggaagatggcggcagccgttctgagtgggccctctgcgggctccgcggctggggttcctggcgggaccgggggtctctcggcagtgagctcgggcccgcggctccgcctgctgctgctggagagtgtttctggtttgctgcaacctcgaacggggtctgccgttgctccggtgcatcccccaaaccgctcggccccacatttgcccgggctcatgtgcctattgcggctgcatgggtcggtgggcggggcccagaacctttcagctcttggggcattggtgagtctcagtaatgcacgtctcagttccatcaaaactcggtttgagggcctgtgtctgctgtccctgctggtaggggagagccccacagagctattccagcagcactgtgtgtcttggcttcggagcattcagcaggtgttacagacccaggacccgcctgccacaatggagctggccgtggctgtcctgagggacctcctccgatatgcagcccagctgcctgcactgttccgggacatctccatgaaccacctccctggccttctcacctccctgctgggcctcaggccagagtgtgagcagtcagcattggaaggaatgaaggcttgtatgacctatttccctcgggcttgtggttctctcaaaggcaagctggcctcattttttctgtctagggtggatgccttgagccctcagctccaacagttggcctgtgagtgttattcccggctgccctctttaggggctggcttttcccaaggcctgaagcacaccgagagctgggagcaggagctacacagtctgctggcctcactgcacaccctgctgggggccctgtacgagggagcagagactgctcctgtgcagaatgaaggccctggggtggagatgctgctgtcctcagaagatggtgatgcccatgtccttctccagcttcggcagaggttttcgggactggcccgctgcctagggctcatgctcagctctgagtttggagctcccgtgtccgtccctgtgcaggaaatcctggatttcatctgccggaccctcagcgtcagtagcaagaatattagcttgcatggagatggtcccctgcggctgctgctgctgccctctatccaccttgaggccttggacctgctgtctgcactcatcctcgcgtgtggaagccggctcttgcgctttgggatcctgatcggccgcctgcttccccaggtcctcaattcctggagcatcggtagagattccctctctccaggccaggagaggccttacagcacggttcggaccaaggtgtatgcgatattagagctgtgggtgcaggtttgtggggcctcggcgggaatgcttcagggaggagcctctggagaggccctgctcacccaccagagacacctgcagaagaagagatggagacagagacagaggccgaagctctccaggaaaaggagcaggatgacacagctgccatgctggccgacttcatcgattgtccccctgatgatgagaagccaccacctcccacagagcctgactcctagccatcttctgcaccccactctttgtttccaataaagttatgtccttagatag

SEQ ID NO: 279007 - DNA, 325 bp, Homo sapiens
agtgattggggaataggattgaagaagtgagaagagggaggggccaagaaaaagtgatttctggagaagggcccttgtggggtgctgggggagatggaatatggtgacatggtgctcgcagcctctcgtttctccctttgtttttcctacagtgtgagcagtcagcattggaaggaatgaaggcttgtatgacctatttccctcgggcttgtggttctctcaaagtaagtatttatgcactcttctccccaccagtgtaagcgttgagagctcttacctcagattcctgtcctgagattcctaagcacctatcttctgattatcc

SEQ ID NO: 279008 - DNA, 378 bp, Homo sapiens
tgaggaaaggccgagaaacagcctttcccacaggaaaaaaggggaaaagctcaaggcttctagtgggatggccttttggcctcagaggagatgtgacttcagaaaggcttcataggtgctgggacagagaagggcttgaagaatcttctgcatttttaacatcccgtttgtgactcgcttccctgttttctttcctccagaacctttcagctcttggggcattggtgagtctcagtaatgcacgtctcagttccatcaaaactcggtaagtctttggcccttttttttctccaggggcgtgttcccttaggaagtgggcatatgtacatctttgctttcattgtcaccgtccccaggattcaagacctctctctattc

SEQ ID NO: 279009 - DNA, 323 bp, Homo sapiens
ggggaagggccccccccccctctctcccccaagattttaaaaaaaagccttttgtttcccccccaaccctttggaagaggagactgaggatgggagtgacaaggtgcagcccccaccagagacacctgcagaagaagagatggagacagagacagaggccgaagctctccaggaaaaggagcaggatgacacagctgccatgctggccgacttcatcgattgtccccctgatgatgagaagccaccacctcccacagagcctgactcctagccatcttctgcaccccactctttgtttccaataaagttatgtccttagatag

SEQ ID NO: 279010 - DNA, 2621 bp, Homo sapiens
acagtgtacagggtagttgtgcttctgccctcctgtgcagaatgaaggccctggggtggagatgctgctgtcctcagaagatggtgatgcccatgtccttctccagcttcggcagaggttttcgggactggcccgctgcctagggctcatgctcagctctgagtttggagctcccgtgtccgtccctgtgcaggaaatcctggatttcatctgccggaccctcagcgtcagtagcaagaatattagcttgcatggagatggtcccctgcggctgctgctgctgccctctatccaccttgaggccttggacctgctgtctgcactcatcctcgcgtgtggaagccggctcttgcgctttgggatcctgatcggccgcctgcttccccaggtcctcaattcctggagcatcggtagagattccctctctccaggccaggagaggccttacagcacggttcggaccaaggtgtatgcgatattagagctgtgggtgcaggtttgtggggcctcggcgggaatgcttcagggaggagcctctggagaggccctgctcacccacctgctcagcgacatctccccgccagctgatgcccttaagctgcgtagcccgcgggggagccctgatgggagtttgcagactgggaagcctagcgcccccaagaagctaaagctggatgtgggggaagctatggccccgccaagccaccggaaaggggatagcaatgccaacagcgacgtgtgtgcggctgcactcagaggcctcagccggaccatcctcatgtgtgggcctctcatcaaggaggagactcacaggagactgcatgacctggtcctccccctggtcatgggtgtacagcagggtgaggtcctaggcagctccccgtacacgagctcccgctgccgccgtgaactctactgcctgctgctggcgctgctgctggccccgtctcctcgctgcccacctcctcttgcctgtgccctgcaagccttctccctcggccagcgagaagatagccttgaggtctcctctttctgctcagaagcactggtgacctgtgctgctctgacccacccccgggttcctcccctgcagcccatgggccccacctgccccacacctgctccagttccccctcctgaggccccatcgcccttcagggccccaccgttccatcctccgggccccatgccctcagtgggctccatgccctcagcaggccccatgccttcagcaggccccatgccctcagcaggccctgtgccctcggcacgccctggacctcccaccacagccaaccacctaggcctttctgtcccaggcctagtgtctgtccctccccggcttcttcctggccctgagaaccaccgggcaggctcaaatgaggaccccatccttgcccctagtgggactcccccacctactatacccccagatgaaacttttggggggagagtgcccagaccagcctttgtccactatgacaaggaggaggcatctgatgtggagatctccttggaaagtgactctgatgacagcgtggtgatcgtgcccgaggggcttccccccctgccacccccaccaccctcaggtgccacaccaccccctatagcccccactgggccaccaacagcctcccctcctgtgccagcgaaggaggagcctgaagaacttcctgcagccccagggcctctcccgccacccccacctccgccgccgcctgttcctggtcctgtgacgctccctccaccccagttggtccctgaagggactcctggtgggggaggacccccagccctggaagaggatttgacagttattaatatcaacagcagtgatgaagaggaggaggaagaggaagaagaggaagaagaagaagaggaagaagaggaagaggaggaagactttgaggaagaggaagaggatgaagaggaatattttgaagaggaagaagaggaggaagaagagtttgaggaagaatttgaggaagaagaaggtgagttagaggaagaagaagaagaggaggatgaggaggaggaagaagaactggaagaggtggaagacctggagtttggcacagcaggaggggaggtagaagaaggtgcacctccacccccaaccctgcctccagctctgcctccccctgagtctcccccaaaggtgcagccagaacccgaacccgaacccgggctgcttttggaagtggaggagccagggacggaggaggagcgtggggctgacacagctcccaccctggcccctgaagcgctcccctcccagggagaggtggagagggaaggggaaagccctgcggcagggccccctccccaggagcttgttgaagaagagccctctgctcccccaaccctgttggaagaggagactgaggatgggagtgacaaggtgcagcccccaccagagacacctgcagaagaagagatggagacagagacagaggccgaagctctccaggaaaaggagcaggatgacacagctgccatgctggccgacttcatcgattgtccccctgatgatgagaagccaccacctcccacagagcctgactcctagccatcttctgcaccccactctttgtttccaataaagttatgtccttagatag

SEQ ID NO: 279011 - DNA, 2444 bp, Homo sapiens
acgatcccgtattctatcgcggagaactgtggccttacacggcgcgtgcacgaggaggaggacgcaggctcggcagctcatcgggttctacgactgaactcaggaccccgtctcctctctgacatccgcatcgattatcccccctgcggctgctgctgctgccctctatccaccttgaggccttggacctgctgtctgcactcatcctcgcgtcctcaattcctggagcatcggtagagattccctctctccaggccaggagaggccttacagcacggttcggaccaaggtgtatgcgatattagagctgtgggtgcaggtttgtggggcctcggcgggaatgcttcagggaggagcctctggagaggccctgctcacccacctgctcagcgacatctccccgccagctgatgcccttaagctgcgtagcccgcgggggagccctgatgggagtttgcagactgggaagcctagcgcccccaagaagctaaagctggatgtgggggaagctatggccccgccaagccaccggaaaggggatagcaatgccaacagcgacgtgtgtgcggctgcactcagaggcctcagccggaccatcctcatgtgtgggcctctcatcaaggaggagactcacaggagactgcatgacctggtcctccccctggtcatgggtgtacagcagggtgaggtcctaggcagctccccgtacacgagctcccgctgccgccgtgaactctactgcctgctgctggcgctgctgctggccccgtctcctcgctgcccacctcctcttgcctgtgccctgcaagccttctccctcggccagcgagaagatagccttgaggtctcctctttctgctcagaagcactggtgacctgtgctgctctgacccacccccgggttcctcccctgcagcccatgggccccacctgccccacacctgctccagttccccctcctgaggccccatcgcccttcagggccccaccgttccatcctccgggccccatgccctcagtgggctccatgccctcagcaggccccatgccttcagcaggccccatgccctcagcaggccctgtgccctcggcacgccctggacctcccaccacagccaaccacctaggcctttctgtcccaggcctagtgtctgtccctccccggcttcttcctggccctgagaaccaccgggcaggctcaaatgaggaccccatccttgcccctagtgggactcccccacctactatacccccagatgaaacttttggggggagagtgcccagaccagcctttgtccactatgacaaggaggaggcatctgatgtggagatctccttggaaagtgactctgatgacagcgtggtgatcgtgcccgaggggcttccccccctgccacccccaccaccctcaggtgccacaccaccccctatagcccccactgggccaccaacagcctcccctcctgtgccagcgaaggaggagcctgaagaacttcctgcagccccagggcctctcccgccacccccacctccgccgccgcctgttcctggtcctgtgacgctccctccaccccagttggtccctgaagggactcctggtgggggaggacccccagccctggaagaggatttgacagttattaatatcaacagcagtgatgaagaggaggaggaagaggaagaagaggaagaagaagaagaggaagaagaggaagaggaggaagactttgaggaagaggaagaggatgaagaggaatattttgaagaggaagaagaggaggaagaagagtttgaggaagaatttgaggaagaagaaggtgagttagaggaagaagaagaagaggaggatgaggaggaggaagaagaactggaagaggtggaagacctggagtttggcacagcaggaggggaggtagaagaaggtgcacctccacccccaaccctgcctccagctctgcctccccctgagtctcccccaaaggtgcagccagaacccgaacccgaacccgggctgcttttggaagtggaggagccagggacggaggaggagcgtggggctgacacagctcccaccctggcccctgaagcgctcccctcccagggagaggtggagagggaaggggaaagccctgcggcagggccccctccccaggagcttgttgaagaagagccctctgctcccccaaccctgttggaagaggagactgaggatgggagtgacaaggtgcagcccccaccagagacacctgcagaagaagagatggagacagagacagaggccgaagctctccaggaaaaggagcaggatgacacagctgccatgctggccgacttcatcgattgtccccctgatgatgagaagccaccacctcccacagagcctgactcctagccatcttctgcaccccactctttgtttccaataaagttatgtccttagatag

SEQ ID NO: 279012 - DNA, 1893 bp, Homo sapiens
gtgggtccattccgacctgggagtaggctctggagaagggttgggtggtcttggggatgtttccaggtgtgctctgtccttttcagagactgcatgacctggtcctccccctggtcatgggtgtacagcagggtgaggtcctaggcagctccccgtacacgagctcccgctgccgccgtgaactctactgcctgctgctggcgctgctgctggccccgtctcctcgctgcccacctcctcttgcctgtgccctgcaagccttctccctcggccagcgagaagatagccttgaggtctcctctttctgctcagaagcactggtgacctgtgctgctctgacccacccccgggttcctcccctgcagcccatgggccccacctgccccacacctgctccagttccccctcctgaggccccatcgcccttcagggccccaccgttccatcctccgggccccatgccctcagtgggctccatgccctcagcaggccccatgccttcagcaggccccatgccctcagcaggccctgtgccctcggcacgccctggacctcccaccacagccaaccacctaggcctttctgtcccaggcctagtgtctgtccctccccggcttcttcctggccctgagaaccaccgggcaggctcaaatgaggaccccatccttgcccctagtgggactcccccacctactatacccccagatgaaacttttggggggagagtgcccagaccagcctttgtccactatgacaaggaggaggcatctgatgtggagatctccttggaaagtgactctgatgacagcgtggtgatcgtgcccgaggggcttccccccctgccacccccaccaccctcaggtgccacaccaccccctatagcccccactgggccaccaacagcctcccctcctgtgccagcgaaggaggagcctgaagaacttcctgcagccccagggcctctcccgccacccccacctccgccgccgcctgttcctggtcctgtgacgctccctccaccccagttggtccctgaagggactcctggtgggggaggacccccagccctggaagaggatttgacagttattaatatcaacagcagtgatgaagaggaggaggaagaggaagaagaggaagaagaagaagaggaagaagaggaagaggaggaagactttgaggaagaggaagaggatgaagaggaatattttgaagaggaagaagaggaggaagaagagtttgaggaagaatttgaggaagaagaaggtgagttagaggaagaagaagaagaggaggatgaggaggaggaagaagaactggaagaggtggaagacctggagtttggcacagcaggaggggaggtagaagaaggtgcacctccacccccaaccctgcctccagctctgcctccccctgagtctcccccaaaggtgcagccagaacccgaacccgaacccgggctgcttttggaagtggaggagccagggacggaggaggagcgtggggctgacacagctcccaccctggcccctgaagcgctcccctcccagggagaggtggagagggaaggggaaagccctgcggcagggccccctccccaggagcttgttgaagaagagccctctgctcccccaaccctgttggaagaggagactgaggatgggagtgacaaggtgcagcccccaccagagacacctgcagaagaagagatggagacagagacagaggccgaagctctccaggaaaaggagcaggatgacacagctgccatgctggccgacttcatcgattgtccccctgatgatgagaagccaccacctcccacagagcctgactcctagccatcttctgcaccccactctttgtttccaataaagttatgtccttagatag

SEQ ID NO: 279013 - DNA, 1024 bp, Homo sapiens
  misc_feature (112)..(112): n is a, c, g, or t
caaggtaggaggccttggttgccgaattccgcacgaggatgaagaggaatattttgaagaggaagaagaggagaagaagagtttgaggaagaacttcctgcagccccagggnctctcccgcctcccccacctactatacccccagatgaaacttttggggggagagtgcccagaccagcctttgtccactatgacaaggaggaggcatctgatgtggagatctccttggaaagtgactctgatgacagcgtggtgatcgtgcccgaggggcttccccccctgccacccccaccaccctcaggtgccacaccaccccctatagcccccactgggccaccaacagcctcccctcctgtgccagcgaaggaggagcctgaagaatttgaggaagaagaaggtgagttagaggaagaagaagaagaggaggatgaggaggaggaagaagaactggaagaggtggaagacctggagtttggcacagcaggaggggaggtagaagaaggtgcacctccacccccaaccctgcctccagctctgcctccccctgagtctcccccaaaggtgcagccagaacccgaacccgaacccgggctgcttttggaagtggaggagccagggacggaggaggagcgtggggctgacacagctcccaccctggcccctgaagcgctcccctcccagggagaggtggagagggaaggggaaagccctgcggcagggccccctccccaggagcttgttgaagaagagccctctgctcccccaaccctgttggaagaggagactgaggatgggagtgacaaggtgcagcccccaccagagacacctgcagaagaagagatggagacagagacagaggccgaagctctccaggaaaaggagcaggatgacacagctgccatgctggccgacttcatcgattgtccccctgatgatgagaagccaccacctcccacagagcctgactcctagccatcttctgcaccccactctttgtttccaataaagttatgtccttagatag

SEQ ID NO: 279014 - DNA, 423 bp, Homo sapiens
acgccaccactggaacccgggggaagatggcggcagccgttctgagtgggccctctgcgggctccgcggctggggttcctggcgggaccgggggtctctcggcagtgagctcgggcccgcggctccgcctgctgctgctggagagtgtttctggtttgctgcaacctcgaacggggtctgccgttgctccggtgcatcccccaaaccgctcggccccacatttgcccgggctcatgtgcctattgcggctgcatgggtcggtgggcggggcccagaacctttcagctcttggggcattggtgagtctcagtaatgcacgtctcagttccatcaaaactcggtaagtctttggcccttttttttctccaggggcgtgttcccttaggaagtgggcatatgtacatctttgctttcattgtcacc

SEQ ID NO: 279015 - DNA, 895 bp, Homo sapiens
gtgatttcatccttatgtgaaaaagggcttagtactgtgctggccatttagtaagtggttaataaactgtgctatcatttacatgatcatcgctgccagaggttgtagatccttgggatatgaatgaagctgatctcacgcatttggactacctaattagtaataaggaccaaacctaaaagagaggtagtaaatgaattgaggaggactgaggcctttccattcatcactgtggagtcctgtacattaaggctcaggtcatatggagatggctgggtctgtgaggcttaggcttaggggacctatgaggctggaccaaaaaaaatctagacattaatgcatggctagagttggaggttctgttgtagatttgctcatgtaggcatgtgactgcagattataatcacaaattgagtaataagtacaaagaggaaggaaggcaggatgtgaaatctgttggccatgttccacacagtctggagtgtatgtcagtgtgagctgaagaccagcagagactaggatggatgacggcctgtccaggggctgaatggacacaggtgtcagcagggccacctggtaaaggtatggaggtgagccatgaacaaggttacctgcttaaggggaaggttgtggcttaaatctagatgctgctgagatattagacattaggtgcccacaggctgtgtggaggtagaagggggatgtgcttctcttatttgcacaaagatgtgagttactgaggagtattattgaacagcagcatgttgggtttgagaagagacctagtagtagaaagagtagtatgtctgccactgaggaagcagggaacagaagggtgcctcaccccagggcagatggggacatggtttaggatcctagtgactaaaaaaaaaaa

SEQ ID NO: 279016 - DNA, 1155 bp, Homo sapiens
gtgatttcatccttatgtgaaaaagggcttagtactgtgctggccatttagtaagtggttaataaactgtgctatcatttacatgatcatcgctgccagaggttgtagatccttgggatatgaatgaagctgatctcacgcatttggactacctaattagtaataaggaccaaacctaaaagagaggtagtaaatgaattgaggaggactgaggcctttccattcatcactgtggagtcctgtacattaaggctcaggtcatatggagatggctgggtctgtgaggcttaggcttaggggacctatgaggctggaccaaaaaaaatctagacattaatgcatggctagagttggaggttctgttgtagatttgctcatgtaggcatgtgactgcagattataatcacaaattgagtaataagtacaaagaggaaggaaggcaggatgtgaaatctgttggccatgttccacacagtctggagtgtatgtcagtgtgagctgaagaccagcagagactaggatggatgacggcctgtccaggggctgaatggacacaggtgtcagcagggccacctggtaaaggtatggaggtgagccagccatgagagggtatcttgtggccatattcctgagtgctgtcttcctctattatgtactgcattgcatattatggggaacgaatgtctattgggtggcacctgtggaaatgaaacggagaaataagatccagccttgtttatcaaagccagcttttgcctctctgctgagtcagagctctgcatatattttaagaaaaggcattgaggaactcaatcaaaccagtattcttttcacacaggtttcatcagtttcacccttttctgtgtgcggctgattttagaaagattgcttccttgtatggtagcgataagtttgatttgccctatgggatgagaacatcagcggaatattttcgacttgctctttcaaaactgcagagttgtgatctctttgatgagtttgacaacataccctgtaaaaagtgtgtggtggttggtaatggaggagttttgaagaataagacattaggagaaaaaatcgactcctatgatgtaataataagcttaagggataataaaaaaagaaaaatgggcccggtttaagaacataagaaaa

SEQ ID NO: 279017 - DNA, 2819 bp, Homo sapiens
caagcctcagtgtttacttctgccgcctgccagccgggcggggaaggggagtacccggccacccctcactttagctcctgcagctttccaaacaaaccagggcgggatgggagtgtcttcttggctgtggaaatcgatcctcctaccttgtcctgaagccacccgccgcctttcctcgtccctcccttcgcggtgattttccggtcccggcgcccggcgagggcgcgcggctggtgtccgccccgcccgaaaggtgagccagccatgagagggtatcttgtggccatattcctgagtgctgtcttcctctattatgtactgcattgcatattatggggaacgaatgtctattgggtggcacctgtggaaatgaaacggagaaataagatccagccttgtttatcaaagccagcttttgcctctctgctgagtcagagctctgcatatattttaagaaaaggcattgaggaactcaatcaaaccagtattcttttcacacaggtttcatcagtttcacccttttctgtgtgcggctgattttagaaagattgcttccttgtatggtagcgataagtttgatttgccctatgggatgagaacatcagcggaatattttcgacttgctctttcaaaactgcagagttgtgatctctttgatgagtttgacaacataccctgtaaaaagtgtgtggtggttggtaatggaggagttttgaagaataagacattaggagaaaaaatcgactcctatgatgtaataataagaatgaataatggtcctgttttaggacatgaagaagaagttgggagaaggacaaccttccgacttttttatccagaatctgttttttcagatcctattcacaatgaccctaatacgacagtgattctcactgcttttaagccacatgatttaaggtggctgttggaattgttgatgggtgacaaaataaacactaatggtttttggaagaaaccagccttaaacctgatttataaaccttatcaaatccgaatattagatcctttcattatcagaacagcagcttatgaactgcttcattttccaaaagtgtttcccaaaaatcagaaacctaaacacccaacaacaggaattattgccatcacattggcgttttacatatgtcacgaagttcacctagctggttttaaatacaacttttctgacctcaagagtcctttgcactactatgggaatgccaccatgtctttgatgaataagaacgcgtatcacaatgtgactgcagagcagctctttttgaaggacattatagaaaaaaacctcgtaatcaacttgactcaagattgactctacagactcagaagatgatgctaacagtgttagttttatttttgtactgcaatttttagtttaaaatatgttggatgcactcgtcaaataattatgtatactgtctgttgctgcctggtgattcataaccaccagcttaatttctgtgaatactgtatatttaacttatgaaaaccaagaaatgtaaagataacaggaaaataagttttgattgcattgtttttaaaataagctagttttctgaggtgttttcacacgtctttttatagttacttcatcttagatttttgaagggatatgacttcctactaaggatttagtttaccacaacaattctgactacaataagacattttgaggaggatatttggctactgtaaacatggctggtggaaaatcacgattgtggcttgatgtggcaagccgaaaccacttggctctggaaatctaagttcatactggtttaattaagctctctcctgacaacccccagaattaaatgaaccatgattgtgaagagtaatttggtacaatgaaggcagtgtttgtttttaagttaaaggaaatgggctaaacataaagttcttattagataagtaaataactaaagaaagaatacaattactaaactctgatggctttgtattattttaaagaaatgaagtttaactttatacaatgaagctaagctaggcaagctcaagaaggaaaaaaaaatcttgaacattatttttttttgcctgacttacttattcattaaattttgaaggttttccacttgaagtaaattaggaaaggtaaagaagataacagaacaagtaaacacttaagaaaagtcaagctgaggccgggcagggtggctcacacctgtaatcctaacaaacactttgggaggccgagggaggcagctggattgcctgaactcaggagttcaagaccagcctggccaacatggtgaaacctcatctctactaaaatacaaaataattagctgggcgtggtggtatgcgctgtagtcccaggtactcgggaggctgaggcacgagaattgcttgagcccgggaggcagaggttgcagtgagccaagatcgcgccactgcacttcagcctgggtgacagagtgaggctgtcttctaaaaaatataaaaagtgaagttgggatttttggatttaaatggtacaaaaagaatatctcattttcccatgattaaagctaatcttcagatggaaagcttgcctggctacctagggtgcaccagagaatctgatccaatgcaagccagtcaatcctacaaatgtggtgagctagtcttccttcctatattttaataaatgtaaccaaaggccatctggaggtaggggaatgagaggtgaagaaacagaaaaatagaggttataaggatggaactaaaagttgtcagaagaggtatgagctgaagaaagaattactctcttttgaccaataaatacaattgggaaacactgg

SEQ ID NO: 279018 - DNA, 3182 bp, Homo sapiens
tgctggtacggtcggaattttgggatccgccgcctttcctcgtccctcccttcgcggtgattttccggtcccggcgcccggcgagggcgcgcggctggtgtccgccccgcccgaaaggtgagccagccatgagagggtatcttgtggccatattcctgagtgctgtcttcctctattatgtactgcattgcatattatggggaacgaatgtctattgggtggcacctgtggaaatgaaacggagaaataagatccagccttgtttatcaaagccagcttttgcctctctgctgagtcagagctctgcatatattttaagaaaaggcattgaggaactcaatcaaaccagtattcttttcacacaggtttcatcagtttcacccttttctgtgtgcggctgattttagaaagattgcttccttgtatggtagcgataagtttgatttgccctatgggatgagaacatcagcggaatattttcgacttgctctttcaaaactgcagagttgtgatctctttgatgagtttgacaaaatgaataatggtcctgttttaggacatgaagaagaagttgggagaaggacaaccttccgacttttttatccagaatctgttttttcagatcctattcacaatgaccctaatacgacagtgattctcactgcttttaagccacatgatttaaggtggctgttggaattgttgatgggtgacaaaataaacactaatggtttttggaagaaaccagccttaaacctgatttataaaccttatcaaatccgaatattagatcctttcattatcagaacagcagcttatgaactgcttcattttccaaaagtgtttcccaaaaatcagaaacctaaacacccaacaacaggaattattgccatcacattggcgttttacatatgtcacgaagttcacctagctggttttaaatacaacttttctgacctcaagagtcctttgcactactatgggaatgccaccatgtctttgatgaataagaacgcgtatcacaatgtgactgcagagcagctctttttgaaggacattatagaaaaaaacctcgtaatcaacttgactcaagattgactctacagactcagaagatgatgctaacagtgttagttttatttttgtactgcaatttttagtttaaaatatgttggatgcactcgtcaaataattatgtatactgtctgttgctgcctggtgattcataaccaccagcttaatttctgtgaatactgtatatttaacttatgaaaaccaagaaatgtaaagataacaggaaaataagttttgattgcattgtttttaaaataagctagttttctgaggtgttttcacacgtctttttatagttacttcatcttagatttttgaagggatatgacttcctactaaggatttagtttaccacaacaattctgactacaataagacattttgaggaggatatttggctactgtaaacatggctggtggaaaatcacgattgtggcttgatgtggcaagccgaaaccacttggctctggaaatctaagttcatactggtttaattaagctctctcctgacaacccccagaattaaatgaaccatgattgtgaagagtaatttggtacaatgaaggcagtgtttgtttttaagttaaaggaaatgggctaaacataaagttcttattagataagtaaataactaaagaaagaatacaattactaaactctgatggctttgtattattttaaagaaatgaagtttaactttatacaatgaagctaagctaggcaagctcaagaaggaaaaaaaaatcttgaacattatttttttttgcctgacttacttattcattaaattttgaaggttttccacttgaagtaaattaggaaaggtaaagaagataacagaacaagtaaacacttaagaaaagtcaagctgaggccgggcagggtggctcacacctgtaatcctaacaaacactttgggaggccgagggaggcagctggattgcctgaactcaggagttcaagaccagcctggccaacatggtgaaacctcatctctactaaaatacaaaataattagctgggcgtggtggtatgcgctgtagtcccaggtactcgggaggctgaggcacgagaattgcttgagcccgggaggcagaggttgcagtgagccaagatcgcgccactgcacttcagcctgggtgacagagtgaggctgtcttctaaaaaatataaaaagtgaagttgggatttttggatttaaatggtacaaaaagaatatctcattttcccatgattaaagctaatcttcagatggaaagcttgcctggctacctagggtgcaccagagaatctgatccaatgcaagccagtcaatcctacaaatgtggtgagctagtcttccttcctatattttaataaatgtaaccaaaggccatctggaggtaggggaatgagaggtgaagaaacagaaaaatagaggttataaggatggaactaaaagttgtcagaagaggtatgagctgaagaaagaattactctcttttgaccaataaatacaattgggaaacactggaaaaccatggcttgattactgacaaccaacctgcctctctaaagagggtgtataaagggtgaaatacattagatttggctcagaaacagaatgcggtacttataaagcagaataaaggggagaacagtagtagttgatctaacccagattagacatgaataccagcatatgtttgcagagtcccacagttttgattcttcttataactttttgaggtgcaaaaggaaggtaccagaactggaatcgcatgtaatcaatcagtgtgattttcccctcataccacacagccataggctgcagtgtggctgctgaagttcaattgatataaagtaaatcaggcttcaaaaagaatggtgctgtgggtacacaaggacataaagatgggaacgatagacactgaggactgcggcggggggagcgaggggagcggggagggcaagggctgaaagactatgtattgggtactatgctcacaacctggatgatgggatcattcataccacaaacctcagtatcacacaatatacccatgtaacaacctgcactctgcacatgtacccttagaatctaaaataaaagttgaaattattttttt

SEQ ID NO: 279019 - DNA, 3344 bp, Homo sapiens
caagcctcagtgtttacttctgccgcctgccagccgggcggggaaggggagtacccggccacccctcactttagctcctgcagctttccaaacaaaccagggcgggatgggagtgtcttcttggctgtggaaatcgatcctcctaccttgtcctgaagccacccgccgcctttcctcgtccctcccttcgcggtgattttccggtcccggcgcccggcgagggcgcgcggctggtgtccgccccgcccgaaaggtgagccagccatgagagggtatcttgtggccatattcctgagtgctgtcttcctctattatgtactgcattgcatattatggggaacgaatgtctattgggtggcacctgtggaaatgaaacggagaaataagatccagccttgtttatcaaagccagcttttgcctctctgctgaggtttcatcagtttcacccttttctgtgtgcggctgattttagaaagattgcttccttgtatggtagcgataagtttgatttgccctatgggatgagaacatcagcggaatattttcgacttgctctttcaaaactgcagagttgtgatctctttgatgagtttgacaacataccctgtaaaaagtgtgtggtggttggtaatggaggagttttgaagaataagacattaggagaaaaaatcgactcctatgatgtaataataagaatgaataatggtcctgttttaggacatgaagaagaagttgggagaaggacaaccttccgacttttttatccagaatctgttttttcagatcctattcacaatgaccctaatacgacagtgattctcactgcttttaagccacatgatttaaggtggctgttggaattgttgatgggtgacaaaataaacactaatggtttttggaagaaaccagccttaaacctgatttataaaccttatcaaatccgaatattagatcctttcattatcagaacagcagcttatgaactgcttcattttccaaaagtgtttcccaaaaatcagaaacctaaacacccaacaacaggaattattgccatcacattggcgttttacatatgtcacgaagttcacctagctggttttaaatacaacttttctgacctcaagagtcctttgcactactatgggaatgccaccatgtctttgatgaataagaacgcgtatcacaatgtgactgcagagcagctctttttgaaggacattatagaaaaaaacctcgtaatcaacttgactcaagattgactctacagactcagaagatgatgctaacagtgttagttttatttttgtactgcaatttttagtttaaaatatgttggatgcactcgtcaaataattatgtatactgtctgttgctgcctggtgattcataaccaccagcttaatttctgtgaatactgtatatttaacttatgaaaaccaagaaatgtaaagataacaggaaaataagttttgattgcattgtttttaaaataagctagttttctgaggtgttttcacacgtctttttatagttacttcatcttagatttttgaagggatatgacttcctactaaggatttagtttaccacaacaattctgactacaataagacattttgaggaggatatttggctactgtaaacatggctggtggaaaatcacgattgtggcttgatgtggcaagccgaaaccacttggctctggaaatctaagttcatactggtttaattaagctctctcctgacaacccccagaattaaatgaaccatgattgtgaagagtaatttggtacaatgaaggcagtgtttgtttttaagttaaaggaaatgggctaaacataaagttcttattagataagtaaataactaaagaaagaatacaattactaaactctgatggctttgtattattttaaagaaatgaagtttaactttatacaatgaagctaagctaggcaagctcaagaaggaaaaaaaaatcttgaacattatttttttttgcctgacttacttattcattaaattttgaaggttttccacttgaagtaaattaggaaaggtaaagaagataacagaacaagtaaacacttaagaaaagtcaagctgaggccgggcagggtggctcacacctgtaatcctaacaaacactttgggaggccgagggaggcagctggattgcctgaactcaggagttcaagaccagcctggccaacatggtgaaacctcatctctactaaaatacaaaataattagctgggcgtggtggtatgcgctgtagtcccaggtactcgggaggctgaggcacgagaattgcttgagcccgggaggcagaggttgcagtgagccaagatcgcgccactgcacttcagcctgggtgacagagtgaggctgtcttctaaaaaatataaaaagtgaagttgggatttttggatttaaatggtacaaaaagaatatctcattttcccatgattaaagctaatcttcagatggaaagcttgcctggctacctagggtgcaccagagaatctgatccaatgcaagccagtcaatcctacaaatgtggtgagctagtcttccttcctatattttaataaatgtaaccaaaggccatctggaggtaggggaatgagaggtgaagaaacagaaaaatagaggttataaggatggaactaaaagttgtcagaagaggtatgagctgaagaaagaattactctcttttgaccaataaatacaattgggaaacactggaaaaccatggcttgattactgacaaccaacctgcctctctaaagagggtgtataaagggtgaaatacattagatttggctcagaaacagaatgcggtacttataaagcagaataaaggggagaacagtagtagttgatctaacccagattagacatgaataccagcatatgtttgcagagtcccacagttttgattcttcttataactttttgaggtgcaaaaggaaggtaccagaactggaatcgcatgtaatcaatcagtgtgattttcccctcataccacacagccataggctgcagtgtggctgctgaagttcaattgatataaagtaaatcaggcttcaaaaagaatggtgctgtgggtacacaaggacataaagatgggaacgatagacactgaggactgcggcggggggagcgaggggagcggggagggcaagggctgaaagactatgtattgggtactatgctcacaacctggatgatgggatcattcataccacaaacctcagtatcacacaatatacccatgtaacaacctgcactctgcacatgtacccttagaatctaaaataaaagttgaaattattttttt

SEQ ID NO: 279020 - DNA, 3681 bp, Homo sapiens
gtgatttcatccttatgtgaaaaagggcttagtactgtgctggccatttagtaagtggttaataaactgtgctatcatttacatgatcatcgctgccagaggttgtagatccttgggatatgaatgaagctgatctcacgcatttggactacctaattagtaataaggaccaaacctaaaagagaggtagtaaatgaattgaggaggactgaggcctttccattcatcactgtggagtcctgtacattaaggctcaggtcatatggagatggctgggtctgtgaggcttaggcttaggggacctatgaggctggaccaaaaaaaatctagacattaatgcatggctagagttggaggttctgttgtagatttgctcatgtaggcatgtgactgcagattataatcacaaattgagtaataagtacaaagaggaaggaaggcaggatgtgaaatctgttggccatgttccacacagtctggagtgtatgtcagtgtgagctgaagaccagcagagactaggatggatgacggcctgtccaggggctgaatggacacaggtgtcagcagggccacctggtaaaggtatggaggtgagccagccatgagagggtatcttgtggccatattcctgagtgctgtcttcctctattatgtactgcattgcatattatggggaacgaatgtctattgggtggcacctgtggaaatgaaacggagaaataagatccagccttgtttatcaaagccagcttttgcctctctgctgaggtttcatcagtttcacccttttctgtgtgcggctgattttagaaagattgcttccttgtatggtagcgataagtttgatttgccctatgggatgagaacatcagcggaatattttcgacttgctctttcaaaactgcagagttgtgatctctttgatgagtttgacaacataccctgtaaaaagtgtgtggtggttggtaatggaggagttttgaagaataagacattaggagaaaaaatcgactcctatgatgtaataataagaatgaataatggtcctgttttaggacatgaagaagaagttgggagaaggacaaccttccgacttttttatccagaatctgttttttcagatcctattcacaatgaccctaatacgacagtgattctcactgcttttaagccacatgatttaaggtggctgttggaattgttgatgggtgacaaaataaacactaatggtttttggaagaaaccagccttaaacctgatttataaaccttatcaaatccgaatattagatcctttcattatcagaacagcagcttatgaactgcttcattttccaaaagtgtttcccaaaaatcagaaacctaaacacccaacaacaggaattattgccatcacattggcgttttacatatgtcacgaagttcacctagctggttttaaatacaacttttctgacctcaagagtcctttgcactactatgggaatgccaccatgtctttgatgaataagaacgcgtatcacaatgtgactgcagagcagctctttttgaaggacattatagaaaaaaacctcgtaatcaacttgactcaagattgactctacagactcagaagatgatgctaacagtgttagttttatttttgtactgcaatttttagtttaaaatatgttggatgcactcgtcaaataattatgtatactgtctgttgctgcctggtgattcataaccaccagcttaatttctgtgaatactgtatatttaacttatgaaaaccaagaaatgtaaagataacaggaaaataagttttgattgcattgtttttaaaataagctagttttctgaggtgttttcacacgtctttttatagttacttcatcttagatttttgaagggatatgacttcctactaaggatttagtttaccacaacaattctgactacaataagacattttgaggaggatatttggctactgtaaacatggctggtggaaaatcacgattgtggcttgatgtggcaagccgaaaccacttggctctggaaatctaagttcatactggtttaattaagctctctcctgacaacccccagaattaaatgaaccatgattgtgaagagtaatttggtacaatgaaggcagtgtttgtttttaagttaaaggaaatgggctaaacataaagttcttattagataagtaaataactaaagaaagaatacaattactaaactctgatggctttgtattattttaaagaaatgaagtttaactttatacaatgaagctaagctaggcaagctcaagaaggaaaaaaaaatcttgaacattatttttttttgcctgacttacttattcattaaattttgaaggttttccacttgaagtaaattaggaaaggtaaagaagataacagaacaagtaaacacttaagaaaagtcaagctgaggccgggcagggtggctcacacctgtaatcctaacaaacactttgggaggccgagggaggcagctggattgcctgaactcaggagttcaagaccagcctggccaacatggtgaaacctcatctctactaaaatacaaaataattagctgggcgtggtggtatgcgctgtagtcccaggtactcgggaggctgaggcacgagaattgcttgagcccgggaggcagaggttgcagtgagccaagatcgcgccactgcacttcagcctgggtgacagagtgaggctgtcttctaaaaaatataaaaagtgaagttgggatttttggatttaaatggtacaaaaagaatatctcattttcccatgattaaagctaatcttcagatggaaagcttgcctggctacctagggtgcaccagagaatctgatccaatgcaagccagtcaatcctacaaatgtggtgagctagtcttccttcctatattttaataaatgtaaccaaaggccatctggaggtaggggaatgagaggtgaagaaacagaaaaatagaggttataaggatggaactaaaagttgtcagaagaggtatgagctgaagaaagaattactctcttttgaccaataaatacaattgggaaacactggaaaaccatggcttgattactgacaaccaacctgcctctctaaagagggtgtataaagggtgaaatacattagatttggctcagaaacagaatgcggtacttataaagcagaataaaggggagaacagtagtagttgatctaacccagattagacatgaataccagcatatgtttgcagagtcccacagttttgattcttcttataactttttgaggtgcaaaaggaaggtaccagaactggaatcgcatgtaatcaatcagtgtgattttcccctcataccacacagccataggctgcagtgtggctgctgaagttcaattgatataaagtaaatcaggcttcaaaaagaatggtgctgtgggtacacaaggacataaagatgggaacgatagacactgaggactgcggcggggggagcgaggggagcggggagggcaagggctgaaagactatgtattgggtactatgctcacaacctggatgatgggatcattcataccacaaacctcagtatcacacaatatacccatgtaacaacctgcactctgcacatgtacccttagaatctaaaataaaagttgaaattattttttt

SEQ ID NO: 279021 - DNA, 3554 bp, Homo sapiens
ctggcgggagcctgagactccgggcagggctgctccctcctctgctcccccgccagatccgcggggaaggaatcgtgcccgcgccgcccctggcccgcgccaccttcctttggtttctgccggcctcgggcttctgcggcccgatgtggcaggcgccgcgagagaggcagcagccggctggagcagcggcccctcaggtctcggagcccggtgcgcctctgcggtcgtcgctcctgggcctcggcgggtcactcttgccggccggcttcgctgcgggtttgcactgcccggcatttgcaagtgaggaagcagcacaaccctgggttttagataatttctaacagagaggccccagcaattcagcaggcagcgtcctgagtctttggcagcctggtccctctttcgcaaattctccacctttgcgaacagagggtctttaggacacagattcttaaaagtgcaggtgagccagccatgagagggtatcttgtggccatattcctgagtgctgtcttcctctattatgtactgcattgcatattatggggaacgaatgtctattgggtggcacctgtggaaatgaaacggagaaataagatccagccttgtttatcaaagccagcttttgcctctctgctgaggtttcatcagtttcacccttttctgtgtgcggctgattttagaaagattgcttccttgtatggtagcgataagtttgatttgccctatgggatgagaacatcagcggaatattttcgacttgctctttcaaaactgcagagttgtgatctctttgatgagtttgacaacataccctgtaaaaagtgtgtggtggttggtaatggaggagttttgaagaataagacattaggagaaaaaatcgactcctatgatgtaataataagaatgaataatggtcctgttttaggacatgaagaagaagttgggagaaggacaaccttccgacttttttatccagaatctgttttttcagatcctattcacaatgaccctaatacgacagtgattctcactgcttttaagccacatgatttaaggtggctgttggaattgttgatgggtgacaaaataaacactaatggtttttggaagaaaccagccttaaacctgatttataaaccttatcaaatccgaatattagatcctttcattatcagaacagcagcttatgaactgcttcattttccaaaagtgtttcccaaaaatcagaaacctaaacacccaacaacaggaattattgccatcacattggcgttttacatatgtcacgaagttcacctagctggttttaaatacaacttttctgacctcaagagtcctttgcactactatgggaatgccaccatgtctttgatgaataagaacgcgtatcacaatgtgactgcagagcagctctttttgaaggacattatagaaaaaaacctcgtaatcaacttgactcaagattgactctacagactcagaagatgatgctaacagtgttagttttatttttgtactgcaatttttagtttaaaatatgttggatgcactcgtcaaataattatgtatactgtctgttgctgcctggtgattcataaccaccagcttaatttctgtgaatactgtatatttaacttatgaaaaccaagaaatgtaaagataacaggaaaataagttttgattgcattgtttttaaaataagctagttttctgaggtgttttcacacgtctttttatagttacttcatcttagatttttgaagggatatgacttcctactaaggatttagtttaccacaacaattctgactacaataagacattttgaggaggatatttggctactgtaaacatggctggtggaaaatcacgattgtggcttgatgtggcaagccgaaaccacttggctctggaaatctaagttcatactggtttaattaagctctctcctgacaacccccagaattaaatgaaccatgattgtgaagagtaatttggtacaatgaaggcagtgtttgtttttaagttaaaggaaatgggctaaacataaagttcttattagataagtaaataactaaagaaagaatacaattactaaactctgatggctttgtattattttaaagaaatgaagtttaactttatacaatgaagctaagctaggcaagctcaagaaggaaaaaaaaatcttgaacattatttttttttgcctgacttacttattcattaaattttgaaggttttccacttgaagtaaattaggaaaggtaaagaagataacagaacaagtaaacacttaagaaaagtcaagctgaggccgggcagggtggctcacacctgtaatcctaacaaacactttgggaggccgagggaggcagctggattgcctgaactcaggagttcaagaccagcctggccaacatggtgaaacctcatctctactaaaatacaaaataattagctgggcgtggtggtatgcgctgtagtcccaggtactcgggaggctgaggcacgagaattgcttgagcccgggaggcagaggttgcagtgagccaagatcgcgccactgcacttcagcctgggtgacagagtgaggctgtcttctaaaaaatataaaaagtgaagttgggatttttggatttaaatggtacaaaaagaatatctcattttcccatgattaaagctaatcttcagatggaaagcttgcctggctacctagggtgcaccagagaatctgatccaatgcaagccagtcaatcctacaaatgtggtgagctagtcttccttcctatattttaataaatgtaaccaaaggccatctggaggtaggggaatgagaggtgaagaaacagaaaaatagaggttataaggatggaactaaaagttgtcagaagaggtatgagctgaagaaagaattactctcttttgaccaataaatacaattgggaaacactggaaaaccatggcttgattactgacaaccaacctgcctctctaaagagggtgtataaagggtgaaatacattagatttggctcagaaacagaatgcggtacttataaagcagaataaaggggagaacagtagtagttgatctaacccagattagacatgaataccagcatatgtttgcagagtcccacagttttgattcttcttataactttttgaggtgcaaaaggaaggtaccagaactggaatcgcatgtaatcaatcagtgtgattttcccctcataccacacagccataggctgcagtgtggctgctgaagttcaattgatataaagtaaatcaggcttcaaaaagaatggtgctgtgggtacacaaggacataaagatgggaacgatagacactgaggactgcggcggggggagcgaggggagcggggagggcaagggctgaaagactatgtattgggtactatgctcacaacctggatgatgggatcattcataccacaaacctcagtatcacacaatatacccatgtaacaacctgcactctgcacatgtacccttagaatctaaaataaaagttgaaattattttttt

SEQ ID NO: 279022 - DNA, 3399 bp, Homo sapiens
acgcgaggagggttgaggggtctggaaggttctggtctcttaccgtataaagtttttcgagaaaccctttttccctccacaatggaactagacctaacaaaacaagctccgaggcagtttaggagaaaggaggacgcatttgcaagtgaggaagcagcacaaccctgggttttagataatttctaacagagaggccccagcaattcagcaggcagcgtcctgagtctttggcagcctggtccctctttcgcaaattctccacctttgcgaacagagggtctttaggacacagattcttaaaagtgcaggtgagccagccatgagagggtatcttgtggccatattcctgagtgctgtcttcctctattatgtactgcattgcatattatggggaacgaatgtctattgggtggcacctgtggaaatgaaacggagaaataagatccagccttgtttatcaaagccagcttttgcctctctgctgaggtttcatcagtttcacccttttctgtgtgcggctgattttagaaagattgcttccttgtatggtagcgataagtttgatttgccctatgggatgagaacatcagcggaatattttcgacttgctctttcaaaactgcagagttgtgatctctttgatgagtttgacaacataccctgtaaaaagtgtgtggtggttggtaatggaggagttttgaagaataagacattaggagaaaaaatcgactcctatgatgtaataataagaatgaataatggtcctgttttaggacatgaagaagaagttgggagaaggacaaccttccgacttttttatccagaatctgttttttcagatcctattcacaatgaccctaatacgacagtgattctcactgcttttaagccacatgatttaaggtggctgttggaattgttgatgggtgacaaaataaacactaatggtttttggaagaaaccagccttaaacctgatttataaaccttatcaaatccgaatattagatcctttcattatcagaacagcagcttatgaactgcttcattttccaaaagtgtttcccaaaaatcagaaacctaaacacccaacaacaggaattattgccatcacattggcgttttacatatgtcacgaagttcacctagctggttttaaatacaacttttctgacctcaagagtcctttgcactactatgggaatgccaccatgtctttgatgaataagaacgcgtatcacaatgtgactgcagagcagctctttttgaaggacattatagaaaaaaacctcgtaatcaacttgactcaagattgactctacagactcagaagatgatgctaacagtgttagttttatttttgtactgcaatttttagtttaaaatatgttggatgcactcgtcaaataattatgtatactgtctgttgctgcctggtgattcataaccaccagcttaatttctgtgaatactgtatatttaacttatgaaaaccaagaaatgtaaagataacaggaaaataagttttgattgcattgtttttaaaataagctagttttctgaggtgttttcacacgtctttttatagttacttcatcttagatttttgaagggatatgacttcctactaaggatttagtttaccacaacaattctgactacaataagacattttgaggaggatatttggctactgtaaacatggctggtggaaaatcacgattgtggcttgatgtggcaagccgaaaccacttggctctggaaatctaagttcatactggtttaattaagctctctcctgacaacccccagaattaaatgaaccatgattgtgaagagtaatttggtacaatgaaggcagtgtttgtttttaagttaaaggaaatgggctaaacataaagttcttattagataagtaaataactaaagaaagaatacaattactaaactctgatggctttgtattattttaaagaaatgaagtttaactttatacaatgaagctaagctaggcaagctcaagaaggaaaaaaaaatcttgaacattatttttttttgcctgacttacttattcattaaattttgaaggttttccacttgaagtaaattaggaaaggtaaagaagataacagaacaagtaaacacttaagaaaagtcaagctgaggccgggcagggtggctcacacctgtaatcctaacaaacactttgggaggccgagggaggcagctggattgcctgaactcaggagttcaagaccagcctggccaacatggtgaaacctcatctctactaaaatacaaaataattagctgggcgtggtggtatgcgctgtagtcccaggtactcgggaggctgaggcacgagaattgcttgagcccgggaggcagaggttgcagtgagccaagatcgcgccactgcacttcagcctgggtgacagagtgaggctgtcttctaaaaaatataaaaagtgaagttgggatttttggatttaaatggtacaaaaagaatatctcattttcccatgattaaagctaatcttcagatggaaagcttgcctggctacctagggtgcaccagagaatctgatccaatgcaagccagtcaatcctacaaatgtggtgagctagtcttccttcctatattttaataaatgtaaccaaaggccatctggaggtaggggaatgagaggtgaagaaacagaaaaatagaggttataaggatggaactaaaagttgtcagaagaggtatgagctgaagaaagaattactctcttttgaccaataaatacaattgggaaacactggaaaaccatggcttgattactgacaaccaacctgcctctctaaagagggtgtataaagggtgaaatacattagatttggctcagaaacagaatgcggtacttataaagcagaataaaggggagaacagtagtagttgatctaacccagattagacatgaataccagcatatgtttgcagagtcccacagttttgattcttcttataactttttgaggtgcaaaaggaaggtaccagaactggaatcgcatgtaatcaatcagtgtgattttcccctcataccacacagccataggctgcagtgtggctgctgaagttcaattgatataaagtaaatcaggcttcaaaaagaatggtgctgtgggtacacaaggacataaagatgggaacgatagacactgaggactgcggcggggggagcgaggggagcggggagggcaagggctgaaagactatgtattgggtactatgctcacaacctggatgatgggatcattcataccacaaacctcagtatcacacaatatacccatgtaacaacctgcactctgcacatgtacccttagaatctaaaataaaagttgaaattattttttt

SEQ ID NO: 279023 - DNA, 3102 bp, Homo sapiens
caagcctcagtgtttacttctgccgcctgccagccgggcggggaaggggagtacccggccacccctcactttagctcctgcagctttccaaacaaaccagggcgggatgggagtgtcttcttggctgtggaaatcgatcctcctaccttgtcctgaagccacccgccgcctttcctcgtccctcccttcgcggtgattttccggtcccggcgcccggcgagggcgcgcggctggtgtccgccccgcccgaaaggtttcatcagtttcacccttttctgtgtgcggctgattttagaaagattgcttccttgtatggtagcgataagtttgatttgccctatgggatgagaacatcagcataccctgtaaaaagtgtgtggtggttggtaatggaggagttttgaagaataagacattaggagaaaaaatcgactcctatgatgtaataataagaatgaataatggtcctgttttaggacatgaagaagaagttgggagaaggacaaccttccgacttttttatccagaatctgttttttcagatcctattcacaatgaccctaatacgacagtgattctcactgcttttaagccacatgatttaaggtggctgttggaattgttgatgggtgacaaaataaacactaatggtttttggaagaaaccagccttaaacctgatttataaaccttatcaaatccgaatattagatcctttcattatcagaacagcagcttatgaactgcttcattttccaaaagtgtttcccaaaaatcagaaacctaaacacccaacaacaggaattattgccatcacattggcgttttacatatgtcacgaagttcacctagctggttttaaatacaacttttctgacctcaagagtcctttgcactactatgggaatgccaccatgtctttgatgaataagaacgcgtatcacaatgtgactgcagagcagctctttttgaaggacattatagaaaaaaacctcgtaatcaacttgactcaagattgactctacagactcagaagatgatgctaacagtgttagttttatttttgtactgcaatttttagtttaaaatatgttggatgcactcgtcaaataattatgtatactgtctgttgctgcctggtgattcataaccaccagcttaatttctgtgaatactgtatatttaacttatgaaaaccaagaaatgtaaagataacaggaaaataagttttgattgcattgtttttaaaataagctagttttctgaggtgttttcacacgtctttttatagttacttcatcttagatttttgaagggatatgacttcctactaaggatttagtttaccacaacaattctgactacaataagacattttgaggaggatatttggctactgtaaacatggctggtggaaaatcacgattgtggcttgatgtggcaagccgaaaccacttggctctggaaatctaagttcatactggtttaattaagctctctcctgacaacccccagaattaaatgaaccatgattgtgaagagtaatttggtacaatgaaggcagtgtttgtttttaagttaaaggaaatgggctaaacataaagttcttattagataagtaaataactaaagaaagaatacaattactaaactctgatggctttgtattattttaaagaaatgaagtttaactttatacaatgaagctaagctaggcaagctcaagaaggaaaaaaaaatcttgaacattatttttttttgcctgacttacttattcattaaattttgaaggttttccacttgaagtaaattaggaaaggtaaagaagataacagaacaagtaaacacttaagaaaagtcaagctgaggccgggcagggtggctcacacctgtaatcctaacaaacactttgggaggccgagggaggcagctggattgcctgaactcaggagttcaagaccagcctggccaacatggtgaaacctcatctctactaaaatacaaaataattagctgggcgtggtggtatgcgctgtagtcccaggtactcgggaggctgaggcacgagaattgcttgagcccgggaggcagaggttgcagtgagccaagatcgcgccactgcacttcagcctgggtgacagagtgaggctgtcttctaaaaaatataaaaagtgaagttgggatttttggatttaaatggtacaaaaagaatatctcattttcccatgattaaagctaatcttcagatggaaagcttgcctggctacctagggtgcaccagagaatctgatccaatgcaagccagtcaatcctacaaatgtggtgagctagtcttccttcctatattttaataaatgtaaccaaaggccatctggaggtaggggaatgagaggtgaagaaacagaaaaatagaggttataaggatggaactaaaagttgtcagaagaggtatgagctgaagaaagaattactctcttttgaccaataaatacaattgggaaacactggaaaaccatggcttgattactgacaaccaacctgcctctctaaagagggtgtataaagggtgaaatacattagatttggctcagaaacagaatgcggtacttataaagcagaataaaggggagaacagtagtagttgatctaacccagattagacatgaataccagcatatgtttgcagagtcccacagttttgattcttcttataactttttgaggtgcaaaaggaaggtaccagaactggaatcgcatgtaatcaatcagtgtgattttcccctcataccacacagccataggctgcagtgtggctgctgaagttcaattgatataaagtaaatcaggcttcaaaaagaatggtgctgtgggtacacaaggacataaagatgggaacgatagacactgaggactgcggcggggggagcgaggggagcggggagggcaagggctgaaagactatgtattgggtactatgctcacaacctggatgatgggatcattcataccacaaacctcagtatcacacaatatacccatgtaacaacctgcactctgcacatgtacccttagaatctaaaataaaagttgaaattattttttt

SEQ ID NO: 279024 - DNA, 3512 bp, Homo sapiens
cccatgtgtgacaaatgtggtcctggcattgtaggcatgtttgtaaagctgcggggaccatcatcccctccctgaatgttacgtgtgcactgattgtgacactcacccgaaagagaagggcttttttttttttttttccatcaaatctactgtgaagagcatgcccaggagcaagtcacaccacttgagggtacgatgtgatcatcatgttccccaagtgatccagcagacctgcactgaccaccgttctccagccagcctctgctgcagctagttctctaaatgttctggccttgtctcttgaaagttctgtacttattcccccaccccacaacccgcttaccttggttttatccctgctcattgaaccttgagtcccttgtcttggttaactgactcacactgactgtgtggtgcccgcccacttttacaatgaatggcaaactgtttttgttcagtgtccccttgccggcaacactgtgtaccttcctcccctcagttcttctctgctgcaaatggacatcagccacatttgaaccaaatcaaatataatatgtctgacattgatttcatttttgctccatctatagactcccagaaaaaagaaataaaaaaaatgcaaagaaaatttaaatgaacaaacagacccttctggaacctactgtgacatgagatgtgtccacaaggcgaggtttcaggcacacactgaaggagcatctgctggacagccctccccgcccccaagtccttaccaacctgtgccactgcataccctgtaaaaagtgtgtggtggttggtaatggaggagttttgaagaataagacattaggagaaaaaatcgactcctatgatgtaataataagaatgaataatggtcctgttttaggacatgaagaagaagttgggagaaggacaaccttccgacttttttatccagaatctgttttttcagatcctattcacaatgaccctaatacgacagtgattctcactgcttttaagccacatgatttaaggtggctgttggaattgttgatgggtgacaaaataaacactaatggtttttggaagaaaccagccttaaacctgatttataaaccttatcaaatccgaatattagatcctttcattatcagaacagcagcttatgaactgcttcattttccaaaagtgtttcccaaaaatcagaaacctaaacacccaacaacaggaattattgccatcacattggcgttttacatatgtcacgaagttcacctagctggttttaaatacaacttttctgacctcaagagtcctttgcactactatgggaatgccaccatgtctttgatgaataagaacgcgtatcacaatgtgactgcagagcagctctttttgaaggacattatagaaaaaaacctcgtaatcaacttgactcaagattgactctacagactcagaagatgatgctaacagtgttagttttatttttgtactgcaatttttagtttaaaatatgttggatgcactcgtcaaataattatgtatactgtctgttgctgcctggtgattcataaccaccagcttaatttctgtgaatactgtatatttaacttatgaaaaccaagaaatgtaaagataacaggaaaataagttttgattgcattgtttttaaaataagctagttttctgaggtgttttcacacgtctttttatagttacttcatcttagatttttgaagggatatgacttcctactaaggatttagtttaccacaacaattctgactacaataagacattttgaggaggatatttggctactgtaaacatggctggtggaaaatcacgattgtggcttgatgtggcaagccgaaaccacttggctctggaaatctaagttcatactggtttaattaagctctctcctgacaacccccagaattaaatgaaccatgattgtgaagagtaatttggtacaatgaaggcagtgtttgtttttaagttaaaggaaatgggctaaacataaagttcttattagataagtaaataactaaagaaagaatacaattactaaactctgatggctttgtattattttaaagaaatgaagtttaactttatacaatgaagctaagctaggcaagctcaagaaggaaaaaaaaatcttgaacattatttttttttgcctgacttacttattcattaaattttgaaggttttccacttgaagtaaattaggaaaggtaaagaagataacagaacaagtaaacacttaagaaaagtcaagctgaggccgggcagggtggctcacacctgtaatcctaacaaacactttgggaggccgagggaggcagctggattgcctgaactcaggagttcaagaccagcctggccaacatggtgaaacctcatctctactaaaatacaaaataattagctgggcgtggtggtatgcgctgtagtcccaggtactcgggaggctgaggcacgagaattgcttgagcccgggaggcagaggttgcagtgagccaagatcgcgccactgcacttcagcctgggtgacagagtgaggctgtcttctaaaaaatataaaaagtgaagttgggatttttggatttaaatggtacaaaaagaatatctcattttcccatgattaaagctaatcttcagatggaaagcttgcctggctacctagggtgcaccagagaatctgatccaatgcaagccagtcaatcctacaaatgtggtgagctagtcttccttcctatattttaataaatgtaaccaaaggccatctggaggtaggggaatgagaggtgaagaaacagaaaaatagaggttataaggatggaactaaaagttgtcagaagaggtatgagctgaagaaagaattactctcttttgaccaataaatacaattgggaaacactggaaaaccatggcttgattactgacaaccaacctgcctctctaaagagggtgtataaagggtgaaatacattagatttggctcagaaacagaatgcggtacttataaagcagaataaaggggagaacagtagtagttgatctaacccagattagacatgaataccagcatatgtttgcagagtcccacagttttgattcttcttataactttttgaggtgcaaaaggaaggtaccagaactggaatcgcatgtaatcaatcagtgtgattttcccctcataccacacagccataggctgcagtgtggctgctgaagttcaattgatataaagtaaatcaggcttcaaaaagaatggtgctgtgggtacacaaggacataaagatgggaacgatagacactgaggactgcggcggggggagcgaggggagcggggagggcaagggctgaaagactatgtattgggtactatgctcacaacctggatgatgggatcattcataccacaaacctcagtatcacacaatatacccatgtaacaacctgcactctgcacatgtacccttagaatctaaaataaaagttgaaattattttttt

SEQ ID NO: 279025 - DNA, 2604 bp, Homo sapiens
ggccactttctcagaaacagaaaagccagcagcaatttggagaagctcttctgggaaacctggagcttttatcttcagtgttataaagagaacatctttccttataattaggcttgggtgtggatttcagctgtcatttatgggatagtgaccccagacttgtcatagctgatacaacttcacatatatggtttcatcagtttcacccttttctgtgtgcggctgattttagaaagattgcttccttgtatggtagcgataagtttgatttgccctatgggatgagaacatcagtgattggcctatatagcattaagttctagatttttgagggatcataaaagcccaaggtgacaagccttcaacattcggaatattttcgacttgctctttcaaaactgcagagttgtgatctctttgatgagtttgacaaaacgcgtatcacaatgtgactgcagagcagctctttttgaaggacattatagaaaaaaacctcgtaatcaacttgactcaagattgactctacagactcagaagatgatgctaacagtgttagttttatttttgtactgcaatttttagtttaaaatatgttggatgcactcgtcaaataattatgtatactgtctgttgctgcctggtgattcataaccaccagcttaatttctgtgaatactgtatatttaacttatgaaaaccaagaaatgtaaagataacaggaaaataagttttgattgcattgtttttaaaataagctagttttctgaggtgttttcacacgtctttttatagttacttcatcttagatttttgaagggatatgacttcctactaaggatttagtttaccacaacaattctgactacaataagacattttgaggaggatatttggctactgtaaacatggctggtggaaaatcacgattgtggcttgatgtggcaagccgaaaccacttggctctggaaatctaagttcatactggtttaattaagctctctcctgacaacccccagaattaaatgaaccatgattgtgaagagtaatttggtacaatgaaggcagtgtttgtttttaagttaaaggaaatgggctaaacataaagttcttattagataagtaaataactaaagaaagaatacaattactaaactctgatggctttgtattattttaaagaaatgaagtttaactttatacaatgaagctaagctaggcaagctcaagaaggaaaaaaaaatcttgaacattatttttttttgcctgacttacttattcattaaattttgaaggttttccacttgaagtaaattaggaaaggtaaagaagataacagaacaagtaaacacttaagaaaagtcaagctgaggccgggcagggtggctcacacctgtaatcctaacaaacactttgggaggccgagggaggcagctggattgcctgaactcaggagttcaagaccagcctggccaacatggtgaaacctcatctctactaaaatacaaaataattagctgggcgtggtggtatgcgctgtagtcccaggtactcgggaggctgaggcacgagaattgcttgagcccgggaggcagaggttgcagtgagccaagatcgcgccactgcacttcagcctgggtgacagagtgaggctgtcttctaaaaaatataaaaagtgaagttgggatttttggatttaaatggtacaaaaagaatatctcattttcccatgattaaagctaatcttcagatggaaagcttgcctggctacctagggtgcaccagagaatctgatccaatgcaagccagtcaatcctacaaatgtggtgagctagtcttccttcctatattttaataaatgtaaccaaaggccatctggaggtaggggaatgagaggtgaagaaacagaaaaatagaggttataaggatggaactaaaagttgtcagaagaggtatgagctgaagaaagaattactctcttttgaccaataaatacaattgggaaacactggaaaaccatggcttgattactgacaaccaacctgcctctctaaagagggtgtataaagggtgaaatacattagatttggctcagaaacagaatgcggtacttataaagcagaataaaggggagaacagtagtagttgatctaacccagattagacatgaataccagcatatgtttgcagagtcccacagttttgattcttcttataactttttgaggtgcaaaaggaaggtaccagaactggaatcgcatgtaatcaatcagtgtgattttcccctcataccacacagccataggctgcagtgtggctgctgaagttcaattgatataaagtaaatcaggcttcaaaaagaatggtgctgtgggtacacaaggacataaagatgggaacgatagacactgaggactgcggcggggggagcgaggggagcggggagggcaagggctgaaagactatgtattgggtactatgctcacaacctggatgatgggatcattcataccacaaacctcagtatcacacaatatacccatgtaacaacctgcactctgcacatgtacccttagaatctaaaataaaagttgaaattattttttt

SEQ ID NO: 279026 - DNA, 2280 bp, Homo sapiens
aacattcgagttctttattcggatttttttagatataaagtactccattggtgctgctaatactttgagattgggaaagaatgatggtaattgtatttttcttctttagaacgcgtatcacaatgtgactgcagagcagctctttttgaaggacattatagaaaaaaacctcgtaatcaacttgactcaagattgactctacagactcagaagatgatgctaacagtgttagttttatttttgtactgcaatttttagtttaaaatatgttggatgcactcgtcaaataattatgtatactgtctgttgctgcctggtgattcataaccaccagcttaatttctgtgaatactgtatatttaacttatgaaaaccaagaaatgtaaagataacaggaaaataagttttgattgcattgtttttaaaataagctagttttctgaggtgttttcacacgtctttttatagttacttcatcttagatttttgaagggatatgacttcctactaaggatttagtttaccacaacaattctgactacaataagacattttgaggaggatatttggctactgtaaacatggctggtggaaaatcacgattgtggcttgatgtggcaagccgaaaccacttggctctggaaatctaagttcatactggtttaattaagctctctcctgacaacccccagaattaaatgaaccatgattgtgaagagtaatttggtacaatgaaggcagtgtttgtttttaagttaaaggaaatgggctaaacataaagttcttattagataagtaaataactaaagaaagaatacaattactaaactctgatggctttgtattattttaaagaaatgaagtttaactttatacaatgaagctaagctaggcaagctcaagaaggaaaaaaaaatcttgaacattatttttttttgcctgacttacttattcattaaattttgaaggttttccacttgaagtaaattaggaaaggtaaagaagataacagaacaagtaaacacttaagaaaagtcaagctgaggccgggcagggtggctcacacctgtaatcctaacaaacactttgggaggccgagggaggcagctggattgcctgaactcaggagttcaagaccagcctggccaacatggtgaaacctcatctctactaaaatacaaaataattagctgggcgtggtggtatgcgctgtagtcccaggtactcgggaggctgaggcacgagaattgcttgagcccgggaggcagaggttgcagtgagccaagatcgcgccactgcacttcagcctgggtgacagagtgaggctgtcttctaaaaaatataaaaagtgaagttgggatttttggatttaaatggtacaaaaagaatatctcattttcccatgattaaagctaatcttcagatggaaagcttgcctggctacctagggtgcaccagagaatctgatccaatgcaagccagtcaatcctacaaatgtggtgagctagtcttccttcctatattttaataaatgtaaccaaaggccatctggaggtaggggaatgagaggtgaagaaacagaaaaatagaggttataaggatggaactaaaagttgtcagaagaggtatgagctgaagaaagaattactctcttttgaccaataaatacaattgggaaacactggaaaaccatggcttgattactgacaaccaacctgcctctctaaagagggtgtataaagggtgaaatacattagatttggctcagaaacagaatgcggtacttataaagcagaataaaggggagaacagtagtagttgatctaacccagattagacatgaataccagcatatgtttgcagagtcccacagttttgattcttcttataactttttgaggtgcaaaaggaaggtaccagaactggaatcgcatgtaatcaatcagtgtgattttcccctcataccacacagccataggctgcagtgtggctgctgaagttcaattgatataaagtaaatcaggcttcaaaaagaatggtgctgtgggtacacaaggacataaagatgggaacgatagacactgaggactgcggcggggggagcgaggggagcggggagggcaagggctgaaagactatgtattgggtactatgctcacaacctggatgatgggatcattcataccacaaacctcagtatcacacaatatacccatgtaacaacctgcactctgcacatgtacccttagaatctaaaataaaagttgaaattattttttt

SEQ ID NO: 279027 - DNA, 1104 bp, Homo sapiens
caagcctcagtgtttacttctgccgcctgccagccgggcggggaaggggagtacccggccacccctcactttagctcctgcagctttccaaacaaaccagggcgggatgggagtgtcttcttggctgtggaaatcgatcctcctaccttgtcctgaagccacccgccgcctttcctcgtccctcccttcgcggtgattttccggtcccggcgcccggcgagggcgcgcggctggtgtccgccccgcccgaaaggtgagccagccatgagagggtatcttgtggccatattcctgagtgctgtcttcctctattatgtactgcattgcatattatggggaacgaatgtctattgggtggcacctgtggaaatgaaacggagaaataagatccagccttgtttatcaaagccagcttttgcctctctgctgaggtttcatcagtttcacccttttctgtgtgcggctgattttagaaagattgcttccttgtatggtagcgataagtttgatttgccctatgggatgagaacatcagcggaatattttcgacttgctctttcaaaactgcagagttgtgatctctttgatgagtttgacaacataccctgtaaaaagtgtgtggtggttggtaatggaggagttttgaagaataagacattaggagaaaaaatcgactcctatgatgtaataataagaatgaataatggtcctgttttaggacatgaagaagaagttgggagaaggacaaccttccgacttttttatccagaatctgttttttcagatcctattcacaatgaccctaatacgacagtgattctcactgcttttaagccacatgatttaaggtggctgttggaattgttgatgggtgacaaaataaacactaatggtttttggaagaaaccagccttaaacctgatttataaaccttatcaaatccgaatattagatcctttcattatcagaacagcagcttatgaactgcttcattttccaaaagtgtttcccaaaaatcagaaacctaaacacccaacaacaggaattattgccatttttacataacctctatgattttaataaaaaaaattatgtaaaaaaaaa

SEQ ID NO: 279028 - DNA, 761 bp, Homo sapiens
taaaatataaattatcactccttttgaggcagtatagaaccaaaggataacaggggtagatttgttgttgttgagaaactactttttacatttgctctgccgccatgtgatccatgtaagttctggtgccttactttattctaatttagaattagcaggaaaacctgagggttagcttccttcctagcttcccatggcttctttttacctgtgagttttatctcatcagcgattcttatctccttaagcagtcttttaatttaaccagtggatattttatttttgttaagtttagagataattattccatcttctaatgataaaacactttcccttctgcttgttgataagtgattggcctatatagcattaagttctagatttttgagggatcataaaagcccaaggtgacaagccttcaacattgtgagtcatattttgcttattcaactgatcctgtgagggtgggggttgtatttttttgttttattttttattttaaaactattttgcagagaatttgagaatttaattgggttaaacttactatttctattctaacatcaatttcagaatcgtgctattttaaaattatatgattgtttttcagattaaatgtgttgttttttggggaggttttggaaagtgtctttagagcatttacgattttgaatgggcctgctgaagtagtgctggctaattgcagttgtatcattaatttttcacagaataaatcaatgtggccatgctggttggaaatg

SEQ ID NO: 279029 - DNA, 99 bp, Homo sapiens
tgagaaactactttttacatttgctctgccgccatgtgatccatgtaagttctggtgccttactttattctaatttagaattagcaggaaaacctgagg

SEQ ID NO: 279030 - DNA, 3382 bp, Homo sapiens
ctggcgggagcctgagactccgggcagggctgctccctcctctgctcccccgccagatccgcggggaaggaatcgtgcccgcgccgcccctggcccgcgccaccttcctttggtttctgccggcctcgggcttctgcggcccgatgtggcaggcgccgcgagagaggcagcagccggctggagcagcggcccctcaggtctcggagcccggtgcgcctctgcggtcgtcgctcctgggcctcggcgggtcactcttgccggccggcttcgctgcgggtttgcactgcccgggtgagccagccatgagagggtatcttgtggccatattcctgagtgctgtcttcctctattatgtactgcattgcatattatggggaacgaatgtctattgggtggcacctgtggaaatgaaacggagaaataagatccagccttgtttatcaaagccagcttttgcctctctgctgaggtttcatcagtttcacccttttctgtgtgcggctgattttagaaagattgcttccttgtatggtagcgataagtttgatttgccctatgggatgagaacatcagcggaatattttcgacttgctctttcaaaactgcagagttgtgatctctttgatgagtttgacaacataccctgtaaaaagtgtgtggtggttggtaatggaggagttttgaagaataagacattaggagaaaaaatcgactcctatgatgtaataataagaatgaataatggtcctgttttaggacatgaagaagaagttgggagaaggacaaccttccgacttttttatccagaatctgttttttcagatcctattcacaatgaccctaatacgacagtgattctcactgcttttaagccacatgatttaaggtggctgttggaattgttgatgggtgacaaaataaacactaatggtttttggaagaaaccagccttaaacctgatttataaaccttatcaaatccgaatattagatcctttcattatcagaacagcagcttatgaactgcttcattttccaaaagtgtttcccaaaaatcagaaacctaaacacccaacaacaggaattattgccatcacattggcgttttacatatgtcacgaagttcacctagctggttttaaatacaacttttctgacctcaagagtcctttgcactactatgggaatgccaccatgtctttgatgaataagaacgcgtatcacaatgtgactgcagagcagctctttttgaaggacattatagaaaaaaacctcgtaatcaacttgactcaagattgactctacagactcagaagatgatgctaacagtgttagttttatttttgtactgcaatttttagtttaaaatatgttggatgcactcgtcaaataattatgtatactgtctgttgctgcctggtgattcataaccaccagcttaatttctgtgaatactgtatatttaacttatgaaaaccaagaaatgtaaagataacaggaaaataagttttgattgcattgtttttaaaataagctagttttctgaggtgttttcacacgtctttttatagttacttcatcttagatttttgaagggatatgacttcctactaaggatttagtttaccacaacaattctgactacaataagacattttgaggaggatatttggctactgtaaacatggctggtggaaaatcacgattgtggcttgatgtggcaagccgaaaccacttggctctggaaatctaagttcatactggtttaattaagctctctcctgacaacccccagaattaaatgaaccatgattgtgaagagtaatttggtacaatgaaggcagtgtttgtttttaagttaaaggaaatgggctaaacataaagttcttattagataagtaaataactaaagaaagaatacaattactaaactctgatggctttgtattattttaaagaaatgaagtttaactttatacaatgaagctaagctaggcaagctcaagaaggaaaaaaaaatcttgaacattatttttttttgcctgacttacttattcattaaattttgaaggttttccacttgaagtaaattaggaaaggtaaagaagataacagaacaagtaaacacttaagaaaagtcaagctgaggccgggcagggtggctcacacctgtaatcctaacaaacactttgggaggccgagggaggcagctggattgcctgaactcaggagttcaagaccagcctggccaacatggtgaaacctcatctctactaaaatacaaaataattagctgggcgtggtggtatgcgctgtagtcccaggtactcgggaggctgaggcacgagaattgcttgagcccgggaggcagaggttgcagtgagccaagatcgcgccactgcacttcagcctgggtgacagagtgaggctgtcttctaaaaaatataaaaagtgaagttgggatttttggatttaaatggtacaaaaagaatatctcattttcccatgattaaagctaatcttcagatggaaagcttgcctggctacctagggtgcaccagagaatctgatccaatgcaagccagtcaatcctacaaatgtggtgagctagtcttccttcctatattttaataaatgtaaccaaaggccatctggaggtaggggaatgagaggtgaagaaacagaaaaatagaggttataaggatggaactaaaagttgtcagaagaggtatgagctgaagaaagaattactctcttttgaccaataaatacaattgggaaacactggaaaaccatggcttgattactgacaaccaacctgcctctctaaagagggtgtataaagggtgaaatacattagatttggctcagaaacagaatgcggtacttataaagcagaataaaggggagaacagtagtagttgatctaacccagattagacatgaataccagcatatgtttgcagagtcccacagttttgattcttcttataactttttgaggtgcaaaaggaaggtaccagaactggaatcgcatgtaatcaatcagtgtgattttcccctcataccacacagccataggctgcagtgtggctgctgaagttcaattgatataaagtaaatcaggcttcaaaaagaatggtgctgtgggtacacaaggacataaagatgggaacgatagacactgaggactgcggcggggggagcgaggggagcggggagggcaagggctgaaagactatgtattgggtactatgctcacaacctggatgatgggatcattcataccacaaacctcagtatcacacaatatacccatgtaacaacctgcactctgcacatgtacccttagaatctaaaataaaagttgaaattattttttt

SEQ ID NO: 279031 - DNA, 3208 bp, Homo sapiens
tgctggtacggtcggaattttgggatccgccgcctttcctcgtccctcccttcgcggtgattttccggtcccggcgcccggcgagggcgcgcggctggtgtccgccccgcccgaaaggtgagccagccatgagagggtatcttgtggccatattcctgagtgctgtcttcctctattatgtactgcattgcatattatggggaacgaatgtctattgggtggcacctgtggaaatgaaacggagaaataagatccagccttgtttatcaaagccagcttttgcctctctgctgaggtttcatcagtttcacccttttctgtgtgcggctgattttagaaagattgcttccttgtatggtagcgataagtttgatttgccctatgggatgagaacatcagcggaatattttcgacttgctctttcaaaactgcagagttgtgatctctttgatgagtttgacaacataccctgtaaaaagtgtgtggtggttggtaatggaggagttttgaagaataagacattaggagaaaaaatcgactcctatgatgtaataataagaatgaataatggtcctgttttaggacatgaagaagaagttgggagaaggacaaccttccgacttttttatccagaatctgttttttcagatcctattcacaatgaccctaatacgacagtgattctcactgcttttaagccacatgatttaaggtggctgttggaattgttgatgggtgacaaaataaacactaatggtttttggaagaaaccagccttaaacctgatttataaaccttatcaaatccgaatattagatcctttcattatcagaacagcagcttatgaactgcttcattttccaaaagtgtttcccaaaaatcagaaacctaaacacccaacaacaggaattattgccatcacattggcgttttacatatgtcacgaagttcacctagctggttttaaatacaacttttctgacctcaagagtcctttgcactactatgggaatgccaccatgtctttgatgaataagaacgcgtatcacaatgtgactgcagagcagctctttttgaaggacattatagaaaaaaacctcgtaatcaacttgactcaagattgactctacagactcagaagatgatgctaacagtgttagttttatttttgtactgcaatttttagtttaaaatatgttggatgcactcgtcaaataattatgtatactgtctgttgctgcctggtgattcataaccaccagcttaatttctgtgaatactgtatatttaacttatgaaaaccaagaaatgtaaagataacaggaaaataagttttgattgcattgtttttaaaataagctagttttctgaggtgttttcacacgtctttttatagttacttcatcttagatttttgaagggatatgacttcctactaaggatttagtttaccacaacaattctgactacaataagacattttgaggaggatatttggctactgtaaacatggctggtggaaaatcacgattgtggcttgatgtggcaagccgaaaccacttggctctggaaatctaagttcatactggtttaattaagctctctcctgacaacccccagaattaaatgaaccatgattgtgaagagtaatttggtacaatgaaggcagtgtttgtttttaagttaaaggaaatgggctaaacataaagttcttattagataagtaaataactaaagaaagaatacaattactaaactctgatggctttgtattattttaaagaaatgaagtttaactttatacaatgaagctaagctaggcaagctcaagaaggaaaaaaaaatcttgaacattatttttttttgcctgacttacttattcattaaattttgaaggttttccacttgaagtaaattaggaaaggtaaagaagataacagaacaagtaaacacttaagaaaagtcaagctgaggccgggcagggtggctcacacctgtaatcctaacaaacactttgggaggccgagggaggcagctggattgcctgaactcaggagttcaagaccagcctggccaacatggtgaaacctcatctctactaaaatacaaaataattagctgggcgtggtggtatgcgctgtagtcccaggtactcgggaggctgaggcacgagaattgcttgagcccgggaggcagaggttgcagtgagccaagatcgcgccactgcacttcagcctgggtgacagagtgaggctgtcttctaaaaaatataaaaagtgaagttgggatttttggatttaaatggtacaaaaagaatatctcattttcccatgattaaagctaatcttcagatggaaagcttgcctggctacctagggtgcaccagagaatctgatccaatgcaagccagtcaatcctacaaatgtggtgagctagtcttccttcctatattttaataaatgtaaccaaaggccatctggaggtaggggaatgagaggtgaagaaacagaaaaatagaggttataaggatggaactaaaagttgtcagaagaggtatgagctgaagaaagaattactctcttttgaccaataaatacaattgggaaacactggaaaaccatggcttgattactgacaaccaacctgcctctctaaagagggtgtataaagggtgaaatacattagatttggctcagaaacagaatgcggtacttataaagcagaataaaggggagaacagtagtagttgatctaacccagattagacatgaataccagcatatgtttgcagagtcccacagttttgattcttcttataactttttgaggtgcaaaaggaaggtaccagaactggaatcgcatgtaatcaatcagtgtgattttcccctcataccacacagccataggctgcagtgtggctgctgaagttcaattgatataaagtaaatcaggcttcaaaaagaatggtgctgtgggtacacaaggacataaagatgggaacgatagacactgaggactgcggcggggggagcgaggggagcggggagggcaagggctgaaagactatgtattgggtactatgctcacaacctggatgatgggatcattcataccacaaacctcagtatcacacaatatacccatgtaacaacctgcactctgcacatgtacccttagaatctaaaataaaagttgaaattattttttt

SEQ ID NO: 279032 - DNA, 3295 bp, Homo sapiens
  misc_feature (21)..(21): n is a, c, g, or t
gggtattatgaccgggcctcngggccttcgtgcggcaccgtatgtgagctgagcgctggctgagaagacgtgcgtgcaccgtacggactagtacgcaggcggcccctcaggtctcggagcccggtgcgcctctgcggtcgtcgctcctgggcctcggcgggtcactcttgccggccggcttcgctgcgggtttgcactgcccgggtgagccagccatgagagggtatcttgtggccatattcctgagtgctgtcttcctctattatgtactgcattgcatattatggggaacgaatgtctattgggtggcacctgtggaaatgaaacggagaaataagatccagccttgtttatcaaagccagcttttgcctctctgctgaggtttcatcagtttcacccttttctgtgtgcggctgattttagaaagattgcttccttgtatggtagcgataagtttgatttgccctatgggatgagaacatcagcggaatattttcgacttgctctttcaaaactgcagagttgtgatctctttgatgagtttgacaacataccctgtaaaaagtgtgtggtggttggtaatggaggagttttgaagaataagacattaggagaaaaaatcgactcctatgatgtaataataagaatgaataatggtcctgttttaggacatgaagaagaagttgggagaaggacaaccttccgacttttttatccagaatctgttttttcagatcctattcacaatgaccctaatacgacagtgattctcactgcttttaagccacatgatttaaggtggctgttggaattgttgatgggtgacaaaataaacactaatggtttttggaagaaaccagccttaaacctgatttataaaccttatcaaatccgaatattagatcctttcattatcagaacagcagcttatgaactgcttcattttccaaaagtgtttcccaaaaatcagaaacctaaacacccaacaacaggaattattgccatcacattggcgttttacatatgtcacgaagttcacctagctggttttaaatacaacttttctgacctcaagagtcctttgcactactatgggaatgccaccatgtctttgatgaataagaacgcgtatcacaatgtgactgcagagcagctctttttgaaggacattatagaaaaaaacctcgtaatcaacttgactcaagattgactctacagactcagaagatgatgctaacagtgttagttttatttttgtactgcaatttttagtttaaaatatgttggatgcactcgtcaaataattatgtatactgtctgttgctgcctggtgattcataaccaccagcttaatttctgtgaatactgtatatttaacttatgaaaaccaagaaatgtaaagataacaggaaaataagttttgattgcattgtttttaaaataagctagttttctgaggtgttttcacacgtctttttatagttacttcatcttagatttttgaagggatatgacttcctactaaggatttagtttaccacaacaattctgactacaataagacattttgaggaggatatttggctactgtaaacatggctggtggaaaatcacgattgtggcttgatgtggcaagccgaaaccacttggctctggaaatctaagttcatactggtttaattaagctctctcctgacaacccccagaattaaatgaaccatgattgtgaagagtaatttggtacaatgaaggcagtgtttgtttttaagttaaaggaaatgggctaaacataaagttcttattagataagtaaataactaaagaaagaatacaattactaaactctgatggctttgtattattttaaagaaatgaagtttaactttatacaatgaagctaagctaggcaagctcaagaaggaaaaaaaaatcttgaacattatttttttttgcctgacttacttattcattaaattttgaaggttttccacttgaagtaaattaggaaaggtaaagaagataacagaacaagtaaacacttaagaaaagtcaagctgaggccgggcagggtggctcacacctgtaatcctaacaaacactttgggaggccgagggaggcagctggattgcctgaactcaggagttcaagaccagcctggccaacatggtgaaacctcatctctactaaaatacaaaataattagctgggcgtggtggtatgcgctgtagtcccaggtactcgggaggctgaggcacgagaattgcttgagcccgggaggcagaggttgcagtgagccaagatcgcgccactgcacttcagcctgggtgacagagtgaggctgtcttctaaaaaatataaaaagtgaagttgggatttttggatttaaatggtacaaaaagaatatctcattttcccatgattaaagctaatcttcagatggaaagcttgcctggctacctagggtgcaccagagaatctgatccaatgcaagccagtcaatcctacaaatgtggtgagctagtcttccttcctatattttaataaatgtaaccaaaggccatctggaggtaggggaatgagaggtgaagaaacagaaaaatagaggttataaggatggaactaaaagttgtcagaagaggtatgagctgaagaaagaattactctcttttgaccaataaatacaattgggaaacactggaaaaccatggcttgattactgacaaccaacctgcctctctaaagagggtgtataaagggtgaaatacattagatttggctcagaaacagaatgcggtacttataaagcagaataaaggggagaacagtagtagttgatctaacccagattagacatgaataccagcatatgtttgcagagtcccacagttttgattcttcttataactttttgaggtgcaaaaggaaggtaccagaactggaatcgcatgtaatcaatcagtgtgattttcccctcataccacacagccataggctgcagtgtggctgctgaagttcaattgatataaagtaaatcaggcttcaaaaagaatggtgctgtgggtacacaaggacataaagatgggaacgatagacactgaggactgcggcggggggagcgaggggagcggggagggcaagggctgaaagactatgtattgggtactatgctcacaacctggatgatgggatcattcataccacaaacctcagtatcacacaatatacccatgtaacaacctgcactctgcacatgtacccttagaatctaaaataaaagttgaaattattttttt

SEQ ID NO: 279033 - DNA, 3321 bp, Homo sapiens
atcaacgcagagtggccattacggcgggggcgcggctggtgtccgccccgtccgaaagcatttgcaagtgaggaagcagcacaaccctgggttttagataatttctaacagagaggccccagcaattcagcaggcagcgtcctgagtctttggcagcctggtccctctttcgcaaattctccacctttgcgaacagagggtctttaggacacagattcttaaaagtgcaggtgagccagccatgagagggtatcttgtggccatattcctgagtgctgtcttcctctattatgtactgcattgcatattatggggaacgaatgtctattgggtggcacctgtggaaatgaaacggagaaataagatccagccttgtttatcaaagccagcttttgcctctctgctgaggtttcatcagtttcacccttttctgtgtgcggctgattttagaaagattgcttccttgtatggtagcgataagtttgatttgccctatgggatgagaacatcagcggaatattttcgacttgctctttcaaaactgcagagttgtgatctctttgatgagtttgacaacataccctgtaaaaagtgtgtggtggttggtaatggaggagttttgaagaataagacattaggagaaaaaatcgactcctatgatgtaataataagaatgaataatggtcctgttttaggacatgaagaagaagttgggagaaggacaaccttccgacttttttatccagaatctgttttttcagatcctattcacaatgaccctaatacgacagtgattctcactgcttttaagccacatgatttaaggtggctgttggaattgttgatgggtgacaaaataaacactaatggtttttggaagaaaccagccttaaacctgatttataaaccttatcaaatccgaatattagatcctttcattatcagaacagcagcttatgaactgcttcattttccaaaagtgtttcccaaaaatcagaaacctaaacacccaacaacaggaattattgccatcacattggcgttttacatatgtcacgaagttcacctagctggttttaaatacaacttttctgacctcaagagtcctttgcactactatgggaatgccaccatgtctttgatgaataagaacgcgtatcacaatgtgactgcagagcagctctttttgaaggacattatagaaaaaaacctcgtaatcaacttgactcaagattgactctacagactcagaagatgatgctaacagtgttagttttatttttgtactgcaatttttagtttaaaatatgttggatgcactcgtcaaataattatgtatactgtctgttgctgcctggtgattcataaccaccagcttaatttctgtgaatactgtatatttaacttatgaaaaccaagaaatgtaaagataacaggaaaataagttttgattgcattgtttttaaaataagctagttttctgaggtgttttcacacgtctttttatagttacttcatcttagatttttgaagggatatgacttcctactaaggatttagtttaccacaacaattctgactacaataagacattttgaggaggatatttggctactgtaaacatggctggtggaaaatcacgattgtggcttgatgtggcaagccgaaaccacttggctctggaaatctaagttcatactggtttaattaagctctctcctgacaacccccagaattaaatgaaccatgattgtgaagagtaatttggtacaatgaaggcagtgtttgtttttaagttaaaggaaatgggctaaacataaagttcttattagataagtaaataactaaagaaagaatacaattactaaactctgatggctttgtattattttaaagaaatgaagtttaactttatacaatgaagctaagctaggcaagctcaagaaggaaaaaaaaatcttgaacattatttttttttgcctgacttacttattcattaaattttgaaggttttccacttgaagtaaattaggaaaggtaaagaagataacagaacaagtaaacacttaagaaaagtcaagctgaggccgggcagggtggctcacacctgtaatcctaacaaacactttgggaggccgagggaggcagctggattgcctgaactcaggagttcaagaccagcctggccaacatggtgaaacctcatctctactaaaatacaaaataattagctgggcgtggtggtatgcgctgtagtcccaggtactcgggaggctgaggcacgagaattgcttgagcccgggaggcagaggttgcagtgagccaagatcgcgccactgcacttcagcctgggtgacagagtgaggctgtcttctaaaaaatataaaaagtgaagttgggatttttggatttaaatggtacaaaaagaatatctcattttcccatgattaaagctaatcttcagatggaaagcttgcctggctacctagggtgcaccagagaatctgatccaatgcaagccagtcaatcctacaaatgtggtgagctagtcttccttcctatattttaataaatgtaaccaaaggccatctggaggtaggggaatgagaggtgaagaaacagaaaaatagaggttataaggatggaactaaaagttgtcagaagaggtatgagctgaagaaagaattactctcttttgaccaataaatacaattgggaaacactggaaaaccatggcttgattactgacaaccaacctgcctctctaaagagggtgtataaagggtgaaatacattagatttggctcagaaacagaatgcggtacttataaagcagaataaaggggagaacagtagtagttgatctaacccagattagacatgaataccagcatatgtttgcagagtcccacagttttgattcttcttataactttttgaggtgcaaaaggaaggtaccagaactggaatcgcatgtaatcaatcagtgtgattttcccctcataccacacagccataggctgcagtgtggctgctgaagttcaattgatataaagtaaatcaggcttcaaaaagaatggtgctgtgggtacacaaggacataaagatgggaacgatagacactgaggactgcggcggggggagcgaggggagcggggagggcaagggctgaaagactatgtattgggtactatgctcacaacctggatgatgggatcattcataccacaaacctcagtatcacacaatatacccatgtaacaacctgcactctgcacatgtacccttagaatctaaaataaaagttgaaattattttttt

SEQ ID NO: 279034 - DNA, 3469 bp, Homo sapiens
acgcgaggagggttgaggggtctggaaggttctggtctcttaccgtataaagtttttcgagaaaccctttttccctccacaatggaactagacctaacaaaacaagctccgaggcagtttaggagaaaggaggacgcatttgcaagtgaggaagcagcacaaccctgggttttagataatttctaacagagaggccccagcaattcagcaggcagcgtcctgagtctttggcagcctggtccctctttcgcaaattctccacctttgcgaacagagggtctttaggacacagattcttaaaagtgcaggtgagccagccatgagagggtatcttgtggccatattcctgagtgctgtcttcctctattatgtactgcattgcatattatggggaacgaatgtctattgggtggcacctgtggaaatgaaacggagaaataagatccagccttgtttatcaaagccagcttttgcctctctgctgagtcagagctctgcatatattttaagaaaaggcattgaggaactcaatcaaaccagtattcttttcacacaggtttcatcagtttcacccttttctgtgtgcggctgattttagaaagattgcttccttgtatggtagcgataagtttgatttgccctatgggatgagaacatcagcggaatattttcgacttgctctttcaaaactgcagagttgtgatctctttgatgagtttgacaacataccctgtaaaaagtgtgtggtggttggtaatggaggagttttgaagaataagacattaggagaaaaaatcgactcctatgatgtaataataagaatgaataatggtcctgttttaggacatgaagaagaagttgggagaaggacaaccttccgacttttttatccagaatctgttttttcagatcctattcacaatgaccctaatacgacagtgattctcactgcttttaagccacatgatttaaggtggctgttggaattgttgatgggtgacaaaataaacactaatggtttttggaagaaaccagccttaaacctgatttataaaccttatcaaatccgaatattagatcctttcattatcagaacagcagcttatgaactgcttcattttccaaaagtgtttcccaaaaatcagaaacctaaacacccaacaacaggaattattgccatcacattggcgttttacatatgtcacgaagttcacctagctggttttaaatacaacttttctgacctcaagagtcctttgcactactatgggaatgccaccatgtctttgatgaataagaacgcgtatcacaatgtgactgcagagcagctctttttgaaggacattatagaaaaaaacctcgtaatcaacttgactcaagattgactctacagactcagaagatgatgctaacagtgttagttttatttttgtactgcaatttttagtttaaaatatgttggatgcactcgtcaaataattatgtatactgtctgttgctgcctggtgattcataaccaccagcttaatttctgtgaatactgtatatttaacttatgaaaaccaagaaatgtaaagataacaggaaaataagttttgattgcattgtttttaaaataagctagttttctgaggtgttttcacacgtctttttatagttacttcatcttagatttttgaagggatatgacttcctactaaggatttagtttaccacaacaattctgactacaataagacattttgaggaggatatttggctactgtaaacatggctggtggaaaatcacgattgtggcttgatgtggcaagccgaaaccacttggctctggaaatctaagttcatactggtttaattaagctctctcctgacaacccccagaattaaatgaaccatgattgtgaagagtaatttggtacaatgaaggcagtgtttgtttttaagttaaaggaaatgggctaaacataaagttcttattagataagtaaataactaaagaaagaatacaattactaaactctgatggctttgtattattttaaagaaatgaagtttaactttatacaatgaagctaagctaggcaagctcaagaaggaaaaaaaaatcttgaacattatttttttttgcctgacttacttattcattaaattttgaaggttttccacttgaagtaaattaggaaaggtaaagaagataacagaacaagtaaacacttaagaaaagtcaagctgaggccgggcagggtggctcacacctgtaatcctaacaaacactttgggaggccgagggaggcagctggattgcctgaactcaggagttcaagaccagcctggccaacatggtgaaacctcatctctactaaaatacaaaataattagctgggcgtggtggtatgcgctgtagtcccaggtactcgggaggctgaggcacgagaattgcttgagcccgggaggcagaggttgcagtgagccaagatcgcgccactgcacttcagcctgggtgacagagtgaggctgtcttctaaaaaatataaaaagtgaagttgggatttttggatttaaatggtacaaaaagaatatctcattttcccatgattaaagctaatcttcagatggaaagcttgcctggctacctagggtgcaccagagaatctgatccaatgcaagccagtcaatcctacaaatgtggtgagctagtcttccttcctatattttaataaatgtaaccaaaggccatctggaggtaggggaatgagaggtgaagaaacagaaaaatagaggttataaggatggaactaaaagttgtcagaagaggtatgagctgaagaaagaattactctcttttgaccaataaatacaattgggaaacactggaaaaccatggcttgattactgacaaccaacctgcctctctaaagagggtgtataaagggtgaaatacattagatttggctcagaaacagaatgcggtacttataaagcagaataaaggggagaacagtagtagttgatctaacccagattagacatgaataccagcatatgtttgcagagtcccacagttttgattcttcttataactttttgaggtgcaaaaggaaggtaccagaactggaatcgcatgtaatcaatcagtgtgattttcccctcataccacacagccataggctgcagtgtggctgctgaagttcaattgatataaagtaaatcaggcttcaaaaagaatggtgctgtgggtacacaaggacataaagatgggaacgatagacactgaggactgcggcggggggagcgaggggagcggggagggcaagggctgaaagactatgtattgggtactatgctcacaacctggatgatgggatcattcataccacaaacctcagtatcacacaatatacccatgtaacaacctgcactctgcacatgtacccttagaatctaaaataaaagttgaaattattttttt

SEQ ID NO: 279035 - DNA, 2688 bp, Homo sapiens
gcaggcagggggagagtggtggaattggaagctgaagcgaatgaataatggtcctgttttaggacatgaagaagaagttgggagaaggacaaccttccgacttttttatccagaatctgttttttcagatcctattcacaatgaccctaatacgacagtgattctcactgcttttaagccacatgatttaaggtggctgttggaattgttgatgggtgacaaaataaacactaatggtttttggaagaaaccagccttaaacctgatttataaaccttatcaaatccgaatattagatcctttcattatcagaacagcagcttatgaactgcttcattttccaaaagtgtttcccaaaaatcagaaacctaaacacccaacaacaggaattattgccatcacattggcgttttacatatgtcacgaagttcacctagctggttttaaatacaacttttctgacctcaagagtcctttgcactactatgggaatgccaccatgtctttgatgaataagaacgcgtatcacaatgtgactgcagagcagctctttttgaaggacattatagaaaaaaacctcgtaatcaacttgactcaagattgactctacagactcagaagatgatgctaacagtgttagttttatttttgtactgcaatttttagtttaaaatatgttggatgcactcgtcaaataattatgtatactgtctgttgctgcctggtgattcataaccaccagcttaatttctgtgaatactgtatatttaacttatgaaaaccaagaaatgtaaagataacaggaaaataagttttgattgcattgtttttaaaataagctagttttctgaggtgttttcacacgtctttttatagttacttcatcttagatttttgaagggatatgacttcctactaaggatttagtttaccacaacaattctgactacaataagacattttgaggaggatatttggctactgtaaacatggctggtggaaaatcacgattgtggcttgatgtggcaagccgaaaccacttggctctggaaatctaagttcatactggtttaattaagctctctcctgacaacccccagaattaaatgaaccatgattgtgaagagtaatttggtacaatgaaggcagtgtttgtttttaagttaaaggaaatgggctaaacataaagttcttattagataagtaaataactaaagaaagaatacaattactaaactctgatggctttgtattattttaaagaaatgaagtttaactttatacaatgaagctaagctaggcaagctcaagaaggaaaaaaaaatcttgaacattatttttttttgcctgacttacttattcattaaattttgaaggttttccacttgaagtaaattaggaaaggtaaagaagataacagaacaagtaaacacttaagaaaagtcaagctgaggccgggcagggtggctcacacctgtaatcctaacaaacactttgggaggccgagggaggcagctggattgcctgaactcaggagttcaagaccagcctggccaacatggtgaaacctcatctctactaaaatacaaaataattagctgggcgtggtggtatgcgctgtagtcccaggtactcgggaggctgaggcacgagaattgcttgagcccgggaggcagaggttgcagtgagccaagatcgcgccactgcacttcagcctgggtgacagagtgaggctgtcttctaaaaaatataaaaagtgaagttgggatttttggatttaaatggtacaaaaagaatatctcattttcccatgattaaagctaatcttcagatggaaagcttgcctggctacctagggtgcaccagagaatctgatccaatgcaagccagtcaatcctacaaatgtggtgagctagtcttccttcctatattttaataaatgtaaccaaaggccatctggaggtaggggaatgagaggtgaagaaacagaaaaatagaggttataaggatggaactaaaagttgtcagaagaggtatgagctgaagaaagaattactctcttttgaccaataaatacaattgggaaacactggaaaaccatggcttgattactgacaaccaacctgcctctctaaagagggtgtataaagggtgaaatacattagatttggctcagaaacagaatgcggtacttataaagcagaataaaggggagaacagtagtagttgatctaacccagattagacatgaataccagcatatgtttgcagagtcccacagttttgattcttcttataactttttgaggtgcaaaaggaaggtaccagaactggaatcgcatgtaatcaatcagtgtgattttcccctcataccacacagccataggctgcagtgtggctgctgaagttcaattgatataaagtaaatcaggcttcaaaaagaatggtgctgtgggtacacaaggacataaagatgggaacgatagacactgaggactgcggcggggggagcgaggggagcggggagggcaagggctgaaagactatgtattgggtactatgctcacaacctggatgatgggatcattcataccacaaacctcagtatcacacaatatacccatgtaacaacctgcactctgcacatgtacccttagaatctaaaataaaagttgaaattattttttt

SEQ ID NO: 279036 - DNA, 3259 bp, Homo sapiens
  misc_feature (2090)..(2090): n is a, c, g, or t
  misc_feature (3228)..(3228): n is a, c, g, or t
  misc_feature (3258)..(3259): n is a, c, g, or t
cttgaggattcagtctggtcctgaagggtttggggggagactgcgaccagaagatgtttccatgtcctaattaatgggtgatggtggttgttagtctgactgttgccacggtgatgaagggagacatccaagtgctggtttcagtactgaggcgaatacagggaatttcaacaggctccaggtcttactatgcagcctgaagtgggaccatcccttaaacccactccatcctgtggccacgatgggggccaggacacctttgccttctttctgggtttctttctttgccgagacagggattttgttcccaggaggcactccctggcccatgggatctcagcattcaaagcagcacaggaaacctgggcccctgaaacggggccaccgaagagatcggagaacaaccaggaggaagtactggaaggaaggaagggagatcgctcgtgtcttagatgatgagggcagaaacctgaggcagcagaagcttgatcggcagcgggccctgctggagcagaagcagaagaagaagcgccaggagcccctgatggtgcaggccaatgcagatgggcggccccggagccggcgggcccggcagtcagaggaacaagcccccctggtggagtcctacctcagcagcagtggcagcaccagctaccaagttcaagaggccgactcactcgccagtgtgcagctgggagccacgcgcccaacagcaccagcttcagccaagagaaccaaggcggcagctacagcagggggccagggtggcgccgctaggaaggagaagaagggaaagcacaaaggcaccagcgggccagcagcactggcagaagacaagtctgaggcccaaggcccagtgcagattctgactgtgggccagtcagaccacgcccaggacgcaggggagacggcagctggtgggggcgaacggcccagcgggcaggatctccgtgccacgatgcagaggaagggcatctccagcagcatgagctttgacgaggatgaggaggatgaggaggagaatagctccagctcctcccagctaaatagtaacacccgccccagctctgctactagcaggaagtccgtcagggaggcagcctcagcccctagcccaacagctccagagcaaccagtggacgttgaggtccaggatcttgaggagtttgcactgaggccggccccccagggtatcaccatcaaatgccgcatcactcgggacaagaaagggatggaccggggcatgtaccccacctactttctgcacctggaccgtgaggatgggaagaaggtgttcctcctggcgggaaggaagagaaagaagagtaaaacttccaattacctcatctctgtggacccaacagacttgtctcgaggaggggacagctatatcgggaaactgcggtccaacttgatgggcaccaagttcactgtttatgacaatggagtcaaccctcagaaggcctcatcctccactttggaaagtggaaccttacgtcaggagctggcagctgtgtgctacgagacaaacgtcttaggcttcaaggggcctcggaagatgagcgtgattgtcccaggcatgaacatggttcatgagagagtctctatccgcccccgcaacgagcatgagacactgctagcacgctggcagaataagaacacggagagtatcatcgagctgcaaaacaagacacctgtctggaatgatgacacacagtcctatgtactcaacttccatgggcgcgtcacacaggcctccgtgaagaacttccagatcatccatggcaatgacccggactacatcgtgatgcagtttggccgggtagcagaggatgtgttcaccatggattacaactacccgctgtgtgcactgcaggcctttgccattgccctgtccagcttcgacagcaagctggcgtgcgagtagaggcctcttcgtgccctttggggttgcccagcctggagcggagcttgcctgcctgcctgtggagacagccctgcctatcctctgtatataggccttccgccagatgaagctttggccctcagtgggctccctggcccagccagccaggaactggctcctttgnctctgctactgaggcaggggagtagtggagagcgggtgggtgggtgttgaagggattgagaataattctttccatgccacgagatcaacacacactcccacccttggggtagtagtgtgttgtagtcgtacttaccaagctgagcaacctcttcagctgggaaggccgcaaaaggcatagagggagaggaagcacactgcagggctgctgtggcccagtcgtccgctcagccaaggagtcagatggcaatgggtactccagcaggtaggggcacagtgaatgtgtgtatgtatgaaggccacatcaactttatgtagcaaagggcttggtggccaagcctggcccttaaacaactgcagaaagcccttcaacttcagaaggcctcactcaagcctgagagaagttgggagggtggtggggacaggtaagtggcaggaccctgtcaggattgcaggtgcctggcttgctgtggctatgggaatcagctggtggctaggtttctagcgcatttgatttctccaggtttgctgtgtctcacagaggcagtaggaacccagctctcagggctgtcttggtggatgggccctgcaagacacaggctcagcatgcagaagtgcatgaacagggtccctggatcagggttgttctgggagtcctgtcagcttccccaggagctctctgctgagcagcccagcacaacccccaggaaacacaaatggggtccaggtcaccagcctgactgcacacagctaggcatgcctgggaatcctgctgccagagaaccattcccaagccatggcatgctccttgaagaatctctcctctctctctctctctggaaagacccaactttctcactgctgtcagccaagtcatggttggtaaccatgtaggttcttgggagggaatgggacagggtgaataaagcagggaatattttagaaccacaagagatcagcagtggcaggacccttaggaatctagtacaaccttgttgctttaggtgagtcacactcagaaaatggggcttgccctgggtcacctagctggttaatggcagcattcagaacttcaagttctcttgatttctttgttcccactgtcccccaagaaactagtatctctggcctcctggggnccattctgcatgccctccccacttcccccnn

SEQ ID NO: 279037 - DNA, 2102 bp, Homo sapiens
taggagagtccgatgttaatcaggacgaggctggcacctcacgggcaagccctgaaaacccctctttcgctctgcagtgtcttagatgatgagggcagaaacctgaggcagcagaagcttgatcggcaggtgagtaggcctggggccgggtagaagggaagagtctgggctgggatctctgagggcagaggggcagggctgtccatcttccctggatgatcccgtctgattgggggatgggattcccatgtggaagaagagaggtgcactctctcccagctcagcactaaccctgccgcggcacatgggctcctgccttcaggcagctgggtgactgcagttggagggctggctgtgctgtgatcctgccagggcagccacctgggccctgttttgcctccctttcctggaccccaagtgttggggtgccaaggacatggggccttggcccaaggtgggccgtggaccccccgataactgggagcccgcccttcctggtggaggcagtgggtcagccaacctctgtgcctccatagcgggccctgctggagcagaagcagaagaagaagcgccaggagcccctgatggtgcaggccaatgcagatgggcggccccggagccggcgggcccggcagtcagaggaacaagcccccctggtggagtcctacctcagcagcagtggcagcaccagctaccaagttcaagaggccgactcactcgccagtgtgcagctgggagccacgcgcccaacagcaccagcttcagccaagagaaccaaggcggcagctacagcagggggccagggtggcgccgctaggaaggagaagaagggaaagcacaaaggcaccagcgggccagcagcactggcagaagacaagtctgaggcccaaggcccagtgcagattctgactgtgggccagtcagaccacgcccaggacgcaggggagacggcagctggtgggggcgaacggcccagcgggcaggatctccgtgccacgatgcagaggaagggcatctccagcagcatgagctttgacgaggatgaggaggatgaggaggagaatagctccagctcctcccagctaaatagtaacacccgccccagctctgctactagcaggaagtccgtcagggaggcagcctcagcccctagcccaacagctccagagcaaccagtggacgttgaggtccaggatcttgaggagtttgcactgaggccggccccccagggtatcaccatcaaatgccgcatcactcgggacaagaaagggatggaccggggcatgtaccccacctactttctgcacctggaccgtgaggatgggaagaaggtgttcctcctggcgggaaggaagagaaagaagagtaaaacttccaattacctcatctctgtggacccaacagacttgtctcgaggaggggacagctatatcgggaaactgcggtccaacttgatgggcaccaagttcactgtttatgacaatggagtcaaccctcagaaggcctcatcctccactttggaaagtggaaccttacgtcaggagctggcagctgtgtgctacgagacaaacgtcttaggcttcaaggggcctcggaagatgagcgtgattgtcccaggcatgaacatggttcatgagagagtctctatccgcccccgcaacgagcatgagacactgctagcacgctggcagaataagaacacggagagtatcatcgagctgcaaaacaagacacctgtctggaatgatgacacacagtcctatgtactcaacttccatgggcgcgtcacacaggcctccgtgaagaacttccagatcatccatggcaatgaccaaacccagagatgtgatacaattttgatctgacagaacaaatactggaatattttgggcttttctaataatcataggagcacagacttgtaaaagaacaaatgccacagaaaatgaggttaaaggacacaaactgggagtgcattgaattgtatcactcactggattaagaaccaaaagatccatgttcaagtcctagttctgccttgttagttgtgaattttggggcaaaacacttaaacattgagtaaacatttcttatgtgaaaaa

SEQ ID NO: 279038 - DNA, 3005 bp, Homo sapiens
  misc_feature (36)..(36): n is a, c, g, or t
  misc_feature (1836)..(1836): n is a, c, g, or t
  misc_feature (2974)..(2974): n is a, c, g, or t
  misc_feature (3004)..(3005): n is a, c, g, or t
tggcgtgcagcaggggcctcggcggggcccagcccnccggtcccggggaggatacgtcccgggggcggcccgggagctgagcaggccccccgcgccggcccctccgggccccggcctccagagccgcagccaccgccccgcccccgagagacatgacttccaagccgcattccgactggattccctacagtgtcttagatgatgagggcagaaacctgaggcagcagaagcttgatcggcagcgggccctgctggagcagaagcagaagaagaagcgccaggagcccctgatggtgcaggccaatgcagatgggcggccccggagccggcgggcccggcagtcagaggaacaagcccccctggtggagtcctacctcagcagcagtggcagcaccagctaccaagttcaagaggccgactcactcgccagtgtgcagctgggagccacgcgcccaacagcaccagcttcagccaagagaaccaaggcggcagctacagcagggggccagggtggcgccgctaggaaggagaagaagggaaagcacaaaggcaccagcgggccagcagcactggcagaagacaagtctgaggcccaaggcccagtgcagattctgactgtgggccagtcagaccacgcccaggacgcaggggagacggcagctggtgggggcgaacggcccagcgggcaggatctccgtgccacgatgcagaggaagggcatctccagcagcatgagctttgacgaggatgaggaggatgaggaggagaatagctccagctcctcccagctaaatagtaacacccgccccagctctgctactagcaggaagtccgtcagggaggcagcctcagcccctagcccaacagctccagagcaaccagtggacgttgaggtccaggatcttgaggagtttgcactgaggccggccccccagggtatcaccatcaaatgccgcatcactcgggacaagaaagggatggaccggggcatgtaccccacctactttctgcacctggaccgtgaggatgggaagaaggtgttcctcctggcgggaaggaagagaaagaagagtaaaacttccaattacctcatctctgtggacccaacagacttgtctcgaggaggggacagctatatcgggaaactgcggtccaacttgatgggcaccaagttcactgtttatgacaatggagtcaaccctcagaaggcctcatcctccactttggaaagtggaaccttacgtcaggagctggcagctgtgtgctacgagacaaacgtcttaggcttcaaggggcctcggaagatgagcgtgattgtcccaggcatgaacatggttcatgagagagtctctatccgcccccgcaacgagcatgagacactgctagcacgctggcagaataagaacacggagagtatcatcgagctgcaaaacaagacacctgtctggaatgatgacacacagtcctatgtactcaacttccatgggcgcgtcacacaggcctccgtgaagaacttccagatcatccatggcaatgacccggactacatcgtgatgcagtttggccgggtagcagaggatgtgttcaccatggattacaactacccgctgtgtgcactgcaggcctttgccattgccctgtccagcttcgacagcaagctggcgtgcgagtagaggcctcttcgtgccctttggggttgcccagcctggagcggagcttgcctgcctgcctgtggagacagccctgcctatcctctgtatataggccttccgccagatgaagctttggccctcagtgggctccctggcccagccagccaggaactggctcctttgnctctgctactgaggcaggggagtagtggagagcgggtgggtgggtgttgaagggattgagaataattctttccatgccacgagatcaacacacactcccacccttggggtagtagtgtgttgtagtcgtacttaccaagctgagcaacctcttcagctgggaaggccgcaaaaggcatagagggagaggaagcacactgcagggctgctgtggcccagtcgtccgctcagccaaggagtcagatggcaatgggtactccagcaggtaggggcacagtgaatgtgtgtatgtatgaaggccacatcaactttatgtagcaaagggcttggtggccaagcctggcccttaaacaactgcagaaagcccttcaacttcagaaggcctcactcaagcctgagagaagttgggagggtggtggggacaggtaagtggcaggaccctgtcaggattgcaggtgcctggcttgctgtggctatgggaatcagctggtggctaggtttctagcgcatttgatttctccaggtttgctgtgtctcacagaggcagtaggaacccagctctcagggctgtcttggtggatgggccctgcaagacacaggctcagcatgcagaagtgcatgaacagggtccctggatcagggttgttctgggagtcctgtcagcttccccaggagctctctgctgagcagcccagcacaacccccaggaaacacaaatggggtccaggtcaccagcctgactgcacacagctaggcatgcctgggaatcctgctgccagagaaccattcccaagccatggcatgctccttgaagaatctctcctctctctctctctctggaaagacccaactttctcactgctgtcagccaagtcatggttggtaaccatgtaggttcttgggagggaatgggacagggtgaataaagcagggaatattttagaaccacaagagatcagcagtggcaggacccttaggaatctagtacaaccttgttgctttaggtgagtcacactcagaaaatggggcttgccctgggtcacctagctggttaatggcagcattcagaacttcaagttctcttgatttctttgttcccactgtcccccaagaaactagtatctctggcctcctggggnccattctgcatgccctccccacttcccccnn

SEQ ID NO: 279039 - DNA, 829 bp, Homo sapiens
taggagagtccgatgttaatcaggacgaggctggcacctcacgggcaagccctgaaaacccctctttcgctctgcagtgtcttagatgatgagggcagaaacctgaggcagcagaagcttgatcggcaggtgagtaggcctggggccgggtagaagggaagagtctgggctgggatctctgagggcagaggggcagggctgtccatcttccctggatgatcccgtctgattgggggatgggattcccatgtggaagaagagaggtgcactctctcccagctcagcactaaccctgccgcggcacatgggctcctgccttcaggcagctgggtgactgcagttggagggctggctgtgctgtgatcctgccagggcagccacctgggccctgttttgcctccctttcctggaccccaagtgttggggtgccaaggacatggggccttggcccaaggtgggccgtggaccccccgataactgggagcccgcccttcctggtggaggcagtgggtcagccaacctctgtgcctccatagcgggccctgctggagcagaagcagaagaagaagcgccaggagcccctgatggtgcaggccaatgcagatgggcggccccggagccggcgggcccggcagtcagaggaacaagcccccctggtggagtcctacctcagcagcagtggcagcaccagctaccaaggtataccttgcctgctgcccaatcccgtcactgcttcggggagcccgtcacttcctgcccacctaggcaggtacggactggtcctgacgggggatgcccaggctgtgtatggcttccagcccaggcagac

SEQ ID NO: 279040 - DNA, 810 bp, Homo sapiens
cactcttgttgcccaggctggagtgcaatggcgcgatctcggctcaccacaatctctgcctcccaggttcaagcaattctcctgcctcagcctccggagtagctgtgattacaggcatgcaccaccacggctggctaattttgtatttttagtagagatgggggtttcaccatgttggtcaggctggtctcgaactcccgatctcagggaatatctttctccaccactttctcttagatttatgtgagtcctcatgtatcaggccaaggcggtgggaccgaagttacctctggagtatgaaaataagcaacaccattatgaaaagtcaaaagaactttggagtcaaacagtcctgcatttgaaggctagtgctaccactcaccattaggctatttaaccccatacttcttaaagttggataagggatggatggtataccaggagatatgaaaaagcagaggctgaacatagtaatcttcctacagaatcagttttattcaattgtttttgggaaatatttttatattcaaataaacaatatgatattatggaacagaatgcaaattatacatgatgtttttgcataaatcatgagactttaaagaaaatttgcaattccagtatgctgcagtgggttaggaaccacaacatgccaagattaactctcctctacctttaggagtatttcagcagaaacattttaaacaatgacttatcttttgggattgaattttctatttacaaaaatagagataacaatacatcatgggattctatgaagattaaatgaaaactcataacattgaccct

SEQ ID NO: 279041 - DNA, 695 bp, Homo sapiens
tcccccagcctcgctgccgccttgcagtttgatctcagactgctgtgctagcaatcagcgagactccgtgggcgtaggaccctccgagccagggaatatctttctccaccactttctcttagatttatgtgagtcctcatgtatcaggccaaggcggtgggaccgaagttacctctggagtatgaaaataagcaacaccattatgaaaagtcaaaagaactttggagtcaaacagtcctgcatttgaaggctagtgctaccactcaccattaggctatttaaccccatacttcttaaagttggataagggatggatggtataccaggagatatgaaaaagcagaggctgaacatagtaatcttcctacagaatcagttttattcaattgtttttgggaaatatttttatattcaaataaacaatatgatattatggaacagaatgcaaattatacatgatgtttttgcataaatcatgagactttaaagaaaatttgcaattccagtatgctgcagtgggttaggaaccacaacatgccaagattaactctcctctacctttaggagtatttcagcagaaacattttaaacaatgacttatcttttgggattgaattttctatttacaaaaatagagataacaatacatcatgggattctatgaagattaaatgaaaactcataacattgaccct

SEQ ID NO: 279042 - DNA, 434 bp, Homo sapiens
aaggatccttaattaaattaatcccccccccccccgcttccgccacggccgtctctggagagcagcagccatggccctacgctaccctatggccgtgggcctcaacaagggccacaaagtgaccaagaacgtgagcaagcccaggcacagccgacgccgcgggcgtctgaccaaacacaccaagttcgtgcgggacatgattcgggaggtgtgtggctttgccccgtacgagcggcgcgccatggagttactgaaggtctccaaggacaaacgggccctcaaatttatcaagaaaagggtggggacgcacatccgcgccaagaggaagcgggaggagctgagcaacgtactggccgccatgaggaaagctgctgccaagaaagactgagcccctcccctgccctctccctgaaataaagaacagcttgacagaa

SEQ ID NO: 279043 - DNA, 432 bp, Homo sapiens
ctctagagcggccgcctactactactaaattcgcggccgctcgacggcgtctctggagagcagcagccatggccctacgctaccctatggccgtgggcctcaacaagggccacaaagtgaccaagaacgtgagcaagcccaggcacagccgacgccgcgggcgtctgaccaaacacaccaagttcgtgcgggacatgattcgggaggtgtgtggctttgccccgtacgagcggcgcgccatggagttactgaaggtctccaaggacaaacgggccctcaaatttatcaagaaaagggtggggacgcacatccgcgccaagaggaagcgggaggagctgagcaacgtactggccgccatgaggaaagctgctgccaagaaagactgagcccctcccctgccctctccctgaaataaagaacagcttgacagaa

SEQ ID NO: 279044 - DNA, 412 bp, Homo sapiens
  misc_feature (1)..(1): n is a, c, g, or t
  misc_feature (6)..(7): n is a, c, g, or t
  misc_feature (10)..(13): n is a, c, g, or t
  misc_feature (16)..(16): n is a, c, g, or t
ngggcnncannnnttnggcacgagggccgtctctggagagcagcagccatggccctacgctaccctatggccgtgggcctcaacaagggccacaaagtgaccaagaacgtgagcaagcccaggcacagccgacgccgcgggcgtctgaccaaacacaccaagttcgtgcgggacatgattcgggaggtgtgtggctttgccccgtacgagcggcgcgccatggagttactgaaggtctccaaggacaaacgggccctcaaatttatcaagaaaagggtggggacgcacatccgcgccaagaggaagcgggaggagctgagcaacgtactggccgccatgaggaaagctgctgccaagaaagactgagcccctcccctgccctctccctgaaataaagaacagcttgacagaa

SEQ ID NO: 279045 - DNA, 412 bp, Homo sapiens
gctggtaccgggccggagtgtagggatcgtctctggagagcagcagccatggccctacgctaccctatggccgtgggcctcaacaagggccacaaagtgaccaagaacgtgagcaagcccaggcacagccgacgccgcgggcgtctgaccaaacacaccaagttcgtgcgggacatgattcgggaggtgtgtggctttgccccgtacgagcggcgcgccatggagttactgaaggtctccaaggacaaacgggccctcaaatttatcaagaaaagggtggggacgcacatccgcgccaagaggaagcgggaggagctgagcaacgtactggccgccatgaggaaagctgctgccaagaaagactgagcccctcccctgccctctccctgaaataaagaacagcttgacagaa

SEQ ID NO: 279046 - DNA, 608 bp, Homo sapiens
  misc_feature (475)..(475): n is a, c, g, or t
  misc_feature (481)..(481): n is a, c, g, or t
gtgcctggtaccggcccgggagtttatgggatggagagcagcagccatggccctacgctaccctatggccgtgggcctcaacaagggccacaaagtgaccaagaacgtgagcaagcccaggcacagccgacgccgcgggcgtctgaccaaacacaccaagttcgtgcgggacatgattcgggaggtgtgtggctttgccccgtacgagcggcgcgccatggagttactgaaggtctccaaggacaaacgggccctcaaatttatcaagaaaagggtggggacgcacatccgcgccaagaggaagcgggaggagctgagcaacgtactggccgccatgaggaaagctgctgccaagaaagactgagcccctcccctgccctctccctgaaataaagaacagcttgacagaaaaaaaaaaaaaaaaaaaaaaaaaaaaaaaaaaaaaaaaaaaaaaaaaaaaccaaaaaaaaaaaanaaaaanaaaaaaggccgggtttcttggtggccgctcttggccccccctttttttacccacgtaactatttttggtgggggccctatttaagactatttggggttcccccttatgggggggcctttcctttgcg

SEQ ID NO: 279047 - DNA, 618 bp, Homo sapiens
  misc_feature (1)..(1): n is a, c, g, or t
  misc_feature (6)..(7): n is a, c, g, or t
  misc_feature (10)..(13): n is a, c, g, or t
  misc_feature (16)..(16): n is a, c, g, or t
ngggcnncannnnttnggcacgagggccgtctctggagagcagcagccatggccctacgctaccctatggccgtgggcctcaacaagggccacaaagtgaccaagaacgtgagcaagcccaggcacagccgacgccgcgggcgtctgaccaaacacaccaagttcgtgcgggacatgattcgggaggtgtgtggctttgccccgtacgagcggcgcgccatggagttactgaaggtctccaaggacaaacgggccctcaaatttatcaagaaaagggtggggacgcacatccgcgccaagaggaagcgggaggagctgagcaacgtactggccgccatgaggaaagctgctgccaagaaagactgagcccctcccctgccctctccctgaaataaagaacagcttgacagaagccctggctctcctgctgtccgtgggtgggtgtgggtgtgtcgggggcccgcagtcccctgtctggtgcccgctctgagccacaccctctccgggtgctgcctggtcgtgaatcaaaagccgtggcccgcccacccttcccggggcagcaggtgaggaagccgccgtactgcaaatgactttaatcattaaatagcttctatgcca

SEQ ID NO: 279048 - DNA, 643 bp, Homo sapiens
taggctagtacgaggctggtttgcggcgttctggagagcagcagccatggccctacgctaccctatggccgtgggcctcaacaagggccacaaagtgaccaagaacgtgagcaagcccaggcacagccgacgccgcgggcgtctgaccaaacacaccaagttcgtgcgggacatgattcgggaggtgtgtggctttgccccgtacgagcggcgcgccatggagttactgaaggtctccaaggacaaacgggccctcaaatttatcaagaaaagggtggggacgcacatccgcgccaagaggaagcgggaggagctgagcaacgtactggccgccatgaggaaagctgctgccaagaaagactgagcccctcccctgccctctccctgaaataaagaacagcttgacagaaagaaattgaaaaaataaagataatgataataaaaacgctcggcggcctctatattgtcgggggcggggaaaaagggggtgtttttagaagtggcgcccttgtggcccatataggtggtttccctggacccagtttttttgtgtccaaaggtgggaaaaatctggcgcgggccccccatatatggggggccggatattaaatttggaaaaacccggggttacccggggttaaga

SEQ ID NO: 279049 - DNA, 565 bp, Homo sapiens
  misc_feature (433)..(433): n is a, c, g, or t
  misc_feature (435)..(436): n is a, c, g, or t
gctggtaccgggccggagtgtagggatcgtctctggagagcagcagccatggccctacgctaccctatggccgtgggcctcaacaagggccacaaagtgaccaagaacgtgagcaagcccaggcacagccgacgccgcgggcgtctgaccaaacacaccaagttcgtgcgggacatgattcgggaggtgtgtggctttgccccgtacgagcggcgcgccatggagttactgaaggtctccaaggacaaacgggccctcaaatttatcaagaaaagggtggggacgcacatccgcgccaagaggaagcgggaggagctgagcaacgtactggccgccatgaggaaagctgctgccaagaaagactgagcccctcccctgccctctccctgaaataaagaacagcttgacagaaaaaaaaaaaaaaaaaaatttntnnctctctcttttcttttaattcacccctcttcccattttcccttccccttcaatttccctcttcttttctttttctccctttttcccaacaactctatatcaactctttttcatccccccaattttcccc

SEQ ID NO: 279050 - DNA, 1080 bp, Homo sapiens
  misc_feature (949)..(949): n is a, c, g, or t
  misc_feature (952)..(952): n is a, c, g, or t
  misc_feature (962)..(962): n is a, c, g, or t
  misc_feature (967)..(967): n is a, c, g, or t
  misc_feature (969)..(969): n is a, c, g, or t
  misc_feature (1027)..(1027): n is a, c, g, or t
  misc_feature (1039)..(1039): n is a, c, g, or t
  misc_feature (1069)..(1069): n is a, c, g, or t
agtcgtggtgtcttgcggctctgagactccagagaagggctgcggtctcgcagcggagggccgctgggaaatggacgctttaaggcccgggccgccgcaaggctgtctgggaaatgtagtcagcacggcgctgtttgcacctggccgcggagcctcctgggaaatgtagttcggcccggccctggcaccgtgaggggaaagaggcgtcaggtgcctggctgaagcctgaaggtgacccgaaaacaagtcagagcccgagagatccacccgcgcccgcgcgggggaccaagggcccggatttaagaagagtgtgcctacaaggcggttgtcacggcaacgagagggcgggattgttcgagcgctgcggccccctcacgtgatcgattcggaggcggggcgtccgcccagtgggcggggccgggcccctgctgggaggcgaagaccaggcgggcactgttgcccggcgacgctccggcgctgggtccccgaggcccggcccctccccgggaggaggtgggcttcgagtcacgtgacccgtgccctacgggagggggtgcggtcggggacccggcaggaggcggccgagaagagaggaccgtgggggcgttcgcgtggctcccagcccgggaccccacccccgctggacagtgggggaaactgaggcctgagcggagtgaccaccccggctatggccagccagcctccagggagcgcgagtgctgctgacaggggccaacgctggtgttggtgaggagctggcctatcactacgcgcgtctgggctcccacctggtgctcactgcccacactgaggctctcctgcagaaggggtggtagggaactgccggaagctgggcgcccccaaggtcttctacatcgcggcggacatggcctcccctgaggcgcccgagagcgtggtgcagtttgcgctggacaagctgggctggacngcntggcgggctngactncncgtgctgaccacattcacgcgctatggccgcacgcgagcacgcagccctagccactcnctgctcatgcangtaactttgtgagctcttgcactgacttcncgcctcttgcc

SEQ ID NO: 279051 - DNA, 1490 bp, Homo sapiens
agtcgtggtgtcttgcggctctgagactccagagaagggctgcggtctcgcagcggagggccgctgggaaatggacgctttaaggcccgggccgccgcaaggctgtctgggaaatgtagtcagcacggcgctgtttgcacctggccgcggagcctcctgggaaatgtagttcggcccggccctggcaccgtgaggggaaagaggcgtcaggtgcctggctgaagcctgaaggtgacccgaaaacaagtcagagcccgagagatccacccgcgcccgcgcgggggaccaagggcccggatttaagaagagtgtgcctacaaggcggttgtcacggcaacgagagggcgggattgttcgagcgctgcggccccctcacgtgatcgattcggaggcggggcgtccgcccagtgggcggggccgggcccctgctgggaggcgaagaccaggcgggcactgttgcccggcgacgctccggcgctgggtccccgaggcccggcccctccccgggaggaggtgggcttcgagtcacgtgacccgtgccctacgggagggggtgcggtcggggacccggcaggaggcggccgagaagagaggaccgtgggggcgttcgcgtggctcccagcccgggaccccacccccgctggacagtgggggaaactgaggcctgagcggagtgaccaccccggctatggccagccagcctccagggagcgcgagtgctgctgacaggggccaacgctggtgttggtgaggagctggcctatcactacgcgcgtctgggctcccacctggtgctcactgcccacactgaggctctcctgcagaagggtcggcccgaaataggcggagttgggattcgaactcatttcacaggcagagggaggagagcagccatagccacctccactggttccgactccagctcccgggctcgcaggagtaaacgcgcatgctcagggagctcggtcgcgcatgctcagcgcaacggcggggaagactccagccgccagggggagcgcgtgccgttcttgcctctctggcctgcgcctcctgagccgagtagatatcccggagttccgcgcggcgccagcccttccgccacggccgtctctggagagcagcagccatggccctacgctaccctatggccgtgggcctcaacaagggccacaaagtgaccaagaacgtgagcaagcccaggcacagccgacgccgcgggcgtctgaccaaacacaccaagttcgtgcgggacatgattcgggaggtgtgtggctttgccccgtacgagcggcgcgccatggagttactgaaggtctccaaggacaaacgggccctcaaatttatcaagaaaagggtggggacgcacatccgcgccaagaggaagcgggaggagctgagcaacgtactggccgccatgaggaaagctgctgccaagaaagactgagcccctcccctgccctctccctgaaataaagaacagcttgacagaa

SEQ ID NO: 279052 - DNA, 1954 bp, Homo sapiens
  misc_feature (1565)..(1565): n is a, c, g, or t
  misc_feature (1584)..(1584): n is a, c, g, or t
  misc_feature (1586)..(1586): n is a, c, g, or t
  misc_feature (1603)..(1603): n is a, c, g, or t
  misc_feature (1605)..(1605): n is a, c, g, or t
  misc_feature (1610)..(1610): n is a, c, g, or t
  misc_feature (1622)..(1623): n is a, c, g, or t
  misc_feature (1638)..(1638): n is a, c, g, or t
  misc_feature (1640)..(1640): n is a, c, g, or t
  misc_feature (1644)..(1644): n is a, c, g, or t
  misc_feature (1651)..(1651): n is a, c, g, or t
  misc_feature (1659)..(1659): n is a, c, g, or t
  misc_feature (1661)..(1661): n is a, c, g, or t
  misc_feature (1667)..(1667): n is a, c, g, or t
  misc_feature (1669)..(1670): n is a, c, g, or t
  misc_feature (1674)..(1674): n is a, c, g, or t
  misc_feature (1688)..(1688): n is a, c, g, or t
  misc_feature (1694)..(1694): n is a, c, g, or t
agtcgtggtgtcttgcggctctgagactccagagaagggctgcggtctcgcagcggagggccgctgggaaatggacgctttaaggcccgggccgccgcaaggctgtctgggaaatgtagtcagcacggcgctgtttgcacctggccgcggagcctcctgggaaatgtagttcggcccggccctggcaccgtgaggggaaagaggcgtcaggtgcctggctgaagcctgaaggtgacccgaaaacaagtcagagcccgagagatccacccgcgcccgcgcgggggaccaagggcccggatttaagaagagtgtgcctacaaggcggttgtcacggcaacgagagggcgggattgttcgagcgctgcggccccctcacgtgatcgattcggaggcggggcgtccgcccagtgggcggggccgggcccctgctgggaggcgaagaccaggcgggcactgttgcccggcgacgctccggcgctgggtccccgaggcccggcccctccccgggaggaggtgggcttcgagtcacgtgacccgtgccctacgggagggggtgcggtcggggacccggcaggaggcggccgagaagagaggaccgtgggggcgttcgcgtggctcccagcccgggaccccacccccgctggacagtgggggaaactgaggcctgagcggagtgaccaccccggctatggccagccagcctccagggagcgcgagtgctgctgacaggggccaacgctggtgttggtgaggagctggcctatcactacgcgcgtctgggctcccacctggtgctcactgcccacactgaggctctcctgcagaagggtcggcccgaaataggcggagttgggattcgaactcatttcacaggcagagggaggagagcagccatagccacctccactggttccgactccagctcccgggctcgcaggagtaaacgcgcatgctcagggagctcggtcgcgcatgctcagcgcaacggcggggaagactccagccgccagggggagcgcgtgccgttcttgcctctctggcctgcgcctcctgagccgagtagatatcccggagttccgcgcggcgccagcccttccgccacggccgtctctggagagcagcagccatggccctacgctaccctatggccgtgggcctcaacaagggccacaaagtgaccaagaacgtgagcaagcccaggcacagccgacgccgcgggcgtctgaccaaacacaccaagttcgtgcgggacatgattcgggaggtgtgtggctttgccccgtacgagcggcgcgccatggagttactgaaggtctccaaggacaaacgggccctcaaatttatcaagaaaagggtggggacgcacatccgcgccaagaggaagcgggaggagctgagcaacgtactggccgccatgaggaaagctgctgccaagaaagactgagcccctcccctgccctctccctgaaataaagaacagcttgacagaaaaaaaaaaaaaaaaaaaaaaaaaaaaaaaaaaaaaaaaaaaaaaaaaaaaaaaaaaaaaaaaaaaaaaaaaaccnttgtgggccgcttgggccnantcaattttaaattgggnangtttntgcttgcggccnnatttggggctaattngnccanttcgccntatagggngnggtttnannattnattgcccgggtttnacacgnggggactgggaaaacccttggggttaccaaatttattggccttgggaaaaattccccttttcccagttggtgaaaagcaaaaaggccgaccggatcgccctcccaaaagttggccacctaatgggaatggaaatttaagcgtaatattttgtaaaaaccggttaaatttttggaaaaagctctttttataccaaagggcggaattggaaaatccttttaaattaaagataaaccggggtgggggttttccatttggctcc

SEQ ID NO: 279053 - DNA, 1786 bp, Homo sapiens
  misc_feature (1565)..(1565): n is a, c, g, or t
  misc_feature (1584)..(1584): n is a, c, g, or t
  misc_feature (1586)..(1586): n is a, c, g, or t
  misc_feature (1603)..(1603): n is a, c, g, or t
  misc_feature (1605)..(1605): n is a, c, g, or t
  misc_feature (1610)..(1610): n is a, c, g, or t
  misc_feature (1622)..(1623): n is a, c, g, or t
  misc_feature (1638)..(1638): n is a, c, g, or t
  misc_feature (1640)..(1640): n is a, c, g, or t
  misc_feature (1644)..(1644): n is a, c, g, or t
  misc_feature (1651)..(1651): n is a, c, g, or t
  misc_feature (1659)..(1659): n is a, c, g, or t
  misc_feature (1661)..(1661): n is a, c, g, or t
  misc_feature (1667)..(1667): n is a, c, g, or t
  misc_feature (1669)..(1670): n is a, c, g, or t
  misc_feature (1674)..(1674): n is a, c, g, or t
  misc_feature (1688)..(1688): n is a, c, g, or t
  misc_feature (1694)..(1694): n is a, c, g, or t
  misc_feature (1757)..(1757): n is a, c, g, or t
agtcgtggtgtcttgcggctctgagactccagagaagggctgcggtctcgcagcggagggccgctgggaaatggacgctttaaggcccgggccgccgcaaggctgtctgggaaatgtagtcagcacggcgctgtttgcacctggccgcggagcctcctgggaaatgtagttcggcccggccctggcaccgtgaggggaaagaggcgtcaggtgcctggctgaagcctgaaggtgacccgaaaacaagtcagagcccgagagatccacccgcgcccgcgcgggggaccaagggcccggatttaagaagagtgtgcctacaaggcggttgtcacggcaacgagagggcgggattgttcgagcgctgcggccccctcacgtgatcgattcggaggcggggcgtccgcccagtgggcggggccgggcccctgctgggaggcgaagaccaggcgggcactgttgcccggcgacgctccggcgctgggtccccgaggcccggcccctccccgggaggaggtgggcttcgagtcacgtgacccgtgccctacgggagggggtgcggtcggggacccggcaggaggcggccgagaagagaggaccgtgggggcgttcgcgtggctcccagcccgggaccccacccccgctggacagtgggggaaactgaggcctgagcggagtgaccaccccggctatggccagccagcctccagggagcgcgagtgctgctgacaggggccaacgctggtgttggtgaggagctggcctatcactacgcgcgtctgggctcccacctggtgctcactgcccacactgaggctctcctgcagaagggtcggcccgaaataggcggagttgggattcgaactcatttcacaggcagagggaggagagcagccatagccacctccactggttccgactccagctcccgggctcgcaggagtaaacgcgcatgctcagggagctcggtcgcgcatgctcagcgcaacggcggggaagactccagccgccagggggagcgcgtgccgttcttgcctctctggcctgcgcctcctgagccgagtagatatcccggagttccgcgcggcgccagcccttccgccacggccgtctctggagagcagcagccatggccctacgctaccctatggccgtgggcctcaacaagggccacaaagtgaccaagaacgtgagcaagcccaggcacagccgacgccgcgggcgtctgaccaaacacaccaagttcgtgcgggacatgattcgggaggtgtgtggctttgccccgtacgagcggcgcgccatggagttactgaaggtctccaaggacaaacgggccctcaaatttatcaagaaaagggtggggacgcacatccgcgccaagaggaagcgggaggagctgagcaacgtactggccgccatgaggaaagctgctgccaagaaagactgagcccctcccctgccctctccctgaaataaagaacagcttgacagaaaaaaaaaaaaaaaaaaaaaaaaaaaaaaaaaaaaaaaaaaaaaaaaaaaaaaaaaaaaaaaaaaaaaaaaaaccnttgtgggccgcttgggccnantcaattttaaattgggnangtttntgcttgcggccnnatttggggctaattngnccanttcgccntatagggngnggtttnannattnattgcccgggtttnacacgnggggactggagttggggtattaccgaagaggcccgaacggttcgcctttccaacatttgcccnccttaatggcaaatggaattttaggcttt

SEQ ID NO: 279054 - DNA, 1770 bp, Homo sapiens
agtcgtggtgtcttgcggctctgagactccagagaagggctgcggtctcgcagcggagggccgctgggaaatggacgctttaaggcccgggccgccgcaaggctgtctgggaaatgtagtcagcacggcgctgtttgcacctggccgcggagcctcctgggaaatgtagttcggcccggccctggcaccgtgaggggaaagaggcgtcaggtgcctggctgaagcctgaaggtgacccgaaaacaagtcagagcccgagagatccacccgcgcccgcgcgggggaccaagggcccggatttaagaagagtgtgcctacaaggcggttgtcacggcaacgagagggcgggattgttcgagcgctgcggccccctcacgtgatcgattcggaggcggggcgtccgcccagtgggcggggccgggcccctgctgggaggcgaagaccaggcgggcactgttgcccggcgacgctccggcgctgggtccccgaggcccggcccctccccgggaggaggtgggcttcgagtcacgtgacccgtgccctacgggagggggtgcggtcggggacccggcaggaggcggccgagaagagaggaccgtgggggcgttcgcgtggctcccagcccgggaccccacccccgctggacagtgggggaaactgaggcctgagcggggcctgtgccggccacctctgtcccctgtccctctgcaggcccacacaggaccatgaaggtgcttctcctcacagggctgggggccctgttcttcgcctattattgggatgacaacttcgacccagccagcctccagggagcgcgagtgctgctgacaggggccaacgctggtgttggtgaggagctggcctatcactacgcgcgtctgggctcccacctggtgctcactgcccacactgaggctctcctgcagaagggtcggcccgaaataggcggagttgggattcgaactcatttcacaggcagagggaggagagcagccatagccacctccactggttccgactccagctcccgggctcgcaggagtaaacgcgcatgctcagggagctcggtcgcgcatgctcagcgcaacggcggggaagactccagccgccagggggagcgcgtgccgttcttgcctctctggcctgcgcctcctgagccgagtagatatcccggagttccgcgcggcgccagcccttccgccacggccgtctctggagagcagcaggtaagtggtttcccgcactgccggtatccgccgccatccggactcccgggtcctctgtgcaggttggaggatggttggttgtggcgagcgaggctgaaggagccgggacgcggggctctgggcctcgggaactgagccggtactcacctccgccccttctccccgtcgctgtccgcagccatggccctacgctaccctatggccgtgggcctcaacaagggccacaaagtgaccaagaacgtgagcaagcccaggcacagccgacgccgcgggcgtctgaccaaacacaccaagttcgtgcgggacatgattcgggaggtgtgtggctttgccccgtacgagcggcgcgccatggagttactgaaggtctccaaggacaaacgggccctcaaatttatcaagaaaagggtggggacgcacatccgcgccaagaggaagcgggaggagctgagcaacgtactggccgccatgaggaaagctgctgccaagaaagactgagcccctcccctgccctctccctgaaataaagaacagcttgacagaa

SEQ ID NO: 279055 - DNA, 874 bp, Homo sapiens
  misc_feature (485)..(485): n is a, c, g, or t
  misc_feature (504)..(504): n is a, c, g, or t
  misc_feature (506)..(506): n is a, c, g, or t
  misc_feature (523)..(523): n is a, c, g, or t
  misc_feature (525)..(525): n is a, c, g, or t
  misc_feature (530)..(530): n is a, c, g, or t
  misc_feature (542)..(543): n is a, c, g, or t
  misc_feature (558)..(558): n is a, c, g, or t
  misc_feature (560)..(560): n is a, c, g, or t
  misc_feature (564)..(564): n is a, c, g, or t
  misc_feature (571)..(571): n is a, c, g, or t
  misc_feature (579)..(579): n is a, c, g, or t
  misc_feature (581)..(581): n is a, c, g, or t
  misc_feature (587)..(587): n is a, c, g, or t
  misc_feature (589)..(590): n is a, c, g, or t
  misc_feature (594)..(594): n is a, c, g, or t
  misc_feature (608)..(608): n is a, c, g, or t
  misc_feature (614)..(614): n is a, c, g, or t
gtgcctggtaccggcccgggagtttatgggatggagagcagcagccatggccctacgctaccctatggccgtgggcctcaacaagggccacaaagtgaccaagaacgtgagcaagcccaggcacagccgacgccgcgggcgtctgaccaaacacaccaagttcgtgcgggacatgattcgggaggtgtgtggctttgccccgtacgagcggcgcgccatggagttactgaaggtctccaaggacaaacgggccctcaaatttatcaagaaaagggtggggacgcacatccgcgccaagaggaagcgggaggagctgagcaacgtactggccgccatgaggaaagctgctgccaagaaagactgagcccctcccctgccctctccctgaaataaagaacagcttgacagaaaaaaaaaaaaaaaaaaaaaaaaaaaaaaaaaaaaaaaaaaaaaaaaaaaaaaaaaaaaaaaaaaaaaaaaaaccnttgtgggccgcttgggccnantcaattttaaattgggnangtttntgcttgcggccnnatttggggctaattngnccanttcgccntatagggngnggtttnannattnattgcccgggtttnacacgnggggactgggaaaacccttggggttaccaaatttattggccttgggaaaaattccccttttcccagttggtgaaaagcaaaaaggccgaccggatcgccctcccaaaagttggccacctaatgggaatggaaatttaagcgtaatattttgtaaaaaccggttaaatttttggaaaaagctctttttataccaaagggcggaattggaaaatccttttaaattaaagataaaccggggtgggggttttccatttggctcc

SEQ ID NO: 279056 - DNA, 1551 bp, Homo sapiens
agtcgtggtgtcttgcggctctgagactccagagaagggctgcggtctcgcagcggagggccgctgggaaatggacgctttaaggcccgggccgccgcaaggctgtctgggaaatgtagtcagcacggcgctgtttgcacctggccgcggagcctcctgggaaatgtagttcggcccggccctggcaccgtgaggggaaagaggcgtcaggtgcctggctgaagcctgaaggtgacccgaaaacaagtcagagcccgagagatccacccgcgcccgcgcgggggaccaagggcccggatttaagaagagtgtgcctacaaggcggttgtcacggcaacgagagggcgggattgttcgagcgctgcggccccctcacgtgatcgattcggaggcggggcgtccgcccagtgggcggggccgggcccctgctgggaggcgaagaccaggcgggcactgttgcccggcgacgctccggcgctgggtccccgaggcccggcccctccccgggaggaggtgggcttcgagtcacgtgacccgtgccctacgggagggggtgcggtcggggacccggcaggaggcggccgagaagagaggaccgtgggggcgttcgcgtggctcccagcccgggaccccacccccgctggacagtgggggaaactgaggcctgagcggagtgaccaccccggctatggccagccagcctccagggagcgcgagtgctgctgacaggggccaacgctggtgttggtgaggagctggcctatcactacgcgcgtctgggctcccacctggtgctcactgcccacactgaggctctcctgcagaagggtcggcccgaaataggcggagttgggattcgaactcatttcacaggcagagggaggagagcagccatagccacctccactggttccgactccagctcccgggctcgcaggagtaaacgcgcatgctcagggagctcggtcgcgcatgctcagcgcaacggcggggaagactccagccgccagggggagcgcgtgccgttcttgcctctctggcctgcgcctcctgagccgagtagatatcccggagttccgcgcggcgccagcccttccgccacggccgtctctggagagcagcagccatggccctacgctaccctatggccgtgggcctcaacaagggccacaaagtgaccaagaacgtgagcaagcccaggcacagccgacgccgcgggcgtctgaccaaacacaccaagttcgtgcgggacatgattcgggaggtgtgtggctttgccccgtacgagcggcgcgccatggagttactgaaggtctccaaggacaaacgggccctcaaatttatcaagaaaagggtggggacgcacatccgcgccaagaggaagcgggaggagctgagcaacgtactggccgccatgaggaaagctgctgccaagaaagactgagcccctcccctgccctctccctgaaataaagaacagcttgacagaaaaaaaaaaaagtcgacgcggccgcgaatttagtagtagtagtagtagtagtaggcggccgc

SEQ ID NO: 279057 - DNA, 1842 bp, Homo sapiens
  misc_feature (1787)..(1788): n is a, c, g, or t
  misc_feature (1792)..(1792): n is a, c, g, or t
  misc_feature (1796)..(1796): n is a, c, g, or t
agtcgtggtgtcttgcggctctgagactccagagaagggctgcggtctcgcagcggagggccgctgggaaatggacgctttaaggcccgggccgccgcaaggctgtctgggaaatgtagtcagcacggcgctgtttgcacctggccgcggagcctcctgggaaatgtagttcggcccggccctggcaccgtgaggggaaagaggcgtcaggtgcctggctgaagcctgaaggtgacccgaaaacaagtcagagcccgagagatccacccgcgcccgcgcgggggaccaagggcccggatttaagaagagtgtgcctacaaggcggttgtcacggcaacgagagggcgggattgttcgagcgctgcggccccctcacgtgatcgattcggaggcggggcgtccgcccagtgggcggggccgggcccctgctgggaggcgaagaccaggcgggcactgttgcccggcgacgctccggcgctgggtccccgaggcccggcccctccccgggaggaggtgggcttcgagtcacgtgacccgtgccctacgggagggggtgcggtcggggacccggcaggaggcggccgagaagagaggaccgtgggggcgttcgcgtggctcccagcccgggaccccacccccgctggacagtgggggaaactgaggcctgagcggggcctgtgccggccacctctgtcccctgtccctctgcaggcccacacaggaccatgaaggtgcttctcctcacagggctgggggccctgttcttcgcctattattgggatgacaacttcgacccagccagcctccagggagcgcgagtgctgctgacaggggccaacgctggtgttggtgaggagctggcctatcactacgcgcgtctgggctcccacctggtgctcactgcccacactgaggctctcctgcagaagggtcggcccgaaataggcggagttgggattcgaactcatttcacaggcagagggaggagagcagccatagccacctccactggttccgactccagctcccgggctcgcaggagtaaacgcgcatgctcagggagctcggtcgcgcatgctcagcgcaacggcggggaagactccagccgccagggggagcgcgtgccgttcttgcctctctggcctgcgcctcctgagccgagtagatatcccggagttccgcgcggcgccagcccttccgccacggccgtctctggagagcagcaggtaagtggtttcccgcactgccggtatccgccgccatccggactcccgggtcctctgtgcaggttggaggatggttggttgtggcgagcgaggctgaaggagccgggacgcggggctctgggcctcgggaactgagccggtactcacctccgccccttctccccgtcgctgtccgcagccatggccctacgctaccctatggccgtgggcctcaacaagggccacaaagtgaccaagaacgtgagcaagcccaggcacagccgacgccgcgggcgtctgaccaaacacaccaagttcgtgcgggacatgattcgggaggtgtgtggctttgccccgtacgagcggcgcgccatggagttactgaaggtctccaaggacaaacgggccctcaaatttatcaagaaaagggtggggacgcacatccgcgccaagaggaagcgggaggagctgagcaacgtactggccgccatgaggaaagctgctgccaagaaagactgagcccctcccctgccctctccctgaaataaagaacagcttgacagaacaacaacacacacccanncacnacancacctctttcccggccccccggcccccgacacagttcaacaccatg

SEQ ID NO: 279058 - DNA, 357 bp, Homo sapiens
tgcgcgctctagactgatgtacccggtgcagaattcgcacgagccaagtacacgtgagcaagcccaggcacagccgacgccgcgggcgtctgaccaaacacaccaagttcgtgcgggacatgattcgggaggtgtgtggctttgccccgtacgagcggcgcgccatggagttactgaaggtctccaaggacaaacgggccctcaaatttatcaagaaaagggtggggacgcacatccgcgccaagaggaagcgggaggagctgagcaacgtactggccgccatgaggaaagctgctgccaagaaagactgagcccctcccctgccctctccctgaaataaagaacagcttgacagaa

SEQ ID NO: 279059 - DNA, 2165 bp, Homo sapiens
agtcgtggtgtcttgcggctctgagactccagagaagggctgcggtctcgcagcggagggccgctgggaaatggacgctttaaggcccgggccgccgcaaggctgtctgggaaatgtagtcagcacggcgctgtttgcacctggccgcggagcctcctgggaaatgtagttcggcccggccctggcaccgtgaggggaaagaggcgtcaggtgcctggctgaagcctgaaggtgacccgaaaacaagtcagagcccgagagatccacccgcgcccgcgcgggggaccaagggcccggatttaagaagagtgtgcctacaaggcggttgtcacggcaacgagagggcgggattgttcgagcgctgcggccccctcacgtgatcgattcggaggcggggcgtccgcccagtgggcggggccgggcccctgctgggaggcgaagaccaggcgggcactgttgcccggcgacgctccggcgctgggtccccgaggcccggcccctccccgggaggaggtgggcttcgagtcacgtgacccgtgccctacgggagggggtgcggtcggggacccggcaggaggcggccgagaagagaggaccgtgggggcgttcgcgtggctcccagcccgggaccccacccccgctggacagtgggggaaactgaggcctgagcggggcctgtgccggccacctctgtcccctgtccctctgcaggcccacacaggaccatgaaggtgcttctcctcacagggctgggggccctgttcttcgcctattattgggatgacaacttcgacccagccagcctccagggagcgcgagtgctgctgacaggggccaacgctggtgttggtgaggagctggcctatcactacgcgcgtctgggctcccacctggtgctcactgcccacactgaggctctcctgcagaaggggtggtagggaactgccggaagctgggcgcccccaaggtcttctacatcgcggcggacatggcctcccctgaggcgcccgagagcgtggtgcagtttgcgctggacaagctgggcgggctggactacctcgtgctgaaccacatcggcggcgccccggccggcacgcgagcccgcagcccccaggcaactcgctggctcatgcaggtaaactttgtgagctacgtgcaactgacgtcgcgggcgctgcccagcctgacggacagcaagggctccctggtggtggtgtcctcgctgctcggccgcgtgcccacgtcgttctccactccctactcggcggccaagtttgcgctggacggcttcttcggctccctgcggcgggagctggacgtgcaggacgtgaacgtggccatcaccatgtgcgtcctgggcctccgagatcgcgcctccgccgccgaggcagtcaggggagtcacgagggtcaaggcggccccggggcccaaggcagccctggccgtgatccgcggcggcgccacgcgcgcggccggcgtcttctacccgtggcgtttccgcctgctgtgcttgctccggcgctggctaccgcgcccgcgggcctggtttatccgccaggagctcaacgtcacggccgcggcagcctgagcaccggggggtgcccctccagtcccagacggcaatgttcctccctccaactgtccctggagccagaacactcacagagacacccctgagagggtggccacagcccaagatgaagtcatcaagacagaaaagcaaaaccgagaaaaacgacgggcacctggaaccagtcacggcttgggaggtgcaggtgccccgtgttaggcgcctttgtcggggacttgcaaggcctcacctgtttggccatgattgatgacgtgactgcttccattttgcagatgaggaaactaaggctcagagaggccacgccacccttgagccacccatggacccctctccatctcctgcctgcgcctttaagtccctgatttattctttccattcattccatctgggaggaacccccccaactcctgccagcttcccctagctggggtctctggtactcttcacacctgcaggggcgtctacactgttcgtctacctggtggcagggtctgagcgggaggaggagggaaagagtgtgttctgagctggacccagcctcttgttcgagaataaaaactcttcttctcttgca

SEQ ID NO: 279060 - DNA, 1876 bp, Homo sapiens
agtcgtggtgtcttgcggctctgagactccagagaagggctgcggtctcgcagcggagggccgctgggaaatggacgctttaaggcccgggccgccgcaaggctgtctgggaaatgtagtcagcacggcgctgtttgcacctggccgcggagcctcctgggaaatgtagttcggcccggccctggcaccgtgaggggaaagaggcgtcaggtgcctggctgaagcctgaaggtgacccgaaaacaagtcagagcccgagagatccacccgcgcccgcgcgggggaccaagggcccggatttaagaagagtgtgcctacaaggcggttgtcacggcaacgagagggcgggattgttcgagcgctgcggccccctcacgtgatcgattcggaggcggggcgtccgcccagtgggcggggccgggcccctgctgggaggcgaagaccaggcgggcactgttgcccggcgacgctccggcgctgggtccccgaggcccggcccctccccgggaggaggtgggcttcgagtcacgtgacccgtgccctacgggagggggtgcggtcggggacccggcaggaggcggccgagaagagaggaccgtgggggcgttcgcgtggctcccagcccgggaccccacccccgctggacagtgggggaaactgaggcctgagcgggcccacacaggaccatgaaggtgcttctcctcacagggctgggggccctgttcttcgcctattattgggatgacaacttcgaccgggctggactacctcgtgctgaaccacatcggcggcgccccggccggcacgcgagcccgcagcccccaggcaactcgctggctcatgcaggtaaactttgtgagctacgtgcaactgacgtcgcgggcgctgcccagcctgacggacagcaagggctccctggtggtggtgtcctcgctgctcggccgcgtgcccacgtcgttctccactccctactcggcggccaagtttgcgctggacggcttcttcggctccctgcggcgggagctggacgtgcaggacgtgaacgtggccatcaccatgtgcgtcctgggcctccgagatcgcgcctccgccgccgaggcagtcaggggagtcacgagggtcaaggcggccccggggcccaaggcagccctggccgtgatccgcggcggcgccacgcgcgcggccggcgtcttctacccgtggcgtttccgcctgctgtgcttgctccggcgctggctaccgcgcccgcgggcctggtttatccgccaggagctcaacgtcacggccgcggcagcctgagcaccggggggtgcccctccagtcccagacggcaatgttcctccctccaactgtccctggagccagaacactcacagagacacccctgagagggtggccacagcccaagatgaagtcatcaagacagaaaagcaaaaccgagaaaaacgacgggcacctggaaccagtcacggcttgggaggtgcaggtgccccgtgttaggcgcctttgtcggggacttgcaaggcctcacctgtttggccatgattgatgacgtgactgcttccattttgcagatgaggaaactaaggctcagagaggccacgccacccttgagccacccatggacccctctccatctcctgcctgcgcctttaagtccctgatttattctttccattcattccatctgggaggaacccccccaactcctgccagcttcccctagctggggtctctggtactcttcacacctgcaggggcgtctacactgttcgtctacctggtggcagggtctgagcgggaggaggagggaaagagtgtgttctgagctggacccagcctcttgttcgagaataaaaactcttcttctcttgca

SEQ ID NO: 279061 - DNA, 2292 bp, Homo sapiens
agtcgtggtgtcttgcggctctgagactccagagaagggctgcggtctcgcagcggagggccgctgggaaatggacgctttaaggcccgggccgccgcaaggctgtctgggaaatgtagtcagcacggcgctgtttgcacctggccgcggagcctcctgggaaatgtagttcggcccggccctggcaccgtgaggggaaagaggcgtcaggtgcctggctgaagcctgaaggtgacccgaaaacaagtcagagcccgagagatccacccgcgcccgcgcgggggaccaagggcccggatttaagaagagtgtgcctacaaggcggttgtcacggcaacgagagggcgggattgttcgagcgctgcggccccctcacgtgatcgattcggaggcggggcgtccgcccagtgggcggggccgggcccctgctgggaggcgaagaccaggcgggcactgttgcccggcgacgctccggcgctgggtccccgaggcccggcccctccccgggaggaggtgggcttcgagtcacgtgacccgtgccctacgggagggggtgcggtcggggacccggcaggaggcggccgagaagagaggaccgtgggggcgttcgcgtggctcccagcccgggaccccacccccgctggacagtgggggaaactgaggcctgagcggggcctgtgccggccacctctgtcccctgtccctctgcaggcccacacaggaccatgaaggtgcttctcctcacagggctgggggccctgttcttcgcctattattgggatgacaacttcgacccagccagcctccagggagcgcgagtgctgctgacaggggccaacgctggtgttggtgaggagctggcctatcactacgcgcgtctgggctcccacctggtgctcactgcccacactgaggctctcctgcagaaggggtggtagggaactgccggaagctgggcgcccccaaggtcttctacatcgcggcggacatggcctcccctgaggcgcccgagagcgtggtgcagtttgcgctggacaagctgggcgggctggactacctcgtgctgaaccacatcggcggcgccccggccggcacgcgagcccgcagcccccaggcaactcgctggctcatgcaggtaaactttgtgagctacgtgcaactgacgtcgcgggcgctgcccagcctgacggacagcaagggctccctggtggtggtgtcctcgctgctcggtgcgtgcacccggccccggctctgcgggacggggagtggggagctcgatgcgggtgagcctggagggtctgggcaggcttcccggacgagggggagccactcagccgctgccgtccgcgcccccaggccgcgtgcccacgtcgttctccactccctactcggcggccaagtttgcgctggacggcttcttcggctccctgcggcgggagctggacgtgcaggacgtgaacgtggccatcaccatgtgcgtcctgggcctccgagatcgcgcctccgccgccgaggcagtcaggggagtcacgagggtcaaggcggccccggggcccaaggcagccctggccgtgatccgcggcggcgccacgcgcgcggccggcgtcttctacccgtggcgtttccgcctgctgtgcttgctccggcgctggctaccgcgcccgcgggcctggtttatccgccaggagctcaacgtcacggccgcggcagcctgagcaccggggggtgcccctccagtcccagacggcaatgttcctccctccaactgtccctggagccagaacactcacagagacacccctgagagggtggccacagcccaagatgaagtcatcaagacagaaaagcaaaaccgagaaaaacgacgggcacctggaaccagtcacggcttgggaggtgcaggtgccccgtgttaggcgcctttgtcggggacttgcaaggcctcacctgtttggccatgattgatgacgtgactgcttccattttgcagatgaggaaactaaggctcagagaggccacgccacccttgagccacccatggacccctctccatctcctgcctgcgcctttaagtccctgatttattctttccattcattccatctgggaggaacccccccaactcctgccagcttcccctagctggggtctctggtactcttcacacctgcaggggcgtctacactgttcgtctacctggtggcagggtctgagcgggaggaggagggaaagagtgtgttctgagctggacccagcctcttgttcgagaataaaaactcttcttctcttgca

SEQ ID NO: 279062 - DNA, 2096 bp, Homo sapiens
agtcgtggtgtcttgcggctctgagactccagagaagggctgcggtctcgcagcggagggccgctgggaaatggacgctttaaggcccgggccgccgcaaggctgtctgggaaatgtagtcagcacggcgctgtttgcacctggccgcggagcctcctgggaaatgtagttcggcccggccctggcaccgtgaggggaaagaggcgtcaggtgcctggctgaagcctgaaggtgacccgaaaacaagtcagagcccgagagatccacccgcgcccgcgcgggggaccaagggcccggatttaagaagagtgtgcctacaaggcggttgtcacggcaacgagagggcgggattgttcgagcgctgcggccccctcacgtgatcgattcggaggcggggcgtccgcccagtgggcggggccgggcccctgctgggaggcgaagaccaggcgggcactgttgcccggcgacgctccggcgctgggtccccgaggcccggcccctccccgggaggaggtgggcttcgagtcacgtgacccgtgccctacgggagggggtgcggtcggggacccggcaggaggcggccgagaagagaggaccgtgggggcgttcgcgtggctcccagcccgggaccccacccccgctggacagtgggggaaactgaggcctgagcgggcccacacaggaccatgaaggtgcttctcctcacagggctgggggccctgttcttcgcctattattgggatgacaacttcgacccagccagcctccagggagcgcgagtgctgctgacaggggccaacgctggtgttggtgaggagctggcctatcactacgcgcgtctgggctcccacctggtgctcactgcccacactgaggctctcctgcagaaggcgggctggactacctcgtgctgaaccacatcggcggcgccccggccggcacgcgagcccgcagcccccaggcaactcgctggctcatgcaggtaaactttgtgagctacgtgcaactgacgtcgcgggcgctgcccagcctgacggacagcaagggctccctggtggtggtgtcctcgctgctcggccgcgtgcccacgtcgttctccactccctactcggcggccaagtttgcgctggacggcttcttcggctccctgcggcgggagctggacgtgcaggacgtgaacgtggccatcaccatgtgcgtcctgggcctccgagatcgcgcctccgccgccgaggcagtcaggtgaggcccggacaagctgggggctgggctgggggccatggcccagccccagccgcagtccccaccgtgccctcctgtccccaggggagtcacgagggtcaaggcggccccggggcccaaggcagccctggccgtgatccgcggcggcgccacgcgcgcggccggcgtcttctacccgtggcgtttccgcctgctgtgcttgctccggcgctggctaccgcgcccgcgggcctggtttatccgccaggagctcaacgtcacggccgcggcagcctgagcaccggggggtgcccctccagtcccagacggcaatgttcctccctccaactgtccctggagccagaacactcacagagacacccctgagagggtggccacagcccaagatgaagtcatcaagacagaaaagcaaaaccgagaaaaacgacgggcacctggaaccagtcacggcttgggaggtgcaggtgccccgtgttaggcgcctttgtcggggacttgcaaggcctcacctgtttggccatgattgatgacgtgactgcttccattttgcagatgaggaaactaaggctcagagaggccacgccacccttgagccacccatggacccctctccatctcctgcctgcgcctttaagtccctgatttattctttccattcattccatctgggaggaacccccccaactcctgccagcttcccctagctggggtctctggtactcttcacacctgcaggggcgtctacactgttcgtctacctggtggcagggtctgagcgggaggaggagggaaagagtgtgttctgagctggacccagcctcttgttcgagaataaaaactcttcttctcttgca

SEQ ID NO: 279063 - DNA, 1720 bp, Homo sapiens
  misc_feature (1720)..(1720): n is a, c, g, or t
agtcgtggtgtcttgcggctctgagactccagagaagggctgcggtctcgcagcggagggccgctgggaaatggacgctttaaggcccgggccgccgcaaggctgtctgggaaatgtagtcagcacggcgctgtttgcacctggccgcggagcctcctgggaaatgtagttcggcccggccctggcaccgtgaggggaaagaggcgtcaggtgcctggctgaagcctgaaggtgacccgaaaacaagtcagagcccgagagatccacccgcgcccgcgcgggggaccaagggcccggatttaagaagagtgtgcctacaaggcggttgtcacggcaacgagagggcgggattgttcgagcgctgcggccccctcacgtgatcgattcggaggcggggcgtccgcccagtgggcggggccgggcccctgctgggaggcgaagaccaggcgggcactgttgcccggcgacgctccggcgctgggtccccgaggcccggcccctccccgggaggaggtgggcttcgagtcacgtgacccgtgccctacgggagggggtgcggtcggggacccggcaggaggcggccgagaagagaggaccgtgggggcgttcgcgtggctcccagcccgggaccccacccccgctggacagtgggggaaactgaggcctgagcgggcccacacaggaccatgaaggtgcttctcctcacagggctgggggccctgttcttcgcctattattgggatgacaacttcgacccagccagcctccagggagcgcgagtgctgctgacaggggccaacgctggtgttggtgaggagctggcctatcactacgcgcgtctgggctcccacctggtgctcactgcccacactgaggctctcctgcagaaggcgggctggactacctcgtgctgaaccacatcggcggcgccccggccggcacgcgagcccgcagcccccaggcaactcgctggctcatgcaggtaaactttgtgagctacgtgcaactgacgtcgcgggcgctgcccagcctgacggacagcaagggctccctggtggtggtgtcctcgctgctcggccgcgtgcccacgtcgttctccactccctactcggcggccaagtttgcgctggacggcttcttcggctccctgcggcgggagctggacgtgcaggacgtgaacgtggccatcaccatgtgcgtcctgggcctccgagatcgcgcctccgccgccgaggcagtcaggtgaggcccggacaagctgggggctgggctgggggccatggcccagccccagccgcagtccccaccgtgccctcctgtccccaggggagtcacgagggtcaaggcggccccggggcccaaggcagccctggccgtgatccgcggcggcgccacgcgcgcggccggcgtcttctacccgtggcgtttccgcctgctgtgcttgctccggcgctggctaccgcgcccgcgggcctggtttatccgccaggagctcaacgtcacggccgcggcagcctgagcaccggggggtgcccctccagtcccagacggcaatgttcctccctccaactgtccctggagccagaacactcacagagacacccctgagagggtggccacagcccaagatgaagtcatcaagacagagcccgagattaggcgcctttgtcggggacttgcggcctcacctgtttggccatgattgatgacgtgctgcttn

SEQ ID NO: 279064 - DNA, 389 bp, Homo sapiens
ggaagagagcctgggtttaatccctgcaatgatccaggcttcccgtgtgaccttgggcaagtcgcctaacctctctgagcctctcagtttcctcatttgcaaaacggggacaataaaaccactttctggccaggcacggtggctcacgcttgtagtcagcactttgggaggccgaggaaagtggatcacctgaggtcaggagttcaagaccagcctggccaacatggcgaaacctggtctctactaagaagacaaaaattaggccaggcatggtggctcatgcctgtaatcctagcactttgggaggccaaggcggatggatcacttgaggtcaggagttcaaaaccagcctggccaacatggtgaaaccctgtctctactaaaaatac

SEQ ID NO: 279065 - DNA, 407 bp, Homo sapiens
ctgcttaactagaatgcagggatccccctaccctgacggccgcccctttcccccctagcgtctgaccaaacacaccaagttcgtgcgggacatgattcgggaggtgtgtggctttgccccgtacgagcggcgcgccatggagttactgaaggtctccaaggacaaacgggccctcaaatttatcaagaaaagggtaggtgggcgctgccggccgaggggcggggtgggatgggagtcagggccgggctgacggcggcctcgtccctggcaggtggggacgcacatccgcgccaagaggaagcgggaggagctgagcaacgtactggccgccatgaggaaagctgctgccaagaaagactgagcccctcccctgccctctccctgaaataaagaacagcttgacagaa

SEQ ID NO: 279066 - DNA, 516 bp, Homo sapiens
actacgttcggctaggtagcgaggcgtgggtggcgatttcccttagttggttgtggcgagcgaggctgaaggagccgggacgcggggctctgggcctcgggaactgagccggtactcacctccgccccttctccccgtcgctgtccgcagccatggccctacgctaccctatggccgtgggcctcaacaagggccacaaagtgaccaagaacgtgagcaagcccaggcacagccgacgccgcgggcgtctgaccaaacacaccaagttcgtgcgggacatgattcgggaggtgtgtggctttgccccgtacgagcggcgcgccatggagttactgaaggtctccaaggacaaacgggccctcaaatttatcaagaaaagggtggggacgcacatccgcgccaagaggaagcgggaggagctgagcaacgtactggccgccatgaggaaagctgctgccaagaaagactgagcccctcccctgccctctccctgaaataaagaacagcttgacagaa

SEQ ID NO: 279067 - DNA, 938 bp, Homo sapiens
ctctagagcggccgcctactactactaaattcgcggccgctcgacggcgtctctggagagcagcagccatggccctacgctaccctatggccgtgggcctcaacaagggccacaaagtgaccaagaacgtgagcaagcccaggcacagccgacgccgcgggcgtctgaccaaacacaccaagttcgtgcgggacatgattcgggaggtgtgtggctttgccccgtacgagcggcgcgccatggagttactgaaggtctccaaggacaaacgggccctcaaatttatcaagaaaagggtggggacgcacatccgcgccaagaggaagcgggaggagctgagcaacgtactggccgccatgaggaaagctgctgccaagaaagactgagcccctcccctgccctctccctgaaataaagaacagcttgacagaaaaaaaaaaaaaaaaaaaaaaaaaaaaaaaaaaaaaaaaaaaaaaaaaaaaaaaaaaaaaaaaaaaaaaaaaaaaaaaggggaaaaaaaaaaaaaaaaaaaaaggggaaaaaaaaaaaaaaaaaaaaaaaaaatcctttgggggccccttggcccaagagatttttaatttggagaagttttttttttggggccaaattgaagctcatttggccaatttccccttaaggggggtgtataaaaaaaaaaggggcggggttttaaaaggggggggtggggaaaaccctggggttcccccaattaaaggccttggaaaaaatcccctttttcccagtggtggaaaataagaaaaaggggccgacccaatccccccttccaaacaagtggccaaccctaaatagggaaaggaaaatttaagccttaattttttggaaaaatccggggaaaaatttttgaaaaaaaccttttttttaaccaaaaggccgaaatggggaatcccttttaaaaa

SEQ ID NO: 279068 - DNA, 500 bp, Homo sapiens
aagcagtgctatcaacgcagagtgcccattacggccggggccttccgccacggccgtctctggagagcagcagccatggccctacgctaccctatggccgtgggcctcaacaagggccacaaagtgaccaagaacgtgagcaagcccaggcacagccgacgccgcgggcgtctgaccaaacacaccaagttcgtgcgggacatgattcgggaggtgtgtggctttgccccgtacgagcggcgcgccatggagttactgaaggtctccaaggacaaacgggccctcaaatttatcaagaaaagggtggggacgcacatccgcgccaagaggaagcgggaggagctgagcaacgtactggccgccatgaggaaagctgctgccaagaaagactgagcccctcccctgccctctccctgaaataaagaacagcttgacagaaaaaaaaaaaagtcgacgcggccgcgaatttagtagtagtagtagtagtagtaggcggccgc

SEQ ID NO: 279069 - DNA, 634 bp, Homo sapiens
  misc_feature (425)..(425): n is a, c, g, or t
  misc_feature (471)..(471): n is a, c, g, or t
cccccccccccccagccttccgccacggccgtctctggagagcagcagccatggccctacgctaccctatggccgtgggcctcaacaagggccacaaagtgaccaagaacgtgagcaagcccaggcacagccgacgccgcgggcgtctgaccaaacacaccaagttcgtgcgggacatgattcgggaggtgtgtggctttgccccgtacgagcggcgcgccatggagttactgaaggtctccaaggacaaacgggccctcaaatttatcaagaaaagggtggggacgcacatccgcgccaagaggaagcgggaggagctgagcaacgtactggccgccatgaggaaagctgctgccaagaaagactgagcccctcccctgccctctccctgaaataaagaacagcttgacagaaaaaaaaaaaanaaaaaaaaaaaaaaacaaaaccatacaaaaaaacaacaaaccaaanaaaaaaaaaaacacaataaacaaaccccaaacaaaaaaaaaaaaaaaaattgggcccgaatttggagctatttgggcaaattgcccttaggggggggcggtttcaaaataaatgggcgggtgttaaaacgggtggttgggcccctgggttccccctttggttt

SEQ ID NO: 279070 - DNA, 1180 bp, Homo sapiens
agtcgtggtgtcttgcggctctgagactccagagaagggctgcggtctcgcagcggagggccgctgggaaatggacgctttaaggcccgggccgccgcaaggctgtctgggaaatgtagtcagcacggcgctgtttgcacctggccgcggagcctcctgggaaatgtagttcggcccggccctggcaccgtgaggggaaagaggcgtcaggtgcctggctgaagcctgaaggtgacccgaaaacaagtcagagcccgagagatccacccgcgcccgcgcgggggaccaagggcccggatttaagaagagtgtgcctacaaggcggttgtcacggcaacgagagggcgggattgttcgagcgctgcggccccctcacgtgatcgattcggaggcggggcgtccgcccagtgggcggggccgggcccctgctgggaggcgaagaccaggcgggcactgttgcccggcgacgctccggcgctgggtccccgaggcccggcccctccccgggaggaggtgggcttcgagtcacgtgacccgtgccctacgggagggggtgcggtcggggacccggcaggaggcggccgagaagagaggaccgtgggggcgttcgcgtggctcccagcccgggaccccacccccgctggacagtgggggaaactgaggcctgagcgggcccacacaggaccatgaaggtgcttctcctcacagggctgggggccctgttcttcgcctattattgggatgacaacttcgacccagccagcctccagggagcgcgagtgctgctgacaggggccaacgctggtgttggtgaggagctggcctatcactacgcgcgtctgggctcccacctggtgctcactgcccacactgaggctctcctgcagaaggaggcacggtggctcacgcttgtagtcagcactttgggaggccgaggaaagtggatcacctgaggtcaggagttcaagaccagcctggccaacatggcgaaacctggtctctactaagaagacaaaaattaggccaggcatggtggctcatgcctgtaatcctagcactttgggaggccaaggcggatggatcacttgaggtcaggagttcaaaaccagcctggccaacatggtgaaaccctgtctctactaaaaatacaaaaaataaaaataaaataaataaataaaaa

SEQ ID NO: 279071 - DNA, 363 bp, Homo sapiens
  misc_feature (1)..(1): n is a, c, g, or t
  misc_feature (6)..(7): n is a, c, g, or t
  misc_feature (10)..(13): n is a, c, g, or t
  misc_feature (16)..(16): n is a, c, g, or t
ngggcnncannnnttnggcacgagggccgtctctggagagcagcagccatggccctacgctaccctatggccgtgggcctcaacaagggccacaaagtgaccaagaacgtgagcaagcccaggcacagccgacgccgcgggcgtctgaccaaacacaccaagttcgtgcgggacatgattcgggaggtgtgtggctttgccccgtacgagcggcgcgccatggagttactgaaggtctccaaggacaaacgggccctcaaatttatcaagaaaaggtactggccgccatgaggaaagctgctgccaagaaagactgagcccctcccctgccctctccctgaaataaagaacagcttgacagaa

SEQ ID NO: 279072 - DNA, 1592 bp, Homo sapiens
agtcgtggtgtcttgcggctctgagactccagagaagggctgcggtctcgcagcggagggccgctgggaaatggacgctttaaggcccgggccgccgcaaggctgtctgggaaatgtagtcagcacggcgctgtttgcacctggccgcggagcctcctgggaaatgtagttcggcccggccctggcaccgtgaggggaaagaggcgtcaggtgcctggctgaagcctgaaggtgacccgaaaacaagtcagagcccgagagatccacccgcgcccgcgcgggggaccaagggcccggatttaagaagagtgtgcctacaaggcggttgtcacggcaacgagagggcgggattgttcgagcgctgcggccccctcacgtgatcgattcggaggcggggcgtccgcccagtgggcggggccgggcccctgctgggaggcgaagaccaggcgggcactgttgcccggcgacgctccggcgctgggtccccgaggcccggcccctccccgggaggaggtgggcttcgagtcacgtgacccgtgccctacgggagggggtgcggtcggggacccggcaggaggcggccgagaagagaggaccgtgggggcgttcgcgtggctcccagcccgggaccccacccccgctggacagtgggggaaactgaggcctgagcggggcctgtgccggccacctctgtcccctgtccctctgcaggcccacacaggaccatgaaggtgcttctcctcacagggctgggggccctgttcttcgcctattattgggatgacaacttcgacccagccagcctccagggagcgcgagtgctgctgacaggggccaacgctggtgttggtgaggagctggcctatcactacgcgcgtctgggctcccacctggtgctcactgcccacactgaggctctcctgcagaagggtcggcccgaaataggcggagttgggattcgaactcatttcacaggcagagggaggagagcagccatagccacctccactggttccgactccagctcccgggctcgcaggagtaaacgcgcatgctcagggagctcggtcgcgcatgctcagcgcaacggcggggaagactccagccgccagggggagcgcgtgccgttcttgcctctctggcctgcgcctcctgagccgagtagatatcccggagttccgcgcggcgccagcccttccgccacggccgtctctggagagcagcagccatggccctacgctaccctatggccgtgggcctcaacaagggccacaaagtgaccaagaacgtgagcaagcccaggcacagccgacgccgcgggcgtctgaccaaacacaccaagttcgtgcgggacatgattcgggaggtgtgtggctttgccccgtacgagcggcgcgccatggagttactgaaggtctccaaggacaaacgggccctcaaatttatcaagaaaagggtggggacgcacatccgcgccaagaggaagcgggaggagctgagcaacgtactggccgccatgaggaaagctgctgccaagaaagactgagcccctcccctgccctctccctgaaataaagaacagcttgacagaa

SEQ ID NO: 279073 - DNA, 1996 bp, Homo sapiens
agtcgtggtgtcttgcggctctgagactccagagaagggctgcggtctcgcagcggagggccgctgggaaatggacgctttaaggcccgggccgccgcaaggctgtctgggaaatgtagtcagcacggcgctgtttgcacctggccgcggagcctcctgggaaatgtagttcggcccggccctggcaccgtgaggggaaagaggcgtcaggtgcctggctgaagcctgaaggtgacccgaaaacaagtcagagcccgagagatccacccgcgcccgcgcgggggaccaagggcccggatttaagaagagtgtgcctacaaggcggttgtcacggcaacgagagggcgggattgttcgagcgctgcggccccctcacgtgatcgattcggaggcggggcgtccgcccagtgggcggggccgggcccctgctgggaggcgaagaccaggcgggcactgttgcccggcgacgctccggcgctgggtccccgaggcccggcccctccccgggaggaggtgggcttcgagtcacgtgacccgtgccctacgggagggggtgcggtcggggacccggcaggaggcggccgagaagagaggaccgtgggggcgttcgcgtggctcccagcccgggaccccacccccgctggacagtgggggaaactgaggcctgagcggagtgaccaccccggctatggccagccagcctccagggagcgcgagtgctgctgacaggggccaacgctggtgttggtgaggagctggcctatcactacgcgcgtctgggctcccacctggtgctcactgcccacactgaggctctcctgcagaagggtcggcccgaaataggcggagttgggattcgaactcatttcacaggcagagggaggagagcagccatagccacctccactggttccgactccagctcccgggctcgcaggagtaaacgcgcatgctcagggagctcggtcgcgcatgctcagcgcaacggcggggaagactccagccgccagggggagcgcgtgccgttcttgcctctctggcctgcgcctcctgagccgagtagatatcccggagttccgcgcggcgccagcccttccgccacggccgtctctggagagcagcagccatggccctacgctaccctatggccgtgggcctcaacaagggccacaaagtgaccaagaacgtgagcaagcccaggcacagccgacgccgcgggcgtctgaccaaacacaccaagttcgtgcgggacatgattcgggaggtgtgtggctttgccccgtacgagcggcgcgccatggagttactgaaggtctccaaggacaaacgggccctcaaatttatcaagaaaagggtggggacgcacatccgcgccaagaggaagcgggaggagctgagcaacgtactggccgccatgaggaaagctgctgccaagaaagactgagcccctcccctgccctctccctgaaataaagaacagcttgacagaaaaaaaaaaaaaaaaaaaaaaaaaaaaaaaaaaaaaaaaaaaaaaaaaaaaaaaaaaaaaaaaaaaaaaaaaaaaaaaggggaaaaaaaaaaaaaaaaaaaaaggggaaaaaaaaaaaaaaaaaaaaaaaaaatcctttgggggccccttggcccaagagatttttaatttggagaagttttttttttggggccaaattgaagctcatttggccaatttccccttaaggggggtgtataaaaaaaaaaggggcggggttttaaaaggggggggtggggaaaaccctggggttcccccaattaaaggccttggaaaaaatcccctttttcccagtggtggaaaataagaaaaaggggccgacccaatccccccttccaaacaagtggccaaccctaaatagggaaaggaaaatttaagccttaattttttggaaaaatccggggaaaaatttttgaaaaaaaccttttttttaaccaaaaggccgaaatggggaatcccttttaaaaa

SEQ ID NO: 279074 - DNA, 2234 bp, Homo sapiens
  misc_feature (1845)..(1845): n is a, c, g, or t
  misc_feature (1864)..(1864): n is a, c, g, or t
  misc_feature (1866)..(1866): n is a, c, g, or t
  misc_feature (1883)..(1883): n is a, c, g, or t
  misc_feature (1885)..(1885): n is a, c, g, or t
  misc_feature (1890)..(1890): n is a, c, g, or t
  misc_feature (1902)..(1903): n is a, c, g, or t
  misc_feature (1918)..(1918): n is a, c, g, or t
  misc_feature (1920)..(1920): n is a, c, g, or t
  misc_feature (1924)..(1924): n is a, c, g, or t
  misc_feature (1931)..(1931): n is a, c, g, or t
  misc_feature (1939)..(1939): n is a, c, g, or t
  misc_feature (1941)..(1941): n is a, c, g, or t
  misc_feature (1947)..(1947): n is a, c, g, or t
  misc_feature (1949)..(1950): n is a, c, g, or t
  misc_feature (1954)..(1954): n is a, c, g, or t
  misc_feature (1968)..(1968): n is a, c, g, or t
  misc_feature (1974)..(1974): n is a, c, g, or t
agtcgtggtgtcttgcggctctgagactccagagaagggctgcggtctcgcagcggagggccgctgggaaatggacgctttaaggcccgggccgccgcaaggctgtctgggaaatgtagtcagcacggcgctgtttgcacctggccgcggagcctcctgggaaatgtagttcggcccggccctggcaccgtgaggggaaagaggcgtcaggtgcctggctgaagcctgaaggtgacccgaaaacaagtcagagcccgagagatccacccgcgcccgcgcgggggaccaagggcccggatttaagaagagtgtgcctacaaggcggttgtcacggcaacgagagggcgggattgttcgagcgctgcggccccctcacgtgatcgattcggaggcggggcgtccgcccagtgggcggggccgggcccctgctgggaggcgaagaccaggcgggcactgttgcccggcgacgctccggcgctgggtccccgaggcccggcccctccccgggaggaggtgggcttcgagtcacgtgacccgtgccctacgggagggggtgcggtcggggacccggcaggaggcggccgagaagagaggaccgtgggggcgttcgcgtggctcccagcccgggaccccacccccgctggacagtgggggaaactgaggcctgagcggggcctgtgccggccacctctgtcccctgtccctctgcaggcccacacaggaccatgaaggtgcttctcctcacagggctgggggccctgttcttcgcctattattgggatgacaacttcgacccagccagcctccagggagcgcgagtgctgctgacaggggccaacgctggtgttggtgaggagctggcctatcactacgcgcgtctgggctcccacctggtgctcactgcccacactgaggctctcctgcagaagggtcggcccgaaataggcggagttgggattcgaactcatttcacaggcagagggaggagagcagccatagccacctccactggttccgactccagctcccgggctcgcaggagtaaacgcgcatgctcagggagctcggtcgcgcatgctcagcgcaacggcggggaagactccagccgccagggggagcgcgtgccgttcttgcctctctggcctgcgcctcctgagccgagtagatatcccggagttccgcgcggcgccagcccttccgccacggccgtctctggagagcagcaggtaagtggtttcccgcactgccggtatccgccgccatccggactcccgggtcctctgtgcaggttggaggatggttggttgtggcgagcgaggctgaaggagccgggacgcggggctctgggcctcgggaactgagccggtactcacctccgccccttctccccgtcgctgtccgcagccatggccctacgctaccctatggccgtgggcctcaacaagggccacaaagtgaccaagaacgtgagcaagcccaggcacagccgacgccgcgggcgtctgaccaaacacaccaagttcgtgcgggacatgattcgggaggtgtgtggctttgccccgtacgagcggcgcgccatggagttactgaaggtctccaaggacaaacgggccctcaaatttatcaagaaaagggtggggacgcacatccgcgccaagaggaagcgggaggagctgagcaacgtactggccgccatgaggaaagctgctgccaagaaagactgagcccctcccctgccctctccctgaaataaagaacagcttgacagaaaaaaaaaaaaaaaaaaaaaaaaaaaaaaaaaaaaaaaaaaaaaaaaaaaaaaaaaaaaaaaaaaaaaaaaaaccnttgtgggccgcttgggccnantcaattttaaattgggnangtttntgcttgcggccnnatttggggctaattngnccanttcgccntatagggngnggtttnannattnattgcccgggtttnacacgnggggactgggaaaacccttggggttaccaaatttattggccttgggaaaaattccccttttcccagttggtgaaaagcaaaaaggccgaccggatcgccctcccaaaagttggccacctaatgggaatggaaatttaagcgtaatattttgtaaaaaccggttaaatttttggaaaaagctctttttataccaaagggcggaattggaaaatccttttaaattaaagataaaccggggtgggggttttccatttggctcc

SEQ ID NO: 279075 - DNA, 1696 bp, Homo sapiens
agtcgtggtgtcttgcggctctgagactccagagaagggctgcggtctcgcagcggagggccgctgggaaatggacgctttaaggcccgggccgccgcaaggctgtctgggaaatgtagtcagcacggcgctgtttgcacctggccgcggagcctcctgggaaatgtagttcggcccggccctggcaccgtgaggggaaagaggcgtcaggtgcctggctgaagcctgaaggtgacccgaaaacaagtcagagcccgagagatccacccgcgcccgcgcgggggaccaagggcccggatttaagaagagtgtgcctacaaggcggttgtcacggcaacgagagggcgggattgttcgagcgctgcggccccctcacgtgatcgattcggaggcggggcgtccgcccagtgggcggggccgggcccctgctgggaggcgaagaccaggcgggcactgttgcccggcgacgctccggcgctgggtccccgaggcccggcccctccccgggaggaggtgggcttcgagtcacgtgacccgtgccctacgggagggggtgcggtcggggacccggcaggaggcggccgagaagagaggaccgtgggggcgttcgcgtggctcccagcccgggaccccacccccgctggacagtgggggaaactgaggcctgagcggagtgaccaccccggctatggccagccagcctccagggagcgcgagtgctgctgacaggggccaacgctggtgttggtgaggagctggcctatcactacgcgcgtctgggctcccacctggtgctcactgcccacactgaggctctcctgcagaagggtcggcccgaaataggcggagttgggattcgaactcatttcacaggcagagggaggagagcagccatagccacctccactggttccgactccagctcccgggctcgcaggagtaaacgcgcatgctcagggagctcggtcgcgcatgctcagcgcaacggcggggaagactccagccgccagggggagcgcgtgccgttcttgcctctctggcctgcgcctcctgagccgagtagatatcccggagttccgcgcggcgccagcccttccgccacggccgtctctggagagcagcagccatggccctacgctaccctatggccgtgggcctcaacaagggccacaaagtgaccaagaacgtgagcaagcccaggcacagccgacgccgcgggcgtctgaccaaacacaccaagttcgtgcgggacatgattcgggaggtgtgtggctttgccccgtacgagcggcgcgccatggagttactgaaggtctccaaggacaaacgggccctcaaatttatcaagaaaagggtggggacgcacatccgcgccaagaggaagcgggaggagctgagcaacgtactggccgccatgaggaaagctgctgccaagaaagactgagcccctcccctgccctctccctgaaataaagaacagcttgacagaagccctggctctcctgctgtccgtgggtgggtgtgggtgtgtcgggggcccgcagtcccctgtctggtgcccgctctgagccacaccctctccgggtgctgcctggtcgtgaatcaaaagccgtggcccgcccacccttcccggggcagcaggtgaggaagccgccgtactgcaaatgactttaatcattaaatagcttctatgcca

SEQ ID NO: 279076 - DNA, 1949 bp, Homo sapiens
agtcgtggtgtcttgcggctctgagactccagagaagggctgcggtctcgcagcggagggccgctgggaaatggacgctttaaggcccgggccgccgcaaggctgtctgggaaatgtagtcagcacggcgctgtttgcacctggccgcggagcctcctgggaaatgtagttcggcccggccctggcaccgtgaggggaaagaggcgtcaggtgcctggctgaagcctgaaggtgacccgaaaacaagtcagagcccgagagatccacccgcgcccgcgcgggggaccaagggcccggatttaagaagagtgtgcctacaaggcggttgtcacggcaacgagagggcgggattgttcgagcgctgcggccccctcacgtgatcgattcggaggcggggcgtccgcccagtgggcggggccgggcccctgctgggaggcgaagaccaggcgggcactgttgcccggcgacgctccggcgctgggtccccgaggcccggcccctccccgggaggaggtgggcttcgagtcacgtgacccgtgccctacgggagggggtgcggtcggggacccggcaggaggcggccgagaagagaggaccgtgggggcgttcgcgtggctcccagcccgggaccccacccccgctggacagtgggggaaactgaggcctgagcggagtgaccaccccggctatggccagccagcctccagggagcgcgagtgctgctgacaggggccaacgctggtgttggtgaggagctggcctatcactacgcgcgtctgggctcccacctggtgctcactgcccacactgaggctctcctgcagaaggcgggctggactacctcgtgctgaaccacatcggcggcgccccggccggcacgcgagcccgcagcccccaggcaactcgctggctcatgcaggtaaactttgtgagctacgtgcaactgacgtcgcgggcgctgcccagcctgacggacagcaagggctccctggtggtggtgtcctcgctgctcggccgcgtgcccacgtcgttctccactccctactcggcggccaagtttgcgctggacggcttcttcggctccctgcggcgggagctggacgtgcaggacgtgaacgtggccatcaccatgtgcgtcctgggcctccgagatcgcgcctccgccgccgaggcagtcaggggagtcacgagggtcaaggcggccccggggcccaaggcagccctggccgtgatccgcggcggcgccacgcgcgcggccggcgtcttctacccgtggcgtttccgcctgctgtgcttgctccggcgctggctaccgcgcccgcgggcctggtttatccgccaggagctcaacgtcacggccgcggcagcctgagcaccggggggtgcccctccagtcccagacggcaatgttcctccctccaactgtccctggagccagaacactcacagagacacccctgagagggtggccacagcccaagatgaagtcatcaagacagaaaagcaaaaccgagaaaaacgacgggcacctggaaccagtcacggcttgggaggtgcaggtgccccgtgttaggcgcctttgtcggggacttgcaaggcctcacctgtttggccatgattgatgacgtgactgcttccattttgcagatgaggaaactaaggctcagagaggccacgccacccttgagccacccatggacccctctccatctcctgcctgcgcctttaagtccctgatttattctttccattcattccatctgggaggaacccccccaactcctgccagcttcccctagctggggtctctggtactcttcacacctgcaggggcgtctacactgttcgtctacctggtggcagggtctgagcgggaggaggagggaaagagtgtgttctgagctggacccagcctcttgttcgagaataaaaactcttcttctcttgca

SEQ ID NO: 279077 - DNA, 2012 bp, Homo sapiens
agtcgtggtgtcttgcggctctgagactccagagaagggctgcggtctcgcagcggagggccgctgggaaatggacgctttaaggcccgggccgccgcaaggctgtctgggaaatgtagtcagcacggcgctgtttgcacctggccgcggagcctcctgggaaatgtagttcggcccggccctggcaccgtgaggggaaagaggcgtcaggtgcctggctgaagcctgaaggtgacccgaaaacaagtcagagcccgagagatccacccgcgcccgcgcgggggaccaagggcccggatttaagaagagtgtgcctacaaggcggttgtcacggcaacgagagggcgggattgttcgagcgctgcggccccctcacgtgatcgattcggaggcggggcgtccgcccagtgggcggggccgggcccctgctgggaggcgaagaccaggcgggcactgttgcccggcgacgctccggcgctgggtccccgaggcccggcccctccccgggaggaggtgggcttcgagtcacgtgacccgtgccctacgggagggggtgcggtcggggacccggcaggaggcggccgagaagagaggaccgtgggggcgttcgcgtggctcccagcccgggaccccacccccgctggacagtgggggaaactgaggcctgagcgggcccacacaggaccatgaaggtgcttctcctcacagggctgggggccctgttcttcgcctattattgggatgacaacttcgacccagccagcctccagggagcgcgagtgctgctgacaggggccaacgctggtgttggtgaggagctggcctatcactacgcgcgtctgggctcccacctggtgctcactgcccacactgaggctctcctgcagaaggcgggctggactacctcgtgctgaaccacatcggcggcgccccggccggcacgcgagcccgcagcccccaggcaactcgctggctcatgcaggtaaactttgtgagctacgtgcaactgacgtcgcgggcgctgcccagcctgacggacagcaagggctccctggtggtggtgtcctcgctgctcggccgcgtgcccacgtcgttctccactccctactcggcggccaagtttgcgctggacggcttcttcggctccctgcggcgggagctggacgtgcaggacgtgaacgtggccatcaccatgtgcgtcctgggcctccgagatcgcgcctccgccgccgaggcagtcaggggagtcacgagggtcaaggcggccccggggcccaaggcagccctggccgtgatccgcggcggcgccacgcgcgcggccggcgtcttctacccgtggcgtttccgcctgctgtgcttgctccggcgctggctaccgcgcccgcgggcctggtttatccgccaggagctcaacgtcacggccgcggcagcctgagcaccggggggtgcccctccagtcccagacggcaatgttcctccctccaactgtccctggagccagaacactcacagagacacccctgagagggtggccacagcccaagatgaagtcatcaagacagaaaagcaaaaccgagaaaaacgacgggcacctggaaccagtcacggcttgggaggtgcaggtgccccgtgttaggcgcctttgtcggggacttgcaaggcctcacctgtttggccatgattgatgacgtgactgcttccattttgcagatgaggaaactaaggctcagagaggccacgccacccttgagccacccatggacccctctccatctcctgcctgcgcctttaagtccctgatttattctttccattcattccatctgggaggaacccccccaactcctgccagcttcccctagctggggtctctggtactcttcacacctgcaggggcgtctacactgttcgtctacctggtggcagggtctgagcgggaggaggagggaaagagtgtgttctgagctggacccagcctcttgttcgagaataaaaactcttcttctcttgca

SEQ ID NO: 279078 - DNA, 1990 bp, Homo sapiens
agtcgtggtgtcttgcggctctgagactccagagaagggctgcggtctcgcagcggagggccgctgggaaatggacgctttaaggcccgggccgccgcaaggctgtctgggaaatgtagtcagcacggcgctgtttgcacctggccgcggagcctcctgggaaatgtagttcggcccggccctggcaccgtgaggggaaagaggcgtcaggtgcctggctgaagcctgaaggtgacccgaaaacaagtcagagcccgagagatccacccgcgcccgcgcgggggaccaagggcccggatttaagaagagtgtgcctacaaggcggttgtcacggcaacgagagggcgggattgttcgagcgctgcggccccctcacgtgatcgattcggaggcggggcgtccgcccagtgggcggggccgggcccctgctgggaggcgaagaccaggcgggcactgttgcccggcgacgctccggcgctgggtccccgaggcccggcccctccccgggaggaggtgggcttcgagtcacgtgacccgtgccctacgggagggggtgcggtcggggacccggcaggaggcggccgagaagagaggaccgtgggggcgttcgcgtggctcccagcccgggaccccacccccgctggacagtgggggaaactgaggcctgagcgggcccacacaggaccatgaaggtgcttctcctcacagggctgggggccctgttcttcgcctattattgggatgacaacttcgacggtggtagggaactgccggaagctgggcgcccccaaggtcttctacatcgcggcggacatggcctcccctgaggcgcccgagagcgtggtgcagtttgcgctggacaagctgggcgggctggactacctcgtgctgaaccacatcggcggcgccccggccggcacgcgagcccgcagcccccaggcaactcgctggctcatgcaggtaaactttgtgagctacgtgcaactgacgtcgcgggcgctgcccagcctgacggacagcaagggctccctggtggtggtgtcctcgctgctcggccgcgtgcccacgtcgttctccactccctactcggcggccaagtttgcgctggacggcttcttcggctccctgcggcgggagctggacgtgcaggacgtgaacgtggccatcaccatgtgcgtcctgggcctccgagatcgcgcctccgccgccgaggcagtcaggggagtcacgagggtcaaggcggccccggggcccaaggcagccctggccgtgatccgcggcggcgccacgcgcgcggccggcgtcttctacccgtggcgtttccgcctgctgtgcttgctccggcgctggctaccgcgcccgcgggcctggtttatccgccaggagctcaacgtcacggccgcggcagcctgagcaccggggggtgcccctccagtcccagacggcaatgttcctccctccaactgtccctggagccagaacactcacagagacacccctgagagggtggccacagcccaagatgaagtcatcaagacagaaaagcaaaaccgagaaaaacgacgggcacctggaaccagtcacggcttgggaggtgcaggtgccccgtgttaggcgcctttgtcggggacttgcaaggcctcacctgtttggccatgattgatgacgtgactgcttccattttgcagatgaggaaactaaggctcagagaggccacgccacccttgagccacccatggacccctctccatctcctgcctgcgcctttaagtccctgatttattctttccattcattccatctgggaggaacccccccaactcctgccagcttcccctagctggggtctctggtactcttcacacctgcaggggcgtctacactgttcgtctacctggtggcagggtctgagcgggaggaggagggaaagagtgtgttctgagctggacccagcctcttgttcgagaataaaaactcttcttctcttgca

SEQ ID NO: 279079 - DNA, 1959 bp, Homo sapiens
agtcgtggtgtcttgcggctctgagactccagagaagggctgcggtctcgcagcggagggccgctgggaaatggacgctttaaggcccgggccgccgcaaggctgtctgggaaatgtagtcagcacggcgctgtttgcacctggccgcggagcctcctgggaaatgtagttcggcccggccctggcaccgtgaggggaaagaggcgtcaggtgcctggctgaagcctgaaggtgacccgaaaacaagtcagagcccgagagatccacccgcgcccgcgcgggggaccaagggcccggatttaagaagagtgtgcctacaaggcggttgtcacggcaacgagagggcgggattgttcgagcgctgcggccccctcacgtgatcgattcggaggcggggcgtccgcccagtgggcggggccgggcccctgctgggaggcgaagaccaggcgggcactgttgcccggcgacgctccggcgctgggtccccgaggcccggcccctccccgggaggaggtgggcttcgagtcacgtgacccgtgccctacgggagggggtgcggtcggggacccggcaggaggcggccgagaagagaggaccgtgggggcgttcgcgtggctcccagcccgggaccccacccccgctggacagtgggggaaactgaggcctgagcgggcccacacaggaccatgaaggtgcttctcctcacagggctgggggccctgttcttcgcctattattgggatgacaacttcgacccagccagcctccagggagcgcgagtgctgctgacaggggccaacgctggtgttggtgaggagctggcctatcactacgcgcgtctgggctcccacctggtgctcactgcccacactgaggctctcctgcagaaggggtggtagggaactgccggaagctgggcgcccccaaggtcttctacatcgcggcggacatggcctcccctgaggcgcccgagagcgtggtgcagtttgcgctggacaagctgggcgggctggactacctcgtgctgaaccacatcggcggcgccccggccggcacgcgagcccgcagcccccaggcaactcgctggctcatgcaggtaaactttgtgagctacgtgcaactgacgtcgcgggcgctgcccagcctgacggacagcaagggctccctggtggtggtgtcctcgctgctcggccgcgtgcccacgtcgttctccactccctactcggcggccaagtttgcgctggacggcttcttcggctccctgcggcgggagctggacgtgcaggacgtgaacgtggccatcaccatgtgcgtcctgggcctccgagatcgcgcctccgccgccgaggcagtagctcaacgtcacggccgcggcagcctgagcaccggggggtgcccctccagtcccagacggcaatgttcctccctccaactgtccctggagccagaacactcacagagacacccctgagagggtggccacagcccaagatgaagtcatcaagacagaaaagcaaaaccgagaaaaacgacgggcacctggaaccagtcacggcttgggaggtgcaggtgccccgtgttaggcgcctttgtcggggacttgcaaggcctcacctgtttggccatgattgatgacgtgactgcttccattttgcagatgaggaaactaaggctcagagaggccacgccacccttgagccacccatggacccctctccatctcctgcctgcgcctttaagtccctgatttattctttccattcattccatctgggaggaacccccccaactcctgccagcttcccctagctggggtctctggtactcttcacacctgcaggggcgtctacactgttcgtctacctggtggcagggtctgagcgggaggaggagggaaagagtgtgttctgagctggacccagcctcttgttcgagaataaaaactcttcttctcttgca

SEQ ID NO: 279080 - DNA, 1219 bp, Homo sapiens
agtcgtggtgtcttgcggctctgagactccagagaagggctgcggtctcgcagcggagggccgctgggaaatggacgctttaaggcccgggccgccgcaaggctgtctgggaaatgtagtcagcacggcgctgtttgcacctggccgcggagcctcctgggaaatgtagttcggcccggccctggcaccgtgaggggaaagaggcgtcaggtgcctggctgaagcctgaaggtgacccgaaaacaagtcagagcccgagagatccacccgcgcccgcgcgggggaccaagggcccggatttaagaagagtgtgcctacaaggcggttgtcacggcaacgagagggcgggattgttcgagcgctgcggccccctcacgtgatcgattcggaggcggggcgtccgcccagtgggcggggccgggcccctgctgggaggcgaagaccaggcgggcactgttgcccggcgacgctccggcgctgggtccccgaggcccggcccctccccgggaggaggtgggcttcgagtcacgtgacccgtgccctacgggagggggtgcggtcggggacccggcaggaggcggccgagaagagaggaccgtgggggcgttcgcgtggctcccagcccgggaccccacccccgctggacagtgggggaaactgaggcctgagcggggcctgtgccggccacctctgtcccctgtccctctgcaggcccacacaggaccatgaaggtgcttctcctcacagggctgggggccctgttcttcgcctattattgggatgacaacttcgacccagccagcctccagggagcgcgagtgctgctgacaggggccaacgctggtgttggtgaggagctggcctatcactacgcgcgtctgggctcccacctggtgctcactgcccacactgaggctctcctgcagaaggaggcacggtggctcacgcttgtagtcagcactttgggaggccgaggaaagtggatcacctgaggtcaggagttcaagaccagcctggccaacatggcgaaacctggtctctactaagaagacaaaaattaggccaggcatggtggctcatgcctgtaatcctagcactttgggaggccaaggcggatggatcacttgaggtcaggagttcaaaaccagcctggccaacatggtgaaaccctgtctctactaaaaatacaaaaaataaaaataaaataaataaataaaaa

SEQ ID NO: 279081 - DNA, 702 bp, Homo sapiens
aaaaaaaattgtccccatgtagacagcatgatattatgaagtgtttttggaaaagtgcttcatagctaaagagcagagtgtaagagttcgttagtgtttcttaaggaaagcaatggcaagttctcttacaaatggacaaaataatcttgtatgtctgaagtgatagtgtacagtacaggaaatgtagctgttactgagctataatgggggcttggttctaccatatctctactttgtgtttatgtttgtgtatgcatgtactccaaagtctttctaatgttgctttaatttccaaaaatgtatgcattgctttaacaatacatgtgatgtgtcatattacagatggggtcacagtggttataaagagttataccctgaagaatttgaaacagacaggtaaggaaaataggcttactgaaagaaactaagatggtacaaaatctgtattataaattgatttcttaacttttacgaagaatatacttgccatcaaaaatgtagctagagaaacaataggtgatttagttaggaggtgatccctgttttcccattctctggttgatgtttggcatgtctgtaagcattttggtttttatatatagtattccatacagtaactcagtatggcagcttagaatttttaccttcattttaaagatgaggaaacaaaaactcaatgagaatattaaagtgttaaagtat

SEQ ID NO: 279082 - DNA, 3695 bp, Homo sapiens
ttctcccaaaccacttcttcccccctaccccccgccacgcgaggctgcggcgcacggtatgggtgtgtttgtgtgtatttgtgtggggagggcgtttggagggaaggttaccgggagctccgaggccgctggggaacagggatcccggtgacaaagatggggatatttcctctgtcttccacttggaaacctcaacccccgcttcaggctccctagatactttctggggcccaaccgaaggccgtagccatccaaagcgttcccagcctttctggggagtgaaacttacccccggggttcgtcctagaggagcgtgagcggggaatgcccaggtcaaccgggctgtccgaattccgccccggctcagcctccggcctcagtccgggagagagatctgcctgtcggtctgggctgggggaaacgcggcagtggcctgggccacaggtgagggcagagtaaccagtgggaaggctgcgttttcacgaaggactcgggtgaagctgcagagctgcctttgagccctgactccttggcttcctgggtcggaggagatcttgtaatggagtggttcttcgtctcactagcaagatgcctgatttcctcaggatcaagggattgaagaatgtcccggattccactggggaaggtcctcctgaggaatgtcatccggcacacagatgctcacaataagattcaggaggaatcagatatgtggaaaataagagaactggaaaaacagatggaagatgcttaccgggggaccaaaaggaaaatgctacccagcagttcaagccggatgcgcagtgatggttttgatgaagaaagtcaaagatactattggaggccaaagaatgaaatttctgggacactggaagatgattttcttaaggctaaatcctggaataaaaagttctatgattatgaagcaaacatgccagacagatggggtcacagtggttataaagagttataccctgaagaatttgaaacagacagtagtgatcagcaagatattaccaacgggaagaaaacatctccccaggtaaagtcatctacccatgaatcccgcaaacacaagaagtcaaagaaatcccacaaaaaaaagcagaaaaaaaggtcacacaaaaaacagaagaaaagcaaaaaggaagccacagatataacagcagattcctcgagtgagttctcagaagaaactggggcttctggtacaaggaaagggaaacaaccacataaacgcaagaaaaaatccaggaaaaagtctctcaaaaaacctgctttattcttagaggcagaaagtaacacttcacattcagatgattcagcatccagcagttctgaggaaagtgaggaaagagacactaagaaaaccaaaaggaaaaagagagagaaaaaagcccatacctctgtagccaacaatgaaatacaggagaggacaaacaaacgcacaaattggaaagtagctacagatgaaaggtctgctgagagctcagaggatgactaaatgggaaacacttttgttttccacatgactgtggatatttacagttcttactccttgtggttttgccagtgactcttgttcagcacggggcctgaggtcagagctgtcttgtgccatctgtatgttctgacagacgtcttgtcttctattttggcgttaagcttgatccccttttcttgttaaaagggaatctggtattttgttatgaaggtttcttgaagagattatttttttttgcaattaattacgtttagtgtagagtgcatatacagcaaattaaaggacccagaaagctggatccaatagtgacctgggtacaccaatcggaatattgaatttggggaagtcaagggctgggatcaagaggtggattggaactaatgccatgtaggatggtatgacaaggcaacactgtattgctctctgtttatatagcaggtgtcacaactaacttgtctttagccttggtgctttgatccttctatattttgaccccacaggtgtggtccggtttacttaatcaggacatgggcctaagaacaaaccttttcccttcatgataacatccatagacaacttattagaagggactagagtttttgcaaatttccctgctggatggggcctatagctatacttagtatatgcctaaacatggtaattggatagtaaatggttttctagttccattgctgtatatttgcctaaatggacttgtgttcaaattatttcttcaattgtcatagataatcctgtaccaaatggggaagaattaggaaataatcatgttgtctaatggtactctggattcagggcagcaactgccatttaaatgttgtcttgttcatttctaaatctgttcatgaagtttaggttttccctgaaactaagttgaattatttccaaaatgaaacaggcttctcagggacatatccacttcttcccagtctgcctttggattaaagcaccaagcagagaccacattaattccctttgctatactgtgatccttagtatgttaattcttaagaaaccaacatatcactgaaagaaggctggcagaacgcaagtgcattttttcactgtgggaagaaagatcaagtgacgtattattttttcctggttgtcacttaatgggctgagtaaaaagcttgaaaactcagactttcggtcttggttctgccactcattggttatgaggaggcccagagcaggtaagttcaccttcctggccttactttcctgatgtgtaatacggaattacttcacagtagcatgacagtataagacaccagcagtagatacaactatgatgacattccatgagttggtatttttagttctaactgctaaatttgttctctttacgggacagatttctaataaagtgcttggtcttaaaatacatggttggacagaggtgccctatcccttaactatgagcaggtgctaccttttgggatatttattttaaattttaatactttggtactcaattgtcagtgttccatggtgtgtatttttatttttgggattagtgggggtctaaagggagaagaatagtctctaattactacctcttaacctaaagcaattattttgttcctggagcaagttaaatctttgttggaaggagctttggccatatattttttagcatgcattgtttctgtgccctgaaagtacctgaaaggttttaagcacagactcaggaaaatgtgccagtagaacaggccatctccaggaaattggctctatttgggtcctgaccttcccttcctcccaagttagcaggcttgttcttttgcaaggaatacacatcttgccttttttttttttttttttttgccatgttttccttttcttggtcatgtataagcaataaagctgttttttgttcttcatctttcttaaccccaaattttcttctatgccttaggcttcgatggttcttccaacccccttaatatggcttagggtggtttttcaaaacctacaatcccccatttgcactactggccatggaacatttatttctagtgttcctgccaatcagagatctctatattaaattctaaaatgggattaaaagaagagttggagaattcacacttattgagtaactgatgtcatacaacctggaatttctgaattccaaataaataaatttcactctttgaaaaaaacatct

SEQ ID NO: 279083 - DNA, 3167 bp, Homo sapiens
ttctcccaaaccacttcttcccccctaccccccgccacgcgaggctgcggcgcacgcaagatgcctgatttcctcaggatcaagggattgaagaatgtcccggattccactggggaaggtcctcctgaggaatgtcatccggcacacagatgctcacaataagattcaggaggaatcagatatgtggaaaataagagaactggaaaaacagatggaagatgcttaccgggggaccaaaaggaaaatgctacccagcagttcaagccggatgcgcagtgatggttttgatgaagaaagtcaaagatactattggaggccaaagaatgaaatttctgggacactggaagatgattttcttaaggctaaatcctggaataaaaagttctatgattatgaagcaaacatgccagacagatggggtcacagtggttataaagagttataccctgaagaatttgaaacagacagtagtgatcagcaagatattaccaacgggaagaaaacatctccccaggtaaagtcatctacccatgaatcccgcaaacacaagaagtcaaagaaatcccacaaaaaaaagcagaaaaaaaggtcacacaaaaaacagaagaaaagcaaaaaggaagccacagatataacagcagattcctcgagtgagttctcagaagaaactggggcttctggtacaaggaaagggaaacaaccacataaacgcaagaaaaaatccaggaaaaagtctctcaaaaaacctgctttattcttagaggcagaaagtaacacttcacattcagatgattcagcatccagcagttctgaggaaagtgaggaaagagacactaagaaaaccaaaaggaaaaagagagagaaaaaagcccatacctctgtagccaacaatgaaatacaggagaggacaaacaaacgcacaaattggaaagtagctacagatgaaaggtctgctgagagctcagaggatgactaaatgggaaacacttttgttttccacatgactgtggatatttacagttcttactccttgtggttttgccagtgactcttgttcagcacggggcctgaggtcagagctgtcttgtgccatctgtatgttctgacagacgtcttgtcttctattttggcgttaagcttgatccccttttcttgttaaaagggaatctggtattttgttatgaaggtttcttgaagagattatttttttttgcaattaattacgtttagtgtagagtgcatatacagcaaattaaaggacccagaaagctggatccaatagtgacctgggtacaccaatcggaatattgaatttggggaagtcaagggctgggatcaagaggtggattggaactaatgccatgtaggatggtatgacaaggcaacactgtattgctctctgtttatatagcaggtgtcacaactaacttgtctttagccttggtgctttgatccttctatattttgaccccacaggtgtggtccggtttacttaatcaggacatgggcctaagaacaaaccttttcccttcatgataacatccatagacaacttattagaagggactagagtttttgcaaatttccctgctggatggggcctatagctatacttagtatatgcctaaacatggtaattggatagtaaatggttttctagttccattgctgtatatttgcctaaatggacttgtgttcaaattatttcttcaattgtcatagataatcctgtaccaaatggggaagaattaggaaataatcatgttgtctaatggtactctggattcagggcagcaactgccatttaaatgttgtcttgttcatttctaaatctgttcatgaagtttaggttttccctgaaactaagttgaattatttccaaaatgaaacaggcttctcagggacatatccacttcttcccagtctgcctttggattaaagcaccaagcagagaccacattaattccctttgctatactgtgatccttagtatgttaattcttaagaaaccaacatatcactgaaagaaggctggcagaacgcaagtgcattttttcactgtgggaagaaagatcaagtgacgtattattttttcctggttgtcacttaatgggctgagtaaaaagcttgaaaactcagactttcggtcttggttctgccactcattggttatgaggaggcccagagcaggtaagttcaccttcctggccttactttcctgatgtgtaatacggaattacttcacagtagcatgacagtataagacaccagcagtagatacaactatgatgacattccatgagttggtatttttagttctaactgctaaatttgttctctttacgggacagatttctaataaagtgcttggtcttaaaatacatggttggacagaggtgccctatcccttaactatgagcaggtgctaccttttgggatatttattttaaattttaatactttggtactcaattgtcagtgttccatggtgtgtatttttatttttgggattagtgggggtctaaagggagaagaatagtctctaattactacctcttaacctaaagcaattattttgttcctggagcaagttaaatctttgttggaaggagctttggccatatattttttagcatgcattgtttctgtgccctgaaagtacctgaaaggttttaagcacagactcaggaaaatgtgccagtagaacaggccatctccaggaaattggctctatttgggtcctgaccttcccttcctcccaagttagcaggcttgttcttttgcaaggaatacacatcttgccttttttttttttttttttttgccatgttttccttttcttggtcatgtataagcaataaagctgttttttgttcttcatctttcttaaccccaaattttcttctatgccttaggcttcgatggttcttccaacccccttaatatggcttagggtggtttttcaaaacctacaatcccccatttgcactactggccatggaacatttatttctagtgttcctgccaatcagagatctctatattaaattctaaaatgggattaaaagaagagttggagaattcacacttattgagtaactgatgtcatacaacctggaatttctgaattccaaataaataaatttcactctttgaaaaaaacatct

SEQ ID NO: 279084 - DNA, 2911 bp, Homo sapiens
ttctcccaaaccacttcttcccccctaccccccgccacgcgaggctgcggcgcacggtatgggtgtgtttgtgtgtatttgtgtggggagggcgtttggagggaaggttaccgggagctccgaggccgctggggaacagggatcccggtgacaaagatggggatatttcctctgtcttccacttggaaacctcaacccccgcttcaggctccctagatactttctggggcccaaccgaaggccgtagccatccaaagcgttcccagcctttctggggagtgaaacttacccccggggttcgtcctagaggagcgtgagcggggaatgcccaggtcaaccgggctgtccgaattccgccccggctcagcctccggcctcagtccgggagagagatctgcctgtcggtctgggctgggggaaacgcggcagtggcctgggccacaggtgagggcagagtaaccagtgggaaggctgcgttttcacgaaggactcgggtgaagctgcagagctgcctttgagccctgactccttggcttcctgggtcggaggagatcttgtaatggagtggttcttcgtctcactagcaagatgcctgatttcctcaggatcaagggattgaagaatgtcccggattccactggggaaggtcctcctgaggaatgtcatccggcacacagatgctcacaataagattcaggaggaatcagatatgtggaaaataagagaactggaaaaacagatggaagatgcttaccgggggaccaaaaggaaaatgctacccagcagttcaagccggatgcgcagtgatggttttgatgaagaaagtcaaagatactattggaggccaaagaatgaaatttctgggacactggaagatgattttcttaaggctaaatcctggaataaaaagttctatgattatgaagcaaacatgccagacagatggggtcacagtggttataaagagttataccctgaagaatttgaaacagacagtagtgatcagcaagatattaccaacgggaagaaaacatctccccaggtaaagtcatctacccatgaatcccgcaaacacaagaagtcaaagaaatcccacaaaaaaaagcagaaaaaaaggtcacacaaaaaacagaagaaaagcaaaaaggaagccacagatataacagcagattcctcgagtgagttctcagaagaaactggggcttctggtacaaggaaagggaaacaaccacataaacgcaagaaaaaatccaggaaaaagtctctcaaaaaacctgctttattcttagaggcagaaagtaacacttcacattcagatgattcagcatccagcagttctgaggaaagtgaggaaagagacactaagaaaaccaaaaggaaaaagagagagaaaaaagcccatacctctgtagccaacaatgaaatacaggagaggacaaacaaacgcacaaattggaaagtagctacagatgaaaggtctgctgagagctcagaggatgactaaatgggaaacacttttgttttccacatgactgtggatatttacagttcttactccttgtggttttgccagtgactcttgttcagcacggggcctgaggtcagagctgtcttgtgccatctgtatgttctgacagacgtcttgtcttctattttggcgttaagcttgatccccttttcttgttaaaagggaatctggtattttgttatgaaggtttcttgaagagattatttttttttgcaattaattacgtttagtgtagagtgcatatacagcaaattaaaggacccagaaagctggatccaatagtgacctgggtacaccaatcggaatattgaatttggggaagtcaagggctgggatcaagaggtggattggaactaatgccatgtaggatggtatgacaaggcaacactgtattgctctctgtttatatagcaggtgtcacaactaacttgtctttagccttggtgctttgatccttctatattttgaccccacaggtgtggtccggtttacttaatcaggacatgggcctaagaacaaaccttttcccttcatgataacatccatagacaacttattagaagggactagagtttttgcaaatttccctgctggatggggcctatagctatacttagtatatgcctaaacatggtaattggatagtaaatggttttctagttccattgctgtatatttgcctaaatggacttgtgttcaaattatttcttcaattgtcatagataatcctgtaccaaatggggaagaattaggaaataatcatgttgtctaatggtactctggattcagggcagcaactgccatttaaatgttgtcttgttcatttctaaatctgttcatgaagtttaggttttccctgaaactaagttgaattatttccaaaatgaaacaggcttctcagggacatatccacttcttcccagtctgcctttggattaaagcaccaagcagagaccacattaattccctttgctatactgtgatccttagtatgttaattcttaagaaaccaacatatcactgaaagaaggctggcagaacgcaagtgcattttttcactgtgggaagaaagatcaagtgacgtattattttttcctggttgtcacttaatgggctgagtaaaaagcttgaaaactcagactttcggtcttggttctgccactcattggttatgaggaggcccagagcaggtaagttcaccttcctggccttactttcctgatgtgtaatacggaattacttcacagtagcatgacagtataagacaccagcagtagatacaactatgatgacattccatgagttggtatttttagttctaactgctaaatttgttctctttacgggacagatttctaataaagtgcttggtcttaaaataca

SEQ ID NO: 279085 - DNA, 3095 bp, Homo sapiens
aaaaaaaattgtccccatgtagacagcatgatattatgaagtgtttttggaaaagtgcttcatagctaaagagcagagtgtaagagttcgttagtgtttcttaaggaaagcaatggcaagttctcttacaaatggacaaaataatcttgtatgtctgaagtgatagtgtacagtacaggaaatgtagctgttactgagctataatgggggcttggttctaccatatctctactttgtgtttatgtttgtgtatgcatgtactccaaagtctttctaatgttgctttaatttccaaaaatgtatgcattgctttaacaatacatgtgatgtgtcatattacagatggggtcacagtggttataaagagttataccctgaagaatttgaaacagacagtagtgatcagcaagatattaccaacgggaagaaaacatctccccaggtaaagtcatctacccatgaatcccgcaaacacaagaagtcaaagaaatcccacaaaaaaaagcagaaaaaaaggtcacacaaaaaacagaagaaaagcaaaaaggaagccacagatataacagcagattcctcgagtgagttctcagaagaaactggggcttctggtacaaggaaagggaaacaaccacataaacgcaagaaaaaatccaggaaaaagtctctcaaaaaacctgctttattcttagaggcagaaagtaacacttcacattcagatgattcagcatccagcagttctgaggaaagtgaggaaagagacactaagaaaaccaaaaggaaaaagagagagaaaaaagcccatacctctgtagccaacaatgaaatacaggagaggacaaacaaacgcacaaattggaaagtagctacagatgaaaggtctgctgagagctcagaggatgactaaatgggaaacacttttgttttccacatgactgtggatatttacagttcttactccttgtggttttgccagtgactcttgttcagcacggggcctgaggtcagagctgtcttgtgccatctgtatgttctgacagacgtcttgtcttctattttggcgttaagcttgatccccttttcttgttaaaagggaatctggtattttgttatgaaggtttcttgaagagattatttttttttgcaattaattacgtttagtgtagagtgcatatacagcaaattaaaggacccagaaagctggatccaatagtgacctgggtacaccaatcggaatattgaatttggggaagtcaagggctgggatcaagaggtggattggaactaatgccatgtaggatggtatgacaaggcaacactgtattgctctctgtttatatagcaggtgtcacaactaacttgtctttagccttggtgctttgatccttctatattttgaccccacaggtgtggtccggtttacttaatcaggacatgggcctaagaacaaaccttttcccttcatgataacatccatagacaacttattagaagggactagagtttttgcaaatttccctgctggatggggcctatagctatacttagtatatgcctaaacatggtaattggatagtaaatggttttctagttccattgctgtatatttgcctaaatggacttgtgttcaaattatttcttcaattgtcatagataatcctgtaccaaatggggaagaattaggaaataatcatgttgtctaatggtactctggattcagggcagcaactgccatttaaatgttgtcttgttcatttctaaatctgttcatgaagtttaggttttccctgaaactaagttgaattatttccaaaatgaaacaggcttctcagggacatatccacttcttcccagtctgcctttggattaaagcaccaagcagagaccacattaattccctttgctatactgtgatccttagtatgttaattcttaagaaaccaacatatcactgaaagaaggctggcagaacgcaagtgcattttttcactgtgggaagaaagatcaagtgacgtattattttttcctggttgtcacttaatgggctgagtaaaaagcttgaaaactcagactttcggtcttggttctgccactcattggttatgaggaggcccagagcaggtaagttcaccttcctggccttactttcctgatgtgtaatacggaattacttcacagtagcatgacagtataagacaccagcagtagatacaactatgatgacattccatgagttggtatttttagttctaactgctaaatttgttctctttacgggacagatttctaataaagtgcttggtcttaaaatacatggttggacagaggtgccctatcccttaactatgagcaggtgctaccttttgggatatttattttaaattttaatactttggtactcaattgtcagtgttccatggtgtgtatttttatttttgggattagtgggggtctaaagggagaagaatagtctctaattactacctcttaacctaaagcaattattttgttcctggagcaagttaaatctttgttggaaggagctttggccatatattttttagcatgcattgtttctgtgccctgaaagtacctgaaaggttttaagcacagactcaggaaaatgtgccagtagaacaggccatctccaggaaattggctctatttgggtcctgaccttcccttcctcccaagttagcaggcttgttcttttgcaaggaatacacatcttgccttttttttttttttttttttgccatgttttccttttcttggtcatgtataagcaataaagctgttttttgttcttcatctttcttaaccccaaattttcttctatgccttaggcttcgatggttcttccaacccccttaatatggcttagggtggtttttcaaaacctacaatcccccatttgcactactggccatggaacatttatttctagtgttcctgccaatcagagatctctatattaaattctaaaatgggattaaaagaagagttggagaattcacacttattgagtaactgatgtcatacaacctggaatttctgaattccaaataaataaatttcactctttgaaaaaaacatct

SEQ ID NO: 279086 - DNA, 3137 bp, Homo sapiens
ttctcccaaaccacttcttcccccctaccccccgccacgcgaggctgcggcgcacgattgaagaatgtcccggattccactggggaaggtcctcctgaggaatgtcatccggcacacagatgctcacaataagattcaggaggaatcagatatgtggaaaataagagaactggaaaaacagatggaagatgcttaccgggggaccaaaaggaaaatgctacccagcagttcaagccggatgcgcagtgatggttttgatgaagaaagtcaaagatactattggaggccaaagaatgaaatttctgggacactggaagatgattttcttaaggctaaatcctggaataaaaagttctatgattatgaagcaaacatgccagacagatggggtcacagtggttataaagagttataccctgaagaatttgaaacagacagtagtgatcagcaagatattaccaacgggaagaaaacatctccccaggtaaagtcatctacccatgaatcccgcaaacacaagaagtcaaagaaatcccacaaaaaaaagcagaaaaaaaggtcacacaaaaaacagaagaaaagcaaaaaggaagccacagatataacagcagattcctcgagtgagttctcagaagaaactggggcttctggtacaaggaaagggaaacaaccacataaacgcaagaaaaaatccaggaaaaagtctctcaaaaaacctgctttattcttagaggcagaaagtaacacttcacattcagatgattcagcatccagcagttctgaggaaagtgaggaaagagacactaagaaaaccaaaaggaaaaagagagagaaaaaagcccatacctctgtagccaacaatgaaatacaggagaggacaaacaaacgcacaaattggaaagtagctacagatgaaaggtctgctgagagctcagaggatgactaaatgggaaacacttttgttttccacatgactgtggatatttacagttcttactccttgtggttttgccagtgactcttgttcagcacggggcctgaggtcagagctgtcttgtgccatctgtatgttctgacagacgtcttgtcttctattttggcgttaagcttgatccccttttcttgttaaaagggaatctggtattttgttatgaaggtttcttgaagagattatttttttttgcaattaattacgtttagtgtagagtgcatatacagcaaattaaaggacccagaaagctggatccaatagtgacctgggtacaccaatcggaatattgaatttggggaagtcaagggctgggatcaagaggtggattggaactaatgccatgtaggatggtatgacaaggcaacactgtattgctctctgtttatatagcaggtgtcacaactaacttgtctttagccttggtgctttgatccttctatattttgaccccacaggtgtggtccggtttacttaatcaggacatgggcctaagaacaaaccttttcccttcatgataacatccatagacaacttattagaagggactagagtttttgcaaatttccctgctggatggggcctatagctatacttagtatatgcctaaacatggtaattggatagtaaatggttttctagttccattgctgtatatttgcctaaatggacttgtgttcaaattatttcttcaattgtcatagataatcctgtaccaaatggggaagaattaggaaataatcatgttgtctaatggtactctggattcagggcagcaactgccatttaaatgttgtcttgttcatttctaaatctgttcatgaagtttaggttttccctgaaactaagttgaattatttccaaaatgaaacaggcttctcagggacatatccacttcttcccagtctgcctttggattaaagcaccaagcagagaccacattaattccctttgctatactgtgatccttagtatgttaattcttaagaaaccaacatatcactgaaagaaggctggcagaacgcaagtgcattttttcactgtgggaagaaagatcaagtgacgtattattttttcctggttgtcacttaatgggctgagtaaaaagcttgaaaactcagactttcggtcttggttctgccactcattggttatgaggaggcccagagcaggtaagttcaccttcctggccttactttcctgatgtgtaatacggaattacttcacagtagcatgacagtataagacaccagcagtagatacaactatgatgacattccatgagttggtatttttagttctaactgctaaatttgttctctttacgggacagatttctaataaagtgcttggtcttaaaatacatggttggacagaggtgccctatcccttaactatgagcaggtgctaccttttgggatatttattttaaattttaatactttggtactcaattgtcagtgttccatggtgtgtatttttatttttgggattagtgggggtctaaagggagaagaatagtctctaattactacctcttaacctaaagcaattattttgttcctggagcaagttaaatctttgttggaaggagctttggccatatattttttagcatgcattgtttctgtgccctgaaagtacctgaaaggttttaagcacagactcaggaaaatgtgccagtagaacaggccatctccaggaaattggctctatttgggtcctgaccttcccttcctcccaagttagcaggcttgttcttttgcaaggaatacacatcttgccttttttttttttttttttttgccatgttttccttttcttggtcatgtataagcaataaagctgttttttgttcttcatctttcttaaccccaaattttcttctatgccttaggcttcgatggttcttccaacccccttaatatggcttagggtggtttttcaaaacctacaatcccccatttgcactactggccatggaacatttatttctagtgttcctgccaatcagagatctctatattaaattctaaaatgggattaaaagaagagttggagaattcacacttattgagtaactgatgtcatacaacctggaatttctgaattccaaataaataaatttcactctttgaaaaaaacatct

SEQ ID NO: 279087 - DNA, 3746 bp, Homo sapiens
ttctcccaaaccacttcttcccccctaccccccgccacgcgaggctgcggcgcacggtatgggtgtgtttgtgtgtatttgtgtggggagggcgtttggagggaaggttaccgggagctccgaggccgctggggaacagggatcccggtgacaaagatggggatatttcctctgtcttccacttggaaacctcaacccccgcttcaggctccctagatactttctggggcccaaccgaaggccgtagccatccaaagcgttcccagcctttctggggagtgaaacttacccccggggttcgtcctagaggagcgtgagcggggaatgcccaggtcaaccgggctgtccgaattccgccccggctcagcctccggcctcagtccgggagagagatctgcctgtcggtctgggctgggggaaacgcggcagtggcctgggccacaggtgagggcagagtaaccagtgggaaggctgcgttttcacgaaggactcgggtgaagctgcagagctgcctttgagccctgactccttggcttcctgggtcggaggagatcttgtaatggagtggttcttcgtctcactagcaagatgcctgatttcctcaggatcaagggattgaagaatgtcccggattccactggggaaggtcctcctgaggaatgtcatccggcacacagatgctcacaataagattcaggaggaatcagatatgtggaaaataagagaactggaaaaacagatggaagatgcttaccgggggaccaaaaggaaaatgctacccagcagttcaagccggatgcgcagtgatggttttgatgaagaaagtcaaagatactattggaggccaaagaatgaaatttctgggacactggaagatgattttcttaaggctaaatcctggaataaaaagttctatgattatgaagcaaacatgccagacagatggggtcacagtggttataaagagttataccctgaagaatttgaaacagacagtagtgatcagcaagatattaccaacgggaagaaaacatctccccaggtaaagtcatctacccatgaatcccgcaaacacaagaagtcaaagaaatcccacaaaaaaaagcagaaaaaaaggtcacacaaaaaacagaagaaaagcaaaaaggaagccacagatataacagcagattcctcgagtgagttctcagaagaaactggggcttctggtacaaggaaagggaaacaaccacataaacgcaagaaaaaatccaggaaaaagtctctcaaaaaacctgctttattcttagaggcagaaagtaacacttcacattcagatgattcagcatccagcagttctgaggaaagtgaggaaagagacactaagaaaaccaaaaggaaaaagagagagaaaaaagcccatacctctgtagccaacaatgaaatacaggagaggacaaacaaacgcacaaattggaaagtagctacagatgaaaggtctgctgagagctcagaggatgactaaatgggaaacacttttgttttccacatgactgtggatatttacagttcttactccttgtggttttgccagtgactcttgttcagcacggggcctgaggtcagagctgtcttgtgccatctgtatgttctgacagacgtcttgtcttctattttggcgttaagcttgatccccttttcttgttaaaagggaatctggtattttgttatgaaggtttcttgaagagattatttttttttgcaattaattacgtttagtgtagagtgcatatacagcaaattaaaggacccagaaagctggatccaatagtgacctgggtacaccaatcggaatattgaatttggggaagtcaagggctgggatcaagaggtggattggaactaatgccatgtaggatggtatgacaaggcaacactgtattgctctctgtttatatagcaggtgtcacaactaacttgtctttagccttggtgctttgatccttctatattttgaccccacaggtgtggtccggtttacttaatcaggacatgggcctaagaacaaaccttttcccttcatgataacatccatagacaacttattagaagggactagagtttttgcaaatttccctgctggatggggcctatagctatacttagtatatgcctaaacatggtaattggatagtaaatggttttctagttccattgctgtatatttgcctaaatggacttgtgttcaaattatttcttcaattgtcatagataatcctgtaccaaatggggaagaattaggaaataatcatgttgtctaatggtactctggattcagggcagcaactgccatttaaatgttgtcttgttcatttctaaatctgttcatgaagtttaggttttccctgaaactaagttgaattatttccaaaatgaaacaggcttctcagggacatatccacttcttcccagtctgcctttggattaaagcaccaagcagagaccacattaattccctttgctatactgtgatccttagtatgttaattcttaagaaaccaacatatcactgaaagaaggctggcagaacgcaagtgcattttttcactgtgggaagaaagatcaagtgacgtattattttttcctggttgtcacttaatgggctgagtaaaaagcttgaaaactcagactttcggtcttggttctgccactcattggttatgaggaggcccagagcaggtaagttcaccttcctggccttactttcctgatgtgtaatacggaattacttcacagtagcatgacagtataagacaccagcagtagatacaactatgatgacattccatgagttggtatttttagttctaactgctaaatttgttctctttacgggacagatttctaataaagtgcttggtcttaaaatacatggttggacagaggtgccctatcccttaactatgagcaggtgctaccttttgggatatttattttaaattttaatactttggtactcaattgtcagtgttccatggtgtgtatttttatttttgggattagtgggggtctaaagggagaagaatagtctctaattactacctcttaacctaaagcaattattttgttcctggagcaagttaaatctttgttggaaggagctttggccatatattttttagcatgcattgtttctgtgccctgaaagtacctgaaaggttttaagcacagactcaggaaaatgtgccagtagaacaggccatctccaggaaattggctctatttgggtcctgaccttcccttcctcccaagttagcaggcttgttcttttgcaaggaatacacatcttgccttttttttttttttttttttgccatgttttccttttcttggtcatgtataagcaataaagctgttttttgttcttcatctttcttaaccccaaattttcttctatgccttaggcttcgatggttcttccaacccccttaatatggcttagggtggtttttcaaaacctacaatcccccatttgcactactggccatggaacatttatttctagtgttcctgccaatcagagatctctatattaaattctaaaatgggattaaaagaagagttggagaattcacacttattgagtaactgatgtcatactaagggggttggaagaaccatcgaagcctaaggcatagaagaaaatttggggttaagaaagatgaagaacaaaaaacagctttattgcttatacatgaccaagaaaa

SEQ ID NO: 279088 - DNA, 1405 bp, Homo sapiens
ttctcccaaaccacttcttcccccctaccccccgccacgcgaggctgcggcgcacggtatgggtgtgtttgtgtgtatttgtgtggggagggcgtttggagggaaggttaccgggagctccgaggccgctggggaacagggatcccggtgacaaagatggggatatttcctctgtcttccacttggaaacctcaacccccgcttcaggctccctagatactttctggggcccaaccgaaggccgtagccatccaaagcgttcccagcctttctggggagtgaaacttacccccggggttcgtcctagaggagcgtgagcggggaatgcccaggtcaaccgggctgtccgaattccgccccggctcagcctccggcctcagtccgggagagagatctgcctgtcggtctgggctgggggaaacgcggcagtggcctgggccacaggtgagggcagagtaaccagtgggaaggctgcgttttcacgaaggactcgggtgaagctgcagagctgcctttgagccctgactccttggcttcctgggtcggaggagatcttgtaatggagtggttcttcgtctcactagcaagatgcctgatttcctcaggatcaagggattgaagaatgtcccggattccactggggaaggtcctcctgaggaatgtcatccggcacacagatgctcacaataagattcaggaggaatcagatatgtggaaaataagagaactggaaaaacagatggaagatgcttaccgggggaccaaaaggaaaatgctacccagcagttcaagccggatgcgcagtgatggttttgatgaagaaagtcaaagatactattggaggccaaagaatgaaatttctgggacactggaagatgattttcttaaggctaaatcctggaataaaaagttctatgattatgaagcaaacatgccagacagatggggtcacagtggttataaagagttataccctgaagaatttgaaacagacagtagtgatcagcaagatattaccaacgggaagaaaacatctccccaggtaaagtcatctacccatgaatcccgcaaacacaagaagtcaaagaaatcccacaaaaaaaagcagaaaaaaaggtcacacaaaaaacagaagaaaagcaaaaaggaagccacagatataacagcagattcctcgagtgagttctcagaagaaactggggcttctggtacaaggaaagggaaacaaccacataaacgcaagaacagaatgaagaaagtcagggggactgcaaaggccaatgttggtgctggcaaaaagtgagctggagattggatcccagccgaaggagtaaaggtgctgcaatgatgttagctgtggcccctgtggatttttcgcaagaacattaataaactaaaaacttca

SEQ ID NO: 279089 - DNA, 785 bp, Homo sapiens
  misc_feature (579)..(579): n is a, c, g, or t
aatcaattcatgttaactataatcaccctattgatctattgaagaacaccaggttttatttcttctatctaactgtatatctgaatgcttcgtcaatctctctttatccctcctctctcaatgtgcagtttcttctagaaccccccacaccaagcttcccttttagcgtcggagaaagctcaagtgaaaaagtgaagcaaagcagttggcaaagagggagacagatgccaccccgaaaggtgccccattaggtgccactctgccatcctgccctctgtcccctcagtcaatgcctggaatggggagatgaggctaaaatttgagagtttgttttaacacaacatcaaagcaatatgagtggaaatctcccttcaaaacatcaggaggaaaatcattgtgtgataggtggatatgaccaaccagcttgaaagttgagatcctaccacatgccaggatgttgtgtcatattttagagggtggaatggaggacaaccagtatctacagctatctaatgtgccatgacacagaaggactttgaaatgtaactgattcatggcgggaaatacctccaatacacntctcgacacttatccccacgaaacgctctcacaggaacacggctggggacgcggcacacatgccactactctggtctcacacgtccgatggacgctcgcgacaagcctaacctggcttcgccttgacagggtcccacgaaatccccaactcgattcgacctgtgcttcacttgttaagcaagtgttgaaactttcgctgtgacctg

SEQ ID NO: 279090 - DNA, 325 bp, Homo sapiens
ctctgcagacgcttggagctgggtcagtccgccgctcaccccgcggcgcaccttcccgccttctagtgacaaccacgaacttgagtgtgtggtccttgcccaggatctcctcgttgcataaaatgtccagctgggggataaggaggtttgattagcagcggagaggtgctcaacccacactgacatggccaccttgatgctggccccatcacaccctgtctaccacacctgccgtactgagcaacgggaagaggtggtttgcagccccatgagcagccctgacagctccggaatcgggcaccctggttccccaggtggcacaggt

SEQ ID NO: 279091 - DNA, 628 bp, Homo sapiens
tttcactcttgttgcccaggctggagtgtaatggcactagacctcggctcactgcaatctccacctcccaggttcaagcgattctcctgcctcagactcctgagtagctgggattacaggcatgcaccaccatgcccggctaattttgtatttttagtagaaacagggtttctccatgttggtcaggctgatctcaaactcccaacctcaggtgatccgcccgcctcggcctcccaaagtgttgggattataggtatgcgccaccatgctaggctaatttttgtattttttgtaaagacaggattttgccatgttacccaggctggtttcaaactcctgggctcaagtgatccacctgcctcggcctcgcaaactgctgggattacaagtgttggcaactgcacccggctccatcttggttattcatagagtttcttgcccatgagctttctcatgttgaataaggaaagtatcataactggaagcttttccacatttgttaacattcacagggcttctctccagtatgaattctctgctgcctagtaagttgacaccgttggctaaaggctttctcgcaatggtcacattcatagggtttgcctccagtgtgtgtcctctcgtgttt

SEQ ID NO: 279092 - DNA, 938 bp, Homo sapiens
cgcgctgcattctgggagttgcagttcccgctgtggccccccgcccccttataaacagccagtctacaagaggcgctagttgcaaagcttccggttctgggggaaggcgtggcttccgcgctctttgaaatgtccggcgccggaatgtctgggtgctttggttggagagggtcccatttccagtcattcttcagcctggtgattcccgcgctcccctgaggagcatatgaagtacgtcggttctgccaggttggaacgcgctgctggacactcggccgtaaggcggatcccggatcccctcccactccgacccttccctccagaagggccggttcccaaacggcccctttagacacatccaagcggttgccgacggccctcacgatgaaaactgctgtccgttggtgaaggcagcctcttctgtgctcctcgccgctgacttcctgaggcggacctacctgtggaggcataccaggaaccagacgatgaccccctccaaaagttgggtctttgaggagagctactaacttgggttcctggtacaccctctacatgcagtggtgaagcttatctaacagtcattcatagaatcagtttgggaaggggaattttcactgaactctcatagagaaactgtgttttagataacagaaagttctgcacggttaaaatggaacagaaatttttttgcacagaaattaggattaccgaaaatactgaagaaagactacctctgattggactcttctcaaggaattaataattcaagaactaaggaaagaaaaaagtgattatatgaaaatactgaagttgatcgtagcagctgaaggctgatcctgtgtgggtaaatgtaaacgctgaattcccacattccaatgtgcgacctgggattaaggcagcaattgagcagggtaatgttactgaggagagcgaacaga

SEQ ID NO: 279093 - DNA, 546 bp, Homo sapiens
cgcgctgcattctgggagttgcagttcccgctgtggccccccgcccccttataaacagccagtctacaagaggcgctagttgcaaagcttccggttctgggggaaggcgtggcttccgcgctctttgaaatgtccggcgccggaatgtctgggtgctttggttggagagggtcccatttccagtcattcttcagcctggtgattcccgcgctcccctgaggagcatatgaagtacgtcggttctgccaggttggaacgcgctgctggacactcggccgtaaggcggatcccggatcccctcccactccgacccttccctccagaagggccggttcccaaacggcccctttagacacatccaagcggttgccgacggccctcacgatgaaaactgctgtccgttggtgaaggcagcctcttctgtgctcctcgccgctgacttcctgaggcaggaggatcctttgagtccagcagtttgaggccagcctggacaccacagcaagaccaccaataaataaataaataaatggaacatgtttccctgtc

SEQ ID NO: 279094 - DNA, 1412 bp, Homo sapiens
cgcgctgcattctgggagttgcagttcccgctgtggccccccgcccccttataaacagccagtctacaagaggcgctagttgcaaagcttccggttctgggggaaggcgtggcttccgcgctctttgaaatgtccggcgccggaatgtctgggtgctttggttggagagggtcccatttccagtcattcttcagcctggtgattcccgcgctcccctgaggagcatatgaagtacgtcggttctgccaggttggaacgcgctgctggacactcggccgtaaggcggatcccggatcccctcccactccgacccttccctccagaagggccggttcccaaacggcccctttagacacatccaagcggttgccgacggccctcacgatgaaaactgctgtccgttggtgaaggcagcctcttctgtgctcctcgccgctgacttcctgaggcggacctacctgtggaggcataccaggaaccagacgatgaccccctccaaaagttgggtctttgaggagagctactaacttgggttcctggtacaccctctacatgcagtggtgaagcttatctaacagtcattcatagaatcagtttgggaaggggaattttcactgaactctcatagagaaactgtgttttagataacagaaagttctgcacggttaaaatggaacagaaatttttttgcacagaaattaggattaccgaaaatactgaagaaagactacctctgattggactcttctcaaggaattaataattcaagaactaaggaaagaaaaaagtgattatatgaaaatactgaagttgatcgtagcagctgaaggctgatcctgtgtgggctgaagtacattggtgcaatcttggctcactgcatctccaccccaggttcaagcgattctcctgcctcagcctcccaagcagctgggattacagaatgtcacataaatggaatcatactgtgtccggaattggtgggttcttggtctcactgacttcaagaatgacgccatggaccctcgcggtgagtgttacagctcttaaggtgggcgcgtctgggagtttgttccttctgatgttcggatgtgttcggagtttcttccttctggtgggttcgtggtctcgctggctcaggagtgaagctgcagactttcgcgatttcatctctctctctgctatggacacagatggcttcactccatcctgtattcttcggaccatgataaaattccagactctcggtagtttttgcgttccaagaagtagagcctagagtggtggcctataattacagttactcaggaggctgaggcaggaggatcctttgagtccagcagtttgaggccagcctggacaccacagcaagaccaccaataaataaataaataaatggaacatgtttccctgtc

SEQ ID NO: 279095 - DNA, 1585 bp, Homo sapiens
cgcgctgcattctgggagttgcagttcccgctgtggccccccgcccccttataaacagccagtctacaagaggcgctagttgcaaagcttccggttctgggggaaggcgtggcttccgcgctctttgaaatgtccggcgccggaatgtctgggtgctttggttggagagggtcccatttccagtcattcttcagcctggtgattcccgcgctcccctgaggagcatatgaagtacgtcggttctgccaggttggaacgcgctgctggacactcggccgtaaggcggatcccggatcccctcccactccgacccttccctccagaagggccggttcccaaacggcccctttagacacatccaagcggttgccgacggccctcacgatgaaaactgctgtccgttggtgaaggcagcctcttctgtgctcctcgccgctgacttcctgaggcggacctacctgtggaggcataccaggaaccagacgatgaccccctccaaaagttgggtctttgaggagagctactaacttgggttcctggtacaccctctacatgcagtggtgaagcttatctaacagtcattcatagaatcagtttgggaaggggaattttcactgaactctcatagagaaactgtgttttagataacagaaagttctgcacggttaaaatggaacagaaatttttttgcacagaaattaggattaccgaaaatactgaagaaagactacctctgattggactcttctcaaggaattaataattcaagaactaaggaaagaaaaaagtgattatatgaaaatactgaagttgatcgtagcagctgaaggctgatcctgtgtgggctgaagtacattggtgcaatcttggctcactgcatctccaccccaggttcaagcgattctcctgcctcagcctcccaagcagctgggattacagaatgtcacataaatggaatcatactgtgtccggaattggtgggttcttggtctcactgacttcaagaatgacgccatggaccctcgcggtgagtgttacagctcttaaggtgggcgcgtctgggagtttgttccttctgatgttcggatgtgttcggagtttcttccttctggtgggttcgtggtctcgctggctcaggagtgaagctgcagactttcgcgatacatcagacagatggtatacatctcttcgtgactcaatctgctgaacgatgcaactgtcacagtattcaacagggtcttactctgtcacctggcctggagtacagtggcacaatcacgcttcgctgcggcctcaacctccctggctcgggcgatcttcctgcctcaggcttccaagtagttgggacagatggtcttactctgttgcccaggctgaggtgcagtggcacgatcttggctcactataacctttgcctcccggattcaagcaattctcctgcctcggcctcccaagtagctgggactacaggccgactaatattccgctgcatcttgctgggcacagtggctcatgcctgaaatccaagcacttcgggagcttgaggtgggtgaatcacttgaggtcaggagtttgagaccagcct

SEQ ID NO: 279096 - DNA, 396 bp, Homo sapiens
gccagcccagaaaggggctcccacagtgcagtggtgggctgaagggctcctcaagtgccgccaaactgggagcccaggcagaggaggtgccgagagcaagcgagggctctgaggactgccagcacgctgtcacctctcaatacaatttcatctctctctctgctatggacacagatggcttcactccatcctgtattcttcggaccatgataaaattccagactctcggtagtttttgcgttccaagaagtagagcctagagtggtggcctataattacagttactcaggaggctgaggcaggaggatcctttgagtccagcagtttgaggccagcctggacaccacagcaagaccaccaataaataaataaataaatggaacatgtttccctgtc

SEQ ID NO: 279097 - DNA, 983 bp, Homo sapiens
ctttagggacagatgacccagcacccctgccttgcacagcctccaccagcctggctgtcctcactgtatcacggtcatcccatcaggagatggggtttcatcatgttggccaggctggtctcgaactcctgaactcaagtgatccacccaccttggcctcccaaagtactgggattacaggcgtgagccaccgcgcctggcgagaaggtgaatttgagctgggtcttggagaatgggggctggaggctccacttccctggagggccagatcccaggaggaactgtggggtggaaaaaacggaggggggggaacagccccagatccacctgccccccaggtctccagccaccggcaccaggtgcaccaggctgtcctcgcaagactggaagtctgtgtccgtgagggcgtcgggtggcatcagcaactcctcatcttgggatgaggatgatgggggctcatcccctgagctcccaggagccccatccccatccccgtccacctctgagtcctgcagcacctgagcgatgtatttctgaaggaggagaggaaatgggggcaaggtgctacagactggccccagcctctcccaggccccttgcctgccacccccagccatgcggcttctcctgtggcctgctctggctggaatccactctgctcgccaccccccgttccctgggtagggatccctcacccgtgcgcatggtggaaaagaagagcagccagaagaggcagaggatgggcgcggccaccacctggttcacagcccccgagtggatcttcttgtccagcttggccggcaggttgttctggtcctgagagtgctgaagggttggccccctcctcctgcccgggccccaggacgggatagtgccccgtgccccagcgtgatcacagaacttcagcttcctccgctacaacccctcattctactctcctcatcaggaattctactattggaaatctagtcatttgaatcaac

SEQ ID NO: 279098 - DNA, 1910 bp, Homo sapiens
aacagctgctgctggctcttcctcttgcggccttttcctgaaacggattcttctttcggggaacagaaagcgccagccatgcagccttggcacggaaaggccatgcagagagcttccgaggccggagccactgcccccaaggcttccgcacggaatgccaggggcgccccgatggatcccaacgagtctccggctgcccccgaggccgccctgcctaaggcgggaaagttcggccccgccaggaagtcgggatcccggcagaaaaagagcgccccggacacccaggagaggccgcccgtccgcgcaactggggcccgcgccaaaaaggcccctcagcgcgcccaggacacgcagccgtctgacgccaccagcgcccctggggcagaggggctggagcctcctgcggctcgggagccggctctttccagggctggttcttgccgccagaggggcgcgcgctgctccacgaagccaagacccccgcccgggccctgggacgtgcccagccccggcctgccggtctcggcccccattctcgtacggagggatgcggcgcctggggcctcgaagctccgggcggttttggagaagttgaagctcagccgcgatgatatctccacggcggcggggatggtgaaaggggttgtggaccacctgctgctcagactgaagtgcgactccgcgttcagaggcgtcgggctgctgaacaccgggagctactatgagcacgtgaagatttctgcacctaatgaatttgatgtcatgtttaaactggaagtccccagaattcaactagaagaatattccaacactcgtgcatattactttgtgaaatttaaaagaaatccgaaagaaaatcctctgagtcagtttttagaaggtgaaatattatcagcttctaagatgctgtcaaagtttaggaaaatcattaaggaagaaattaacgacattaaagatacagatgtcatcatgaagaggaaaagaggagggagccctgctgtaacacttcttattagtgaaaaaatatctgtggatataaccctggctttggaatcaaaaagtagctggcctgctagcacccaagaaggcctgcgcattcaaaactggctttcagcaaaagttaggaagcaactacgactaaagccattttaccttgtacccaagcatgcaaaggaaggaaatggtttccaagaagaaacatggcggctatccttctctcacatcgaaaaggaaattttgaacaatcatggaaaatctaaaacgtgctgtgaaaacaaagaagagaaatgttgcaggaaagattgtttaaaactaatgaaataccttttagaacagctgaaagaaaggtttaaagacaaaaaacatctggataaattctcttcttatcatgtgaaaactgccttctttcacagactctactgatatatttccaagtattaggtcacttgataagtgatccgcactgaagcaaaagataaactcagcattcttaggtgcttattctaatgccaccagttttacttctgttagcaaaaatctaaagtaacataacagacttatcacccccatttggaattagtatacaaatagaaatgatcctaatcaatttaattaattataatggacacacaagaaaaaatacctacacagcttttcgagaaacgaagacaatgactttgtctgtggatgacatactctgtagaaaagtttgcatgtgactccatttctcttcctcggtggttacaattatattttgcttcactgaacttacagcctaaaggattcaaagaacatagttcatcaaggtcatcatgattgagggtgagaccgcatacatcagctcaaaatgcatcttctctctcattggttaatgtttttaataaactgctaagcaaaatggcagacgtcct

SEQ ID NO: 279099 - DNA, 2404 bp, Homo sapiens
aacagctgctgctggctcttcctcttgcggccttttcctgaaacggattcttctttcggggaacagaaagcgccagccatgcagccttggcacggaaaggccatgcagagagcttccgaggccggagccactgcccccaaggcttccgcacggaatgccaggggcgccccgatggatcccaacgagtctccggctgcccccgaggccgccctgcctaaggcgggaaagttcggccccgccaggaagtcgggatcccggcagaaaaagagcgccccggacacccaggagaggccgcccgtccgcgcaactggggcccgcgccaaaaaggcccctcagcgcgcccaggacacgcagccgtctgacgccaccagcgcccctggggcagaggggctggagcctcctgcggctcgggagccggctctttccagggctggttcttgccgccagaggggcgcgcgctgctccacgaagccaagacccccgcccgggccctgggacgtgcccagccccggcctgccggtctcggcccccattctcgtacggagggatgcggcgcctggggcctcgaagctccgggcggttttggagaagttgaagctcagccgcgatgatatctccacggcggcggggatggtgaaaggggttgtggaccacctgctgctcagactgaagtgcgactccgcgttcagaggcgtcgggctgctgaacaccgggagctactatgagcacgtgaagatttctgcacctaatgaatttgatgtcatgtttaaactggaagtccccagaattcaactagaagaatattccaacactcgtgcatattactttgtgaaatttaaaagaaatccgaaagaaaatcctctgagtcagtttttagaaggtgaaatattatcagcttctaagatgctgtcaaagtttaggaaaatcattaaggaagaaattaacgacattaaagatacagatgtcatcatgaagaggaaaagaggagggagccctgctgtaacacttcttattagtgaaaaaatatctgtggatataaccctggctttggaatcaaaaagtagctggcctgctagcacccaagaaggcctgcgcattcaaaactggctttcagcaaaagttaggaagcaactacgactaaagccattttaccttgtacccaagcatgcaaaggaaggaaatggtttccaagaagaaacatggcggctatccttctctcacatcgaaaaggaaattttgaacaatcatggaaaatctaaaacgtgctgtgaaaacaaagaagagaaatgttgcaggaaagattgtttaaaactaatgaaataccttttagaacagctgaaagaaaggtttaaagacaaaaaacatctggataaattctcttcttatcatgtgaaaactgccttctttcacgtatgtacccagaaccctcaagacagtcagtgggaccgcaaagacctgggcctctgctttgataactgcgtgacatactttcttcagtgcctcaggacagaaaaacttgagaattattttattcctgaattcaatctattctctagcaacttaattgacaaaagaagtaaggaatttctgacaaagcaaattgaatatgaaagaaacaatgagtttccagtttttgatgaattttgagattgtatttttagaaagatctaagaactagagtcaccctaaatcctggagaatacaagaaaaatttgaaaaggggccagacgctgtggctcacacctgtagatcccagctctttggaggccgaggcaggcggatcacttgaggtcaggagtttgagaccagcctgaccaacatggtgaaactccatctctgctaaaaatataaaaattagccgggcatggtgatgcatgcctgtaatcccagctactcgggaggcttagacatgagaatcacttgaacccaggaggtggaggttgcagtgagtcaagatggcaccactgcactccatcctgggtgacagagcaagacttcctctcaaaaaataaataaataaataagaaaaataaattaggaaattattaaaataattttttagaaaagcaacaaaataacaaaaattagtgactgtaataattggaatgtttgaaatttgtcacagcaataattgactaaaatgaatgtaaataattattcagttttcagtttgttgtaataaactctaatcagtataaaggattgactatcctaggaaaaagattagtcaaggaataagaagcaaaagtagtatttgaaatctaaaaacattaccatgtttgctttatcatgcaggcaaataaataaataaatgacatttttaggttggaataaaaaaagataaagtacatattgccttaattaaattcatcaagttcttactgaaaaacagctctccgccgtg

SEQ ID NO: 279100 - DNA, 1584 bp, Homo sapiens
aacagctgctgctggctcttcctcttgcggccttttcctgaaacggattcttctttcggggaacagaaagcgccagccatgcagccttggcacggaaaggccatgcagagagcttccgaggccggagccactgcccccaaggcttccgcacggaatgccaggggcgccccgatggatcccaacgagtctccggctgcccccgaggccgccctgcctaaggcgggaaagttcggccccgccaggaagtcgggatcccggcagaaaaagagcgccccggacacccaggagaggccgcccgtccgcgcaactggggcccgcgccaaaaaggcccctcagcgcgcccaggacacgcagccgtctgacgccaccagcgcccctggggcagaggggctggagcctcctgcggctcgggagccggctctttccagggctggttcttgccgccagaggggcgcgcgctgctccacgaagccaagacccccgcccgggccctgggacgtgcccagccccggcctgccggtctcggcccccattctcgtacggagggatgcggcgcctggggcctcgaagctccgggcggttttggagaagttgaagctcagccgcgatgatatctccacggcggcggggatggtgaaaggggttgtggaccacctgctgctcagactgaagtgcgactccgcgttcagaggcgtcgggctgctgaacaccgggagctactatgagcacgtgaagatttctgcacctaatgaatttgatgtcatgtttaaactggaagtccccagaattcaactagaagaatattccaacactcgtgcatattactttgtgaaatttaaaagaaatccgaaagaaaatcctctgagtcagtttttagaaggtgaaatattatcagcttctaagatgctgtcaaagtttaggaaaatcattaaggaagaaattaacgacattaaagatacagatgtcatcatgaagaggaaaagaggagggagccctgctgtaacacttcttattagtgaaaaaatatctgtggatataaccctggctttggaatcaaaaagtagctggcctgctagcacccaagaaggcctgcgcattcaaaactggctttcagcaaaagttaggaagcaactacgactaaagccattttaccttgtacccaagcatgcaaaggaaggaaatggtttccaaggtattttaaatattaaagttaacttaaagaagtaaaagagttgttaatgttatatgttcaggcagtaaaagatcaacagccaaccaatgctgttgtcatttcaagagccatcaggcaaaataggttataagatgggagtctggtgacagacagaattgaaaagggcaaagttgtagtattaatatcaaatactcagctttaaaatgtctagcaatccatatttgaattttattttatttttttcggtaaagaaaagcagtattggccttggagtcagactgccctggttctgaatcctgaggctccttctactagttgtgtgaattcgagctagttatgatgctttctaaacccatttgctcatccgtacactgtgttaaccaaaagtactt

SEQ ID NO: 279101 - DNA, 797 bp, Homo sapiens
agctttggaacctaagaaaccaaggaaggcttaagatgcagaaccttgcttctctctgaggactgccttttaggaggccatttggaaagtaattttgaaacactgctcctttgccagtatctgaaaggtgctggatggtgtcagctggaagatgaggggcaacctgaggtagctgaaaaaactttggattaggtgtcaaaagggtgccaggtctcatctccaggcctttcctctaggccaggcagtgtggaaggaagcatttgctgggacgcggtatgaccaggacccagaagggaaagacctttctcccccattgcttctatcagtcactgcccccacgactgggatggggcatgattttaaactactcaaaattgaaaggcaaggaggagtgtgcctctgtctccagtgtgcctatggtcttcttcagctcacagtaccgtctacaccgcaagagccaatatttgaaaatggctgctgcaaaccttaccttctctcaggaggtggtgtggcagcgaggcctgcccagcattccttatagccagtacagctttgaccacctctacaataccaatgacatcatccatactccccagatcaggaaggcccggcctcagaaacctgttagcttcaagttcctgggttcctcaagtcccttaacaggagacacctccctggctgtgaagacagaaagctctgccaatcccgaaaagaagctgaagaaatcaaagccagccagcaccgtccgggaagcaccccgccctctcatccatcatccctgcatgcatccagatatg

SEQ ID NO: 279102 - DNA, 3247 bp, Homo sapiens
ggcgtctccgccattttgtgagtctataactcggagccgttgggtcggttcctgctattccggcgcctccactccgtcccccgcgggtctgctctgtgtgccatggacggcattgtcccagatatagccgttggtacaaagcggggatctgacgagcttttctctacttgtgtcactaacggaccgtttatcatgagcagcaactcggcttctgcagcaaacggaaatgacagcaagaagttcaaaggtgacagccgaagtgcaggcgtcccctctagagtgatccacatccggaagctccccatcgacgtcacggagggggaagtcatctccctggggctgccctttgggaaggtcaccaacctcctgatgctgaaggggaaaaaccaggccttcatcgagatgaacacggaggaggctgccaacaccatggtgaactactacacctcggtgacccctgtgctgcgcggccagcccatctacatccagttctccaaccacaaggagctgaagaccgacagctctcccaaccaggcgcgggcccaggcggccctgcaggcggtgaactcggtccagtcggggaacctggccttggctgcctcggcggcggccgtggacgcagggatggcgatggccgggcagagccccgtgctcaggatcatcgtggagaacctcttctaccctgtgaccctggatgtgctgcaccagattttctccaagttcggcacagtgttgaagatcatcaccttcaccaagaacaaccagttccaggccctgctgcagtatgcggaccccgtgagcgcccagcacgccaagctgtcgctggacgggcagaacatctacaacgcctgctgcacgctgcgcatcgacttttccaagctcaccagcctcaacgtcaagtacaacaatgacaagagccgtgactacacacgcccagacctgccttccggggacagccagccctcgctggaccagaccatggccgcggccttcgcctctccgtatgcaggagctggtttccctcccacctttgccattcctcaagctgcaggcaggcctttccgttccgaacgtccacggcgccctggcccccctggccatcccctcggcggcggcggcagctgcggcggcaggtcggatcgccatcccgggcctggcgggggcaggaaattctgtattgctggtcagcaacctcaacccagagagagtcacaccccaaagcctctttattcttttcggcgtctacggtgacgtgcagcgcgtgaagatcctgttcaataagaaggagaacgccctagtgcagatggcggacggcaaccaggcccagctggccatgagccacctgaacgggcacaagctgcacgggaagcccatccgcatcacgctctcgaagcaccagaacgtgcagctgccccgcgagggccaggaggaccagggcctgaccaaggactacggcaactcacccctgcaccgcttcaagaagccgggctccaagaacttccagaacatattcccgccctcggccacgctgcacctctccaacatcccgccctcagtctccgaggaggatctcaaggtcctgttttccagcaatgggggcgtcgtcaaaggattcaagttcttccagaaggaccgcaagatggcactgatccagatgggctccgtggaggaggcggtccaggccctcattgacctgcacaaccacgacctcggggagaaccaccacctgcgggtctccttctccaagtccaccatctaggggcacaggcccccacggccgggccccctggcgacaacttccatcattccagagaaaagccactttaaaaacagctgaagtgaccttagcagaccagagattttatttttttaaagagaaatcagtttacctgtttttaaaaaaattaaatctagttcaccttgctcaccctgcggtgacagggacagctcaggctcttggtgactgtggcagcgggagttcccggccctccacacccggggccagaccctcggggccatgccttggtggggcctgtgtcgggcgtggggcctgcaggtgggcgccccgaccacgacttggcttccttgtgccttaaaaaacctgccttcctgcagccacacacccacccggggtgtcctggggacccaaggggtgggggggtcacaccagagagaggcagggggcctggccggctcctgcaggatcatgcagctggggcgcggcggccgcggctgcgacaccccaaccccagccctctaatcaagtcacgtgattctcccttcaccccgcccccagggccttcccttctgcccccaggcgggctccccgctgctccagctgcggagctggtcgacataatctctgtattatatactttgcagttgcagacgtctgtgcctagcaatatttccagttgaccaaatattctaatcttttttcatttatatgcaaaagaaatagttttaagtaactttttatagcaagatgatacaatggtatgagtgtaatctaaacttccttgtggtattaccttgtatgctgttacttttattttattccttgtaattaagtcacaggcaggacccagtttccagagagcaggcggggccgcccagtgggtcaggcacagggagccccggtcctatcttagagcccctgagcttcagggaaggggcgggcgtgtcgccgcctctggcatcgcctccggttgccttacaccacgccttcacctgcagtcgcctagaaaacttgctctcaaacttcagggttttttcttccttcaaattttggaccaaagtctcatttctgtgttttgcctgcctctgatgctgggacccggaaggcgggcgctcctcctgtcttctctgtgctctttctaccgcccccgcgtcctgtcccgggggctctcctaggatcccctttccgtaaaagcgtgtaacaagggtgtaaatatttataattttttatacctgttgtgagacccgaggggcggcggcgcggttttttatggtgacacaaatgtatattttgctaacagcaattccaggctcagtattgtgaccgcggagccacaggggaccccacgcacattccgttgccttacccgatggcttgtgacgcggagagaaccgattaaaaccgtttgagaaactcctcccttgtctagccctgtgttcgctgtggacgctgtagaggcaggttggccagtctgtacctggacttcgaataaatcttctgtatcctcgc

SEQ ID NO: 279103 - DNA, 3264 bp, Homo sapiens
ggcgtctccgccattttgtgagtctataactcggagccgttgggtcggttcctgctattccggcgcctccactccgtcccccgcgggtctgctctgtgtgccatggacggcattgtcccagatatagccgttggtacaaagcggggatctgacgagcttttctctacttgtgtcactaacggaccgtttatcatgagcagcaactcggcttctgcagcaaacggaaatgacagcaagaagttcaaaggtgacagccgaagtgcaggcgtcccctctagagtgatccacatccggaagctccccatcgacgtcacggagggggaagtcatctccctggggctgccctttgggaaggtcaccaacctcctgatgctgaaggggaaaaaccaggccttcatcgagatgaacacggaggaggctgccaacaccatggtgaactactacacctcggtgacccctgtgctgcgcggccagcccatctacatccagttctccaaccacaaggagctgaagaccgacagctctcccaaccaggcgcgggcccaggcggccctgcaggcggtgaactcggtccagtcggggaacctggccttggctgcctcggcggcggccgtggacgcagggatggcgatggccgggcagagccccgtgctcaggatcatcgtggagaacctcttctaccctgtgaccctggatgtgctgcaccagattttctccaagttcggcacagtgttgaagatcatcaccttcaccaagaacaaccagttccaggccctgctgcagtatgcggaccccgtgagcgcccagcacgccaagctgtcgctggacgggcagaacatctacaacgcctgctgcacgctgcgcatcgacttttccaagctcaccagcctcaacgtcaagtacaacaatgacaagagccgtgactacacacgcccagacctgccttccggggacagccagccctcgctggaccagaccatggccgcggccttcggtgcacctggtataatctcagcctctccgtatgcaggagctggtttccctcccacctttgccattcctcaagctgcaggcctttccgttccgaacgtccacggcgccctggcccccctggccatcccctcggcggcggcggcagctgcggcggcaggtcggatcgccatcccgggcctggcgggggcaggaaattctgtattgctggtcagcaacctcaacccagagagagtcacaccccaaagcctctttattcttttcggcgtctacggtgacgtgcagcgcgtgaagatcctgttcaataagaaggagaacgccctagtgcagatggcggacggcaaccaggcccagctggccatgagccacctgaacgggcacaagctgcacgggaagcccatccgcatcacgctctcgaagcaccagaacgtgcagctgccccgcgagggccaggaggaccagggcctgaccaaggactacggcaactcacccctgcaccgcttcaagaagccgggctccaagaacttccagaacatattcccgccctcggccacgctgcacctctccaacatcccgccctcagtctccgaggaggatctcaaggtcctgttttccagcaatgggggcgtcgtcaaaggattcaagttcttccagaaggaccgcaagatggcactgatccagatgggctccgtggaggaggcggtccaggccctcattgacctgcacaaccacgacctcggggagaaccaccacctgcgggtctccttctccaagtccaccatctaggggcacaggcccccacggccgggccccctggcgacaacttccatcattccagagaaaagccactttaaaaacagctgaagtgaccttagcagaccagagattttatttttttaaagagaaatcagtttacctgtttttaaaaaaattaaatctagttcaccttgctcaccctgcggtgacagggacagctcaggctcttggtgactgtggcagcgggagttcccggccctccacacccggggccagaccctcggggccatgccttggtggggcctgtgtcgggcgtggggcctgcaggtgggcgccccgaccacgacttggcttccttgtgccttaaaaaacctgccttcctgcagccacacacccacccggggtgtcctggggacccaaggggtgggggggtcacaccagagagaggcagggggcctggccggctcctgcaggatcatgcagctggggcgcggcggccgcggctgcgacaccccaaccccagccctctaatcaagtcacgtgattctcccttcaccccgcccccagggccttcccttctgcccccaggcgggctccccgctgctccagctgcggagctggtcgacataatctctgtattatatactttgcagttgcagacgtctgtgcctagcaatatttccagttgaccaaatattctaatcttttttcatttatatgcaaaagaaatagttttaagtaactttttatagcaagatgatacaatggtatgagtgtaatctaaacttccttgtggtattaccttgtatgctgttacttttattttattccttgtaattaagtcacaggcaggacccagtttccagagagcaggcggggccgcccagtgggtcaggcacagggagccccggtcctatcttagagcccctgagcttcagggaaggggcgggcgtgtcgccgcctctggcatcgcctccggttgccttacaccacgccttcacctgcagtcgcctagaaaacttgctctcaaacttcagggttttttcttccttcaaattttggaccaaagtctcatttctgtgttttgcctgcctctgatgctgggacccggaaggcgggcgctcctcctgtcttctctgtgctctttctaccgcccccgcgtcctgtcccgggggctctcctaggatcccctttccgtaaaagcgtgtaacaagggtgtaaatatttataattttttatacctgttgtgagacccgaggggcggcggcgcggttttttatggtgacacaaatgtatattttgctaacagcaattccaggctcagtattgtgaccgcggagccacaggggaccccacgcacattccgttgccttacccgatggcttgtgacgcggagagaaccgattaaaaccgtttgagaaactcctcccttgtctagccctgtgttcgctgtggacgctgtagaggcaggttggccagtctgtacctggacttcgaataaatcttctgtatcctcgc

SEQ ID NO: 279104 - DNA, 265 bp, Homo sapiens
actagtaatattactagtgaattcactagtgacacaaatgtatattttgctaacagcaattccaggctcagtattgtgaccgcggagccacaggggaccccacgcacattccgttgccttacccgatggcttgtgacgcggagagaaccgattaaaaccgtttgagaaactcctcccttgtctagccctgtgttcgctgtggacgctgtagaggcaggttggccagtctgtacctggacttcgaataaatcttctgtatcctcgc

SEQ ID NO: 279105 - DNA, 357 bp, Homo sapiens
tctcaaacttcagggttttttcttcctatcttagagcccctgagcttcagggaaggggcgggcgtgtcgccgcctctttctaccgcccccgcgtcctgtcccgggggctctcctaggatcccctttccgtaaaagcgtgtaacaagggtgtaaatatttataattttttatacctgttgtgagacccgaggggcggcggcgcggttttttatggtgacacaaatgtatattttgctaacagcaattccaggctcagtattgtgaccgcggagccacaggggaccccacgcacattccgttgccttacccgatggcttgtgacgcggagagaaccgattaaaaccgtttgagaaactc

SEQ ID NO: 279106 - DNA, 3164 bp, Homo sapiens
agcgacacgaaaaaaacttaggctaggtacgaggctgggtgttgccactccgtcccccgcgggtctgctctgtgtgccatggacggcattgtcccagatatagccgttggtacaaagcggggatctgacgagcttttctctacttgtgtcactaacggaccgtttatcatgagcagcaactcggcttctgcagcaaacggaaatgacagcaagaagttcaaaggtgacagccgaagtgcaggcgtcccctctagagtgatccacatccggaagctccccatcgacgtcacggagggggaagtcatctccctggggctgccctttgggaaggtcaccaacctcctgatgctgaaggggaaaaaccaggccttcatcgagatgaacacggaggaggctgccaacaccatggtgaactactacacctcggtgacccctgtgctgcgcggccagcccatctacatccagttctccaaccacaaggagctgaagaccgacagctctcccaaccaggcgcgggcccaggcggccctgcaggcggtgaactcggtccagtcggggaacctggccttggctgcctcggcggcggccgtggacgcagggatggcgatggccgggcagagccccgtgctcaggatcatcgtggagaacctcttctaccctgtgaccctggatgtgctgcaccagattttctccaagttcggcacagtgttgaagatcatcaccttcaccaagaacaaccagttccaggccctgctgcagtatgcggaccccgtgagcgcccagcacgccaagctgtcgctggacgggcagaacatctacaacgcctgctgcacgctgcgcatcgacttttccaagctcaccagcctcaacgtcaagtacaacaatgacaagagccgtgactacacacgcccagacctgccttccggggacagccagccctcgctggaccagaccatggccgcggccttccaggcctttccgttccgaacgtccacggcgccctggcccccctggccatcccctcggcggcggcggcagctgcggcggcaggtcggatcgccatcccgggcctggcgggggcaggaaattctgtattgctggtcagcaacctcaacccagagagagtcacaccccaaagcctctttattcttttcggcgtctacggtgacgtgcagcgcgtgaagatcctgttcaataagaaggagaacgccctagtgcagatggcggacggcaaccaggcccagctggccatgagccacctgaacgggcacaagctgcacgggaagcccatccgcatcacgctctcgaagcaccagaacgtgcagctgccccgcgagggccaggaggaccagggcctgaccaaggactacggcaactcacccctgcaccgcttcaagaagccgggctccaagaacttccagaacatattcccgccctcggccacgctgcacctctccaacatcccgccctcagtctccgaggaggatctcaaggtcctgttttccagcaatgggggcgtcgtcaaaggattcaagttcttccagaaggaccgcaagatggcactgatccagatgggctccgtggaggaggcggtccaggccctcattgacctgcacaaccacgacctcggggagaaccaccacctgcgggtctccttctccaagtccaccatctaggggcacaggcccccacggccgggccccctggcgacaacttccatcattccagagaaaagccactttaaaaacagctgaagtgaccttagcagaccagagattttatttttttaaagagaaatcagtttacctgtttttaaaaaaattaaatctagttcaccttgctcaccctgcggtgacagggacagctcaggctcttggtgactgtggcagcgggagttcccggccctccacacccggggccagaccctcggggccatgccttggtggggcctgtgtcgggcgtggggcctgcaggtgggcgccccgaccacgacttggcttccttgtgccttaaaaaacctgccttcctgcagccacacacccacccggggtgtcctggggacccaaggggtgggggggtcacaccagagagaggcagggggcctggccggctcctgcaggatcatgcagctggggcgcggcggccgcggctgcgacaccccaaccccagccctctaatcaagtcacgtgattctcccttcaccccgcccccagggccttcccttctgcccccaggcgggctccccgctgctccagctgcggagctggtcgacataatctctgtattatatactttgcagttgcagacgtctgtgcctagcaatatttccagttgaccaaatattctaatcttttttcatttatatgcaaaagaaatagttttaagtaactttttatagcaagatgatacaatggtatgagtgtaatctaaacttccttgtggtattaccttgtatgctgttacttttattttattccttgtaattaagtcacaggcaggacccagtttccagagagcaggcggggccgcccagtgggtcaggcacagggagccccggtcctatcttagagcccctgagcttcagggaaggggcgggcgtgtcgccgcctctggcatcgcctccggttgccttacaccacgccttcacctgcagtcgcctagaaaacttgctctcaaacttcagggttttttcttccttcaaattttggaccaaagtctcatttctgtgttttgcctgcctctgatgctgggacccggaaggcgggcgctcctcctgtcttctctgtgctctttctaccgcccccgcgtcctgtcccgggggctctcctaggatcccctttccgtaaaagcgtgtaacaagggtgtaaatatttataattttttatacctgttgtgagacccgaggggcggcggcgcggttttttatggtgacacaaatgtatattttgctaacagcaattccaggctcagtattgtgaccgcggagccacaggggaccccacgcacattccgttgccttacccgatggcttgtgacgcggagagaaccgattaaaaccgtttgagaaactcctcccttgtctagccctgtgttcgctgtggacgctgtagaggcaggttggccagtctgtacctggacttcgaataaatcttctgtatcctcgc

SEQ ID NO: 279107 - DNA, 4078 bp, Homo sapiens
agcgacacgaaaaaaacttaggctaggtacgaggctgggtgttgccactccgtcccccgcgggtctgctctgtgtgccatggacggcattgtcccagatatagccgttggtacaaagcggggatctgacgagcttttctctacttgtgtcactaacggaccgtttatcatgagcagcaactcggcttctgcagcaaacggaaatgacagcaagaagttcaaaggtgacagccgaagtgcaggcgtcccctctagagtgatccacatccggaagctccccatcgacgtcacggagggggaagtcatctccctggggctgccctttgggaaggtcaccaacctcctgatgctgaaggggaaaaaccaggccttcatcgagatgaacacggaggaggctgccaacaccatggtgaactactacacctcggtgacccctgtgctgcgcggccagcccatctacatccagttctccaaccacaaggagctgaagaccgacagctctcccaaccaggcgcgggcccaggcggccctgcaggcggtgaactcggtccagtcggggaacctggccttggctgcctcggcggcggccgtggacgcagggatggcgatggccgggcagagccccgtgctcaggatcatcgtggagaacctcttctaccctgtgaccctggatgtgctgcaccagattttctccaagttcggcacagtgttgaagatcatcaccttcaccaagaacaaccagttccaggccctgctgcagtatgcggaccccgtgagcgcccagcacgccaagctgtcgctggacgggcagaacatctacaacgcctgctgcacgctgcgcatcgacttttccaagctcaccagcctcaacgtcaagtacaacaatgacaagagccgtgactacacacgcccagacctgccttccggggacagccagccctcgctggaccagaccatggccgcggccttcggtgcacctggtataatctcagcctctccgtatgcaggagctggtttccctcccacctttgccattcctcaagctgcaggtattcaaacgcttggtcttggttccccagcgactgcatgcccacaccaccttcccaggcagctccgcatccacggcggcagcctgggcggactgggcactcgagtgccaggtcaggggcccttcccgggagaggggacgccacgtccacagagcaggcttggccagggcagtggtaggacagggctgtggaggcccacgtgtggacggcgccagccagaagccgctaatcgcacagtctttgtggtctggttcccttcaagcacctccgggcgagcgcgaggaccgccagtggttggagggatgtctctagtagttgaatttgagtggcctggtaagcgcgcggcccgaggctgagcagcatgaccggcggcgggacgtgtgtgcgtggccgtcctcccgcttcccttctgggaccggggcccggccgccccagtgctggccgtggacggagcagcgcgtgccgcccggcggccgcctcgtctgcatggaggcatgggcgcgcatgcgcggtggtcccgggacgggccctgcttgccgagggccccgtgtctgtgctggcggagccggagcttttctgtgctgtgggcggggcgcatgcagatgagcccaggcccggcccggcccgtgctgtgaggagaggcgggcgctggtgcaggagccggcgggtggctgtgcgggggtcgggcgaccccacaggcacccagggtagggccagagccagggccgcctcccgcgcggctcggctcctcggtgcatgaggacggggagcgtcggcctctcccactctgcggtggagtcgggggcgccgccgctcatctcacctcctgcttttccaggcctttccgttccgaacgtccacggcgccctggcccccctggccatcccctcggcggcggcggcagctgcggcggcaggtcggatcgccatcccgggcctggcgggggcaggaaattctgtattgctggtcagcaacctcaacccagagagagtcacaccccaaagcctctttattcttttcggcgtctacggtgacgtgcagcgcgtgaagatcctgttcaataagaaggagaacgccctagtgcagatggcggacggcaaccaggcccagctggccatgagccacctgaacgggcacaagctgcacgggaagcccatccgcatcacgctctcgaagcaccagaacgtgcagctgccccgcgagggccaggaggaccagggcctgaccaaggactacggcaactcacccctgcaccgcttcaagaagccgggctccaagaacttccagaacatattcccgccctcggccacgctgcacctctccaacatcccgccctcagtctccgaggaggatctcaaggtcctgttttccagcaatgggggcgtcgtcaaaggattcaagttcttccagaaggaccgcaagatggcactgatccagatgggctccgtggaggaggcggtccaggccctcattgacctgcacaaccacgacctcggggagaaccaccacctgcgggtctccttctccaagtccaccatctaggggcacaggcccccacggccgggccccctggcgacaacttccatcattccagagaaaagccactttaaaaacagctgaagtgaccttagcagaccagagattttatttttttaaagagaaatcagtttacctgtttttaaaaaaattaaatctagttcaccttgctcaccctgcggtgacagggacagctcaggctcttggtgactgtggcagcgggagttcccggccctccacacccggggccagaccctcggggccatgccttggtggggcctgtgtcgggcgtggggcctgcaggtgggcgccccgaccacgacttggcttccttgtgccttaaaaaacctgccttcctgcagccacacacccacccggggtgtcctggggacccaaggggtgggggggtcacaccagagagaggcagggggcctggccggctcctgcaggatcatgcagctggggcgcggcggccgcggctgcgacaccccaaccccagccctctaatcaagtcacgtgattctcccttcaccccgcccccagggccttcccttctgcccccaggcgggctccccgctgctccagctgcggagctggtcgacataatctctgtattatatactttgcagttgcagacgtctgtgcctagcaatatttccagttgaccaaatattctaatcttttttcatttatatgcaaaagaaatagttttaagtaactttttatagcaagatgatacaatggtatgagtgtaatctaaacttccttgtggtattaccttgtatgctgttacttttattttattccttgtaattaagtcacaggcaggacccagtttccagagagcaggcggggccgcccagtgggtcaggcacagggagccccggtcctatcttagagcccctgagcttcagggaaggggcgggcgtgtcgccgcctctggcatcgcctccggttgccttacaccacgccttcacctgcagtcgcctagaaaacttgctctcaaacttcagggttttttcttccttcaaattttggaccaaagtctcatttctgtgttttgcctgcctctgatgctgggacccggaaggcgggcgctcctcctgtcttctctgtgctctttctaccgcccccgcgtcctgtcccgggggctctcctaggatcccctttccgtaaaagcgtgtaacaagggtgtaaatatttataattttttatacctgttgtgagacccgaggggcggcggcgcggttttttatggtgacacaaatgtatattttgctaacagcaattccaggctcagtattgtgaccgcggagccacaggggaccccacgcacattccgttgccttacccgatggcttgtgacgcggagagaaccgattaaaaccgtttgagaaactcctcccttgtctagccctgtgttcgctgtggacgctgtagaggcaggttggccagtctgtacctggacttcgaataaatcttctgtatcctcgc

SEQ ID NO: 279108 - DNA, 3884 bp, Homo sapiens
agcgacacgaaaaaaacttaggctaggtacgaggctgggtgttgccactccgtcccccgcgggtctgctctgtgtgccatggacggcattgtcccagatatagccgttggtacaaagcggggatctgacgagcttttctctacttgtgtcactaacggaccgtttatcatgagcagcaactcggcttctgcagcaaacggaaatgacagcaagaagttcaaaggtgacagccgaagtgcaggcgtcccctctagagtgatccacatccggaagctccccatcgacgtcacggagggggaagtcatctccctggggctgccctttgggaaggtcaccaacctcctgatgctgaaggggaaaaaccaggccttcatcgagatgaacacggaggaggctgccaacaccatggtgaactactacacctcggtgacccctgtgctgcgcggccagcccatctacatccagttctccaaccacaaggagctgaagaccgacagctctcccaaccaggcgcgggcccaggcggccctgcaggcggtgaactcggtccagtcggggaacctggccttggctgcctcggcggcggccgtggacgcagggatggcgatggccgggcagagccccgtgctcaggatcatcgtggagaacctcttctaccctgtgaccctggatgtgctgcaccagattttctccaagttcggcacagtgttgaagatcatcaccttcaccaagaacaaccagttccaggccctgctgcagtatgcggaccccgtgagcgcccagcacgccaagctgtcgctggacgggcagaacatctacaacgcctgctgcacgctgcgcatcgacttttccaagctcaccagcctcaacgtcaagtacaacaatgacaagagccgtgactacacacgcccagacctgccttccggggacagccagccctcgctggaccagaccatggccgcggccttcggtgcacctggtataatctcagcctctccgtatgcaggagctggtttccctcccacctttgccattcctcaagctgcaggtattcaaacgcttggtcttggttccccagcgactgcatgcccacaccaccttcccaggcagctccgcatccacggcggcagcctgggcggactgggcactcgagtgccaggtcaggggcccttcccgggagaggggacgccacgtccacagagcaggctgagcagcatgaccggcggcgggacgtgtgtgcgtggccgtcctcccgcttcccttctgggaccggggcccggccgccccagtgctggccgtggacggagcagcgcgtgccgcccggcggccgcctcgtctgcatggaggcatgggcgcgcatgcgcggtggtcccgggacgggccctgcttgccgagggccccgtgtctgtgctggcggagccggagcttttctgtgctgtgggcggggcgcatgcagatgagcccaggcccggcccggcccgtgctgtgaggagaggcgggcgctggtgcaggagccggcgggtggctgtgcgggggtcgggcgaccccacaggcacccagggtagggccagagccagggccgcctcccgcgcggctcggctcctcggtgcatgaggacggggagcgtcggcctctcccactctgcggtggagtcgggggcgccgccgctcatctcacctcctgcttttccaggcctttccgttccgaacgtccacggcgccctggcccccctggccatcccctcggcggcggcggcagctgcggcggcaggtcggatcgccatcccgggcctggcgggggcaggaaattctgtattgctggtcagcaacctcaacccagagagagtcacaccccaaagcctctttattcttttcggcgtctacggtgacgtgcagcgcgtgaagatcctgttcaataagaaggagaacgccctagtgcagatggcggacggcaaccaggcccagctggccatgagccacctgaacgggcacaagctgcacgggaagcccatccgcatcacgctctcgaagcaccagaacgtgcagctgccccgcgagggccaggaggaccagggcctgaccaaggactacggcaactcacccctgcaccgcttcaagaagccgggctccaagaacttccagaacatattcccgccctcggccacgctgcacctctccaacatcccgccctcagtctccgaggaggatctcaaggtcctgttttccagcaatgggggcgtcgtcaaaggattcaagttcttccagaaggaccgcaagatggcactgatccagatgggctccgtggaggaggcggtccaggccctcattgacctgcacaaccacgacctcggggagaaccaccacctgcgggtctccttctccaagtccaccatctaggggcacaggcccccacggccgggccccctggcgacaacttccatcattccagagaaaagccactttaaaaacagctgaagtgaccttagcagaccagagattttatttttttaaagagaaatcagtttacctgtttttaaaaaaattaaatctagttcaccttgctcaccctgcggtgacagggacagctcaggctcttggtgactgtggcagcgggagttcccggccctccacacccggggccagaccctcggggccatgccttggtggggcctgtgtcgggcgtggggcctgcaggtgggcgccccgaccacgacttggcttccttgtgccttaaaaaacctgccttcctgcagccacacacccacccggggtgtcctggggacccaaggggtgggggggtcacaccagagagaggcagggggcctggccggctcctgcaggatcatgcagctggggcgcggcggccgcggctgcgacaccccaaccccagccctctaatcaagtcacgtgattctcccttcaccccgcccccagggccttcccttctgcccccaggcgggctccccgctgctccagctgcggagctggtcgacataatctctgtattatatactttgcagttgcagacgtctgtgcctagcaatatttccagttgaccaaatattctaatcttttttcatttatatgcaaaagaaatagttttaagtaactttttatagcaagatgatacaatggtatgagtgtaatctaaacttccttgtggtattaccttgtatgctgttacttttattttattccttgtaattaagtcacaggcaggacccagtttccagagagcaggcggggccgcccagtgggtcaggcacagggagccccggtcctatcttagagcccctgagcttcagggaaggggcgggcgtgtcgccgcctctggcatcgcctccggttgccttacaccacgccttcacctgcagtcgcctagaaaacttgctctcaaacttcagggttttttcttccttcaaattttggaccaaagtctcatttctgtgttttgcctgcctctgatgctgggacccggaaggcgggcgctcctcctgtcttctctgtgctctttctaccgcccccgcgtcctgtcccgggggctctcctaggatcccctttccgtaaaagcgtgtaacaagggtgtaaatatttataattttttatacctgttgtgagacccgaggggcggcggcgcggttttttatggtgacacaaatgtatattttgctaacagcaattccaggctcagtattgtgaccgcggagccacaggggaccccacgcacattccgttgccttacccgatggcttgtgacgcggagagaaccgattaaaaccgtttgagaaactcctcccttgtctagccctgtgttcgctgtggacgctgtagaggcaggttggccagtctgtacctggacttcgaataaatcttctgtatcctcgc

SEQ ID NO: 279109 - DNA, 3375 bp, Homo sapiens
agcgacacgaaaaaaacttaggctaggtacgaggctgggtgttgccactccgtcccccgcgggtctgctctgtgtgccatggacggcattgtcccagatatagccgttggtacaaagcggggatctgacgagcttttctctacttgtgtcactaacggaccgtttatcatgagcagcaactcggcttctgcagcaaacggaaatgacagcaagaagttcaaaggtgacagccgaagtgcaggcgtcccctctagagtgatccacatccggaagctccccatcgacgtcacggagggggaagtcatctccctggggctgccctttgggaaggtcaccaacctcctgatgctgaaggggaaaaaccaggccttcatcgagatgaacacggaggaggctgccaacaccatggtgaactactacacctcggtgacccctgtgctgcgcggccagcccatctacatccagttctccaaccacaaggagctgaagaccgacagctctcccaaccaggcgcgggcccaggcggccctgcaggcggtgaactcggtccagtcggggaacctggccttggctgcctcggcggcggccgtggacgcagggatggcgatggccgggcagagccccgtgctcaggatcatcgtggagaacctcttctaccctgtgaccctggatgtgctgcaccagattttctccaagttcggcacagtgttgaagatcatcaccttcaccaagaacaaccagttccaggccctgctgcagtatgcggaccccgtgagcgcccagcacgccaagctgtcgctggacgggcagaacatctacaacgcctgctgcacgctgcgcatcgacttttccaagctcaccagcctcaacgtcaagtacaacaatgacaagagccgtgactacacacgcccagacctgccttccggggacagccagccctcgctggaccagaccatggccgcggccttccaggcctttccgttccgaacgtccacggcgccctggcccccctggccatcccctcggcggcggcggcagctgcggcggcaggtcggatcgccatcccgggcctggcgggggcaggaaattctgtattgctggtcagcaacctcaacccagagagagtcacaccccaaagcctctttattcttttcggcgtctacggtgacgtgcagcgcgtgaagatcctgttcaataagaaggagaacgccctagtgcagatggcggacggcaaccaggcccagctggccatgagccacctgaacgggcacaagctgcacgggaagcccatccgcatcacgctctcgaagcaccagaacgtgcagctgccccgcgagggccaggaggaccagggcctgaccaaggactacggcaactcacccctgcaccgcttcaagaagccgggctccaagaacttccagaacatattcccgccctcggccacgctgcacctctccaacatcccgccctcagtctccgaggaggatctcaaggtcctgttttccagcaatgggggcgtcgtcaaaggattcaagttcttccagaaggaccgcaagatggcactgatccagatgggctccgtggaggaggcggtccaggccctcattgacctgcacaaccacgacctcggggagaaccaccacctgcgggtctccttctccaagtccaccatctaggggcacaggcccccacggccgggccccctggcgacaacttccatcattccagagaaaagccactttaaaaacagctgaagtgaccttagcagaccagagattttatttttttaaagagaaatcagtttacctgtttttaaaaaaattaaatctagttcaccttgctcaccctgcggtgacagggacagctcaggctcttggtgactgtggcagcgggagttcccggccctccacacccggggccagaccctcggggccatgccttggtggggcctgtgtcgggcgtggggcctgcaggtgggcgccccgaccacgacttggcttccttgtgccttaaaaaacctgccttcctgcagccacacacccacccggggtgtcctggggacccaaggggtgggggggtcacaccagagagaggcagggggcctggccggctcctgcaggatcatgcagctggggcgcggcggccgcggctgcgacaccccaaccccagccctctaatcaagtcacgtgattctcccttcaccccgcccccagggccttcccttctgcccccaggcgggctccccgctgctccagctgcggagctggtcgacataatctctgtattatatactttgcagttgcagacgtctgtgcctagcaatatttccagttgaccaaatattctaatcttttttcatttatatgcaaaagaaatagttttaagtaactttttatagcaagatgatacaatggtatgagtgtaatctaaacttccttgtggtattaccttgtatgctgttacttttattttattccttgtaattaagtcacaggcaggacccagtttccagagagcaggcggggccgcccagtgggtcaggcacagggagccccggtcctatcttagagcccctgagcttcagggaaggggcgggcgtgtcgccgcctctggcatcgcctccggttgccttacaccacgccttcacctgcagtcgcctagaaaacttgctctcaaacttcagggttttttcttccttcaaattttggaccaaagtctcatttctgtgttttgcctgcctctgatgctgggacccggaaggcgggcgctcctcctgtcttctctgtgctctttctaccgcccccgcgtcctgtcccgggggctctcctaggatcccctttccgtaaaagcgtgtaacaagggtgtaaatatttataattttttatacctgttgtgagacccgaggggcggcggcgcggttttttatggtgacacaaatgtatattttgctaacagcaattccaggctcagtattgtgaccgcggagccacaggggaccccacgcacattccgttgccttacccgatggcttgtgacgcggagagaaccgattaaaaccgtttgagaaactcctcccttgtctagccctgtgttcgctgtggacgctgtagaggcaggttggccagtctgtacctggacttcgaataaatcttctgtatcctcgctccgttccgccttcgttgctggcttcctctttctgtgccgcgggcggccccgactcccgcccgggtgtccgccgaagcgccaggtggggccacgggcggggtgggcccggccctgagagtgggggtccctgcgtggggcgtgcgggccagagcgaatgaccaagagccggacctcggtttctgccgctttattgagcatccgcgcggccgc

SEQ ID NO: 279110 - DNA, 3147 bp, Homo sapiens
agcgacacgaaaaaaacttaggctaggtacgaggctgggtgttgccactccgtcccccgcgggtctgctctgtgtgccatggacggcattgtcccagatatagccgttggtacaaagcggggatctgacgagcttttctctacttgtgtcactaacggaccgtttatcatgagcagcaactcggcttctgcagcaaacggaaatgacagcaagaagttcaaaggtgacagccgaagtgcaggcgtcccctctagagtgatccacatccggaagctccccatcgacgtcacggagggggaagtcatctccctggggctgccctttgggaaggtcaccaacctcctgatgctgaaggggaaaaaccaggccttcatcgagatgaacacggaggaggctgccaacaccatggtgaactactacacctcggtgacccctgtgctgcgcggccagcccatctacatccagttctccaaccacaaggagctgaagaccgacagctctcccaaccaggcgcgggcccaggcggccctgcaggcggtgaactcggtccagtcggggaacctggccttggctgcctcggcggcggccgtggacgcagggatggcgatggccgggcagagccccgtgctcaggatcatcgtggagaacctcttctaccctgtgaccctggatgtgctgcaccagattttctccaagttcggcacagtgttgaagatcatcaccttcaccaagaacaaccagttccaggccctgctgcagtatgcggaccccgtgagcgcccagcacgccaagctgtcgctggacgggcagaacatctacaacgcctgctgcacgctgcgcatcgacttttccaagctcaccagcctcaacgtcaagtacaacaatgacaagagccgtgactacacacgcccagacctgccttccggggacagccagccctcgctggaccagaccatggccgcggccttcggtgcacctggtataatctcagcctctccgtatgcaggagctggtttccctcccacctttgccattcctcaagctgcaggcctttccgttccgaacgtccacggcgccctggcccccctggccatcccctcggcggcggcggcagctgcggcggcaggtcggatcgccatcccgggcctggcgggggcaggaaattctgtattgctggtcagcaacctcaacccagagagagtcacaccccaaagcctctttattcttttcggcgtctacggtgacgtgcagcgcgtgaagatcctgttcaataagaaggagaacgccctagtgcagatggcggacggcaaccaggcccagctggccatgagccacctgaacgggcacaagctgcacgggaagcccatccgcatcacgctctcgaagcaccagaacgtgcagctgccccgcgagggccaggaggaccagggcctgaccaaggactacggcaactcacccctgcaccgcttcaagaagccgggctccaagaacttccagaacatattcccgccctcggccacgctgcacctctccaacatcccgccctcagtctccgaggaggatctcaaggtcctgttttccagcaatgggggcgtcgtcaaaggattcaagttcttccagaaggaccgcaagatggcactgatccagatgggctccgtggaggaggcggtccaggccctcattgacctgcacaaccacgacctcggggagaaccaccacctgcgggtctccttctccaagtccaccatctaggggcacaggcccccacggccgggccccctggcgacaacttccatcattccagagaaaagccactttaaaaacagctgaagtgaccttagcagaccagagattttatttttttaaagagaaatcagtttacctgtttttaaaaaaattaaatctagttcaccttgctcaccctgcggtgacagggacagctcaggctcttggtgactgtggcagcgggagttcccggccctccacacccggggccagaccctcggggccatgccttggtggggcctgtgtcgggcgtggggcctgcaggtgggcgccccgaccacgacttggcttccttgtgccttaaaaaacctgccttcctgcagccacacacccacccggggtgtcctggggacccaaggggtgggggggtcacaccagagagaggcagggggcctggccggctcctgcaggatcatgcagctggggcgcggcggccgcggctgcgacaccccaaccccagccctctaatcaagtcacgtgattctcccttcaccccgcccccagggccttcccttctgcccccaggcgggctccccgctgctccagctgcggagctggtcgacataatctctgtattatatactttgcagttgcagacgtctgtgcctagcaatatttccagttgaccaaatattctaatcttttttcatttatatgcaaaagaaatagttttaagtaactttttatagcaagatgatacaatggtatgagtgtaatctaaacttccttgtggtattaccttgtatgctgttacttttattttattccttgtaattaagtcacaggcaggacccagtttccagagagcaggcggggccgcccagtgggtcaggcacagggagccccggtcctatcttagagcccctgagcttcagggaaggggcgggcgtgtcgccgcctctggcatcgcctccggttgccttacaccacgccttcacctgcagtcgcctagaaaacttgctctcaaacttcagggttttttcttccttcaaattttggaccaaagtctcatttctgtgttttgcctgcctctgatgctgggacccggaaggcgggcgctcctcctgtcttctctgtgctctttctaccgcccccgcgtcctgtcccgggggctctcctaggatcccctttccgtaaaagcgtgtaacaagggtgtaaatatttataattttttatacctgttgtgagacccgaggggcggcggcgcggttttttatggtgacacaaatgtatattttgctaacagcaattccaggctcagtattgtgaccgcggagccacaggggaccccacgcacattccgttgccttacccgatggcttgtgacgcggagagaaccgattaaaaccgtttgagaaactc

SEQ ID NO: 279111 - DNA, 3131 bp, Homo sapiens
agcgacacgaaaaaaacttaggctaggtacgaggctgggtgttgccactccgtcccccgcgggtctgctctgtgtgccatggacggcattgtcccagatatagccgttggtacaaagcggggatctgacgagcttttctctacttgtgtcactaacggaccgtttatcatgagcagcaactcggcttctgcagcaaacggaaatgacagcaagaagttcaaaggtgacagccgaagtgcaggcgtcccctctagagtgatccacatccggaagctccccatcgacgtcacggagggggaagtcatctccctggggctgccctttgggaaggtcaccaacctcctgatgctgaaggggaaaaaccaggccttcatcgagatgaacacggaggaggctgccaacaccatggtgaactactacacctcggtgacccctgtgctgcgcggccagcccatctacatccagttctccaaccacaaggagctgaagaccgacagctctcccaaccaggcgcgggcccaggcggccctgcaggcggtgaactcggtccagtcggggaacctggccttggctgcctcggcggcggccgtggacgcagggatggcgatggccgggcagagccccgtgctcaggatcatcgtggagaacctcttctaccctgtgaccctggatgtgctgcaccagattttctccaagttcggcacagtgttgaagatcatcaccttcaccaagaacaaccagttccaggccctgctgcagtatgcggaccccgtgagcgcccagcacgccaagctgtcgctggacgggcagaacatctacaacgcctgctgcacgctgcgcatcgacttttccaagctcaccagcctcaacgtcaagtacaacaatgacaagagccgtgactacacacgcccagacctgccttccggggacagccagccctcgctggaccagaccatggccgcggccttccaggcctttccgttccgaacgtccacggcgccctggcccccctggccatcccctcggcggcggcggcagctgcggcggcaggtcggatcgccatcccgggcctggcgggggcaggaaattctgtattgctggtcagcaacctcaacccagagggcgtctacggtgacgtgcagcgcgtgaagatcctgttcaataagaaggagaacgccctagtgcagatggcggacggcaaccaggcccagctggccatgagccacctgaacgggcacaagctgcacgggaagcccatccgcatcacgctctcgaagcaccagaacgtgcagctgccccgcgagggccaggaggaccagggcctgaccaaggactacggcaactcacccctgcaccgcttcaagaagccgggctccaagaacttccagaacatattcccgccctcggccacgctgcacctctccaacatcccgccctcagtctccgaggaggatctcaaggtcctgttttccagcaatgggggcgtcgtcaaaggattcaagttcttccagaaggaccgcaagatggcactgatccagatgggctccgtggaggaggcggtccaggccctcattgacctgcacaaccacgacctcggggagaaccaccacctgcgggtctccttctccaagtccaccatctaggggcacaggcccccacggccgggccccctggcgacaacttccatcattccagagaaaagccactttaaaaacagctgaagtgaccttagcagaccagagattttatttttttaaagagaaatcagtttacctgtttttaaaaaaattaaatctagttcaccttgctcaccctgcggtgacagggacagctcaggctcttggtgactgtggcagcgggagttcccggccctccacacccggggccagaccctcggggccatgccttggtggggcctgtgtcgggcgtggggcctgcaggtgggcgccccgaccacgacttggcttccttgtgccttaaaaaacctgccttcctgcagccacacacccacccggggtgtcctggggacccaaggggtgggggggtcacaccagagagaggcagggggcctggccggctcctgcaggatcatgcagctggggcgcggcggccgcggctgcgacaccccaaccccagccctctaatcaagtcacgtgattctcccttcaccccgcccccagggccttcccttctgcccccaggcgggctccccgctgctccagctgcggagctggtcgacataatctctgtattatatactttgcagttgcagacgtctgtgcctagcaatatttccagttgaccaaatattctaatcttttttcatttatatgcaaaagaaatagttttaagtaactttttatagcaagatgatacaatggtatgagtgtaatctaaacttccttgtggtattaccttgtatgctgttacttttattttattccttgtaattaagtcacaggcaggacccagtttccagagagcaggcggggccgcccagtgggtcaggcacagggagccccggtcctatcttagagcccctgagcttcagggaaggggcgggcgtgtcgccgcctctggcatcgcctccggttgccttacaccacgccttcacctgcagtcgcctagaaaacttgctctcaaacttcagggttttttcttccttcaaattttggaccaaagtctcatttctgtgttttgcctgcctctgatgctgggacccggaaggcgggcgctcctcctgtcttctctgtgctctttctaccgcccccgcgtcctgtcccgggggctctcctaggatcccctttccgtaaaagcgtgtaacaagggtgtaaatatttataattttttatacctgttgtgagacccgaggggcggcggcgcggttttttatggtgacacaaatgtatattttgctaacagcaattccaggctcagtattgtgaccgcggagccacaggggaccccacgcacattccgttgccttacccgatggcttgtgacgcggagagaaccgattaaaaccgtttgagaaactcctcccttgtctagccctgtgttcgctgtggacgctgtagaggcaggttggccagtctgtacctggacttcgaataaatcttctgtatcctcgc

SEQ ID NO: 279112 - DNA, 3207 bp, Homo sapiens
agcgacacgaaaaaaacttaggctaggtacgaggctgggtgttgccactccgtcccccgcgggtctgctctgtgtgccatggacggcattgtcccagatatagccgttggtacaaagcggggatctgacgagcttttctctacttgtgtcactaacggaccgtttatcatgagcagcaactcggcttctgcagcaaacggaaatgacagcaagaagttcaaaggtgacagccgaagtgcaggcgtcccctctagagtgatccacatccggaagctccccatcgacgtcacggagggggaagtcatctccctggggctgccctttgggaaggtcaccaacctcctgatgctgaaggggaaaaaccaggccttcatcgagatgaacacggaggaggctgccaacaccatggtgaactactacacctcggtgacccctgtgctgcgcggccagcccatctacatccagttctccaaccacaaggagctgaagaccgacagctctcccaaccaggcgcgggcccaggcggccctgcaggcggtgaactcggtccagtcggggaacctggccttggctgcctcggcggcggccgtggacgcagggatggcgatggccgggcagagccccgtgctcaggatcatcgtggagaacctcttctaccctgtgaccctggatgtgctgcaccagattttctccaagttcggcacagtgttgaagatcatcaccttcaccaagaacaaccagttccaggccctgctgcagtatgcggaccccgtgagcgcccagcacgccaagctgtcgctggacgggcagaacatctacaacgcctgctgcacgctgcgcatcgacttttccaagctcaccagcctcaacgtcaagtacaacaatgacaagagccgtgactacacacgcccagacctgccttccggggacagccagccctcgctggaccagaccatggccgcggccttcggtgcacctggtataatctcagcctctccgtatgcaggagctggtttccctcccacctttgccattcctcaagctgcaggcctttccgttccgaacgtccacggcgccctggcccccctggccatcccctcggcggcggcggcagctgcggcggcaggtcggatcgccatcccgggcctggcgggggcaggaaattctgtattgctggtcagcaacctcaacccagagggcgtctacggtgacgtgcagcgcgtgaagatcctgttcaataagaaggagaacgccctagtgcagatggcggacggcaaccaggcccagctggccatgagccacctgaacgggcacaagctgcacgggaagcccatccgcatcacgctctcgaagcaccagaacgtgcagctgccccgcgagggccaggaggaccagggcctgaccaaggactacggcaactcacccctgcaccgcttcaagaagccgggctccaagaacttccagaacatattcccgccctcggccacgctgcacctctccaacatcccgccctcagtctccgaggaggatctcaaggtcctgttttccagcaatgggggcgtcgtcaaaggattcaagttcttccagaaggaccgcaagatggcactgatccagatgggctccgtggaggaggcggtccaggccctcattgacctgcacaaccacgacctcggggagaaccaccacctgcgggtctccttctccaagtccaccatctaggggcacaggcccccacggccgggccccctggcgacaacttccatcattccagagaaaagccactttaaaaacagctgaagtgaccttagcagaccagagattttatttttttaaagagaaatcagtttacctgtttttaaaaaaattaaatctagttcaccttgctcaccctgcggtgacagggacagctcaggctcttggtgactgtggcagcgggagttcccggccctccacacccggggccagaccctcggggccatgccttggtggggcctgtgtcgggcgtggggcctgcaggtgggcgccccgaccacgacttggcttccttgtgccttaaaaaacctgccttcctgcagccacacacccacccggggtgtcctggggacccaaggggtgggggggtcacaccagagagaggcagggggcctggccggctcctgcaggatcatgcagctggggcgcggcggccgcggctgcgacaccccaaccccagccctctaatcaagtcacgtgattctcccttcaccccgcccccagggccttcccttctgcccccaggcgggctccccgctgctccagctgcggagctggtcgacataatctctgtattatatactttgcagttgcagacgtctgtgcctagcaatatttccagttgaccaaatattctaatcttttttcatttatatgcaaaagaaatagttttaagtaactttttatagcaagatgatacaatggtatgagtgtaatctaaacttccttgtggtattaccttgtatgctgttacttttattttattccttgtaattaagtcacaggcaggacccagtttccagagagcaggcggggccgcccagtgggtcaggcacagggagccccggtcctatcttagagcccctgagcttcagggaaggggcgggcgtgtcgccgcctctggcatcgcctccggttgccttacaccacgccttcacctgcagtcgcctagaaaacttgctctcaaacttcagggttttttcttccttcaaattttggaccaaagtctcatttctgtgttttgcctgcctctgatgctgggacccggaaggcgggcgctcctcctgtcttctctgtgctctttctaccgcccccgcgtcctgtcccgggggctctcctaggatcccctttccgtaaaagcgtgtaacaagggtgtaaatatttataattttttatacctgttgtgagacccgaggggcggcggcgcggttttttatggtgacacaaatgtatattttgctaacagcaattccaggctcagtattgtgaccgcggagccacaggggaccccacgcacattccgttgccttacccgatggcttgtgacgcggagagaaccgattaaaaccgtttgagaaactcctcccttgtctagccctgtgttcgctgtggacgctgtagaggcaggttggccagtctgtacctggacttcgaataaatcttctgtatcctcgc

SEQ ID NO: 279113 - DNA, 3209 bp, Homo sapiens
agcgacacgaaaaaaacttaggctaggtacgaggctgggtgttgccactccgtcccccgcgggtctgctctgtgtgccatggacggcggggatctgacgagcttttctctacttgtgtcactaacggaccgtttatcatgagcagcaactcggcttctgcagcaaacggaaatgacagcaagaagttcaaaggtgacagccgaagtgcaggcgtcccctctagagtgatccacatccggaagctccccatcgacgtcacggagggggaagtcatctccctggggctgccctttgggaaggtcaccaacctcctgatgctgaaggggaaaaaccaggccttcatcgagatgaacacggaggaggctgccaacaccatggtgaactactacacctcggtgacccctgtgctgcgcggccagcccatctacatccagttctccaaccacaaggagctgaagaccgacagctctcccaaccaggcgcgggcccaggcggccctgcaggcggtgaactcggtccagtcggggaacctggccttggctgcctcggcggcggccgtggacgcagggatggcgatggccgggcagagccccgtgctcaggatcatcgtggagaacctcttctaccctgtgaccctggatgtgctgcaccagattttctccaagttcggcacagtgttgaagatcatcaccttcaccaagaacaaccagttccaggccctgctgcagtatgcggaccccgtgagcgcccagcacgccaagctgtcgctggacgggcagaacatctacaacgcctgctgcacgctgcgcatcgacttttccaagctcaccagcctcaacgtcaagtacaacaatgacaagagccgtgactacacacgcccagacctgccttccggggacagccagccctcgctggaccagaccatggccgcggccttcggtgcacctggtataatctcagcctctccgtatgcaggagctggtttccctcccacctttgccattcctcaagctgcaggcctttccgttccgaacgtccacggcgccctggcccccctggccatcccctcggcggcggcggcagctgcggcggcaggtcggatcgccatcccgggcctggcgggggcaggaaattctgtattgctggtcagcaacctcaacccagagagagtcacaccccaaagcctctttattcttttcggcgtctacggtgacgtgcagcgcgtgaagatcctgttcaataagaaggagaacgccctagtgcagatggcggacggcaaccaggcccagctggccatgagccacctgaacgggcacaagctgcacgggaagcccatccgcatcacgctctcgaagcaccagaacgtgcagctgccccgcgagggccaggaggaccagggcctgaccaaggactacggcaactcacccctgcaccgcttcaagaagccgggctccaagaacttccagaacatattcccgccctcggccacgctgcacctctccaacatcccgccctcagtctccgaggaggatctcaaggtcctgttttccagcaatgggggcgtcgtcaaaggattcaagttcttccagaaggaccgcaagatggcactgatccagatgggctccgtggaggaggcggtccaggccctcattgacctgcacaaccacgacctcggggagaaccaccacctgcgggtctccttctccaagtccaccatctaggggcacaggcccccacggccgggccccctggcgacaacttccatcattccagagaaaagccactttaaaaacagctgaagtgaccttagcagaccagagattttatttttttaaagagaaatcagtttacctgtttttaaaaaaattaaatctagttcaccttgctcaccctgcggtgacagggacagctcaggctcttggtgactgtggcagcgggagttcccggccctccacacccggggccagaccctcggggccatgccttggtggggcctgtgtcgggcgtggggcctgcaggtgggcgccccgaccacgacttggcttccttgtgccttaaaaaacctgccttcctgcagccacacacccacccggggtgtcctggggacccaaggggtgggggggtcacaccagagagaggcagggggcctggccggctcctgcaggatcatgcagctggggcgcggcggccgcggctgcgacaccccaaccccagccctctaatcaagtcacgtgattctcccttcaccccgcccccagggccttcccttctgcccccaggcgggctccccgctgctccagctgcggagctggtcgacataatctctgtattatatactttgcagttgcagacgtctgtgcctagcaatatttccagttgaccaaatattctaatcttttttcatttatatgcaaaagaaatagttttaagtaactttttatagcaagatgatacaatggtatgagtgtaatctaaacttccttgtggtattaccttgtatgctgttacttttattttattccttgtaattaagtcacaggcaggacccagtttccagagagcaggcggggccgcccagtgggtcaggcacagggagccccggtcctatcttagagcccctgagcttcagggaaggggcgggcgtgtcgccgcctctggcatcgcctccggttgccttacaccacgccttcacctgcagtcgcctagaaaacttgctctcaaacttcagggttttttcttccttcaaattttggaccaaagtctcatttctgtgttttgcctgcctctgatgctgggacccggaaggcgggcgctcctcctgtcttctctgtgctctttctaccgcccccgcgtcctgtcccgggggctctcctaggatcccctttccgtaaaagcgtgtaacaagggtgtaaatatttataattttttatacctgttgtgagacccgaggggcggcggcgcggttttttatggtgacacaaatgtatattttgctaacagcaattccaggctcagtattgtgaccgcggagccacaggggaccccacgcacattccgttgccttacccgatggcttgtgacgcggagagaaccgattaaaaccgtttgagaaactcctcccttgtctagccctgtgttcgctgtggacgctgtagaggcaggttggccagtctgtacctggacttcgaataaatcttctgtatcctcgc

SEQ ID NO: 279114 - DNA, 3295 bp, Homo sapiens
agcgacacgaaaaaaacttaggctaggtacgaggctgggtgttgccactccgtcccccgcgggtctgctctgtgtgccatggacggcattgtcccagatatagccgttggtacaaagcggggatctgacgagcttttctctacttgtgtcactaacggaccgtttatcatgagcagcaactcggcttctgcagcaaacggaaatgacagcaagaagttcaaaggtgacagccgaagtgcaggcgtcccctctagagtgatccacatccggaagctccccatcgacgtcacggagggggaagtcatctccctggggctgccctttgggaaggtcaccaacctcctgatgctgaaggggaaaaaccaggccttcatcgagatgaacacggaggaggctgccaacaccatggtgaactactacacctcggtgacccctgtgctgcgcggccagcccatctacatccagttctccaaccacaaggagctgaagaccgacagctctcccaaccaggcgcgggcccaggcggccctgcaggcggtgaactcggtccagtcggggaacctggccttggctgcctcggcggcggccgtggacgcagggatggcgatggccgggcagagccccgtgctcaggatcatcgtggagaacctcttctaccctgtgaccctggatgtgctgcaccagattttctccaagttcggcacagtgttgaagatcatcaccttcaccaagaacaaccagttccaggccctgctgcagtatgcggaccccgtgagcgcccagcacgccaagctgtcgctggacgggcagaacatctacaacgcctgctgcacgctgcgcatcgacttttccaagctcaccagcctcaacgtcaagtacaacaatgacaagagccgtgactacacacgcccagacctgccttccggggacagccagccctcgctggaccagaccatggccgcggccttcggtgcacctggtataatctcagcctctccgtatgcaggagctggtttccctcccacctttgccattcctcaagctgcaggcctttccgttccgaacgtccacggcgccctggcccccctggccatcccctcggcggcggcggcagctgcggcggcaggtcggatcgccatcccgggcctggcgggggcaggaaattctgtattgctggtcagcaacctcaacccagagagagtcacaccccaaagcctctttattcttttcggcgtctacggtgacgtgcagcgcgtgaagatcctgttcaataagaaggagaacgccctagtgcagatggcggacggcaaccaggcccagctggccatgagccacctgaacgggcacaagctgcacgggaagcccatccgcatcacgctctcgaagcaccagaacgtgcagctgccccgcgagggccaggaggaccagggcctgaccaaggactacggcaactcacccctgcaccgcttcaagaagccgggctccaagaacttccagaacatattcccgccctcggccacgctgcacctctccaacatcccgccctcagtctccgaggaggatctcaaggtcctgttttccagcaatgggggcgtcgtcaaaggattcaagttcttccagaaggaccgcaagatggcactgatccagatgggctccgtggaggaggcggtccaggccctcattgacctgcacaaccacgacctcggggagaaccaccacctgcgggtctccttctccaagtccaccatctaggggcacaggcccccacggccgggccccctggcgacaacttccatcattccagagaaaagccactttaaaaacagctgaagtgaccttagcagaccagagattttatttttttaaagagaaatcagtttacctgtttttaaaaaaattaaatctagttcaccttgctcaccctgcggtgacagggacagctcaggctcttggtgactgtggcagcgggagttcccggccctccacacccggggccagaccctcggggccatgccttggtggggcctgtgtcgggcgtggggcctgcaggtgggcgccccgaccacgacttggcttccttgtgccttaaaaaacctgccttcctgcagccacacacccacccggggtgtcctggggacccaaggggtgggggggtcacaccagagagaggcagggggcctggccggctcctgcaggatcatgcagctggggcgcggcggccgcggctgcgacaccccaaccccagccctctaatcaagtcacgtgattctcccttcaccccgcccccagggccttcccttctgcccccaggcgggctccccgctgctccagctgcggagctggtcgacataatctctgtattatatactttgcagttgcagacgtctgtgcctagcaatatttccagttgaccaaatattctaatcttttttcatttatatgcaaaagaaatagttttaagtaactttttatagcaagatgatacaatggtatgagtgtaatctaaacttccttgtggtattaccttgtatgctgttacttttattttattccttgtaattaagtcacaggcaggacccagtttccagagagcaggcggggccgcccagtgggtcaggcacagggagccccggtcctatcttagagcccctgagcttcagggaaggggcgggcgtgtcgccgcctctggcatcgcctccggttgccttacaccacgccttcacctgcagtcgcctagaaaacttgctctcaaacttcagggttttttcttccttcaaattttggaccaaagtctcatttctgtgttttgcctgcctctgatgctgggacccggaaggcgggcgctcctcctgtcttctctgagcttcagggaaggggcgggcgtgtcgcgcctctggcatcgctccggttgccttacaccacgccttcacctgcagtcgcctagaaaacttgctctcctaggatcccctttccgtaaaagcgtgtaacaagggtgtaaatatttataattttttatacctgttgtgagacccgaggggcggcggcgcggttttttatggtgacacaaatgtatattttgctaacagcaattccaggctcagtattgtgaccgcggagccacaggggaccccacgcacattccgttgccttacccgatggcttgtgacgcggagagaaccgattaaaaccgtttgagaaactcctcccttgtctagccctgtgttcgctgtggacgctgtagaggcaggttggccagtctgtacctggacttcgaataaatcttctgtatcctcgc

SEQ ID NO: 279115 - DNA, 3199 bp, Homo sapiens
agcgacacgaaaaaaacttaggctaggtacgaggctgggtgttgccactccgtcccccgcgggtctgctctgtgtgccatggacggcattgtcccagatatagccgttggtacaaagcggggatctgacgagcttttctctacttgtgtcactaacggaccgtttatcatgagcagcaactcggcttctgcagcaaacggaaatgacagcaagaagttcaaaggtgacagccgaagtgcaggcgtcccctctagagtgatccacatccggaagctccccatcgacgtcacggagggggaagtcatctccctggggctgccctttgggaaggtcaccaacctcctgatgctgaaggggaaaaaccaggccttcatcgagatgaacacggaggaggctgccaacaccatggtgaactactacacctcggtgacccctgtgctgcgcggccagcccatctacatccagttctccaaccacaaggagctgaagaccgacagctctcccaaccaggcgcgggcccaggcggccctgcaggcggtgaactcggtccagtcggggaacctggccttggctgcctcggcggcggccgtggacgcagggatggcgatggccgggcagagccccgtgctcaggatcatcgtggagaacctcttctaccctgtgaccctggatgtgctgcaccagattttctccaagttcggcacagtgttgaagatcatcaccttcaccaagaacaaccagttccaggccctgctgcagtatgcggaccccgtgagcgcccagcacgccaagctgtcgctggacgggcagaacatctacaacgcctgctgcacgctgcgcatcgacttttccaagctcaccagcctcaacgtcaagtacaacaatgacaagagccgtgactacacacgcccagacctgccttccggggacagccagccctcgctggaccagaccatggccgcggccttcggtgcacctggtataatctcagcctctccgtatgcaggagctggtttccctcccacctttgccattcctcaagctgcaggcctttccgttccgaacgtccacggcgccctggcccccctggccatcccctcggcggcggcggcagctgcggcggcaggtcggatcgccatcccgggcctggcgggggcaggaaattctgtattgctggtcagcaacctcaacccagagagagtcacaccccaaagcctctttattcttttcggcgtctacggtgacgtgcagcgcgtgaagatcctgttcaataagaaggagaacgccctagtgcagatggcggacggcaaccaggcccagctggccatgagccacctgaacgggcacaagctgcacgggaagcccatccgcatcacgctctcgaagcaccagaacgtgcagctgccccgcgagggccaggaggaccagggcctgaccaaggactacggcaactcacccctgcaccgcttcaagaagccgggctccaagaacttccagaacatattcccgccctcggccacgctgcacctctccaacatcccgccctcagtctccgaggaggatctcaaggtcctgttttccagcaatgggggcgtcgtcaaaggattcaagttcttccagaaggaccgcaagatggcactgatccagatgggctccgtggaggaggcggtccaggccctcattgacctgcacaaccacgacctcggggagaaccaccacctgcgggtctccttctccaagtccaccatctaggggcacaggcccccacggccgggccccctggcgacaacttccatcattccagagaaaagccactttaaaaacagctgaagtgaccttagcagaccagagattttatttttttaaagagaaatcagtttacctgtttttaaaaaaattaaatctagttcaccttgctcaccctgcggtgacagggacagctcaggctcttggtgactgtggcagcgggagttcccggccctccacacccggggccagaccctcggggccatgccttggtggggcctgtgtcgggcgtggggcctgcaggtgggcgccccgaccacgacttggcttccttgtgccttaaaaaacctgccttcctgcagccacacacccacccggggtgtcctggggacccaaggggtgggggggtcacaccagagagaggcagggggcctggccggctcctgcaggatcatgcagctggggcgcggcggccgcggctgcgacaccccaaccccagccctctaatcaagtcacgtgattctcccttcaccccgcccccagggccttcccttctgcccccaggcgggctccccgctgctccagctgcggagctggtcgacataatctctgtattatatactttgcagttgcagacgtctgtgcctagcaatatttccagttgaccaaatattctaatcttttttcatttatatgcaaaagaaatagttttaagtaactttttatagcaagatgatacaatggtatgagtgtaatctaaacttccttgtaattaagtcacaggcaggacccagtttccagagagcaggcggggccgcccagtgggtcaggcacagggagccccggtcctatcttagagcccctgagcttcagggaaggggcgggcgtgtcgccgcctctggcatcgcctccggttgccttacaccacgccttcacctgcagtcgcctagaaaacttgctctcaaacttcagggttttttcttccttcaaattttggaccaaagtctcatttctgtgttttgcctgcctctgatgctgggacccggaaggcgggcgctcctcctgtcttctctgtgctctttctaccgcccccgcgtcctgtcccgggggctctcctaggatcccctttccgtaaaagcgtgtaacaagggtgtaaatatttataattttttatacctgttgtgagacccgaggggcggcggcgcggttttttatggtgacacaaatgtatattttgctaacagcaattccaggctcagtattgtgaccgcggagccacaggggaccccacgcacattccgttgccttacccgatggcttgtgacgcggagagaaccgattaaaaccgtttgagaaactcctcccttgtctagccctgtgttcgctgtggacgctgtagaggcaggttggccagtctgtacctggacttcgaataaatcttctgtatcctcgc

SEQ ID NO: 279116 - DNA, 2967 bp, Homo sapiens
agcgacacgaaaaaaacttaggctaggtacgaggctgggtgttgccactccgtcccccgcgggtctgctctgtgtgccatggacggcattgtcccagatatagccgttggtacaaagcggggatctgacgagcttttctctacttgtgtcactaacggaccgtttatcatgagcagcaactcggcttctgcagcaaacggaaatgacagcaagaagttcaaaggtgacagccgaagtgcaggcgtcccctctagagtgatccacatccggaagctccccatcgacgtcacggagggggaagtcatctccctggggctgccctttgggaaggtcaccaacctcctgatgctgaaggggaaaaaccaggccttcatcgagatgaacacggaggaggctgccaacaccatggtgaactactacacctcggtgacccctgtgctgcgcggccagcccatctacatccagttctccaaccacaaggagctgaagaccgacagctctcccaaccaggcgcgggcccaggcggccctgcaggcggtgaactcggtccagtcggggaacctggccttggctgcctcggcggcggccgtggacgcagggatggcgatggccgggcagagccccgtgctcaggatcatcgtggagaacctcttctaccctgtgaccctggatgtgctgcaccagattttctccaagttcggcacagtgttgaagatcatcaccttcaccaagaacaaccagttccaggccctgctgcagtatgcggaccccgtgagcgcccagcacgccaagctgtcgctggacgggcagaacatctacaacgcctgctgcacgctgcgcatcgacttttccaagctcaccagcctcaacgtcaagtacaacaatgacaagagccgtgactacacacgcccagacctgccttccggggacagccagccctcgctggaccagaccatggccgcggccttcggtgcacctggtataatctcagcctctccgtatgcaggagctggtttccctcccacctttgccattcctcaagctgcaggcctttccgttccgaacgtccacggcgccctggcccccctggccatcccctcggcggcggcggcagctgcggcggcaggtcggatcgccatcccgggcctggcgggggcaggaaattctgtattgctggtcagcaacctcaacccagagagagtcacaccccaaagcctctttattcttttcggcgtctacggtgacgtgcagcgcgtgaagatcctgttcaataagaaggagaacgccctagtgcagatggcggacggcaaccaggcccagctggccatgagccacctgaacgggcacaagctgcacgggaagcccatccgcatcacgctctcgaagcaccagaacgtgcagctgccccgcgagggccaggaggaccagggcctgaccaaggactacggcaactcacccctgcaccgcttcaagaagccgggctccaagaacttccagaacatattcccgccctcggccacgctgcacctctccaacatcccgccctcagtctccgaggaggatctcaaggtcctgttttccagcaatgggggcgtcgtcaaaggattcaagttcttccagaaggaccgcaagatggcactgatccagatgggctccgtggaggaggcggtccaggccctcattgacctgcacaaccacgacctcggggagaaccaccacctgcgggtctccttctccaagtccaccatctaggggcacaggcccccacggccgggccccctggcgacaacttccatcattccagagaaaagccactttaaaaacagctgaagtgaccttagcagaccagagattttatttttttaaagagaaatcagtttacctgtttttaaaaaaattaaatctagttcaccttgctcaccctgcggtgacagggacagctcaggctcttggtgactgtggcagcgggagttcccggccctccacacccggggccagaccctcggggccatgccttggtggggcctgtgtcgggcgtggggcctgcaggtgggcgccccgaccacgacttggcttccttgtgccttaaaaaacctgccttcctgcagccacacacccacccggggtgtcctggggacccaaggggtgggggggtcacaccagagagaggcagggggcctggccggctcctgcaggatcatgcagctggggcgcggcggccgcggctgcgacaccccaaccccagccctctaatcaagtcacgtgattctcccttcaccccgcccccagggccttcccttctgcccccaggcgggctccccgctgctccagctgcggagctggtcgacataatctctgtattatatactttgcagttgcagacgtctgtgcctagcaatatttccagttgaccaaatattctaatcttttttcatttatatgcaaaagaaatagttttaagtaactttttatagcaagatgatacaatggtatgagtgtaatctaaacttccttgtggtattaccttgtatgctgttacttttattttattccttgtaattaagtcacaggcaggacccagtttccagagagcaggcggggccgcccagtgggtcaggcacagggagccccggtcctatcttagagcccctgagcttcagggaaggggcgggcgtgtcgccgcctctttctaccgcccccgcgtcctgtcccgggggctctcctaggatcccctttccgtaaaagcgtgtaacaagggtgtaaatatttataattttttatacctgttgtgagacccgaggggcggcggcgcggttttttatggtgacacaaatgtatattttgctaacagcaattccaggctcagtattgtgaccgcggagccacaggggaccccacgcacattccgttgccttacccgatggcttgtgacgcggagagaaccgattaaaaccgtttgagaaactc

SEQ ID NO: 279117 - DNA, 3219 bp, Homo sapiens
agcgacacgaaaaaaacttaggctaggtacgaggctgggtgttgccactccgtcccccgcgggtctgctctgtgtgccatggacggcattgtcccagatatagccgttggtacaaagcggggatctgacgagcttttctctacttgtgtcactaacggaccgtttatcatgagcagcaactcggcttctgcagcaaacggaaatgacagcaagaagttcaaaggtgacagccgaagtgcaggcgtcccctctagagtgatccacatccggaagctccccatcgacgtcacggagggggaagtcatctccctggggctgccctttgggaaggtcaccaacctcctgatgctgaaggggaaaaaccaggccttcatcgagatgaacacggaggaggctgccaacaccatggtgaactactacacctcggtgacccctgtgctgcgcggccagcccatctacatccagttctccaaccacaaggagctgaagaccgacagctctcccaaccaggcgcgggcccaggcggccctgcaggcggtgaactcggtccagtcggggaacctggccttggctgcctcggcggcggccgtggacgcagggatggcgatggccgggcagagccccgtgctcaggatcatcgtggagaacctcttctaccctgtgaccctggatgtgctgcaccagattttctccaagttcggcacagtgttgaagatcatcaccttcaccaagaacaaccagttccaggccctgctgcagtatgcggaccccgtgagcgcccagcacgccaagctgtcgctggacgggcagaacatctacaacgcctgctgcacgctgcgcatcgacttttccaagctcaccagcctcaacgtcaagtacaacaatgacaagagccgtgactacacacgcccagacctgccttccggggacagccagccctcgctggaccagaccatggccgcggccttcggtgcacctggtataatctcagcctctccgtatgcaggagctggtttccctcccacctttgccattcctcaagctgcaggcctttccgttccgaacgtccacggcgccctggcccccctggccatcccctcggcggcggcggcagctgcggcggcaggtcggatcgccatcccgggcctggcgggggcaggaaattctgtattgctggtcagcaacctcaacccagagagagtcacaccccaaagcctctttattcttttcggcgtctacggtgacgtgcagcgcgtgaagatcctgttcaataagaaggagaacgccctagtgcagatggcggacggcaaccaggcccagctggccatgagccacctgaacgggcacaagctgcacgggaagcccatccgcatcacgctctcgaagcaccagaacgtgcagctgccccgcgagggccaggaggaccagggcctgaccaaggactacggcaactcacccctgcaccgcttcaagaagccgggctccaagaacttccagaacatattcccgccctcggccacgctgcacctctccaacatcccgccctcagtctccgaggaggatctcaaggtcctgttttccagcaatgggggcgtcgtcaaaggattcaagttcttccagaaggaccgcaagatggcactgatccagatgggctccgtggaggaggcggtccaggccctcattgacctgcacaaccacgacctcggggagaaccaccacctgcgggtctccttctccaagtccaccatctaggggcacaggcccccacggccgggccccctggcgacaacttccatcattccagagaaaagccactttaaaaacagctgaagtgaccttagcagaccagagattttatttttttaaagagaaatcagtttacctgtttttaaaaaaattaaatctagttcaccttgctcaccctgcggtgacagggacagctcaggctcttggtgactgtggcagcgggagttcccgaccctcggggccatgccttggtggggcctgtgtcgggcgtggggcctgcaggtgggcgccccgaccacgacttggcttccttgtgccttaaaaaacctgccttcctgcagccacacacccacccggggtgtcctggggacccaaggggtgggggggtcacaccagagagaggcagggggcctggccggctcctgcaggatcatgcagctggggcgcggcggccgcggctgcgacaccccaaccccagccctctaatcaagtcacgtgattctcccttcaccccgcccccagggccttcccttctgcccccaggcgggctccccgctgctccagctgcggagctggtcgacataatctctgtattatatactttgcagttgcagacgtctgtgcctagcaatatttccagttgaccaaatattctaatcttttttcatttatatgcaaaagaaatagttttaagtaactttttatagcaagatgatacaatggtatgagtgtaatctaaacttccttgtggtattaccttgtatgctgttacttttattttattccttgtaattaagtcacaggcaggacccagtttccagagagcaggcggggccgcccagtgggtcaggcacagggagccccggtcctatcttagagcccctgagcttcagggaaggggcgggcgtgtcgccgcctctggcatcgcctccggttgccttacaccacgccttcacctgcagtcgcctagaaaacttgctctcaaacttcagggttttttcttccttcaaattttggaccaaagtctcatttctgtgttttgcctgcctctgatgctgggacccggaaggcgggcgctcctcctgtcttctctgtgctctttctaccgcccccgcgtcctgtcccgggggctctcctaggatcccctttccgtaaaagcgtgtaacaagggtgtaaatatttataattttttatacctgttgtgagacccgaggggcggcggcgcggttttttatggtgacacaaatgtatattttgctaacagcaattccaggctcagtattgtgaccgcggagccacaggggaccccacgcacattccgttgccttacccgatggcttgtgacgcggagagaaccgattaaaaccgtttgagaaactcctcccttgtctagccctgtgttcgctgtggacgctgtagaggcaggttggccagtctgtacctggacttcgaataaatcttctgtatcctcgc

SEQ ID NO: 279118 - DNA, 4892 bp, Homo sapiens
agcgacacgaaaaaaacttaggctaggtacgaggctgggtgttgccactccgtcccccgcgggtctgctctgtgtgccatggacggcattgtcccagatatagccgttggtacaaagcggggatctgacgagcttttctctacttgtgtcactaacggaccgtttatcatgagcagcaactcggcttctgcagcaaacggaaatgacagcaagaagttcaaaggtgacagccgaagtgcaggcgtcccctctagagtgatccacatccggaagctccccatcgacgtcacggagggggaagtcatctccctggggctgccctttgggaaggtcaccaacctcctgatgctgaaggggaaaaaccaggccttcatcgagatgaacacggaggaggctgccaacaccatggtgaactactacacctcggtgacccctgtgctgcgcggccagcccatctacatccagttctccaaccacaaggagctgaagaccgacagctctcccaaccaggcgcgggcccaggcggccctgcaggcggtgaactcggtccagtcggggaacctggccttggctgcctcggcggcggccgtggacgcagggatggcgatggccgggcagagccccgtgctcaggatcatcgtggagaacctcttctaccctgtgaccctggatgtgctgcaccagattttctccaagttcggcacagtgttgaagatcatcaccttcaccaagaacaaccagttccaggccctgctgcagtatgcggaccccgtgagcgcccagcacgccaagctgtcgctggacgggcagaacatctacaacgcctgctgcacgctgcgcatcgacttttccaagctcaccagcctcaacgtcaagtacaacaatgacaagagccgtgactacacacgcccagacctgccttccggggacagccagccctcgctggaccagaccatggccgcggccttcggtgcacctggtataatctcagcctctccgtatgcaggagctggtttccctcccacctttgccattcctcaagctgcaggtattcaaacgcttggtcttggttccccagcgactgcatgcccacaccaccttcccaggcagctccgcatccacggcggcagcctgggcggactgggcactcgagtgccaggtcaggggcccttcccgggagaggggacgccacgtccacagagcaggcttggccagggcagtggtaggacagggctgtggaggcccacgtgtggacggcgccagccagaagccgctaatcgcacagtctttgtggtctggttcccttcaagcacctccgggcgagcgcgaggaccgccagtggttggagggatgtctctagtagttgaatttgagtggcctggtaagcgcgcggcccgaggctgagcagcatgaccggcggcgggacgtgtgtgcgtggccgtcctcccgcttcccttctgggaccggggcccggccgccccagtgctggccgtggacggagcagcgcgtgccgcccggcggccgcctcgtctgcatggaggcatgggcgcgcatgcgcggtggtcccgggacgggccctgcttgccgagggccccgtgtctgtgctggcggagccggagcttttctgtgctgtgggcggggcgcatgcagatgagcccaggcccggcccggcccgtgctgtgaggagaggcgggcgctggtgcaggagccggcgggtggctgtgcgggggtcgggcgaccccacaggcacccagggtagggccagagccagggccgcctcccgcgcggctcggctcctcggtgcatgaggacggggagcgtcggcctctcccactctgcggtggagtcgggggcgccgccgctcatctcacctcctgcttttccaggcctttccgttccgaacgtccacggcgccctggcccccctggccatcccctcggcggcggcggcagctgcggcggcaggtcggatcgccatcccgggcctggcgggggcaggaaattctgtattgctggtcagcaacctcaacccagaggtacgtgggcttttcctccgcgccgccgttcctcccggaagagcgagcaggggatgttgtgctcgggctcgggtcccggagcagcgccgcccctcgctgtgtctgcgcctctgccctggcagcccctctgctgcagcgctgagaccctccttttccaagatggcttgagttttcctcttttcctgaattcacatcttggttcgcgttttctcttgcatgatacgcagaatgaattattttttggttacccaaaggcaatctaaaaattacttggagctgagcagggcgcgcagttcagagccccagcaggccgccctgctggtcagcgggacacacagggttagcgcggcggggtgtgggcagcccctgtggctcgagagcctgtcacttaactggtggatccgttatttcccagaatggttaaattcccctcggggagagcttgggtgaaacaagaggcccaaaatatgtaactcttgatggatgggatcctcctggaatcagcatttcaggctgttctgtttcccggcaactcctgtgacttcctcaaggcggtgcccagcctggccctccctcgcgggggcccaggacgcactccctgcctgtgcctcttaccacgagccgggtgctgtccctccagctcctcctgagcgaggccgtgcactaacagactcgatctcccttcacgcctgtaatcgtccttagagactgacttgtgccacagctgcgggagacagcgctgctgcagggcttggctgaggtggccgcgagcggagctgcacgcgcgctcctggggggcgtggttgggatcggcttctgggagcccctccagcagcgctgtctctgccggcatgtgagtgaaggtgcttctcttaccgtgtgcccgtcgaggtaaacctgtaactggaatgtgtgtggagtgtgactgatagaacactacctgattcttatgtatttactgacctgtgtttttttgctactttttttcttttctccccttcccctttccctattttttttcttgccctgatccggaatttctttgccaactgactgcacggtacttctgcttcctgttgttgcttgaaacaaaacaaaaacataaacaaataaaaaacaaaaattccccctcaaaccctgctctccggaaaccaacctgcccttgaatattaacatcctgacaacttcatcatccatcaaccactgcacgcctgcggggactgtcttcctcgtgtggacgattggcaactcgccccccttgacctctccctctcccctgtccctccgctgccttgctctgctgtctctaaagagagtcacaccccaaagcctctttattcttttcggcgtctacggtgacgtgcagcgcgtgaagatcctgttcaataagaaggagaacgccctagtgcagatggcggacggcaaccaggcccagctggccatgagccacctgaacgggcacaagctgcacgggaagcccatccgcatcacgctctcgaagcaccagaacgtgcagctgccccgcgagggccaggaggaccagggcctgaccaaggactacggcaactcacccctgcaccgcttcaagaagccgggctccaagaacttccagaacatattcccgccctcggcccccctggcgacaacttccatcattccagagaaaagccactttaaaaacagctgaagtgaccttagcagaccagagattttatttttttaaagagaaatcagtttacctgtttttaaaaaaattaaatctagttcaccttgctcaccctgcggtgacagggacagctcaggctcctgcaggatcatgcagctggggcgcggcggccgcggctgcgacaccccaaccccagccctctaatcaagtcacgtgattctcccttcaccccgcccccagggccttcccttctgcccccaggcgggctccccgctgctccagctgcggagctggtcgacataatctctgtattatatactttgcagttgcagacgtctgtgcctagcaatatttccagttgaccaaatattctaatcttttttcatttatatgcaaaagaaatagttttaagtaactttttatagcaagatgatacaatggtatgagtgtaatctaaacttccttgtggtattaccttgtatgctgttacttttattttattccttgtaattaagtcacaggcaggacccagtttccagagagcaggcggggccgcccagtgggtcaggcacagggagccccggtcctatcttagagcccctgagcttcagggaaggggcgggcgtgtcgccgcctctggcatcgcctccggttgccttacaccacgccttcacctgcagtcgcctagaaaacttgctctcaaacttcagggttttttcttccttcaaattttggaccaaagtctcatttctgtgttttgcctgcctctgatgctgggacccggaaggcgggcgctcctcctgtcttctctgtgctctttctaccgcccccgcgtcctgtcccgggggctctcctaggatcccctttccgtaaaagcgtgtaacaagggtgtaaatatttataattttttatacctgttgtgagacccgaggggcggcggcgcggttttttatggtgacacaaatgtatattttgctaacagcaattccaggctcagtattgtgaccgcggagccacaggggaccccacgcacattccgttgccttacccgatggcttgtgacgcggagagaaccgattaaaaccgtttgagaaactcctcccttgtctagccctgtgttcgctgtggacgctgtagaggcaggttggccagtctgtacctggacttcgaataaatcttctgtatcctcgc

SEQ ID NO: 279119 - DNA, 3943 bp, Homo sapiens
agcgacacgaaaaaaacttaggctaggtacgaggctgggtgttgccactccgtcccccgcgggtctgctctgtgtgccatggacggcattgtcccagatatagccgttggtacaaagcggggatctgacgagcttttctctacttgtgtcactaacggaccgtttatcatgagcagcaactcggcttctgcagcaaacggaaatgacagcaagaagttcaaaggtgacagccgaagtgcaggcgtcccctctagagtgatccacatccggaagctccccatcgacgtcacggagggggaagtcatctccctggggctgccctttgggaaggtcaccaacctcctgatgctgaaggggaaaaaccaggccttcatcgagatgaacacggaggaggctgccaacaccatggtgaactactacacctcggtgacccctgtgctgcgcggccagcccatctacatccagttctccaaccacaaggagctgaagaccgacagctctcccaaccaggcgcgggcccaggcggccctgcaggcggtgaactcggtccagtcggggaacctggccttggctgcctcggcggcggccgtggacgcagggatggcgatggccgggcagagccccgtgctcaggatcatcgtggagaacctcttctaccctgtgaccctggatgtgctgcaccagattttctccaagttcggcacagtgttgaagatcatcaccttcaccaagaacaaccagttccaggccctgctgcagtatgcggaccccgtgagcgcccagcacgccaagctgtcgctggacgggcagaacatctacaacgcctgctgcacgctgcgcatcgacttttccaagctcaccagcctcaacgtcaagtacaacaatgacaagagccgtgactacacacgcccagacctgccttccggggacagccagccctcgctggaccagaccatggccgcggccttcggtgcacctggtataatctcagcctctccgtatgcaggagctggtttccctcccacctttgccattcctcaagctgcaggtattcaaacgcttggtcttggttccccagcgactgcatgcccacaccaccttcccaggcagctccgcatccacggcggcagcctgggcggactgggcactcgagtgccaggtcaggggcccttcccgggagaggggacgccacgtccacagagcaggcttggccagggcagtggtaggacagggctgtggaggcccacgtgtggacggcgccagccagaagccgctaatcgcacagtctttgtggtctggttcccttcaagcacctccgggcgagcgcgaggaccgccagtggttggagggatgtctctagtagttgaatttgagtggcctggtaagcgcgcggcccgaggctgagcagcatgaccggcggcgggacgtgtgtgcgtggccgtcctcccgcttcccttctgggaccggggcccggccgccccagtgctggccgtggacggagcagcgcgtgccgcccggcggccgcctcgtctgcatggaggcatgggcgcgcatgcgcggtggtcccgggacgggccctgcttgccgagggccccgtgtctgtgctggcggagccggagcttttctgtgctgtgggcggggcgcatgcagatgagcccaggcccggcccggcccgtgctgtgaggagaggcgggcgctggtgcaggagccggcgggtggctgtgcgggggtcgggcgaccccacaggcacccagggtagggccagagccagggccgcctcccgcgcggctcggctcctcggtgcatgaggacggggagcgtcggcctctcccactctgcggtggagtcgggggcgccgccgctcatctcacctcctgcttttccaggcctttccgttccgaacgtccacggcgccctggcccccctggccatcccctcggcggcggcggcagctgcggcggcaggtcggatcgccatcccgggcctggcgggggcaggaaattctgtattgctggtcagcaacctcaacccagaggtacgtgggcttttcctccgcgccgccgttcctcccggaagagcgagcaggggatgttgtgctcgggctcgggtcccggagcagcgccgcccctcgctgtgtctgcgcctctgccctggcagcccctctgctgcagcgctgagaccctccttttccaagatggcttgagttttcctcttttcctgaattcacatcttggttcgcgttttctcttgcatgatacgcagaatgaattattttttggttacccaaaggcaatctaaaaattacttggagctgagcagggcgcgcagttcagagccccagcaggccgccctgctggtcagcgggacacacagggttagcgcggcggggtgtgggcagcccctgtggctcgagagcctgtcacttaactggtggatccgttatttcccagaatggttaaattcccctcggggagagcttgggtgaaacaagaggcccaaaatatgtaactcttgatggatgggatcctcctggaatcagcatttcaggctgttctgtttcccggcaactcctgtgacttcctcaaggcggtgcccagcctggccctccctcgcgggggcccaggacgcactccctgcctgtgcctcttaccacgagccgggtgctgtccctccagctcctcctgagcgaggccgtgcactaacagactcgatctcccttcacgcctgtaatcgtccttagagactgacttgtgccacagctgcgggagacagcgctgctgcagggcttggctgaggtggccgcgagcggagctgcacgcgcgctcctggggggcgtggttgggatcggcttctgggagcccctccagcagcgctgtctctgccggcaggctcctgcaggatcatgcagctggggcgcggcggccgcggctgcgacaccccaaccccagccctctaatcaagtcacgtgattctcccttcaccccgcccccagggccttcccttctgcccccaggcgggctccccgctgctccagctgcggagctggtcgacataatctctgtattatatactttgcagttgcagacgtctgtgcctagcaatatttccagttgaccaaatattctaatcttttttcatttatatgcaaaagaaatagttttaagtaactttttatagcaagatgatacaatggtatgagtgtaatctaaacttccttgtggtattaccttgtatgctgttacttttattttattccttgtaattaagtcacaggcaggacccagtttccagagagcaggcggggccgcccagtgggtcaggcacagggagccccggtcctatcttagagcccctgagcttcagggaaggggcgggcgtgtcgccgcctctggcatcgcctccggttgccttacaccacgccttcacctgcagtcgcctagaaaacttgctctcaaacttcagggttttttcttccttcaaattttggaccaaagtctcatttctgtgttttgcctgcctctgatgctgggacccggaaggcgggcgctcctcctgtcttctctgtgctctttctaccgcccccgcgtcctgtcccgggggctctcctaggatcccctttccgtaaaagcgtgtaacaagggtgtaaatatttataattttttatacctgttgtgagacccgaggggcggcggcgcggttttttatggtgacacaaatgtatattttgctaacagcaattccaggctcagtattgtgaccgcggagccacaggggaccccacgcacattccgttgccttacccgatggcttgtgacgcggagagaaccgattaaaaccgtttgagaaactcctcccttgtctagccctgtgttcgctgtggacgctgtagaggcaggttggccagtctgtacctggacttcgaataaatcttctgtatcctcgc

SEQ ID NO: 279120 - DNA, 1909 bp, Homo sapiens
agcgacacgaaaaaaacttaggctaggtacgaggctgggtgttgccactccgtcccccgcgggtctgctctgtgtgccatggacggcattgtcccagatatagccgttggtacaaagcggggatctgacgagcttttctctacttgtgtcactaacggaccgtttatcatgagcagcaactcggcttctgcagcaaacggaaatgacagcaagaagttcaaaggtgacagccgaagtgcaggcgtcccctctagagtgatccacatccggaagctccccatcgacgtcacggagggggaagtcatctccctggggctgccctttgggaaggtcaccaacctcctgatgctgaaggggaaaaaccagggcctgaccaaggactacggcaactcacccctgcaccgcttcaagaagccgggctccaagaacttccagaacatattcccgccctcggccacgctgcacctctccaacatcccgccctcagtctccgaggaggatctcaaggtcctgttttccagcaatgggggcgtcgtcaaaggattcaagttcttccagaaggaccgcaagatggcactgatccagatgggctccgtggaggaggcggtccaggccctcattgacctgcacaaccacgacctcggggagaaccaccacctgcgggtctccttctccaagtccaccatctaggggcctgtgtcgggcgtggggcctgcaggtgggcgccccgaccacgacttggcttccttgtgccttaaaaaacctgccttcctgcagccacacacccacccggggtgtcctggggacccaaggggtgggggggtcacaccagagagaggcagggggcctggccggctcctgcaggatcatgcagctggggcgcggcggccgcggctgcgacaccccaaccccagccctctaatcaagtcacgtgattctcccttcaccccgcccccagggccttcccttctgcccccaggcgggctccccgctgctccagctgcggagctggtcgacataatctctgtattatatactttgcagttgcagacgtctgtgcctagcaatatttccagttgaccaaatattctaatcttttttcatttatatgcaaaagaaatagttttaagtaactttttatagcaagatgatacaatggtatgagtgtaatctaaacttccttgtggtattaccttgtatgctgttacttttattttattccttgtaattaagtcacaggcaggacccagtttccagagagcaggcggggccgcccagtgggtcaggcacagggagccccggtcctatcttagagcccctgagcttcagggaaggggcgggcgtgtcgccgcctctggcatcgcctccggttgccttacaccacgccttcacctgcagtcgcctagaaaacttgctctcaaacttcagggttttttcttccttcaaattttggaccaaagtctcatttctgtgttttgcctgcctctgatgctgggacccggaaggcgggcgctcctcctgtcttctctgtgctctttctaccgcccccgcgtcctgtcccgggggctctcctaggatcccctttccgtaaaagcgtgtaacaagggtgtaaatatttataattttttatacctgttgtgagacccgaggggcggcggcgcggttttttatggtgacacaaatgtatattttgctaacagcaattccaggctcagtattgtgaccgcggagccacaggggaccccacgcacattccgttgccttacccgatggcttgtgacgcggagagaaccgattaaaaccgtttgagaaactcctcccttgtctagccctgtgttcgctgtggacgctgtagaggcaggttggccagtctgtacctggacttcgaataaatcttctgtatcctcgc

SEQ ID NO: 279121 - DNA, 2659 bp, Homo sapiens
agcgacacgaaaaaaacttaggctaggtacgaggctgggtgttgccactccgtcccccgcgggtctgctctgtgtgccatggacggcattgtcccagatatagccgttggtacaaagcggggatctgacgagcttttctctacttgtgtcactaacggaccgtttatcatgagcagcaactcggcttctgcagcaaacggaaatgacagcaagaagttcaaaggtgacagccgaagtgcaggcgtcccctctagagtgatccacatccggaagctccccatcgacgtcacggagggggaagtcatctccctggggctgccctttgggaaggtcaccaacctcctgatgctgaaggggaaaaaccaggccttcatcgagatgaacacggaggaggctgccaacaccatggtgaactactacacctcggtgacccctgtgctgcgcggccagcccatctacatccagttctccaaccacaaggagctgaagaccgacagctctcccaaccaggcgcgggcccaggcggccctgcaggcggtgaactcggtccagtcggggaacctggccttggctgcctcggcggcggccgtggacgcagggatggcgatggccgggcagagccccgtgctcaggatcatcgtggagaacctcttctaccctgtgaccctggatgtgctgcaccagattttctccaagttcggcacagtgttgaagatcatcaccttcaccaagaacaaccagttccaggccctgctgcagtatgcggaccccgtgagcgcccagcacgccaagctgtcgctggacgggcagaacatctacaacgcctgctgcacgctgcgcatcgacttttccaagctcaccagcctcaacgtcaagtacaacaatgacaagagccgtgactacacacgcccagacctgccttccggggacagccagccctcgctggaccagaccatggccgcggccttcggtgcacctggtataatctcagcctctccgtatgcaggagctggtttccctcccacctttgccattcctcaagctgcaggcctttccgttccgaacgtccacggcgccctggcccccctggccatcccctcggcggcggcggcagctgcggcggcaggtcggatcgccatcccgggcctggcgggggcaggaaattctgtattgctggtcagcaacctcaacccagagagagtcacaccccaaagcctctttattcttttcggcgtctacggtgacgtgcagcgcgtgaagatcctgttcaataagaaggagaacgccctagtgcagatggcggacggcaaccaggcccagctggccatgagccacctgaacgggcacaagctgcacgggaagcccatccgcatcacgctctcgaagcaccagaacgtgcagctgccccgcgagggccaggaggaccagggcctgaccaaggactacggcaactcacccctgcaccgcttcaagaagccgggctccaagaacttccagaacatattcccgccctcggccacgctgcacctctccaacatcccgccctcagtctccgaggaggatctcaaggtcctgttttccagcaatgggggcgtcgtcaaaggattcaagttcttccagaaggaccgcaagatggcactgatccagatgggctccgtggaggaggcggtccaggccctcattgacctgcacaaccacgacctcggggagaaccaccacctgcgggtctccttctccaagtccaccatctaggggcacaggcccccacggccgggccccctggcgacaacttccatcattccagagaaaagccactttaaaaacagctgaagtgaccttagcagaccagagattttatttttttaaagagaaatcagtttacctgtttttaaaaaaattaaatctagttcaccttgctcaccctgcggtgacagggacagctcaggctcttggtgactgtggcagcgggagttcccggccctccacacccggggccagaccctcggggccatgccttggtggggcctgtgtcgggcgtggggcctgcaggtgggcgcctagaagcttgcattggcattcataagtttcgtgtaagtaaaccatgcagattacatgaatcagagacaaaaaaatgacttagtaaaaaaaaaaaaaaaaaaaaaaaaagagagagaggaattagagagagggaagaggagagaaaaaaaggaaaaaaatatgagtgaaaatatgatggagtaatagagggagcaaaaagaaaaaagagaaaaattataatgtgaagtgaaagagtggtgaagaaatattgagagagggataatctcatatattgtgagagaagagaattatataaataggaaaaaaaaagaaacggttacacacgagcaggagtatcaacagaaaccaccgggcgaaaagacaataatgaggaacgctccaaacaacataagcccatgaaacaacagtcaacacatacagaccaacatcacaagtacccatgaaagatcaaaatatacgataaaatacaatcaaaaacacaaaaaatgtagcctaacgacaaaagataaatacatatcaacaccccaaccgaaaaaagaatcattaaacatacaactaaaaacgagaaatcaaacataaagaacactacacctaaacacac

SEQ ID NO: 279122 - DNA, 3853 bp, Homo sapiens
agcgacacgaaaaaaacttaggctaggtacgaggctgggtgttgccactccgtcccccgcgggtctgctctgtgtgccatggacggcattgtcccagatatagccgttggtacaaagcggggatctgacgagcttttctctacttgtgtcactaacggaccgtttatcatgagcagcaactcggcttctgcagcaaacggaaatgacagcaagaagttcaaaggtgacagccgaagtgcaggcgtcccctctagagtgatccacatccggaagctccccatcgacgtcacggagggggaagtcatctccctggggctgccctttgggaaggtcaccaacctcctgatgctgaaggggaaaaaccaggccttcatcgagatgaacacggaggaggctgccaacaccatggtgaactactacacctcggtgacccctgtgctgcgcggccagcccatctacatccagttctccaaccacaaggagctgaagaccgacagctctcccaaccaggcgcgggcccaggcggccctgcaggcggtgaactcggtccagtcggggaacctggccttggctgcctcggcggcggccgtggacgcagggatggcgatggccgggcagagccccgtgctcaggatcatcgtggagaacctcttctaccctgtgaccctggatgtgctgcaccagattttctccaagttcggcacagtgttgaagatcatcaccttcaccaagaacaaccagttccaggccctgctgcagtatgcggaccccgtgagcgcccagcacgccaagctgtcgctggacgggcagaacatctacaacgcctgctgcacgctgcgcatcgacttttccaagctcaccagcctcaacgtcaagtacaacaatgacaagagccgtgactacacacgcccagacctgccttccggggacagccagccctcgctggaccagaccatggccgcggccttcggtgcacctggtataatctcagcctctccgtatgcaggagctggtttccctcccacctttgccattcctcaagctgcaggtattcaaacgcttggtcttggttccccagcgactgcatgcccacaccaccttcccaggcagctccgcatccacggcggcagcctgggcggactgggcactcgagtgccaggtcaggggcccttcccgggagaggggacgccacgtccacagagcaggcttggccagggcagtggtaggacagggctgtggaggcccacgtgtggacggcgccagccagaagccgctaatcgcacagtctttgtggtctggttcccttcaagcacctccgggcgagcgcgaggaccgccagtggttggagggatgtctctagtagttgaatttgagtggcctggtaagcgcgcggcccgaggctgagcagcatgaccggcggcgggacgtgtgtgcgtggccgtcctcccgcttcccttctgggaccggggcccggccgccccagtgctggccgtggacggagcagcgcgtgccgcccggcggccgcctcgtctgcatggaggcatgggcgcgcatgcgcggtggtcccgggacgggccctgcttgccgagggccccgtgtctgtgctggcggagccggagcttttctgtgctgtgggcggggcgcatgcagatgagcccaggcccggcccggcccgtgctgtgaggagaggcgggcgctggtgcaggagccggcgggtggctgtgcgggggtcgggcgaccccacaggcacccagggtagggccagagccagggccgcctcccgcgcggctcggctcctcggtgcatgaggacggggagcgtcggcctctcccactctgcggtggagtcgggggcgccgccgctcatctcacctcctgcttttccaggcctttccgttccgaacgtccacggcgccctggcccccctggccatcccctcggcggcggcggcagctgcggcggcaggtcggatcgccatcccgggcctggcgggggcaggaaattctgtattgctggtcagcaacctcaacccagaggtacgtgggcttttcctccgcgccgccgttcctcccggaagagcgagcaggggatgttgtgctcgggctcgggtcccggagcagcgccgcccctcgctgtgtctgcgcctctgccctggcagcccctctgctgcagcgctgagaccctccttttccaagatggcttgagttttcctcttttcctgaattcacatcttggttcgcgttttctcttgcatgatacgcagaatgaattattttttggttacccaaaggcaatctaaaaattacttggagctgagcagggcgcgcagttcagagccccagcaggccgccctgctggtcagcgggacacacagggttagcgcggcggggtgtgggcagcccctgtggctcgagagcctgtcacttaactggtggatccgttatttcccagaatggttaaattcccctcggggagagcttgggtgaaacaagaggcccaaaatatgtaactcttgatggatgggatcctcctggaatcagcatttcaggctgttctgtttcccggcaactcctgtgacttcctcaaggcggtgcccagcctggccctccctcgcgggggcccaggacgcactccctgcctgtgcctcttaccacgagccgggtgctgtccctccagctcctcctgagcgaggccgtgcactaacagactcgatctcccttcacgcctgtaatcgtccttagagactgacttgtgccacagctgcgggagacagcgctgctgcagggcttggctgaggtggccgcgagcggagctgcacgcgcgctcctggggggcgtggttgggatcggcttctgggagcccctccagcagcgctgtctctgccggcatgtgagtgaaggtgcttctcttaccgtgtgcccgtcgaggtaaacctgtaactggaatgtgtgtggagtgtgactgatagaacactacctgattcttatgtatttactgacctgtgtttttttgctactttttttcttttctccccttcccctttccctattttttttcttgccctgatccggaatttctttgccaactgactgcacggtacttctgcttcctgttgttgcttgaaacaaaacaaaaacataaacaaataaaaaacaaaaattccccctcaaaccctgctctccggaaaccaacctgcccttgaatattaacatcctgacaacttcatcatccatcaaccactgcacgcctgcggggactgtcttcctcgtgtggacgattggcaactcgccccccttgacctctccctctcccctgtccctccgctgccttgctctgctgtctctaaagagagtcacaccccaaagcctctttattcttttcggcgtctacggtgacgtgcagcgcgtgaagatcctgttcaataagaaggagaacgccctagtgcagatggcggacggcaaccaggcccagctggccatgagccacctgaacgggcacaagctgcacgggaagcccatccgcatcacgctctcgaagcaccagaacgtgcagctgccccgcgagggccaggaggaccagggcctgaccaaggactacggcaactcacccctgcaccgcttcaagaagccgggctccaagaacttccagaacatattcccgccctcggccacgctgcacctctccaacatcccgccctcagtctccgaggaggatctcaaggtcctgttttccagcaatgggggcgtcgtcaaaggattcaagttcttccagaaggaccgcaagatggcactgatccagatgggctccgtggaggaggcggtcaagccctcattgaaccgatagcttaaggatct

SEQ ID NO: 279123 - DNA, 2863 bp, Homo sapiens
agcgacacgaaaaaaacttaggctaggtacgaggctgggtgttgccactccgtcccccgcgggtctgctctgtgtgccatggacggcattgtcccagatatagccgttggtacaaagcggggatctgacgagcttttctctacttgtgtcactaacggaccgtttatcatgagcagcaactcggcttctgcagcaaacggaaatgacagcaagaagttcaaaggtgacagccgaagtgcaggcgtcccctctagagtgatccacatccggaagctccccatcgacgtcacggagggggaagtcatctccctggggctgccctttgggaaggtcaccaacctcctgatgctgaaggggaaaaaccaggccttcatcgagatgaacacggaggaggctgccaacaccatggtgaactactacacctcggtgacccctgtgctgcgcggccagcccatctacatccagttctccaaccacaaggagctgaagaccgacagctctcccaaccaggcgcgggcccaggcggccctgcaggcggtgaactcggtccagtcggggaacctggccttggctgcctcggcggcggccgtggacgcagggatggcgatggccgggcagagccccgtgctcaggatcatcgtggagaacctcttctaccctgtgaccctggatgtgctgcaccagattttctccaagttcggcacagtgttgaagatcatcaccttcaccaagaacaaccagttccaggccctgctgcagtatgcggaccccgtgagcgcccagcacgccaagctgtcgctggacgggcagaacatctacaacgcctgctgcacgctgcgcatcgacttttccaagctcaccagcctcaacgtcaagtacaacaatgacaagagccgtgactacacacgcccagacctgccttccggggacagccagccctcgctggaccagaccatggccgcggccttcggtgcacctggtataatctcagcctctccgtatgcaggagctggtttccctcccacctttgccattcctcaagctgcaggtattcaaacgcttggtcttggttccccagcgactgcatgcccacaccaccttcccaggcagctccgcatccacggcggcagcctgggcggactgggcactcgagtgccaggtcaggggcccttcccgggagaggggacgccacgtccacagagcaggcttggccagggcagtggtaggacagggctgtggaggcccacgtgtggacggcgccagccagaagccgctaatcgcacagtctttgtggtctggttcccttcaagcacctccgggcgagcgcgaggaccgccagtggttggagggatgtctctagtagttgaatttgagtggcctggtaagcgcgcggcccgaggctgagcagcatgaccggcggcgggacgtgtgtgcgtggccgtcctcccgcttcccttctgggaccggggcccggccgccccagtgctggccgtggacggagcagcgcgtgccgcccggcggccgcctcgtctgcatggaggcatgggcgcgcatgcgcggtggtcccgggacgggccctgcttgccgagggccccgtgtctgtgctggcggagccggagcttttctgtgctgtgggcggggcgcatgcagatgagcccaggcccggcccggcccgtgctgtgaggagaggcgggcgctggtgcaggagccggcgggtggctgtgcgggggtcgggcgaccccacaggcacccagggtagggccagagccagggccgcctcccgcgcggctcggctcctcggtgcatgaggacggggagcgtcggcctctcccactctgcggtggagtcgggggcgccgccgctcatctcacctcctgcttttccaggcctttccgttccgaacgtccacggcgccctggcccccctggccatcccctcggcggcggcggcagctgcggcggcaggtcggatcgccatcccgggcctggcgggggcaggaaattctgtattgctggtcagcaacctcaacccagaggtacgtgggcttttcctccgcgccgccgttcctcccggaagagcgagcaggggatgttgtgctcgggctcgggtcccggagcagcgccgcccctcgctgtgtctgcgcctctgccctggcagcccctctgctgcagcgctgagaccctccttttccaagatggcttgagttttcctcttttcctgaattcacatcttggttcgcgttttctcttgcatgatacgcagaatgaattattttttggttacccaaaggcaatctaaaaattacttggagctgagcagggcgcgcagttcagagccccagcaggccgccctgctggtcagcgggacacacagggttagcgcggcggggtgtgggcagcccctgtggctcgagagctgacacaaatgtatattttgctaacagcaattccaggctcagtattgtgaccgcggagccacaggggaccccacgcacattccgttgccttacccgatggcttgtgacgcggagagaaccgattaaaaccgtttgagaaactcctcccttgtctagccctgtgttcgctgtggacgctgtagaggcaggttggccagtctgtacctggacttcgaataaatcttctgtatcctcgctccgttccgccttcgttgctggcttcctctttctgtgccgcgggcggccccgactcccgcccgggtgtccgccgaagcgccaggtggggccacgggcggggtgggcccggccctgagagtgggggtccctgcgtggggcgtgcgggccagagcgaatgaccaagagccggacctcggtttctgccgctttattgagcatccgcgcggccgc

SEQ ID NO: 279124 - DNA, 879 bp, Homo sapiens
agcgacacgaaaaaaacttaggctaggtacgaggctgggtgttgccactccgtcccccgcgggtctgctctgtgtgccatggacggcattgtcccagatatagccgttggtacaaagcggggatctgacgagcttttctctacttgtgtcactaacggaccgtttatcatgagcagcaactcggcttctgcagcaaacggaaatgacagcaagaagttcaaaggtgacagccgaagtgcaggcgtcccctctagagtgatccacatccggaagctccccatcgacgtcacggagggggaagtcatctccctggggctgccctttgggaaggtcaccaacctcctgatgctgaaggggaaaaaccaggccttcatcgagatgaacacggaggaggctgccaacaccatggtgaactactacacctcggtgacccctgtgctgcgcggccagcccatctacatccagttctccaaccacaaggagctgaagaccgacagctctcccaaccaggcgcgggcccaggcggccctgcaggcggtgaactcggtccagtcggggaacctggccttggctgcctcggcggcggccgtggacgcagggatggcgatggccgggcagagccccgtgctcaggatcatcgtggagaacctcttctaccctgtgaccctggatgtgctgcaccagattttctccaagttcggcacagtgttgaagatcatcaccttcaccaagaacaaccagttccaggccctgcgccgcgaggcagcaaggcaggttccccgactgaccgagttcacgtctgcaggcctgctgtgccgcgcctggttgggagagctgtcggtcttcagctccttgtggttagagaactggatgtagatg

SEQ ID NO: 279125 - DNA, 864 bp, Homo sapiens
agcgacacgaaaaaaacttaggctaggtacgaggctgggtgttgccactccgtcccccgcgggtctgctctgtgtgccatggacggcattgtcccagatatagccgttggtacaaagcggggatctgacgagcttttctctacttgtgtcactaacggaccgtttatcatgagcagcaactcggcttctgcagcaaacggaaatgacagcaagaagttcaaaggtgacagccgaagtgcaggcgtcccctctagagtgatccacatccggaagctccccatcgacgtcacggagggggaagtcatctccctggggctgccctttgggaaggtcaccaacctcctgatgctgaaggggaaaaaccaggccttcatcgagatgaacacggaggaggctgccaacaccatggtgaactactacacctcggtgacccctgtgctgcgcggccagcccatctacatccagttctcctcctgtcttctctgtgctctttctaccgcccccgcgtcctgtcccgggggctctcctaggatcccctttccgtaaaagcgtgtaacaagggtgtaaatatttataattttttatacctgttgtgagacccgaggggcggcggcgcggttttttatggtgacacaaatgtatattttgctaacagcaattccaggctcagtattgtgaccgcggagccacaggggaccccacgcacattccgttgccttacccgatggcttgtgacgcggagagaaccgattaaaaccgtttgagaaactcctcccttgtctagccctgtgttcgctgtggacgctgtagaggcaggttggccagtctgtacctggacttcgaataaatcttctgtatcctcgc

SEQ ID NO: 279126 - DNA, 526 bp, Homo sapiens
ggcggccgccccgagggtctgtcctccgccccggggccggaggggcctctccagggacccccgcgggcgccgtcatggggaggggccttcccggctctcgggccggggcagcctttccgggcggctttgctgggcgggcttcccttgggagaggtgggagccccctccagaaaggccgtgtcccgccgagcgcttcctgcgcgaggccctccctgggaataggaagcgggagaggctggagatgtttcgcattctttccgttttcctgagaagtttttcttgggttcagtcacttttaaaagtctgttaaacgtggtccgtgcagtctgtggtgtcagaagaggcgcagccctagagtgggtctggaccccttagcatgcgtgcgggcaggtgggtcctgcagacggcgagacgagggctccccgctctcggacccagcaccgcgggctcgggggccgcgcactcgcctcccggagtgaggcaggaggcccggaggctgcccttccgacggacgctccgagtcact

SEQ ID NO: 279127 - DNA, 3475 bp, Homo sapiens
ggcgtctccgccattttgtgagtctataactcggagccgttgggtcggttcctgctattccggcgcctccactccgtcccccgcgggtctgctctgtgtgccatggacggcattgtcccagatatagccgttggtacaaagcggggatctgacgagcttttctctacttgtgtcactaacggaccgtttatcatgagcagcaactcggcttctgcagcaaacggaaatgacagcaagaagttcaaaggtgacagccgaagtgcaggcgtcccctctagagtgatccacatccggaagctccccatcgacgtcacggagggggaagtcatctccctggggctgccctttgggaaggtcaccaacctcctgatgctgaaggggaaaaaccaggccttcatcgagatgaacacggaggaggctgccaacaccatggtgaactactacacctcggtgacccctgtgctgcgcggccagcccatctacatccagttctccaaccacaaggagctgaagaccgacagctctcccaaccaggcgcgggcccaggcggccctgcaggcggtgaactcggtccagtcggggaacctggccttggctgcctcggcggcggccgtggacgcagggatggcgatggccgggcagagccccgtgctcaggatcatcgtggagaacctcttctaccctgtgaccctggatgtgctgcaccagattttctccaagttcggcacagtgttgaagatcatcaccttcaccaagaacaaccagttccaggccctgctgcagtatgcggaccccgtgagcgcccagcacgccaagctgtcgctggacgggcagaacatctacaacgcctgctgcacgctgcgcatcgacttttccaagctcaccagcctcaacgtcaagtacaacaatgacaagagccgtgactacacacgcccagacctgccttccggggacagccagccctcgctggaccagaccatggccgcggccttcggtgcacctggtataatctcagcctctccgtatgcaggagctggtttccctcccacctttgccattcctcaagctgcaggcctttccgttccgaacgtccacggcgccctggcccccctggccatcccctcggcggcggcggcagctgcggcggcaggtcggatcgccatcccgggcctggcgggggcaggaaattctgtattgctggtcagcaacctcaacccagagagagtcacaccccaaagcctctttattcttttcggcgtctacggtgacgtgcagcgcgtgaagatcctgttcaataagaaggagaacgccctagtgcagatggcggacggcaaccaggcccagctggccatgagccacctgaacgggcacaagctgcacgggaagcccatccgcatcacgctctcgaagcaccagaacgtgcagctgccccgcgagggccaggaggaccagggcctgaccaaggactacggcaactcacccctgcaccgcttcaagaagccgggctccaagaacttccagaacatattcccgccctcggccacgctgcacctctccaacatcccgccctcagtctccgaggaggatctcaaggtcctgttttccagcaatgggggcgtcgtcaaaggattcaagttcttccagaaggaccgcaagatggcactgatccagatgggctccgtggaggaggcggtccaggccctcattgacctgcacaaccacgacctcggggagaaccaccacctgcgggtctccttctccaagtccaccatctaggggcacaggcccccacggccgggccccctggcgacaacttccatcattccagagaaaagccactttaaaaacagctgaagtgaccttagcagaccagagattttatttttttaaagagaaatcagtttacctgtttttaaaaaaattaaatctagttcaccttgctcaccctgcggtgacagggacagctcaggctcttggtgactgtggcagcgggagttcccggccctccacacccggggccagaccctcggggccatgccttggtggggcctgtgtcgggcgtggggcctgcaggtgggcgccccgaccacgacttggcttccttgtgccttaaaaaacctgccttcctgcagccacacacccacccggggtgtcctggggacccaaggggtgggggggtcacaccagagagaggcagggggcctggccggctcctgcaggatcatgcagctggggcgcggcggccgcggctgcgacaccccaaccccagccctctaatcaagtcacgtgattctcccttcaccccgcccccagggccttcccttctgcccccaggcgggctccccgctgctccagctgcggagctggtcgacataatctctgtattatatactttgcagttgcagacgtctgtgcctagcaatatttccagttgaccaaatattctaatcttttttcatttatatgcaaaagaaatagttttaagtaactttttatagcaagatgatacaatggtatgagtgtaatctaaacttccttgtggtattaccttgtatgctgttacttttattttattccttgtaattaagtcacaggcaggacccagtttccagagagcaggcggggccgcccagtgggtcaggcacagggagccccggtcctatcttagagcccctgagcttcagggaaggggcgggcgtgtcgccgcctctggcatcgcctccggttgccttacaccacgccttcacctgcagtcgcctagaaaacttgctctcaaacttcagggttttttcttccttcaaattttggaccaaagtctcatttctgtgttttgcctgcctctgatgctgggacccggaaggcgggcgctcctcctgtcttctctgtgctctttctaccgcccccgcgtcctgtcccgggggctctcctaggatcccctttccgtaaaagcgtgtaacaagggtgtaaatatttataattttttatacctgttgtgagacccgaggggcggcggcgcggttttttatggtgacacaaatgtatattttgctaacagcaattccaggctcagtattgtgaccgcggagccacaggggaccccacgcacattccgttgccttacccgatggcttgtgacgcggagagaaccgattaaaaccgtttgagaaactcctcccttgtctagccctgtgttcgctgtggacgctgtagaggcaggttggccagtctgtacctggacttcgaataaatcttctgtatcctcgctccgttccgccttcgttgctggcttcctctttctgtgccgcgggcggccccgactcccgcccgggtgtccgccgaagcgccaggtggggccacgggcggggtgggcccggccctgagagtgggggtccctgcgtggggcgtgcgggccagagcgaatgaccaagagccggacctcggtttctgccgctttattgagcatccgcgcggccgc

SEQ ID NO: 279128 - DNA, 3399 bp, Homo sapiens
ggcgtctccgccattttgtgagtctataactcggagccgttgggtcggttcctgctattccggcgcctccactccgtcccccgcgggtctgctctgtgtgccatggacggcattgtcccagatatagccgttggtacaaagcggggatctgacgagcttttctctacttgtgtcactaacggaccgtttatcatgagcagcaactcggcttctgcagcaaacggaaatgacagcaagaagttcaaaggtgacagccgaagtgcaggcgtcccctctagagtgatccacatccggaagctccccatcgacgtcacggagggggaagtcatctccctggggctgccctttgggaaggtcaccaacctcctgatgctgaaggggaaaaaccaggccttcatcgagatgaacacggaggaggctgccaacaccatggtgaactactacacctcggtgacccctgtgctgcgcggccagcccatctacatccagttctccaaccacaaggagctgaagaccgacagctctcccaaccaggcgcgggcccaggcggccctgcaggcggtgaactcggtccagtcggggaacctggccttggctgcctcggcggcggccgtggacgcagggatggcgatggccgggcagagccccgtgctcaggatcatcgtggagaacctcttctaccctgtgaccctggatgtgctgcaccagattttctccaagttcggcacagtgttgaagatcatcaccttcaccaagaacaaccagttccaggccctgctgcagtatgcggaccccgtgagcgcccagcacgccaagctgtcgctggacgggcagaacatctacaacgcctgctgcacgctgcgcatcgacttttccaagctcaccagcctcaacgtcaagtacaacaatgacaagagccgtgactacacacgcccagacctgccttccggggacagccagccctcgctggaccagaccatggccgcggccttccaggcctttccgttccgaacgtccacggcgccctggcccccctggccatcccctcggcggcggcggcagctgcggcggcaggtcggatcgccatcccgggcctggcgggggcaggaaattctgtattgctggtcagcaacctcaacccagagagagtcacaccccaaagcctctttattcttttcggcgtctacggtgacgtgcagcgcgtgaagatcctgttcaataagaaggagaacgccctagtgcagatggcggacggcaaccaggcccagctggccatgagccacctgaacgggcacaagctgcacgggaagcccatccgcatcacgctctcgaagcaccagaacgtgcagctgccccgcgagggccaggaggaccagggcctgaccaaggactacggcaactcacccctgcaccgcttcaagaagccgggctccaagaacttccagaacatattcccgccctcggccacgctgcacctctccaacatcccgccctcagtctccgaggaggatctcaaggtcctgttttccagcaatgggggcgtcgtcaaaggattcaagttcttccagaaggaccgcaagatggcactgatccagatgggctccgtggaggaggcggtccaggccctcattgacctgcacaaccacgacctcggggagaaccaccacctgcgggtctccttctccaagtccaccatctaggggcacaggcccccacggccgggccccctggcgacaacttccatcattccagagaaaagccactttaaaaacagctgaagtgaccttagcagaccagagattttatttttttaaagagaaatcagtttacctgtttttaaaaaaattaaatctagttcaccttgctcaccctgcggtgacagggacagctcaggctcttggtgactgtggcagcgggagttcccggccctccacacccggggccagaccctcggggccatgccttggtggggcctgtgtcgggcgtggggcctgcaggtgggcgccccgaccacgacttggcttccttgtgccttaaaaaacctgccttcctgcagccacacacccacccggggtgtcctggggacccaaggggtgggggggtcacaccagagagaggcagggggcctggccggctcctgcaggatcatgcagctggggcgcggcggccgcggctgcgacaccccaaccccagccctctaatcaagtcacgtgattctcccttcaccccgcccccagggccttcccttctgcccccaggcgggctccccgctgctccagctgcggagctggtcgacataatctctgtattatatactttgcagttgcagacgtctgtgcctagcaatatttccagttgaccaaatattctaatcttttttcatttatatgcaaaagaaatagttttaagtaactttttatagcaagatgatacaatggtatgagtgtaatctaaacttccttgtggtattaccttgtatgctgttacttttattttattccttgtaattaagtcacaggcaggacccagtttccagagagcaggcggggccgcccagtgggtcaggcacagggagccccggtcctatcttagagcccctgagcttcagggaaggggcgggcgtgtcgccgcctctggcatcgcctccggttgccttacaccacgccttcacctgcagtcgcctagaaaacttgctctcaaacttcagggttttttcttccttcaaattttggaccaaagtctcatttctgtgttttgcctgcctctgatgctgggacccggaaggcgggcgctcctcctgtcttctctgtgctctttctaccgcccccgcgtcctgtcccgggggctctcctaggatcccctttccgtaaaagcgtgtaacaagggtgtaaatatttataattttttatacctgttgtgagacccgaggggcggcggcgcggttttttatggtgacacaaatgtatattttgctaacagcaattccaggctcagtattgtgaccgcggagccacaggggaccccacgcacattccgttgccttacccgatggcttgtgacgcggagagaaccgattaaaaccgtttgagaaactcctcccttgtctagccctgtgttcgctgtggacgctgtagaggcaggttggccagtctgtacctggacttcgaataaatcttctgtatcctcgctccgttccgccttcgttgctggcttcctctttctgtgccgcgggcggccccgactcccgcccgggtgtccgccgaagcgccaggtggggccacgggcggggtgggcccggccctgagagtgggggtccctgcgtggggcgtgcgggccagagcgaatgaccaagagccggacctcggtttctgccgctttattgagcatccgcgcggccgc

SEQ ID NO: 279129 - DNA, 877 bp, Homo sapiens
  misc_feature (90)..(90): n is a, c, g, or t
  misc_feature (552)..(552): n is a, c, g, or t
tgtggggcttgccgatcttgttcccccagtagcctctgcgcacggggacgatggagagcttggccaggatgatggccccacggatggcgntggccacctccttggagcacttaacacccagaccgacgtggccattgtagtccccgatagcaacaaatgccttgaacctggtgcgctggccggcacgggtctgcttctgcactggcataatcttcaaaacctcatccttgagagaggcggttttttatggtgacacaaatgtatattttgctaacagcaattccaggctcagtattgtgaccgcggagccacaggggaccccacgcacattccgttgccttacccgatggcttgtgacgcggagagaaccgattaaaaccgtttgagaaactcaaaaaaaaaaaaaaaaaaaaaaaaaaaaacggtggggggggccggggccccgcgagaaaagcttttcaagaaccattcgcggtgggggcgcgcgggggcccagaggagaggaaagagggaaagcgtggggccaaagcggggttcccaaaggagaaaccngcgggccgaggaacaaaggggcggggaattctctctccaccaaaataaaaagaggccgcgggggggaaacacgcgagaggcgttctgggaacaacaactcccaaggaggggagttccgggagaggcccaatagaggggggaccctatacacaaggggggagccccaagaggaggagcagccgagaaatcctacaaaaattaaaccgcccaggggacggggggggagcactggcaacaccaacgagacgcagcaccaaaaaaaaacagaaagcacacgaaagcaaaagaaaagcaagccaaaccacaacaagcagcgagagagagt

SEQ ID NO: 279130 - DNA, 3240 bp, Homo sapiens
agcgacacgaaaaaaacttaggctaggtacgaggctgggtgttgccactccgtcccccgcgggtctgctctgtgtgccatggacggcattgtcccagatatagccgttggtacaaagcggggatctgacgagcttttctctacttgtgtcactaacggaccgtttatcatgagcagcaactcggcttctgcagcaaacggaaatgacagcaagaagttcaaaggtgacagccgaagtgcaggcgtcccctctagagtgatccacatccggaagctccccatcgacgtcacggagggggaagtcatctccctggggctgccctttgggaaggtcaccaacctcctgatgctgaaggggaaaaaccaggccttcatcgagatgaacacggaggaggctgccaacaccatggtgaactactacacctcggtgacccctgtgctgcgcggccagcccatctacatccagttctccaaccacaaggagctgaagaccgacagctctcccaaccaggcgcgggcccaggcggccctgcaggcggtgaactcggtccagtcggggaacctggccttggctgcctcggcggcggccgtggacgcagggatggcgatggccgggcagagccccgtgctcaggatcatcgtggagaacctcttctaccctgtgaccctggatgtgctgcaccagattttctccaagttcggcacagtgttgaagatcatcaccttcaccaagaacaaccagttccaggccctgctgcagtatgcggaccccgtgagcgcccagcacgccaagctgtcgctggacgggcagaacatctacaacgcctgctgcacgctgcgcatcgacttttccaagctcaccagcctcaacgtcaagtacaacaatgacaagagccgtgactacacacgcccagacctgccttccggggacagccagccctcgctggaccagaccatggccgcggccttcggtgcacctggtataatctcagcctctccgtatgcaggagctggtttccctcccacctttgccattcctcaagctgcaggcctttccgttccgaacgtccacggcgccctggcccccctggccatcccctcggcggcggcggcagctgcggcggcaggtcggatcgccatcccgggcctggcgggggcaggaaattctgtattgctggtcagcaacctcaacccagagagagtcacaccccaaagcctctttattcttttcggcgtctacggtgacgtgcagcgcgtgaagatcctgttcaataagaaggagaacgccctagtgcagatggcggacggcaaccaggcccagctggccatgagccacctgaacgggcacaagctgcacgggaagcccatccgcatcacgctctcgaagcaccagaacgtgcagctgccccgcgagggccaggaggaccagggcctgaccaaggactacggcaactcacccctgcaccgcttcaagaagccgggctccaagaacttccagaacatattcccgccctcggccacgctgcacctctccaacatcccgccctcagtctccgaggaggatctcaaggtcctgttttccagcaatgggggcgtcgtcaaaggattcaagttcttccagaaggaccgcaagatggcactgatccagatgggctccgtggaggaggcggtccaggccctcattgacctgcacaaccacgacctcggggagaaccaccacctgcgggtctccttctccaagtccaccatctaggggcacaggcccccacggccgggccccctggcgacaacttccatcattccagagaaaagccactttaaaaacagctgaagtgaccttagcagaccagagattttatttttttaaagagaaatcagtttacctgtttttaaaaaaattaaatctagttcaccttgctcaccctgcggtgacagggacagctcaggctcttggtgactgtggcagcgggagttcccggccctccacacccggggccagaccctcggggccatgccttggtggggcctgtgtcgggcgtggggcctgcaggtgggcgccccgaccacgacttggcttccttgtgccttaaaaaacctgccttcctgcagccacacacccacccggggtgtcctggggacccaaggggtgggggggtcacaccagagagaggcagggggcctggccggctcctgcaggatcatgcagctggggcgcggcggccgcggctgcgacaccccaaccccagccctctaatcaagtcacgtgattctcccttcaccccgcccccagggccttcccttctgcccccaggcgggctccccgctgctccagctgcggagctggtcgacataatctctgtattatatactttgcagttgcagacgtctgtgcctagcaatatttccagttgaccaaatattctaatcttttttcatttatatgcaaaagaaatagttttaagtaactttttatagcaagatgatacaatggtatgagtgtaatctaaacttccttgtggtattaccttgtatgctgttacttttattttattccttgtaattaagtcacaggcaggacccagtttccagagagcaggcggggccgcccagtgggtcaggcacagggagccccggtcctatcttagagcccctgagcttcagggaaggggcgggcgtgtcgccgcctctggcatcgcctccggttgccttacaccacgccttcacctgcagtcgcctagaaaacttgctctcaaacttcagggttttttcttccttcaaattttggaccaaagtctcatttctgtgttttgcctgcctctgatgctgggacccggaaggcgggcgctcctcctgtcttctctgtgctctttctaccgcccccgcgtcctgtcccgggggctctcctaggatcccctttccgtaaaagcgtgtaacaagggtgtaaatatttataattttttatacctgttgtgagacccgaggggcggcggcgcggttttttatggtgacacaaatgtatattttgctaacagcaattccaggctcagtattgtgaccgcggagccacaggggaccccacgcacattccgttgccttacccgatggcttgtgacgcggagagaaccgattaaaaccgtttgagaaactcctcccttgtctagccctgtgttcgctgtggacgctgtagaggcaggttggccagtctgtacctggacttcgaataaatcttctgtatcctcgc

SEQ ID NO: 279131 - DNA, 5390 bp, Homo sapiens
agcgacacgaaaaaaacttaggctaggtacgaggctgggtgttgccactccgtcccccgcgggtctgctctgtgtgccatggacggcattgtcccagatatagccgttggtacaaagcggggatctgacgagcttttctctacttgtgtcactaacggaccgtttatcatgagcagcaactcggcttctgcagcaaacggaaatgacagcaagaagttcaaaggtgacagccgaagtgcaggcgtcccctctagagtgatccacatccggaagctccccatcgacgtcacggagggggaagtcatctccctggggctgccctttgggaaggtcaccaacctcctgatgctgaaggggaaaaaccaggccttcatcgagatgaacacggaggaggctgccaacaccatggtgaactactacacctcggtgacccctgtgctgcgcggccagcccatctacatccagttctccaaccacaaggagctgaagaccgacagctctcccaaccaggcgcgggcccaggcggccctgcaggcggtgaactcggtccagtcggggaacctggccttggctgcctcggcggcggccgtggacgcagggatggcgatggccgggcagagccccgtgctcaggatcatcgtggagaacctcttctaccctgtgaccctggatgtgctgcaccagattttctccaagttcggcacagtgttgaagatcatcaccttcaccaagaacaaccagttccaggccctgctgcagtatgcggaccccgtgagcgcccagcacgccaagctgtcgctggacgggcagaacatctacaacgcctgctgcacgctgcgcatcgacttttccaagctcaccagcctcaacgtcaagtacaacaatgacaagagccgtgactacacacgcccagacctgccttccggggacagccagccctcgctggaccagaccatggccgcggccttcggtgcacctggtataatctcagcctctccgtatgcaggagctggtttccctcccacctttgccattcctcaagctgcaggtattcaaacgcttggtcttggttccccagcgactgcatgcccacaccaccttcccaggcagctccgcatccacggcggcagcctgggcggactgggcactcgagtgccaggtcaggggcccttcccgggagaggggacgccacgtccacagagcaggcttggccagggcagtggtaggacagggctgtggaggcccacgtgtggacggcgccagccagaagccgctaatcgcacagtctttgtggtctggttcccttcaagcacctccgggcgagcgcgaggaccgccagtggttggagggatgtctctagtagttgaatttgagtggcctggtaagcgcgcggcccgaggctgagcagcatgaccggcggcgggacgtgtgtgcgtggccgtcctcccgcttcccttctgggaccggggcccggccgccccagtgctggccgtggacggagcagcgcgtgccgcccggcggccgcctcgtctgcatggaggcatgggcgcgcatgcgcggtggtcccgggacgggccctgcttgccgagggccccgtgtctgtgctggcggagccggagcttttctgtgctgtgggcggggcgcatgcagatgagcccaggcccggcccggcccgtgctgtgaggagaggcgggcgctggtgcaggagccggcgggtggctgtgcgggggtcgggcgaccccacaggcacccagggtagggccagagccagggccgcctcccgcgcggctcggctcctcggtgcatgaggacggggagcgtcggcctctcccactctgcggtggagtcgggggcgccgccgctcatctcacctcctgcttttccaggcctttccgttccgaacgtccacggcgccctggcccccctggccatcccctcggcggcggcggcagctgcggcggcaggtcggatcgccatcccgggcctggcgggggcaggaaattctgtattgctggtcagcaacctcaacccagaggtacgtgggcttttcctccgcgccgccgttcctcccggaagagcgagcaggggatgttgtgctcgggctcgggtcccggagcagcgccgcccctcgctgtgtctgcgcctctgccctggcagcccctctgctgcagcgctgagaccctccttttccaagatggcttgagttttcctcttttcctgaattcacatcttggttcgcgttttctcttgcatgatacgcagaatgaattattttttggttacccaaaggcaatctaaaaattacttggagctgagcagggcgcgcagttcagagccccagcaggccgccctgctggtcagcgggacacacagggttagcgcggcggggtgtgggcagcccctgtggctcgagagcctgtcacttaactggtggatccgttatttcccagaatggttaaattcccctcggggagagcttgggtgaaacaagaggcccaaaatatgtaactcttgatggatgggatcctcctggaatcagcatttcaggctgttctgtttcccggcaactcctgtgacttcctcaaggcggtgcccagcctggccctccctcgcgggggcccaggacgcactccctgcctgtgcctcttaccacgagccgggtgctgtccctccagctcctcctgagcgaggccgtgcactaacagactcgatctcccttcacgcctgtaatcgtccttagagactgacttgtgccacagctgcgggagacagcgctgctgcagggcttggctgaggtggccgcgagcggagctgcacgcgcgctcctggggggcgtggttgggatcggcttctgggagcccctccagcagcgctgtctctgccggcatgtgagtgaaggtgcttctcttaccgtgtgcccgtcgaggtaaacctgtaactggaatgtgtgtggagtgtgactgatagaacactacctgattcttatgtatttactgacctgtgtttttttgctactttttttcttttctccccttcccctttccctattttttttcttgccctgatccggaatttctttgccaactgactgcacggtacttctgcttcctgttgttgcttgaaacaaaacaaaaacataaacaaataaaaaacaaaaattccccctcaaaccctgctctccggaaaccaacctgcccttgaatattaacatcctgacaacttcatcatccatcaaccactgcacgcctgcggggactgtcttcctcgtgtggacgattggcaactcgccccccttgacctctccctctcccctgtccctccgctgccttgctctgctgtctctaaagagagtcacaccccaaagcctctttattcttttcggcgtctacggtgacgtgcagcgcgtgaagatcctgttcaataagaaggagaacgccctagtgcagatggcggacggcaaccaggcccagctggccatgagccacctgaacgggcacaagctgcacgggaagcccatccgcatcacgctctcgaagcaccagaacgtgcagctgccccgcgagggccaggaggaccagggcctgaccaaggactacggcaactcacccctgcaccgcttcaagaagccgggctccaagaacttccagaacatattcccgccctcggccacgctgcacctctccaacatcccgccctcagtctccgaggaggatctcaaggtcctgttttccagcaatgggggcgtcgtcaaaggattcaagttcttccagaaggaccgcaagatggcactgatccagatgggctccgtggaggaggcggtccaggccctcattgacctgcacaaccacgacctcggggagaaccaccacctgcgggtctccttctccaagtccaccatctaggggcacaggcccccacggccgggccccctggcgacaacttccatcattccagagaaaagccactttaaaaacagctgaagtgaccttagcagaccagagattttatttttttaaagagaaatcagtttacctgtttttaaaaaaattaaatctagttcaccttgctcaccctgcggtgacagggacagctcaggctcttggtgactgtggcagcgggagttcccggccctccacacccggggccagaccctcggggccatgccttggtggggcctgtgtcgggcgtggggcctgcaggtgggcgccccgaccacgacttggcttccttgtgccttaaaaaacctgccttcctgcagccacacacccacccggggtgtcctggggacccaaggggtgggggggtcacaccagagagaggcagggggcctggccggctcctgcaggatcatgcagctggggcgcggcggccgcggctgcgacaccccaaccccagccctctaatcaagtcacgtgattctcccttcaccccgcccccagggccttcccttctgcccccaggcgggctccccgctgctccagctgcggagctggtcgacataatctctgtattatatactttgcagttgcagacgtctgtgcctagcaatatttccagttgaccaaatattctaatcttttttcatttatatgcaaaagaaatagttttaagtaactttttatagcaagatgatacaatggtatgagtgtaatctaaacttccttgtggtattaccttgtatgctgttacttttattttattccttgtaattaagtcacaggcaggacccagtttccagagagcaggcggggccgcccagtgggtcaggcacagggagccccggtcctatcttagagcccctgagcttcagggaaggggcgggcgtgtcgccgcctctggcatcgcctccggttgccttacaccacgccttcacctgcagtcgcctagaaaacttgctctcaaacttcagggttttttcttccttcaaattttggaccaaagtctcatttctgtgttttgcctgcctctgatgctgggacccggaaggcgggcgctcctcctgtcttctctgtgctctttctaccgcccccgcgtcctgtcccgggggctctcctaggatcccctttccgtaaaagcgtgtaacaagggtgtaaatatttataattttttatacctgttgtgagacccgaggggcggcggcgcggttttttatggtgacacaaatgtatattttgctaacagcaattccaggctcagtattgtgaccgcggagccacaggggaccccacgcacattccgttgccttacccgatggcttgtgacgcggagagaaccgattaaaaccgtttgagaaactcctcccttgtctagccctgtgttcgctgtggacgctgtagaggcaggttggccagtctgtacctggacttcgaataaatcttctgtatcctcgc

SEQ ID NO: 279132 - DNA, 4045 bp, Homo sapiens
agcgacacgaaaaaaacttaggctaggtacgaggctgggtgttgccactccgtcccccgcgggtctgctctgtgtgccatggacggcattgtcccagatatagccgttggtacaaagcggggatctgacgagcttttctctacttgtgtcactaacggaccgtttatcatgagcagcaactcggcttctgcagcaaacggaaatgacagcaagaagttcaaaggtgacagccgaagtgcaggcgtcccctctagagtgatccacatccggaagctccccatcgacgtcacggagggggaagtcatctccctggggctgccctttgggaaggtcaccaacctcctgatgctgaaggggaaaaaccaggccttcatcgagatgaacacggaggaggctgccaacaccatggtgaactactacacctcggtgacccctgtgctgcgcggccagcccatctacatccagttctccaaccacaaggagctgaagaccgacagctctcccaaccaggcgcgggcccaggcggccctgcaggcggtgaactcggtccagtcggggaacctggccttggctgcctcggcggcggccgtggacgcagggatggcgatggccgggcagagccccgtgctcaggatcatcgtggagaacctcttctaccctgtgaccctggatgtgctgcaccagattttctccaagttcggcacagtgttgaagatcatcaccttcaccaagaacaaccagttccaggccctgctgcagtatgcggaccccgtgagcgcccagcacgccaagctgtcgctggacgggcagaacatctacaacgcctgctgcacgctgcgcatcgacttttccaagctcaccagcctcaacgtcaagtacaacaatgacaagagccgtgactacacacgcccagacctgccttccggggacagccagccctcgctggaccagaccatggccgcggccttcggtgcacctggtataatctcagcctctccgtatgcaggagctggtttccctcccacctttgccattcctcaagctgcaggtattcaaacgcttggtcttggttccccagcgactgcatgcccacaccaccttcccaggcagctccgcatccacggcggcagcctgggcggactgggcactcgagtgccaggtcaggggcccttcccgggagaggggacgccacgtccacagagcaggcttggccagggcagtggtaggacagggctgtggaggcccacgtgtggacggcgccagccagaagccgctaatcgcacagtctttgtggtctggttcccttcaagcacctccgggcgagcgcgaggaccgccagtggttggagggatgtctctagtagttgaatttgagtggcctggtaagcgcgcggcccgaggctgagcagcatgaccggcggcgggacgtgtgtgcgtggccgtcctcccgcttcccttctgggaccggggcccggccgccccagtgctggccgtggacggagcagcgcgtgccgcccggcggccgcctcgtctgcatggaggcatgggcgcgcatgcgcggtggtcccgggacgggccctgcttgccgagggccccgtgtctgtgctggcggagccggagcttttctgtgctgtgggcggggcgcatgcagatgagcccaggcccggcccggcccgtgctgtgaggagaggcgggcgctggtgcaggagccggcgggtggctgtgcgggggtcgggcgaccccacaggcacccagggtagggccagagccagggccgcctcccgcgcggctcggctcctcggtgcatgaggacggggagcgtcggcctctcccactctgcggtggagtcgggggcgccgccgctcatctcacctcctgcttttccaggcctttccgttccgaacgtccacggcgccctggcccccctggccatcccctcggcggcggcggcagctgcggcggcaggtcggatcgccatcccgggcctggcgggggcaggaaattctgtattgctggtcagcaacctcaacccagagggcgtctacggtgacgtgcagcgcgtgaagatcctgttcaataagaaggagaacgccctagtgcagatggcggacggcaaccaggcccagctggccatgagccacctgaacgggcacaagctgcacgggaagcccatccgcatcacgctctcgaagcaccagaacgtgcagctgccccgcgagggccaggaggaccagggcctgaccaaggactacggcaactcacccctgcaccgcttcaagaagccgggctccaagaacttccagaacatattcccgccctcggccacgctgcacctctccaacatcccgccctcagtctccgaggaggatctcaaggtcctgttttccagcaatgggggcgtcgtcaaaggattcaagttcttccagaaggaccgcaagatggcactgatccagatgggctccgtggaggaggcggtccaggccctcattgacctgcacaaccacgacctcggggagaaccaccacctgcgggtctccttctccaagtccaccatctaggggcacaggcccccacggccgggccccctggcgacaacttccatcattccagagaaaagccactttaaaaacagctgaagtgaccttagcagaccagagattttatttttttaaagagaaatcagtttacctgtttttaaaaaaattaaatctagttcaccttgctcaccctgcggtgacagggacagctcaggctcttggtgactgtggcagcgggagttcccggccctccacacccggggccagaccctcggggccatgccttggtggggcctgtgtcgggcgtggggcctgcaggtgggcgccccgaccacgacttggcttccttgtgccttaaaaaacctgccttcctgcagccacacacccacccggggtgtcctggggacccaaggggtgggggggtcacaccagagagaggcagggggcctggccggctcctgcaggatcatgcagctggggcgcggcggccgcggctgcgacaccccaaccccagccctctaatcaagtcacgtgattctcccttcaccccgcccccagggccttcccttctgcccccaggcgggctccccgctgctccagctgcggagctggtcgacataatctctgtattatatactttgcagttgcagacgtctgtgcctagcaatatttccagttgaccaaatattctaatcttttttcatttatatgcaaaagaaatagttttaagtaactttttatagcaagatgatacaatggtatgagtgtaatctaaacttccttgtggtattaccttgtatgctgttacttttattttattccttgtaattaagtcacaggcaggacccagtttccagagagcaggcggggccgcccagtgggtcaggcacagggagccccggtcctatcttagagcccctgagcttcagggaaggggcgggcgtgtcgccgcctctggcatcgcctccggttgccttacaccacgccttcacctgcagtcgcctagaaaacttgctctcaaacttcagggttttttcttccttcaaattttggaccaaagtctcatttctgtgttttgcctgcctctgatgctgggacccggaaggcgggcgctcctcctgtcttctctgtgctctttctaccgcccccgcgtcctgtcccgggggctctcctaggatcccctttccgtaaaagcgtgtaacaagggtgtaaatatttataattttttatacctgttgtgagacccgaggggcggcggcgcggttttttatggtgacacaaatgtatattttgctaacagcaattccaggctcagtattgtgaccgcggagccacaggggaccccacgcacattccgttgccttacccgatggcttgtgacgcggagagaaccgattaaaaccgtttgagaaactcctcccttgtctagccctgtgttcgctgtggacgctgtagaggcaggttggccagtctgtacctggacttcgaataaatcttctgtatcctcgc

SEQ ID NO: 279133 - DNA, 3381 bp, Homo sapiens
agcgacacgaaaaaaacttaggctaggtacgaggctgggtgttgccactccgtcccccgcgggtctgctctgtgtgccatggacggcattgtcccagatatagccgttggtacaaagcggggatctgacgagcttttctctacttgtgtcactaacggaccgtttatcatgagcagcaactcggcttctgcagcaaacggaaatgacagcaagaagttcaaaggtgacagccgaagtgcaggcgtcccctctagagtgatccacatccggaagctccccatcgacgtcacggagggggaagtcatctccctggggctgccctttgggaaggtcaccaacctcctgatgctgaaggggaaaaaccaggccttcatcgagatgaacacggaggaggctgccaacaccatggtgaactactacacctcggtgacccctgtgctgcgcggccagcccatctacatccagttctccaaccacaaggagctgaagaccgacagctctcccaaccaggcgcgggcccaggcggccctgcaggcggtgaactcggtccagtcggggaacctggccttggctgcctcggcggcggccgtggacgcagggatggcgatggccgggcagagccccgtgctcaggatcatcgtggagaacctcttctaccctgtgaccctggatgtgctgcaccagattttctccaagttcggcacagtgttgaagatcatcaccttcaccaagaacaaccagttccaggccctgctgcagtatgcggaccccgtgagcgcccagcacgccaagctgtcgctggacgggcagaacatctacaacgcctgctgcacgctgcgcatcgacttttccaagctcaccagcctcaacgtcaagtacaacaatgacaagagccgtgactacacacgcccagacctgccttccggggacagccagccctcgctggaccagaccatggccgcggccttccaggcctttccgttccgaacgtccacggcgccctggcccccctggccatcccctcggcggcggcggcagctgcggcggcaggtcggatcgccatcccgggcctggcgggggcaggaaattctgtattgctggtcagcaacctcaacccagagagagtcacaccccaaagcctctttattcttttcggcgtctacggtgacgtgcagcgcgtgaagatcctgttcaataagaaggagaacgccctagtgcagatggcggacggcaaccaggcccagctggccatgagccacctgaacgggcacaagctgcacgggaagcccatccgcatcacgctctcgaagcaccagaacgtgcagctgccccgcgagggccaggaggaccagggcctgaccaaggactacggcaactcacccctgcaccgcttcaagaagccgggctccaagaacttccagaacatattcccgccctcggccacgctgcacctctccaacatcccgccctcagtctccgaggaggatctcaaggtcctgttttccagcaatgggggcgtcgtcaaaggattcaagttcttccagaaggaccgcaagatggcactgatccagatgggctccgtggaggaggcggtccaggccctcattgacctgcacaaccacgacctcggggagaaccaccacctgcgggtctccttctccaagtccaccatctaggggcacaggcccccacggccgggccccctggcgacaacttccatcattccagagaaaagccactttaaaaacagctgaagtgaccttagcagaccagagattttatttttttaaagagaaatcagtttacctgtttttaaaaaaattaaatctagttcaccttgctcaccctgcggtgacagggacagctcaggctcttggtgactgtggcagcgggagttcccggccctccacacccggggccagaccctcggggccatgccttggtggggcctgtgtcgggcgtggggcctgcaggtgggcgccccgaccacgacttggcttccttgtgccttaaaaaacctgccttcctgcagccacacacccacccggggtgtcctggggacccaaggggtgggggggtcacaccagagagaggcagggggcctggccggctcctgcaggatcatgcagctggggcgcggcggccgcggctgcgacaccccaaccccagccctctaatcaagtcacgtgattctcccttcaccccgcccccagggccttcccttctgcccccaggcgggctccccgctgctccagctgcggagctggtcgacataatctctgtattatatactttgcagttgcagacgtctgtgcctagcaatatttccagttgaccaaatattctaatcttttttcatttatatgcaaaagaaatagttttaagtaactttttatagcaagatgatacaatggtatgagtgtaatctaaacttccttgtggtattaccttgtatgctgttacttttattttattccttgtaattaagtcacaggcaggacccagtttccagagagcaggcggggccgcccagtgggtcaggcacagggagccccggtcctatcttagagcccctgagcttcagggaaggggcgggcgtgtcgccgcctctggcatcgcctccggttgccttacaccacgccttcacctgcagtcgcctagaaaacttgctctcaaacttcagggttttttcttccttcaaattttggaccaaagtctcatttctgtgttttgcctgcctctgatgctgggacccggaaggcgggcgctcctcctgtcttctctgtgctctttctaccgcccccgcgtcctgtcccgggggctctcctaggatcccctttccgtaaaagcgtgtaacaagggtgtaaatatttataattttttatacctgttgtgagacccgaggggcggcggcgcggttttttatggtgacacaaatgtatattttgctaacagcaattccaggctcagtattgtgaccgcggagccacaggggaccccacgcacattccgttgccttacccgatggcttgtgacgcggagagaaccgattaaaaccgtttgagaaactcctcccttgtctagccctgtgttcgctgtggacgctgtagaggcaggttggccagtctgtacctggacttcgaataaatcttctgtatcctcgcaaaaaaaaaaaaaaaaaaaaaaaaaaaattgggggcattaatgccgggcgggcgggaataagcggggcccgacaacgggggccacgggggccaatcaggtggtccccgggacccaaggtttcctggggccacaacgggggacaaaactcgggcgagtacccccattaataggggaggccggaaataaatccgaaaacccggggtaaaccgggtagag

SEQ ID NO: 279134 - DNA, 4556 bp, Homo sapiens
agcgacacgaaaaaaacttaggctaggtacgaggctgggtgttgccactccgtcccccgcgggtctgctctgtgtgccatggacggcattgtcccagatatagccgttggtacaaagcggggatctgacgagcttttctctacttgtgtcactaacggaccgtttatcatgagcagcaactcggcttctgcagcaaacggaaatgacagcaagaagttcaaaggtgacagccgaagtgcaggcgtcccctctagagtgatccacatccggaagctccccatcgacgtcacggagggggaagtcatctccctggggctgccctttgggaaggtcaccaacctcctgatgctgaaggggaaaaaccaggccttcatcgagatgaacacggaggaggctgccaacaccatggtgaactactacacctcggtgacccctgtgctgcgcggccagcccatctacatccagttctccaaccacaaggagctgaagaccgacagctctcccaaccaggcgcgggcccaggcggccctgcaggcggtgaactcggtccagtcggggaacctggccttggctgcctcggcggcggccgtggacgcagggatggcgatggccgggcagagccccgtgctcaggatcatcgtggagaacctcttctaccctgtgaccctggatgtgctgcaccagattttctccaagttcggcacagtgttgaagatcatcaccttcaccaagaacaaccagttccaggccctgctgcagtatgcggaccccgtgagcgcccagcacgccaagctgtcgctggacgggcagaacatctacaacgcctgctgcacgctgcgcatcgacttttccaagctcaccagcctcaacgtcaagtacaacaatgacaagagccgtgactacacacgcccagacctgccttccggggacagccagccctcgctggaccagaccatggccgcggccttcggtgcacctggtataatctcagcctctccgtatgcaggagctggtttccctcccacctttgccattcctcaagctgcaggcaggcctttccgttccgaacgtccacggcgccctggcccccctggccatcccctcggcggcggcggcagctgcggcggcaggtcggatcgccatcccgggcctggcgggggcaggaaattctgtattgctggtcagcaacctcaacccagaggtacgtgggcttttcctccgcgccgccgttcctcccggaagagcgagcaggggatgttgtgctcgggctcgggtcccggagcagcgccgcccctcgctgtgtctgcgcctctgccctggcagcccctctgctgcagcgctgagaccctccttttccaagatggcttgagttttcctcttttcctgaattcacatcttggttcgcgttttctcttgcatgatacgcagaatgaattattttttggttacccaaaggcaatctaaaaattacttggagctgagcagggcgcgcagttcagagccccagcaggccgccctgctggtcagcgggacacacagggttagcgcggcggggtgtgggcagcccctgtggctcgagagcctgtcacttaactggtggatccgttatttcccagaatggttaaattcccctcggggagagcttgggtgaaacaagaggcccaaaatatgtaactcttgatggatgggatcctcctggaatcagcatttcaggctgttctgtttcccggcaactcctgtgacttcctcaaggcggtgcccagcctggccctccctcgcgggggcccaggacgcactccctgcctgtgcctcttaccacgagccgggtgctgtccctccagctcctcctgagcgaggccgtgcactaacagactcgatctcccttcacgcctgtaatcgtccttagagactgacttgtgccacagctgcgggagacagcgctgctgcagggcttggctgaggtggccgcgagcggagctgcacgcgcgctcctggggggcgtggttgggatcggcttctgggagcccctccagcagcgctgtctctgccggcatgtgagtgaaggtgcttctcttaccgtgtgcccgtcgaggtaaacctgtaactggaatgtgtgtggagtgtgactgatagaacactacctgattcttatgtatttactgacctgtgtttttttgctactttttttcttttctccccttcccctttccctattttttttcttgccctgatccggaatttctttgccaactgactgcacggtacttctgcttcctgttgttgcttgaaacaaaacaaaaacataaacaaataaaaaacaaaaattccccctcaaaccctgctctccggaaaccaacctgcccttgaatattaacatcctgacaacttcatcatccatcaaccactgcacgcctgcggggactgtcttcctcgtgtggacgattggcaactcgccccccttgacctctccctctcccctgtccctccgctgccttgctctgctgtctctaaagagagtcacaccccaaagcctctttattcttttcggcgtctacggtgacgtgcagcgcgtgaagatcctgttcaataagaaggagaacgccctagtgcagatggcggacggcaaccaggcccagctggccatgagccacctgaacgggcacaagctgcacgggaagcccatccgcatcacgctctcgaagcaccagaacgtgcagctgccccgcgagggccaggaggaccagggcctgaccaaggactacggcaactcacccctgcaccgcttcaagaagccgggctccaagaacttccagaacatattcccgccctcggccacgctgcacctctccaacatcccgccctcagtctccgaggaggatctcaaggtcctgttttccagcaatgggggcgtcgtcaaaggattcaagttcttccagaaggaccgcaagatggcactgatccagatgggctccgtggaggaggcggtccaggccctcattgacctgcacaaccacgacctcggggagaaccaccacctgcgggtctccttctccaagtccaccatctaggggcacaggcccccacggccgggccccctggcgacaacttccatcattccagagaaaagccactttaaaaacagctgaagtgaccttagcagaccagagattttatttttttaaagagaaatcagtttacctgtttttaaaaaaattaaatctagttcaccttgctcaccctgcggtgacagggacagctcaggctcttggtgactgtggcagcgggagttcccggccctccacacccggggccagaccctcggggccatgccttggtggggcctgtgtcgggcgtggggcctgcaggtgggcgccccgaccacgacttggcttccttgtgccttaaaaaacctgccttcctgcagccacacacccacccggggtgtcctggggacccaaggggtgggggggtcacaccagagagaggcagggggcctggccggctcctgcaggatcatgcagctggggcgcggcggccgcggctgcgacaccccaaccccagccctctaatcaagtcacgtgattctcccttcaccccgcccccagggccttcccttctgcccccaggcgggctccccgctgctccagctgcggagctggtcgacataatctctgtattatatactttgcagttgcagacgtctgtgcctagcaatatttccagttgaccaaatattctaatcttttttcatttatatgcaaaagaaatagttttaagtaactttttatagcaagatgatacaatggtatgagtgtaatctaaacttccttgtggtattaccttgtatgctgttacttttattttattccttgtaattaagtcacaggcaggacccagtttccagagagcaggcggggccgcccagtgggtcaggcacagggagccccggtcctatcttagagcccctgagcttcagggaaggggcgggcgtgtcgccgcctctggcatcgcctccggttgccttacaccacgccttcacctgcagtcgcctagaaaacttgctctcaaacttcagggttttttcttccttcaaattttggaccaaagtctcatttctgtgttttgcctgcctctgatgctgggacccggaaggcgggcgctcctcctgtcttctctgtgctctttctaccgcccccgcgtcctgtcccgggggctctcctaggatcccctttccgtaaaagcgtgtaacaagggtgtaaatatttataattttttatacctgttgtgagacccgaggggcggcggcgcggttttttatggtgacacaaatgtatattttgctaacagcaattccaggctcagtattgtgaccgcggagccacaggggaccccacgcacattccgttgccttacccgatggcttgtgacgcggagagaaccgattaaaaccgtttgagaaactcctcccttgtctagccctgtgttcgctgtggacgctgtagaggcaggttggccagtctgtacctggacttcgaataaatcttctgtatcctcgc

SEQ ID NO: 279135 - DNA, 2811 bp, Homo sapiens
ggcaggggaggctgggttggaatcggccgagggtcccttcaagcacctccgggcgagcgcgaggaccgccagtggttggagggatgtctctagtagttgaatttgagtggcctggtaagcgcgcggcccgaggctgagcagcatgaccggcggcgggacgtgtgtgcgtggccgtcctcccgcttcccttctgggaccggggcccggccgccccagtgctggccgtggacggagcagcgcgtgccgcccggcggccgcctcgtctgcatggaggcatgggcgcgcatgcgcggtggtcccgggacgggccctgcttgccgagggccccgtgtctgtgctggcggagccggagcttttctgtgctgtgggcggggcgcatgcagatgagcccaggcccggcccggcccgtgctgtgaggagaggcgggcgctggtgcaggagccggcgggtggctgtgcgggggtcgggcgaccccacaggcacccagggtagggccagagccagggccgcctcccgcgcggctcggctcctcggtgcatgaggacggggagcgtcggcctctcccactctgcggtggagtcgggggcgccgccgctcatctcacctcctgcttttccaggcctttccgttccgaacgtccacggcgccctggcccccctggccatcccctcggcggcggcggcagctgcggcggcaggtcggatcgccatcccgggcctggcgggggcaggaaattctgtattgctggtcagcaacctcaacccagagagagtcacaccccaaagcctctttattcttttcggcgtctacggtgacgtgcagcgcgtgaagatcctgttcaataagaaggagaacgccctagtgcagatggcggacggcaaccaggcccagctggccatgagccacctgaacgggcacaagctgcacgggaagcccatccgcatcacgctctcgaagcaccagaacgtgcagctgccccgcgagggccaggaggaccagggcctgaccaaggactacggcaactcacccctgcaccgcttcaagaagccgggctccaagaacttccagaacatattcccgccctcggccacgctgcacctctccaacatcccgccctcagtctccgaggaggatctcaaggtcctgttttccagcaatgggggcgtcgtcaaaggattcaagttcttccagaaggaccgcaagatggcactgatccagatgggctccgtggaggaggcggtccaggccctcattgacctgcacaaccacgacctcggggagaaccaccacctgcgggtctccttctccaagtccaccatctaggggcacaggcccccacggccgggccccctggcgacaacttccatcattccagagaaaagccactttaaaaacagctgaagtgaccttagcagaccagagattttatttttttaaagagaaatcagtttacctgtttttaaaaaaattaaatctagttcaccttgctcaccctgcggtgacagggacagctcaggctcttggtgactgtggcagcgggagttcccggccctccacacccggggccagaccctcggggccatgccttggtggggcctgtgtcgggcgtggggcctgcaggtgggcgccccgaccacgacttggcttccttgtgccttaaaaaacctgccttcctgcagccacacacccacccggggtgtcctggggacccaaggggtgggggggtcacaccagagagaggcagggggcctggccggctcctgcaggatcatgcagctggggcgcggcggccgcggctgcgacaccccaaccccagccctctaatcaagtcacgtgattctcccttcaccccgcccccagggccttcccttctgcccccaggcgggctccccgctgctccagctgcggagctggtcgacataatctctgtattatatactttgcagttgcagacgtctgtgcctagcaatatttccagttgaccaaatattctaatcttttttcatttatatgcaaaagaaatagttttaagtaactttttatagcaagatgatacaatggtatgagtgtaatctaaacttccttgtggtattaccttgtatgctgttacttttattttattccttgtaattaagtcacaggcaggacccagtttccagagagcaggcggggccgcccagtgggtcaggcacagggagccccggtcctatcttagagcccctgagcttcagggaaggggcgggcgtgtcgccgcctctggcatcgcctccggttgccttacaccacgccttcacctgcagtcgcctagaaaacttgctctcaaacttcagggttttttcttccttcaaattttggaccaaagtctcatttctgtgttttgcctgcctctgatgctgggacccggaaggcgggcgctcctcctgtcttctctgtgctctttctaccgcccccgcgtcctgtcccgggggctctcctaggatcccctttccgtaaaagcgtgtaacaagggtgtaaatatttataattttttatacctgttgtgagacccgaggggcggcggcgcggttttttatggtgacacaaatgtatattttgctaacagcaattccaggctcagtattgtgaccgcggagccacaggggaccccacgcacattccgttgccttacccgatggcttgtgacgcggagagaaccgattaaaaccgtttgagaaactcctcccttgtctagccctgtgttcgctgtggacgctgtagaggcaggttggccagtctgtacctggacttcgaataaatcttctgtatcctcgc

SEQ ID NO: 279136 - DNA, 2126 bp, Homo sapiens
agcgacacgaaaaaaacttaggctaggtacgaggctgggtgttgccactccgtcccccgcgggtctgctctgtgtgccatggacggcattgtcccagatatagccgttggtacaaaggcgtctacggtgacgtgcagcgcgtgaagatcctgttcaataagaaggagaacgccctagtgcagatggcggacggcaaccaggcccagctggccatgagccacctgaacgggcacaagctgcacgggaagcccatccgcatcacgctctcgaagcaccagaacgtgcagctgccccgcgagggccaggaggaccagggcctgaccaaggactacggcaactcacccctgcaccgcttcaagaagccgggctccaagaacttccagaacatattcccgccctcggccacgctgcacctctccaacatcccgccctcagtctccgaggaggatctcaaggtcctgttttccagcaatgggggcgtcgtcaaaggattcaagttcttccagaaggaccgcaagatggcactgatccagatgggctccgtggaggaggcggtccaggccctcattgacctgcacaaccacgacctcggggagaaccaccacctgcgggtctccttctccaagtccaccatctaggggcacaggcccccacggccgggccccctggcgacaacttccatcattccagagaaaagccactttaaaaacagctgaagtgaccttagcagaccagagattttatttttttaaagagaaatcagtttacctgtttttaaaaaaattaaatctagttcaccttgctcaccctgcggtgacagggacagctcaggctcttggtgactgtggcagcgggagttcccggccctccacacccggggccagaccctcggggccatgccttggtggggcctgtgtcgggcgtggggcctgcaggtgggcgccccgaccacgacttggcttccttgtgccttaaaaaacctgccttcctgcagccacacacccacccggggtgtcctggggacccaaggggtgggggggtcacaccagagagaggcagggggcctggccggctcctgcaggatcatgcagctggggcgcggcggccgcggctgcgacaccccaaccccagccctctaatcaagtcacgtgattctcccttcaccccgcccccagggccttcccttctgcccccaggcgggctccccgctgctccagctgcggagctggtcgacataatctctgtattatatactttgcagttgcagacgtctgtgcctagcaatatttccagttgaccaaatattctaatcttttttcatttatatgcaaaagaaatagttttaagtaactttttatagcaagatgatacaatggtatgagtgtaatctaaacttccttgtggtattaccttgtatgctgttacttttattttattccttgtaattaagtcacaggcaggacccagtttccagagagcaggcggggccgcccagtgggtcaggcacagggagccccggtcctatcttagagcccctgagcttcagggaaggggcgggcgtgtcgccgcctctggcatcgcctccggttgccttacaccacgccttcacctgcagtcgcctagaaaacttgctctcaaacttcagggttttttcttccttcaaattttggaccaaagtctcatttctgtgttttgcctgcctctgatgctgggacccggaaggcgggcgctcctcctgtcttctctgtgctctttctaccgcccccgcgtcctgtcccgggggctctcctaggatcccctttccgtaaaagcgtgtaacaagggtgtaaatatttataattttttatacctgttgtgagacccgaggggcggcggcgcggttttttatggtgacacaaatgtatattttgctaacagcaattccaggctcagtattgtgaccgcggagccacaggggaccccacgcacattccgttgccttacccgatggcttgtgacgcggagagaaccgattaaaaccgtttgagaaactcctcccttgtctagccctgtgttcgctgtggacgctgtagaggcaggttggccagtctgtacctggacttcgaataaatcttctgtatcctcgc

SEQ ID NO: 279137 - DNA, 2178 bp, Homo sapiens
agcgacacgaaaaaaacttaggctaggtacgaggctgggtgttgccactccgtcccccgcgggtctgctctgtgtgccatggacggcattgtcccagatatagccgttggtacaaagcggggatctgacgagcttttctctacttgtgtcactaacggaccgtttatcatgagcagcaactcggcttctgcagcaaacggaaatgacagcaagaagttcaaaggtgacagccgaagtgcaggcgtcccctctagagtgatccacatccggaagctccccatcgacgtcacggagggggaagtcatctccctggggctgccctttgggaaggtcaccaacctcctgatgctgaaggggaaaaaccagggcctgaccaaggactacggcaactcacccctgcaccgcttcaagaagccgggctccaagaacttccagaacatattcccgccctcggccacgctgcacctctccaacatcccgccctcagtctccgaggaggatctcaaggtcctgttttccagcaatgggggcgtcgtcaaaggattcaagttcttccagaaggaccgcaagatggcactgatccagatgggctccgtggaggaggcggtccaggccctcattgacctgcacaaccacgacctcggggagaaccaccacctgcgggtctccttctccaagtccaccatctaggggcacaggcccccacggccgggccccctggcgacaacttccatcattccagagaaaagccactttaaaaacagctgaagtgaccttagcagaccagagattttatttttttaaagagaaatcagtttacctgtttttaaaaaaattaaatctagttcaccttgctcaccctgcggtgacagggacagctcaggctcttggtgactgtggcagcgggagttcccggccctccacacccggggccagaccctcggggccatgccttggtggggcctgtgtcgggcgtggggcctgcaggtgggcgccccgaccacgacttggcttccttgtgccttaaaaaacctgccttcctgcagccacacacccacccggggtgtcctggggacccaaggggtgggggggtcacaccagagagaggcagggggcctggccggctcctgcaggatcatgcagctggggcgcggcggccgcggctgcgacaccccaaccccagccctctaatcaagtcacgtgattctcccttcaccccgcccccagggccttcccttctgcccccaggcgggctccccgctgctccagctgcggagctggtcgacataatctctgtattatatactttgcagttgcagacgtctgtgcctagcaatatttccagttgaccaaatattctaatcttttttcatttatatgcaaaagaaatagttttaagtaactttttatagcaagatgatacaatggtatgagtgtaatctaaacttccttgtggtattaccttgtatgctgttacttttattttattccttgtaattaagtcacaggcaggacccagtttccagagagcaggcggggccgcccagtgggtcaggcacagggagccccggtcctatcttagagcccctgagcttcagggaaggggcgggcgtgtcgccgcctctggcatcgcctccggttgccttacaccacgccttcacctgcagtcgcctagaaaacttgctctcaaacttcagggttttttcttccttcaaattttggaccaaagtctcatttctgtgttttgcctgcctctgatgctgggacccggaaggcgggcgctcctcctgtcttctctgtgctctttctaccgcccccgcgtcctgtcccgggggctctcctaggatcccctttccgtaaaagcgtgtaacaagggtgtaaatatttataattttttatacctgttgtgagacccgaggggcggcggcgcggttttttatggtgacacaaatgtatattttgctaacagcaattccaggctcagtattgtgaccgcggagccacaggggaccccacgcacattccgttgccttacccgatggcttgtgacgcggagagaaccgattaaaaccgtttgagaaactcctcccttgtctagccctgtgttcgctgtggacgctgtagaggcaggttggccagtctgtacctggacttcgaataaatcttctgtatcctcgc

SEQ ID NO: 279138 - DNA, 1968 bp, Homo sapiens
agcgacacgaaaaaaacttaggctaggtacgaggctgggtgttgccactccgtcccccgcgggtctgctctgtgtgccatggacggcattgtcccagatatagccgttggtacaaagcggggatctgacgagcttttctctacttgtgtcactaacggaccgtttatcatgagcagcaactcggcttctgcagcaaacggaaatgacagcaagaagttcaaaggtgacagccgaagtgcaggcgtcccctctagagtgatccacatccggaagctccccatcgacgtcacggagggggaagtcatctccctggggctgccctttgggaaggtcaccaacctcctgatgctgaaggggaaaaaccaggccttcatcgagatgaacacggaggaggctgcccaggccctcattgacctgcacaaccacgacctcggggagaaccaccacctgcgggtctccttctccaagtccaccatctaggggcacaggcccccacggccgggccccctggcgacaacttccatcattccagagaaaagccactttaaaaacagctgaagtgaccttagcagaccagagattttatttttttaaagagaaatcagtttacctgtttttaaaaaaattaaatctagttcaccttgctcaccctgcggtgacagggacagctcaggctcttggtgactgtggcagcgggagttcccggccctccacacccggggccagaccctcggggccatgccttggtggggcctgtgtcgggcgtggggcctgcaggtgggcgccccgaccacgacttggcttccttgtgccttaaaaaacctgccttcctgcagccacacacccacccggggtgtcctggggacccaaggggtgggggggtcacaccagagagaggcagggggcctggccggctcctgcaggatcatgcagctggggcgcggcggccgcggctgcgacaccccaaccccagccctctaatcaagtcacgtgattctcccttcaccccgcccccagggccttcccttctgcccccaggcgggctccccgctgctccagctgcggagctggtcgacataatctctgtattatatactttgcagttgcagacgtctgtgcctagcaatatttccagttgaccaaatattctaatcttttttcatttatatgcaaaagaaatagttttaagtaactttttatagcaagatgatacaatggtatgagtgtaatctaaacttccttgtggtattaccttgtatgctgttacttttattttattccttgtaattaagtcacaggcaggacccagtttccagagagcaggcggggccgcccagtgggtcaggcacagggagccccggtcctatcttagagcccctgagcttcagggaaggggcgggcgtgtcgccgcctctggcatcgcctccggttgccttacaccacgccttcacctgcagtcgcctagaaaacttgctctcaaacttcagggttttttcttccttcaaattttggaccaaagtctcatttctgtgttttgcctgcctctgatgctgggacccggaaggcgggcgctcctcctgtcttctctgtgctctttctaccgcccccgcgtcctgtcccgggggctctcctaggatcccctttccgtaaaagcgtgtaacaagggtgtaaatatttataattttttatacctgttgtgagacccgaggggcggcggcgcggttttttatggtgacacaaatgtatattttgctaacagcaattccaggctcagtattgtgaccgcggagccacaggggaccccacgcacattccgttgccttacccgatggcttgtgacgcggagagaaccgattaaaaccgtttgagaaactcctcccttgtctagccctgtgttcgctgtggacgctgtagaggcaggttggccagtctgtacctggacttcgaataaatcttctgtatcctcgc

SEQ ID NO: 279139 - DNA, 5040 bp, Homo sapiens
agcgacacgaaaaaaacttaggctaggtacgaggctgggtgttgccactccgtcccccgcgggtctgctctgtgtgccatggacggcattgtcccagatatagccgttggtacaaagcggggatctgacgagcttttctctacttgtgtcactaacggaccgtttatcatgagcagcaactcggcttctgcagcaaacggaaatgacagcaagaagttcaaaggtgacagccgaagtgcaggcgtcccctctagagtgatccacatccggaagctccccatcgacgtcacggagggggaagtcatctccctggggctgccctttgggaaggtcaccaacctcctgatgctgaaggggaaaaaccaggccttcatcgagatgaacacggaggaggctgccaacaccatggtgaactactacacctcggtgacccctgtgctgcgcggccagcccatctacatccagttctccaaccacaaggagctgaagaccgacagctctcccaaccaggcgcgggcccaggcggccctgcaggcggtgaactcggtccagtcggggaacctggccttggctgcctcggcggcggccgtggacgcagggatggcgatggccgggcagagccccgtgctcaggatcatcgtggagaacctcttctaccctgtgaccctggatgtgctgcaccagattttctccaagttcggcacagtgttgaagatcatcaccttcaccaagaacaaccagttccaggccctgctgcagtatgcggaccccgtgagcgcccagcacgccaagctgtcgctggacgggcagaacatctacaacgcctgctgcacgctgcgcatcgacttttccaagctcaccagcctcaacgtcaagtacaacaatgacaagagccgtgactacacacgcccagacctgccttccggggacagccagccctcgctggaccagaccatggccgcggccttcggtgcacctggtataatctcagcctctccgtatgcaggagctggtttccctcccacctttgccattcctcaagctgcaggtattcaaacgcttggtcttggttccccagcgactgcatgcccacaccaccttcccaggcagctccgcatccacggcggcagcctgggcggactgggcactcgagtgccaggtcaggggcccttcccgggagaggggacgccacgtccacagagcaggcttggccagggcagtggtaggacagggctgtggaggcccacgtgtggacggcgccagccagaagccgctaatcgcacagtctttgtggtctggttcccttcaagcacctccgggcgagcgcgaggaccgccagtggttggagggatgtctctagtagttgaatttgagtggcctggtaagcgcgcggcccgaggctgagcagcatgaccggcggcgggacgtgtgtgcgtggccgtcctcccgcttcccttctgggaccggggcccggccgccccagtgctggccgtggacggagcagcgcgtgccgcccggcggccgcctcgtctgcatggaggcatgggcgcgcatgcgcggtggtcccgggacgggccctgcttgccgagggccccgtgtctgtgctggcggagccggagcttttctgtgctgtgggcggggcgcatgcagatgagcccaggcccggcccggcccgtgctgtgaggagaggcgggcgctggtgcaggagccggcgggtggctgtgcgggggtcgggcgaccccacaggcacccagggtagggccagagccagggccgcctcccgcgcggctcggctcctcggtgcatgaggacggggagcgtcggcctctcccactctgcggtggagtcgggggcgccgccgctcatctcacctcctgcttttccaggcctttccgttccgaacgtccacggcgccctggcccccctggccatcccctcggcggcggcggcagctgcggcggcaggtcggatcgccatcccgggcctggcgggggcaggaaattctgtattgctggtcagcaacctcaacccagaggtacgtgggcttttcctccgcgccgccgttcctcccggaagagcgagcaggggatgttgtgctcgggctcgggtcccggagcagcgccgcccctcgctgtgtctgcgcctctgccctggcagcccctctgctgcagcgctgagaccctccttttccaagatggcttgagttttcctcttttcctgaattcacatcttggttcgcgttttctcttgcatgatacgcagaatgaattattttttggttacccaaaggcaatctaaaaattacttggagctgagcagggcgcgcagttcagagccccagcaggccgccctgctggtcagcgggacacacagggttagcgcggcggggtgtgggcagcccctgtggctcgagagcctgtcacttaactggtggatccgttatttcccagaatggttaaattcccctcggggagagcttgggtgaaacaagaggcccaaaatatgtaactcttgatggatgggatcctcctggaatcagcatttcaggctgttctgtttcccggcaactcctgtgacttcctcaaggcggtgcccagcctggccctccctcgcgggggcccaggacgcactccctgcctgtgcctcttaccacgagccgggtgctgtccctccagctcctcctgagcgaggccgtgcactaacagactcgatctcccttcacgcctgtaatcgtccttagagactgacttgtgccacagctgcgggagacagcgctgctgcagggcttggctgaggtggccgcgagcggagctgcacgcgcgctcctggggggcgtggttgggatcggcttctgggagcccctccagcagcgctgtctctgccggcatgtgagtgaaggtgcttctcttaccgtgtgcccgtcgaggtaaacctgtaactggaatgtgtgtggagtgtgactgatagaacactacctgattcttatgtatttactgacctgtgtttttttgctactttttttcttttctccccttcccctttccctattttttttcttgccctgatccggaatttctttgccaactgactgcacggtacttctgcttcctgttgttgcttgaaacaaaacaaaaacataaacaaataaaaaacaaaaattccccctcaaaccctgctctccggaaaccaacctgcccttgaatattaacatcctgacaacttcatcatccatcaaccactgcacgcctgcggggactgtcttcctcgtgtggacgattggcaactcgccccccttgacctctccctctcccctgtccctccgctgccttgctctgctgtctctaaagagagtcacaccccaaagcctctttattcttttcggcgtctacggtgacgtgcagcgcgtgaagatcctgttcaataagaaggagaacgccctagtgcagatggcggacggcaaccaggcccagctggccatgagccacctgaacgggcacaagctgcacgggaagcccatccgcatcacgctctcgaagcaccagaacgtgcagctgccccgcgagggccaggaggaccagggcctgaccaaggactacggcaactcacccctgcaccgcttcaagaagccgggctccaagaacttccagaacatattcccgccctcggccacgctgcacctctccaacatcccgccctcagtctccgaggaggatctcaaggtcctgttttccagcaatgggggcgtcgtcaaaggattcaagttcttccagaaggaccgcaagatggcactgatccagatgggctccgtggaggaggcggtccaggccctcattgacctgcacaaccacgacctcggggccgaccacgacttggcttccttgtgccttaaaaaacctgccttcctgcagccacacacccacccggggtgtcctggggacccaaggggtgggggggtcacaccagagagaggcagggggcctggccggctcctgcaggatcatgcagctggggcgcggcggccgcggctgcgacaccccaaccccagccctctaatcaagtcacgtgattctcccttcaccccgcccccagggccttcccttctgcccccaggcgggctccccgctgctccagctgcggagctggtcgacataatctctgtattatatactttgcagttgcagacgtctgtgcctagcaatatttccagttgaccaaatattctaatcttttttcatttatatgcaaaagaaatagttttaagtaactttttatagcaagatgatacaatggtatgagtgtaatctaaacttccttgtggtattaccttgtatgctgttacttttattttattccttgtaattaagtcacaggcaggacccagtttccagagagcaggcggggccgcccagtgggtcaggcacagggagccccggtcctatcttagagcccctgagcttcagggaaggggcgggcgtgtcgccgcctctggcatcgcctccggttgccttacaccacgccttcacctgcagtcgcctagaaaacttgctctcaaacttcagggttttttcttccttcaaattttggaccaaagtctcatttctgtgttttgcctgcctctgatgctgggacccggaaggcgggcgctcctcctgtcttctctgtgctctttctaccgcccccgcgtcctgtcccgggggctctcctaggatcccctttccgtaaaagcgtgtaacaagggtgtaaatatttataattttttatacctgttgtgagacccgaggggcggcggcgcggttttttatggtgacacaaatgtatattttgctaacagcaattccaggctcagtattgtgaccgcggagccacaggggaccccacgcacattccgttgccttacccgatggcttgtgacgcggagagaaccgattaaaaccgtttgagaaactcctcccttgtctagccctgtgttcgctgtggacgctgtagaggcaggttggccagtctgtacctggacttcgaataaatcttctgtatcctcgc

SEQ ID NO: 279140 - DNA, 3440 bp, Homo sapiens
agcgacacgaaaaaaacttaggctaggtacgaggctgggtgttgccactccgtcccccgcgggtctgctctgtgtgccatggacggcattgtcccagatatagccgttggtacaaagcggggatctgacgagcttttctctacttgtgtcactaacggaccgtttatcatgagcagcaactcggcttctgcagcaaacggaaatgacagcaagaagttcaaaggtgacagccgaagtgcaggcgtcccctctagagtgatccacatccggaagctccccatcgacgtcacggagggggaagtcatctccctggggctgccctttgggaaggtcaccaacctcctgatgctgaaggggaaaaaccaggccttcatcgagatgaacacggaggaggctgccaacaccatggtgaactactacacctcggtgacccctgtgctgcgcggccagcccatctacatccagttctccaaccacaaggagctgaagaccgacagctctcccaaccaggcgcgggcccaggcggccctgcaggcggtgaactcggtccagtcggggaacctggccttggctgcctcggcggcggccgtggacgcagggatggcgatggccgggcagagccccgtgctcaggatcatcgtggagaacctcttctaccctgtgaccctggatgtgctgcaccagattttctccaagttcggcacagtgttgaagatcatcaccttcaccaagaacaaccagttccaggccctgctgcagtatgcggaccccgtgagcgcccagcacgccaagctgtcgctggacgggcagaacatctacaacgcctgctgcacgctgcgcatcgacttttccaagctcaccagcctcaacgtcaagtacaacaatgacaagagccgtgactacacacgcccagacctgccttccggggacagccagccctcgctggaccagaccatggccgcggccttcggtgcacctggtataatctcagcctctccgtatgcaggagctggtttccctcccacctttgccattcctcaagctgcaggtattcaaacgcttggtcttggttccccagcgactgcatgcccacaccaccttcccaggcagctccgcatccacggcggcagcctgggcggactgggcactcgagtgccaggtcaggggcccttcccgggagaggggacgccacgtccacagagcaggcttggccagggcagtggtaggacagggctgtggaggcccacgtgtggacggcgccagccagaagccgctaatcgcacagtctttgtggtctggttcccttcaagcacctccgggcgagcgcgaggaccgccagtggttggagggatgtctctagtagttgaatttgagtggcctggtaagcgcgcggcccgaggctgagcagcatgaccggcggcgggacgtgtgtgcgtggccgtcctcccgcttcccttctgggaccggggcccggccgccccagtgctggccgtggacggagcagcgcgtgccgcccggcggccgcctcgtctgcatggaggcatgggcgcgcatgcgcggtggtcccgggacgggccctgcttgccgagggccccgtgtctgtgctggcggagccggagcttttctgtgctgtgggcggggcgcatgcagatgagcccaggcccggcccggcccgtgctgtgaggagaggcgggcgctggtgcaggagccggcgggtggctgtgcgggggtcgggcgaccccacaggcacccagggtagggccagagccagggccgcctcccgcgcggctcggctcctcggtgcatgaggacggggagcgtcggcctctcccactctgcggtggagtcgggggcgccgccgctcatctcacctcctgcttttccaggcctttccgttccgaacgtccacggcgccctggcccccctggccatcccctcggcggcggcggcagctgcggcggcaggtcggatcgccatcccgggcctggcgggggcaggaaattctgtattgctggtcagcaacctcaacccagagagagtcacaccccaaagcctctttattcttttcggcgtctacggtgacgtgcagcgcgtgaagatcctgttcaataagaaggagaacgccctagtgcagatggcggacggcaaccaggcccagctggccatgagccacctgaacgggcacaagctgcacgggaagcccatccgcatcacgctctcggggcctgtgtcgggcgtggggcctgcaggtgggcgccccgaccacgacttggcttccttgtgccttaaaaaacctgccttcctgcagccacacacccacccggggtgtcctggggacccaaggggtgggggggtcacaccagagagaggcagggggcctggccggctcctgcaggatcatgcagctggggcgcggcggccgcggctgcgacaccccaaccccagccctctaatcaagtcacgtgattctcccttcaccccgcccccagggccttcccttctgcccccaggcgggctccccgctgctccagctgcggagctggtcgacataatctctgtattatatactttgcagttgcagacgtctgtgcctagcaatatttccagttgaccaaatattctaatcttttttcatttatatgcaaaagaaatagttttaagtaactttttatagcaagatgatacaatggtatgagtgtaatctaaacttccttgtggtattaccttgtatgctgttacttttattttattccttgtaattaagtcacaggcaggacccagtttccagagagcaggcggggccgcccagtgggtcaggcacagggagccccggtcctatcttagagcccctgagcttcagggaaggggcgggcgtgtcgccgcctctggcatcgcctccggttgccttacaccacgccttcacctgcagtcgcctagaaaacttgctctcaaacttcagggttttttcttccttcaaattttggaccaaagtctcatttctgtgttttgcctgcctctgatgctgggacccggaaggcgggcgctcctcctgtcttctctgtgctctttctaccgcccccgcgtcctgtcccgggggctctcctaggatcccctttccgtaaaagcgtgtaacaagggtgtaaatatttataattttttatacctgttgtgagacccgaggggcggcggcgcggttttttatggtgacacaaatgtatattttgctaacagcaattccaggctcagtattgtgaccgcggagccacaggggaccccacgcacattccgttgccttacccgatggcttgtgacgcggagagaaccgattaaaaccgtttgagaaactcctcccttgtctagccctgtgttcgctgtggacgctgtagaggcaggttggccagtctgtacctggacttcgaataaatcttctgtatcctcgc

SEQ ID NO: 279141 - DNA, 2284 bp, Homo sapiens
agcgacacgaaaaaaacttaggctaggtacgaggctgggtgttgccactccgtcccccgcgggtctgctctgtgtgccatggacggcattgtcccagatatagccgttggtacaaagcggggatctgacgagcttttctctacttgtgtcactaacggaccgtttatcatgagcagcaactcggcttctgcagcaaacggaaatgacagcaagaagttcaaaggtgacagccgaagtgcaggcgtcccctctagagtgatccacatccggaagctccccatcgacgtcacggagggggaagtcatctccctggggctgccctttgggaaggtcaccaacctcctgatgctgaaggggaaaaaccaggccttcatcgagatgaacacggaggaggctgccaacaccatggtgaactactacacctcggtgacccctgtgctgcgcggccagcccatctacatccagttctccaaccacaaggagctgaagaccgacagctctcccaaccaggcgcgggcccaggcggccctgcaggcggtgaactcggtccagtcggggaacctggccttggctgcctcggcggcggccgtggacgcagggatggcgatggccgggcagagccccgtgctcaggatcatcgtggagaacctcttctaccctgtgaccctggatgtgctgcaccagattttctccaagttcggcacagtgttgaagatcatcaccttcaccaagaacaaccagttccaggccctgctgcagtatgcggaccccgtgagcgcccagcacgccaagctgtcgctggacgggcagaacatctacaacgcctgctgcacgctgcgcatcgacttttccaagctcaccagcctcaacgtcaagtacaacaatgacaagagccgtgactacacacgcccagacctgccttccggggacagccagccctcgctggaccagaccatggccgcggccttcggtgcacctggtataatctcagcctctccgtatgcaggagctggtttccctcccacctttgccattcctcaagctgcaggcctttccgttccgaacgtccacggcgccctggcccccctggccatcccctcggcggcggcggcagctgcggcggcaggtcggatcgccatcccgggcctggcgggggcaggaaattctgtattgctggtcagcaacctcaacccagaggtcacaccagagagaggcagggggcctggccggctcctgcaggatcatgcagctggggcgcggcggccgcggctgcgacaccccaaccccagccctctaatcaagtcacgtgattctcccttcaccccgcccccagggccttcccttctgcccccaggcgggctccccgctgctccagctgcggagctggtcgacataatctctgtattatatactttgcagttgcagacgtctgtgcctagcaatatttccagttgaccaaatattctaatcttttttcatttatatgcaaaagaaatagttttaagtaactttttatagcaagatgatacaatggtatgagtgtaatctaaacttccttgtggtattaccttgtatgctgttacttttattttattccttgtaattaagtcacaggcaggacccagtttccagagagcaggcggggccgcccagtgggtcaggcacagggagccccggtcctatcttagagcccctgagcttcagggaaggggcgggcgtgtcgccgcctctggcatcgcctccggttgccttacaccacgccttcacctgcagtcgcctagaaaacttgctctcaaacttcagggttttttcttccttcaaattttggaccaaagtctcatttctgtgttttgcctgcctctgatgctgggacccggaaggcgggcgctcctcctgtcttctctgtgctctttctaccgcccccgcgtcctgtcccgggggctctcctaggatcccctttccgtaaaagcgtgtaacaagggtgtaaatatttataattttttatacctgttgtgagacccgaggggcggcggcgcggttttttatggtgacacaaatgtatattttgctaacagcaattccaggctcagtattgtgaccgcggagccacaggggaccccacgcacattccgttgccttacccgatggcttgtgacgcggagagaaccgattaaaaccgtttgagaaactcctcccttgtctagccctgtgttcgctgtggacgctgtagaggcaggttggccagtctgtacctggacttcgaataaatcttctgtatcctcgc

SEQ ID NO: 279142 - DNA, 2207 bp, Homo sapiens
agcgacacgaaaaaaacttaggctaggtacgaggctgggtgttgccactccgtcccccgcgggtctgctctgtgtgccatggacggcattgtcccagatatagccgttggtacaaagcggggatctgacgagcttttctctacttgtgtcactaacggaccgtttatcatgagcagcaactcggcttctgcagcaaacggaaatgacagcaagaagttcaaaggtgacagccgaagtgcaggcgtcccctctagagtgatccacatccggaagctccccatcgacgtcacggagggggaagtcatctccctggggctgccctttgggaaggtcaccaacctcctgatgctgaaggggaaaaaccaggccttcatcgagatgaacacggaggaggctgccaacaccatggtgaactactacacctcggtgacccctgtgctgcgcggccagcccatctacatccagttctccaaccacaaggagctgaagaccgacagctctcccaaccaggcgcgggcccaggcggccctgcaggcggtgaactcggtccagtcggggaacctggccttggctgcctcggcggcggccgtggacgcagggatggcgatggccgggcagagccccgtgctcaggatcatcgtggagaacctcttctaccctgtgaccctggatgtgctgcaccagattttctccaagttcggcacagtgttgaagatcatcaccttcaccaagaacaaccagttccaggccctgctgcagtatgcggaccccgtgagcgcccagcacgccaagctgtcgctggacgggcagaacatctacaacgcctgctgcacgctgcgcatcgacttttccaagctcaccagcctcaacgtcaagtacaacaatgacaagagccgtgactacacacgcccagacctgccttccggggacagccagccctcgctggaccagaccatggccgcggccttcggtgcacctggtataatctcagcctctccgtatgcaggagctggtttccctcccacctttgccattcctcaagctgcaggcctttccgttccgaacgtccacggcgccctggcccccctggccatcccctcggcggcggcggcagctgcggcggcaggtcggatcgccatcccgggcctggcgggggcaggaaattctgtattgctggtcagcaacctcaacccagagagagtcacaccccaaagcctctttattcttttcggcgtctacggtgacgtgcagcgcgtgaagatcctgttcaataagaaggagaacgccctagtgcagatggcggacggcaaccaggcccagctggccatgagccacctgaacgggcacaagctgcacgggaagcccatccgcatcacgctctcgaagcaccagaacgtgcagctgccccgcgagggccaggaggaccagggcctgaccaaggactacggcaactcacccctgcaccgcttcaagaagccgggctccaagaacttccagaacatattcccgccctcggccacgctgcacctctccaacatcccgccctcagtctccgaggaggatctcaaggtcctgttttccagcaatgggggcgtcgtcaaaggattcaagttcttccagaaggaccgcaagatggcactgatccagatgggctccgtggaggaggcggtccaggccctcattgacctgcacaaccacgacctcggggagaaccaccacctgcgggtctccttctccaagtccaccatctaggggcacaggcccccacggccgggccccctggcgacaacttccatcattccagagaaaagccactttaaaaacagctgaagtgaccttagcagaccagagatcctccgtcaacgacaaatccagttacggttccaagaacttcaagctagcgtaccacgtggctcgcccccgtggcgcggcacagggacacgggcaagggccaaggggaacgaggccagtggagagcactcgggacactcaaccagggggcaacacccggggcccacacgagacgaggaagagcacgaaagtacacaaaatgatcacccaacaacaaacggaacgcagtcgacacgacactcgaaaacacccgcggtcgatcagaccaggagatcacacagcaggcgatcctacacaagagcgacgacaccaagaagcaccagcagcagtagatcggtgcggatcggaacgaacat

SEQ ID NO: 279143 - DNA, 3850 bp, Homo sapiens
agcgacacgaaaaaaacttaggctaggtacgaggctgggtgttgccactccgtcccccgcgggtctgctctgtgtgccatggacggcattgtcccagatatagccgttggtacaaagcggggatctgacgagcttttctctacttgtgtcactaacggaccgtttatcatgagcagcaactcggcttctgcagcaaacggaaatgacagcaagaagttcaaaggtgacagccgaagtgcaggcgtcccctctagagtgatccacatccggaagctccccatcgacgtcacggagggggaagtcatctccctggggctgccctttgggaaggtcaccaacctcctgatgctgaaggggaaaaaccaggccttcatcgagatgaacacggaggaggctgccaacaccatggtgaactactacacctcggtgacccctgtgctgcgcggccagcccatctacatccagttctccaaccacaaggagctgaagaccgacagctctcccaaccaggcgcgggcccaggcggccctgcaggcggtgaactcggtccagtcggggaacctggccttggctgcctcggcggcggccgtggacgcagggatggcgatggccgggcagagccccgtgctcaggatcatcgtggagaacctcttctaccctgtgaccctggatgtgctgcaccagattttctccaagttcggcacagtgttgaagatcatcaccttcaccaagaacaaccagttccaggccctgctgcagtatgcggaccccgtgagcgcccagcacgccaagctgtcgctggacgggcagaacatctacaacgcctgctgcacgctgcgcatcgacttttccaagctcaccagcctcaacgtcaagtacaacaatgacaagagccgtgactacacacgcccagacctgccttccggggacagccagccctcgctggaccagaccatggccgcggccttcggtgcacctggtataatctcagcctctccgtatgcaggagctggtttccctcccacctttgccattcctcaagctgcaggtattcaaacgcttggtcttggttccccagcgactgcatgcccacaccaccttcccaggcagctccgcatccacggcggcagcctgggcggactgggcactcgagtgccaggtcaggggcccttcccgggagaggggacgccacgtccacagagcaggcttggccagggcagtggtaggacagggctgtggaggcccacgtgtggacggcgccagccagaagccgctaatcgcacagtctttgtggtctggttcccttcaagcacctccgggcgagcgcgaggaccgccagtggttggagggatgtctctagtagttgaatttgagtggcctggtaagcgcgcggcccgaggctgagcagcatgaccggcggcgggacgtgtgtgcgtggccgtcctcccgcttcccttctgggaccggggcccggccgccccagtgctggccgtggacggagcagcgcgtgccgcccggcggccgcctcgtctgcatggaggcatgggcgcgcatgcgcggtggtcccgggacgggccctgcttgccgagggccccgtgtctgtgctggcggagccggagcttttctgtgctgtgggcggggcgcatgcagatgagcccaggcccggcccggcccgtgctgtgaggagaggcgggcgctggtgcaggagccggcgggtggctgtgcgggggtcgggcgaccccacaggcacccagggtagggccagagccagggccgcctcccgcgcggctcggctcctcggtgcatgaggacggggagcgtcggcctctcccactctgcggtggagtcgggggcgccgccgctcatctcacctcctgcttttccaggcctttccgttccgaacgtccacggcgccctggcccccctggccatcccctcggcggcggcggcagctgcggcggcaggtcggatcgccatcccgggcctggcgggggcaggaaattctgtattgctggtcagcaacctcaacccagaggtacgtgggcttttcctccgcgccgccgttcctcccggaagagcgagcaggggatgttgtgctcgggctcgggtcccggagcagcgccgcccctcgctgtgtctgcgcctctgccctggcagcccctctgctgcagcgctgagaccctccttttccaagatggcttgagttttcctcttttcctgaattcacatcttggttcgcgttttctcttgcatgatacgcagaatgaattattttttggttacccaaaggcaatctaaaaattacttggagctgagcagggcgcgcagttcagagccccagcaggccgccctgctggtcagcgggacacacagggttagcgcggcggggtgtgggcagcccctgtggctcgagagcctgtcacttaactggtggatccgttatttcccagaatggttaaattcccctcggggagagcttgggtgaaacaagaggcccaaaatatgtaactcttgatggatgggatcctcctggaatcagcatttcaggctgttctgtttcccggcaactcctgtgacttcctcaaggcggtgcccagcctggccctccctcgcgggggcccaggacgcactccctgcctgtgcctcttaccacgagccgggtgctgtccctccagctcctcctgagcgaggccgtgcactaacagactcgatctcccttcacgcctgtaatcgtccttagagactgacttgtgccacagctgcgggagacagcgctgctgcagggcttggctgaggtggccgcgagcggagctgcacgcgcgctcctggggggcgtggttgggatcggcttctgggagcccctccagcagcgctgtctctgccggcatgtgagtgaaggtgcttctcttaccgtgtgcccgtcgaggtaaacctgtaactggaatgtgtgtggagtgtgactgatagaacactacctgattcttatgtatttactgacctgtgtttttttgctactttttttcttttctccccttcccctttccctattttttttcttgccctgatccggaatttctttgccaactgactgcacggtacttctgcttcctgttgttgcttgaaacaaaacaaaaacataaacaaataaaaaacaaaaattccccctcaaaccctgctctccggaaaccaacctgcccttgaatattaacatcctgacaacttcatcatccatcaaccactgcacgcctgcggggactgtcttcctcgtgtggacgattggcaactcgccccccttgacctctccctctcccctgtccctccgctgccttgctctgctgtctctaaagagagtcacaccccaaagcctctttattcttttcggcgtctacggtgacgtgcagcgcgtgaagatcctgttcaataagaaggagaacgccctagtgcagatggcggacggcaaccaggcccagctggccatgagccacctgaacgggcacaagctgcacgggaagcccatccgcatcacgctctcgaagcaccagaacgtgcagctgccccgcgagggccaggaggaccagggcctgaccaaggactacggcaactcacccctgcaccgcttcaagaagccgggctccaagaacttccagaacatattcccgccctcggccacgctgcacctctccaacatcccgccctcagtctccgaggaggatctcaaggtcctgttttccagcaatgggggcgtcgtcaaaggattcaagttcttccagaaggaccgcaagatggcactgatccagatgggctccgtggaggaggcggtccaggccctctacctgcccgccaccccata

SEQ ID NO: 279144 - DNA, 2340 bp, Homo sapiens
agcgacacgaaaaaaacttaggctaggtacgaggctgggtgttgccactccgtcccccgcgggtctgctctgtgtgccatggacggcattgtcccagatatagccgttggtacaaagcggggatctgacgagcttttctctacttgtgtcactaacggaccgtttatcatgagcagcaactcggcttctgcagcaaacggaaatgacagcaagaagttcaaaggtgacagccgaagtgcaggcgtcccctctagagtgatccacatccggaagctccccatcgacgtcacggagggggaagtcatctccctggggctgccctttgggaaggtcaccaacctcctgatgctgaaggggaaaaaccaggccttcatcgagatgaacacggaggaggctgccaacaccatggtgaactactacacctcggtgacccctgtgctgcgcggccagcccatctacatccagttctccaaccacaaggagctgaagaccgacagctctcccaaccaggcgcgggcccaggcggccctgcaggcggtgaactcggtccagtcggggaacctggccttggctgcctcggcggcggccgtggacgcagggatggcgatggccgggcagagccccgtgctcaggatcatcgtggagaacctcttctaccctgtgaccctggatgtgctgcaccagattttctccaagttcggcacagtgttgaagatcatcaccttcaccaagaacaaccagttccaggccctgctgcagtatgcggaccccgtgagcgcccagcacgccaagctgtcgctggacgggcagaacatctacaacgcctgctgcacgctgcgcatcgacttttccaagctcaccagcctcaacgtcaagtacaacaatgacaagagccgtgactacacacgcccagacctgccttccggggacagccagccctcgctggaccagaccatggccgcggccttcggtgcacctggtataatctcagcctctccgtatgcaggagctggtttccctcccacctttgccattcctcaagctgcaggtattcaaacgcttggtcttggttccccagcgactgcatgcccacaccaccttcccaggcagctccgcatccacggcggcagcctgggcggactgggcactcgagtgccaggtcaggggcccttcccgggagaggggacgccacgtccacagagcaggcttggccagggcagtggtaggacagggctgtggaggcccacgtgtggacggcgccagccagaagccgctaatcgcacagtctttgtggtctggttcccttcaagcacctccgggcgagcgcgaggaccgccagtggttggagggatgtctctagtagttgaatttgagtggcctggtaagcgcgcggcccgaggctgagcagcatgaccggcggcgggacgtgtgtgcgtggccgtcctcccgcttcccttctgggaccggggcccggccgccccagtgctggccgtggacggagcagcgcgtgccgcccggcggccgcctcgtctgcatggaggcatgggcgcgcatgcgcggtggtcccgggacgggccctgcttgccgagggccccgtgtctgtgctggcggagccggagcttttctgtgctgtgggcggggcgcatgcagatgagcccaggcccggcccggcccgtgctgtgaggagaggcgggcgctggtgcaggagccggcgggtggctgtgcgggggtcgggcgaccccacaggcacccagggtagggccagagccagggccgcctcccgcgcggctcggctcctcggtgcatgaggacggggagcgtcggcctctcccactctgcggtggagtcgggggcgccgccgctcatctcacctcctgcttttccaggcctttccgttccgaacgtccacggcgccctggcccccctggccatcccctcggcggcggcggcagctgcggcggcaggtcggatcgccatcccgggcctggcgggggcaggaaattctgtattgctggtcagcaacctcaacccagagagagtcacaccccaaagcctctttattcttttcggcgtctacggtgacgtgcagcgcgtgaagatcctgttcaataagaaggagaacgccctagtgcagatggcggacggcaaccaggcccagctggccatgagccacctgaacgggcacaagctgcacgggaagcccatccgcatcacgctctcgaagcaccagaacgtgcagctgccccgcgagggccaggaggaccagggcctgaccaaggactacggcaactcacctctctcgctcaagaaccggcgcagtctgtgatagatctctagagt

SEQ ID NO: 279145 - DNA, 560 bp, Homo sapiens
  misc_feature (560)..(560): n is a, c, g, or t
agcgacacgaaaaaaacttaggctaggtacgaggctgggtgttgccactccgtcccccgcgggtctgctctgtgtgccatggacggcattgtcccagatatagccgttggtacaaagcggggatctgacgagcttttctctacttgtgtcactaacggaccgtttatcatgagcagcaactcggcttctgcagcaaacggaaatgacagcaagaagttcaaaggtgacagccgaagtgcaggcgtcccctctagagtgatccacatccggaagctccccatcgacgtcacggagggggaagtcatctccctggggctgccctttgggaaggtcaccaacctcctgatgctgaaggggaaaaaccaggccttcatcgagatgaacacggaggaggctgccaacaccatggtgaactactacacctcggtgacccctgtgctgcgcggccagcccatctacatccagttctccaaccacaaggagctgaagaccgacagctctcccaaccggcctttgacgggtacctgacgctcgcacattctgtacatcactggggtcan

SEQ ID NO: 279146 - DNA, 730 bp, Homo sapiens
gcagggcaaaggaggaaagccagagaaaaggcctcaagtctaggaagaggaagtcaatgctctggaagccagactctggctctctatgcctcaaaggaacaagctcagagctgtgctgggatctaggaaagcctggtcccaggctgaaggggaagcggcgggtcacagtgggtgaggccacactgttctggtcctgatgtcgcgatgcaaacacttcattctgcaagggctcaaagggagacaggtggaggttgttaccagggctggaaagcacctcattcccagagcaaggcagacattaacccctctgctgggcctgctgacctgagatgactccagcaagcttccctggaaattcagcctaagcagctcacctcgtgcatgctgggactgcggcctccctgtaagtgctcaggtctgtaataccacaggaggctcatcatcagctctcctggaaggacaacacagtggttatggcttgaactggcaacctgagttacttagacaggcagagaggctggctggctgccctggaggttcatccaacctcaatcctgcaggctccggcaacccatgtcccctgccccaggccaagcattcagaggcctggaatgctgttaggcatggagggagaagggggagaaggcactgacaggtgaggtggggggacaggtgcccaggctctgctggctggaaaggttaatgagctgatccaacccaagccacaagg

SEQ ID NO: 279147 - DNA, 450 bp, Homo sapiens
tcttgctgctcagctgaatacaaggcctcagtggtttgctgggctttggtgagatcttaaaggcaaacctctcttggcgcaaggaaggagccatgcagttgtatctgtactcgatgtccacagccatcatggggctagatgaacaggctagaaccgtggaaagggaagagaagaaagaaaacagtggagcaatcagatcagacagatgtgtaaaggcatcattccagcagggactggcaaacaatatttccttttatctatgcccacctggctacaggtccacgtatgctcagattctcttctgcctctgccgccctgagacagcaagaccaaccccttctcctcctcttcctcctcctcagcctactcaacgtgaagaggatgagaatgaagacctttatgatgacccgcatccacttaatgaatagtaaatatattttctctttccta

SEQ ID NO: 279148 - DNA, 2686 bp, Homo sapiens
cggaattggacttgggaggcgcggtgaggagtcaggcttaaaacttgttggaggggagtaaccagcctgctcctctcgctctcctcctcgtctgcgccgcgtttcagagagaaaattcctgttccaagagaaaataaggcaacatcaatgaaggagagaagagccagccagaaattatccagcaaatctatcatggatcctaatcagaacgtgaaatgcaagatagttgtggtgggagacagtcagtgtggaaaaactgcgctgctccatgtcttcgccaaggactgcttccccgagaattacgttcctacagtgtttgagaattacacggccagttttgaaatcgacacacaaagaatagagttgagcctgtgggacacttcgggttctccttactatgacaatgtccgccccctctcttaccctgattcggatgctgtgctgatttgctttgacatcagtagaccagagaccctggacagtgtcctcaaaaagtggaaaggtgaaatccaggaattttgtccaaataccaaaatgctcttggtcggctgcaagtctgatctgcggacagatgttagtacattagtagagctctccaatcacaggcagacgccagtgtcctatgaccagggggcaaatatggccaaacagattggagcagctacttatatcgaatgctcagctttacagtcggaaaatagcgtcagagacatttttcacgttgccaccttggcatgtgtaaataagacaaataaaaacgttaagcggaacaaatcacagagagccacaaagcggatttcacacatgcctagcagaccagaactctcggcagttgctacggacttacgaaaggacaaagcgaagagctgcactgtgatgtgaatctttcattatctttaatgaagacaaaggaatctagtgtaaaaaacaacagcaaacaaaaaggtgaagtctaaatgaagtgcacagccaaagtcatgtataccagaggcttaggaggcgtttgagaggatactcatctttttggaatcctgaccttaggttcggcatgtagaccaagtgatgagaagtgaatacatggaagagtttttaagtgtgacttgaaaaatatgccaaaaaatgagagatacaaatgagctagaggaagatgaggggggatgcgagtacctccaagaagaaaaatcacactctgaatggtgcttgcatttttgggtttttttttttttttgttataatctattcatggatctccactttgatttaatttttaaatgttttaatctcctttacaaaaagtatacgttaatataccgtcctcaagggggaactggcactgtgaccttagcatttagttttctagaggatgtgatctaatttctttctagctcatcattaaaaaggaaattgtatcaggacccatgggatatatccagaggcaaactttatgaggctttgaaatcttgccttcctgaagatagctgagtaggatggttctaaggaaagcctttgcaatcttgcaagatttgtagaccagcactacaaagatcgcatagatcaaataggaaaaaaaatgtcgatttttattcagtctgatggttctgttcttcattgtgattgtcattaaaaagtggtaaattgctcaatgtaatatttttgtgcgctgtttagaagttgtgtgattttttgccatcgttgataaaaatgcaaagtcaaataaaaggtgtcttggtttgatgtcatagaatgatccaaggagagaaaaaaggtagttactgttttcaccagaaaaggtaatgagtgaaggaaagaatagtagcagaaagcacagtttgtgagtaaagctgtctggaattaagttaccaaaaatacaaagcaaaaggactattattttgggttgaagctccaaaactgacagcatctgataatctgttggtttatttcacttttcattaaatgaacattgatgagagaagatgccacttacccaagctttagagaatccctagtggaagattatatgataaactttcagtcctgacataacactagggcatttctagagtgtcattgctaaaacctcactgaacagacgcagccaaggtctgtgttcagcacttggtctctgttgttacgtaaaataataagcatttaaaatagtttacagatatttttgaccagttccttttagagattctttcagagaagaaaccagatctgacctgtttattgttggcgcttgttgaaaacgagctttctttcccatgatagtgcttcgtttttgaagtgttgaagctgtgctccccttaaatcgtggcaggagagattaaggtaattacaacactcagttctatgtcttacaagcactttgtcttgtctctgcaagaaaattcgattccagtcatttcccataaaatacagacattttaccaacataatatgctttgattgatgcagcattatgctttgggcagtattacaaaatagctggcgagtgctttctgtatttaaatattgtaaaaagaaaataagttataactgttataaagcagaacttttgttgcattttttaaactgttgaagtcactgtgtatgtttgtttggtcaatgtttccgcagtatttattaaaacatacttttttttttcttcaaataaaaaagtaaccatgtctttgtctaaatgtgatct

SEQ ID NO: 279149 - DNA, 2969 bp, Homo sapiens
cttgttcttaaagaggacagttggaattccaagccaggcattgctgaaggttctaataattattgttagatcatgaaacaactagacaaattggaatagattgaaatagttttaaactaacttgaaggcatatgagctacaggaccagctgccttcccgatgacccaagagatgttcctttgcaaatgtcatggtctgtgttgatgcaaccatgtgaacagaaactccttcaaggcaggatgttctgttttattaactatctcaggtacttaaaatagagcctcagctcgtggtggcatgcttcagtgtttcatgatgggatcagggaatgcatacttgtgctagtgttgcctctgccttatccccagccttctagtgaaggaggatcagatccacacatcgaaggatgtggtcacttgttaggatatataattattcttaagacacatttatctttaagagacacaccaataattaagacattattgaagctacctttggacaacatctaccaagtctctttcagtagcaacagatgagtcacagagagggagaatcaatcataatatacataattattctctaatgcttaaaaagtagtaaaacttcacatctgttcaggagataaatgcaaagtttgcttcttcatctcaagggacactccatttttaacatcttttctgagtttcattctaatgtcagccagtggagaaatggttttcatgatatggataccgttactttgttcatttttaatctttttttttttctttcatagtggaaaggtgaaatccaggaattttgtccaaataccaaaatgctcttggtcggctgcaagtctgatctgcggacagatgttagtacattagtagagctctccaatcacaggcagacgccagtgtcctatgaccagggggcaaatatggccaaacagattggagcagctacttatatcgaatgctcagctttacagtcggaaaatagcgtcagagacatttttcacgttgccaccttggcatgtgtaaataagacaaataaaaacgttaagcggaacaaatcacagagagccacaaagcggatttcacacatgcctagcagaccagaactctcggcagttgctacggacttacgaaaggacaaagcgaagagctgcactgtgatgtgaatctttcattatctttaatgaagacaaaggaatctagtgtaaaaaacaacagcaaacaaaaaggtgaagtctaaatgaagtgcacagccaaagtcatgtataccagaggcttaggaggcgtttgagaggatactcatctttttggaatcctgaccttaggttcggcatgtagaccaagtgatgagaagtgaatacatggaagagtttttaagtgtgacttgaaaaatatgccaaaaaatgagagatacaaatgagctagaggaagatgaggggggatgcgagtacctccaagaagaaaaatcacactctgaatggtgcttgcatttttgggtttttttttttttttgttataatctattcatggatctccactttgatttaatttttaaatgttttaatctcctttacaaaaagtatacgttaatataccgtcctcaagggggaactggcactgtgaccttagcatttagttttctagaggatgtgatctaatttctttctagctcatcattaaaaaggaaattgtatcaggacccatgggatatatccagaggcaaactttatgaggctttgaaatcttgccttcctgaagatagctgagtaggatggttctaaggaaagcctttgcaatcttgcaagatttgtagaccagcactacaaagatcgcatagatcaaataggaaaaaaaatgtcgatttttattcagtctgatggttctgttcttcattgtgattgtcattaaaaagtggtaaattgctcaatgtaatatttttgtgcgctgtttagaagttgtgtgattttttgccatcgttgataaaaatgcaaagtcaaataaaaggtgtcttggtttgatgtcatagaatgatccaaggagagaaaaaaggtagttactgttttcaccagaaaaggtaatgagtgaaggaaagaatagtagcagaaagcacagtttgtgagtaaagctgtctggaattaagttaccaaaaatacaaagcaaaaggactattattttgggttgaagctccaaaactgacagcatctgataatctgttggtttatttcacttttcattaaatgaacattgatgagagaagatgccacttacccaagctttagagaatccctagtggaagattatatgataaactttcagtcctgacataacactagggcatttctagagtgtcattgctaaaacctcactgaacagacgcagccaaggtctgtgttcagcacttggtctctgttgttacgtaaaataataagcatttaaaatagtttacagatatttttgaccagttccttttagagattctttcagagaagaaaccagatctgacctgtttattgttggcgcttgttgaaaacgagctttctttcccatgatagtgcttcgtttttgaagtgttgaagctgtgctccccttaaatcgtggcaggagagattaaggtaattacaacactcagttctatgtcttacaagcactttgtcttgtctctgcaagaaaattcgattccagtcatttcccataaaatacagacattttaccaacataatatgctttgattgatgcagcattatgctttgggcagtattacaaaatagctggcgagtgctttctgtatttaaatattgtaaaaagaaaataagttataactgttataaagcagaacttttgttgcattttttaaactgttgaagtcactgtgtatgtttgtttggtcaatgtttccgcagtatttattaaaacatacttttttttttcttcaaataaaaaagtaaccatgtctttgtctaaatgtgatct

SEQ ID NO: 279150 - DNA, 280 bp, Homo sapiens
gaaaattcctgttccaagagaaaataaggcaacatcaatgaaggagagaagagccagccagaaattatccagcaaatctatcatggatcctaatcagaacgtgaaatgcaagatagttgtggtgggagacagtcagtgtggaaaaactgcgctgctccatgtcttcgccaaggactgcttccccgaggtgagtgtggccggccgcggcttccacgagggggtcggccagtgggatcccagtcccgaggtgggcctccccgctttcatccgttttccctta

SEQ ID NO: 279151 - DNA, 2780 bp, Homo sapiens
cggaattggacttgggaggcgcggtgaggagtcaggcttaaaacttgttggaggggagtaaccagcctgctcctctcgctctcctcctcgtctgcgccgcgtttcagaggttgcccatcagccttgtgatttatttttatatctgctttttataaagagagaaatatatatatatatatatatattttttttttcttcttaagagaaaattcctgttccaagagaaaataaggcaacatcaatgaaggagagaagagccagccagaaattatccagcaaatctatcatggatcctaatcagaacgtgaaatgcaagatagttgtggtgggagacagtcagtgtggaaaaactgcgctgctccatgtcttcgccaaggactgcttccccgagaattacgttcctacagtgtttgagaattacacggccagttttgaaatcgacacacaaagaatagagttgagcctgtgggacacttcgggttctccttactatgacaatgtccgccccctctcttaccctgattcggatgctgtgctgatttgctttgacatcagtagaccagagaccctggacagtgtcctcaaaaagtggaaaggtgaaatccaggaattttgtccaaataccaaaatgctcttggtcggctgcaagtctgatctgcggacagatgttagtacattagtagagctctccaatcacaggcagacgccagtgtcctatgaccagggggcaaatatggccaaacagattggagcagctacttatatcgaatgctcagctttacagtcggaaaatagcgtcagagacatttttcacgttgccaccttggcatgtgtaaataagacaaataaaaacgttaagcggaacaaatcacagagagccacaaagcggatttcacacatgcctagcagaccagaactctcggcagttgctacggacttacgaaaggacaaagcgaagagctgcactgtgatgtgaatctttcattatctttaatgaagacaaaggaatctagtgtaaaaaacaacagcaaacaaaaaggtgaagtctaaatgaagtgcacagccaaagtcatgtataccagaggcttaggaggcgtttgagaggatactcatctttttggaatcctgaccttaggttcggcatgtagaccaagtgatgagaagtgaatacatggaagagtttttaagtgtgacttgaaaaatatgccaaaaaatgagagatacaaatgagctagaggaagatgaggggggatgcgagtacctccaagaagaaaaatcacactctgaatggtgcttgcatttttgggtttttttttttttttgttataatctattcatggatctccactttgatttaatttttaaatgttttaatctcctttacaaaaagtatacgttaatataccgtcctcaagggggaactggcactgtgaccttagcatttagttttctagaggatgtgatctaatttctttctagctcatcattaaaaaggaaattgtatcaggacccatgggatatatccagaggcaaactttatgaggctttgaaatcttgccttcctgaagatagctgagtaggatggttctaaggaaagcctttgcaatcttgcaagatttgtagaccagcactacaaagatcgcatagatcaaataggaaaaaaaatgtcgatttttattcagtctgatggttctgttcttcattgtgattgtcattaaaaagtggtaaattgctcaatgtaatatttttgtgcgctgtttagaagttgtgtgattttttgccatcgttgataaaaatgcaaagtcaaataaaaggtgtcttggtttgatgtcatagaatgatccaaggagagaaaaaaggtagttactgttttcaccagaaaaggtaatgagtgaaggaaagaatagtagcagaaagcacagtttgtgagtaaagctgtctggaattaagttaccaaaaatacaaagcaaaaggactattattttgggttgaagctccaaaactgacagcatctgataatctgttggtttatttcacttttcattaaatgaacattgatgagagaagatgccacttacccaagctttagagaatccctagtggaagattatatgataaactttcagtcctgacataacactagggcatttctagagtgtcattgctaaaacctcactgaacagacgcagccaaggtctgtgttcagcacttggtctctgttgttacgtaaaataataagcatttaaaatagtttacagatatttttgaccagttccttttagagattctttcagagaagaaaccagatctgacctgtttattgttggcgcttgttgaaaacgagctttctttcccatgatagtgcttcgtttttgaagtgttgaagctgtgctccccttaaatcgtggcaggagagattaaggtaattacaacactcagttctatgtcttacaagcactttgtcttgtctctgcaagaaaattcgattccagtcatttcccataaaatacagacattttaccaacataatatgctttgattgatgcagcattatgctttgggcagtattacaaaatagctggcgagtgctttctgtatttaaatattgtaaaaagaaaataagttataactgttataaagcagaacttttgttgcattttttaaactgttgaagtcactgtgtatgtttgtttggtcaatgtttccgcagtatttattaaaacatacttttttttttcttcaaataaaaaagtaaccatgtctttgtctaaatgtgatct

SEQ ID NO: 279152 - DNA, 1189 bp, Homo sapiens
tctttgacatttcacattttatttttagtaccatatcctttgtcagtgctcatcagaatgcacattaaaatgggtttattttatgcatattactgtaccacaataaatttattacaaatcacatgacctttatgttagacattttaatacatcaataggaggtcacgtttcattcagaaaatagcagtttttccctcaaacaccttcaggtttactgtgggttcacatagcctaggttaagcagttggcaacattttgcttcactgtctggttttacaaagctttcttgtgacaacaggtataaaagagtctaccgagttcaccaagacatctgcttcaaagagagctgtgaaagcacaagcctcaagaagaccccaaacaggtgcctctggggagcaggcccatgccgtgtcctgcatgtagcccacagggtgatggggcaagggcggggtgctatgggatgctgcaggcctgtgggctgagccaggcggtctactcgcccagataggcagccctgggcagccacgttctgctacgaaactgtatgtccatatatgtgcatgtgagcatacccagaggggcacagccgggcatgctgggtgctggggggggtcactctggttatgcatattcacacagaacatggtgctacaattgggaagcacagggtgttacggacagccccgagtatttaatggccgatatagcgcgtcgctctttactttttattcactcacacccaggttctttccacaaagggttcaaggtagttacaagaattactactgtttggcgtttgctgaaagaagtacgtgagaatattatatgctttagaaaccacagagtcgaagcctgtcatcgtcctcatagaccaatgagtagccacacgtacttgtttggcattaccaagtgtccgggcaaggccgcagcctgcagctcaccagccgtgctgctcggcctgtgcacgtcaccggctcttccctagggtagcttttgcttgctttctcccacgtccatcctctctctctctgactcacagccagccaggtttctagccttgtcattcctaaactactgcctcaagccaggcgggcgcacacaaactaaaatgctaatctccacagcggtgtctggactaatggtgtcccccaccgtggaatgtatgtgagctaaagacaggatctcagca

SEQ ID NO: 279153 - DNA, 989 bp, Homo sapiens
tgaagcactgggtgaagcactgggtgaagcactgggttaagcagttggcaacattttgcttcactgtctggttttacaaagctttcttgtgacaacaggtataaaagagtctaccgagttcaccaagacatctgcttcaaagagagctgtgaaagcacaagcctcaagaagaccccaaacaggtgcctctggggagcaggcccatgccgtgtcctgcatgtagcccacagggtgatggggcaagggcggggtgctatgggatgctgcaggcctgtgggctgagccaggcggtctactcgcccagataggcagccctgggcagccacgttctgctacgaaactgtatgtccatatatgtgcatgtgagcatacccagaggggcacagccgggcatgctgggtgctggggggggtcactctggttatgcatattcacacagaacatggtgctacaattgggaagcacagggtgttacggacagccccgagtatttaatggccgatatagcgcgtcgctctttactttttattcactcacacccaggttctttccacaaagggttcaaggtagttacaagaattactactgtttggcgtttgctgaaagaagtacgtgagaatattatatgctttagaaaccacagagtcgaagcctgtcatcgtcctcatagaccaatgagtagccacacgtacttgtttggcattaccaagtgtccgggcaaggccgcagcctgcagctcaccagccgtgctgctcggcctgtgcacgtcaccggctcttccctagggtagcttttgcttgctttctcccacgtccatcctctctctctctgactcacagccagccaggtttctagccttgtcattcctaaactactgcctcaagccaggcgggcgcacacaaactaaaatgctaatctccacagcggtgtctggactaatggtgtcccccaccgtggaatgtatgtgagctaaagacaggatctcagca

SEQ ID NO: 279154 - DNA, 877 bp, Homo sapiens
tctttgacatttcacattttatttttagtaccatatcctttgtcagtgctcatcagaatgcacattaaaatgggtttattttatgcatattactgtaccacaataaatttattacaaatcacatgacctttatgttagacattttaatacatcaataggaggtcacgtttcattcagaaaatagcagtttttccctcaaacaccttcaggtttactgtgggttcacatagcctaggttaagcagttggcaacattttgcttcactgtctggttttacaaagctttcttgtgacaacaggtataaaagagtctaccgagttcaccaagacatctgcttcaaagagagctgtgaaagcacaagcctcaagaagaccccaaacaggaaacaaagtaagagtcagacactggagaaatcttaaggatttaagacgttcttgttacactccaccaacctcacgagtttctaacacccaggaagatgaggtctaaaaactggatgaaaaaggacaccctgagaaaaggtcctagctggagtcagtcccctctgtgacctctctcctcaggcctctagaggacagatggccaggcctgtgcacacaccagcccaccctgagagacccctctgggaccaaccacctgtgagtcctgcgatgcgtttaagcagcctgtgccctcacccaagctgcagttcctgaaggtgtagtctgtgtctctgcggatgagatgacagctcgccattccccggaatcagtgaggctgtcagtcagccacgcttctgcagtatgcagaaacctgttcttagactccaaagccagagaaagaattctcccttcgaggcccaacaaattgagaaggaactgtgatgggaccacttcca

SEQ ID NO: 279155 - DNA, 670 bp, Homo sapiens
tggctaatgcctgctcatttctcatagcgcagcccatttactgccttctccaggaagcttttctgaatcctccagtgagtaagggagagcccactgctaaaaaaggcctagtcaaatcctcaggtgtacatggacatcaagattgggaacaagccggctggctgcatccaaaccctcctgcgttccgacgtcgtgcccatgaccacagagaattttctctacatgtgcacccatttaaaggactcggcttcaagggaagcagcttccaccgcattatcccccagttcatttgccagggcagtgatttcacaaaccacggtggcaccaggggtctgcgcaggcatggcactaagtgtcccatggcacatttggccctcatggaggcctcaaaagggcaggaccagcaccctcttctacggaggaaggaacgggcacagcagaaacaaggagagtcagcaattaccagccagccaaggtcctggaagctgacgtagagctcgtgccgacggcagacctgccggccgtgggagccgcggacgtcatctgcagggacagaaggggcaaggtcttttctggggttcctgctgtgtgcagctactatggggtaccagggtgggggatgccctgatgagcacatttgtcaaataaatgaatgacaggaaaccaaaag

SEQ ID NO: 279156 - DNA, 847 bp, Homo sapiens
tgaccagggactgcaggatggcgtggttggtggcgttcatgcaggagtccagcgggaaggagcactccccctcacagtaataggctgagtagccttggggggcgatgacccagtcctggggggcaagggagaaggtgagtcccatccatgtgctcctccctgagcctcagggcccaaacccatcctccagccctgcagggccgtctcccccaagaggcttgaatccacccaggaacccccggcggaaaaggctgggcaggagctcaggcccaacaacccccatcttcactttgtgtcccctccccagccggccctccccagccggccctcccctgcccacacctcccagagctgcagtcgtagccaatgcagggaggtctcagttaccctgcggcaatgctgacagcttagttggttgattcagtcttcattttcatggttttaaaaaaaacaaaaaacacaaccaacaacaacaaaaccctttctcaccatattctcactttagaaaacttggaaaacacagaagaaaaaaatacataagaaaattgaagtcaccatgattctatgtcctccctgcagattcacttctgatctacaggtggtgattgtcatttcagaaacaaggagagtcagcaattaccagccagccaaggtcctggaagctgacgtagagctcgtgccgacggcagacctgccggccgtgggagccgcggacgtcatctgcagggacagaaggggcaaggtcttttctggggttcctgctgtgtgcagctactatggggtaccagggtgggggatgccctgatgagcacatttgtcaaataaatgaatgacaggaaaccaaaag

SEQ ID NO: 279157 - DNA, 504 bp, Homo sapiens
cgtgctgcctcggaccacctgcccagtcgagctgccatcacctgccagggtgagccactgcgcctgatcaaggcatcaccgttgaacctcctaagaggaaaacataaggctgtgcaataccaggaactgggattctaggttgccccagacaccaaggcatcaaaagccaggggatccagagaaaacacagacagccaagagagaaactgcgggaaaaagccaaaaggttgagagccacaccatctagaagcttcctgcctgtggtgcggcacagaaacaaggagagtcagcaattaccagccagccaaggtcctggaagctgacgtagagctcgtgccgacggcagacctgccggccgtgggagccgcggacgtcatctgcagggacagaaggggcaaggtcttttctggggttcctgctgtgtgcagctactatggggtaccagggtgggggatgccctgatgagcacatttgtcaaataaatgaatgacaggaaaccaaaag

SEQ ID NO: 279158 - DNA, 1107 bp, Homo sapiens
gattgttgaccaatgggatgaagctgtggtactgccaggggacagagttgcctctgttgagccaggaagctgtgggaagttgtaggttcctgactgaggcctgaggtggtggtgctgtcaggcaacgctgttgtgtgcgttgagcctggttgactgtgggatgtgctggattcttcgctgaggcctgagctaggttgtggatcatgggcaagaaaagcgctgttctgggactgcggggcaggagaaggaaactgatgcttctgagggtgagtctgatgagataacatgcctgtgtgtgggcctcaggttagacagtgctgaggtctcccgtcactgggcatccagctgggtgctacggccgtggctcctgccttctgcagccctgtcagggcccaaggccttccccatcagcacttgctccagcctactcactggagttgtgttctgggtgggtgtgtagaatactcgcactcctacttggggcatcagggagctctctagcaatttcttctgcacctagggagagcccactgctaaaaaaggcctagtcaaatcctcaggtgtacatggacatcaagattgggaacaagccggctggctgcatccaaaccctcctgcgttccgacgtcgtgcccatgaccacagagaattttctctacatgtgcacccatttaaaggactcggcttcaagggaagcagcttccaccgcattatcccccagttcatttgccagggcagtgatttcacaaaccacggtggcaccaggggtctgcgcaggcatggcactaagtgtcccatggcacatttggccctcatggaggcctcaaaagggcaggaccagcaccctcttctacggaggaaggaacgggcacagcagaaacaaggagagtcagcaattaccagccagccaaggtcctggaagctgacgtagagctcgtgccgacggcagacctgccggccgtgggagccgcggacgtcatctgcagggacagaaggggcaaggtcttttctggggttcctgctgtgtgcagctactatggggtaccagggtgggggatgccctgatgagcacatttgtcaaataaatgaatgacaggaaaccaaaag

SEQ ID NO: 279159 - DNA, 997 bp, Homo sapiens
ctgggcaataagagctactccagcctgggcaataagagctactccagcctgggcaataagagctactccagcctgggcaataagagctactccaccctgggcaaaagcgctgttctgggactgcggggcaggagaaggaaactgatgcttctgagggtgagtctgatgagataacatgcctgtgtgtgggcctcaggttagacagtgctgaggtctcccgtcactgggcatccagctgggtgctacggccgtggctcctgccttctgcagccctgtcagggcccaaggccttccccatcagcacttgctccagcctactcactggagttgtgttctgggtgggtgtgtagaatactcgcactcctacttggggcatcagggagctctctagcaatttcttctgcacctagggagagcccactgctaaaaaaggcctagtcaaatcctcaggtgtacatggacatcaagattgggaacaagccggctggctgcatccaaaccctcctgcgttccgacgtcgtgcccatgaccacagagaattttctctacatgtgcacccatttaaaggactcggcttcaagggaagcagcttccaccgcattatcccccagttcatttgccagggcagtgatttcacaaaccacggtggcaccaggggtctgcgcaggcatggcactaagtgtcccatggcacatttggccctcatggaggcctcaaaagggcaggaccagcaccctcttctacggaggaaggaacgggcacagcagaaacaaggagagtcagcaattaccagccagccaaggtcctggaagctgacgtagagctcgtgccgacggcagacctgccggccgtgggagccgcggacgtcatctgcagggacagaaggggcaaggtcttttctggggttcctgctgtgtgcagctactatggggtaccagggtgggggatgccctgatgagcacatttgtcaaataaatgaatgacaggaaaccaaaag

SEQ ID NO: 279160 - DNA, 1146 bp, Homo sapiens
gattgttgaccaatgggatgaagctgtggtactgccaggggacagagttgcctctgttgagccaggaagctgtgggaagttgtaggttcctgactgaggcctgaggtggtggtgctgtcaggcaacgctgttgtgtgcgttgagcctggttgactgtgggatgtgctggattcttcgctgaggcctgagctaggttgtggatcatgggcaagaaaagcgctgttctgggactgcggggcaggagaaggaaactgatgcttctgagggtgagtctgatgagataacatgcctgtgtgtgggcctcaggttagacagtgctgaggtctcccgtcactgggcatccagctgggtgctacggccgtggctcctgccttctgcagccctgtcagggcccaaggccttccccatcagcacttgctccagcctactcactggagttgtgttctgggtgggtgtgtagaatactcgcactcctacttggggcatcagggagctctctagcaatttcttctgcacctagggagagcccactgctaaaaaaggcctagtcaaatcctcaggtgtacatggacatcaagattgggaacaagccggctggctgcatccaaaccctcctgcgttccgacgtcgtgcccatgaccacagagaattttctctacatgtgcacccatttaaaggactcggcttcaagggaagcagcttccaccgcattatcccccagttcatttgccagggcagtgatttcacaaaccacggtggcaccaggggtctgcgcaggcatggcactaagtgtcccatggcacatttggccctcatggaggcctcaaaagggcaggaccagcaccctcttctacggaggaaggaacgggcacagcaggtacatgatgtggtcaaattaacaagaggcagaggccggaaacaaggagagtcagcaattaccagccagccaaggtcctggaagctgacgtagagctcgtgccgacggcagacctgccggccgtgggagccgcggacgtcatctgcagggacagaaggggcaaggtcttttctggggttcctgctgtgtgcagctactatggggtaccagggtgggggatgccctgatgagcacatttgtcaaataaatgaatgacaggaaaccaaaag

SEQ ID NO: 279161 - DNA, 575 bp, Homo sapiens
cgtgctgcctcggaccacctgcccagtcgagctgccatcacctgccagggtgagccactgcgcctgatcaaggcatcaccgttgaacctcctaagaggaaaacataaggctgtgcaataccaggaactgggattctaggtaaaaacttctagaaggaagcctcggtgccagaatccgcaaacacacagagcactcagtggtgagcagcaccagtgatcccatcagaagcctgcttttgtcctttaaggttgccccagacaccaaggcatcaaaagccaggggatccagagaaaacacagacagccaagagagaaactgcgggaaaaagccaaaaggttgagagccacaccatctagaagcttcctgcctgtggtgcggcacaggtgggtgagtgcacacgcacaccccacacactgtgcgcacatatcacgggcggtcagtattgccagcgtactcgggggcccgtgtgttaagatcacacagcccccacacagtgtacacatctgtttcatgtgctgtgcctctgagcgccgcacgcaggtgtgtaagtgtcccacaggagtatgctcagcgct

SEQ ID NO: 279162 - DNA, 227 bp, Homo sapiens
ccgtggctgggacccaaatgattatttttatttttgtagagatggcatgttacagagagctggagttttaattatctagttagatattcttacctcagcacttttctctttctcaatcccagagaattttctctacatgtgcacccatttaaaggactcggcttcaagggaagcagcttccaccgcattatcccccagttcatttgccagggcagtgatttcacaaa

SEQ ID NO: 279163 - DNA, 923 bp, Homo sapiens
  misc_feature (77)..(77): n is a, c, g, or t
  misc_feature (80)..(80): n is a, c, g, or t
  misc_feature (91)..(91): n is a, c, g, or t
  misc_feature (105)..(105): n is a, c, g, or t
  misc_feature (108)..(109): n is a, c, g, or t
aagtcttccatcttgtaccaagtggtcaagcagtggtgatggtcccatttttgtggcaggcggttcggttgagtagngangaggtcaattnaatggtttggcaantgnnaagattacaggctgtgccagccctggaaaaacagttacaattgttgttcgtggttctaacaaactggtgattgaagaagctgagcgctccattcatgatgccctatgtgttattcgttgtttagtgaagaagagggctcttattgcaggaggtggtgctccagaaatagagttggccctacgattaactgaatattcacgaacactgagtggtatggaatcctactgcgttcgtgcttttgcagatgctatggaggtcattccatctacactagctgaaaatgccggcctgaatcccatttctacagtaacagaactaagaaaccggcatgcccagggagaaaaaactgcaggcattaatgtccgaaagggtggtatttccaacattttggaggaactggttgtccagcctctgttggtatcagtcagtgctctgactcttgcaactgaaactgttcggagcattctgaaaatagatgatgtggtaaacactcgataatctggataactgactagcaccattatgatcaccagtattgtggctggaatggaagaagatcaccttggtgttccttgtttggaagattatttcctctgaatttctgggcttggtcttccagttggcatttgcctgaagttgtattgaaacaatttaatgaaaatattaaatatttggtttcaaaaggcagatttatcttctcccaacattctgttatttctgatacttttgaaaaactaataaaaactaataaaagaatctcgcatgcgggccggcggccccccccgtacgtctcttacatacacgacattattga

SEQ ID NO: 279164 - DNA, 453 bp, Homo sapiens
aatacaaaaaattagccgggcatggtggcgcgtgcctgtaatcccagctaaggcaggagaatcacttgaacccgggaggtagaggttgcagtgagccaagatcatgccattgcagtccagcctgggcaacaagagcaaactccatctcaaaaaaaaaaaaaaagaaatgagtggtagaaatattactaatcttggactcttatacaagaaagaagatttgggagagaaagtcaggattgtctttgctttagtaaatggtatttaattatagtagtgactatccaatcacttattttacttataatgtagatttgtgatattttgagaagtatcggccaggtgcggtgactcatacttgtaatcccagcactttgggaggctgaggctggcagaacaattgagcccaaggagttgagaccagactgggcaacatggcaaaaccctgtctccacc

SEQ ID NO: 279165 - DNA, 658 bp, Homo sapiens
aaaagtttaataaaactattaaggtgtgacattgaaatataactttaaaattttttttctagattcaagatggaaaaggtgatgtaaccattacaaatgatggtgctaccattctgaaacaaatgcaagtattacatccagcagccagaatgctggtggtaagtgtaattttaggtgagtctttttttttttttttttttgagacagagtcttgctctgtcatccaggctagagtgccgtggcacaatctcagctcactgcaacctctgcctcccagattcatttctcctgcctcagcctcctgagtagctgggattacaggctcgtgccaccatgcctggttgatttttgtattttcagtagagacgggtttcaccatgttggtcaggctgttctcaaactcctgaccttgtgatccacctacgttggcctcccaaagtgctgggattacagacatgagctactgcgcccggccagatgagtcttcttttttaagtgtatttgatacttggtaaacagttaaatttatttgatcacatgatatttaagcacgatgaacacttttcgtgctgaacaggcatatttttaggatacattgtgtgcctaacattgtgctttttggtgtgagggggttttcgacatttagccggccttctgg

SEQ ID NO: 279166 - DNA, 374 bp, Homo sapiens
  misc_feature (133)..(133): n is a, c, g, or t
gtagttaggattgggtgacaccagcattaattcagttttccaaattttaattgaaataacatcccacagtgtagagaaaagcttagtagagtatcatattctaatcttcttagaaagaaaactagatttaggncttgaggtacactggtaaccacgtggctgctgatgtgtattatcacagacactaaaagcaacttgtgctgatttgatttgcagggtggtatttccaacattttggaggaactggttgtccagcctctgttggtatcagtcagtgctctgactcttgcaactgaaactgttcggagcattctgaaaatagatgatgtgtaagtgtttccaggttgcaaattttcttaggaggtcaaaaaggc

SEQ ID NO: 279167 - DNA, 2549 bp, Homo sapiens
agcggcttctccgcctccgcctcctcccgacgccggcgccgctttctggaaggttcgtgaaggcagtgagggcttaccgttattacactgcggccggccagaatccgggtccatccgtccttcccgagccaacccagacacagcggagtttgccatgcccgagaatgtggcaccccggagcggggcgactgccggggctgccggcggccgcgggaaaggcgcctatcaggaccgcgacaagccagcccagatccgcttcagcaacatttccgccgccaaagcggttgctgatgctattagaacaagccttggaccaaaaggaatggataaaatgattcaagatggaaaaggtgatgtaaccattacaaatgatggtgctaccattctgaaacaaatgcaagtattacatccagcagccagaatgctggtggagctgtctaaggctcaagatatagaagcaggagatggcaccacatcagtagtcatcattgctggctccctcttagattcttgtaccaagcttcttcagaaagggattcatccaaccatcatttctgagtcattccagaaggccctggaaaagggcattgaaatcttgactgacatgtctcgacctgtggaactgagtgacagagaaactttgttaaatagtgcaaccacttcactgaactcaaaggtggtttctcagtattcaagtctgctttctccaatgagtgtaaatgcagtgatgaaagtgattgacccagccacagccaccagtgtagatcttagagatattaaaatagttaagaagcttggtgggacaattgatgactgtgagttggtggaagggctggttctcacccaaaaagtgtcaaattctggcataaccagagttgaaaaggccaagattgggcttattcagttttgcttatctgctcccaaaacagacatggataatcaaatagtggtttctgactatgcccagatggaccgagtgctgcgagaagagagagcctatattttaaatttagtgaagcaaattaaaaaaacaggatgtaatgtccttctcatacagaaatctattctaagagatgctcttagtgatcttgcattacactttctgaataaaatgaagatcatggtgattaaggatattgaaagagaagacattgaattcatttgtaagacaattggaaccaagccagttgctcatattgaccaatttactgctgacatgctgggttctgctgagttagctgaggaggtcaatttaaatggttctggcaaactgctcaagattacaggctgtgccagccctggaaaaacagttacaattgttgttcgtggttctaacaaactggtgattgaagaagctgagcgctccattcatgatgccctatgtgttattcgttgtttagtgaagaagagggctcttattgcaggaggtggtgctccagaaatagagttggccctacgattaactgaatattcacgaacactgagtggtatggaatcctactgcgttcgtgcttttgcagatgctatggaggtcattccatctacactagctgaaaatgccggcctgaatcccatttctacagtaacagaactaagaaaccggcatgcccagggagaaaaaactgcaggcattaatgtccgaaagggtggtatttccaacattttggaggaactggttgtccagcctctgttggtatcagtcagtgctctgactcttgcaactgaaactgttcggagcattctgaaaatagatgatgtggtaaacactcgataatctggataactgactagcaccattatgatcaccagtattgtggctggaatggaagaagatcaccttggtgttccttgtttggaagattatttcctctgaatttctgggcttggtcttccagttggcatttgcctgaagttgtattgaaacaatttaatgaaaatattaaatatttggtttcaaaaggcagatttatcttctcccaacattctgttatttctgatacttttgaaaaactaataaaaactaataaaagaagcgtaaaaagtgagtttacatgttgaggaaaaaaatggcccaatatgctcatcactgataaatgctccctggccttaaaaactaccaacatataatatatatgctgtcttaaaagttaatgatccaagtggcacctctctgaacctactttggcttgggaggctgcccagttaaaacaaaaataagttaatggtacagaaagagaatgaaaaatgaaagcctccttttatcctatcatcctaattccttttcccagtaataatgactgctgtgttggattccttctgcaaataaaagtgtatacagtaaaaaaaaacgaagaaaaaaaaaaaacaaaaaaaaacacaaaaagaacaaaagaaaagaaacaaagaaaaaaaaaaagacaatcaagaaaaaaacaaaaaagaacatcaaaacacaaacaacaaaaaaaaaaaagaaagggggggggccaacatgaaaaccaacaggaggagacgcaaaagagacaacgcgagaggagaaaagccgcaaa

SEQ ID NO: 279168 - DNA, 2546 bp, Homo sapiens
  misc_feature (36)..(36): n is a, c, g, or t
  misc_feature (43)..(43): n is a, c, g, or t
tcacggcagttactccccggcgtatgtaccgaggcngggtggngggaaggttcgtgaaggcagtgagggcttaccgttattacactgcggccggccagaatccgggtccatccgtccttcccgagccaacccagacacagcggagtttgccatgcccgagaatgtggcaccccggagcggggcgactgccggggctgccggcggccgcgggaaaggcgcctatcaggaccgcgacaagccagcccagatccgcttcagcaacatttccgccgccaaagcggttgctgatgctattagaacaagccttggaccaaaaggaatggataaaatgattcaagatggaaaaggtgatgtaaccattacaaatgatggtgctaccattctgaaacaaatgcaagtattacatccagcagccagaatgctggtggagctgtctaaggctcaagatatagaagcaggagatggcaccacatcagtagtcatcattgctggctccctcttagattcttgtaccaagcttcttcagaaagggattcatccaaccatcatttctgagtcattccagaaggccctggaaaagggcattgaaatcttgactgacatgtctcgacctgtggaactgagtgacagagaaactttgttaaatagtgcaaccacttcactgaactcaaaggtggtttctcagtattcaagtctgctttctccaatgagtgtaaatgcagtgatgaaagtgattgacccagccacagccaccagtgtagatcttagagatattaaaatagttaagaagcttggtgggacaattgatgactgtgagttggtggaagggctggttctcacccaaaaagtgtcaaattctggcataaccagagttgaaaaggccaagattgggcttattcagttttgcttatctgctcccaaaacagacatggataatcaaatagtggtttctgactatgcccagatggaccgagtgctgcgagaagagagagcctatattttaaatttagtgaagcaaattaaaaaaacaggatgtaatgtccttctcatacagaaatctattctaagagatgctcttagtgatcttgcattacactttctgaataaaatgaagatcatggtgattaaggatattgaaagagaagacattgaattcatttgtaagacaattggaaccaagccagttgctcatattgaccaatttactgctgacatgctgggttctgctgagttagctgaggaggtcaatttaaatggttctggcaaactgctcaagattacaggctgtgccagccctggaaaaacagttacaattgttgttcgtggttctaacaaactggtgattgaagaagctgagcgctccattcatgatgccctatgtgttattcgttgtttagtgaagaagagggctcttattgcaggaggtggtgctccagaaatagagttggccctacgattaactgaatattcacgaacactgagtggtatggaatcctactgcgttcgtgcttttgcagatgctatggaggtcattccatctacactagctgaaaatgccggcctgaatcccatttctacagtaacagaactaagaaaccggcatgcccagggagaaaaaactgcaggcattaatgtccgaaagggtggtatttccaacattttggaggaactggttgtccagcctctgttggtatcagtcagtgctctgactcttgcaactgaaactgttcggagcattctgaaaatagatgatgtggtaaacactcgataatctggataactgactagcaccattatgatcaccagtattgtggctggaatggaagaagatcaccttggtgttccttgtttggaagattatttcctctgaatttctgggcttggtcttccagttggcatttgcctgaagttgtattgaaacaatttaatgaaaatattaaatatttggtttcaaaaggcagatttatcttctcccaacattctgttatttctgatacttttgaaaaactaataaaaactaataaaagaagcgtaaaaagtgagtttacatgttgaggaaaaaaatggcccaatatgctcatcactgataaatgctccctggccttaaaaactaccaacatataatatatatgctgtcttaaaagttaatgatccaagtggcacctctctgaacctactttggcttgggaggctgcccagttaaaacaaaaataagttaatggtacagaaagagaatgaaaaatgaaagcctccttttatcctatcatcctaattccttttcccagtaataatgactgctgtgttggattccttctgcaaataaaagtgtatacagtaaaaaaaaacgaagaaaaaaaaaaaacaaaaaaaaacacaaaaagaacaaaagaaaagaaacaaagaaaaaaaaaaagacaatcaagaaaaaaacaaaaaagaacatcaaaacacaaacaacaaaaaaaaaaaagaaagggggggggccaacatgaaaaccaacaggaggagacgcaaaagagacaacgcgagaggagaaaagccgcaaa

SEQ ID NO: 279169 - DNA, 2566 bp, Homo sapiens
aagctaggtacgaggctgcgtttaatcggcagagggcttcctcccgtacgcaggagcgctttctggaaggttcgtgaaggcagtgagggcttaccgttattacactgcggccggccagaatccgggtccatccgtccttcccgagccaacccagacacagcggagtttgccatgcccgagaatgtggcaccccggagcggggcgactgccggggctgccggcggccgcgggaaaggcgcctatcaggaccgcgacaagccagcccagatccgcttcagcaacatttccgccgccaaagcggttgctgatgctattagaacaagccttggaccaaaaggaatggataaaatgattcaagatggaaaaggtgatgtaaccattacaaatgatggtgctaccattctgaaacaaatgcaagtattacatccagcagccagaatgctggtggagctgtctaaggctcaagatatagaagcaggagatggcaccacatcagtagtcatcattgctggctccctcttagattcttgtaccaagcttcttcagaaagggattcatccaaccatcatttctgagtcattccagaaggccctggaaaagggcattgaaatcttgactgacatgtctcgacctgtggaactgagtgacagagaaactttgttaaatagtgcaaccacttcactgaactcaaaggtggtttctcagtattcaagtctgctttctccaatgagtgtaaatgcagtgatgaaagtgattgacccagccacagccaccagtgtagatcttagagatattaaaatagttaagaagcttggtgggacaattgatgactgtgagttggtggaagggctggttctcacccaaaaagtgtcaaattctggcataaccagagttgaaaaggccaagattgggcttattcagttttgcttatctgctcccaaaacagacatggataatcaaatagtggtttctgactatgcccagatggaccgagtgctgcgagaagagagagcctatattttaaatttagtgaagcaaattaaaaaaacaggatgtaatgtccttctcatacagaaatctattctaagagatgctcttagtgatcttgcattacactttctgaataaaatgaagatcatggtgattaaggatattgaaagagaagacattgaattcatttgtaagacaattggaaccaagccagttgctcatattgaccaatttactgctgacatgctgggttctgctgagttagctgaggaggtcaatttaaatggttctggcaaactgctcaagattacaggctgtgccagccctggaaaaacagttacaattgttgttcgtggttctaacaaactggtgattgaagaagctgagcgctccattcatgatgccctatgtgttattcgttgtttagtgaagaagagggctcttattgcaggaggtggtgctccagaaatagagttggccctacgattaactgaatattcacgaacactgagtggtatggaatcctactgcgttcgtgcttttgcagatgctatggaggtcattccatctacactagctgaaaatgccggcctgaatcccatttctacagtaacagaactaagaaaccggcatgcccagggagaaaaaactgcaggcattaatgtccgaaagggtggtatttccaacattttggaggaactggttgtccagcctctgttggtatcagtcagtgctctgactcttgcaactgaaactgttcggagcattctgaaaatagatgatgtggtaaacactcgataatctggataactgactagcaccattatgatcaccagtattgtggctggaatggaagaagatcaccttggtgttccttgtttggaagattatttcctctgaatttctgggcttggtcttccagttggcatttgcctgaagttgtattgaaacaatttaatgaaaatattaaatatttggtttcaaaaggcagatttatcttctcccaacattctgttatttctgatacttttgaaaaactaataaaaactaataaaagaagcgtaaaaagtgagtttacatgttgaggaaaaaaatggcccaatatgctcatcactgataaatgctccctggccttaaaaactaccaacatataatatatatgctgtcttaaaagttaatgatccaagtggcacctctctgaacctactttggcttgggaggctgcccagttaaaacaaaaataagttaatggtacagaaagagaatgaaaaatgaaagcctccttttatcctatcatcctaattccttttcccagtaataatgactgctgtgttggattccttctgcaaataaaagtgtatacagtaaaaaaaaacgaagaaaaaaaaaaaacaaaaaaaaacacaaaaagaacaaaagaaaagaaacaaagaaaaaaaaaaagacaatcaagaaaaaaacaaaaaagaacatcaaaacacaaacaacaaaaaaaaaaaagaaagggggggggccaacatgaaaaccaacaggaggagacgcaaaagagacaacgcgagaggagaaaagccgcaaa

SEQ ID NO: 279170 - DNA, 2493 bp, Homo sapiens
tcgtgacttgtagtacttctgtgcagttcgcttcagtctggccagaatccgggtccatccgtccttcccgagccaacccagacacagcggagtttgccatgcccgagaatgtggcaccccggagcggggcgactgccggggctgccggcggccgcgggaaaggcgcctatcaggaccgcgacaagccagcccagatccgcttcagcaacatttccgccgccaaagcggttgctgatgctattagaacaagccttggaccaaaaggaatggataaaatgattcaagatggaaaaggtgatgtaaccattacaaatgatggtgctaccattctgaaacaaatgcaagtattacatccagcagccagaatgctggtggagctgtctaaggctcaagatatagaagcaggagatggcaccacatcagtagtcatcattgctggctccctcttagattcttgtaccaagcttcttcagaaagggattcatccaaccatcatttctgagtcattccagaaggccctggaaaagggcattgaaatcttgactgacatgtctcgacctgtggaactgagtgacagagaaactttgttaaatagtgcaaccacttcactgaactcaaaggtggtttctcagtattcaagtctgctttctccaatgagtgtaaatgcagtgatgaaagtgattgacccagccacagccaccagtgtagatcttagagatattaaaatagttaagaagcttggtgggacaattgatgactgtgagttggtggaagggctggttctcacccaaaaagtgtcaaattctggcataaccagagttgaaaaggccaagattgggcttattcagttttgcttatctgctcccaaaacagacatggataatcaaatagtggtttctgactatgcccagatggaccgagtgctgcgagaagagagagcctatattttaaatttagtgaagcaaattaaaaaaacaggatgtaatgtccttctcatacagaaatctattctaagagatgctcttagtgatcttgcattacactttctgaataaaatgaagatcatggtgattaaggatattgaaagagaagacattgaattcatttgtaagacaattggaaccaagccagttgctcatattgaccaatttactgctgacatgctgggttctgctgagttagctgaggaggtcaatttaaatggttctggcaaactgctcaagattacaggctgtgccagccctggaaaaacagttacaattgttgttcgtggttctaacaaactggtgattgaagaagctgagcgctccattcatgatgccctatgtgttattcgttgtttagtgaagaagagggctcttattgcaggaggtggtgctccagaaatagagttggccctacgattaactgaatattcacgaacactgagtggtatggaatcctactgcgttcgtgcttttgcagatgctatggaggtcattccatctacactagctgaaaatgccggcctgaatcccatttctacagtaacagaactaagaaaccggcatgcccagggagaaaaaactgcaggcattaatgtccgaaagggtggtatttccaacattttggaggaactggttgtccagcctctgttggtatcagtcagtgctctgactcttgcaactgaaactgttcggagcattctgaaaatagatgatgtggtaaacactcgataatctggataactgactagcaccattatgatcaccagtattgtggctggaatggaagaagatcaccttggtgttccttgtttggaagattatttcctctgaatttctgggcttggtcttccagttggcatttgcctgaagttgtattgaaacaatttaatgaaaatattaaatatttggtttcaaaaggcagatttatcttctcccaacattctgttatttctgatacttttgaaaaactaataaaaactaataaaagaagcgtaaaaagtgagtttacatgttgaggaaaaaaatggcccaatatgctcatcactgataaatgctccctggccttaaaaactaccaacatataatatatatgctgtcttaaaagttaatgatccaagtggcacctctctgaacctactttggcttgggaggctgcccagttaaaacaaaaataagttaatggtacagaaagagaatgaaaaatgaaagcctccttttatcctatcatcctaattccttttcccagtaataatgactgctgtgttggattccttctgcaaataaaagtgtatacagtaaaaaaaaacgaagaaaaaaaaaaaacaaaaaaaaacacaaaaagaacaaaagaaaagaaacaaagaaaaaaaaaaagacaatcaagaaaaaaacaaaaaagaacatcaaaacacaaacaacaaaaaaaaaaaagaaagggggggggccaacatgaaaaccaacaggaggagacgcaaaagagacaacgcgagaggagaaaagccgcaaa

SEQ ID NO: 279171 - DNA, 2077 bp, Homo sapiens
agcggcttctccgcctccgcctcctcccgacgccggcgccgctttctggaaggttcgtgaaggcagtgagggcttaccgttattacactgcggccggccagaatccgggtccatccgtccttcccgagccaacccagacacagcggagtttgccatgcccgagaatgtggcaccccggagcggggcgactgccggggctgccggcggccgcgggaaaggcgcctatcaggaccgcgacaagccagcccagatccgcttcagcaacatttccgccgccaaagcggttgctgatgctattagaacaagccttggaccaaaaggaatggataaaatgattcaagatggaaaaggtgatgtaaccattacaaatgatggtgctaccattctgaaacaaatgcaagtattacatccagcagccagaatgctggtggagctgtctaaggctcaagatatagaagcaggagatggcaccacatcagtagtcatcattgctggctccctcttagattcttgtaccaagcttcttcagaaagggattcatccaaccatcatttctgagtcattccagaaggccctggaaaagggcattgaaatcttgactgacatgtctcgacctgtggaactgagtgacagagaaactttgttaaatagtgcaaccacttcactgaactcaaaggtggtttctcagtattcaagtctgctttctccaatgagtgtaaatgcagtgatgaaagtgattgacccagccacagccaccagtgtagatcttagagatattaaaatagttaagaagcttggtgggacaattgatgactgtgagttggtggaagggctggttctcacccaaaaagtgtcaaattctggcataaccagagttgaaaaggccaagattgggcttattcagttttgcttatctgctcccaaaacagacatggataatcaaatagtggtttctgactatgcccagatggaccgagtgctgcgagaagagagagcctatattttaaatttagtgaagcaaattaaaaaaacaggatgtaatgtccttctcatacagaaatctattctaagagatgctcttagtgatcttgcattacactttctgaataaaatgaagatcatggtgattaaggatattgaaagagaagacattgaattcatttgtaagacaattggaaccaagccagttgctcatattgaccaatttactgctgacatgctgggttctgctgagttagctgaggaggtcaatttaaatggttctggcaaactgctcaagattacaggctgtgccagccctggaaaaacagttacaattgttgttcgtggttctaacaaactggtgattgaagaagctgagcgctccattcatgatgccctatgtgttattcgttgtttagtgaagaagagggctcttattgcaggaggtggtgctccagaaatagagttggccctacgattaactgaatattcacgaacactgagtggtatggaatcctactgcgttcgtgcttttgcagatgctatggaggtcattccatctacactagctgaaaatgccggcctgaatcccatttctacagtaacagaactaagaaaccggcatgcccagggagaaaaaactgcaggcattaatgtccgaaagggtggtatttccaacattttggaggaactggttgtccagcctctgttggtatcagtcagtgctctgactcttgcaactgaaactgttcggagcattctgaaaatagatgatgtggtaaacactcgataatctggataactgactagcaccattatgatcaccagtattgtggctggaatggaagaagatcaccttggtgttccttgtttggaagattatttcctctgaatttctgggcttggtcttccagttggcatttgcctgaagttgtattgaaacaatttaatgaaaatattaaatatttggtttcaaaaggcagatttatcttctcccaacattctgttatttctgatacttttgaaaaactaataaaaactaataaaagaagcgtaaaaagtgtaaaaaacctctagcgtcccaaaaccaacatgt

SEQ ID NO: 279172 - DNA, 2666 bp, Homo sapiens
agcggcttctccgcctccgcctcctcccgacgccggcgccgctttctggaaggttcgtgaaggcagtgagggcttaccgttattacactgcggccggccagaatccgggtccatccgtccttcccgagccaacccagacacagcggagtttgccatgcccgagaatgtggcaccccggagcggggcgactgccggggctgccggcggccgcgggaaaggcgcctatcaggaccgcgacaagccagcccagatccgcttcagcaacatttccgccgccaaagcggttgctgatgctattagaacaagccttggaccaaaaggaatggataaaatgattcaagatggaaaaggtgatgtaaccattacaaatgatggtgctaccattctgaaacaaatgcaagtattacatccagcagccagaatgctggtggagctgtctaaggctcaagatatagaagcaggagatggcaccacatcagtagtcatcattgctggctccctcttagattcttgtaccaagcttcttcagaaagggattcatccaaccatcatttctgagtcattccagaaggccctggaaaagggcattgaaatcttgactgacatgtctcgacctgtggaactgagtgacagagaaactttgttaaatagtgcaaccacttcactgaactcaaaggtggtttctcagtattcaagtctgctttctccaatgagtgtaaatgcagtgatgaaagtgattgacccagccacagccaccagtgtagatcttagagatattaaaatagttaagaagcttggtgggacaattgatgactgtgagttggtggaagggctggttctcacccaaaaagtgtcaaattctggcataaccagagttgaaaaggccaagattgggcttattcagttttgcttatctgctcccaaaacagacatggataatcaaatagtggtttctgactatgcccagatggaccgagtgctgcgagaagagagagcctatattttaaatttagtgaagcaaattaaaaaaacaggatgtaatgtccttctcatacagaaatctattctaagagatgctcttagtgatcttgcattacactttctgaataaaatgaagatcatggtgattaaggatattgaaagagaagacattgaattcatttgtaagacaattggaaccaagccagttgctcatattgaccaatttactgctgacatgctgggttctgctgagttagctgaggaggtcaatttaaatggttctggcaaactgctcaagattacaggctgtgccagccctggaaaaacagttacaattgttgttcgtggttctaacaaactggtgattgaagaagctgagcgctccattcatgatgccctatgtgttattcgttgtttagtgaagaagagggctcttattgcaggaggtggtgctccagaaatagagttggccctacgattaactgaatattcacgaacactgagtggtatggaatcctactgcgttcgtgcttttgcagatgctatggaggtcattccatctacactagctgaaaatgccggcctgaatcccatttctacagtaacagaactaagaaaccggcatgcccagggagaaaaaactgcaggcattaatgtccgaaagggtggtatttccaacattttggaggaactggttgtccagcctctgttggtatcagtcagtgctctgactcttgcaactgaaactgttcggagcattctgaaaatagatgatgtggtaaacactcgataatctggataactgactagcaccattatgatcaccagtattgtggctggaatggaagaagatcaccttggtgttccttgtttggaagattatttcctctgaatttctgggcttggtcttccagttggcatttgcctgaagttgtattgaaacaatttaatgaaaatattaaatatttggtttcaaaaggcagatttatcttctcccaacattctgttatttctgatacttttgaaaaactaataaaaactaataaaagaagcaaaaaaaaaaaaaaaaaaaaaaaaaaaaaaaaaaaaaaaaaaaaaaaaaaaaaaaaaaaaaaaaaaaaaaaaaaaaaaaaaaaagaaaaaacaaaaaaaaagaaggggggcgcggcgcactataaatccacccccgggggggcgacacaagtagcagacgacacacacattatagaacaaaagaggggcccccaaagaatgaggaagtgttcatataaaaagcagagcgaagagaaggggcgagcaggataaaaacaaaagatcgagaggaggagaaacaaaacgaggacaagagaggaaaaacatgtgtgaataaaagaacaaccccatccagaaggggggggcgaaaacacaaaaagaggcgcagacaatccaccctcaccaaccgagagacaaatacaaaggacacccaacgagagagcgacgaagcacaaataatccgccacaccacagacaggacggaatgacatcaggcgagtggtgtaccaaaacgaccacacgggcaggatacgaaacgacgcggagggcaagcacgcgaagacacagcacggctgccgccacccctaacggcgaaacgatcagctctactagcgccgacgacaaaatattacaacacacagcaagagagacca

SEQ ID NO: 279173 - DNA, 2551 bp, Homo sapiens
agcggcttctccgcctccgcctcctcccgacgccggcgccgctttctggaaggttcgtgaaggcagtgagggcttaccgttattacactgcggccggccagaatccgggtccatccgtccttcccgagccaacccagacacagcggagtttgccatgcccgagaatgtggcaccccggagcggggcgactgccggggctgccggcggccgcgggaaaggcgcctatcaggaccgcgacaagccagcccagatccgcttcagcaacatttccgccgccaaagcggttgctgatgctattagaacaagccttggaccaaaaggaatggataaaatgattcaagatggaaaaggtgatgtaaccattacaaatgatggtgctaccattctgaaacaaatgcaagtattacatccagcagccagaatgctggtggagctgtctaaggctcaagatatagaagcaggagatggcaccacatcagtagtcatcattgctggctccctcttagattcttgtaccaagcttcttcagaaagggattcatccaaccatcatttctgagtcattccagaaggccctggaaaagggcattgaaatcttgactgacatgtctcgacctgtggaactgagtgacagagaaactttgttaaatagtgcaaccacttcactgaactcaaaggtggtttctcagtattcaagtctgctttctccaatgagtgtaaatgcagtgatgaaagtgattgacccagccacagccaccagtgtagatcttagagatattaaaatagttaagaagcttggtgggacaattgatgactgtgagttggtggaagggctggttctcacccaaaaagtgtcaaattctggcataaccagagttgaaaaggccaagattgggcttattcagttttgcttatctgctcccaaaacagacatggataatcaaatagtggtttctgactatgcccagatggaccgagtgctgcgagaagagagagcctatattttaaatttagtgaagcaaattaaaaaaacaggatgtaatgtccttctcatacagaaatctattctaagagatgctcttagtgatcttgcattacactttctgaataaaatgaagatcatggtgattaaggatattgaaagagaagacattgaattcatttgtaagacaattggaaccaagccagttgctcatattgaccaatttactgctgacatgctgggttctgctgagttagctgaggaggtcaatttaaatggttctggcaaactgctcaagattacaggctgtgccagccctggaaaaacagttacaattgttgttcgtggttctaacaaactggtgattgaagaagctgagcgctccattcatgatgccctatgtgttattcgttgtttagtgaagaagagggctcttattgcaggaggtggtgctccagaaatagagttggccctacgattaactgaatattcacgaacactgagtggtatggaatcctactgcgttcgtgcttttgcagatgctatggaggtcattccatctacactagctgaaaatgccggcctgaatcccatttctacagtaacagaactaagaaaccggcatgcccagggagaaaaaactgcaggcattaatgtccgaaagggtggtatttccaacattttggaggaactggttgtccagcctctgttggtatcagtcagtgctctgactcttgcaactgaaactgttcggagcattctgaaaatagatgatgtggtaaacactcgataatctggataactgactagcaccattatgatcaccagtattgtggctggaatggaagaagatcaccttggtgttccttgtttggaagattatttcctctgaatttctgggcttggtcttccagttggcatttgcctgaagttgtattgaaacaatttaatgaaaatattaaatatttggtttcaaaaggcagatttatcttctcccaacattctgttatttctgatacttttgaaaaactaataaaaactaataaaagaagcaaaaaaaaaaaaaaaaaaaaaaaaaaaaaaaaaaaaaaaaaaaaaaaaaaaaaaaaaaaaaaaaaaaaaaaaaaaaaaaaaaaagggggggggggggaaaatcacactccccggcggggggcgaaagaacatgagatggacacccacaaactagttggttgagtagaaaaaagagggagcccccacaatgagagggcccgacgctatatactatttacaacgaagagacgaggcgcgcggcgatgaaaactaacgaacggtggtgagggcggggaaaagcaagcgactcatatcagtcgagtattctgtgggagagacgagaaacacaacactactgtggggtggggaacaaaataattgttggggaaaaccaccccgccacagaaattaatgacggtctcgggagagtgataataaaaaaacaatgttggtgttgtatagttgtgaaaaaccggcggtagtgactgtggcgagtaaaaatgtgccatcgatgttgttttccaaaaaatttacgggg

SEQ ID NO: 279174 - DNA, 2412 bp, Homo sapiens
agcggcttctccgcctccgcctcctcccgacgccggcgccgctttctggaaggttcgtgaaggcagtgagggcttaccgttattacactgcggccggccagaatccgggtccatccgtccttcccgagccaacccagacacagcggagtttgccatgcccgagaatgtggcaccccggagcggggcgactgccggggctgccggcggccgcgggaaaggcgcctatcaggaccgcgacaagccagcccagatccgcttcagcaacatttccgccgccaaagcggttgctgatgctattagaacaagccttggaccaaaaggaatggataaaatgattcaagatggaaaaggtgatgtaaccattacaaatgatggtgctaccattctgaaacaaatgcaagtattacatccagcagccagaatgctggtggagctgtctaaggctcaagatatagaagcaggagatggcaccacatcagtagtcatcattgctggctccctcttagattcttgtaccaagcttcttcagaaagggattcatccaaccatcatttctgagtcattccagaaggccctggaaaagggcattgaaatcttgactgacatgtctcgacctgtggaactgagtgacagagaaactttgttaaatagtgcaaccacttcactgaactcaaaggtggtttctcagtattcaagtctgctttctccaatgagtgtaaatgcagtgatgaaagtgattgacccagccacagccaccagtgtagatcttagagatattaaaatagttaagaagcttggtgggacaattgatgactgtgagttggtggaagggctggttctcacccaaaaagtgtcaaattctggcataaccagagttgaaaaggccaagattgggcttattcagttttgcttatctgctcccaaaacagacatggataatcaaatagtggtttctgactatgcccagatggaccgagtgctgcgagaagagagagcctatattttaaatttagtgaagcaaattaaaaaaacaggatgtaatgtccttctcatacagaaatctattctaagagatgctcttagtgatcttgcattacactttctgaataaaatgaagatcatggtgattaaggatattgaaagagaagacattgaattcatttgtaagacaattggaaccaagccagttgctcatattgaccaatttactgctgacatgctgggttctgctgagttagctgaggaggtcaatttaaatggttctggcaaactgctcaagattacaggctgtgccagccctggaaaaacagttacaattgttgttcgtggttctaacaaactggtgattgaagaagctgagcgctccattcatgatgccctatgtgttattcgttgtttagtgaagaagagggctcttattgcaggaggtggtgctccagaaatagagttggccctacgattaactgaatattcacgaacactgagtggtatggaatcctactgcgttcgtgcttttgcagatgctatggaggtcattccatctacactagctgaaaatgccggcctgaatcccatttctacagtaacagaactaagaaaccggcatgcccagggagaaaaaactgcaggcattaatgtccgaaagggtggtatttccaacattttggaggaactggttgtccagcctctgttggtatcagtcagtgctctgactcttgcaactgaaactgttcggagcattctgaaaatagatgatgtggtaaacactcgataatctggataactgactagcaccattatgatcaccagtattgtggctggaatggaagaagatcaccttggtgttccttgtttggaagattatttcctctgaatttctgggcttggtcttccagttggcatttgcctgaagttgtattgaaacaatttaatgaaaatattaaatatttggtttcaaaaggcagatttatcttctcccaacattctgttatttctgatacttttgaaaaactaataaaaactaataaaagaagcaaaaaaaaaaaaaaaaaaaaaaaaaaaaaaatgtgtgtgggcgcgcgcgcttggggccctcgaggagaagagttttttaaacaccatttcggtgtggggcggcgggggcgcccggtagggtaaggggaaactggggccaataacggggggtccccataaggagaaatctccgggggacatagagacaaacgggcgtgggagattccccacccaaaaataaaaaaagcgcccgggggggggaaccgagagggcggttgctgggaacacattccccaagagggggagtgtccggagagggatcaatcacgggggatccaacacaaacagggggtgccacaacgaagaggctcggatattaaaattaacgcccggactggg

SEQ ID NO: 279175 - DNA, 2089 bp, Homo sapiens
agcggcttctccgcctccgcctcctcccgacgccggcgccgctttctggaaggttcgtgaaggcagtgagggcttaccgttattacactgcggccggccagaatccgggtccatccgtccttcccgagccaacccagacacagcggagtttgccatgcccgagaatgtggcaccccggagcggggcgactgccggggctgccggcggccgcgggaaaggcgcctatcaggaccgcgacaagccagcccagatccgcttcagcaacatttccgccgccaaagcggttgctgatgctattagaacaagccttggaccaaaaggaatggataaaatgattcaagatggaaaaggtgatgtaaccattacaaatgatggtgctaccattctgaaacaaatgcaagtattacatccagcagccagaatgctggtggagctgtctaaggctcaagatatagaagcaggagatggcaccacatcagtagtcatcattgctggctccctcttagattcttgtaccaagcttcttcagaaagggattcatccaaccatcatttctgagtcattccagaaggccctggaaaagggcattgaaatcttgactgacatgtctcgacctgtggaactgagtgacagagaaactttgttaaatagtgcaaccacttcactgaactcaaaggtggtttctcagtattcaagtctgctttctccaatgagtgtaaatgcagtgatgaaagtgattgacccagccacagccaccagtgtagatcttagagatattaaaatagttaagaagcttggtgggacaattgatgactgtgagttggtggaagggctggttctcacccaaaaagtgtcaaattctggcataaccagagttgaaaaggccaagattgggcttattcagttttgcttatctgctcccaaaacagacatggataatcaaatagtggtttctgactatgcccagatggaccgagtgctgcgagaagagagagcctatattttaaatttagtgaagcaaattaaaaaaacaggatgtaatgtccttctcatacagaaatctattctaagagatgctcttagtgatcttgcattacactttctgaataaaatgaagatcatggtgattaaggatattgaaagagaagacattgaattcatttgtaagacaattggaaccaagccagttgctcatattgaccaatttactgctgacatgctgggttctgctgagttagctgaggaggtcaatttaaatggttctggcaaactgctcaagattacaggctgtgccagccctggaaaaacagttacaattgttgttcgtggttctaacaaactggtgattgaagaagctgagcgctccattcatgatgccctatgtgttattcgttgtttagtgaagaagagggctcttattgcaggaggtggtgctccagaaatagagttggccctacgattaactgaatattcacgaacactgagtggtatggaatcctactgcgttcgtgcttttgcagatgctatggaggtcattccatctacactagctgaaaatgccggcctgaatcccatttctacagtaacagaactaagaaaccggcatgcccagggagaaaaaactgcaggcattaatgtccgaaagggtggtatttccaacattttggaggaactggttgtccagcctctgttggtatcagtcagtgctctgactcttgcaactgaaactgttcggagcattctgaaaatagatgatgtggtaaacactcgataatctggataactgactagcaccattatgatcaccagtattgtggctggaatggaagaagatcaccttggtgttccttgtttggaagattatttcctctgaatttctgggcttggtcttccagttggcatttgcctgaagttgtattgaaacaatttaatgaaaatattaaatatttggtttcaaaaggcagatttatcttctcccaacattctgttatttctgatacttttgaaaaactaataaaaactaataaaagaatctcggatgcgcccagctatattaaaaggaaggtaaaaaagtgaatacgataagtgg

SEQ ID NO: 279176 - DNA, 2097 bp, Homo sapiens
agcggcttctccgcctccgcctcctcccgacgccggcgccgctttctggaaggttcgtgaaggcagtgagggcttaccgttattacactgcggccggccagaatccgggtccatccgtccttcccgagccaacccagacacagcggagtttgccatgcccgagaatgtggcaccccggagcggggcgactgccggggctgccggcggccgcgggaaaggcgcctatcaggaccgcgacaagccagcccagatccgcttcagcaacatttccgccgccaaagcggttgctgatgctattagaacaagccttggaccaaaaggaatggataaaatgattcaagatggaaaaggtgatgtaaccattacaaatgatggtgctaccattctgaaacaaatgcaagtattacatccagcagccagaatgctggtggagctgtctaaggctcaagatatagaagcaggagatggcaccacatcagtagtcatcattgctggctccctcttagattcttgtaccaagcttcttcagaaagggattcatccaaccatcatttctgagtcattccagaaggccctggaaaagggcattgaaatcttgactgacatgtctcgacctgtggaactgagtgacagagaaactttgttaaatagtgcaaccacttcactgaactcaaaggtggtttctcagtattcaagtctgctttctccaatgagtgtaaatgcagtgatgaaagtgattgacccagccacagccaccagtgtagatcttagagatattaaaatagttaagaagcttggtgggacaattgatgactgtgagttggtggaagggctggttctcacccaaaaagtgtcaaattctggcataaccagagttgaaaaggccaagattgggcttattcagttttgcttatctgctcccaaaacagacatggataatcaaatagtggtttctgactatgcccagatggaccgagtgctgcgagaagagagagcctatattttaaatttagtgaagcaaattaaaaaaacaggatgtaatgtccttctcatacagaaatctattctaagagatgctcttagtgatcttgcattacactttctgaataaaatgaagatcatggtgattaaggatattgaaagagaagacattgaattcatttgtaagacaattggaaccaagccagttgctcatattgaccaatttactgctgacatgctgggttctgctgagttagctgaggaggtcaatttaaatggttctggcaaactgctcaagattacaggctgtgccagccctggaaaaacagttacaattgttgttcgtggttctaacaaactggtgattgaagaagctgagcgctccattcatgatgccctatgtgttattcgttgtttagtgaagaagagggctcttattgcaggaggtggtgctccagaaatagagttggccctacgattaactgaatattcacgaacactgagtggtatggaatcctactgcgttcgtgcttttgcagatgctatggaggtcattccatctacactagctgaaaatgccggcctgaatcccatttctacagtaacagaactaagaaaccggcatgcccagggagaaaaaactgcaggcattaatgtccgaaagggtggtatttccaacattttggaggaactggttgtccagcctctgttggtatcagtcagtgctctgactcttgcaactgaaactgttcggagcattctgaaaatagatgatgtggtaaacactcgataatctggataactgactagcaccattatgatcaccagtattgtggctggaatggaagaagatcaccttggtgttccttgtttggaagattatttcctctgaatttctgggcttggtcttccagttggcatttgcctgaagttgtattgaaacaatttaatgaaaatattaaatatttggtttcaaaaggcagatttatcttctcccaacattctgttatttctgatacttttgaaaaactaataaaaactaataaaagaacgatgcagcccagaccccccccctactttaatacacaataaatataaaaatccgcgcgcgcgcgc

SEQ ID NO: 279177 - DNA, 2085 bp, Homo sapiens
agcggcttctccgcctccgcctcctcccgacgccggcgccgctttctggaaggttcgtgaaggcagtgagggcttaccgttattacactgcggccggccagaatccgggtccatccgtccttcccgagccaacccagacacagcggagtttgccatgcccgagaatgtggcaccccggagcggggcgactgccggggctgccggcggccgcgggaaaggcgcctatcaggaccgcgacaagccagcccagatccgcttcagcaacatttccgccgccaaagcggttgctgatgctattagaacaagccttggaccaaaaggaatggataaaatgattcaagatggaaaaggtgatgtaaccattacaaatgatggtgctaccattctgaaacaaatgcaagtattacatccagcagccagaatgctggtggagctgtctaaggctcaagatatagaagcaggagatggcaccacatcagtagtcatcattgctggctccctcttagattcttgtaccaagcttcttcagaaagggattcatccaaccatcatttctgagtcattccagaaggccctggaaaagggcattgaaatcttgactgacatgtctcgacctgtggaactgagtgacagagaaactttgttaaatagtgcaaccacttcactgaactcaaaggtggtttctcagtattcaagtctgctttctccaatgagtgtaaatgcagtgatgaaagtgattgacccagccacagccaccagtgtagatcttagagatattaaaatagttaagaagcttggtgggacaattgatgactgtgagttggtggaagggctggttctcacccaaaaagtgtcaaattctggcataaccagagttgaaaaggccaagattgggcttattcagttttgcttatctgctcccaaaacagacatggataatcaaatagtggtttctgactatgcccagatggaccgagtgctgcgagaagagagagcctatattttaaatttagtgaagcaaattaaaaaaacaggatgtaatgtccttctcatacagaaatctattctaagagatgctcttagtgatcttgcattacactttctgaataaaatgaagatcatggtgattaaggatattgaaagagaagacattgaattcatttgtaagacaattggaaccaagccagttgctcatattgaccaatttactgctgacatgctgggttctgctgagttagctgaggaggtcaatttaaatggttctggcaaactgctcaagattacaggctgtgccagccctggaaaaacagttacaattgttgttcgtggttctaacaaactggtgattgaagaagctgagcgctccattcatgatgccctatgtgttattcgttgtttagtgaagaagagggctcttattgcaggaggtggtgctccagaaatagagttggccctacgattaactgaatattcacgaacactgagtggtatggaatcctactgcgttcgtgcttttgcagatgctatggaggtcattccatctacactagctgaaaatgccggcctgaatcccatttctacagtaacagaactaagaaaccggcatgcccagggagaaaaaactgcaggcattaatgtccgaaagggtggtatttccaacattttggaggaactggttgtccagcctctgttggtatcagtcagtgctctgactcttgcaactgaaactgttcggagcattctgaaaatagatgatgtggtaaacactcgataatctggataactgactagcaccattatgatcaccagtattgtggctggaatggaagaagatcaccttggtgttccttgtttggaagattatttcctctgaatttctgggcttggtcttccagttggcatttgcctgaagttgtattgaaacaatttaatgaaaatattaaatatttggtttcaaaaggcagatttatcttctcccaacattctgttatttctgatacttttgaaaaactaataaaaactaataaaagaacgatgcggccgtttattgtttggcataaattaggcgaggaaatataataatag

SEQ ID NO: 279178 - DNA, 2081 bp, Homo sapiens
agcggcttctccgcctccgcctcctcccgacgccggcgccgctttctggaaggttcgtgaaggcagtgagggcttaccgttattacactgcggccggccagaatccgggtccatccgtccttcccgagccaacccagacacagcggagtttgccatgcccgagaatgtggcaccccggagcggggcgactgccggggctgccggcggccgcgggaaaggcgcctatcaggaccgcgacaagccagcccagatccgcttcagcaacatttccgccgccaaagcggttgctgatgctattagaacaagccttggaccaaaaggaatggataaaatgattcaagatggaaaaggtgatgtaaccattacaaatgatggtgctaccattctgaaacaaatgcaagtattacatccagcagccagaatgctggtggagctgtctaaggctcaagatatagaagcaggagatggcaccacatcagtagtcatcattgctggctccctcttagattcttgtaccaagcttcttcagaaagggattcatccaaccatcatttctgagtcattccagaaggccctggaaaagggcattgaaatcttgactgacatgtctcgacctgtggaactgagtgacagagaaactttgttaaatagtgcaaccacttcactgaactcaaaggtggtttctcagtattcaagtctgctttctccaatgagtgtaaatgcagtgatgaaagtgattgacccagccacagccaccagtgtagatcttagagatattaaaatagttaagaagcttggtgggacaattgatgactgtgagttggtggaagggctggttctcacccaaaaagtgtcaaattctggcataaccagagttgaaaaggccaagattgggcttattcagttttgcttatctgctcccaaaacagacatggataatcaaatagtggtttctgactatgcccagatggaccgagtgctgcgagaagagagagcctatattttaaatttagtgaagcaaattaaaaaaacaggatgtaatgtccttctcatacagaaatctattctaagagatgctcttagtgatcttgcattacactttctgaataaaatgaagatcatggtgattaaggatattgaaagagaagacattgaattcatttgtaagacaattggaaccaagccagttgctcatattgaccaatttactgctgacatgctgggttctgctgagttagctgaggaggtcaatttaaatggttctggcaaactgctcaagattacaggctgtgccagccctggaaaaacagttacaattgttgttcgtggttctaacaaactggtgattgaagaagctgagcgctccattcatgatgccctatgtgttattcgttgtttagtgaagaagagggctcttattgcaggaggtggtgctccagaaatagagttggccctacgattaactgaatattcacgaacactgagtggtatggaatcctactgcgttcgtgcttttgcagatgctatggaggtcattccatctacactagctgaaaatgccggcctgaatcccatttctacagtaacagaactaagaaaccggcatgcccagggagaaaaaactgcaggcattaatgtccgaaagggtggtatttccaacattttggaggaactggttgtccagcctctgttggtatcagtcagtgctctgactcttgcaactgaaactgttcggagcattctgaaaatagatgatgtggtaaacactcgataatctggataactgactagcaccattatgatcaccagtattgtggctggaatggaagaagatcaccttggtgttccttgtttggaagattatttcctctgaatttctgggcttggtcttccagttggcatttgcctgaagttgtattgaaacaatttaatgaaaatattaaatatttggtttcaaaaggcagatttatcttctcccaacattctgttatttctgatacttttgaaaaactaataaaaactaataaaagaatgcggcagcgcacaataaacattaaatgaagcggaattaaataatgcag

SEQ ID NO: 279179 - DNA, 2090 bp, Homo sapiens
agcggcttctccgcctccgcctcctcccgacgccggcgccgctttctggaaggttcgtgaaggcagtgagggcttaccgttattacactgcggccggccagaatccgggtccatccgtccttcccgagccaacccagacacagcggagtttgccatgcccgagaatgtggcaccccggagcggggcgactgccggggctgccggcggccgcgggaaaggcgcctatcaggaccgcgacaagccagcccagatccgcttcagcaacatttccgccgccaaagcggttgctgatgctattagaacaagccttggaccaaaaggaatggataaaatgattcaagatggaaaaggtgatgtaaccattacaaatgatggtgctaccattctgaaacaaatgcaagtattacatccagcagccagaatgctggtggagctgtctaaggctcaagatatagaagcaggagatggcaccacatcagtagtcatcattgctggctccctcttagattcttgtaccaagcttcttcagaaagggattcatccaaccatcatttctgagtcattccagaaggccctggaaaagggcattgaaatcttgactgacatgtctcgacctgtggaactgagtgacagagaaactttgttaaatagtgcaaccacttcactgaactcaaaggtggtttctcagtattcaagtctgctttctccaatgagtgtaaatgcagtgatgaaagtgattgacccagccacagccaccagtgtagatcttagagatattaaaatagttaagaagcttggtgggacaattgatgactgtgagttggtggaagggctggttctcacccaaaaagtgtcaaattctggcataaccagagttgaaaaggccaagattgggcttattcagttttgcttatctgctcccaaaacagacatggataatcaaatagtggtttctgactatgcccagatggaccgagtgctgcgagaagagagagcctatattttaaatttagtgaagcaaattaaaaaaacaggatgtaatgtccttctcatacagaaatctattctaagagatgctcttagtgatcttgcattacactttctgaataaaatgaagatcatggtgattaaggatattgaaagagaagacattgaattcatttgtaagacaattggaaccaagccagttgctcatattgaccaatttactgctgacatgctgggttctgctgagttagctgaggaggtcaatttaaatggttctggcaaactgctcaagattacaggctgtgccagccctggaaaaacagttacaattgttgttcgtggttctaacaaactggtgattgaagaagctgagcgctccattcatgatgccctatgtgttattcgttgtttagtgaagaagagggctcttattgcaggaggtggtgctccagaaatagagttggccctacgattaactgaatattcacgaacactgagtggtatggaatcctactgcgttcgtgcttttgcagatgctatggaggtcattccatctacactagctgaaaatgccggcctgaatcccatttctacagtaacagaactaagaaaccggcatgcccagggagaaaaaactgcaggcattaatgtccgaaagggtggtatttccaacattttggaggaactggttgtccagcctctgttggtatcagtcagtgctctgactcttgcaactgaaactgttcggagcattctgaaaatagatgatgtggtaaacactcgataatctggataactgactagcaccattatgatcaccagtattgtggctggaatggaagaagatcaccttggtgttccttgtttggaagattatttcctctgaatttctgggcttggtcttccagttggcatttgcctgaagttgtattgaaacaatttaatgaaaatattaaatatttggtttcaaaaggcagatttatcttctcccaacattctgttatttctgatacttttgaaaaactaataaaaactaataaaagaatctcgcatgcgggccggcggccccccccgtacgtctcttacatacacgacattattga

SEQ ID NO: 279180 - DNA, 2559 bp, Homo sapiens
  misc_feature (162)..(162): n is a, c, g, or t
gcagaccgtcgtgatctgaccaggcccatcgagacgcatccgtggtcttgtcgctgtatcagtgggcgcgctcacatgtccatcatgtattccactttcactaacctctcctgacataatgaactctgtgcatgtctcgcataatgtaaggctaaccttggnaggctcactcgacctcgtggtggcgtggcggtccgcgcccgttggtgacaggcagccatcaatcatgtgaccagttacaaagcacaagacccaagaatccagcattcagcaacatttccgccgccaaagcggttgctgatgctattagaacaagccttggaccaaaaggaatggataaaatgattcaagatggaaaaggtgatgtaaccattacaaatgatggtgctaccattctgaaacaaatgcaagtattacatccagcagccagaatgctggtggagctgtctaaggctcaagatatagaagcaggagatggcaccacatcagtagtcatcattgctggctccctcttagattcttgtaccaagcttcttcagaaagggattcatccaaccatcatttctgagtcattccagaaggccctggaaaagggcattgaaatcttgactgacatgtctcgacctgtggaactgagtgacagagaaactttgttaaatagtgcaaccacttcactgaactcaaaggtggtttctcagtattcaagtctgctttctccaatgagtgtaaatgcagtgatgaaagtgattgacccagccacagccaccagtgtagatcttagagatattaaaatagttaagaagcttggtgggacaattgatgactgtgagttggtggaagggctggttctcacccaaaaagtgtcaaattctggcataaccagagttgaaaaggccaagattgggcttattcagttttgcttatctgctcccaaaacagacatggataatcaaatagtggtttctgactatgcccagatggaccgagtgctgcgagaagagagagcctatattttaaatttagtgaagcaaattaaaaaaacaggatgtaatgtccttctcatacagaaatctattctaagagatgctcttagtgatcttgcattacactttctgaataaaatgaagatcatggtgattaaggatattgaaagagaagacattgaattcatttgtaagacaattggaaccaagccagttgctcatattgaccaatttactgctgacatgctgggttctgctgagttagctgaggaggtcaatttaaatggttctggcaaactgctcaagattacaggctgtgccagccctggaaaaacagttacaattgttgttcgtggttctaacaaactggtgattgaagaagctgagcgctccattcatgatgccctatgtgttattcgttgtttagtgaagaagagggctcttattgcaggaggtggtgctccagaaatagagttggccctacgattaactgaatattcacgaacactgagtggtatggaatcctactgcgttcgtgcttttgcagatgctatggaggtcattccatctacactagctgaaaatgccggcctgaatcccatttctacagtaacagaactaagaaaccggcatgcccagggagaaaaaactgcaggcattaatgtccgaaagggtggtatttccaacattttggaggaactggttgtccagcctctgttggtatcagtcagtgctctgactcttgcaactgaaactgttcggagcattctgaaaatagatgatgtggtaaacactcgataatctggataactgactagcaccattatgatcaccagtattgtggctggaatggaagaagatcaccttggtgttccttgtttggaagattatttcctctgaatttctgggcttggtcttccagttggcatttgcctgaagttgtattgaaacaatttaatgaaaatattaaatatttggtttcaaaaggcagatttatcttctcccaacattctgttatttctgatacttttgaaaaactaataaaaactaataaaagaagcgtaaaaagtgagtttacatgttgaggaaaaaaatggcccaatatgctcatcactgataaatgctccctggccttaaaaactaccaacatataatatatatgctgtcttaaaagttaatgatccaagtggcacctctctgaacctactttggcttgggaggctgcccagttaaaacaaaaataagttaatggtacagaaagagaatgaaaaatgaaagcctccttttatcctatcatcctaattccttttcccagtaataatgactgctgtgttggattccttctgcaaataaaagtgtatacagtaaaaaaaaacgaagaaaaaaaaaaaacaaaaaaaaacacaaaaagaacaaaagaaaagaaacaaagaaaaaaaaaaagacaatcaagaaaaaaacaaaaaagaacatcaaaacacaaacaacaaaaaaaaaaaagaaagggggggggccaacatgaaaaccaacaggaggagacgcaaaagagacaacgcgagaggagaaaagccgcaaa

SEQ ID NO: 279181 - DNA, 1962 bp, Homo sapiens
agcggcttctccgcctccgcctcctcccgacgccggcgccgctttctggaaggttcgtgaaggcagtgagggcttaccgttattacactgcggccggccagaatccgggtccatccgtccttcccgagccaacccagacacagcggagtttgccatgcccgagaatgtggcaccccggagcggggcgactgccggggctgccggcggccgcgggaaaggcgcctatcaggaccgcgacaagccagcccagatccgcttcagcaacatttccgccgccaaagcggttgctgatgctattagaacaagccttggaccaaaaggaatggataaaatgattcaagatggaaaaggtgatgtaaccattacaaatgatggtgctaccattctgaaacaaatgcaagtattacatccagcagccagaatgctggtggagctgtctaaggctcaagatatagaagcaggagatggcaccacatcagtagtcatcattgctggctccctcttagattcttgtaccaagcttcttcagaaagggattcatccaaccatcatttctgagtcattccagaaggccctggaaaagggcattgaaatcttgactgacatgtctcgacctgtggaactgagtgacagagaaactttgttaaatagtgcaaccacttcactgaactcaaaggtggtttctcagtattcaagtctgctttctccaatgagtgtaaatgcagtgatgaaagtgattgacccagccacagccaccagtgtagatcttagagatattaaaatagttaagaagcttggtgggacaattgatgactgtgagttggtggaagggctggttctcacccaaaaagtgtcaaattctggcataaccagagttgaaaaggccaagattgggcttattcagttttgcttatctgctcccaaaacagacatggataatcaaatagtggtttctgactatgcccagatggaccgagtgctgcgagaagagagagcctatattttaaatttagtgaagcaaattaaaaaaacaggatgtaatgtccttctcatacagaaatctattctaagagatgctcttagtgatcttgcattacactttctgaataaaatgaagatcatggtgattaaggatattgaaagagaagacattgaattcatttgtaagacaattggaaccaagccagttgctcatattgaccaatttactgctgacatgctgggttctgctgagttagctgaggaggtcaatttaaatggttctggcaaactgctcaagattacaggctgtgccagccctggaaaaacagttacaattgttgttcgtggttctaacaaactggtgattgaagaagctgagcgctccattcatgatgccctatgtgttattcgttgtttagtgaagaagagggctcttattgcaggaggtggtgctccagaaatagagttggccctacgattaactgaatattcacgaacactgagtggtatggaatcctactgcgttcgtgcttttgcagatgctatggaggtcattccatctacactagctgaaaatgccggcctgaatcccatttctacagtaacagaactaagaaaccggcatgcccagggagaaaaaactgcaggcattaatgtccgaaagggtggtatttccaacattttggaggaactggttgtccagcctctgttggtatcagtcagtgctctgactcttgcaactgaaactgttcggagcattctgaaaatagatgatgtggtaaacactcgataatctggataactgactagcaccattatgatcaccagtattgtggctggaatggaagaagatcaccttggtgttccttgtttggaagattatttcctctgaatttctgggcttggtcttccagttggcatttgcctgaagttgtattgaaacaatttaatgaaaatattaaatatttggtttcaaaaggc

SEQ ID NO: 279182 - DNA, 2446 bp, Homo sapiens
agcggcttctccgcctccgcctcctcccgacgccggcgccgctttctggaaggttcgtgaaggcagtgagggcttaccgttattacactgcggccggccagaatccgggtccatccgtccttcccgagccaacccagacacagcggagtttgccatgcccgagaatgtggcaccccggagcggggcgactgccggggctgccggcggccgcgggaaaggcgcctatcaggaccgcgacaagccagcccagatccgcttcagcaacatttccgccgccaaagcggttgctgatgctattagaacaagccttggaccaaaaggaatggataaaatgattcaagatggaaaaggtgatgtaaccattacaaatgatggtgctaccattctgaaacaaatgcaagtattacatccagcagccagaatgctggtgggattcatccaaccatcatttctgagtcattccagaaggccctggaaaagggcattgaaatcttgactgacatgtctcgacctgtggaactgagtgacagagaaactttgttaaatagtgcaaccacttcactgaactcaaaggtggtttctcagtattcaagtctgctttctccaatgagtgtaaatgcagtgatgaaagtgattgacccagccacagccaccagtgtagatcttagagatattaaaatagttaagaagcttggtgggacaattgatgactgtgagttggtggaagggctggttctcacccaaaaagtgtcaaattctggcataaccagagttgaaaaggccaagattgggcttattcagttttgcttatctgctcccaaaacagacatggataatcaaatagtggtttctgactatgcccagatggaccgagtgctgcgagaagagagagcctatattttaaatttagtgaagcaaattaaaaaaacaggatgtaatgtccttctcatacagaaatctattctaagagatgctcttagtgatcttgcattacactttctgaataaaatgaagatcatggtgattaaggatattgaaagagaagacattgaattcatttgtaagacaattggaaccaagccagttgctcatattgaccaatttactgctgacatgctgggttctgctgagttagctgaggaggtcaatttaaatggttctggcaaactgctcaagattacaggctgtgccagccctggaaaaacagttacaattgttgttcgtggttctaacaaactggtgattgaagaagctgagcgctccattcatgatgccctatgtgttattcgttgtttagtgaagaagagggctcttattgcaggaggtggtgctccagaaatagagttggccctacgattaactgaatattcacgaacactgagtggtatggaatcctactgcgttcgtgcttttgcagatgctatggaggtcattccatctacactagctgaaaatgccggcctgaatcccatttctacagtaacagaactaagaaaccggcatgcccagggagaaaaaactgcaggcattaatgtccgaaagggtggtatttccaacattttggaggaactggttgtccagcctctgttggtatcagtcagtgctctgactcttgcaactgaaactgttcggagcattctgaaaatagatgatgtggtaaacactcgataatctggataactgactagcaccattatgatcaccagtattgtggctggaatggaagaagatcaccttggtgttccttgtttggaagattatttcctctgaatttctgggcttggtcttccagttggcatttgcctgaagttgtattgaaacaatttaatgaaaatattaaatatttggtttcaaaaggcagatttatcttctcccaacattctgttatttctgatacttttgaaaaactaataaaaactaataaaagaagcgtaaaaagtgagtttacatgttgaggaaaaaaatggcccaatatgctcatcactgataaatgctccctggccttaaaaactaccaacatataatatatatgctgtcttaaaagttaatgatccaagtggcacctctctgaacctactttggcttgggaggctgcccagttaaaacaaaaataagttaatggtacagaaagagaatgaaaaatgaaagcctccttttatcctatcatcctaattccttttcccagtaataatgactgctgtgttggattccttctgcaaataaaagtgtatacagtaaaaaaaaacgaagaaaaaaaaaaaacaaaaaaaaacacaaaaagaacaaaagaaaagaaacaaagaaaaaaaaaaagacaatcaagaaaaaaacaaaaaagaacatcaaaacacaaacaacaaaaaaaaaaaagaaagggggggggccaacatgaaaaccaacaggaggagacgcaaaagagacaacgcgagaggagaaaagccgcaaa

SEQ ID NO: 279183 - DNA, 2017 bp, Homo sapiens
agcggcttctccgcctccgcctcctcccgacgccggcgccgctttctggaaggttcgtgaaggcagtgagggcttaccgttattacactgcggccggccagaatccgggtccatccgtccttcccgagccaacccagacacagcggagtttgccatgcccgagaatgtggcaccccggagcggggcgactgccggggctgccggcggccgcgggaaaggcgcctatcaggaccgcgacaagccagcccagatccgcttcagcaacatttccgccgccaaagcggttgctgatgctattagaacaagccttggaccaaaaggaatggataaaatgattcaagatggaaaaggtgatgtaaccattacaaatgatggtgctaccattctgaaacaaatgcaagtattacatccagcagccagaatgctggtggagctgtctaaggctcaagatatagaagcaggagatggcaccacatcagtagtcatcattgctggctccctcttagattcttgtaccaagcttcttcagaaagggattcatccaaccatcatttctgagtcattccagaaggccctggaaaagggcattgaaatcttgactgacatgtctcgacctgtggaactgagtgacagagaaactttgttaaatagtgcaaccacttcactgaactcaaaggtggtttctcagtattcaagtctgctttctccaatgagtgtaaatgcagtgatgaaagtgattgacccagccacagccaccagtgtagatcttagagatattaaaatagttaagaagcttggtgggacaattgatgactgtgagttggtggaagggctggttctcacccaaaaagtgtcaaattctggcataaccagagttgaaaaggccaagattgggcttattcagttttgcttatctgctcccaaaacagacatggataatcaaatagtggtttctgactatgcccagatggaccgagtgctgcgagaagagagagcctatattttaaatttagtgaagcaaattaaaaaaacaggatgtaatgtccttctcatacagaaatctattctaagagatgctcttagtgatcttgcattacactttctgaataaaatgaagatcatggtgattaaggatattgaaagagaagacattgaattcatttgtaagacaattggaaccaagccagttgctcatattgaccaatttactgctgacatgctgggttctgctgagttagctgaggaggtcaatttaaatggttctggcaaactgctcaagattacaggctgtgccagccctggaaaaacagttacaattgttgttcgtggttctaacaaactggtgattgaagaagctgagcgctccattcatgatgccctatgtgttattcgttgtttagtgaagaagagggctcttattgcaggaggtggtgctccagaaatagagttggccctacgattaactgaatattcacgaacactgagtggtatggaatcctactgcgttcgtgcttttgcagatgctatggaggtcattccatctacactagctgaaaatgccggcctgaatcccatttctacagtaacagaactaagaaaccggcatgcccagggagaaaaaactgcaggcattaatgtccgaaagggtggtatttccaacattttggaggaactggttgtccagcctctgttggtatcagtcagtgctctgactcttgcaactgaaactgttcggagcattctgaaaatagatgatgtggtaaacactcgataatctggataactgactagcaccattatgatcaccagtattgtggctggaatggaagaagatcaccttggtgttccttgtttggaagattatttcctctgaatttctgggcttggtcttccagttggcatttgcctgaagttgtattgaaacaatttaatgaaaatattaaatatttggtttcaaaaggccaaaaaaaaaaaaaagggagccgctcgcgatctagaactagtcgacgcgtgggtc

SEQ ID NO: 279184 - DNA, 1556 bp, Homo sapiens
  misc_feature (65)..(65): n is a, c, g, or t
tttaagggtggatattatttaagaaagaagagggaaggaccatagctgaacgactctcttaatcntccaccgctacagagatgctcttagtgatcttgcattacactttctgaataaaatgaagatcatggtgattaaggatattgaaagagaagacattgaattcatttgtaagacaattggaaccaagccagttgctcatattgaccaatttactgctgacatgctgggttctgctgagttagctgaggaggtcaatttaaatggttctggcaaactgctcaagattacaggctgtgccagccctggaaaaacagttacaattgttgttcgtggttctaacaaactggtgattgaagaagctgagcgctccattcatgatgccctatgtgttattcgttgtttagtgaagaagagggctcttattgcaggaggtggtgctccagaaatagagttggccctacgattaactgaatattcacgaacactgagtggtatggaatcctactgcgttcgtgcttttgcagatgctatggaggtcattccatctacactagctgaaaatgccggcctgaatcccatttctacagtaacagaactaagaaaccggcatgcccagggagaaaaaactgcaggcattaatgtccgaaagggtggtatttccaacattttggaggaactggttgtccagcctctgttggtatcagtcagtgctctgactcttgcaactgaaactgttcggagcattctgaaaatagatgatgtggtaaacactcgataatctggataactgactagcaccattatgatcaccagtattgtggctggaatggaagaagatcaccttggtgttccttgtttggaagattatttcctctgaatttctgggcttggtcttccagttggcatttgcctgaagttgtattgaaacaatttaatgaaaatattaaatatttggtttcaaaaggcagatttatcttctcccaacattctgttatttctgatacttttgaaaaactaataaaaactaataaaagaagcgtaaaaagtgagtttacatgttgaggaaaaaaatggcccaatatgctcatcactgataaatgctccctggccttaaaaactaccaacatataatatatatgctgtcttaaaagttaatgatccaagtggcacctctctgaacctactttggcttgggaggctgcccagttaaaacaaaaataagttaatggtacagaaagagaatgaaaaatgaaagcctccttttatcctatcatcctaattccttttcccagtaataatgactgctgtgttggattccttctgcaaataaaagtgtatacagtaaaaaaaaacgaagaaaaaaaaaaaacaaaaaaaaacacaaaaagaacaaaagaaaagaaacaaagaaaaaaaaaaagacaatcaagaaaaaaacaaaaaagaacatcaaaacacaaacaacaaaaaaaaaaaagaaagggggggggccaacatgaaaaccaacaggaggagacgcaaaagagacaacgcgagaggagaaaagccgcaaa

SEQ ID NO: 279185 - DNA, 2509 bp, Homo sapiens
agcggcttctccgcctccgcctcctcccgacgccggcgccgctttctggaaggttcgtgaaggcagtgagggcttaccgttattacactgcggccggccagaatccgggtccatccgtccttcccgagccaacccagacacagcggagtttgccatgcccgagaatgtggcaccccggagcggggcgactgccggggctgccggcggccgcgggaaaggcgcctatcaggaccgcgacaagccagcccagatccgcttcagcaacatttccgccgccaaagcggttgctgatgctattagaacaagccttggaccaaaaggaatggataaaatgattcaagatggaaaaggtgatgtaaccattacaaatgatggtgctaccattctgaaacaaatgcaagtattacatccagcagccagaatgctggtggagctgtctaaggctcaagatatagaagcaggagatggcaccacatcagtagtcatcattgctggctccctcttagattcttgtaccaagcttcttcagaaagggattcatccaaccatcatttctgagtcattccagaaggccctggaaaagggcattgaaatcttgactgacatgtctcgacctgtggaactgagtgacagagaaactttgttaaatagtgcaaccacttcactgaactcaaaggtggtttctcagtattcaagtctgctttctccaatgagtgtaaatgcagtgatgaaagtgattgacccagccacagccaccagtgtagatcttagagatattaaaatagttaagaagcttggtgggacaattgatgactgtgagttggtggaagggctggttctcacccaaaaagtgtcaaattctggcataaccagagttgaaaaggccaagattgggcttattcagttttgcttatctgctcccaaaacagacatggataatcaaatagtggtttctgactatgcccagatggaccgagtgctgcgagaagagagagcctatattttaaatttagtgaagcaaattaaaaaaacaggatgtaatgtccttctcatacagaaatctattctaagagatgctcttagtgatcttgcattacactttctgaataaaatgaagatcatggtgattaaggatattgaaagagaagacattgaattcatttgtaagacaattggaaccaagccagttgctcatattgaccaatttactgctgacatgctgggttctgctgagttagctgaggaggtcaatttaaatggttctggcaaactgctcaagattacaggctgtgccagccctggaaaaacagttacaattgttgttcgtggttctaacaaactggtgattgaagaagctgagcgctccattcatgatgccctatgtgttattcgttgtttagtgaagaagagggctcttattgcaggaggtggtgctccagaaatagagttggccctacgattaactgaatattcacgaacactgagtggtatggaatcctactgcgttcgtgcttttgcagatgctatggaggtcattccatctacactagctgaaaatgccggcctgaatcccatttctacagtaacagaactaagaaaccggcatgcccagggagaaaaaactgcaggcattaatgtccgaaagggtggtatttccaacattttggaggaactggttgtccagcctctgttggtatcagtcagtgctctgactcttgcaactgaaactgttcggagcattctgaaaatagatgatgtatgatcaccagtattgtggctggaatggaagaagatcaccttggtgttccttgtttggaagattatttcctctgaatttctgggcttggtcttccagttggcatttgcctgaagttgtattgaaacaatttaatgaaaatattaaatatttggtttcaaaaggcagatttatcttctcccaacattctgttatttctgatacttttgaaaaactaataaaaactaataaaagaagcgtaaaaagtgagtttacatgttgaggaaaaaaatggcccaatatgctcatcactgataaatgctccctggccttaaaaactaccaacatataatatatatgctgtcttaaaagttaatgatccaagtggcacctctctgaacctactttggcttgggaggctgcccagttaaaacaaaaataagttaatggtacagaaagagaatgaaaaatgaaagcctccttttatcctatcatcctaattccttttcccagtaataatgactgctgtgttggattccttctgcaaataaaagtgtatacagtaaaaaaaaacgaagaaaaaaaaaaaacaaaaaaaaacacaaaaagaacaaaagaaaagaaacaaagaaaaaaaaaaagacaatcaagaaaaaaacaaaaaagaacatcaaaacacaaacaacaaaaaaaaaaaagaaagggggggggccaacatgaaaaccaacaggaggagacgcaaaagagacaacgcgagaggagaaaagccgcaaa

SEQ ID NO: 279186 - DNA, 1500 bp, Homo sapiens
tatacggctagtgcgaggccagagatgctcttagtgatcttgcattacactttctgaataaaatgaagatcatggtgattaaggatattgaaagagaagacattgaattcatttgtaagacaattggaaccaagccagttgctcatattgaccaatttactgctgacatgctgggttctgctgagttagctgaggaggtcaatttaaatggttctggcaaactgctcaagattacaggctgtgccagccctggaaaaacagttacaattgttgttcgtggttctaacaaactggtgattgaagaagctgagcgctccattcatgatgccctatgtgttattcgttgtttagtgaagaagagggctcttattgcaggaggtggtgctccagaaatagagttggccctacgattaactgaatattcacgaacactgagtggtatggaatcctactgcgttcgtgcttttgcagatgctatggaggtcattccatctacactagctgaaaatgccggcctgaatcccatttctacagtaacagaactaagaaaccggcatgcccagggagaaaaaactgcaggcattaatgtccgaaagggtggtatttccaacattttggaggaactggttgtccagcctctgttggtatcagtcagtgctctgactcttgcaactgaaactgttcggagcattctgaaaatagatgatgtggtaaacactcgataatctggataactgactagcaccattatgatcaccagtattgtggctggaatggaagaagatcaccttggtgttccttgtttggaagattatttcctctgaatttctgggcttggtcttccagttggcatttgcctgaagttgtattgaaacaatttaatgaaaatattaaatatttggtttcaaaaggcagatttatcttctcccaacattctgttatttctgatacttttgaaaaactaataaaaactaataaaagaagcgtaaaaagtgagtttacatgttgaggaaaaaaatggcccaatatgctcatcactgataaatgctccctggccttaaaaactaccaacatataatatatatgctgtcttaaaagttaatgatccaagtggcacctctctgaacctactttggcttgggaggctgcccagttaaaacaaaaataagttaatggtacagaaagagaatgaaaaatgaaagcctccttttatcctatcatcctaattccttttcccagtaataatgactgctgtgttggattccttctgcaaataaaagtgtatacagtaaaaaaaaacgaagaaaaaaaaaaaacaaaaaaaaacacaaaaagaacaaaagaaaagaaacaaagaaaaaaaaaaagacaatcaagaaaaaaacaaaaaagaacatcaaaacacaaacaacaaaaaaaaaaaagaaagggggggggccaacatgaaaaccaacaggaggagacgcaaaagagacaacgcgagaggagaaaagccgcaaa

SEQ ID NO: 279187 - DNA, 1767 bp, Homo sapiens
gtacattttaatactggaattgtactaaaatttccaatagaattggaaatcttaattttgaccttacgaacttagtaaactaaagcatttttcttcagaaataatgattggccatttaagaaacagtaattaaaaccttaaaggcatttgaagagcaaaatttttttaatctagcattgacataatcactgattttgtattttagagatgctcttagtgatcttgcattacactttctgaataaaatgaagatcatggtgattaaggatattgaaagagaagacattgaattcatttgtaaggtaaaacattaacatctgtatttgtggaaaatgtctgataattagataaatgtcttaatttgtggatttgactgttttttccagacaattggaaccaagccagttgctcatattgaccaatttactgctgacatgctgggttctgctgagttagctgaggaggtcaatttaaatggttctggcaaactgctcaagattacaggctgtgccagccctggaaaaacagttacaattgttgttcgtggttctaacaaactggtgattgaagaagctgagcgctccattcatgatgccctatgtgttattcgttgtttagtgaagaagagggctcttattgcaggaggtggtgctccagaaatagagttggccctacgattaactgaatattcacgaacactgagtggtatggaatcctactgcgttcgtgcttttgcagatgctatggaggtcattccatctacactagctgaaaatgccggcctgaatcccatttctacagtaacagaactaagaaaccggcatgcccagggagaaaaaactgcaggcattaatgtccgaaagggtggtatttccaacattttggaggaactggttgtccagcctctgttggtatcagtcagtgctctgactcttgcaactgaaactgttcggagcattctgaaaatagatgatgtggtaaacactcgataatctggataactgactagcaccattatgatcaccagtattgtggctggaatggaagaagatcaccttggtgttccttgtttggaagattatttcctctgaatttctgggcttggtcttccagttggcatttgcctgaagttgtattgaaacaatttaatgaaaatattaaatatttggtttcaaaaggcagatttatcttctcccaacattctgttatttctgatacttttgaaaaactaataaaaactaataaaagaagcgtaaaaagtgagtttacatgttgaggaaaaaaatggcccaatatgctcatcactgataaatgctccctggccttaaaaactaccaacatataatatatatgctgtcttaaaagttaatgatccaagtggcacctctctgaacctactttggcttgggaggctgcccagttaaaacaaaaataagttaatggtacagaaagagaatgaaaaatgaaagcctccttttatcctatcatcctaattccttttcccagtaataatgactgctgtgttggattccttctgcaaataaaagtgtatacagtaaaaaaaaacgaagaaaaaaaaaaaacaaaaaaaaacacaaaaagaacaaaagaaaagaaacaaagaaaaaaaaaaagacaatcaagaaaaaaacaaaaaagaacatcaaaacacaaacaacaaaaaaaaaaaagaaagggggggggccaacatgaaaaccaacaggaggagacgcaaaagagacaacgcgagaggagaaaagccgcaaa

SEQ ID NO: 279188 - DNA, 1518 bp, Homo sapiens
  misc_feature (1381)..(1381): n is a, c, g, or t
  misc_feature (1383)..(1383): n is a, c, g, or t
agcggcttctccgcctccgcctcctcccgacgccggcgccgctttctggaaggttcgtgaaggcagtgagggcttaccgttattacactgcggccggccagaatccgggtccatccgtccttcccgagccaacccagacacagcggagtttgccatgcccgagaatgtggcaccccggagcggggcgactgccggggctgccggcggccgcgggaaaggcgcctatcaggaccgcgacaagccagcccagatccgcttcagcaacatttccgccgccaaagcggttgctgatgctattagaacaagccttggaccaaaaggaatggataaaatgattcaagatggaaaaggtgatgtaaccattacaaatgatggtgctaccattctgaaacaaatgcaagtattacatccagcagccagaatgctggtggagctgtctaaggctcaagatatagaagcaggagatggcaccacatcagtagtcatcattgctggctccctcttagattcttgtaccaagcttcttcagaaagggattcatccaaccatcatttctgagtcattccagaaggccctggaaaagggcattgaaatcttgactgacatgtctcgacctgtggaactgagtgacagagaaactttgttaaatagtgcaaccacttcactgaactcaaaggtggtttctcagtattcaagtctgctttctccaatgagtgtaaatgcagtgatgaaagtgattgacccagccacagccaccagtgtagatcttagagatattaaaatagttaagaagcttggtgggacaattgatgactgtgagttggtggaagggctggttctcacccaaaaagtgtcaaattctggcataaccagagttgaaaaggccaagattgggcttattcagttttgcttatctgctcccaaaacagacatggataatcaaatagtggtttctgactatgcccagatggaccgagtgctgcgagaagagagagcctatattttaaatttagtgaagcaaattaaaaaaacaggatgtaatgtccttctcatacagaaatctattctaagagatgctcttagtgatcttgcattacactttctgaataaaatgaagatcatggtgattaaggatattgaaagagaagacattgaattcatttgtaagacaattggaaccaagccagttgctcatattgaccaatttactgctgacatgctgggttctgctgagttagctgaggaggtcaatttaaatggttctggcaaactgctcaagattacaggctgtgccagccctggaaaaacagttacaattgttgttcgtggttctaacaaactggtgattgaagaagctgagcgctccattcatgatgcccangngtatcggggttaggcacacaagggcctatgggggagggggcccaaaatgagttgcccgatacgagattcaaaagacggttggaccaagggcggctgaagcggggaccccacaggcaaggggaaccttcgcaaacg

SEQ ID NO: 279189 - DNA, 1382 bp, Homo sapiens
  misc_feature (77)..(77): n is a, c, g, or t
  misc_feature (80)..(80): n is a, c, g, or t
  misc_feature (91)..(91): n is a, c, g, or t
  misc_feature (105)..(105): n is a, c, g, or t
  misc_feature (108)..(109): n is a, c, g, or t
aagtcttccatcttgtaccaagtggtcaagcagtggtgatggtcccatttttgtggcaggcggttcggttgagtagngangaggtcaattnaatggtttggcaantgnnaagattacaggctgtgccagccctggaaaaacagttacaattgttgttcgtggttctaacaaactggtgattgaagaagctgagcgctccattcatgatgccctatgtgttattcgttgtttagtgaagaagagggctcttattgcaggaggtggtgctccagaaatagagttggccctacgattaactgaatattcacgaacactgagtggtatggaatcctactgcgttcgtgcttttgcagatgctatggaggtcattccatctacactagctgaaaatgccggcctgaatcccatttctacagtaacagaactaagaaaccggcatgcccagggagaaaaaactgcaggcattaatgtccgaaagggtggtatttccaacattttggaggaactggttgtccagcctctgttggtatcagtcagtgctctgactcttgcaactgaaactgttcggagcattctgaaaatagatgatgtggtaaacactcgataatctggataactgactagcaccattatgatcaccagtattgtggctggaatggaagaagatcaccttggtgttccttgtttggaagattatttcctctgaatttctgggcttggtcttccagttggcatttgcctgaagttgtattgaaacaatttaatgaaaatattaaatatttggtttcaaaaggcagatttatcttctcccaacattctgttatttctgatacttttgaaaaactaataaaaactaataaaagaagcgtaaaaagtgagtttacatgttgaggaaaaaaatggcccaatatgctcatcactgataaatgctccctggccttaaaaactaccaacatataatatatatgctgtcttaaaagttaatgatccaagtggcacctctctgaacctactttggcttgggaggctgcccagttaaaacaaaaataagttaatggtacagaaagagaatgaaaaatgaaagcctccttttatcctatcatcctaattccttttcccagtaataatgactgctgtgttggattccttctgcaaataaaagtgtatacagtaaaaaaaaacgaagaaaaaaaaaaaacaaaaaaaaacacaaaaagaacaaaagaaaagaaacaaagaaaaaaaaaaagacaatcaagaaaaaaacaaaaaagaacatcaaaacacaaacaacaaaaaaaaaaaagaaagggggggggccaacatgaaaaccaacaggaggagacgcaaaagagacaacgcgagaggagaaaagccgcaaa

SEQ ID NO: 279190 - DNA, 1010 bp, Homo sapiens
agcggcttctccgcctccgcctcctcccgacgccggcgccgctttctggaaggttcgtgaaggcagtgagggcttaccgttattacactgcggccggccagaatccgggtccatccgtccttcccgagccaacccagacacagcggagtttgccatgcccgagaatgtggcaccccggagcggggcgactgccggggctgccggcggccgcgggaaaggcgcctatcaggaccgcgacaagccagcccagatccgcttcagcaacatttccgccgccaaagcggttgctgatgctattagaacaagccttggaccaaaaggaatggataaaatgattcaagatggaaaaggtgatgtaaccattacaaatgatggtgctaccattctgaaacaaatgcaagtattacatccagcagccagaatgctggtggagctgtctaaggctcaagatatagaagcaggagatggcaccacatcagtagtcatcattgctggctccctcttagattcttgtaccaagcttcttcagaaagggattcatccaaccatcatttctgagtcattccagaaggccctggaaaagggcattgaaatcttgactgacatgtctcgacctgtggaactgagtgacagagaaactttgttaaatagtgcaaccacttcactgaactcaaaggtggtttctcagtattcaagtctgctttctccaatgagtgtaaatgcagtgatgaaagtgattgacccagccacagccaccagtgtagatcttagagatattaaaatagttaagaagcttggtgggacaattgatgactgtgagttggtggaagggctggttctcacccaaaaagtgtcaaattctggcataaccagagttgaaaaggccaagattgggcttattcagttttgcttatctgctcccaaaacagacatggataatcaaatagtggtttctgactatgcccagatggaccgaatgttcaggtaccagctcgattctatcatgtcta

SEQ ID NO: 279191 - DNA, 1036 bp, Homo sapiens
gcggccgcctactactactaaattcgcggccgcgtcgacgaaaatgccggcctgaatcccatttctacagtaacagaactaagaaaccggcatgcccagggagaaaaaactgcaggcattaatgtccgaaagggtggtatttccaacattttggaggaactggttgtccagcctctgttggtatcagtcagtgctctgactcttgcaactgaaactgttcggagcattctgaaaatagatgatgtggtaaacactcgataatctggataactgactagcaccattatgatcaccagtattgtggctggaatggaagaagatcaccttggtgttccttgtttggaagattatttcctctgaatttctgggcttggtcttccagttggcatttgcctgaagttgtattgaaacaatttaatgaaaatattaaatatttggtttcaaaaggcagatttatcttctcccaacattctgttatttctgatacttttgaaaaactaataaaaactaataaaagaagcgtaaaaagtgagtttacatgttgaggaaaaaaatggcccaatatgctcatcactgataaatgctccctggccttaaaaactaccaacatataatatatatgctgtcttaaaagttaatgatccaagtggcacctctctgaacctactttggcttgggaggctgcccagttaaaacaaaaataagttaatggtacagaaagagaatgaaaaatgaaagcctccttttatcctatcatcctaattccttttcccagtaataatgactgctgtgttggattccttctgcaaataaaagtgtatacagtaaaaaaaaacgaagaaaaaaaaaaaacaaaaaaaaacacaaaaagaacaaaagaaaagaaacaaagaaaaaaaaaaagacaatcaagaaaaaaacaaaaaagaacatcaaaacacaaacaacaaaaaaaaaaaagaaagggggggggccaacatgaaaaccaacaggaggagacgcaaaagagacaacgcgagaggagaaaagccgcaaa

SEQ ID NO: 279192 - DNA, 990 bp, Homo sapiens
ccggaccaatgcatattactgacagtacagaactaagaaaccggcatgcccagggagaaaaaactgcaggcattaatgtccgaaagggtggtatttccaacattttggaggaactggttgtccagcctctgttggtatcagtcagtgctctgactcttgcaactgaaactgttcggagcattctgaaaatagatgatgtggtaaacactcgataatctggataactgactagcaccattatgatcaccagtattgtggctggaatggaagaagatcaccttggtgttccttgtttggaagattatttcctctgaatttctgggcttggtcttccagttggcatttgcctgaagttgtattgaaacaatttaatgaaaatattaaatatttggtttcaaaaggcagatttatcttctcccaacattctgttatttctgatacttttgaaaaactaataaaaactaataaaagaagcgtaaaaagtgagtttacatgttgaggaaaaaaatggcccaatatgctcatcactgataaatgctccctggccttaaaaactaccaacatataatatatatgctgtcttaaaagttaatgatccaagtggcacctctctgaacctactttggcttgggaggctgcccagttaaaacaaaaataagttaatggtacagaaagagaatgaaaaatgaaagcctccttttatcctatcatcctaattccttttcccagtaataatgactgctgtgttggattccttctgcaaataaaagtgtatacagtaaaaaaaaacgaagaaaaaaaaaaaacaaaaaaaaacacaaaaagaacaaaagaaaagaaacaaagaaaaaaaaaaagacaatcaagaaaaaaacaaaaaagaacatcaaaacacaaacaacaaaaaaaaaaaagaaagggggggggccaacatgaaaaccaacaggaggagacgcaaaagagacaacgcgagaggagaaaagccgcaaa

SEQ ID NO: 279193 - DNA, 1120 bp, Homo sapiens
  misc_feature (133)..(133): n is a, c, g, or t
gtagttaggattgggtgacaccagcattaattcagttttccaaattttaattgaaataacatcccacagtgtagagaaaagcttagtagagtatcatattctaatcttcttagaaagaaaactagatttaggncttgaggtacactggtaaccacgtggctgctgatgtgtattatcacagacactaaaagcaacttgtgctgatttgatttgcagggtggtatttccaacattttggaggaactggttgtccagcctctgttggtatcagtcagtgctctgactcttgcaactgaaactgttcggagcattctgaaaatagatgatgtggtaaacactcgataatctggataactgactagcaccattatgatcaccagtattgtggctggaatggaagaagatcaccttggtgttccttgtttggaagattatttcctctgaatttctgggcttggtcttccagttggcatttgcctgaagttgtattgaaacaatttaatgaaaatattaaatatttggtttcaaaaggcagatttatcttctcccaacattctgttatttctgatacttttgaaaaactaataaaaactaataaaagaagcgtaaaaagtgagtttacatgttgaggaaaaaaatggcccaatatgctcatcactgataaatgctccctggccttaaaaactaccaacatataatatatatgctgtcttaaaagttaatgatccaagtggcacctctctgaacctactttggcttgggaggctgcccagttaaaacaaaaataagttaatggtacagaaagagaatgaaaaatgaaagcctccttttatcctatcatcctaattccttttcccagtaataatgactgctgtgttggattccttctgcaaataaaagtgtatacagtaaaaaaaaacgaagaaaaaaaaaaaacaaaaaaaaacacaaaaagaacaaaagaaaagaaacaaagaaaaaaaaaaagacaatcaagaaaaaaacaaaaaagaacatcaaaacacaaacaacaaaaaaaaaaaagaaagggggggggccaacatgaaaaccaacaggaggagacgcaaaagagacaacgcgagaggagaaaagccgcaaa

SEQ ID NO: 279194 - DNA, 1315 bp, Homo sapiens
  misc_feature (137)..(137): n is a, c, g, or t
  misc_feature (140)..(140): n is a, c, g, or t
  misc_feature (157)..(157): n is a, c, g, or t
  misc_feature (169)..(169): n is a, c, g, or t
  misc_feature (184)..(184): n is a, c, g, or t
  misc_feature (186)..(186): n is a, c, g, or t
  misc_feature (236)..(236): n is a, c, g, or t
  misc_feature (258)..(258): n is a, c, g, or t
  misc_feature (282)..(282): n is a, c, g, or t
gtggtttgcgcttttggcggtgttggcgggccacctatctaccatgttcacattagtgaacaaaagtctttgctctcagagattacatactagacagagtaaacaaataagtgaattatctgtaaattgagcattcntantttgaatactccaaaantcaaaacacttnggtcctaatcatttngnaaaaaggatactcctccatcagtattttagatctagacagttctgttgcngcttgtcctgttttaggaatgnaggaaatagcattctcagagctcntaactagattgtaccattttgacatctgaaggaagatgagatgaatcctcaaaatgtattctgccataagctgattacaaataccgtgcccggccaagtttttacttttgataaatatttgctagtcatcaaggtgacagcagttcttaatacaggttttccttttattaattgccttaaacattttccagctttaaaattctgtcattacaggttttgaaatctaagtttttctcttatcaggtaaacactcgataatctggataactgactagcaccattatgatcaccagtattgtggctggaatggaagaagatcaccttggtgttccttgtttggaagattatttcctctgaatttctgggcttggtcttccagttggcatttgcctgaagttgtattgaaacaatttaatgaaaatattaaatatttggtttcaaaaggcagatttatcttctcccaacattctgttatttctgatacttttgaaaaactaataaaaactaataaaagaagcgtaaaaagtgagtttacatgttgaggaaaaaaatggcccaatatgctcatcactgataaatgctccctggccttaaaaactaccaacatataatatatatgctgtcttaaaagttaatgatccaagtggcacctctctgaacctactttggcttgggaggctgcccagttaaaacaaaaataagttaatggtacagaaagagaatgaaaaatgaaagcctccttttatcctatcatcctaattccttttcccagtaataatgactgctgtgttggattccttctgcaaataaaagtgtatacagtaaaaaaaaacgaagaaaaaaaaaaaacaaaaaaaaacacaaaaagaacaaaagaaaagaaacaaagaaaaaaaaaaagacaatcaagaaaaaaacaaaaaagaacatcaaaacacaaacaacaaaaaaaaaaaagaaagggggggggccaacatgaaaaccaacaggaggagacgcaaaagagacaacgcgagaggagaaaagccgcaaa

SEQ ID NO: 279195 - DNA, 160 bp, Homo sapiens
taataaatgtgaggctgaatcatattttattggactgatgacttttaatctgttcatctattaaacgtacagatgtccactccctcttaactacccctctttgttttcttttatccttagtgggacaattgatgactgtgagttggtggaagggctggtt

SEQ ID NO: 279196 - DNA, 2090 bp, Homo sapiens
  misc_feature (2055)..(2055): n is a, c, g, or t
  misc_feature (2059)..(2059): n is a, c, g, or t
  misc_feature (2066)..(2066): n is a, c, g, or t
agcggcttctccgcctccgcctcctcccgacgccggcgccgctttctggaaggttcgtgaaggcagtgagggcttaccgttattacactgcggccggccagaatccgggtccatccgtccttcccgagccaacccagacacagcggagtttgccatgcccgagaatgtggcaccccggagcggggcgactgccggggctgccggcggccgcgggaaaggcgcctatcaggaccgcgacaagccagcccagatccgcttcagcaacatttccgccgccaaagcggttgctgatgctattagaacaagccttggaccaaaaggaatggataaaatgattcaagatggaaaaggtgatgtaaccattacaaatgatggtgctaccattctgaaacaaatgcaagtattacatccagcagccagaatgctggtggagctgtctaaggctcaagatatagaagcaggagatggcaccacatcagtagtcatcattgctggctccctcttagattcttgtaccaagcttcttcagaaagggattcatccaaccatcatttctgagtcattccagaaggccctggaaaagggcattgaaatcttgactgacatgtctcgacctgtggaactgagtgacagagaaactttgttaaatagtgcaaccacttcactgaactcaaaggtggtttctcagtattcaagtctgctttctccaatgagtgtaaatgcagtgatgaaagtgattgacccagccacagccaccagtgtagatcttagagatattaaaatagttaagaagcttggtgggacaattgatgactgtgagttggtggaagggctggttctcacccaaaaagtgtcaaattctggcataaccagagttgaaaaggccaagattgggcttattcagttttgcttatctgctcccaaaacagacatggataatcaaatagtggtttctgactatgcccagatggaccgagtgctgcgagaagagagagcctatattttaaatttagtgaagcaaattaaaaaaacaggatgtaatgtccttctcatacagaaatctattctaagagatgctcttagtgatcttgcattacactttctgaataaaatgaagatcatggtgattaaggatattgaaagagaagacattgaattcatttgtaagacaattggaaccaagccagttgctcatattgaccaatttactgctgacatgctgggttctgctgagttagctgaggaggtcaatttaaatggttctggcaaactgctcaagattacaggctgtgccagccctggaaaaacagttacaattgttgttcgtggttctaacaaactggtgattgaagaagctgagcgctccattcatgatgccctatgtgttattcgttgtttagtgaagaagagggctcttattgcaggaggtggtgctccagaaatagagttggccctacgattaactgaatattcacgaacactgagtggtatggaatcctactgcgttcgtgcttttgcagatgctatggaggtcattccatctacactagctgaaaatgccggcctgaatcccatttctacagtaacagaactaagaaaccggcatgcccagggagaaaaaactgcaggcattaatgtccgaaagggtggtatttccaacattttggaggaactggttgtccagcctctgttggtatcagtcagtgctctgactcttgcaactgaaactgttcggagcattctgaaaatagatgatgtggtaaacactcgataatctggataactgactagcaccattatgatcaccagtattgtggctggaatggaagaagatcaccttggtgttccttgtttggaagattatttcctctgaatttctgggcttggtcttccagttggcatttgcctgaagttgtattgaaacaatttaatgaaaatattaaatatttggtttcaaaaggcagatttatcttctcccaacattctgttatttctgatacttttgaaaaactaataaaaactaataaaagaagatgcggccagaaataaaaacangggngtgcagnaaatgtgaacagtcaattactgcg

SEQ ID NO: 279197 - DNA, 2082 bp, Homo sapiens
agcggcttctccgcctccgcctcctcccgacgccggcgccgctttctggaaggttcgtgaaggcagtgagggcttaccgttattacactgcggccggccagaatccgggtccatccgtccttcccgagccaacccagacacagcggagtttgccatgcccgagaatgtggcaccccggagcggggcgactgccggggctgccggcggccgcgggaaaggcgcctatcaggaccgcgacaagccagcccagatccgcttcagcaacatttccgccgccaaagcggttgctgatgctattagaacaagccttggaccaaaaggaatggataaaatgattcaagatggaaaaggtgatgtaaccattacaaatgatggtgctaccattctgaaacaaatgcaagtattacatccagcagccagaatgctggtggagctgtctaaggctcaagatatagaagcaggagatggcaccacatcagtagtcatcattgctggctccctcttagattcttgtaccaagcttcttcagaaagggattcatccaaccatcatttctgagtcattccagaaggccctggaaaagggcattgaaatcttgactgacatgtctcgacctgtggaactgagtgacagagaaactttgttaaatagtgcaaccacttcactgaactcaaaggtggtttctcagtattcaagtctgctttctccaatgagtgtaaatgcagtgatgaaagtgattgacccagccacagccaccagtgtagatcttagagatattaaaatagttaagaagcttggtgggacaattgatgactgtgagttggtggaagggctggttctcacccaaaaagtgtcaaattctggcataaccagagttgaaaaggccaagattgggcttattcagttttgcttatctgctcccaaaacagacatggataatcaaatagtggtttctgactatgcccagatggaccgagtgctgcgagaagagagagcctatattttaaatttagtgaagcaaattaaaaaaacaggatgtaatgtccttctcatacagaaatctattctaagagatgctcttagtgatcttgcattacactttctgaataaaatgaagatcatggtgattaaggatattgaaagagaagacattgaattcatttgtaagacaattggaaccaagccagttgctcatattgaccaatttactgctgacatgctgggttctgctgagttagctgaggaggtcaatttaaatggttctggcaaactgctcaagattacaggctgtgccagccctggaaaaacagttacaattgttgttcgtggttctaacaaactggtgattgaagaagctgagcgctccattcatgatgccctatgtgttattcgttgtttagtgaagaagagggctcttattgcaggaggtggtgctccagaaatagagttggccctacgattaactgaatattcacgaacactgagtggtatggaatcctactgcgttcgtgcttttgcagatgctatggaggtcattccatctacactagctgaaaatgccggcctgaatcccatttctacagtaacagaactaagaaaccggcatgcccagggagaaaaaactgcaggcattaatgtccgaaagggtggtatttccaacattttggaggaactggttgtccagcctctgttggtatcagtcagtgctctgactcttgcaactgaaactgttcggagcattctgaaaatagatgatgtggtaaacactcgataatctggataactgactagcaccattatgatcaccagtattgtggctggaatggaagaagatcaccttggtgttccttgtttggaagattatttcctctgaatttctgggcttggtcttccagttggcatttgcctgaagttgtattgaaacaatttaatgaaaatattaaatatttggtttcaaaaggcagatttatcttctcccaacattctgttatttctgatacttttgaaaaactaataaaaactaataaaagaagattgcggctggctttcataccttaacacatcctccgcggccaacgttga

SEQ ID NO: 279198 - DNA, 2495 bp, Homo sapiens
agcggcttctccgcctccgcctcctcccgacgccggcgccgctttctggaaggttcgtgaaggcagtgagggcttaccgttattacactgcggccggccagaatccgggtccatccgtccttcccgagccaacccagacacagcggagtttgccatgcccgagaatgtggcaccccggagcggggcgactgccggggctgccggcggccgcgggaaaggcgcctatcaggaccgcgacaagccagcccagatccgcttcagcaacatttccgccgccaaagcggttgctgatgctattagaacaagccttggaccaaaaggaatggataaaatgattcaagatggaaaaggtgatgtaaccattacaaatgatggtgctaccattctgaaacaaatgcaagtattacatccagcagccagaatgctggtggagctgtctaaggctcaagatatagaagcaggagatggcaccacatcagtagtcatcattgctggctccctcttagattcttgtaccaagcttcttcagaaagggattcatccaaccatcatttctgagtcattccagaaggccctggaaaagggcattgaaatcttgactgacatgtctcgacctgtggaactgagtgacagagaaactttgttaaatagtgcaaccacttcactgaactcaaaggtggtttctcagtattcaagtctgctttctccaatgagtgtaaatgcagtgatgaaagtgattgacccagccacagccaccagtgtagatcttagagatattaaaatagttaagaagcttggtgggacaattgatgactgtgagttggtggaagggctggttctcacccaaaaagtgtcaaattctggcataaccagagttgaaaaggccaagattgggcttattcagttttgcttatctgctcccgtgctgcgagaagagagagcctatattttaaatttagtgaagcaaattaaaaaaacaggatgtaatgtccttctcatacagaaatctattctaagagatgctcttagtgatcttgcattacactttctgaataaaatgaagatcatggtgattaaggatattgaaagagaagacattgaattcatttgtaagacaattggaaccaagccagttgctcatattgaccaatttactgctgacatgctgggttctgctgagttagctgaggaggtcaatttaaatggttctggcaaactgctcaagattacaggctgtgccagccctggaaaaacagttacaattgttgttcgtggttctaacaaactggtgattgaagaagctgagcgctccattcatgatgccctatgtgttattcgttgtttagtgaagaagagggctcttattgcaggaggtggtgctccagaaatagagttggccctacgattaactgaatattcacgaacactgagtggtatggaatcctactgcgttcgtgcttttgcagatgctatggaggtcattccatctacactagctgaaaatgccggcctgaatcccatttctacagtaacagaactaagaaaccggcatgcccagggagaaaaaactgcaggcattaatgtccgaaagggtggtatttccaacattttggaggaactggttgtccagcctctgttggtatcagtcagtgctctgactcttgcaactgaaactgttcggagcattctgaaaatagatgatgtggtaaacactcgataatctggataactgactagcaccattatgatcaccagtattgtggctggaatggaagaagatcaccttggtgttccttgtttggaagattatttcctctgaatttctgggcttggtcttccagttggcatttgcctgaagttgtattgaaacaatttaatgaaaatattaaatatttggtttcaaaaggcagatttatcttctcccaacattctgttatttctgatacttttgaaaaactaataaaaactaataaaagaagcgtaaaaagtgagtttacatgttgaggaaaaaaatggcccaatatgctcatcactgataaatgctccctggccttaaaaactaccaacatataatatatatgctgtcttaaaagttaatgatccaagtggcacctctctgaacctactttggcttgggaggctgcccagttaaaacaaaaataagttaatggtacagaaagagaatgaaaaatgaaagcctccttttatcctatcatcctaattccttttcccagtaataatgactgctgtgttggattccttctgcaaataaaagtgtatacagtaaaaaaaaacgaagaaaaaaaaaaaacaaaaaaaaacacaaaaagaacaaaagaaaagaaacaaagaaaaaaaaaaagacaatcaagaaaaaaacaaaaaagaacatcaaaacacaaacaacaaaaaaaaaaaagaaagggggggggccaacatgaaaaccaacaggaggagacgcaaaagagacaacgcgagaggagaaaagccgcaaa

SEQ ID NO: 279199 - DNA, 2147 bp, Homo sapiens
cggacgcgtgggtcgacccacgcgtccggagctgtctaaggctcaagatatagaagcaggagatggcaccacatcagtagtcatcattgctggctccctcttagattcttgtaccaagcttcttcagaaagggattcatccaaccatcatttctgagtcattccagaaggccctggaaaagggcattgaaatcttgactgacatgtctcgacctgtggaactgagtgacagagaaactttgttaaatagtgcaaccacttcactgaactcaaaggtggtttctcagtattcaagtctgctttctccaatgagtgtaaatgcagtgatgaaagtgattgacccagccacagccaccagtgtagatcttagagatattaaaatagttaagaagcttggtgggacaattgatgactgtgagttggtggaagggctggttctcacccaaaaagtgtcaaattctggcataaccagagttgaaaaggccaagattgggcttattcagttttgcttatctgctcccaaaacagacatggataatcaaatagtggtttctgactatgcccagatggaccgagtgctgcgagaagagagagcctatattttaaatttagtgaagcaaattaaaaaaacaggatgtaatgtccttctcatacagaaatctattctaagagatgctcttagtgatcttgcattacactttctgaataaaatgaagatcatggtgattaaggatattgaaagagaagacattgaattcatttgtaagacaattggaaccaagccagttgctcatattgaccaatttactgctgacatgctgggttctgctgagttagctgaggaggtcaatttaaatggttctggcaaactgctcaagattacaggctgtgccagccctggaaaaacagttacaattgttgttcgtggttctaacaaactggtgattgaagaagctgagcgctccattcatgatgccctatgtgttattcgttgtttagtgaagaagagggctcttattgcaggaggtggtgctccagaaatagagttggccctacgattaactgaatattcacgaacactgagtggtatggaatcctactgcgttcgtgcttttgcagatgctatggaggtcattccatctacactagctgaaaatgccggcctgaatcccatttctacagtaacagaactaagaaaccggcatgcccagggagaaaaaactgcaggcattaatgtccgaaagggtggtatttccaacattttggaggaactggttgtccagcctctgttggtatcagtcagtgctctgactcttgcaactgaaactgttcggagcattctgaaaatagatgatgtggtaaacactcgataatctggataactgactagcaccattatgatcaccagtattgtggctggaatggaagaagatcaccttggtgttccttgtttggaagattatttcctctgaatttctgggcttggtcttccagttggcatttgcctgaagttgtattgaaacaatttaatgaaaatattaaatatttggtttcaaaaggcagatttatcttctcccaacattctgttatttctgatacttttgaaaaactaataaaaactaataaaagaagcgtaaaaagtgagtttacatgttgaggaaaaaaatggcccaatatgctcatcactgataaatgctccctggccttaaaaactaccaacatataatatatatgctgtcttaaaagttaatgatccaagtggcacctctctgaacctactttggcttgggaggctgcccagttaaaacaaaaataagttaatggtacagaaagagaatgaaaaatgaaagcctccttttatcctatcatcctaattccttttcccagtaataatgactgctgtgttggattccttctgcaaataaaagtgtatacagtaaaaaaaaacgaagaaaaaaaaaaaacaaaaaaaaacacaaaaagaacaaaagaaaagaaacaaagaaaaaaaaaaagacaatcaagaaaaaaacaaaaaagaacatcaaaacacaaacaacaaaaaaaaaaaagaaagggggggggccaacatgaaaaccaacaggaggagacgcaaaagagacaacgcgagaggagaaaagccgcaaa

SEQ ID NO: 279200 - DNA, 2495 bp, Homo sapiens
agcggcttctccgcctccgcctcctcccgacgccggcgccgctttctggaaggttcgtgaaggcagtgagggcttaccgttattacactgcggccggccagaatccgggtccatccgtccttcccgagccaacccagacacagcggagtttgccatgcccgagaatgtggcaccccggagcggggcgactgccggggctgccggcggccgcgggaaaggcgcctatcaggaccgcgacaagccagcccagatccgcttcagcaacatttccgccgccaaagcggttgctgatgctattagaacaagccttggaccaaaaggaatggataaaatgattcaagatggaaaaggtgatgtaaccattacaaatgatggtgctaccattctgaaacaaatgcaagtattacatccagcagccagaatgctggtggagctgtctaaggctcaagatatagaagcaggagatggcaccacatcagtagtcatcattgctggctccctcttagattcttgtaccaagcttcttcagaaagggattcatccaaccatcatttctgagtcattccagaaggccctgggagaaactttgttaaatagtgcaaccacttcactgaactcaaaggtggtttctcagtattcaagtctgctttctccaatgagtgtaaatgcagtgatgaaagtgattgacccagccacagccaccagtgtagatcttagagatattaaaatagttaagaagcttggtgggacaattgatgactgtgagttggtggaagggctggttctcacccaaaaagtgtcaaattctggcataaccagagttgaaaaggccaagattgggcttattcagttttgcttatctgctcccaaaacagacatggataatcaaatagtggtttctgactatgcccagatggaccgagtgctgcgagaagagagagcctatattttaaatttagtgaagcaaattaaaaaaacaggatgtaatgtccttctcatacagaaatctattctaagagatgctcttagtgatcttgcattacactttctgaataaaatgaagatcatggtgattaaggatattgaaagagaagacattgaattcatttgtaagacaattggaaccaagccagttgctcatattgaccaatttactgctgacatgctgggttctgctgagttagctgaggaggtcaatttaaatggttctggcaaactgctcaagattacaggctgtgccagccctggaaaaacagttacaattgttgttcgtggttctaacaaactggtgattgaagaagctgagcgctccattcatgatgccctatgtgttattcgttgtttagtgaagaagagggctcttattgcaggaggtggtgctccagaaatagagttggccctacgattaactgaatattcacgaacactgagtggtatggaatcctactgcgttcgtgcttttgcagatgctatggaggtcattccatctacactagctgaaaatgccggcctgaatcccatttctacagtaacagaactaagaaaccggcatgcccagggagaaaaaactgcaggcattaatgtccgaaagggtggtatttccaacattttggaggaactggttgtccagcctctgttggtatcagtcagtgctctgactcttgcaactgaaactgttcggagcattctgaaaatagatgatgtggtaaacactcgataatctggataactgactagcaccattatgatcaccagtattgtggctggaatggaagaagatcaccttggtgttccttgtttggaagattatttcctctgaatttctgggcttggtcttccagttggcatttgcctgaagttgtattgaaacaatttaatgaaaatattaaatatttggtttcaaaaggcagatttatcttctcccaacattctgttatttctgatacttttgaaaaactaataaaaactaataaaagaagcgtaaaaagtgagtttacatgttgaggaaaaaaatggcccaatatgctcatcactgataaatgctccctggccttaaaaactaccaacatataatatatatgctgtcttaaaagttaatgatccaagtggcacctctctgaacctactttggcttgggaggctgcccagttaaaacaaaaataagttaatggtacagaaagagaatgaaaaatgaaagcctccttttatcctatcatcctaattccttttcccagtaataatgactgctgtgttggattccttctgcaaataaaagtgtatacagtaaaaaaaaacgaagaaaaaaaaaaaacaaaaaaaaacacaaaaagaacaaaagaaaagaaacaaagaaaaaaaaaaagacaatcaagaaaaaaacaaaaaagaacatcaaaacacaaacaacaaaaaaaaaaaagaaagggggggggccaacatgaaaaccaacaggaggagacgcaaaagagacaacgcgagaggagaaaagccgcaaa

SEQ ID NO: 279201 - DNA, 1949 bp, Homo sapiens
agttaactcgaccagtgcgttcgcgacgcgtgcgacctcctgtcatgtctcctgatcatggtcattgctgtgatctaaagtagatccgagcctacatcgacatagctagcctatgtggatatcattcattcaaatgaataatatacgacactcaggtgagagaaaccgtatgcgtggctagcaactaagatcgcacagttgagttcttgagagatcgtcatgtggcatcatactcaaacaggtagtccaattcgtaggctctatactcgagttgacagcccggcaccgtgttgggcttattcagttttgcttatctgctcccaaaacagacatggataatcaaatagtggtttctgactatgcccagatggaccgagtgctgcgagaagagagagcctatattttaaatttagtgaagcaaattaaaaaaacaggatgtaatgtccttctcatacagaaatctattctaagagatgctcttagtgatcttgcattacactttctgaataaaatgaagatcatggtgattaaggatattgaaagagaagacattgaattcatttgtaagacaattggaaccaagccagttgctcatattgaccaatttactgctgacatgctgggttctgctgagttagctgaggaggtcaatttaaatggttctggcaaactgctcaagattacaggctgtgccagccctggaaaaacagttacaattgttgttcgtggttctaacaaactggtgattgaagaagctgagcgctccattcatgatgccctatgtgttattcgttgtttagtgaagaagagggctcttattgcaggaggtggtgctccagaaatagagttggccctacgattaactgaatattcacgaacactgagtggtatggaatcctactgcgttcgtgcttttgcagatgctatggaggtcattccatctacactagctgaaaatgccggcctgaatcccatttctacagtaacagaactaagaaaccggcatgcccagggagaaaaaactgcaggcattaatgtccgaaagggtggtatttccaacattttggaggaactggttgtccagcctctgttggtatcagtcagtgctctgactcttgcaactgaaactgttcggagcattctgaaaatagatgatgtggtaaacactcgataatctggataactgactagcaccattatgatcaccagtattgtggctggaatggaagaagatcaccttggtgttccttgtttggaagattatttcctctgaatttctgggcttggtcttccagttggcatttgcctgaagttgtattgaaacaatttaatgaaaatattaaatatttggtttcaaaaggcagatttatcttctcccaacattctgttatttctgatacttttgaaaaactaataaaaactaataaaagaagcgtaaaaagtgagtttacatgttgaggaaaaaaatggcccaatatgctcatcactgataaatgctccctggccttaaaaactaccaacatataatatatatgctgtcttaaaagttaatgatccaagtggcacctctctgaacctactttggcttgggaggctgcccagttaaaacaaaaataagttaatggtacagaaagagaatgaaaaatgaaagcctccttttatcctatcatcctaattccttttcccagtaataatgactgctgtgttggattccttctgcaaataaaagtgtatacagtaaaaaaaaacgaagaaaaaaaaaaaacaaaaaaaaacacaaaaagaacaaaagaaaagaaacaaagaaaaaaaaaaagacaatcaagaaaaaaacaaaaaagaacatcaaaacacaaacaacaaaaaaaaaaaagaaagggggggggccaacatgaaaaccaacaggaggagacgcaaaagagacaacgcgagaggagaaaagccgcaaa

SEQ ID NO: 279202 - DNA, 1516 bp, Homo sapiens
  misc_feature (22)..(23): n is a, c, g, or t
  misc_feature (29)..(30): n is a, c, g, or t
  misc_feature (34)..(35): n is a, c, g, or t
ggctagcgggactgctctcttnntaaccnncgcnncagagatgctcttagtgatcttgcattacactttctgaataaaatgaagatcatggtgattaaggatattgaaagagaagacattgaattcatttgtaagacaattggaaccaagccagttgctcatattgaccaatttactgctgacatgctgggttctgctgagttagctgaggaggtcaatttaaatggttctggcaaactgctcaagattacaggctgtgccagccctggaaaaacagttacaattgttgttcgtggttctaacaaactggtgattgaagaagctgagcgctccattcatgatgccctatgtgttattcgttgtttagtgaagaagagggctcttattgcaggaggtggtgctccagaaatagagttggccctacgattaactgaatattcacgaacactgagtggtatggaatcctactgcgttcgtgcttttgcagatgctatggaggtcattccatctacactagctgaaaatgccggcctgaatcccatttctacagtaacagaactaagaaaccggcatgcccagggagaaaaaactgcaggcattaatgtccgaaagggtggtatttccaacattttggaggaactggttgtccagcctctgttggtatcagtcagtgctctgactcttgcaactgaaactgttcggagcattctgaaaatagatgatgtggtaaacactcgataatctggataactgactagcaccattatgatcaccagtattgtggctggaatggaagaagatcaccttggtgttccttgtttggaagattatttcctctgaatttctgggcttggtcttccagttggcatttgcctgaagttgtattgaaacaatttaatgaaaatattaaatatttggtttcaaaaggcagatttatcttctcccaacattctgttatttctgatacttttgaaaaactaataaaaactaataaaagaagcgtaaaaagtgagtttacatgttgaggaaaaaaatggcccaatatgctcatcactgataaatgctccctggccttaaaaactaccaacatataatatatatgctgtcttaaaagttaatgatccaagtggcacctctctgaacctactttggcttgggaggctgcccagttaaaacaaaaataagttaatggtacagaaagagaatgaaaaatgaaagcctccttttatcctatcatcctaattccttttcccagtaataatgactgctgtgttggattccttctgcaaataaaagtgtatacagtaaaaaaaaacgaagaaaaaaaaaaaacaaaaaaaaacacaaaaagaacaaaagaaaagaaacaaagaaaaaaaaaaagacaatcaagaaaaaaacaaaaaagaacatcaaaacacaaacaacaaaaaaaaaaaagaaagggggggggccaacatgaaaaccaacaggaggagacgcaaaagagacaacgcgagaggagaaaagccgcaaa

SEQ ID NO: 279203 - DNA, 2300 bp, Homo sapiens
agcggcttctccgcctccgcctcctcccgacgccggcgccgctttctggaaggttcgtgaaggcagtgagggcttaccgttattacactgcggccggccagaatccgggtccatccgtccttcccgagccaacccagacacagcggagtttgccatgcccgagaatgtggcaccccggagcggggcgactgccggggctgccggcggccgcgggaaaggcgcctatcaggaccgcgacaagccagcccagatccgcttcagcaacatttccgccgccaaagcggttgctgatgctattagaacaagccttggaccaaaaggaatggataaaatgattcaagatggaaaaggtgatgtaaccattacaaatgatggtgctaccattctgaaacaaatgcaagtattacatccagcagccagaatgctggtggagctgtctaaggctcaagatatagaagcaggagatggcaccacatcagtagtcatcattgctggctccctcttagattcttgtaccaagcttcttcagaaagggattcatccaaccatcatttctgagtcattccagaaggccctggaaaagggcattgaaatcttgactgacatgtctcgacctgtggaactgagtgacagagaaactttgttaaatagtgcaaccacttcactgaactcaaaggtggtttctcagtattcaagtctgctttctccaatgagtgtaaatgcagtgatgaaagtgattgacccagccacagccaccagtgtagatcttagagatattaaaatagttaagaagcttggtgggacaattgatgactgtgagttggtggaagggctggttctcacccaaaaagtgtcaaattctggcataaccagagttgaaaaggccaagattgggcttattcagttttgcttatctgctcccaaaacagacatggataatcaaatagtggtttctgactatgcccagatggaccgagtgctgcgagaagagagagcctatattttaaatttagtgaagcaaattaaaaaaacaggatgtaatgtccttctcatacagaaatctattctaagagatgctcttagtgatcttgcattacactttctgaataaaatgaagatcatggtgattaaggatattgaaagagaagacattgaattcatttgtaagacaattggaaccaagccagttgctcatattgaccaatttactgctgacatgctgggttctgctgagttagctgaggaggtcaatttaaatggttctggcaaactgctcaagggtggtatttccaacattttggaggaactggttgtccagcctctgttggtatcagtcagtgctctgactcttgcaactgaaactgttcggagcattctgaaaatagatgatgtggtaaacactcgataatctggataactgactagcaccattatgatcaccagtattgtggctggaatggaagaagatcaccttggtgttccttgtttggaagattatttcctctgaatttctgggcttggtcttccagttggcatttgcctgaagttgtattgaaacaatttaatgaaaatattaaatatttggtttcaaaaggcagatttatcttctcccaacattctgttatttctgatacttttgaaaaactaataaaaactaataaaagaagcaaaaaaaaaaaaaaaaaaaaaaaaaaaaaaaaaaaaaaaaaaaaaaaaaaaaaaaaaaaaaaaaaaaaaaaaaaaaaaaaaaaagaaaaaacaaaaaaaaagaaggggggcgcggcgcactataaatccacccccgggggggcgacacaagtagcagacgacacacacattatagaacaaaagaggggcccccaaagaatgaggaagtgttcatataaaaagcagagcgaagagaaggggcgagcaggataaaaacaaaagatcgagaggaggagaaacaaaacgaggacaagagaggaaaaacatgtgtgaataaaagaacaaccccatccagaaggggggggcgaaaacacaaaaagaggcgcagacaatccaccctcaccaaccgagagacaaatacaaaggacacccaacgagagagcgacgaagcacaaataatccgccacaccacagacaggacggaatgacatcaggcgagtggtgtaccaaaacgaccacacgggcaggatacgaaacgacgcggagggcaagcacgcgaagacacagcacggctgccgccacccctaacggcgaaacgatcagctctactagcgccgacgacaaaatattacaacacacagcaagagagacca

SEQ ID NO: 279204 - DNA, 678 bp, Homo sapiens
agcggcttctccgcctccgcctcctcccgacgccggcgccgctttctggaaggttcgtgaaggcagtgagggcttaccgttattacactgcggccggccagaatccgggtccatccgtccttcccgagccaacccagacacagcggagtttgccatgcccgagaatgtggcaccccggagcggggcgactgccggggctgccggcggccgcgggaaaggcgcctatcaggaccgcgacaagccagcccagatccgcttcagcaacatttccgccgccaaagcggttgctgatgctattagaacaagccttggaccaaaaggaatggataaaatgattcaagatggaaaaggtgatgtaaccattacaaatgatggtgctaccattctgaaacaaatgcaagtattacatccagcagccagaatgctggtggagctgtctaaggctcaagatatagaagcaggagatggcaccacatcagtagtcatcattgctggctccctcttagattcttgtaccaagcttcttcagaaaagatttgtgatattttgagaagtatcggccaggtgcggtgactcatacttgtaatcccagcactttgggaggctgaggctggcagaacaattgagcccaaggagttgagaccagactgggcaacatggcaaaaccctgtctccacc

SEQ ID NO: 279205 - DNA, 581 bp, Homo sapiens
agcggcttctccgcctccgcctcctcccgacgccggcgccgctttctggaaggttcgtgaaggcagtgagggcttaccgttattacactgcggccggccagaatccgggtccatccgtccttcccgagccaacccagacacagcggagtttgccatgcccgagaatgtggcaccccggagcggggcgactgccggggctgccggcggccgcgggaaaggcgcctatcaggaccgcgacaagccagcccagatccgcttcagcaacatttccgccgccaaagcggttgctgatgctattagaacaagccttggaccaaaaggaatggataaaatgattcaagatggaaaaggtgatgtaaccattacaaatgatggtgctaccattctgaaacaaatgcaagtattacatccagcagccagaatgctggtggagctgtctaaggctcaagatatagaagcaggagatggcaccacatcagtagtcatcattgctggctccctcttagattcttgtaccaagcttcttcagaaagattctccaccatattcgaggattccgaggcctggaagggcttgaatct

SEQ ID NO: 279206 - DNA, 1066 bp, Homo sapiens
agcggcttctccgcctccgcctcctcccgacgccggcgccgctttctggaaggttcgtgaaggcagtgagggcttaccgttattacactgcggccggccagaatccgggtccatccgtccttcccgagccaacccagacacagcggagtttgccatgcccgagaatgtggcaccccggagcggggcgactgccggggctgccggcggccgcgggaaaggcgcctatcaggaccgcgacaagccagcccagatccgcttcagcaacatttccgccgccaaagcggttgctgatgctattagaacaagccttggaccaaaaggaatggataaaatgattcaagatggaaaaggtgatgtaaccattacaaatgatggtgctaccattctgaaacaaatgcaagtattacatccagcagccagaatgctggtggtaagtgtaattttaggtgagtctttttttttttttttttttgagacagagtcttgctctgtcatccaggctagagtgccgtggcacaatctcagctcactgcaacctctgcctcccagattcatttctcctgcctcagcctcctgagtagctgggattacaggctcgtgccaccatgcctggttgatttttgtattttcagtagagacgggtttcaccatgttggtcaggctgttctcaaactcctgaccttgtgatccacctacgttggcctcccaaagtgctgggattacagacatgagctactgcgcccggccagatgagtcttcttttttaagtgtatttgatacttggtaaacagttaaatttatttgatcacatgatatttaagcacgatgaacacttttcgtgctgaacaggcatatttttaggatacattgtgtgcctaacattgtgctttttggtgtgaggtgataataaaacacaaatcaagccaggcatagtggtgcatgcctttagtcccagccactccataggctgacatgggaggattatttgagcccaagagtttgtggctgcagagagctataatcacaccacaacactccattctgagtgacagagtgaaaccccaga

SEQ ID NO: 279207 - DNA, 2036 bp, Homo sapiens
acccaactcccccgcccgccccgtgcaggctgtggagactcccttcccgggggagggggcccccactgccgcaggtgccccctctgcctccaccccggctcctggccagaagctggagggggcttggccaaaaagagggagaaacaactcagctgttctttctagctctgaaatagaaaatgtctgcagacggcggaggcatccaggacacccaggacaaggagacacccccggaggttccagatcgtggacatcctcatcaggaaatgccttctaagctgggggaggcggtaccttcaggggacactcaggagtcactgcacattaagatggagcccgaagagccacactccgagggggcatcgcaggaggatggggctcaaggtgcctggggctgggcacccctaagtcacggctctaaggagaaagctctcttcctgcctggcggagccctcccctccccccggatccccgtgctttcccgagaggggaggaccagagaccggcagatggctgcagcgctcctcactgcctggtcccagatgccagtgactttcgaggatgtggccttgtacctctcccgggaggagtggggacggctggaccacacgcagcagaacttctacagggatgtcctgcagaagaaaaatgggctgtcactgggctttcccttcagcaggcctttctgggcccctcaagcgcacggcaagggtgaggcctcgggctccagccggcaggcaggagatgagaaggagtggagaggcgcgtgcacaggagccgtcgaggtggggcagagggtgcagacctcatccgtggcagcccttgggaatgtgaagcccttcagaaccagggcagggagagtccagtggggcgtcccgcagtgcgcgcaggaagcagcctgcggccggagctcagggccggccaaagactccgggcagccggctgagccagatcgcaccccggatgcagctccgccagaccccagtcccacggagccccaggagtaccgcgtcccggagaagcccaacgaggaggagaagggcgccccggagagtggcgaggagggcctggcccctgacagtgaggtgggcaggaagagctaccggtgcgagcagtgcggcaagggcttcagctggcactcgcacctggtgacgcaccggcgcacgcacacgggcgagaagccctacgcctgcactgactgcgggaagcgcttcggccgcagctcgcacctcatccagcaccagatcatccacacgggcgagaagccctacacctgccccgcctgccggaagagcttcagccaccactccacgctgattcagcaccagcgcatccacaccggagagaagccctacgtgtgcgaccgctgcgccaagcgcttcacccgccgctcggacttggtcacccaccagggcacccacacgggcgccaagccgcacaagtgccccatctgcgccaagtgcttcacgcagagctcggcgctagtcacccaccagcgcacccacactggggtcaagccctatccgtgccccgagtgcggcaagtgcttcagccagcgttccaacctcatcgcgcacaaccgcacacacacaggcgagaagccctaccactgcctcgactgcggcaagagcttcagccacagctcgcacctcaccgcgcaccagcgcacccaccgtggcgtgcggccctacgcctgcccgttgtgtggcaagagcttcagccggcgctccaacctgcaccggcacgagaagatccacaccaccgggcccaaggccctggccatgctgatgctgggggcggcggcggcgggggctctggccacacccccacccgctcccacctaggaggccaggaaagggggagcggggcgcccagggccactggaacagccccactggagtcaaggctccgagggaggagagaggggctcgggaagggagctggggcggtgagggcatggggtgaggcatggcgatgggggagggcgagggcgagaaagggcaggcactctgcgaattaaaggccttggacttgaa

SEQ ID NO: 279208 - DNA, 2317 bp, Homo sapiens
  misc_feature (1975)..(1975): n is a, c, g, or t
  misc_feature (1979)..(1979): n is a, c, g, or t
  misc_feature (1988)..(1988): n is a, c, g, or t
  misc_feature (1993)..(1993): n is a, c, g, or t
  misc_feature (1995)..(1995): n is a, c, g, or t
  misc_feature (2002)..(2002): n is a, c, g, or t
acccaactcccccgcccgccccgtgcaggctgtggagactcccttcccgggggagggggcccccactgccgcaggtgccccctctgcctccaccccgctctgaaatagaaaatgtctgcagacggcggaggcatccaggacacccaggacaaggagacacccccggaggttccagatcgtggacatcctcatcaggaaatgccttctaagctgggggaggcggtaccttcaggggacactcaggagtcactgcacattaagatggagcccgaagagccacactccgagggggcatcgcaggaggatggggctcaaggtgcctggggctgggcacccctaagtcacggctctaaggagaaagctctcttcctgcctggcggagccctcccctccccccggatccccgtgctttcccgagaggggaggaccagagaccggcagatggctgcagcgctcctcactgcctggtcccagatgccagtgactttcgaggatgtggccttgtacctctcccgggaggagtggggacggctggaccacacgcagcagaacttctacagggatgtcctgcagaagaaaaatgggctgtcactgggctttcccttcagcaggcctttctgggcccctcaagcgcacggcaagggtgaggcctcgggctccagccggcaggcaggagatgagaaggagtggagaggcgcgtgcacaggagccgtcgaggtggggcagagggtgcagacctcatccgtggcagcccttgggaatgtgaagcccttcagaaccagggcagggagagtccagtggggcgtcccgcagtgcgcgcaggaagcagcctgcggccggagctcagggccggccaaagactccgggcagccggctgagccagatcgcaccccggatgcagctccgccagaccccagtcccacggagccccaggagtaccgcgtcccggagaagcccaacgaggaggagaagggcgccccggagagtggcgaggagggcctggcccctgacagtgaggtgggcaggaagagctaccggtgcgagcagtgcggcaagggcttcagctggcactcgcacctggtgacgcaccggcgcacgcacacgggcgagaagccctacgcctgcactgactgcgggaagcgcttcggccgcagctcgcacctcatccagcaccagatcatccacacgggcgagaagccctacacctgccccgcctgccggaagagcttcagccaccactccacgctgattcagcaccagcgcatccacaccggagagaagccctacgtgtgcgaccgctgcgccaagcgcttcacccgccgctcggacttggtcacccaccagggcacccacacgggcgccaagccgcacaagtgccccatctgcgccaagtgcttcacgcagagctcggcgctagtcacccaccagcgcacccacactggggtcaagccctatccgtgccccgagtgcggcaagtgcttcagccagcgttccaacctcatcgcgcacaaccgcacacacacaggcgagaagccctaccactgcctcgactgcggcaagagcttcagccacagctcgcacctcaccgcgcaccagcgcacccaccgtggcgtgcggccctacgcctgcccgttgtgtggcaagagcttcagccggcgctccaacctgcaccggcacgagaagatccacaccaccgggcccaaggccctggccatgctgatgctgggggcggcggcggcgggggctctggccacacccccacccgctcccacctaggaggccaggaaagggggagcggggcgcccagggccactggaacagccccactggagtcaaggctccgagggaggagagaggggctcgggaagggagctggggcggtgagggcatggggtgaggcatggcgatgggggagggcgagggcgagaaagggcaggcactctgcgaattaaaggccttggacttgaaaaaaaanaaanaaaaaaaanaaaananaaaaaanaaaaaaaaacaacaaaaaaggggggggggcccaaaaattactaccgcggaggggggcacccagagagtgctggccaccccctatagtgtgtacaagaggggcccccataaggaaggacccataaaaacaccaaggacgggggaccgcggtaacaaccagcctcgaggggaaaaaacgcccccggggaccttttggagagaccccccatcgtgggtggcacaggggtcaccaccccaaagatatgacgccgcgagaaatacagcggggttggtgcacacaccattgtctcgggaaaggcccgggataatggagtcc

SEQ ID NO: 279209 - DNA, 2495 bp, Homo sapiens
acccaactcccccgcccgccccgtgcaggctgtggagactcccttcccgggggagggggcccccactgccgcaggtgccccctctgcctccaccccgctctgaaatagaaaatgtctgcagacggcggaggcatccaggacacccaggacaaggagacacccccggaggttccagatcgtggacatcctcatcaggaaatgccttctaagctgggggaggcggtaccttcaggggacactcaggagtcactgcacattaagatggagcccgaagagccacactccgagggggcatcgcaggaggatggggctcaaggtgcctggggctgggcacccctaagtcacggctctaaggagaaagctctcttcctgcctggcggagccctcccctccccccggatccccgtgctttcccgagaggggaggaccagagaccggcagatggctgcagcgctcctcactgcctggtcccagatgccagtgactttcgaggatgtggccttgtacctctcccgggaggagtggggacggctggaccacacgcagcagaacttctacagggatgtcctgcagaagaaaaatgggctgtcactgggctttcccttcagcaggcctttctgggcccctcaagcgcacggcaagggtgaggcctcgggctccagccggcaggcaggagatgagaaggagtggagaggcgcgtgcacaggagccgtcgaggtggggcagagggtgcagacctcatccgtggcagcccttgggaatgtgaagcccttcagaaccagggcagggagagtccagtggggcgtcccgcagtgcgcgcaggaagcagcctgcggccggagctcagggccggccaaagactccgggcagccggctgagccagatcgcaccccggatgcagctccgccagaccccagtcccacggagccccaggagtaccgcgtcccggagaagcccaacgaggaggagaagggcgccccggagagtggcgaggagggcctggcccctgacagtgaggtgggcaggaagagctaccggtgcgagcagtgcggcaagggcttcagctggcactcgcacctggtgacgcaccggcgcacgcacacgggcgagaagccctacgcctgcactgactgcgggaagcgcttcggccgcagctcgcacctcatccagcaccagatcatccacacgggcgagaagccctacacctgccccgcctgccggaagagcttcagccaccactccacgctgattcagcaccagcgcatccacaccggagagaagccctacgtgtgcgaccgctgcgccaagcgcttcacccgccgctcggacttggtcacccaccagggcacccacacgggcgccaagccgcacaagtgccccatctgcgccaagtgcttcacgcagagctcggcgctagtcacccaccagcgcacccacactggggtcaagccctatccgtgccccgagtgcggcaagtgcttcagccagcgttccaacctcatcgcgcacaaccgcacacacacaggcgagaagccctaccactgcctcgactgcggcaagagcttcagccacagctcgcacctcaccgcgcaccagcgcacccaccgtggcgtgcggccctacgcctgcccgttgtgtggcaagagcttcagccggcgctccaacctgcaccggcacgagaagatccacaccaccgggcccaaggccctggccatgctgatgctgggggcggcggcggcgggggctctggccacacccccacccgctcccacctaggaggccaggaaagggggagcggggcgcccagggccactggaacagccccactggagtcaaggctccgagggaggagagaggggctcgggaagggagctggggcggtgagggcatggggtgaggcatggcgatgggggagggcgagggcgagaaagggcaggcactctgcgaattaaaggccttggacttgaagcgcccgcctacacagctttgtctcctggtgccctggcgctgattccccgagcgtgggggagctcctgggctaatcccctgtcctcattgaggcatccccgcatcaccactcttggcttgggtctccaccagggttggggtcccttttgccaaaggcccattccaaagcgttgcacacattggcaagcaaaggcttcaagtacagagaggtttccagggctgaagccagtcagccgctcctggacctggggaccccttgccggccgtctgctgctgacgccacttgtcccaagggcactgcttactgagcccgcactctcccttggctcttctctttggaagccaggagcaggcagaactggtccggaaattcctgcctgccccatctcccactcaggcatcggtggctgggttttgtgactggcctttgccatttgctcccaccatggcctgcctgtggtcctgcgagggctcctcactcaccaggggccactttccttcttggcccatgctgcagctgctgtcac

SEQ ID NO: 279210 - DNA, 2436 bp, Homo sapiens
acccaactcccccgcccgccccgtgcaggctgtggagactcccttcccgggggagggggcccccactgccgcaggtgccccctctgcctccaccccgctctgaaatagaaaatgtctgcagacggcggaggcatccaggacacccaggacaaggagacacccccggaggttccagatcgtggacatcctcatcaggaaatgccttctaagctgggggaggcggtaccttcaggggacactcaggagtcactgcacattaagatggagcccgaagagccacactccgagggggcatcgcaggaggatggggctcaaggtgcctggggctgggcacccctaagtcacggctctaaggagaaagctctcttcctgcctggcggagccctcccctccccccggatccccgtgctttcccgagaggggaggaccagagaccggcagatggctgcagcgctcctcactgcctggtcccagatgccagtgactttcgaggatgtggccttgtacctctcccgggaggagtggggacggctggaccacacgcagcagaacttctacagggatgtcctgcagaagaaaaatgggctgtcactgggctttcccttcagcaggcctttctgggcccctcaagcgcacggcaagggtgaggcctcgggctccagccggcaggcaggagatgagaaggagtggagaggcgcgtgcacaggagccgtcgaggtggggcagagggtgcagacctcatccgtggcagcccttgggaatgtgaagcccttcagaaccagggcagggagagtccagtggggcgtcccgcagtgcgcgcaggaagcagcctgcggccggagctcagggccggccaaagactccgggcagccggctgagccagatcgcaccccggatgcagctccgccagaccccagtcccacggagccccaggagtaccgcgtcccggagaagcccaacgaggaggagaagggcgccccggagagtggcgaggagggcctggcccctgacagtgaggtgggcaggaagagctaccggtgcgagcagtgcggcaagggcttcagctggcactcgcacctggtgacgcaccggcgcacgcacacgggcgagaagccctacgcctgcactgactgcgggaagcgcttcggccgcagctcgcacctcatccagcaccagatcatccacacgggcgagaagccctacacctgccccgcctgccggaagagcttcagccaccactccacgctgattcagcaccagcgcatccacaccggagagaagccctacgtgtgcgaccgctgcgccaagcgcttcacccgccgctcggacttggtcacccaccagggcacccacacgggcgccaagccgcacaagtgccccatctgcgccaagtgcttcacgcagagctcggcgctagtcacccaccagccgttccaacctcatcgcgcacaaccgcacacacacaggcgagaagccctaccactgcctcgactgcggcaagagcttcagccacagctcgcacctcaccgcgcaccagcgcacccaccgtggcgtgcggccctacgcctgcccgttgtgtggcaagagcttcagccggcgctccaacctgcaccggcacgagaagatccacaccaccgggcccaaggccctggccatgctgatgctgggggcggcggcggcgggggctctggccacacccccacccgctcccacctaggaggccaggaaagggggagcggggcgcccagggccactggaacagccccactggagtcaaggctccgagggaggagagaggggctcgggaagggagctggggcggtgagggcatggggtgaggcatggcgatgggggagggcgagggcgagaaagggcaggcactctgcgaattaaaggccttggacttgaagcgcccgcctacacagctttgtctcctggtgccctggcgctgattccccgagcgtgggggagctcctgggctaatcccctgtcctcattgaggcatccccgcatcaccactcttggcttgggtctccaccagggttggggtcccttttgccaaaggcccattccaaagcgttgcacacattggcaagcaaaggcttcaagtacagagaggtttccagggctgaagccagtcagccgctcctggacctggggaccccttgccggccgtctgctgctgacgccacttgtcccaagggcactgcttactgagcccgcactctcccttggctcttctctttggaagccaggagcaggcagaactggtccggaaattcctgcctgccccatctcccactcaggcatcggtggctgggttttgtgactggcctttgccatttgctcccaccatggcctgcctgtggtcctgcgagggctcctcactcaccaggggccactttccttcttggcccatgctgcagctgctgtcac

SEQ ID NO: 279211 - DNA, 2206 bp, Homo sapiens
  misc_feature (1864)..(1864): n is a, c, g, or t
  misc_feature (1868)..(1868): n is a, c, g, or t
  misc_feature (1877)..(1877): n is a, c, g, or t
  misc_feature (1882)..(1882): n is a, c, g, or t
  misc_feature (1884)..(1884): n is a, c, g, or t
  misc_feature (1891)..(1891): n is a, c, g, or t
acccaactcccccgcccgccccgtgcaggctgtggagactcccttcccgggggagggggcccccactgccgcaggtgccccctctgcctccaccccgctctgaaatagaaaatgtctgcagacggcggaggcatccaggacacccaggacaaggagacacccccggaggttccagatcgtggacatcctcatcaggaaatgccttctaagctgggggaggcggtaccttcaggggacactcaggagtcactgcacattaagatggagcccgaagagccacactccgagggggcatcgcaggaggatggggctcaaggtgcctggggctgggcacccctaagtcacggctctaaggagaaagctctcttcctgcctggcggagccctcccctccccccggatccccgtgctttcccgagaggggaggaccagagaccggcagatggctgcagcgctcctcactgcctggtcccagatgccagtgactttcgaggatgtggccttgtacctctcccgggaggagtggggacggctggaccacacgcagcagaacttctacagggatgtcctgcagaagaaaaatgggctgtcactgggagccgtcgaggtggggcagagggtgcagacctcatccgtggcagcccttgggaatgtgaagcccttcagaaccagggcagggagagtccagtggggcgtcccgcagtgcgcgcaggaagcagcctgcggccggagctcagggccggccaaagactccgggcagccggctgagccagatcgcaccccggatgcagctccgccagaccccagtcccacggagccccaggagtaccgcgtcccggagaagcccaacgaggaggagaagggcgccccggagagtggcgaggagggcctggcccctgacagtgaggtgggcaggaagagctaccggtgcgagcagtgcggcaagggcttcagctggcactcgcacctggtgacgcaccggcgcacgcacacgggcgagaagccctacgcctgcactgactgcgggaagcgcttcggccgcagctcgcacctcatccagcaccagatcatccacacgggcgagaagccctacacctgccccgcctgccggaagagcttcagccaccactccacgctgattcagcaccagcgcatccacaccggagagaagccctacgtgtgcgaccgctgcgccaagcgcttcacccgccgctcggacttggtcacccaccagggcacccacacgggcgccaagccgcacaagtgccccatctgcgccaagtgcttcacgcagagctcggcgctagtcacccaccagcgcacccacactggggtcaagccctatccgtgccccgagtgcggcaagtgcttcagccagcgttccaacctcatcgcgcacaaccgcacacacacaggcgagaagccctaccactgcctcgactgcggcaagagcttcagccacagctcgcacctcaccgcgcaccagcgcacccaccgtggcgtgcggccctacgcctgcccgttgtgtggcaagagcttcagccggcgctccaacctgcaccggcacgagaagatccacaccaccgggcccaaggccctggccatgctgatgctgggggcggcggcggcgggggctctggccacacccccacccgctcccacctaggaggccaggaaagggggagcggggcgcccagggccactggaacagccccactggagtcaaggctccgagggaggagagaggggctcgggaagggagctggggcggtgagggcatggggtgaggcatggcgatgggggagggcgagggcgagaaagggcaggcactctgcgaattaaaggccttggacttgaaaaaaaanaaanaaaaaaaanaaaananaaaaaanaaaaaaaaacaacaaaaaaggggggggggcccaaaaattactaccgcggaggggggcacccagagagtgctggccaccccctatagtgtgtacaagaggggcccccataaggaaggacccataaaaacaccaaggacgggggaccgcggtaacaaccagcctcgaggggaaaaaacgcccccggggaccttttggagagaccccccatcgtgggtggcacaggggtcaccaccccaaagatatgacgccgcgagaaatacagcggggttggtgcacacaccattgtctcgggaaaggcccgggataatggagtcc

SEQ ID NO: 279212 - DNA, 411 bp, Homo sapiens
cctagtcagctttggcagccgccaggcagggggcggacccccgacccagggggccttcttgaaactgctttattttaccccctgtttccagagcctcaccccctacttgggcccatcagtttgggggagatgctgtctgcagctgggcagcgccagaaggcctgtgacagcacagcatctctttctgggcaggctttcccttcagcaggcctttctgggcccctcaagcgcacggcaagggtgaggcctcgggctccagccggcaggcaggagatgagaaggagtggagaggcgcgtgcacaggtgagggacgggcgcgcgcctttgtctgcgggagtggggcgcagacgcaggccttctggctgttgtctgtgggagtggggcagggccaccagaccccctcctgggcgg

SEQ ID NO: 279213 - DNA, 314 bp, Homo sapiens
  misc_feature (283)..(283): n is a, c, g, or t
  misc_feature (299)..(299): n is a, c, g, or t
  misc_feature (309)..(309): n is a, c, g, or t
gggctctctcctctcttctctttcaggctccagggagcagtgtcagggccagggagacgatggtctccgtgactatggccacttccgagtggatccagttctttaaggaagccggcattcctccaggacctgccgtcaattatgccgtgatgtttgtggataataggattcagaagagcatgctgctggatctcaataaggagataatgaatgagctgggcgtgaccgtggtgggtgacatcatcgccattctcaagcatgccaaagtggtgcaccgtcaggnccaattgttcaaaagnttgccacttnaggta

SEQ ID NO: 279214 - DNA, 2496 bp, Homo sapiens
ctgacttcaggtgatctgcccgcctctgcctcccaaagtgctgggattacaggtgtgagccaccgtgcccggcgcattgctgtcttcaatggaaaactagcattgctggccatgagaggaaggaaaagttcaggctccagggagcagtgtcagggccagggagacgatggtctccgtgactatggccacttccgagtggatccagttctttaaggaagccggcattcctccaggacctgccgtcaattatgccgtgatgtttgtggataataggattcagaagagcatgctgctggatctcaataaggagataatgaatgagctgggcgtgaccgtggtgggtgacatcatcgccattctcaagcatgccaaagtggtgcaccgtcaggacatgtgcaaagctgccactgagtcagtaccctgcagccctagcccccttgcaggcgaaattcgccgtggcaccagtgctgcctcccgaatgatcaccaacagcctgaaccatgactctccacccagcacaccccccaggcgcccggacaccagcacctccaagatctcggtcactgtgtccaacaagatggcagcaaagagtgccaaggccactgcagccctggcccgccgggaggaggagagcctggctgttcctgccaagcggcgccgggtcactgctgagatggaggggaagtacgtcatcaacatgcccaaaggcaccacaccccgcacccgcaagatcctggagcagcagcaggctgcaaaaggtctccataggacgtctgtgtttgaccgcctcggcgccgagaccaaggcagacaccacgacagggagtaaacccacaggagtcttcagccgcctgggggccaccccagaaacggacgaggatctggcttgggacagcgacaatgacagcagcagctctgtcttgcagtatgccggggtcctgaagaagctaggacggggcccagccaaggccagtccccagccagcactgactgtcaaagccaaggccacaagctcagcgacaacggctgctgccccgacactgcggcgcctggcgctttcctcacggtctgggcttgagaggaagccggagtccttgtctaaagtcagcatcatcaagagactgggcgcagctgcccttgtgcccgaggcccaggacagccaggtcaccagcaccaagagtaagtcctcagccgaggtcaaggtcaccattaagaggactctggtggggccccgggggagcagctccagcgagggccttggtgcccagatggaccacgcgggcactgtgagcgtgttcaaaagactgggccgcaggaccttctagcccacctgtgggcggggtgcaggcagcagagcctgcgggcatctgccctggccgccccaggctcctggcttcatcacgcctcccaccagctcctggatgacacagcttgtctccctcgggctctagagctaggcccgagcattcgggggatcaccccatttctcctagcctgggatggtcgtcgcagctggcctggcctgctccaggactccccttctctcatgtcctctgtgctttcttctctggctgtggccttggcagaacccacttttctacctctcccaagtgccagggggcttcttcctctcctacattccccttcttcccctgagcagggtctgctgcctcagaccccagctcatcagcctccctgtccccctcaactaagtgggtgtcacctggtgggcctcccttcccccactccccactgacctccctcactcctctgcgcctccccccactgctgtgacttctctctctccctgtcttcactttgttcatttctcttctgttttctgtccccgtggcaaggcccgactgtccgctgcgtcctgcccgaccctcctgtacctccggcctcccagcggccccctcgtcggcggtggcgtcgagcctgttgagactgttagccgccctctactcccaggctggagggacctctccagaccctgggctgcggctgaggcgcatccgttttcctgccctgggcatctgtctctgaaagtgtatggcgggtggtgggcaaggggcactgggaagggaggccagtgcctagagtgaagacagctgctgttttaatatatttttgtgactttcaaatcatttcccccactccttcagggtgagttgcaggactgtttcacactatgcgcagctgggctggggatggtggcagaggattgggctgtgtctctaaaggtcaggcttcctgcacacacatggtccatgtccctgctgcaagccctgagtcagggggagtaatggccacagtcaccattcagttaggccgccccctgcccccaataagccgtagtggttttgtcactctatcccctccccccatggatttcacctgcctgctggcacctttccaaatgatgggctccgtttgtgagaccatgagtttccactggtttggtcgcccacccctccctgctgcacagcgcccctga

SEQ ID NO: 279215 - DNA, 2443 bp, Homo sapiens
ggatggttatggccgcactctcgctggtggcggcctgttggggtagagcggccgcggacgagtcagttcagcttccggcggctccagggagcagtgtcagggccagggagacgatggtctccgtgactatggccacttccgagtggatccagttctttaaggaagccggcattcctccaggacctgccgtcaattatgccgtgatgtttgtggataataggattcagaagagcatgctgctggatctcaataaggagataatgaatgagctgggcgtgaccgtggtgggtgacatcatcgccattctcaagcatgccaaagtggtgcaccgtcaggacatgtgcaaagctgccactgagtcagtaccctgcagccctagcccccttgcaggcgaaattcgccgtggcaccagtgctgcctcccgaatgatcaccaacagcctgaaccatgactctccacccagcacaccccccaggcgcccggacaccagcacctccaagatctcggtcactgtgtccaacaagatggcagcaaagagtgccaaggccactgcagccctggcccgccgggaggaggagagcctggctgttcctgccaagcggcgccgggtcactgctgagatggaggggaagtacgtcatcaacatgcccaaaggcaccacaccccgcacccgcaagatcctggagcagcagcaggctgcaaaaggtctccataggacgtctgtgtttgaccgcctcggcgccgagaccaaggcagacaccacgacagggagtaaacccacaggagtcttcagccgcctgggggccaccccagaaacggacgaggatctggcttgggacagcgacaatgacagcagcagctctgtcttgcagtatgccggggtcctgaagaagctaggacggggcccagccaaggccagtccccagccagcactgactgtcaaagccaaggccacaagctcagcgacaacggctgctgccccgacactgcggcgcctggcgctttcctcacggtctgggcttgagaggaagccggagtccttgtctaaagtcagcatcatcaagagactgggcgcagctgcccttgtgcccgaggcccaggacagccaggtcaccagcaccaagagtaagtcctcagccgaggtcaaggtcaccattaagaggactctggtggggccccgggggagcagctccagcgagggccttggtgcccagatggaccacgcgggcactgtgagcgtgttcaaaagactgggccgcaggaccttctagcccacctgtgggcggggtgcaggcagcagagcctgcgggcatctgccctggccgccccaggctcctggcttcatcacgcctcccaccagctcctggatgacacagcttgtctccctcgggctctagagctaggcccgagcattcgggggatcaccccatttctcctagcctgggatggtcgtcgcagctggcctggcctgctccaggactccccttctctcatgtcctctgtgctttcttctctggctgtggccttggcagaacccacttttctacctctcccaagtgccagggggcttcttcctctcctacattccccttcttcccctgagcagggtctgctgcctcagaccccagctcatcagcctccctgtccccctcaactaagtgggtgtcacctggtgggcctcccttcccccactccccactgacctccctcactcctctgcgcctccccccactgctgtgacttctctctctccctgtcttcactttgttcatttctcttctgttttctgtccccgtggcaaggcccgactgtccgctgcgtcctgcccgaccctcctgtacctccggcctcccagcggccccctcgtcggcggtggcgtcgagcctgttgagactgttagccgccctctactcccaggctggagggacctctccagaccctgggctgcggctgaggcgcatccgttttcctgccctgggcatctgtctctgaaagtgtatggcgggtggtgggcaaggggcactgggaagggaggccagtgcctagagtgaagacagctgctgttttaatatatttttgtgactttcaaatcatttcccccactccttcagggtgagttgcaggactgtttcacactatgcgcagctgggctggggatggtggcagaggattgggctgtgtctctaaaggtcaggcttcctgcacacacatggtccatgtccctgctgcaagccctgagtcagggggagtaatggccacagtcaccattcagttaggccgccccctgcccccaataagccgtagtggttttgtcactctatcccctccccccatggatttcacctgcctgctggcacctttccaaatgatgggctccgtttgtgagaccatgagtttccactggtttggtcgcccacccctccctgctgcacagcgcccctga

SEQ ID NO: 279216 - DNA, 2502 bp, Homo sapiens
cccgggccgggggaggagtgtctgacagttggcgccgccgggagggagggcgggcggcgcgagtgggcgcgggcccggtgggccaggctccagggagcagtgtcagggccagggagacgatggtctccgtgactatgggtgagtctgtggccttctctccagggccccctctccccactgccctttttgagccacttccgagtggatccagttctttaaggaagccggcattcctccaggacctgccgtcaattatgccgtgatgtttgtggataataggattcagaagagcatgctgctggatctcaataaggagataatgaatgagctgggcgtgaccgtggtgggtgacatcatcgccattctcaagcatgccaaagtggtgcaccgtcaggacatgtgcaaagctgccactgagtcagtaccctgcagccctagcccccttgcaggcgaaattcgccgtggcaccagtgctgcctcccgaatgatcaccaacagcctgaaccatgactctccacccagcacaccccccaggcgcccggacaccagcacctccaagatctcggtcactgtgtccaacaagatggcagcaaagagtgccaaggccactgcagccctggcccgccgggaggaggagagcctggctgttcctgccaagcggcgccgggtcactgctgagatggaggggaagtacgtcatcaacatgcccaaaggcaccacaccccgcacccgcaagatcctggagcagcagcaggctgcaaaaggtctccataggacgtctgtgtttgaccgcctcggcgccgagaccaaggcagacaccacgacagggagtaaacccacaggagtcttcagccgcctgggggccaccccagaaacggacgaggatctggcttgggacagcgacaatgacagcagcagctctgtcttgcagtatgccggggtcctgaagaagctaggacggggcccagccaaggccagtccccagccagcactgactgtcaaagccaaggccacaagctcagcgacaacggctgctgccccgacactgcggcgcctggcgctttcctcacggtctgggcttgagaggaagccggagtccttgtctaaagtcagcatcatcaagagactgggcgcagctgcccttgtgcccgaggcccaggacagccaggtcaccagcaccaagagtaagtcctcagccgaggtcaaggtcaccattaagaggactctggtggggccccgggggagcagctccagcgagggccttggtgcccagatggaccacgcgggcactgtgagcgtgttcaaaagactgggccgcaggaccttctagcccacctgtgggcggggtgcaggcagcagagcctgcgggcatctgccctggccgccccaggctcctggcttcatcacgcctcccaccagctcctggatgacacagcttgtctccctcgggctctagagctaggcccgagcattcgggggatcaccccatttctcctagcctgggatggtcgtcgcagctggcctggcctgctccaggactccccttctctcatgtcctctgtgctttcttctctggctgtggccttggcagaacccacttttctacctctcccaagtgccagggggcttcttcctctcctacattccccttcttcccctgagcagggtctgctgcctcagaccccagctcatcagcctccctgtccccctcaactaagtgggtgtcacctggtgggcctcccttcccccactccccactgacctccctcactcctctgcgcctccccccactgctgtgacttctctctctccctgtcttcactttgttcatttctcttctgttttctgtccccgtggcaaggcccgactgtccgctgcgtcctgcccgaccctcctgtacctccggcctcccagcggccccctcgtcggcggtggcgtcgagcctgttgagactgttagccgccctctactcccaggctggagggacctctccagaccctgggctgcggctgaggcgcatccgttttcctgccctgggcatctgtctctgaaagtgtatggcgggtggtgggcaaggggcactgggaagggaggccagtgcctagagtgaagacagctgctgttttaatatatttttgtgactttcaaatcatttcccccactccttcagggtgagttgcaggactgtttcacactatgcgcagctgggctggggatggtggcagaggattgggctgtgtctctaaaggtcaggcttcctgcacacacatggtccatgtccctgctgcaagccctgagtcagggggagtaatggccacagtcaccattcagttaggccgccccctgcccccaataagccgtagtggttttgtcactctatcccctccccccatggatttcacctgcctgctggcacctttccaaatgatgggctccgtttgtgagaccatgagtttccactggtttggtcgcccacccctccctgctgcacagcgcccctga

SEQ ID NO: 279217 - DNA, 2895 bp, Homo sapiens
gggagagatgacagtgtttcctggcagaggagagtatgtagaaagttggtgaggcatgaaagaacattgtatgttcaagaagctgcaaagcagagtggtgtcacctgtgaagaggcacggggaagcagcagctgcaggagatggagcgtgagaagtcaagccacatcattcaagtctgtgggcttccaagacgattgagagatggtttttcaacaaatgtttctaggccaactggatgagaatatcagttcctgtgctggagagaaaggcagtcagaggagaaaatgaggtccagctcgtccctggctcccaaagtgctgggattacaggtgtgagccaccgtgcccggcgcattgctgtcttcaatggaaaactagcattgctggccatgagaggaaggaaaagttcaggctccagggagcagtgtcagggccagggagacgatggtctccgtgactatggccacttccgagtggatccagttctttaaggaagccggcattcctccaggacctgccgtcaattatgccgtgatgtttgtggataataggattcagaagagcatgctgctggatctcaataaggagataatgaatgagctgggcgtgaccgtggtgggtgacatcatcgccattctcaagcatgccaaagtggtgcaccgtcaggacatgtgcaaagctgccactgagtcagtaccctgcagccctagcccccttgcaggcgaaattcgccgtggcaccagtgatggagtctccctctgttgcccaggctggagtacagtggcgcgaccttggctcagtgcaacctccgcctcccgggttcaagcagttctcctgcctcagcctcccgagtagctgggattacagctgcctcccgaatgatcaccaacagcctgaaccatgactctccacccagcacaccccccaggcgcccggacaccagcacctccaagatctcggtcactgtgtccaacaagatggcagcaaagagtgccaaggccactgcagccctggcccgccgggaggaggagagcctggctgttcctgccaagcggcgccgggtcactgctgagatggaggggaagtacgtcatcaacatgcccaaaggcaccacaccccgcacccgcaagatcctggagcagcagcaggctgcaaaaggtctccataggacgtctgtgtttgaccgcctcggcgccgagaccaaggcagacaccacgacagggagtaaacccacaggagtcttcagccgcctgggggccaccccagaaacggacgaggatctggcttgggacagcgacaatgacagcagcagctctgtcttgcagtatgccggggtcctgaagaagctaggacggggcccagccaaggccagtccccagccagcactgactgtcaaagccaaggccacaagctcagcgacaacggctgctgccccgacactgcggcgcctggcgctttcctcacggtctgggcttgagaggaagccggagtccttgtctaaagtcagcatcatcaagagactgggcgcagctgcccttgtgcccgaggcccaggacagccaggtcaccagcaccaagagtaagtcctcagccgaggtcaaggtcaccattaagaggactctggtggggccccgggggagcagctccagcgagggccttggtgcccagatggaccacgcgggcactgtgagcgtgttcaaaagactgggccgcaggaccttctagcccacctgtgggcggggtgcaggcagcagagcctgcgggcatctgccctggccgccccaggctcctggcttcatcacgcctcccaccagctcctggatgacacagcttgtctccctcgggctctagagctaggcccgagcattcgggggatcaccccatttctcctagcctgggatggtcgtcgcagctggcctggcctgctccaggactccccttctctcatgtcctctgtgctttcttctctggctgtggccttggcagaacccacttttctacctctcccaagtgccagggggcttcttcctctcctacattccccttcttcccctgagcagggtctgctgcctcagaccccagctcatcagcctccctgtccccctcaactaagtgggtgtcacctggtgggcctcccttcccccactccccactgacctccctcactcctctgcgcctccccccactgctgtgacttctctctctccctgtcttcactttgttcatttctcttctgttttctgtccccgtggcaaggcccgactgtccgctgcgtcctgcccgaccctcctgtacctccggcctcccagcggccccctcgtcggcggtggcgtcgagcctgttgagactgttagccgccctctactcccaggctggagggacctctccagaccctgggctgcggctgaggcgcatccgttttcctgccctgggcatctgtctctgaaagtgtatggcgggtggtgggcaaggggcactgggaagggaggccagtgcctagagtgaagacagctgctgttttaatatatttttgtgactttcaaatcatttcccccactccttcagggtgagttgcaggactgtttcacactatgcgcagctgggctggggatggtggcagaggattgggctgtgtctctaaaggtcaggcttcctgcacacacatggtccatgtccctgctgcaagccctgagtcagggggagtaatggccacagtcaccattcagttaggccgccccctgcccccaataagccgtagtggttttgtcactctatcccctccccccatggatttcacctgcctgctggcacctttccaaatgatgggctccgtttgtgagaccatgagtttccactggtttggtcgcccacccctccctgctgcacagcgcccctga

SEQ ID NO: 279218 - DNA, 1764 bp, Homo sapiens
cccgggccgggggaggagtgtctgacagttggcgccgccgggagggagggcgggcggcgcgagtgggcgcgggcccggtgggccaggctccagggagcagtgtcagggccagggagacgatggtctccgtgactatggccacttccgagtggatccagttctttaaggaagccggcattcctccaggacctgccgtcaattatgccgtgatgtttgtggataataggattcagaagagcatgctgctggatctcaataaggagataatgaatgagctgggcgtgaccgtggtgggtgacatcatcgccattctcaagcatgccaaagtggtgcaccgtcaggacatgtgcaaagctgccactgagtcagtaccctgcagccctagcccccttgcaggcgaaattcgccgtggcaccagtgctgcctcccgaatgatcaccaacagcctgaaccatgactctccacccagcacaccccccaggcgcccggacaccagcacctccaagatctcggtcactgtgtccaacaagatggcagcaaagagtgccaaggccactgcagccctggcccgccgggaggaggagagcctggctgttcctgccaagcggcgccgggtcactgctgagatggaggggaagtacgtcatcaacatgcccaaaggcaccacaccccgcacccgcaagatcctggagcagcagcaggctgcaaaaggtctccataggacgtctgtgtttgaccgcctcggcgccgagaccaaggcagacaccacgacagggagtaaacccacaggagtcttcagccgcctgggggccaccccagaaacggacgaggatctggcttgggacagcgacaatgacagcagcagctctgtcttgcagtatgccggggtcctgaagaagctaggacggggcccagccaaggccagtccccagccagcactgactgtcaaagccaaggccacaagctcagcgacaacggctgctgccccgacactgcggcgcctggcgctttcctcacggtctgggcttgagaggaagccggagtccttgtctaaagtcagcatcatcaagagactgggcgcagctgcccttgtgcccgaggcccaggacagccaggtcaccaggcccgactgtccgctgcgtcctgcccgaccctcctgtacctccggcctcccagcggccccctcgtcggcggtggcgtcgagcctgttgagactgttagccgccctctactcccaggctggagggacctctccagaccctgggctgcggctgaggcgcatccgttttcctgccctgggcatctgtctctgaaagtgtatggcgggtggtgggcaaggggcactgggaagggaggccagtgcctagagtgaagacagctgctgttttaatatatttttgtgactttcaaatcatttcccccactccttcagggtgagttgcaggactgtttcacactatgcgcagctgggctggggatggtggcagaggattgggctgtgtctctaaaggtcaggcttcctgcacacacatggtccatgtccctgctgcaagccctgagtcagggggagtaatggccacagtcaccattcagttaggccgccccctgcccccaataagccgtagtggttttgtcactctatcccctccccccatggatttcacctgcctgctggcacctttccaaatgatgggctccgtttgtgagaccatgagtttccactggtttggtcgcccacccctccctgctgcacagcgcccctga

SEQ ID NO: 279219 - DNA, 1624 bp, Homo sapiens
cccgggccgggggaggagtgtctgacagttggcgccgccgggagggagggcgggcggcgcgagtgggcgcgggcccggtgggccaggctccagggagcagtgtcagggccagggagacgatggtctccgtgactatggccacttccgagtggatccagttctttaaggaagccggcattcctccaggacctgccgtcaattatgccgtgatgtttgtggataataggattcagaagagcatgctgctggatctcaataaggagataatgaatgagctgggcgtgaccgtggtgggtgacatcatcgccattctcaagcatgccaaagtggtgcaccgtcaggacatgtgcaaagctgccactgagtcagtaccctgcagccctagcccccttgcaggcgaaattcgccgtggcaccagtgctgcctcccgaatgatcaccaacagcctgaaccatgactctccacccagcacaccccccaggcgcccggacaccagcacctccaagatctcggtcactgtgtccaacaagatggcagcaaagagtgccaaggccactgcagccctggcccgccgggaggaggagagcctggctgttcctgccaagcggcgccgggtcactgctgagatggaggggaagtacgtcatcaacatgcccaaaggcaccacaccccgcacccgcaagatcctggagcagcagcaggctgcaaaaggtctccataggacgtctgtgtttgaccgcctcggcgccgagaccaaggcagacaccacgacagggagtaaacccacaggagtcttcagccgcctgggggccaccccagaaacggacgaggatctggcttgggacagcgacaatgacagcagcagctctgtcttgcagtatgccggggtcctgaagaagctaggacggggcccagccaaggccagtccccagccagcactgactgtcaaagccaaggccacaagctcagcgacaacggctgctgccccgacactgcggcgcctggcgctttcctcacggtctgggcttgagaggaagccggagtccttgtctaaagtcagcatcatcaagagaactgttagccgccctctactcccaggctggagggacctctccagaccctgggctgcggctgaggcgcatccgttttcctgccctgggcatctgtctctgaaagtgtatggcgggtggtgggcaaggggcactgggaagggaggccagtgcctagagtgaagacagctgctgttttaatatatttttgtgactttcaaatcatttcccccactccttcagggtgagttgcaggactgtttcacactatgcgcagctgggctggggatggtggcagaggattgggctgtgtctctaaaggtcaggcttcctgcacacacatggtccatgtccctgctgcaagccctgagtcagggggagtaatggccacagtcaccattcagttaggccgccccctgcccccaataagccgtagtggttttgtcactctatcccctccccccatggatttcacctgcctgctggcacctttccaaatgatgggctccgtttgtgagaccatgagtttccactggtttggtcgcccacccctccctgctgcacagcgcccctga

SEQ ID NO: 279220 - DNA, 620 bp, Homo sapiens
  misc_feature (580)..(580): n is a, c, g, or t
gggagagatgacagtgtttcctggcagaggagagtatgtagaaagttggtgaggcatgaaagaacattgtatgttcaagaagctgcaaagcagagtggtgtcacctgtgaagaggcacggggaagcagcagctgcaggagatggagcgtgagaagtcaagccacatcattcaagtctgtgggcttccaagacgattgagagatggtttttcaacaaatgtttctaggccaactggatgagaatatcagttcctgtgctggagagaaaggcagtcagaggagaaaatgaggtccagctcgtccctggctcccaaagtgctgggattacaggtgtgagccaccgtgcccggcgcattgctgtcttcaatggaaaactagcattgctggccatgagaggaaggaaaagttcaggctccagggagcagtgtcagggccagggagacgatggtctccgtgactatggccacttccgagtggatccagttctttaaggaagccggcattcctccaggacctgccgtcaattatgccgtgatgtttgtggataataggattcagaagagcatgctgctggatctcantaatggaggaggaggattcgcccgggatcctactcggtca

SEQ ID NO: 279221 - DNA, 2449 bp, Homo sapiens
cccgggccgggggaggagtgtctgacagttggcgccgccgggagggagggcgggcggcgcgagtgggcgcgggcccggtgggccaggctccagggagcagtgtcagggccagggagacgatggtctccgtgactatggccacttccgagtggatccagttctttaaggaagccggcattcctccaggacctgccgtcaattatgccgtgatgtttgtggataataggattcagaagagcatgctgctggatctcaataaggagataatgaatgagctgggcgtgaccgtggtgggtgacatcatcgccattctcaagcatgccaaagtggtgcaccgtcaggacatgtgcaaagctgccactgagtcagtaccctgcagccctagcccccttgcaggcgaaattcgccgtggcaccagtgctgcctcccgaatgatcaccaacagcctgaaccatgactctccacccagcacaccccccaggcgcccggacaccagcacctccaagatctcggtcactgtgtccaacaagatggcagcaaagagtgccaaggccactgcagccctggcccgccgggaggaggagagcctggctgttcctgccaagcggcgccgggtcactgctgagatggaggggaagtacgtcatcaacatgcccaaaggcaccacaccccgcacccgcaagatcctggagcagcagcaggctgcaaaaggtctccataggacgtctgtgtttgaccgcctcggcgccgagaccaaggcagacaccacgacagggagtaaacccacaggagtcttcagccgcctgggggccaccccagaaacggacgaggatctggcttgggacagcgacaatgacagcagcagctctgtcttgcagtatgccggggtcctgaagaagctaggacggggcccagccaaggccagtccccagccagcactgactgtcaaagccaaggccacaagctcagcgacaacggctgctgccccgacactgcggcgcctggcgctttcctcacggtctgggcttgagaggaagccggagtccttgtctaaagtcagcatcatcaagagactgggcgcagctgcccttgtgcccgaggcccaggacagccaggtcaccagcaccaagagtaagtcctcagccgaggtcaaggtcaccattaagaggactctggtggggccccgggggagcagctccagcgagggccttggtgcccagatggaccacgcgggcactgtgagcgtgttcaaaagactgggccgcaggaccttctagcccacctgtgggcggggtgcaggcagcagagcctgcgggcatctgccctggccgccccaggctcctggcttcatcacgcctcccaccagctcctggatgacacagcttgtctccctcgggctctagagctaggcccgagcattcgggggatcaccccatttctcctagcctgggatggtcgtcgcagctggcctggcctgctccaggactccccttctctcatgtcctctgtgctttcttctctggctgtggccttggcagaacccacttttctacctctcccaagtgccagggggcttcttcctctcctacattccccttcttcccctgagcagggtctgctgcctcagaccccagctcatcagcctccctgtccccctcaactaagtgggtgtcacctggtgggcctcccttcccccactccccactgacctccctcactcctctgcgcctccccccactgctgtgacttctctctctccctgtcttcactttgttcatttctcttctgttttctgtccccgtggcaaggcccgactgtccgctgcgtcctgcccgaccctcctgtacctccggcctcccagcggccccctcgtcggcggtggcgtcgagcctgttgagactgttagccgccctctactcccaggctggagggacctctccagaccctgggctgcggctgaggcgcatccgttttcctgccctgggcatctgtctctgaaagtgtatggcgggtggtgggcaaggggcactgggaagggaggccagtgcctagagtgaagacagctgctgttttaatatatttttgtgactttcaaatcatttcccccactccttcagggtgagttgcaggactgtttcacactatgcgcagctgggctggggatggtggcagaggattgggctgtgtctctaaaggtcaggcttcctgcacacacatggtccatgtccctgctgcaagccctgagtcagggggagtaatggccacagtcaccattcagttaggccgccccctgcccccaataagccgtagtggttttgtcactctatcccctccccccatggatttcacctgcctgctggcacctttccaaatgatgggctccgtttgtgagaccatgagtttccactggtttggtcgcccacccctccctgctgcacagcgcccctga

SEQ ID NO: 279222 - DNA, 2694 bp, Homo sapiens
aaaaaaaaaattgagcagaagccagagaagggcaagattaaccctagtgaggatagagaagagagtctcatatgtggggacttagggaaagtgtcacaaagtagatggcagtggagcagaaggaaggataggttgccaggaggagacaggcattccaggcacaggtgacatcctctaaaaactgggaggccggcaaagcacctgtgtggggaaggaggcctggaggatgagaccaggcacaacacctccagggtgcttagtaggcaccaagcactgtctcaagtgcttttattcatagaaactcatccagcccttatagcagtcctctaaggctccagggagcagtgtcagggccagggagacgatggtctccgtgactatggccacttccgagtggatccagttctttaaggaagccggcattcctccaggacctgccgtcaattatgccgtgatgtttgtggataataggattcagaagagcatgctgctggatctcaataaggagataatgaatgagctgggcgtgaccgtggtgggtgacatcatcgccattctcaagcatgccaaagtggtgcaccgtcaggacatgtgcaaagctgccactgagtcagtaccctgcagccctagcccccttgcaggcgaaattcgccgtggcaccagtgctgcctcccgaatgatcaccaacagcctgaaccatgactctccacccagcacaccccccaggcgcccggacaccagcacctccaagatctcggtcactgtgtccaacaagatggcagcaaagagtgccaaggccactgcagccctggcccgccgggaggaggagagcctggctgttcctgccaagcggcgccgggtcactgctgagatggaggggaagtacgtcatcaacatgcccaaaggcaccacaccccgcacccgcaagatcctggagcagcagcaggctgcaaaaggtctccataggacgtctgtgtttgaccgcctcggcgccgagaccaaggcagacaccacgacagggagtaaacccacaggagtcttcagccgcctgggggccaccccagaaacggacgaggatctggcttgggacagcgacaatgacagcagcagctctgtcttgcagtatgccggggtcctgaagaagctaggacggggcccagccaaggccagtccccagccagcactgactgtcaaagccaaggccacaagctcagcgacaacggctgctgccccgacactgcggcgcctggcgctttcctcacggtctgggcttgagaggaagccggagtccttgtctaaagtcagcatcatcaagagactgggcgcagctgcccttgtgcccgaggcccaggacagccaggtcaccagcaccaagagtaagtcctcagccgaggtcaaggtcaccattaagaggactctggtggggccccgggggagcagctccagcgagggccttggtgcccagatggaccacgcgggcactgtgagcgtgttcaaaagactgggccgcaggaccttctagcccacctgtgggcggggtgcaggcagcagagcctgcgggcatctgccctggccgccccaggctcctggcttcatcacgcctcccaccagctcctggatgacacagcttgtctccctcgggctctagagctaggcccgagcattcgggggatcaccccatttctcctagcctgggatggtcgtcgcagctggcctggcctgctccaggactccccttctctcatgtcctctgtgctttcttctctggctgtggccttggcagaacccacttttctacctctcccaagtgccagggggcttcttcctctcctacattccccttcttcccctgagcagggtctgctgcctcagaccccagctcatcagcctccctgtccccctcaactaagtgggtgtcacctggtgggcctcccttcccccactccccactgacctccctcactcctctgcgcctccccccactgctgtgacttctctctctccctgtcttcactttgttcatttctcttctgttttctgtccccgtggcaaggcccgactgtccgctgcgtcctgcccgaccctcctgtacctccggcctcccagcggccccctcgtcggcggtggcgtcgagcctgttgagactgttagccgccctctactcccaggctggagggacctctccagaccctgggctgcggctgaggcgcatccgttttcctgccctgggcatctgtctctgaaagtgtatggcgggtggtgggcaaggggcactgggaagggaggccagtgcctagagtgaagacagctgctgttttaatatatttttgtgactttcaaatcatttcccccactccttcagggtgagttgcaggactgtttcacactatgcgcagctgggctggggatggtggcagaggattgggctgtgtctctaaaggtcaggcttcctgcacacacatggtccatgtccctgctgcaagccctgagtcagggggagtaatggccacagtcaccattcagttaggccgccccctgcccccaataagccgtagtggttttgtcactctatcccctccccccatggatttcacctgcctgctggcacctttccaaatgatgggctccgtttgtgagaccatgagtttccactggtttggtcgcccacccctccctgctgcacagcgcccctga

SEQ ID NO: 279223 - DNA, 2773 bp, Homo sapiens
gggagagatgacagtgtttcctggcagaggagagtatgtagaaagttggtgaggcatgaaagaacattgtatgttcaagaagctgcaaagcagagtggtgtcacctgtgaagaggcacggggaagcagcagctgcaggagatggagcgtgagaagtcaagccacatcattcaagtctgtgggcttccaagacgattgagagatggtttttcaacaaatgtttctaggccaactggatgagaatatcagttcctgtgctggagagaaaggcagtcagaggagaaaatgaggtccagctcgtccctggctcccaaagtgctgggattacaggtgtgagccaccgtgcccggcgcattgctgtcttcaatggaaaactagcattgctggccatgagaggaaggaaaagttcaggctccagggagcagtgtcagggccagggagacgatggtctccgtgactatggccacttccgagtggatccagttctttaaggaagccggcattcctccaggacctgccgtcaattatgccgtgatgtttgtggataataggattcagaagagcatgctgctggatctcaataaggagataatgaatgagctgggcgtgaccgtggtgggtgacatcatcgccattctcaagcatgccaaagtggtgcaccgtcaggacatgtgcaaagctgccactgagtcagtaccctgcagccctagcccccttgcaggcgaaattcgccgtggcaccagtgctgcctcccgaatgatcaccaacagcctgaaccatgactctccacccagcacaccccccaggcgcccggacaccagcacctccaagatctcggtcactgtgtccaacaagatggcagcaaagagtgccaaggccactgcagccctggcccgccgggaggaggagagcctggctgttcctgccaagcggcgccgggtcactgctgagatggaggggaagtacgtcatcaacatgcccaaaggcaccacaccccgcacccgcaagatcctggagcagcagcaggctgcaaaaggtctccataggacgtctgtgtttgaccgcctcggcgccgagaccaaggcagacaccacgacagggagtaaacccacaggagtcttcagccgcctgggggccaccccagaaacggacgaggatctggcttgggacagcgacaatgacagcagcagctctgtcttgcagtatgccggggtcctgaagaagctaggacggggcccagccaaggccagtccccagccagcactgactgtcaaagccaaggccacaagctcagcgacaacggctgctgccccgacactgcggcgcctggcgctttcctcacggtctgggcttgagaggaagccggagtccttgtctaaagtcagcatcatcaagagactgggcgcagctgcccttgtgcccgaggcccaggacagccaggtcaccagcaccaagagtaagtcctcagccgaggtcaaggtcaccattaagaggactctggtggggccccgggggagcagctccagcgagggccttggtgcccagatggaccacgcgggcactgtgagcgtgttcaaaagactgggccgcaggaccttctagcccacctgtgggcggggtgcaggcagcagagcctgcgggcatctgccctggccgccccaggctcctggcttcatcacgcctcccaccagctcctggatgacacagcttgtctccctcgggctctagagctaggcccgagcattcgggggatcaccccatttctcctagcctgggatggtcgtcgcagctggcctggcctgctccaggactccccttctctcatgtcctctgtgctttcttctctggctgtggccttggcagaacccacttttctacctctcccaagtgccagggggcttcttcctctcctacattccccttcttcccctgagcagggtctgctgcctcagaccccagctcatcagcctccctgtccccctcaactaagtgggtgtcacctggtgggcctcccttcccccactccccactgacctccctcactcctctgcgcctccccccactgctgtgacttctctctctccctgtcttcactttgttcatttctcttctgttttctgtccccgtggcaaggcccgactgtccgctgcgtcctgcccgaccctcctgtacctccggcctcccagcggccccctcgtcggcggtggcgtcgagcctgttgagactgttagccgccctctactcccaggctggagggacctctccagaccctgggctgcggctgaggcgcatccgttttcctgccctgggcatctgtctctgaaagtgtatggcgggtggtgggcaaggggcactgggaagggaggccagtgcctagagtgaagacagctgctgttttaatatatttttgtgactttcaaatcatttcccccactccttcagggtgagttgcaggactgtttcacactatgcgcagctgggctggggatggtggcagaggattgggctgtgtctctaaaggtcaggcttcctgcacacacatggtccatgtccctgctgcaagccctgagtcagggggagtaatggccacagtcaccattcagttaggccgccccctgcccccaataagccgtagtggttttgtcactctatcccctccccccatggatttcacctgcctgctggcacctttccaaatgatgggctccgtttgtgagaccatgagtttccactggtttggtcgcccacccctccctgctgcacagcgcccctga

SEQ ID NO: 279224 - DNA, 1532 bp, Homo sapiens
cccgggccgggggaggagtgtctgacagttggcgccgccgggagggagggcgggcggcgcgagtgggcgcgggcccggtgggccaggctccagggagcagtgtcagggccagggagacgatggtctccgtgactatggccacttccgagtggatccagttctttaaggaagccggcattcctccaggacctgccgtcaattatgccgtgatgtttgtggataataggattcagaagagcatgctgctggatctcaataaggagataatgaatgagctgggcgtgaccgtggtgggtgacatcatcgccattctcaagcatgccaaagtggtgcaccgtcaggacatgtgcaaagctgccactgagtcagtaccctgcagccctagcccccttgcaggcgaaattcgccgtggcaccagtgctgcctcccgaatgatcaccaacagcctgaaccatgactctccacccagcacaccccccaggcgcccggacaccagcacctccaagatctcggtcactgtgtccaacaagatggcagcaaagagtgccaaggccactgcagccctggcccgccgggaggaggagagcctggctgttcctgccaagcggcgccgggtcactgctgagatggaggggaagtacgtcatcaacatgcccaaaggcaccacaccccgcacccgcaagatcctggagcagcagcaggctgcaaaaggtctccataggacgtctgtgtttgaccgcctcggcgccgagaccaaggcagacaccacgacagggagtaaacccacaggagtcttcagccgcctgggggccaccccagaaacggacgaggatctggcttgggacagcgacaatgacagcagcagctctgtcttgcagtatgccggggtcctgaagaagctaggacggggcccagccaaggccagtccccagccagcactgactgtcaaagccaaggccacaagctcagcgacaacggctgctgccccgacactgcggcgcctggcgctttcctcacggtctgggcttgagaggaagccggagtccttgtctaaagtcagcatcatcaagagactgggcgcagctgcccttgtgcccgaggcccaggacagccaggtcaccaggccagtgcctagagtgaagacagctgctgttttaatatatttttgtgactttcaaatcatttcccccactccttcagggtgagttgcaggactgtttcacactatgcgcagctgggctggggatggtggcagaggattgggctgtgtctctaaaggtcaggcttcctgcacacacatggtccatgtccctgctgcaagccctgagtcagggggagtaatggccacagtcaccattcagttaggccgccccctgcccccaataagccgtagtggttttgtcactctatcccctccccccatggatttcacctgcctgctggcacctttccaaatgatgggctccgtttgtgagaccatgagtttccactggtttggtcgcccacccctccctgctgcacagcgcccctga

SEQ ID NO: 279225 - DNA, 2193 bp, Homo sapiens
aaaaaaaaaattgagcagaagccagagaagggcaagattaaccctagtgaggatagagaagagagtctcatatgtggggacttagggaaagtgtcacaaagtagatggcagtggagcagaaggaaggataggttgccaggaggagacaggcattccaggcacaggtgacatcctctaaaaactgggaggccggcaaagcacctgtgtggggaaggaggcctggaggatgagaccaggcacaacacctccagggtgcttagtaggcaccaagcactgtctcaagtgcttttattcatagaaactcatccagcccttatagcagtcctctaaggctccagggagcagtgtcagggccagggagacgatggtctccgtgactatggccacttccgagtggatccagttctttaaggaagccggcattcctccaggacctgccgtcaattatgccgtgatgtttgtggataataggattcagaagagcatgctgctggatctcaataaggagataatgaatgagctgggcgtgaccgtggtgggtgacatcatcgccattctcaagcatgccaaagtggtgcaccgtcaggacatgtgcaaagctgccactgagtcagtaccctgcagccctagcccccttgcaggcgaaattcgccgtggcaccagtgctgcctcccgaatgatcaccaacagcctgaaccatgactctccacccagcacaccccccaggcgcccggacaccagcacctccaagatctcggtcactgtgtccaacaagatggcagcaaagagtgccaaggccactgcagccctggcccgccgggaggaggagagcctggctgttcctgccaagcggcgccgggtcactgctgagatggaggggaagtacgtcatcaacatgcccaaaggcaccacaccccgcacccgcaagatcctggacagctccagcgagggccttggtgcccagatggaccacgcgggcactgtgagcgtgttcaaaagactgggccgcaggaccttctagcccacctgtgggcggggtgcaggcagcagagcctgcgggcatctgccctggccgccccaggctcctggcttcatcacgcctcccaccagctcctggatgacacagcttgtctccctcgggctctagagctaggcccgagcattcgggggatcaccccatttctcctagcctgggatggtcgtcgcagctggcctggcctgctccaggactccccttctctcatgtcctctgtgctttcttctctggctgtggccttggcagaacccacttttctacctctcccaagtgccagggggcttcttcctctcctacattccccttcttcccctgagcagggtctgctgcctcagaccccagctcatcagcctccctgtccccctcaactaagtgggtgtcacctggtgggcctcccttcccccactccccactgacctccctcactcctctgcgcctccccccactgctgtgacttctctctctccctgtcttcactttgttcatttctcttctgttttctgtccccgtggcaaggcccgactgtccgctgcgtcctgcccgaccctcctgtacctccggcctcccagcggccccctcgtcggcggtggcgtcgagcctgttgagactgttagccgccctctactcccaggctggagggacctctccagaccctgggctgcggctgaggcgcatccgttttcctgccctgggcatctgtctctgaaagtgtatggcgggtggtgggcaaggggcactgggaagggaggccagtgcctagagtgaagacagctgctgttttaatatatttttgtgactttcaaatcatttcccccactccttcagggtgagttgcaggactgtttcacactatgcgcagctgggctggggatggtggcagaggattgggctgtgtctctaaaggtcaggcttcctgcacacacatggtccatgtccctgctgcaagccctgagtcagggggagtaatggccacagtcaccattcagttaggccgccccctgcccccaataagccgtagtggttttgtcactctatcccctccccccatggatttcacctgcctgctggcacctttccaaatgatgggctccgtttgtgagaccatgagtttccactggtttggtcgcccacccctccctgctgcacagcgcccctga

SEQ ID NO: 279226 - DNA, 1109 bp, Homo sapiens
  misc_feature (340)..(340): n is a, c, g, or t
ccgcgtccgcgcttacccaatacaagccgggctacgtccgagggtaacaacatgatcaaaaccacagcaggaaccacaataaggaacaagactcaggttaaagcaaacacagcgacagctcctgcgccgcatctcctggttccagtggcggcactgaactcgcggcaatttgtcccgcctctttcgcttcacggcagccaatcgcttccgccagagaaagaaaggcgccgaaatgaaacccgcctccgttcgccttcggaactgtcgtcacttccgtcctcagacttggaggggcggggatgaggagggcggggaggacgacgagggcgaagagggtggntgagagccccggagcccgagccgaagggcgagccgcaaacgctaagtcgctggccattggtggacatggcgcaggcgcgtttgctccgacgggccgaatgttttggggcagtgttttgagcgcggagaccgcgtgatactggatgcgcatgggcataccgtgctctgcggctgcttggcgttgcttcttcctccagaagtgggcgctgggcagtcacgcagggtttgaaccggaagcgggagtaggtagctgcgtggctaacggagaaaagaagccgtggccacgggaggaggcgagaggagtcgggatctgcgctgcagccaccgccgcggttgatactactttgaccttccgagtgcagtgacagtgatgtgtgttctgaaattgtgaaccatgagtctagtacttaatgatctgcttatctgctgccgtcaactagaacatgatagagctacagaacgaaagaaagaagttgagaaatttaagcgcctgattcgagatcctgaaacaattaaacatctagatcggcattcagattccaaacaaggaaaatatttgaattgggatgctgtttttagatttttacagaaatatattcagaaagaaacagaatgtctgagaatagcaaaaccaaatgtatcagcctcaacacaagcctccaggcagaaaaagatgcaggaaatcagtagtttggtcaaatacttcatcaaatgtgcaaacagaagtaagtgatgttataaattataaataaatggcttaacagattact

SEQ ID NO: 279227 - DNA, 1679 bp, Homo sapiens
cctgaggtgtttgtatgccataaatgctattataggacttagaactaattttgctttccaaggtaaatattctccttgtaatcttatgttattctaataaattcattcttcataaagagtgccaaaaaacttgggatcatttttggtctaacaccagaaattgtgaattattaaggttataattgtttaagaatgattgcttttcgagatgagcagatcacttgaggtcaggagttcaagaccagcctggtcaacatggtgaaaccctgtctctactaaaagtagaaaaattagcagggtgtggtggtgcacgcctctagtctcagctacttggaggctgaggtgggagaattacttgaacccaggaggtggaggctgcagtgtgctgagtttgtgccactgcactccagcctgggtgacagaccaagattccatctcaaaaaaaaaaaaaaaagaatgattgtttttgctatatattcctataaaagaggcgttggcaaacttactgtgtaaagaggccagatagtaaatgttcttgactttataggccatgtggtcacctctgtcttaattacaaaagcagccataaacaataagtaaatgaatggttgtgactatgttccaataaaatgttatttgcaaagaaaaaaaaaatgaattttgcttggggccataatttgccaatttcttctctacaaaagaagtttagttaatagtaatttcccaaatggaattatttaaatagttgccattccaagtgtcttatttttgttcaaatttatgtttttctttatttgtttattttgaaataggagcacctaggctaaaatgtcaagaactcttaaattatatcatggatacagtgaaagattcatctaatggtgctatttacggagctgattgtagcaacatactactcaaagacattctttctgtgagaaaatactggtgtgaaatatctcagcaacagtggttaggtatgttttgaaggttgttgtttgtgaatttttcctcatgaaatgaaacttcaccaaagaaagcactctgtctgtatctgtctatatcccccaagtgacctgacagtttaacagtactttagtaaaattatatggttatcgaactgacccttaatttttatttattatgtagcttttgaataaagtcatgaataatatatcaggtgcctgatatcagagccggaattacagttgaaaaataccatctccatcgtcaaggagttgacagtggcagaagaaaacccaagtaaaccagagttcataatgtgctgtgatacagacatatttgggttcagtaggtatacaaaacaatgacacctaaactcaaccatgatttaagtagaaagggagaaaaccaagagagggaagtaccataaaagtgaaagcaggcagggtgcagtggctcacgcctgtaatcctagcactttgggaggccaaggccggtggattgcttgagctcaggagttcaagaccagcctgggcaacatggtgaaactctgtctttaaaaaaatagcggaggtaatggctcttgcttgtagtcccagttacttgggaggctgaggcaggaggatcacctgagccctggaggttaaggctgcagtgagctgtgatcacactgcactccggcctccatgacagagtgagaccctgtttccatttaa

SEQ ID NO: 279228 - DNA, 724 bp, Homo sapiens
  misc_feature (708)..(708): n is a, c, g, or t
ggcaccagttagttcagatcttggctttattataaactcctctgagatatatgttccctgacagtttatctaaaatgattctctctacagttattttctattactgtgtttttgtttcctcagaggcatacatcacaatttggaattatgcattggtttatcaatttacttgtttattgtcaccctgctgcccagatatgacttcatgagggtaggatttgtatctgtttagttcattatttgtctagctataagtagtaaatattgtttgcatctatcagtgaatgagcatcttctgtttatgtagataatactgaactgttttgttttcttcaaagtaatcattaagctgaaggtaagaaaaacaagttcaaggaagtcacaccatggggaaaaaaaagtcaagtttagggctgcctcttccgggaagtgtcaaatctttagtatatttaggaataaaggtgccaaaccttatggttctttggatattgctaaggtattttcattggttagattaccagtttcattttccttattgactcaagagggctttaaactgagattgaagaagtaagaagattcctagataaaacaaaaaaaaaaaattattaaaaaaatttttggggggtttggggcttgagaagaattttttaaaccatttggtgggggggggggggccttgtgtgtttggacactgggtcaaaaggnggttcccagagggaac

SEQ ID NO: 279229 - DNA, 13918 bp, Homo sapiens
  misc_feature (340)..(340): n is a, c, g, or t
  misc_feature (2481)..(2481): n is a, c, g, or t
  misc_feature (3071)..(3071): n is a, c, g, or t
  misc_feature (11595)..(11595): n is a, c, g, or t
ccgcgtccgcgcttacccaatacaagccgggctacgtccgagggtaacaacatgatcaaaaccacagcaggaaccacaataaggaacaagactcaggttaaagcaaacacagcgacagctcctgcgccgcatctcctggttccagtggcggcactgaactcgcggcaatttgtcccgcctctttcgcttcacggcagccaatcgcttccgccagagaaagaaaggcgccgaaatgaaacccgcctccgttcgccttcggaactgtcgtcacttccgtcctcagacttggaggggcggggatgaggagggcggggaggacgacgagggcgaagagggtggntgagagccccggagcccgagccgaagggcgagccgcaaacgctaagtcgctggccattggtggacatggcgcaggcgcgtttgctccgacgggccgaatgttttggggcagtgttttgagcgcggagaccgcgtgatactggatgcgcatgggcataccgtgctctgcggctgcttggcgttgcttcttcctccagaagtgggcgctgggcagtcacgcagggtttgaaccggaagcgggagtaggtagctgcgtggctaacggagaaaagaagccgtggccacgggaggaggcgagaggagtcgggatctgcgctgcagccaccgccgcggttgatactactttgaccttccgagtgcagtgaggcatacatcacaatttggaattatgcattggtttatcaatttacttgtttattgtcaccctgctgcccagatatgacttcatgaggacagtgatgtgtgttctgaaattgtgaaccatgagtctagtacttaatgatctgcttatctgctgccgtcaactagaacatgatagagctacagaacgaaagaaagaagttgagaaatttaagcgcctgattcgagatcctgaaacaattaaacatctagatcggcattcagattccaaacaaggaaaatatttgaattgggatgctgtttttagatttttacagaaatatattcagaaagaaacagaatgtctgagaatagcaaaaccaaatgtatcagcctcaacacaagcctccaggcagaaaaagatgcaggaaatcagtagtttggtcaaatacttcatcaaatgtgcaaacagaagagcacctaggctaaaatgtcaagaactcttaaattatatcatggatacagtgaaagattcatctaatggtgctatttacggagctgattgtagcaacatactactcaaagacattctttctgtgagaaaatactggtgtgaaatatctcagcaacagtggttagaattgttctctgtgtacttcaggctctatctgaaaccttcacaagatgttcatagagttttagtggctagaataattcatgctgttaccaaaggatgctgttctcagactgacggattaaattccaaatttttggactttttttccaaggctattcagtgtgcgagacaagaaaagagctcttcaggtctaaatcatatcttagcagctcttactatcttcctcaagactttggctgtcaactttcgaattcgagtgtgtgaattaggagatgaaattcttcccactttgctttatatttggactcaacataggcttaatgattctttaaaagaagtcattattgaattatttcaactgcaaatttatatccatcatccgaaaggagccaaaacccaagaaaaaggtgcttatgaatcaacaaaatggagaagtattttatacaacttatatgatctgctagtgaatgagataagtcatataggaagtagaggaaagtattcttcaggatttcgtaatattgccgtcaaagaaaatttgattgaattgatggcagatatctgtcaccaggtttttaatgaagataccagatccttggagatttctcaatcttacactactacacaaagagaatctagtgattacagtgtcccttgcaaaaggaagaaaatagaactaggctgggaagtaataaaagatcaccttcagaagtcacagaatgattttgatcttgtgccttggctacagattgcaacccaattaatatcaaagtatcctgcaagtttacctaactgtgagctgtctccattactgatgatactatctcagcttctaccccaacagcgacatggggaacgtacaccatatgtgttacgatgccttacggaagttgcattgtgtcaagacaagaggtcaaacctagaaagctcacaaaagtcagatttattaaaactctggaataaaatttggtgtattacctttcgtggtataagttctgagcaaatacaagctgaaaactttggcttacttggagccataattcagggtagtttagttgaggttgacagagaattctggaagttatttactgggtcagcctgcagaccttcatgtcctgcagtatgctgtttgactttggcactgaccaccagtatagttccaggancggtaaaaatgggaatagagcaaaatatgtgtgaagtaaatagaagcttttctttaaaggaatcaataatgaaatggctcttattctatcagttagagggtgacttagaaaatagcacagaagtgcctccaattcttcacagtaattttcctcatcttgtactggagaaaattcttgtgagtctcactatgaaaaactgtaaagctgcaatgaattttttccaaagcgtgccagaatgtgaacaccaccaaaaagataaagaagaactttcattctcagaagtagaagaactatttcttcagacaacttttgacaagatggactttttaaccattgtgagagaatgtggtatagaaaagcaccagtccagtattggcttctctgtccaccagaatctcaaggaatcactggatcgctgtcttctgggattatcagaacagcttctgaataattactcatctgagattacaaattcagaaactcttgtccggtgttcacgtcttttggtgggtgtccttggctgctactgttacatgggtgtaatagctgaagaggaagcatataagtcagaattattccagaaagccaantctctaatgcaatgtgcaggagaaagtatcactctgtttaaaaataagacaaatgaggaattcagaattggttccttgagaaatatgatgcagctatgtacacgttgcttgagcaactgtaccaagaagagtccaaataagattgcatctggctttttcctgcgattgttaacatcaaagctaatgaatgacattgcagatatttgtaaaagtttagcatccttcatcaaaaagccatttgaccgtggagaagtagaatcaatggaagatgatactaatggaaatctaatggaggtggaggatcagtcatccatgaatctatttaacgattaccctgatagtagtgttagtgatgcaaacgaacctggagagagccaaagtaccataggtgccattaatcctttagctgaagaatatctgtcaaagcaagatctacttttcttagacatgctcaagttcttgtgtttgtgtgtaactactgctcagaccaatactgtgtcctttagggcagctgatattcggaggaaattgttaatgttaattgattctagcacgctagaacctaccaaatccctccacctgcatatgtatctaatgcttttaaaggagcttcctggagaagagtaccccttgccaatggaagatgttcttgaacttctgaaaccactatccaatgtgtgttctttgtatcgtcgtgaccaagatgtttgtaaaactattttaaaccatgtccttcatgtagtgaaaaacctaggtcaaagcaatatggactctgagaacacaagggatgctcaaggacagtttcttacagtaattggagcattttggcatctaacaaaggagaggaaatatatattctctgtaagaatggccctagtaaattgccttaaaactttgcttgaggctgatccttattcaaaatgggccattcttaatgtaatgggaaaagactttcctgtaaatgaagtatttacacaatttcttgctgacaatcatcaccaagttcgcatgttggctgcagagtcaatcaatagattgttccaggacacgaagggagattcttccaggttactgaaagcacttcctttgaagcttcagcaaacagcttttgaaaatgcatacttgaaagctcaggaaggaatgagagaaatgtcccatagtgctgagaaccctgaaactttggatgaaatttataatagaaaatctgttttactgacgttgatagctgtggttttatcctgtagccctatctgcgaaaaacaggctttgtttgccctgtgtaaatctgtgaaagagaatggattagaacctcaccttgtgaaaaaggttttagagaaagtttctgaaacttttggatatagacgtttagaagactttatggcatctcatttagattatctggttttggaatggctaaatcttcaagatactgaatacaacttatcttcttttccttttattttattaaactacacaaatattgaggatttctatagatcttgttataaggttttgattccacatctggtgattagaagtcattttgatgaggtgaagtccattgctaatcagattcaagaggactggaaaagtcttctaacagactgctttccaaagattcttgtaaatattcttccttattttgcctatgagggtaccagagacagtgggatggcacagcaaagagagactgctaccaaggtctatgatatgcttaaaagtgaaaacttattgggaaaacagattgatcacttattcattagtaatttaccagagattgtggtggagttattgatgacgttacatgagccagcaaattctagtgccagtcagagcactgacctctgtgacttttcaggggatttggatcctgctcctaatccacctcattttccatcgcatgtgattaaagcaacatttgcctatatcagcaattgtcataaaaccaagttaaaaagcattttagaaattctttccaaaagccctgattcctatcagaaaattcttcttgccatatgtgagcaagcagctgaaacaaataatgtttataagaagcacagaattcttaaaatatatcacctgtttgttagtttattactgaaagatataaaaagtggcttaggaggagcttgggcctttgttcttcgagacgttatttatactttgattcactatatcaaccaaaggccttcttgtatcatggatgtgtcattacgtagcttctccctttgttgtgacttattaagtcaggtttgccagacagccgtgacttactgtaaggatgctctagaaaaccatcttcatgttattgttggtacacttataccccttgtgtatgagcaggtggaggttcagaaacaggtattggacttgttgaaatacttagtgatagataacaaggataatgaaaacctctatatcacgattaagcttttagatccttttcctgaccatgttgtttttaaggatttgcgtattactcagcaaaaaatcaaatacagtagaggacccttttcactcttggaggaaattaaccattttctctcagtaagtgtttatgatgcacttccattgacaagacttgaaggactaaaggatcttcgaagacaactggaactacataaagatcagatggtggacattatgagagcttctcaggataatccgcaagatgggattatggtgaaactagttgtcaatttgttgcagttatccaagatggcaataaaccacactggtgaaaaagaagttctagaggctgttggaagctgcttgggagaagtgggtcctatagatttctctaccatagctatacaacatagtaaagatgcatcttataccaaggcccttaagttatttgaagataaagaacttcagtggaccttcataatgctgacctacctgaataacacactggtagaagattgtgtcaaagttcgatcagcagctgttacctgtttgaaaaacattttagccacaaagactggacatagtttctgggagatttataagatgacaacagatccaatgctggcctatctacagccttttagaacatcaagaaaaaagtttttagaagtacccagatttgacaaagaaaacccttttgaaggcctggatgatataaatctgtggattcctctaagtgaaaatcatgacatttggataaagacactgacttgtgcttttttggacagtggaggcacaaaatgtgaaattcttcaattattaaagccaatgtgtgaagtgaaaactgacttttgtcagactgtacttccatacttgattcatgatattttactccaagatacaaatgaatcatggagaaatctgctttctacacatgttcagggatttttcaccagctgtcttcgacacttctcgcaaacgagccgatccacaacccctgcaaacttggattcagagtcagagcactttttccgatgctgtttggataaaaaatcacaaagaacaatgcttgctgttgtggactacatgagaagacaaaagagaccttcttcaggaacaatttttaatgatgctttctggctggatttaaattatctagaagttgccaaggtagctcagtcttgtgctgctcactttacagctttactctatgcagaaatctatgcagataagaaaagtatggatgatcaagagaaaagaagtcttgcatttgaagaaggaagccagagtacaactatttctagcttgagtgaaaaaagtaaagaagaaactggaataagtttacaggatcttctcttagaaatctacagaagtataggggagccagatagtttgtatggctgtggtggagggaagatgttacaacccattactagactacgaacatatgaacacgaagcaatgtggggcaaagccctagtaacatatgacctcgaaacagcaatcccctcatcaacacgccaggcaggaatcattcaggccttgcagaatttgggactctgccatattctttccgtctatttaaaaggattggattatgaaaataaagactggtgtcctgaactagaagaacttcattaccaagcagcatggaggaatatgcagtgggaccattgcacttccgtcagcaaagaagtagaaggaaccagttaccatgaatcattgtacaatgctctacaatctctaagagacagagaattctctacattttatgaaagtctcaaatatgccagagtaaaagaagtggaagagatgtgtaagcgcagccttgagtctgtgtattcgctctatcccacacttagcaggttgcaggccattggagagctggaaagcattggggagcttttctcaagatcagtcacacatagacaactctctgaagtatatattaagtggcagaaacactcccagcttctcaaggacagtgattttagttttcaggagcctatcatggctctacgcacagtcattttggagatcctgatggaaaaggaaatggacaactcacaaagagaatgtattaaggacattctcaccaaacaccttgtagaactctctatactggccagaactttcaagaacactcagctccctgaaagggcaatatttcaaattaaacagtacaattcagttagctgtggagtctctgagtggcagctggaagaagcacaagtattctgggcaaaaaaggagcagagtcttgccctgagtattctcaagcaaatgatcaagaagttggatgccagctgtgcagcgaacaatcccagcctaaaacttacatacacagaatgtctgagggtttgtggcaactggttagcagaaacgtgcttagaaaatcctgcggtcatcatgcagacctatctagaaaaggcagtagaagttgctggaaattatgatggagaaagtagtgatgagctaagaaatggaaaaatgaaggcatttctctcattagcccggttttcagatactcaataccaaagaattgaaaactacatgaaatcatcggaatttgaaaacaagcaagctctcctgaaaagagccaaagaggaagtaggtctccttagggaacataaaattcagacaaacagatacacagtaaaggttcagcgagagctggagttggatgaattagccctgcgtgcactgaaagaggatcgtaaacgcttcttatgtaaagcagttgaaaattatatcaactgcttattaagtggagaagaacatgatatgtgggtattccgactttgttccctctggcttgaaaattctggagtttctgaagtcaatggcatgatgaagagagacggaatgaagattccaacatataaatttttgcctcttatgtaccaattggctgctagaatggggaccaagatgatgggaggcctaggatttcatgaagtcctcaataatctaatctctagaatttcaatggatcacccccatcacactttgtttattatactggccttagcaaatgcaaacagagatgaatttctgactaaaccagaggtagccagaagaagcagaataactaaaaatgtgcctaaacaaagctctcagcttgatgaggatcgaacagaggctgcaaatagaataatatgtactatcagaagtaggagacctcagatggtcagaagtgttgaggcactttgtgatgcttatattatattagcaaacttagatgccactcagtggaagactcagagaaaaggcataaatattccagcagaccagccaattactaaacttaagaatttagaagatgttgttgtccctactatggaaattaaggtggaccacacaggagaatatggaaatctggtgactatacagtcatttaaagcagaatttcgcttagcaggaggtgtaaatttaccaaaaataatagattgtgtaggttccgatggcaaggagaggagacagcttgttaagggccgtgatgacctgagacaagatgctgtcatgcaacaggtcttccagatgtgtaatacattactgcagagaaacacggaaactaggaagaggaaattaactatctgtacttataaggtggttcccctctctcagcgaagtggtgttcttgaatggtgcacaggaactgtccccattggtgaatttcttgttaacaatgaagatggtgctcataaaagatacaggccaaatgatttcagtgcctttcagtgccaaaagaaaatgatggaggtgcaaaaaaagtcttttgaagagaaatatgaagtcttcatggatgtttgccaaaattttcaaccagttttccgttacttctgcatggaaaaattcttggatccagctatttggtttgagaagcgattggcttatacgcgcagtgtagctacttcttctattgttggttacatacttggacttggtgatagacatgtacagaatatcttgataaatgagcagtcagcagaacttgtacatatagatctaggtgttgcttttgaacagggcaaaatccttcctactcctgagacagttccttttagactcaccagagatattgtggatggcatgggcattacgggtgttgaaggtgtcttcagaagatgctgtgagaaaaccatggaagtgatgagaaactctcaggaaactctgttaaccattgtagaggtccttctatatgatccactctttgactggaccatgaatcctttgaaagctttgtatttacagcagaggccggaagatgaaactgagcttcaccctactctgaatgcagatgaccaagaatgcaaacgaaatctcagtgatattgaccagagtttcaacaaagtagctgaacgtgtcttaatgagactacaagagaaactgaaaggagtggaagaaggcactgtgctcagtgttggtggacaagtgaatttgctcatacagcaggccatagaccccaaaaatctcagccgacttttcccaggatggaaagcttgggtgtgatcttcagtatatgaattaccctttcattcagcctttagaaattatattttagcctttatttttaacctgccaacatactttaagtagggattaatatttaagtgaactattgtgggtttttttgaatgttggttttaatacttgatttaatcaccactcaaaaatgttttgatggtcttaaggaacatctctgctttcactctttagaaataatggtcattcgggctgggcgcagcggctcacgcctgtaatcccagcactttgggaggccgaggtgagcggatcacaaggtcaggagttcgagaccagcctggccaagagaccagcctggccagtatggtgaaaccctgtctctactaaaaatacaaaaattagccgagcatggtggcgggcacctgtaatcccagctactcgagaggctgaggcaggagaatctcttgaacctgggaggtgaaggttgctgtgggccaaaatcatgccattgcactccagcctgggtgacaagagcgaaactccatctcaaaaaaaaaaaaaaaaaacagaaacttatttggatttttcctagtaagatcactcagtgttactaaataatgaagttgttatggagaacaaatttcaaagacacagttagtgtagttactatttttttaagtgtgtattaaaacttctcattctattctctttatcttttaagcccttctgtactgtccatgtatgttatctttctgtgataacttcatagattgccttctagttcatgaattctcttgtcagatgtatataatctcttttaccctatccattgggcttcttctttcagaaattgtttttcatttctaattatgcatcatttttcagatctctgtttcttgatgtcatttttaatgtttttttaatgttttttatgtcactaattattttaaatgtctgtacttgatagacactgtaatagttctattaaatttagttcctgctgtttatatctgttgatttttgtatttgataggctgttcatccagttttgtctttttgaaaagtgagtttattttcagcaaggctttatctatgggaatcttgagtgtctgtttatgtcatattcccagggctgttgctgcacacaagcccattcttattttaatttcttggctttagggtttccatacctgaagtgtagcataaatactgataggagatttcccaggccaaggcaaacacacttcctcctcatctccttgtgctagtgggcagaatatttgattgatgcctttttcactgagagtataagcttccatgtgtcccacctttatggcaggggtggaaggaggtacatttaattcccactgcctgcctttggcaagccctgggttctttgctccccatatagatgtctaagctaaaagccgtgggttaatgagactggcaaattgttccaggacagctacagcatcagctcacatattcacctctctggtttttcattcccctcatttttttctgagacagagtcttgctctgtcacccaggctggagtgcagtggcatgatctcagctcactgaaacctctgcctcctgggttcaagcaattctcctgcctcagcctccngagtagctgggactacaggcgtgtgccaacacgcccggctaattttttgtatttttattagagacggagtttcaccgtgttagccaggatggtctcgatcgcttgacctcgtgatccaccctcctcggcctcccaaagtgctgggattacaggtgtgagccaccgcgcccggcctcattcccctcatttttgaccgtaaggatttcccctttcttgtaagttctgctatgtatttaaaagaatgttttctacattttatccagcatttctctgtgttctgttggaagggaagggcttaggtatctagtttgatacataggtagaagtggaacatttctctgtcccccagctgtcatcatataagataaacatcagataaaaagccacctgaaagtaaaactactgactcgtgtattagtgagtataatctcttctccatccttaggaaaatgttcatcccagctgcggagattaacaaatgggtgattgagctttctcctcgtatttggaccttgaaggttatataaatttttttcttatgaagagttggcatttctttttattgccaatggcaggcactcattcatatttgatctcctcaccttcccctcccctaaaaccaatctccagaactttttggactataaatttcttggtttgacttctggagaactgttcagaatattactttgcatttcaaattacaaacttaccttggtgtatctttttcttacaagctgcctaaatgaatatttggtatatattggtagttttattactatagtaaatcaaggaaatgcagtaaacttaaaatgtctttaagaaagccctgaaatcttcatgggtgaaattagaaattatcaactagataatagtatagataaatgaatttgtagctaattcttgctagttgttgcatccagagagctttgaataacatcattaatctactctttagccttgcatggtatgctatgaggctcctgttctgttcaagtattctaatcaatggctttgaaaagtttatcaaatttacatacagatcacaagcctaggagaaataactaattcacagatgacagaattaagattataaaagattttttttttgtaattttagtagagacagggttgccattgtattccagccttggcgacagagcaagactctgcctcaaaaaaaaaaaaaaaaaggttttggcaagctggaactctttctgcaaatgactaagatagaaaactgccaaggacaaatgaggagtagttagattttgaaaatattaatctcattagaaattagttgtggtggtttgtgcttagcgctcactgtgacccaattatttagtgtttcggaaattttcgtgacttttaactttgcaagattagtgatactatcccaatacactgctggagaaatcagaatttggagaaataagttgtccaaggcaagaagatagtaaattataagtacaagtgtaatatggacagtatctaacttgaaaagatttcaggcgaaaagaatctggggtttgccagtcagttgctcaaaaggtcaatgaaaaccaaatagtgaagctatcagagaagctaataaattatagactgcttgaacagttgtgtccagattaagggagataatagctttcccaccctactttgtgcaggtcatacctccccaaagtgtttacctaatcagtaggttcacaaactcttggtcattatagtatatgcctaaaatgtatgcacttaggaatgctaaaaatttaaatatggtctaaagcaaataaaagcaaagaggaaaaactttggacatcgtaaagactagaatagtcttttaaaaagaaagccagtatattggtttgaaatatagagatgtgtcccaatttcaagtattttaattgcaccttaatgaaattatctattttctatagattttagtactattgaatgtattactttactgttacctgaatttattataaagtgtttttgaataaataattctaaaagcatatactaagactcattcactttattcaaatatttgtgtgttctgtgtgccaggcatgggactcgttctaaggagaaagcagtgagcaaggcaggcatagtctgcctatataaagctcccaatctgaggaggataggcaactgaccacgcagtgtgaaccggggagcctattgcacaaccagtctgataatgctgcatctcagtctaaatatcctagtagtgtttcttagtcgcctcctgacaaaaaggcaaatatgaatgttctttctttgggcctagaaagtgatctagttgacatttctagcctaaaag

SEQ ID NO: 279230 - DNA, 12619 bp, Homo sapiens
  misc_feature (340)..(340): n is a, c, g, or t
  misc_feature (2481)..(2481): n is a, c, g, or t
  misc_feature (3071)..(3071): n is a, c, g, or t
  misc_feature (11595)..(11595): n is a, c, g, or t
ccgcgtccgcgcttacccaatacaagccgggctacgtccgagggtaacaacatgatcaaaaccacagcaggaaccacaataaggaacaagactcaggttaaagcaaacacagcgacagctcctgcgccgcatctcctggttccagtggcggcactgaactcgcggcaatttgtcccgcctctttcgcttcacggcagccaatcgcttccgccagagaaagaaaggcgccgaaatgaaacccgcctccgttcgccttcggaactgtcgtcacttccgtcctcagacttggaggggcggggatgaggagggcggggaggacgacgagggcgaagagggtggntgagagccccggagcccgagccgaagggcgagccgcaaacgctaagtcgctggccattggtggacatggcgcaggcgcgtttgctccgacgggccgaatgttttggggcagtgttttgagcgcggagaccgcgtgatactggatgcgcatgggcataccgtgctctgcggctgcttggcgttgcttcttcctccagaagtgggcgctgggcagtcacgcagggtttgaaccggaagcgggagtaggtagctgcgtggctaacggagaaaagaagccgtggccacgggaggaggcgagaggagtcgggatctgcgctgcagccaccgccgcggttgatactactttgaccttccgagtgcagtgaggcatacatcacaatttggaattatgcattggtttatcaatttacttgtttattgtcaccctgctgcccagatatgacttcatgaggacagtgatgtgtgttctgaaattgtgaaccatgagtctagtacttaatgatctgcttatctgctgccgtcaactagaacatgatagagctacagaacgaaagaaagaagttgagaaatttaagcgcctgattcgagatcctgaaacaattaaacatctagatcggcattcagattccaaacaaggaaaatatttgaattgggatgctgtttttagatttttacagaaatatattcagaaagaaacagaatgtctgagaatagcaaaaccaaatgtatcagcctcaacacaagcctccaggcagaaaaagatgcaggaaatcagtagtttggtcaaatacttcatcaaatgtgcaaacagaagagcacctaggctaaaatgtcaagaactcttaaattatatcatggatacagtgaaagattcatctaatggtgctatttacggagctgattgtagcaacatactactcaaagacattctttctgtgagaaaatactggtgtgaaatatctcagcaacagtggttagaattgttctctgtgtacttcaggctctatctgaaaccttcacaagatgttcatagagttttagtggctagaataattcatgctgttaccaaaggatgctgttctcagactgacggattaaattccaaatttttggactttttttccaaggctattcagtgtgcgagacaagaaaagagctcttcaggtctaaatcatatcttagcagctcttactatcttcctcaagactttggctgtcaactttcgaattcgagtgtgtgaattaggagatgaaattcttcccactttgctttatatttggactcaacataggcttaatgattctttaaaagaagtcattattgaattatttcaactgcaaatttatatccatcatccgaaaggagccaaaacccaagaaaaaggtgcttatgaatcaacaaaatggagaagtattttatacaacttatatgatctgctagtgaatgagataagtcatataggaagtagaggaaagtattcttcaggatttcgtaatattgccgtcaaagaaaatttgattgaattgatggcagatatctgtcaccaggtttttaatgaagataccagatccttggagatttctcaatcttacactactacacaaagagaatctagtgattacagtgtcccttgcaaaaggaagaaaatagaactaggctgggaagtaataaaagatcaccttcagaagtcacagaatgattttgatcttgtgccttggctacagattgcaacccaattaatatcaaagtatcctgcaagtttacctaactgtgagctgtctccattactgatgatactatctcagcttctaccccaacagcgacatggggaacgtacaccatatgtgttacgatgccttacggaagttgcattgtgtcaagacaagaggtcaaacctagaaagctcacaaaagtcagatttattaaaactctggaataaaatttggtgtattacctttcgtggtataagttctgagcaaatacaagctgaaaactttggcttacttggagccataattcagggtagtttagttgaggttgacagagaattctggaagttatttactgggtcagcctgcagaccttcatgtcctgcagtatgctgtttgactttggcactgaccaccagtatagttccaggancggtaaaaatgggaatagagcaaaatatgtgtgaagtaaatagaagcttttctttaaaggaatcaataatgaaatggctcttattctatcagttagagggtgacttagaaaatagcacagaagtgcctccaattcttcacagtaattttcctcatcttgtactggagaaaattcttgtgagtctcactatgaaaaactgtaaagctgcaatgaattttttccaaagcgtgccagaatgtgaacaccaccaaaaagataaagaagaactttcattctcagaagtagaagaactatttcttcagacaacttttgacaagatggactttttaaccattgtgagagaatgtggtatagaaaagcaccagtccagtattggcttctctgtccaccagaatctcaaggaatcactggatcgctgtcttctgggattatcagaacagcttctgaataattactcatctgagattacaaattcagaaactcttgtccggtgttcacgtcttttggtgggtgtccttggctgctactgttacatgggtgtaatagctgaagaggaagcatataagtcagaattattccagaaagccaantctctaatgcaatgtgcaggagaaagtatcactctgtttaaaaataagacaaatgaggaattcagaattggttccttgagaaatatgatgcagctatgtacacgttgcttgagcaactgtaccaagaagagtccaaataagattgcatctggctttttcctgcgattgttaacatcaaagctaatgaatgacattgcagatatttgtaaaagtttagcatccttcatcaaaaagccatttgaccgtggagaagtagaatcaatggaagatgatactaatggaaatctaatggaggtggaggatcagtcatccatgaatctatttaacgattaccctgatagtagtgttagtgatgcaaacgaacctggagagagccaaagtaccataggtgccattaatcctttagctgaagaatatctgtcaaagcaagatctacttttcttagacatgctcaagttcttgtgtttgtgtgtaactactgctcagaccaatactgtgtcctttagggcagctgatattcggaggaaattgttaatgttaattgattctagcacgctagaacctaccaaatccctccacctgcatatgtatctaatgcttttaaaggagcttcctggagaagagtaccccttgccaatggaagatgttcttgaacttctgaaaccactatccaatgtgtgttctttgtatcgtcgtgaccaagatgtttgtaaaactattttaaaccatgtccttcatgtagtgaaaaacctaggtcaaagcaatatggactctgagaacacaagggatgctcaaggacagtttcttacagtaattggagcattttggcatctaacaaaggagaggaaatatatattctctgtaagaatggccctagtaaattgccttaaaactttgcttgaggctgatccttattcaaaatgggccattcttaatgtaatgggaaaagactttcctgtaaatgaagtatttacacaatttcttgctgacaatcatcaccaagttcgcatgttggctgcagagtcaatcaatagattgttccaggacacgaagggagattcttccaggttactgaaagcacttcctttgaagcttcagcaaacagcttttgaaaatgcatacttgaaagctcaggaaggaatgagagaaatgtcccatagtgctgagaaccctgaaactttggatgaaatttataatagaaaatctgttttactgacgttgatagctgtggttttatcctgtagccctatctgcgaaaaacaggctttgtttgccctgtgtaaatctgtgaaagagaatggattagaacctcaccttgtgaaaaaggttttagagaaagtttctgaaacttttggatatagacgtttagaagactttatggcatctcatttagattatctggttttggaatggctaaatcttcaagatactgaatacaacttatcttcttttccttttattttattaaactacacaaatattgaggatttctatagatcttgttataaggttttgattccacatctggtgattagaagtcattttgatgaggtgaagtccattgctaatcagattcaagaggactggaaaagtcttctaacagactgctttccaaagattcttgtaaatattcttccttattttgcctatgagggtaccagagacagtgggatggcacagcaaagagagactgctaccaaggtctatgatatgcttaaaagtgaaaacttattgggaaaacagattgatcacttattcattagtaatttaccagagattgtggtggagttattgatgacgttacatgagccagcaaattctagtgccagtcagagcactgacctctgtgacttttcaggggatttggatcctgctcctaatccacctcattttccatcgcatgtgattaaagcaacatttgcctatatcagcaattgtcataaaaccaagttaaaaagcattttagaaattctttccaaaagccctgattcctatcagaaaattcttcttgccatatgtgagcaagcagctgaaacaaataatgtttataagaagcacagaattcttaaaatatatcacctgtttgttagtttattactgaaagatataaaaagtggcttaggaggagcttgggcctttgttcttcgagacgttatttatactttgattcactatatcaaccaaaggccttcttgtatcatggatgtgtcattacgtagcttctccctttgttgtgacttattaagtcaggtttgccagacagccgtgacttactgtaaggatgctctagaaaaccatcttcatgttattgttggtacacttataccccttgtgtatgagcaggtggaggttcagaaacaggtattggacttgttgaaatacttagtgatagataacaaggataatgaaaacctctatatcacgattaagcttttagatccttttcctgaccatgttgtttttaaggatttgcgtattactcagcaaaaaatcaaatacagtagaggacccttttcactcttggaggaaattaaccattttctctcagtaagtgtttatgatgcacttccattgacaagacttgaaggactaaaggatcttcgaagacaactggaactacataaagatcagatggtggacattatgagagcttctcaggataatccgcaagatgggattatggtgaaactagttgtcaatttgttgcagttatccaagatggcaataaaccacactggtgaaaaagaagttctagaggctgttggaagctgcttgggagaagtgggtcctatagatttctctaccatagctatacaacatagtaaagatgcatcttataccaaggcccttaagttatttgaagataaagaacttcagtggaccttcataatgctgacctacctgaataacacactggtagaagattgtgtcaaagttcgatcagcagctgttacctgtttgaaaaacattttagccacaaagactggacatagtttctgggagatttataagatgacaacagatccaatgctggcctatctacagccttttagaacatcaagaaaaaagtttttagaagtacccagatttgacaaagaaaacccttttgaaggcctggatgatataaatctgtggattcctctaagtgaaaatcatgacatttggataaagacactgacttgtgcttttttggacagtggaggcacaaaatgtgaaattcttcaattattaaagccaatgtgtgaagtgaaaactgacttttgtcagactgtacttccatacttgattcatgatattttactccaagatacaaatgaatcatggagaaatctgctttctacacatgttcagggatttttcaccagctgtcttcgacacttctcgcaaacgagccgatccacaacccctgcaaacttggattcagagtcagagcactttttccgatgctgtttggataaaaaatcacaaagaacaatgcttgctgttgtggactacatgagaagacaaaagagaccttcttcaggaacaatttttaatgatgctttctggctggatttaaattatctagaagttgccaaggtagctcagtcttgtgctgctcactttacagctttactctatgcagaaatctatgcagataagaaaagtatggatgatcaagagaaaagaagtcttgcatttgaagaaggaagccagagtacaactatttctagcttgagtgaaaaaagtaaagaagaaactggaataagtttacaggatcttctcttagaaatctacagaagtataggggagccagatagtttgtatggctgtggtggagggaagatgttacaacccattactagactacgaacatatgaacacgaagcaatgtggggcaaagccctagtaacatatgacctcgaaacagcaatcccctcatcaacacgccaggcaggaatcattcaggccttgcagaatttgggactctgccatattctttccgtctatttaaaaggattggattatgaaaataaagactggtgtcctgaactagaagaacttcattaccaagcagcatggaggaatatgcagtgggaccattgcacttccgtcagcaaagaagtagaaggaaccagttaccatgaatcattgtacaatgctctacaatctctaagagacagagaattctctacattttatgaaagtctcaaatatgccagagtaaaagaagtggaagagatgtgtaagcgcagccttgagtctgtgtattcgctctatcccacacttagcaggttgcaggccattggagagctggaaagcattggggagcttttctcaagatcagtcacacatagacaactctctgaagtatatattaagtggcagaaacactcccagcttctcaaggacagtgattttagttttcaggagcctatcatggctctacgcacagtcattttggagatcctgatggaaaaggaaatggacaactcacaaagagaatgtattaaggacattctcaccaaacaccttgtagaactctctatactggccagaactttcaagaacactcagctccctgaaagggcaatatttcaaattaaacagtacaattcagttagctgtggagtctctgagtggcagctggaagaagcacaagtattctgggcaaaaaaggagcagagtcttgccctgagtattctcaagcaaatgatcaagaagttggatgccagctgtgcagcgaacaatcccagcctaaaacttacatacacagaatgtctgagggtttgtggcaactggttagcagaaacgtgcttagaaaatcctgcggtcatcatgcagacctatctagaaaaggcagtagaagttgctggaaattatgatggagaaagtagtgatgagctaagaaatggaaaaatgaaggcatttctctcattagcccggttttcagatactcaataccaaagaattgaaaactacatgaaatcatcggaatttgaaaacaagcaagctctcctgaaaagagccaaagaggaagtaggtctccttagggaacataaaattcagacaaacagatacacagtaaaggttcagcgagagctggagttggatgaattagccctgcgtgcactgaaagaggatcgtaaacgcttcttatgtaaagcagttgaaaattatatcaactgcttattaagtggagaagaacatgatatgtgggtattccgactttgttccctctggcttgaaaattctggagtttctgaagtcaatggcatgatgaagagagacggaatgaagattccaacatataaatttttgcctcttatgtaccaattggctgctagaatggggaccaagatgatgggaggcctaggatttcatgaagtcctcaataatctaatctctagaatttcaatggatcacccccatcacactttgtttattatactggccttagcaaatgcaaacagagatgaatttctgactaaaccagaggtagccagaagaagcagaataactaaaaatgtgcctaaacaaagctctcagcttgatgaggatcgaacagaggctgcaaatagaataatatgtactatcagaagtaggagacctcagatggtcagaagtgttgaggcactttgtgatgcttatattatattagcaaacttagatgccactcagtggaagactcagagaaaaggcataaatattccagcagaccagccaattactaaacttaagaatttagaagatgttgttgtccctactatggaaattaaggtggaccacacaggagaatatggaaatctggtgactatacagtcatttaaagcagaatttcgcttagcaggaggtgtaaatttaccaaaaataatagattgtgtaggttccgatggcaaggagaggagacagcttgttaagggccgtgatgacctgagacaagatgctgtcatgcaacaggtcttccagatgtgtaatacattactgcagagaaacacggaaactaggaagaggaaattaactatctgtacttataaggtggttcccctctctcagcgaagtggtgttcttgaatggtgcacaggaactgtccccattggtgaatttcttgttaacaatgaagatggtgctcataaaagatacaggccaaatgatttcagtgcctttcagtgccaaaagaaaatgatggaggtgcaaaaaaagtcttttgaagagaaatatgaagtcttcatggatgtttgccaaaattttcaaccagttttccgttacttctgcatggaaaaattcttggatccagctatttggtttgagaagcgattggcttatacgcgcagtgtagctacttcttctattgttggttacatacttggacttggtgatagacatgtacagaatatcttgataaatgagcagtcagcagaacttgtacatatagatctaggtgttgcttttgaacagggcaaaatccttcctactcctgagacagttccttttagactcaccagagatattgtggatggcatgggcattacgggtgttgaaggtgtcttcagaagatgctgtgagaaaaccatggaagtgatgagaaactctcaggaaactctgttaaccattgtagaggtccttctatatgatccactctttgactggaccatgaatcctttgaaagctttgtatttacagcagaggccggaagatgaaactgagcttcaccctactctgaatgcagatgaccaagaatgcaaacgaaatctcagtgatattgaccagagtttcaacaaagtagctgaacgtgtcttaatgagactacaagagaaactgaaaggagtggaagaaggcactgtgctcagtgttggtggacaagtgaatttgctcatacagcaggccatagaccccaaaaatctcagccgacttttcccaggatggaaagcttgggtgtgatcttcagtatatgaattaccctttcattcagcctttagaaattatattttagcctttatttttaacctgccaacatactttaagtagggattaatatttaagtgaactattgtgggtttttttgaatgttggttttaatacttgatttaatcaccactcaaaaatgttttgatggtcttaaggaacatctctgctttcactctttagaaataatggtcattcgggctgggcgcagcggctcacgcctgtaatcccagcactttgggaggccgaggtgagcggatcacaaggtcaggagttcgagaccagcctggccaagagaccagcctggccagtatggtgaaaccctgtctctactaaaaatacaaaaattagccgagcatggtggcgggcacctgtaatcccagctactcgagaggctgaggcaggagaatctcttgaacctgggaggtgaaggttgctgtgggccaaaatcatgccattgcactccagcctgggtgacaagagcgaaactccatctcaaaaaaaaaaaaaaaaaacagaaacttatttggatttttcctagtaagatcactcagtgttactaaataatgaagttgttatggagaacaaatttcaaagacacagttagtgtagttactatttttttaagtgtgtattaaaacttctcattctattctctttatcttttaagcccttctgtactgtccatgtatgttatctttctgtgataacttcatagattgccttctagttcatgaattctcttgtcagatgtatataatctcttttaccctatccattgggcttcttctttcagaaattgtttttcatttctaattatgcatcatttttcagatctctgtttcttgatgtcatttttaatgtttttttaatgttttttatgtcactaattattttaaatgtctgtacttgatagacactgtaatagttctattaaatttagttcctgctgtttatatctgttgatttttgtatttgataggctgttcatccagttttgtctttttgaaaagtgagtttattttcagcaaggctttatctatgggaatcttgagtgtctgtttatgtcatattcccagggctgttgctgcacacaagcccattcttattttaatttcttggctttagggtttccatacctgaagtgtagcataaatactgataggagatttcccaggccaaggcaaacacacttcctcctcatctccttgtgctagtgggcagaatatttgattgatgcctttttcactgagagtataagcttccatgtgtcccacctttatggcaggggtggaaggaggtacatttaattcccactgcctgcctttggcaagccctgggttctttgctccccatatagatgtctaagctaaaagccgtgggttaatgagactggcaaattgttccaggacagctacagcatcagctcacatattcacctctctggtttttcattcccctcatttttttctgagacagagtcttgctctgtcacccaggctggagtgcagtggcatgatctcagctcactgaaacctctgcctcctgggttcaagcaattctcctgcctcagcctccngagtagctgggactacaggcgtgtgccaacacgcccggctaattttttgtatttttattagagacggagtttcaccgtgttagccaggatggtctcgatcgcttgacctcgtgatccaccctcctcggcctcccaaagtgctgggattacaggtgtgagccaccgcgcccggcctcattcccctcatttttgaccgtaaggatttcccctttcttgtaagttctgctatgtatttaaaagaatgttttctacattttatccagcatttctctgtgttctgttggaagggaagggcttaggtatctagtttgatacataggtagaagtggaacatttctctgtcccccagctgtcatcatataagataaacatcagataaaaagccacctgaaagtaaaactactgactcgtgtattagtgagtataatctcttctccatccttaggaaaatgttcatcccagctgcggagattaacaaatgggtgattgagctttctcctcgtatttggaccttgaaggttatataaatttttttcttatgaagagttggcatttctttttattgccaatggcaggcactcattcatatttgatctcctcaccttcccctcccctaaaaccaatctccagaactttttggactataaatttcttggtttgacttctggagaactgttcagaatattactttgcatttcaaattacaaacttaccttggtgtatctttttcttacaagctgcctaaatgaatatttggtatatattggtagttttattactatagtaaatcaaggaaatgcagtaaacttaaaatgtctttaagaaagccctgaaatcttcatgggtgaaattagaaattatcaactagataatagtatagataaatgaatttgtagctaattcttgctagttgttgcatccagagagcatacacttcacctgttacagcatacaaatccagtggttttcagtatatgcacaaattgtgctaccatcaccaccagatcaccaccgaactcttccg

SEQ ID NO: 279231 - DNA, 12288 bp, Homo sapiens
  misc_feature (340)..(340): n is a, c, g, or t
  misc_feature (2481)..(2481): n is a, c, g, or t
  misc_feature (3071)..(3071): n is a, c, g, or t
  misc_feature (11595)..(11595): n is a, c, g, or t
ccgcgtccgcgcttacccaatacaagccgggctacgtccgagggtaacaacatgatcaaaaccacagcaggaaccacaataaggaacaagactcaggttaaagcaaacacagcgacagctcctgcgccgcatctcctggttccagtggcggcactgaactcgcggcaatttgtcccgcctctttcgcttcacggcagccaatcgcttccgccagagaaagaaaggcgccgaaatgaaacccgcctccgttcgccttcggaactgtcgtcacttccgtcctcagacttggaggggcggggatgaggagggcggggaggacgacgagggcgaagagggtggntgagagccccggagcccgagccgaagggcgagccgcaaacgctaagtcgctggccattggtggacatggcgcaggcgcgtttgctccgacgggccgaatgttttggggcagtgttttgagcgcggagaccgcgtgatactggatgcgcatgggcataccgtgctctgcggctgcttggcgttgcttcttcctccagaagtgggcgctgggcagtcacgcagggtttgaaccggaagcgggagtaggtagctgcgtggctaacggagaaaagaagccgtggccacgggaggaggcgagaggagtcgggatctgcgctgcagccaccgccgcggttgatactactttgaccttccgagtgcagtgaggcatacatcacaatttggaattatgcattggtttatcaatttacttgtttattgtcaccctgctgcccagatatgacttcatgaggacagtgatgtgtgttctgaaattgtgaaccatgagtctagtacttaatgatctgcttatctgctgccgtcaactagaacatgatagagctacagaacgaaagaaagaagttgagaaatttaagcgcctgattcgagatcctgaaacaattaaacatctagatcggcattcagattccaaacaaggaaaatatttgaattgggatgctgtttttagatttttacagaaatatattcagaaagaaacagaatgtctgagaatagcaaaaccaaatgtatcagcctcaacacaagcctccaggcagaaaaagatgcaggaaatcagtagtttggtcaaatacttcatcaaatgtgcaaacagaagagcacctaggctaaaatgtcaagaactcttaaattatatcatggatacagtgaaagattcatctaatggtgctatttacggagctgattgtagcaacatactactcaaagacattctttctgtgagaaaatactggtgtgaaatatctcagcaacagtggttagaattgttctctgtgtacttcaggctctatctgaaaccttcacaagatgttcatagagttttagtggctagaataattcatgctgttaccaaaggatgctgttctcagactgacggattaaattccaaatttttggactttttttccaaggctattcagtgtgcgagacaagaaaagagctcttcaggtctaaatcatatcttagcagctcttactatcttcctcaagactttggctgtcaactttcgaattcgagtgtgtgaattaggagatgaaattcttcccactttgctttatatttggactcaacataggcttaatgattctttaaaagaagtcattattgaattatttcaactgcaaatttatatccatcatccgaaaggagccaaaacccaagaaaaaggtgcttatgaatcaacaaaatggagaagtattttatacaacttatatgatctgctagtgaatgagataagtcatataggaagtagaggaaagtattcttcaggatttcgtaatattgccgtcaaagaaaatttgattgaattgatggcagatatctgtcaccaggtttttaatgaagataccagatccttggagatttctcaatcttacactactacacaaagagaatctagtgattacagtgtcccttgcaaaaggaagaaaatagaactaggctgggaagtaataaaagatcaccttcagaagtcacagaatgattttgatcttgtgccttggctacagattgcaacccaattaatatcaaagtatcctgcaagtttacctaactgtgagctgtctccattactgatgatactatctcagcttctaccccaacagcgacatggggaacgtacaccatatgtgttacgatgccttacggaagttgcattgtgtcaagacaagaggtcaaacctagaaagctcacaaaagtcagatttattaaaactctggaataaaatttggtgtattacctttcgtggtataagttctgagcaaatacaagctgaaaactttggcttacttggagccataattcagggtagtttagttgaggttgacagagaattctggaagttatttactgggtcagcctgcagaccttcatgtcctgcagtatgctgtttgactttggcactgaccaccagtatagttccaggancggtaaaaatgggaatagagcaaaatatgtgtgaagtaaatagaagcttttctttaaaggaatcaataatgaaatggctcttattctatcagttagagggtgacttagaaaatagcacagaagtgcctccaattcttcacagtaattttcctcatcttgtactggagaaaattcttgtgagtctcactatgaaaaactgtaaagctgcaatgaattttttccaaagcgtgccagaatgtgaacaccaccaaaaagataaagaagaactttcattctcagaagtagaagaactatttcttcagacaacttttgacaagatggactttttaaccattgtgagagaatgtggtatagaaaagcaccagtccagtattggcttctctgtccaccagaatctcaaggaatcactggatcgctgtcttctgggattatcagaacagcttctgaataattactcatctgagattacaaattcagaaactcttgtccggtgttcacgtcttttggtgggtgtccttggctgctactgttacatgggtgtaatagctgaagaggaagcatataagtcagaattattccagaaagccaantctctaatgcaatgtgcaggagaaagtatcactctgtttaaaaataagacaaatgaggaattcagaattggttccttgagaaatatgatgcagctatgtacacgttgcttgagcaactgtaccaagaagagtccaaataagattgcatctggctttttcctgcgattgttaacatcaaagctaatgaatgacattgcagatatttgtaaaagtttagcatccttcatcaaaaagccatttgaccgtggagaagtagaatcaatggaagatgatactaatggaaatctaatggaggtggaggatcagtcatccatgaatctatttaacgattaccctgatagtagtgttagtgatgcaaacgaacctggagagagccaaagtaccataggtgccattaatcctttagctgaagaatatctgtcaaagcaagatctacttttcttagacatgctcaagttcttgtgtttgtgtgtaactactgctcagaccaatactgtgtcctttagggcagctgatattcggaggaaattgttaatgttaattgattctagcacgctagaacctaccaaatccctccacctgcatatgtatctaatgcttttaaaggagcttcctggagaagagtaccccttgccaatggaagatgttcttgaacttctgaaaccactatccaatgtgtgttctttgtatcgtcgtgaccaagatgtttgtaaaactattttaaaccatgtccttcatgtagtgaaaaacctaggtcaaagcaatatggactctgagaacacaagggatgctcaaggacagtttcttacagtaattggagcattttggcatctaacaaaggagaggaaatatatattctctgtaagaatggccctagtaaattgccttaaaactttgcttgaggctgatccttattcaaaatgggccattcttaatgtaatgggaaaagactttcctgtaaatgaagtatttacacaatttcttgctgacaatcatcaccaagttcgcatgttggctgcagagtcaatcaatagattgttccaggacacgaagggagattcttccaggttactgaaagcacttcctttgaagcttcagcaaacagcttttgaaaatgcatacttgaaagctcaggaaggaatgagagaaatgtcccatagtgctgagaaccctgaaactttggatgaaatttataatagaaaatctgttttactgacgttgatagctgtggttttatcctgtagccctatctgcgaaaaacaggctttgtttgccctgtgtaaatctgtgaaagagaatggattagaacctcaccttgtgaaaaaggttttagagaaagtttctgaaacttttggatatagacgtttagaagactttatggcatctcatttagattatctggttttggaatggctaaatcttcaagatactgaatacaacttatcttcttttccttttattttattaaactacacaaatattgaggatttctatagatcttgttataaggttttgattccacatctggtgattagaagtcattttgatgaggtgaagtccattgctaatcagattcaagaggactggaaaagtcttctaacagactgctttccaaagattcttgtaaatattcttccttattttgcctatgagggtaccagagacagtgggatggcacagcaaagagagactgctaccaaggtctatgatatgcttaaaagtgaaaacttattgggaaaacagattgatcacttattcattagtaatttaccagagattgtggtggagttattgatgacgttacatgagccagcaaattctagtgccagtcagagcactgacctctgtgacttttcaggggatttggatcctgctcctaatccacctcattttccatcgcatgtgattaaagcaacatttgcctatatcagcaattgtcataaaaccaagttaaaaagcattttagaaattctttccaaaagccctgattcctatcagaaaattcttcttgccatatgtgagcaagcagctgaaacaaataatgtttataagaagcacagaattcttaaaatatatcacctgtttgttagtttattactgaaagatataaaaagtggcttaggaggagcttgggcctttgttcttcgagacgttatttatactttgattcactatatcaaccaaaggccttcttgtatcatggatgtgtcattacgtagcttctccctttgttgtgacttattaagtcaggtttgccagacagccgtgacttactgtaaggatgctctagaaaaccatcttcatgttattgttggtacacttataccccttgtgtatgagcaggtggaggttcagaaacaggtattggacttgttgaaatacttagtgatagataacaaggataatgaaaacctctatatcacgattaagcttttagatccttttcctgaccatgttgtttttaaggatttgcgtattactcagcaaaaaatcaaatacagtagaggacccttttcactcttggaggaaattaaccattttctctcagtaagtgtttatgatgcacttccattgacaagacttgaaggactaaaggatcttcgaagacaactggaactacataaagatcagatggtggacattatgagagcttctcaggataatccgcaagatgggattatggtgaaactagttgtcaatttgttgcagttatccaagatggcaataaaccacactggtgaaaaagaagttctagaggctgttggaagctgcttgggagaagtgggtcctatagatttctctaccatagctatacaacatagtaaagatgcatcttataccaaggcccttaagttatttgaagataaagaacttcagtggaccttcataatgctgacctacctgaataacacactggtagaagattgtgtcaaagttcgatcagcagctgttacctgtttgaaaaacattttagccacaaagactggacatagtttctgggagatttataagatgacaacagatccaatgctggcctatctacagccttttagaacatcaagaaaaaagtttttagaagtacccagatttgacaaagaaaacccttttgaaggcctggatgatataaatctgtggattcctctaagtgaaaatcatgacatttggataaagacactgacttgtgcttttttggacagtggaggcacaaaatgtgaaattcttcaattattaaagccaatgtgtgaagtgaaaactgacttttgtcagactgtacttccatacttgattcatgatattttactccaagatacaaatgaatcatggagaaatctgctttctacacatgttcagggatttttcaccagctgtcttcgacacttctcgcaaacgagccgatccacaacccctgcaaacttggattcagagtcagagcactttttccgatgctgtttggataaaaaatcacaaagaacaatgcttgctgttgtggactacatgagaagacaaaagagaccttcttcaggaacaatttttaatgatgctttctggctggatttaaattatctagaagttgccaaggtagctcagtcttgtgctgctcactttacagctttactctatgcagaaatctatgcagataagaaaagtatggatgatcaagagaaaagaagtcttgcatttgaagaaggaagccagagtacaactatttctagcttgagtgaaaaaagtaaagaagaaactggaataagtttacaggatcttctcttagaaatctacagaagtataggggagccagatagtttgtatggctgtggtggagggaagatgttacaacccattactagactacgaacatatgaacacgaagcaatgtggggcaaagccctagtaacatatgacctcgaaacagcaatcccctcatcaacacgccaggcaggaatcattcaggccttgcagaatttgggactctgccatattctttccgtctatttaaaaggattggattatgaaaataaagactggtgtcctgaactagaagaacttcattaccaagcagcatggaggaatatgcagtgggaccattgcacttccgtcagcaaagaagtagaaggaaccagttaccatgaatcattgtacaatgctctacaatctctaagagacagagaattctctacattttatgaaagtctcaaatatgccagagtaaaagaagtggaagagatgtgtaagcgcagccttgagtctgtgtattcgctctatcccacacttagcaggttgcaggccattggagagctggaaagcattggggagcttttctcaagatcagtcacacatagacaactctctgaagtatatattaagtggcagaaacactcccagcttctcaaggacagtgattttagttttcaggagcctatcatggctctacgcacagtcattttggagatcctgatggaaaaggaaatggacaactcacaaagagaatgtattaaggacattctcaccaaacaccttgtagaactctctatactggccagaactttcaagaacactcagctccctgaaagggcaatatttcaaattaaacagtacaattcagttagctgtggagtctctgagtggcagctggaagaagcacaagtattctgggcaaaaaaggagcagagtcttgccctgagtattctcaagcaaatgatcaagaagttggatgccagctgtgcagcgaacaatcccagcctaaaacttacatacacagaatgtctgagggtttgtggcaactggttagcagaaacgtgcttagaaaatcctgcggtcatcatgcagacctatctagaaaaggcagtagaagttgctggaaattatgatggagaaagtagtgatgagctaagaaatggaaaaatgaaggcatttctctcattagcccggttttcagatactcaataccaaagaattgaaaactacatgaaatcatcggaatttgaaaacaagcaagctctcctgaaaagagccaaagaggaagtaggtctccttagggaacataaaattcagacaaacagatacacagtaaaggttcagcgagagctggagttggatgaattagccctgcgtgcactgaaagaggatcgtaaacgcttcttatgtaaagcagttgaaaattatatcaactgcttattaagtggagaagaacatgatatgtgggtattccgactttgttccctctggcttgaaaattctggagtttctgaagtcaatggcatgatgaagagagacggaatgaagattccaacatataaatttttgcctcttatgtaccaattggctgctagaatggggaccaagatgatgggaggcctaggatttcatgaagtcctcaataatctaatctctagaatttcaatggatcacccccatcacactttgtttattatactggccttagcaaatgcaaacagagatgaatttctgactaaaccagaggtagccagaagaagcagaataactaaaaatgtgcctaaacaaagctctcagcttgatgaggatcgaacagaggctgcaaatagaataatatgtactatcagaagtaggagacctcagatggtcagaagtgttgaggcactttgtgatgcttatattatattagcaaacttagatgccactcagtggaagactcagagaaaaggcataaatattccagcagaccagccaattactaaacttaagaatttagaagatgttgttgtccctactatggaaattaaggtggaccacacaggagaatatggaaatctggtgactatacagtcatttaaagcagaatttcgcttagcaggaggtgtaaatttaccaaaaataatagattgtgtaggttccgatggcaaggagaggagacagcttgttaagggccgtgatgacctgagacaagatgctgtcatgcaacaggtcttccagatgtgtaatacattactgcagagaaacacggaaactaggaagaggaaattaactatctgtacttataaggtggttcccctctctcagcgaagtggtgttcttgaatggtgcacaggaactgtccccattggtgaatttcttgttaacaatgaagatggtgctcataaaagatacaggccaaatgatttcagtgcctttcagtgccaaaagaaaatgatggaggtgcaaaaaaagtcttttgaagagaaatatgaagtcttcatggatgtttgccaaaattttcaaccagttttccgttacttctgcatggaaaaattcttggatccagctatttggtttgagaagcgattggcttatacgcgcagtgtagctacttcttctattgttggttacatacttggacttggtgatagacatgtacagaatatcttgataaatgagcagtcagcagaacttgtacatatagatctaggtgttgcttttgaacagggcaaaatccttcctactcctgagacagttccttttagactcaccagagatattgtggatggcatgggcattacgggtgttgaaggtgtcttcagaagatgctgtgagaaaaccatggaagtgatgagaaactctcaggaaactctgttaaccattgtagaggtccttctatatgatccactctttgactggaccatgaatcctttgaaagctttgtatttacagcagaggccggaagatgaaactgagcttcaccctactctgaatgcagatgaccaagaatgcaaacgaaatctcagtgatattgaccagagtttcaacaaagtagctgaacgtgtcttaatgagactacaagagaaactgaaaggagtggaagaaggcactgtgctcagtgttggtggacaagtgaatttgctcatacagcaggccatagaccccaaaaatctcagccgacttttcccaggatggaaagcttgggtgtgatcttcagtatatgaattaccctttcattcagcctttagaaattatattttagcctttatttttaacctgccaacatactttaagtagggattaatatttaagtgaactattgtgggtttttttgaatgttggttttaatacttgatttaatcaccactcaaaaatgttttgatggtcttaaggaacatctctgctttcactctttagaaataatggtcattcgggctgggcgcagcggctcacgcctgtaatcccagcactttgggaggccgaggtgagcggatcacaaggtcaggagttcgagaccagcctggccaagagaccagcctggccagtatggtgaaaccctgtctctactaaaaatacaaaaattagccgagcatggtggcgggcacctgtaatcccagctactcgagaggctgaggcaggagaatctcttgaacctgggaggtgaaggttgctgtgggccaaaatcatgccattgcactccagcctgggtgacaagagcgaaactccatctcaaaaaaaaaaaaaaaaaacagaaacttatttggatttttcctagtaagatcactcagtgttactaaataatgaagttgttatggagaacaaatttcaaagacacagttagtgtagttactatttttttaagtgtgtattaaaacttctcattctattctctttatcttttaagcccttctgtactgtccatgtatgttatctttctgtgataacttcatagattgccttctagttcatgaattctcttgtcagatgtatataatctcttttaccctatccattgggcttcttctttcagaaattgtttttcatttctaattatgcatcatttttcagatctctgtttcttgatgtcatttttaatgtttttttaatgttttttatgtcactaattattttaaatgtctgtacttgatagacactgtaatagttctattaaatttagttcctgctgtttatatctgttgatttttgtatttgataggctgttcatccagttttgtctttttgaaaagtgagtttattttcagcaaggctttatctatgggaatcttgagtgtctgtttatgtcatattcccagggctgttgctgcacacaagcccattcttattttaatttcttggctttagggtttccatacctgaagtgtagcataaatactgataggagatttcccaggccaaggcaaacacacttcctcctcatctccttgtgctagtgggcagaatatttgattgatgcctttttcactgagagtataagcttccatgtgtcccacctttatggcaggggtggaaggaggtacatttaattcccactgcctgcctttggcaagccctgggttctttgctccccatatagatgtctaagctaaaagccgtgggttaatgagactggcaaattgttccaggacagctacagcatcagctcacatattcacctctctggtttttcattcccctcatttttttctgagacagagtcttgctctgtcacccaggctggagtgcagtggcatgatctcagctcactgaaacctctgcctcctgggttcaagcaattctcctgcctcagcctccngagtagctgggactacaggcgtgtgccaacacgcccggctaattttttgtatttttattagagacggagtttcaccgtgttagccaggatggtctcgatcgcttgacctcgtgatccaccctcctcggcctcccaaagtgctgggattacaggtgtgagccaccgcgcccggcctcattcccctcatttttgaccgtaaggatttcccctttcttgtaagttctgctatgtatttaaaagaatgttttctacattttatccagcatttctctgtgttctgttggaagggaagggcttaggtatctagtttgatacataggtagaagtggaacatttctctgtcccccagctgtcatcatataagataaacatcagataaaaagccacctgaaagtaaaactactgactcgtgtattagtgagtataatctcttctccatccttaggaaaatgttcatcccagctgcggagattaacaaatgggtgattgagctttctcctcgtatttggaccttgaaggttatataaatttttttcttatgaagagttggcatttctttttattgccaatggcaggcactcattcatatttgatctcctcaccttcccctcccctaaaaccaatctccagaactttttggactataaatttcttggtttgacttctggagattgatttttaggggggaacagg

SEQ ID NO: 279232 - DNA, 9192 bp, Homo sapiens
  misc_feature (7204)..(7204): n is a, c, g, or t
ggaattcttaacagtaaagttctgtaattgagacagaattcccaaataaagtcaagagtaaaattcagatagaggagcagttatacatcagtgggaaatttggttggcagaaaaattaccaggtcatacaacttaatgatagacctgaagtcttatttaaaatgattctctaaaattgaagaattggattaagggggccttgtttggctgattttcatactttttcctcttagtctacaggttggctgcatagaagaaaaaggtagagttatttataatcttgtaaatcttggactttgagtcatctattttcttttacagtcatcgaatacttttggaaataaggtaatatatgccttttgagctgtcttgacgttcacagatataaaatattaaatatattttaattttgtgcccttgcagattgatcacttattcattagtaatttaccagagattgtggtggagttattgatgacgttacatgagccagcaaattctagtgccagtcagagcactgacctctgtgacttttcaggggatttggatcctgctcctaatccacctcattttccatcgcatgtgattaaagcaacatttgcctatatcagcaattgtcataaaaccaagttaaaaagcattttagaaattctttccaaaagccctgattcctatcagaaaattcttcttgccatatgtgagcaagcagctgaaacaaataatgtttataagaagcacagaattcttaaaatatatcacctgtttgttagtttattactgaaagatataaaaagtggcttaggaggagcttgggcctttgttcttcgagacgttatttatactttgattcactatatcaaccaaaggccttcttgtatcatggatgtgtcattacgtagcttctccctttgttgtgacttattaagtcaggtttgccagacagccgtgacttactgtaaggatgctctagaaaaccatcttcatgttattgttggtacacttataccccttgtgtatgagcaggtggaggttcagaaacaggtattggacttgttgaaatacttagtgatagataacaaggataatgaaaacctctatatcacgattaagcttttagatccttttcctgaccatgttgtttttaaggatttgcgtattactcagcaaaaaatcaaatacagtagaggacccttttcactcttggaggaaattaaccattttctctcagtaagtgtttatgatgcacttccattgacaagacttgaaggactaaaggatcttcgaagacaactggaactacataaagatcagatggtggacattatgagagcttctcaggataatccgcaagatgggattatggtgaaactagttgtcaatttgttgcagttatccaagatggcaataaaccacactggtgaaaaagaagttctagaggctgttggaagctgcttgggagaagtgggtcctatagatttctctaccatagctatacaacatagtaaagatgcatcttataccaaggcccttaagttatttgaagataaagaacttcagtggaccttcataatgctgacctacctgaataacacactggtagaagattgtgtcaaagttcgatcagcagctgttacctgtttgaaaaacattttagccacaaagactggacatagtttctgggagatttataagatgacaacagatccaatgctggcctatctacagccttttagaacatcaagaaaaaagtttttagaagtacccagatttgacaaagaaaacccttttgaaggcctggatgatataaatctgtggattcctctaagtgaaaatcatgacatttggataaagacactgacttgtgcttttttggacagtggaggcacaaaatgtgaaattcttcaattattaaagccaatgtgtgaagtgaaaactgacttttgtcagactgtacttccatacttgattcatgatattttactccaagatacaaatgaatcatggagaaatctgctttctacacatgttcagggatttttcaccagctgtcttcgacacttctcgcaaacgagccgatccacaacccctgcaaacttggattcagagtcagagcactttttccgatgctgtttggataaaaaatcacaaagaacaatgcttgctgttgtggactacatgagaagacaaaagagaccttcttcaggaacaatttttaatgatgctttctggctggatttaaattatctagaagttgccaaggtagctcagtcttgtgctgctcactttacagctttactctatgcagaaatctatgcagataagaaaagtatggatgatcaagagaaaagaagtcttgcatttgaagaaggaagccagagtacaactatttctagcttgagtgaaaaaagtaaagaagaaactggaataagtttacaggatcttctcttagaaatctacagaagtataggggagccagatagtttgtatggctgtggtggagggaagatgttacaacccattactagactacgaacatatgaacacgaagcaatgtggggcaaagccctagtaacatatgacctcgaaacagcaatcccctcatcaacacgccaggcaggaatcattcaggccttgcagaatttgggactctgccatattctttccgtctatttaaaaggattggattatgaaaataaagactggtgtcctgaactagaagaacttcattaccaagcagcatggaggaatatgcagtgggaccattgcacttccgtcagcaaagaagtagaaggaaccagttaccatgaatcattgtacaatgctctacaatctctaagagacagagaattctctacattttatgaaagtctcaaatatgccagagtaaaagaagtggaagagatgtgtaagcgcagccttgagtctgtgtattcgctctatcccacacttagcaggttgcaggccattggagagctggaaagcattggggagcttttctcaagatcagtcacacatagacaactctctgaagtatatattaagtggcagaaacactcccagcttctcaaggacagtgattttagttttcaggagcctatcatggctctacgcacagtcattttggagatcctgatggaaaaggaaatggacaactcacaaagagaatgtattaaggacattctcaccaaacaccttgtagaactctctatactggccagaactttcaagaacactcagctccctgaaagggcaatatttcaaattaaacagtacaattcagttagctgtggagtctctgagtggcagctggaagaagcacaagtattctgggcaaaaaaggagcagagtcttgccctgagtattctcaagcaaatgatcaagaagttggatgccagctgtgcagcgaacaatcccagcctaaaacttacatacacagaatgtctgagggtttgtggcaactggttagcagaaacgtgcttagaaaatcctgcggtcatcatgcagacctatctagaaaaggcagtagaagttgctggaaattatgatggagaaagtagtgatgagctaagaaatggaaaaatgaaggcatttctctcattagcccggttttcagatactcaataccaaagaattgaaaactacatgaaatcatcggaatttgaaaacaagcaagctctcctgaaaagagccaaagaggaagtaggtctccttagggaacataaaattcagacaaacagatacacagtaaaggttcagcgagagctggagttggatgaattagccctgcgtgcactgaaagaggatcgtaaacgcttcttatgtaaagcagttgaaaattatatcaactgcttattaagtggagaagaacatgatatgtgggtattccgactttgttccctctggcttgaaaattctggagtttctgaagtcaatggcatgatgaagagagacggaatgaagattccaacatataaatttttgcctcttatgtaccaattggctgctagaatggggaccaagatgatgggaggcctaggatttcatgaagtcctcaataatctaatctctagaatttcaatggatcacccccatcacactttgtttattatactggccttagcaaatgcaaacagagatgaatttctgactaaaccagaggtagccagaagaagcagaataactaaaaatgtgcctaaacaaagctctcagcttgatgaggatcgaacagaggctgcaaatagaataatatgtactatcagaagtaggagacctcagatggtcagaagtgttgaggcactttgtgatgcttatattatattagcaaacttagatgccactcagtggaagactcagagaaaaggcataaatattccagcagaccagccaattactaaacttaagaatttagaagatgttgttgtccctactatggaaattaaggtggaccacacaggagaatatggaaatctggtgactatacagtcatttaaagcagaatttcgcttagcaggaggtgtaaatttaccaaaaataatagattgtgtaggttccgatggcaaggagaggagacagcttgttaagggccgtgatgacctgagacaagatgctgtcatgcaacaggtcttccagatgtgtaatacattactgcagagaaacacggaaactaggaagaggaaattaactatctgtacttataaggtggttcccctctctcagcgaagtggtgttcttgaatggtgcacaggaactgtccccattggtgaatttcttgttaacaatgaagatggtgctcataaaagatacaggccaaatgatttcagtgcctttcagtgccaaaagaaaatgatggaggtgcaaaaaaagtcttttgaagagaaatatgaagtcttcatggatgtttgccaaaattttcaaccagttttccgttacttctgcatggaaaaattcttggatccagctatttggtttgagaagcgattggcttatacgcgcagtgtagctacttcttctattgttggttacatacttggacttggtgatagacatgtacagaatatcttgataaatgagcagtcagcagaacttgtacatatagatctaggtgttgcttttgaacagggcaaaatccttcctactcctgagacagttccttttagactcaccagagatattgtggatggcatgggcattacgggtgttgaaggtgtcttcagaagatgctgtgagaaaaccatggaagtgatgagaaactctcaggaaactctgttaaccattgtagaggtccttctatatgatccactctttgactggaccatgaatcctttgaaagctttgtatttacagcagaggccggaagatgaaactgagcttcaccctactctgaatgcagatgaccaagaatgcaaacgaaatctcagtgatattgaccagagtttcaacaaagtagctgaacgtgtcttaatgagactacaagagaaactgaaaggagtggaagaaggcactgtgctcagtgttggtggacaagtgaatttgctcatacagcaggccatagaccccaaaaatctcagccgacttttcccaggatggaaagcttgggtgtgatcttcagtatatgaattaccctttcattcagcctttagaaattatattttagcctttatttttaacctgccaacatactttaagtagggattaatatttaagtgaactattgtgggtttttttgaatgttggttttaatacttgatttaatcaccactcaaaaatgttttgatggtcttaaggaacatctctgctttcactctttagaaataatggtcattcgggctgggcgcagcggctcacgcctgtaatcccagcactttgggaggccgaggtgagcggatcacaaggtcaggagttcgagaccagcctggccaagagaccagcctggccagtatggtgaaaccctgtctctactaaaaatacaaaaattagccgagcatggtggcgggcacctgtaatcccagctactcgagaggctgaggcaggagaatctcttgaacctgggaggtgaaggttgctgtgggccaaaatcatgccattgcactccagcctgggtgacaagagcgaaactccatctcaaaaaaaaaaaaaaaaaacagaaacttatttggatttttcctagtaagatcactcagtgttactaaataatgaagttgttatggagaacaaatttcaaagacacagttagtgtagttactatttttttaagtgtgtattaaaacttctcattctattctctttatcttttaagcccttctgtactgtccatgtatgttatctttctgtgataacttcatagattgccttctagttcatgaattctcttgtcagatgtatataatctcttttaccctatccattgggcttcttctttcagaaattgtttttcatttctaattatgcatcatttttcagatctctgtttcttgatgtcatttttaatgtttttttaatgttttttatgtcactaattattttaaatgtctgtacttgatagacactgtaatagttctattaaatttagttcctgctgtttatatctgttgatttttgtatttgataggctgttcatccagttttgtctttttgaaaagtgagtttattttcagcaaggctttatctatgggaatcttgagtgtctgtttatgtcatattcccagggctgttgctgcacacaagcccattcttattttaatttcttggctttagggtttccatacctgaagtgtagcataaatactgataggagatttcccaggccaaggcaaacacacttcctcctcatctccttgtgctagtgggcagaatatttgattgatgcctttttcactgagagtataagcttccatgtgtcccacctttatggcaggggtggaaggaggtacatttaattcccactgcctgcctttggcaagccctgggttctttgctccccatatagatgtctaagctaaaagccgtgggttaatgagactggcaaattgttccaggacagctacagcatcagctcacatattcacctctctggtttttcattcccctcatttttttctgagacagagtcttgctctgtcacccaggctggagtgcagtggcatgatctcagctcactgaaacctctgcctcctgggttcaagcaattctcctgcctcagcctccngagtagctgggactacaggcgtgtgccaacacgcccggctaattttttgtatttttattagagacggagtttcaccgtgttagccaggatggtctcgatcgcttgacctcgtgatccaccctcctcggcctcccaaagtgctgggattacaggtgtgagccaccgcgcccggcctcattcccctcatttttgaccgtaaggatttcccctttcttgtaagttctgctatgtatttaaaagaatgttttctacattttatccagcatttctctgtgttctgttggaagggaagggcttaggtatctagtttgatacataggtagaagtggaacatttctctgtcccccagctgtcatcatataagataaacatcagataaaaagccacctgaaagtaaaactactgactcgtgtattagtgagtataatctcttctccatccttaggaaaatgttcatcccagctgcggagattaacaaatgggtgattgagctttctcctcgtatttggaccttgaaggttatataaatttttttcttatgaagagttggcatttctttttattgccaatggcaggcactcattcatatttgatctcctcaccttcccctcccctaaaaccaatctccagaactttttggactataaatttcttggtttgacttctggagaactgttcagaatattactttgcatttcaaattacaaacttaccttggtgtatctttttcttacaagctgcctaaatgaatatttggtatatattggtagttttattactatagtaaatcaaggaaatgcagtaaacttaaaatgtctttaagaaagccctgaaatcttcatgggtgaaattagaaattatcaactagataatagtatagataaatgaatttgtagctaattcttgctagttgttgcatccagagagctttgaataacatcattaatctactctttagccttgcatggtatgctatgaggctcctgttctgttcaagtattctaatcaatggctttgaaaagtttatcaaatttacatacagatcacaagcctaggagaaataactaattcacagatgacagaattaagattataaaagattttttttttgtaattttagtagagacagggttgccattgtattccagccttggcgacagagcaagactctgcctcaaaaaaaaaaaaaaaaaggttttggcaagctggaactctttctgcaaatgactaagatagaaaactgccaaggacaaatgaggagtagttagattttgaaaatattaatcatagaatagttgttgtatgctaagtcactgacccatattatgtacagcatttctgatctttactttgcaagattagtgatactatcccaatacactgctggagaaatcagaatttggagaaataagttgtccaaggcaagaagatagtaaattataagtacaagtgtaatatggacagtatctaacttgaaaagatttcaggcgaaaagaatctggggtttgccagtcagttgctcaaaaggtcaatgaaaaccaaatagtgaagctatcagagaagctaataaattatagactgcttgaacagttgtgtccagattaagggagataatagctttcccaccctactttgtgcaggtcatacctccccaaagtgtttacctaatcagtaggttcacaaactcttggtcattatagtatatgcctaaaatgtatgcacttaggaatgctaaaaatttaaatatggtctaaagcaaataaaagcaaagaggaaaaactttggacatcgtaaagactagaatagtcttttaaaaagaaagccagtatattggtttgaaatatagagatgtgtcccaatttcaagtattttaattgcaccttaatgaaattatctattttctatagattttagtactattgaatgtattactttactgttacctgaatttattataaagtgtttttgaataaataattctaaaagca

SEQ ID NO: 279233 - DNA, 13155 bp, Homo sapiens
  misc_feature (2141)..(2141): n is a, c, g, or t
  misc_feature (2731)..(2731): n is a, c, g, or t
  misc_feature (11167)..(11167): n is a, c, g, or t
cctgaggtgtttgtatgccataaatgctattataggacttagaactaattttgctttccaaggtaaatattctccttgtaatcttatgttattctaataaattcattcttcataaagagtgccaaaaaacttgggatcatttttggtctaacaccagaaattgtgaattattaaggttataattgtttaagaatgattgcttttcgagatgagcagatcacttgaggtcaggagttcaagaccagcctggtcaacatggtgaaaccctgtctctactaaaagtagaaaaattagcagggtgtggtggtgcacgcctctagtctcagctacttggaggctgaggtgggagaattacttgaacccaggaggtggaggctgcagtgtgctgagtttgtgccactgcactccagcctgggtgacagaccaagattccatctcaaaaaaaaaaaaaaaagaatgattgtttttgctatatattcctataaaagaggcgttggcaaacttactgtgtaaagaggccagatagtaaatgttcttgactttataggccatgtggtcacctctgtcttaattacaaaagcagccataaacaataagtaaatgaatggttgtgactatgttccaataaaatgttatttgcaaagaaaaaaaaaatgaattttgcttggggccataatttgccaatttcttctctacaaaagaagtttagttaatagtaatttcccaaatggaattatttaaatagttgccattccaagtgtcttatttttgttcaaatttatgtttttctttatttgtttattttgaaataggagcacctaggctaaaatgtcaagaactcttaaattatatcatggatacagtgaaagattcatctaatggtgctatttacggagctgattgtagcaacatactactcaaagacattctttctgtgagaaaatactggtgtgaaatatctcagcaacagtggttagaattgttctctgtgtacttcaggctctatctgaaaccttcacaagatgttcatagagttttagtggctagaataattcatgctgttaccaaaggatgctgttctcagactgacggattaaattccaaatttttggactttttttccaaggctattcagtgtgcgagacaagaaaagagctcttcaggtctaaatcatatcttagcagctcttactatcttcctcaagactttggctgtcaactttcgaattcgagtgtgtgaattaggagatgaaattcttcccactttgctttatatttggactcaacataggcttaatgattctttaaaagaagtcattattgaattatttcaactgcaaatttatatccatcatccgaaaggagccaaaacccaagaaaaaggtgcttatgaatcaacaaaatggagaagtattttatacaacttatatgatctgctagtgaatgagataagtcatataggaagtagaggaaagtattcttcaggatttcgtaatattgccgtcaaagaaaatttgattgaattgatggcagatatctgtcaccaggtttttaatgaagataccagatccttggagatttctcaatcttacactactacacaaagagaatctagtgattacagtgtcccttgcaaaaggaagaaaatagaactaggctgggaagtaataaaagatcaccttcagaagtcacagaatgattttgatcttgtgccttggctacagattgcaacccaattaatatcaaagtatcctgcaagtttacctaactgtgagctgtctccattactgatgatactatctcagcttctaccccaacagcgacatggggaacgtacaccatatgtgttacgatgccttacggaagttgcattgtgtcaagacaagaggtcaaacctagaaagctcacaaaagtcagatttattaaaactctggaataaaatttggtgtattacctttcgtggtataagttctgagcaaatacaagctgaaaactttggcttacttggagccataattcagggtagtttagttgaggttgacagagaattctggaagttatttactgggtcagcctgcagaccttcatgtcctgcagtatgctgtttgactttggcactgaccaccagtatagttccaggancggtaaaaatgggaatagagcaaaatatgtgtgaagtaaatagaagcttttctttaaaggaatcaataatgaaatggctcttattctatcagttagagggtgacttagaaaatagcacagaagtgcctccaattcttcacagtaattttcctcatcttgtactggagaaaattcttgtgagtctcactatgaaaaactgtaaagctgcaatgaattttttccaaagcgtgccagaatgtgaacaccaccaaaaagataaagaagaactttcattctcagaagtagaagaactatttcttcagacaacttttgacaagatggactttttaaccattgtgagagaatgtggtatagaaaagcaccagtccagtattggcttctctgtccaccagaatctcaaggaatcactggatcgctgtcttctgggattatcagaacagcttctgaataattactcatctgagattacaaattcagaaactcttgtccggtgttcacgtcttttggtgggtgtccttggctgctactgttacatgggtgtaatagctgaagaggaagcatataagtcagaattattccagaaagccaantctctaatgcaatgtgcaggagaaagtatcactctgtttaaaaataagacaaatgaggaattcagaattggttccttgagaaatatgatgcagctatgtacacgttgcttgagcaactgtaccaagaagagtccaaataagattgcatctggctttttcctgcgattgttaacatcaaagctaatgaatgacattgcagatatttgtaaaagtttagcatccttcatcaaaaagccatttgaccgtggagaagtagaatcaatggaagatgatactaatggaaatctaatggaggtggaggatcagtcatccatgaatctatttaacgattaccctgatagtagtgttagtgatgcaaacgaacctggagagagccaaagtaccataggtgccattaatcctttagctgaagaatatctgtcaaagcaagatctacttttcttagacatgctcaagttcttgtgtttgtgtgtaactactgctcagaccaatactgtgtcctttagggcagctgatattcggaggaaattgttaatgttaattgattctagcacgctagaacctaccaaatccctccacctgcatatgtatctaatgcttttaaaggagcttcctggagaagagtaccccttgccaatggaagatgttcttgaacttctgaaaccactatccaatgtgtgttctttgtatcgtcgtgaccaagatgtttgtaaaactattttaaaccatgtccttcatgtagtgaaaaacctaggtcaaagcaatatggactctgagaacacaagggatgctcaaggacagtttcttacagtaattggagcattttggcatctaacaaaggagaggaaatatatattctctgtaagaatggccctagtaaattgccttaaaactttgcttgaggctgatccttattcaaaatgggccattcttaatgtaatgggaaaagactttcctgtaaatgaagtatttacacaatttcttgctgacaatcatcaccaagttcgcatgttggctgcagagtcaatcaatagattgttccaggacacgaagggagattcttccaggttactgaaagcacttcctttgaagcttcagcaaacagcttttgaaaatgcatacttgaaagctcaggaaggaatgagagaaatgtcccatagtgctgagaaccctgaaactttggatgaaatttataatagaaaatctgttttactgacgttgatagctgtggttttatcctgtagccctatctgcgaaaaacaggctttgtttgccctgtgtaaatctgtgaaagagaatggattagaacctcaccttgtgaaaaaggttttagagaaagtttctgaaacttttggatatagacgtttagaagactttatggcatctcatttagattatctggttttggaatggctaaatcttcaagatactgaatacaacttatcttcttttccttttattttattaaactacacaaatattgaggatttctatagatcttgttataaggttttgattccacatctggtgattagaagtcattttgatgaggtgaagtccattgctaatcagattcaagaggactggaaaagtcttctaacagactgctttccaaagattcttgtaaatattcttccttattttgcctatgagggtaccagagacagtgggatggcacagcaaagagagactgctaccaaggtctatgatatgcttaaaagtgaaaacttattgggaaaacagattgatcacttattcattagtaatttaccagagattgtggtggagttattgatgacgttacatgagccagcaaattctagtgccagtcagagcactgacctctgtgacttttcaggggatttggatcctgctcctaatccacctcattttccatcgcatgtgattaaagcaacatttgcctatatcagcaattgtcataaaaccaagttaaaaagcattttagaaattctttccaaaagccctgattcctatcagaaaattcttcttgccatatgtgagcaagcagctgaaacaaataatgtttataagaagcacagaattcttaaaatatatcacctgtttgttagtttattactgaaagatataaaaagtggcttaggaggagcttgggcctttgttcttcgagacgttatttatactttgattcactatatcaaccaaaggccttcttgtatcatggatgtgtcattacgtagcttctccctttgttgtgacttattaagtcaggtttgccagacagccgtgacttactgtaaggatgctctagaaaaccatcttcatgttattgttggtacacttataccccttgtgtatgagcaggtggaggttcagaaacaggtattggacttgttgaaatacttagtgatagataacaaggataatgaaaacctctatatcacgattaagcttttagatccttttcctgaccatgttgtttttaaggatttgcgtattactcagcaaaaaatcaaatacagtagaggacccttttcactcttggaggaaattaaccattttctctcagtaagtgtttatgatgcacttccattgacaagacttgaaggactaaaggatcttcgaagacaactggaactacataaagatcagatggtggacattatgagagcttctcaggataatccgcaagatgggattatggtgaaactagttgtcaatttgttgcagttatccaagatggcaataaaccacactggtgaaaaagaagttctagaggctgttggaagctgcttgggagaagtgggtcctatagatttctctaccatagctatacaacatagtaaagatgcatcttataccaaggcccttaagttatttgaagataaagaacttcagtggaccttcataatgctgacctacctgaataacacactggtagaagattgtgtcaaagttcgatcagcagctgttacctgtttgaaaaacattttagccacaaagactggacatagtttctgggagatttataagatgacaacagatccaatgctggcctatctacagccttttagaacatcaagaaaaaagtttttagaagtacccagatttgacaaagaaaacccttttgaaggcctggatgatataaatctgtggattcctctaagtgaaaatcatgacatttggataaagacactgacttgtgcttttttggacagtggaggcacaaaatgtgaaattcttcaattattaaagccaatgtgtgaagtgaaaactgacttttgtcagactgtacttccatacttgattcatgatattttactccaagatacaaatgaatcatggagaaatctgctttctacacatgttcagggatttttcaccagctgtcttcgacacttctcgcaaacgagccgatccacaacccctgcaaacttggattcagaccttcttcaggaacaatttttaatgatgctttctggctggatttaaattatctagaagttgccaaggtagctcagtcttgtgctgctcactttacagctttactctatgcagaaatctatgcagataagaaaagtatggatgatcaagagaaaagaagtcttgcatttgaagaaggaagccagagtacaactatttctagcttgagtgaaaaaagtaaagaagaaactggaataagtttacaggatcttctcttagaaatctacagaagtataggggagccagatagtttgtatggctgtggtggagggaagatgttacaacccattactagactacgaacatatgaacacgaagcaatgtggggcaaagccctagtaacatatgacctcgaaacagcaatcccctcatcaacacgccaggcaggaatcattcaggccttgcagaatttgggactctgccatattctttccgtctatttaaaaggattggattatgaaaataaagactggtgtcctgaactagaagaacttcattaccaagcagcatggaggaatatgcagtgggaccattgcacttccgtcagcaaagaagtagaaggaaccagttaccatgaatcattgtacaatgctctacaatctctaagagacagagaattctctacattttatgaaagtctcaaatatgccagagtaaaagaagtggaagagatgtgtaagcgcagccttgagtctgtgtattcgctctatcccacacttagcaggttgcaggccattggagagctggaaagcattggggagcttttctcaagatcagtcacacatagacaactctctgaagtatatattaagtggcagaaacactcccagcttctcaaggacagtgattttagttttcaggagcctatcatggctctacgcacagtcattttggagatcctgatggaaaaggaaatggacaactcacaaagagaatgtattaaggacattctcaccaaacaccttgtagaactctctatactggccagaactttcaagaacactcagctccctgaaagggcaatatttcaaattaaacagtacaattcagttagctgtggagtctctgagtggcagctggaagaagcacaagtattctgggcaaaaaaggagcagagtcttgccctgagtattctcaagcaaatgatcaagaagttggatgccagctgtgcagcgaacaatcccagcctaaaacttacatacacagaatgtctgagggtttgtggcaactggttagcagaaacgtgcttagaaaatcctgcggtcatcatgcagacctatctagaaaaggcagtagaagttgctggaaattatgatggagaaagtagtgatgagctaagaaatggaaaaatgaaggcatttctctcattagcccggttttcagatactcaataccaaagaattgaaaactacatgaaatcatcggaatttgaaaacaagcaagctctcctgaaaagagccaaagaggaagtaggtctccttagggaacataaaattcagacaaacagatacacagtaaaggttcagcgagagctggagttggatgaattagccctgcgtgcactgaaagaggatcgtaaacgcttcttatgtaaagcagttgaaaattatatcaactgcttattaagtggagaagaacatgatatgtgggtattccgactttgttccctctggcttgaaaattctggagtttctgaagtcaatggcatgatgaagagagacggaatgaagattccaacatataaatttttgcctcttatgtaccaattggctgctagaatggggaccaagatgatgggaggcctaggatttcatgaagtcctcaataatctaatctctagaatttcaatggatcacccccatcacactttgtttattatactggccttagcaaatgcaaacagagatgaatttctgactaaaccagaggtagccagaagaagcagaataactaaaaatgtgcctaaacaaagctctcagcttgatgaggatcgaacagaggctgcaaatagaataatatgtactatcagaagtaggagacctcagatggtcagaagtgttgaggcactttgtgatgcttatattatattagcaaacttagatgccactcagtggaagactcagagaaaaggcataaatattccagcagaccagccaattactaaacttaagaatttagaagatgttgttgtccctactatggaaattaaggtggaccacacaggagaatatggaaatctggtgactatacagtcatttaaagcagaatttcgcttagcaggaggtgtaaatttaccaaaaataatagattgtgtaggttccgatggcaaggagaggagacagcttgttaagggccgtgatgacctgagacaagatgctgtcatgcaacaggtcttccagatgtgtaatacattactgcagagaaacacggaaactaggaagaggaaattaactatctgtacttataaggtggttcccctctctcagcgaagtggtgttcttgaatggtgcacaggaactgtccccattggtgaatttcttgttaacaatgaagatggtgctcataaaagatacaggccaaatgatttcagtgcctttcagtgccaaaagaaaatgatggaggtgcaaaaaaagtcttttgaagagaaatatgaagtcttcatggatgtttgccaaaattttcaaccagttttccgttacttctgcatggaaaaattcttggatccagctatttggtttgagaagcgattggcttatacgcgcagtgtagctacttcttctattgttggttacatacttggacttggtgatagacatgtacagaatatcttgataaatgagcagtcagcagaacttgtacatatagatctaggtgttgcttttgaacagggcaaaatccttcctactcctgagacagttccttttagactcaccagagatattgtggatggcatgggcattacgggtgttgaaggtgtcttcagaagatgctgtgagaaaaccatggaagtgatgagaaactctcaggaaactctgttaaccattgtagaggtccttctatatgatccactctttgactggaccatgaatcctttgaaagctttgtatttacagcagaggccggaagatgaaactgagcttcaccctactctgaatgcagatgaccaagaatgcaaacgaaatctcagtgatattgaccagagtttcaacaaagtagctgaacgtgtcttaatgagactacaagagaaactgaaaggagtggaagaaggcactgtgctcagtgttggtggacaagtgaatttgctcatacagcaggccatagaccccaaaaatctcagccgacttttcccaggatggaaagcttgggtgtgatcttcagtatatgaattaccctttcattcagcctttagaaattatattttagcctttatttttaacctgccaacatactttaagtagggattaatatttaagtgaactattgtgggtttttttgaatgttggttttaatacttgatttaatcaccactcaaaaatgttttgatggtcttaaggaacatctctgctttcactctttagaaataatggtcattcgggctgggcgcagcggctcacgcctgtaatcccagcactttgggaggccgaggtgagcggatcacaaggtcaggagttcgagaccagcctggccaagagaccagcctggccagtatggtgaaaccctgtctctactaaaaatacaaaaattagccgagcatggtggcgggcacctgtaatcccagctactcgagaggctgaggcaggagaatctcttgaacctgggaggtgaaggttgctgtgggccaaaatcatgccattgcactccagcctgggtgacaagagcgaaactccatctcaaaaaaaaaaaaaaaaaacagaaacttatttggatttttcctagtaagatcactcagtgttactaaataatgaagttgttatggagaacaaatttcaaagacacagttagtgtagttactatttttttaagtgtgtattaaaacttctcattctattctctttatcttttaagcccttctgtactgtccatgtatgttatctttctgtgataacttcatagattgccttctagttcatgaattctcttgtcagatgtatataatctcttttaccctatccattgggcttcttctttcagaaattgtttttcatttctaattatgcatcatttttcagatctctgtttcttgatgtcatttttaatgtttttttaatgttttttatgtcactaattattttaaatgtctgtacttgatagacactgtaatagttctattaaatttagttcctgctgtttatatctgttgatttttgtatttgataggctgttcatccagttttgtctttttgaaaagtgagtttattttcagcaaggctttatctatgggaatcttgagtgtctgtttatgtcatattcccagggctgttgctgcacacaagcccattcttattttaatttcttggctttagggtttccatacctgaagtgtagcataaatactgataggagatttcccaggccaaggcaaacacacttcctcctcatctccttgtgctagtgggcagaatatttgattgatgcctttttcactgagagtataagcttccatgtgtcccacctttatggcaggggtggaaggaggtacatttaattcccactgcctgcctttggcaagccctgggttctttgctccccatatagatgtctaagctaaaagccgtgggttaatgagactggcaaattgttccaggacagctacagcatcagctcacatattcacctctctggtttttcattcccctcatttttttctgagacagagtcttgctctgtcacccaggctggagtgcagtggcatgatctcagctcactgaaacctctgcctcctgggttcaagcaattctcctgcctcagcctccngagtagctgggactacaggcgtgtgccaacacgcccggctaattttttgtatttttattagagacggagtttcaccgtgttagccaggatggtctcgatcgcttgacctcgtgatccaccctcctcggcctcccaaagtgctgggattacaggtgtgagccaccgcgcccggcctcattcccctcatttttgaccgtaaggatttcccctttcttgtaagttctgctatgtatttaaaagaatgttttctacattttatccagcatttctctgtgttctgttggaagggaagggcttaggtatctagtttgatacataggtagaagtggaacatttctctgtcccccagctgtcatcatataagataaacatcagataaaaagccacctgaaagtaaaactactgactcgtgtattagtgagtataatctcttctccatccttaggaaaatgttcatcccagctgcggagattaacaaatgggtgattgagctttctcctcgtatttggaccttgaaggttatataaatttttttcttatgaagagttggcatttctttttattgccaatggcaggcactcattcatatttgatctcctcaccttcccctcccctaaaaccaatctccagaactttttggactataaatttcttggtttgacttctggagaactgttcagaatattactttgcatttcaaattacaaacttaccttggtgtatctttttcttacaagctgcctaaatgaatatttggtatatattggtagttttattactatagtaaatcaaggaaatgcagtaaacttaaaatgtctttaagaaagccctgaaatcttcatgggtgaaattagaaattatcaactagataatagtatagataaatgaatttgtagctaattcttgctagttgttgcatccagagagctttgaataacatcattaatctactctttagccttgcatggtatgctatgaggctcctgttctgttcaagtattctaatcaatggctttgaaaagtttatcaaatttacatacagatcacaagcctaggagaaataactaattcacagatgacagaattaagattataaaagattttttttttgtaattttagtagagacagggttgccattgtattccagccttggcgacagagcaagactctgcctcaaaaaaaaaaaaaaaaaggttttggcaagctggaactctttctgcaaatgactaagatagaaaactgccaaggacaaatgaggagtagttagattttgaaaatattaatcatagaatagttgttgtatgctaagtcactgacccatattatgtacagcatttctgatctttactttgcaagattagtgatactatcccaatacactgctggagaaatcagaatttggagaaataagttgtccaaggcaagaagatagtaaattataagtacaagtgtaatatggacagtatctaacttgaaaagatttcaggcgaaaagaatctggggtttgccagtcagttgctcaaaaggtcaatgaaaaccaaatagtgaagctatcagagaagctaataaattatagactgcttgaacagttgtgtccagattaagggagataatagctttcccaccctactttgtgcaggtcatacctccccaaagtgtttacctaatcagtaggttcacaaactcttggtcattatagtatatgcctaaaatgtatgcacttaggaatgctaaaaatttaaatatggtctaaagcaaataaaagcaaagaggaaaaactttggacatcgtaaagactagaatagtcttttaaaaagaaagccagtatattggtttgaaatatagagatgtgtcccaatttcaagtattttaattgcaccttaatgaaattatctattttctatagattttagtactattgaatgtattactttactgttacctgaatttattataaagtgtttttgaataaataattctaaaagca

SEQ ID NO: 279234 - DNA, 9273 bp, Homo sapiens
  misc_feature (340)..(340): n is a, c, g, or t
  misc_feature (2393)..(2393): n is a, c, g, or t
  misc_feature (2983)..(2983): n is a, c, g, or t
  misc_feature (6974)..(6974): n is a, c, g, or t
ccgcgtccgcgcttacccaatacaagccgggctacgtccgagggtaacaacatgatcaaaaccacagcaggaaccacaataaggaacaagactcaggttaaagcaaacacagcgacagctcctgcgccgcatctcctggttccagtggcggcactgaactcgcggcaatttgtcccgcctctttcgcttcacggcagccaatcgcttccgccagagaaagaaaggcgccgaaatgaaacccgcctccgttcgccttcggaactgtcgtcacttccgtcctcagacttggaggggcggggatgaggagggcggggaggacgacgagggcgaagagggtggntgagagccccggagcccgagccgaagggcgagccgcaaacgctaagtcgctggccattggtggacatggcgcaggcgcgtttgctccgacgggccgaatgttttggggcagtgttttgagcgcggagaccgcgtgatactggatgcgcatgggcataccgtgctctgcggctgcttggcgttgcttcttcctccagaagtgggcgctgggcagtcacgcagggtttgaaccggaagcgggagtaggtagctgcgtggctaacggagaaaagaagccgtggccacgggaggaggcgagaggagtcgggatctgcgctgcagccaccgccgcggttgatactactttgaccttccgagtgcagtgacagtgatgtgtgttctgaaattgtgaaccatgagtctagtacttaatgatctgcttatctgctgccgtcaactagaacatgatagagctacagaacgaaagaaagaagttgagaaatttaagcgcctgattcgagatcctgaaacaattaaacatctagatcggcattcagattccaaacaaggaaaatatttgaattgggatgctgtttttagatttttacagaaatatattcagaaagaaacagaatgtctgagaatagcaaaaccaaatgtatcagcctcaacacaagcctccaggcagaaaaagatgcaggaaatcagtagtttggtcaaatacttcatcaaatgtgcaaacagaagagcacctaggctaaaatgtcaagaactcttaaattatatcatggatacagtgaaagattcatctaatggtgctatttacggagctgattgtagcaacatactactcaaagacattctttctgtgagaaaatactggtgtgaaatatctcagcaacagtggttagaattgttctctgtgtacttcaggctctatctgaaaccttcacaagatgttcatagagttttagtggctagaataattcatgctgttaccaaaggatgctgttctcagactgacggattaaattccaaatttttggactttttttccaaggctattcagtgtgcgagacaagaaaagagctcttcaggtctaaatcatatcttagcagctcttactatcttcctcaagactttggctgtcaactttcgaattcgagtgtgtgaattaggagatgaaattcttcccactttgctttatatttggactcaacataggcttaatgattctttaaaagaagtcattattgaattatttcaactgcaaatttatatccatcatccgaaaggagccaaaacccaagaaaaaggtgcttatgaatcaacaaaatggagaagtattttatacaacttatatgatctgctagtgaatgagataagtcatataggaagtagaggaaagtattcttcaggatttcgtaatattgccgtcaaagaaaatttgattgaattgatggcagatatctgtcaccaggtttttaatgaagataccagatccttggagatttctcaatcttacactactacacaaagagaatctagtgattacagtgtcccttgcaaaaggaagaaaatagaactaggctgggaagtaataaaagatcaccttcagaagtcacagaatgattttgatcttgtgccttggctacagattgcaacccaattaatatcaaagtatcctgcaagtttacctaactgtgagctgtctccattactgatgatactatctcagcttctaccccaacagcgacatggggaacgtacaccatatgtgttacgatgccttacggaagttgcattgtgtcaagacaagaggtcaaacctagaaagctcacaaaagtcagatttattaaaactctggaataaaatttggtgtattacctttcgtggtataagttctgagcaaatacaagctgaaaactttggcttacttggagccataattcagggtagtttagttgaggttgacagagaattctggaagttatttactgggtcagcctgcagaccttcatgtcctgcagtatgctgtttgactttggcactgaccaccagtatagttccaggancggtaaaaatgggaatagagcaaaatatgtgtgaagtaaatagaagcttttctttaaaggaatcaataatgaaatggctcttattctatcagttagagggtgacttagaaaatagcacagaagtgcctccaattcttcacagtaattttcctcatcttgtactggagaaaattcttgtgagtctcactatgaaaaactgtaaagctgcaatgaattttttccaaagcgtgccagaatgtgaacaccaccaaaaagataaagaagaactttcattctcagaagtagaagaactatttcttcagacaacttttgacaagatggactttttaaccattgtgagagaatgtggtatagaaaagcaccagtccagtattggcttctctgtccaccagaatctcaaggaatcactggatcgctgtcttctgggattatcagaacagcttctgaataattactcatctgagattacaaattcagaaactcttgtccggtgttcacgtcttttggtgggtgtccttggctgctactgttacatgggtgtaatagctgaagaggaagcatataagtcagaattattccagaaagccaantctctaatgcaatgtgcaggagaaagtatcactctgtttaaaaataagacaaatgaggaattcagaattggttccttgagaaatatgatgcagctatgtacacgttgcttgagcaactgtaccaagaagagtccaaataagattgcatctggctttttcctgcgattgttaacatcaaagctaatgaatgacattgcagatatttgtaaaagtttagcatccttcatcaaaaagccatttgaccgtggagaagtagaatcaatggaagatgatactaatggaaatctaatggaggtggaggatcagtcatccatgaatctatttaacgattaccctgatagtagtgttagtgatgcaaacgaacctggagagagccaaagtaccataggtgccattaatcctttagctgaagaatatctgtcaaagcaagatctacttttcttagacatgctcaagttcttgtgtttgtgtgtaactactgctcagaccaatactgtgtcctttagggcagctgatattcggaggaaattgttaatgttaattgattctagcacgctagaacctaccaaatccctccacctgcatatgtatctaatgcttttaaaggagcttcctggagaagagtaccccttgccaatggaagatgttcttgaacttctgaaaccactatccaatgtgtgttctttgtatcgtcgtgaccaagatgtttgtaaaactattttaaaccatgtccttcatgtagtgaaaaacctaggtcaaagcaatatggactctgagaacacaagggatgctcaaggacagtttcttacagtaattggagcattttggcatctaacaaaggagaggaaatatatattctctgtaagaatggccctagtaaattgccttaaaactttgcttgaggctgatccttattcaaaatgggccattcttaatgtaatgggaaaagactttcctgtaaatgaagtatttacacaatttcttgctgacaatcatcaccaagttcgcatgttggctgcagagtcaatcaatagattgttccaggacacgaagggagattcttccaggttactgaaagcacttcctttgaagcttcagcaaacagcttttgaaaatgcatacttgaaagctcaggaaggaatgagagaaatgtcccatagtgctgagaaccctgaaactttggatgaaatttataatagaaaatctgttttactgacgttgatagctgtggttttatcctgtagccctatctgcgaaaaacaggctttgtttgccctgtgtaaatctgtgaaagagaatggattagaacctcaccttgtgaaaaaggttttagagaaagtttctgaaacttttggatatagacgtttagaagactttatggcatctcatttagattatctggttttggaatggctaaatcttcaagatactgaatacaacttatcttcttttccttttattttattaaactacacaaatattgaggatttctatagatcttgttataaggttttgattccacatctggtgattagaagtcattttgatgaggtgaagtccattgctaatcagattcaagaggactggaaaagtcttctaacagactgctttccaaagattcttgtaaatattcttccttattttgcctatgagggtaccagagacagtgggatggcacagcaaagagagactgctaccaaggtctatgatatgcttaaaagtgaaaacttattgggaaaacagattgatcacttattcattagtaatttaccagagattgtggtggagttattgatgacgttacatgagccagcaaattctagtgccagtcagagcactgacctctgtgacttttcaggggatttggatcctgctcctaatccacctcattttccatcgcatgtgattaaagcaacatttgcctatatcagcaattgtcataaaaccaagttaaaaagcattttagaaattctttccaaaagccctgattcctatcagaaaattcttcttgccatatgtgagcaagcagctgaaacaaataatgtttataagaagcacagaattcttaaaatatatcacctgtttgttagtttattactgaaagatataaaaagtggcttaggaggagcttgggcctttgttcttcgagacgttatttatactttgattcactatatcaaccaaaggaaattaaccattttctctcagtaagtgtttatgatgcacttccattgacaagacttgaaggactaaaggatcttcgaagacaactggaactacataaagatcagatggtggacattatgagagcttctcagggtgctaattttaaatgacatgggctatttctacctgtttctttttgaaagaatattttgcaaagtcttgctcttggtttcattgtcacagacttagttcagactctcatcatttagttcagaccctcatttctcatctaactgtaaaactggtcctaactggtcttctcaccctgaactcttcctgttttattcatcctctgccagatgatttctctaaacccaaatatgatcatgtttttctactgcctaaattttttttttaagagacagagtttttttttttttttaagagtctcactctgtcacctaggctggagtgtagtggcaccatcataacttactatgaccttgaattcctgggtacaaggaattctcctgtctcagccttctgaatagctggaacaacaggcacacaccactacacctagctactttatttattttttttattttttgtagggacaggggtcccactatgttgcctaggttggtctcgaattcttggcctcaagtgatcctcctgccttagcctcacaaagcattgggattagaggtgtgacctgggtgacaagagcgaaactccatctcaaaaaaaaaaaaaaaaaacagaaacttatttggatttttcctagtaagatcactcagtgttactaaataatgaagttgttatggagaacaaatttcaaagacacagttagtgtagttactatttttttaagtgtgtattaaaacttctcattctattctctttatcttttaagcccttctgtactgtccatgtatgttatctttctgtgataacttcatagattgccttctagttcatgaattctcttgtcagatgtatataatctcttttaccctatccattgggcttcttctttcagaaattgtttttcatttctaattatgcatcatttttcagatctctgtttcttgatgtcatttttaatgtttttttaatgttttttatgtcactaattattttaaatgtctgtacttgatagacactgtaatagttctattaaatttagttcctgctgtttatatctgttgatttttgtatttgataggctgttcatccagttttgtctttttgaaaagtgagtttattttcagcaaggctttatctatgggaatcttgagtgtctgtttatgtcatattcccagggctgttgctgcacacaagcccattcttattttaatttcttggctttagggtttccatacctgaagtgtagcataaatactgataggagatttcccaggccaaggcaaacacacttcctcctcatctccttgtgctagtgggcagaatatttgattgatgcctttttcactgagagtataagcttccatgtgtcccacctttatggcaggggtggaaggaggtacatttaattcccactgcctgcctttggcaagccctgggttctttgctccccatatagatgtctaagctaaaagccgtgggttaatgagactggcaaattgttccaggacagctacagcatcagctcacatattcacctctctggtttttcattcccctcatttttttctgagacagagtcttgctctgtcacccaggctggagtgcagtggcatgatctcagctcactgaaacctctgcctcctgggttcaagcaattctcctgcctcagcctccngagtagctgggactacaggcgtgtgccaacacgcccggctaattttttgtatttttattagagacggagtttcaccgtgttagccaggatggtctcgatcgcttgacctcgtgatccaccctcctcggcctcccaaagtgctgggattacaggtgtgagccaccgcgcccggcctcattcccctcatttttgaccgtaaggatttcccctttcttgtaagttctgctatgtatttaaaagaatgttttctacattttatccagcatttctctgtgttctgttggaagggaagggcttaggtatctagtttgatacataggtagaagtggaacatttctctgtcccccagctgtcatcatataagataaacatcagataaaaagccacctgaaagtaaaactactgactcgtgtattagtgagtataatctcttctccatccttaggaaaatgttcatcccagctgcggagattaacaaatgggtgattgagctttctcctcgtatttggaccttgaaggttatataaatttttttcttatgaagagttggcatttctttttattgccaatggcaggcactcattcatatttgatctcctcaccttcccctcccctaaaaccaatctccagaactttttggactataaatttcttggtttgacttctggagaactgttcagaatattactttgcatttcaaattacaaacttaccttggtgtatctttttcttacaagctgcctaaatgaatatttggtatatattggtagttttattactatagtaaatcaaggaaatgcagtaaacttaaaatgtctttaagaaagccctgaaatcttcatgggtgaaattagaaattatcaactagataatagtatagataaatgaatttgtagctaattcttgctagttgttgcatccagagagctttgaataacatcattaatctactctttagccttgcatggtatgctatgaggctcctgttctgttcaagtattctaatcaatggctttgaaaagtttatcaaatttacatacagatcacaagcctaggagaaataactaattcacagatgacagaattaagattataaaagattttttttttgtaattttagtagagacagggttgccattgtattccagccttggcgacagagcaagactctgcctcaaaaaaaaaaaaaaaaaggttttggcaagctggaactctttctgcaaatgactaagatagaaaactgccaaggacaaatgaggagtagttagattttgaaaatattaatcatagaatagttgttgtatgctaagtcactgacccatattatgtacagcatttctgatctttactttgcaagattagtgatactatcccaatacactgctggagaaatcagaatttggagaaataagttgtccaaggcaagaagatagtaaattataagtacaagtgtaatatggacagtatctaacttgaaaagatttcaggcgaaaagaatctggggtttgccagtcagttgctcaaaaggtcaatgaaaaccaaatagtgaagctatcagagaagctaataaattatagactgcttgaacagttgtgtccagattaagggagataatagctttcccaccctactttgtgcaggtcatacctccccaaagtgtttacctaatcagtaggttcacaaactcttggtcattatagtatatgcctaaaatgtatgcacttaggaatgctaaaaatttaaatatggtctaaagcaaataaaagcaaagaggaaaaactttggacatcgtaaagactagaatagtcttttaaaaagaaagccagtatattggtttgaaatatagagatgtgtcccaatttcaagtattttaattgcaccttaatgaaattatctattttctatagattttagtactattgaatgtattactttactgttacctgaatttattataaagtgtttttgaataaataattctaaaagcatatactaagactcattcactttattcaaatatttgtgtgttctgtgtgccaggcatgggactcgttctaaggagaaagcagtgagcaaggcaggcatagtctgcctatataaagctcccaatctgaggaggataggcaactgaccacgcagtgtgaaccggggagcctattgcacaaccagtctgataatgctgcatctcagtctaaatatcctagtagtgtttcttagtcgcctcctgacaaaaaggcaaatatgaatgttctttctttgggcctagaaagtgatctagttgacatttctagcctaaaag

SEQ ID NO: 279235 - DNA, 5608 bp, Homo sapiens
  misc_feature (3620)..(3620): n is a, c, g, or t
tggggaaaagcaattacttcattttattgtacactgacttctcaggaatcaagatcacagtcacactcagatcacatttgtcttccttagattttttggaatataaacagtaagtattctagttctgaatccagtttaatttaggaccaaatattttgatttaccaatgcattaatctagagtacccattagaaagaccttcagataagaaaagaaatgaaggaaaacaatatagttagtgaagttttgttaaccacttgtgctaatagaggagcactgtcttaaaataacttacttgcttagatgtgagaatatttgaaataccttgtttcttaattttgtgtcttttttttaatggtagagagacggaatgaagattccaacatataaatttttgcctcttatgtaccaattggctgctagaatggggaccaagatgatgggaggcctaggatttcatgaagtcctcaataatctaatctctagaatttcaatggatcacccccatcacactttgtttattatactggccttagcaaatgcaaacagagatgaatttctgactaaaccagaggtagccagaagaagcagaataactaaaaatgtgcctaaacaaagctctcagcttgatgaggatcgaacagaggctgcaaatagaataatatgtactatcagaagtaggagacctcagatggtcagaagtgttgaggcactttgtgatgcttatattatattagcaaacttagatgccactcagtggaagactcagagaaaaggcataaatattccagcagaccagccaattactaaacttaagaatttagaagatgttgttgtccctactatggaaattaaggtggaccacacaggagaatatggaaatctggtgactatacagtcatttaaagcagaatttcgcttagcaggaggtgtaaatttaccaaaaataatagattgtgtaggttccgatggcaaggagaggagacagcttgttaagggccgtgatgacctgagacaagatgctgtcatgcaacaggtcttccagatgtgtaatacattactgcagagaaacacggaaactaggaagaggaaattaactatctgtacttataaggtggttcccctctctcagcgaagtggtgttcttgaatggtgcacaggaactgtccccattggtgaatttcttgttaacaatgaagatggtgctcataaaagatacaggccaaatgatttcagtgcctttcagtgccaaaagaaaatgatggaggtgcaaaaaaagtcttttgaagagaaatatgaagtcttcatggatgtttgccaaaattttcaaccagttttccgttacttctgcatggaaaaattcttggatccagctatttggtttgagaagcgattggcttatacgcgcagtgtagctacttcttctattgttggttacatacttggacttggtgatagacatgtacagaatatcttgataaatgagcagtcagcagaacttgtacatatagatctaggtgttgcttttgaacagggcaaaatccttcctactcctgagacagttccttttagactcaccagagatattgtggatggcatgggcattacgggtgttgaaggtgtcttcagaagatgctgtgagaaaaccatggaagtgatgagaaactctcaggaaactctgttaaccattgtagaggtccttctatatgatccactctttgactggaccatgaatcctttgaaagctttgtatttacagcagaggccggaagatgaaactgagcttcaccctactctgaatgcagatgaccaagaatgcaaacgaaatctcagtgatattgaccagagtttcaacaaagtagctgaacgtgtcttaatgagactacaagagaaactgaaaggagtggaagaaggcactgtgctcagtgttggtggacaagtgaatttgctcatacagcaggccatagaccccaaaaatctcagccgacttttcccaggatggaaagcttgggtgtgatcttcagtatatgaattaccctttcattcagcctttagaaattatattttagcctttatttttaacctgccaacatactttaagtagggattaatatttaagtgaactattgtgggtttttttgaatgttggttttaatacttgatttaatcaccactcaaaaatgttttgatggtcttaaggaacatctctgctttcactctttagaaataatggtcattcgggctgggcgcagcggctcacgcctgtaatcccagcactttgggaggccgaggtgagcggatcacaaggtcaggagttcgagaccagcctggccaagagaccagcctggccagtatggtgaaaccctgtctctactaaaaatacaaaaattagccgagcatggtggcgggcacctgtaatcccagctactcgagaggctgaggcaggagaatctcttgaacctgggaggtgaaggttgctgtgggccaaaatcatgccattgcactccagcctgggtgacaagagcgaaactccatctcaaaaaaaaaaaaaaaaaacagaaacttatttggatttttcctagtaagatcactcagtgttactaaataatgaagttgttatggagaacaaatttcaaagacacagttagtgtagttactatttttttaagtgtgtattaaaacttctcattctattctctttatcttttaagcccttctgtactgtccatgtatgttatctttctgtgataacttcatagattgccttctagttcatgaattctcttgtcagatgtatataatctcttttaccctatccattgggcttcttctttcagaaattgtttttcatttctaattatgcatcatttttcagatctctgtttcttgatgtcatttttaatgtttttttaatgttttttatgtcactaattattttaaatgtctgtacttgatagacactgtaatagttctattaaatttagttcctgctgtttatatctgttgatttttgtatttgataggctgttcatccagttttgtctttttgaaaagtgagtttattttcagcaaggctttatctatgggaatcttgagtgtctgtttatgtcatattcccagggctgttgctgcacacaagcccattcttattttaatttcttggctttagggtttccatacctgaagtgtagcataaatactgataggagatttcccaggccaaggcaaacacacttcctcctcatctccttgtgctagtgggcagaatatttgattgatgcctttttcactgagagtataagcttccatgtgtcccacctttatggcaggggtggaaggaggtacatttaattcccactgcctgcctttggcaagccctgggttctttgctccccatatagatgtctaagctaaaagccgtgggttaatgagactggcaaattgttccaggacagctacagcatcagctcacatattcacctctctggtttttcattcccctcatttttttctgagacagagtcttgctctgtcacccaggctggagtgcagtggcatgatctcagctcactgaaacctctgcctcctgggttcaagcaattctcctgcctcagcctccngagtagctgggactacaggcgtgtgccaacacgcccggctaattttttgtatttttattagagacggagtttcaccgtgttagccaggatggtctcgatcgcttgacctcgtgatccaccctcctcggcctcccaaagtgctgggattacaggtgtgagccaccgcgcccggcctcattcccctcatttttgaccgtaaggatttcccctttcttgtaagttctgctatgtatttaaaagaatgttttctacattttatccagcatttctctgtgttctgttggaagggaagggcttaggtatctagtttgatacataggtagaagtggaacatttctctgtcccccagctgtcatcatataagataaacatcagataaaaagccacctgaaagtaaaactactgactcgtgtattagtgagtataatctcttctccatccttaggaaaatgttcatcccagctgcggagattaacaaatgggtgattgagctttctcctcgtatttggaccttgaaggttatataaatttttttcttatgaagagttggcatttctttttattgccaatggcaggcactcattcatatttgatctcctcaccttcccctcccctaaaaccaatctccagaactttttggactataaatttcttggtttgacttctggagaactgttcagaatattactttgcatttcaaattacaaacttaccttggtgtatctttttcttacaagctgcctaaatgaatatttggtatatattggtagttttattactatagtaaatcaaggaaatgcagtaaacttaaaatgtctttaagaaagccctgaaatcttcatgggtgaaattagaaattatcaactagataatagtatagataaatgaatttgtagctaattcttgctagttgttgcatccagagagctttgaataacatcattaatctactctttagccttgcatggtatgctatgaggctcctgttctgttcaagtattctaatcaatggctttgaaaagtttatcaaatttacatacagatcacaagcctaggagaaataactaattcacagatgacagaattaagattataaaagattttttttttgtaattttagtagagacagggttgccattgtattccagccttggcgacagagcaagactctgcctcaaaaaaaaaaaaaaaaaggttttggcaagctggaactctttctgcaaatgactaagatagaaaactgccaaggacaaatgaggagtagttagattttgaaaatattaatcatagaatagttgttgtatgctaagtcactgacccatattatgtacagcatttctgatctttactttgcaagattagtgatactatcccaatacactgctggagaaatcagaatttggagaaataagttgtccaaggcaagaagatagtaaattataagtacaagtgtaatatggacagtatctaacttgaaaagatttcaggcgaaaagaatctggggtttgccagtcagttgctcaaaaggtcaatgaaaaccaaatagtgaagctatcagagaagctaataaattatagactgcttgaacagttgtgtccagattaagggagataatagctttcccaccctactttgtgcaggtcatacctccccaaagtgtttacctaatcagtaggttcacaaactcttggtcattatagtatatgcctaaaatgtatgcacttaggaatgctaaaaatttaaatatggtctaaagcaaataaaagcaaagaggaaaaactttggacatcgtaaagactagaatagtcttttaaaaagaaagccagtatattggtttgaaatatagagatgtgtcccaatttcaagtattttaattgcaccttaatgaaattatctattttctatagattttagtactattgaatgtattactttactgttacctgaatttattataaagtgtttttgaataaataattctaaaagca

SEQ ID NO: 279236 - DNA, 6235 bp, Homo sapiens
  misc_feature (340)..(340): n is a, c, g, or t
  misc_feature (2393)..(2393): n is a, c, g, or t
  misc_feature (2983)..(2983): n is a, c, g, or t
ccgcgtccgcgcttacccaatacaagccgggctacgtccgagggtaacaacatgatcaaaaccacagcaggaaccacaataaggaacaagactcaggttaaagcaaacacagcgacagctcctgcgccgcatctcctggttccagtggcggcactgaactcgcggcaatttgtcccgcctctttcgcttcacggcagccaatcgcttccgccagagaaagaaaggcgccgaaatgaaacccgcctccgttcgccttcggaactgtcgtcacttccgtcctcagacttggaggggcggggatgaggagggcggggaggacgacgagggcgaagagggtggntgagagccccggagcccgagccgaagggcgagccgcaaacgctaagtcgctggccattggtggacatggcgcaggcgcgtttgctccgacgggccgaatgttttggggcagtgttttgagcgcggagaccgcgtgatactggatgcgcatgggcataccgtgctctgcggctgcttggcgttgcttcttcctccagaagtgggcgctgggcagtcacgcagggtttgaaccggaagcgggagtaggtagctgcgtggctaacggagaaaagaagccgtggccacgggaggaggcgagaggagtcgggatctgcgctgcagccaccgccgcggttgatactactttgaccttccgagtgcagtgacagtgatgtgtgttctgaaattgtgaaccatgagtctagtacttaatgatctgcttatctgctgccgtcaactagaacatgatagagctacagaacgaaagaaagaagttgagaaatttaagcgcctgattcgagatcctgaaacaattaaacatctagatcggcattcagattccaaacaaggaaaatatttgaattgggatgctgtttttagatttttacagaaatatattcagaaagaaacagaatgtctgagaatagcaaaaccaaatgtatcagcctcaacacaagcctccaggcagaaaaagatgcaggaaatcagtagtttggtcaaatacttcatcaaatgtgcaaacagaagagcacctaggctaaaatgtcaagaactcttaaattatatcatggatacagtgaaagattcatctaatggtgctatttacggagctgattgtagcaacatactactcaaagacattctttctgtgagaaaatactggtgtgaaatatctcagcaacagtggttagaattgttctctgtgtacttcaggctctatctgaaaccttcacaagatgttcatagagttttagtggctagaataattcatgctgttaccaaaggatgctgttctcagactgacggattaaattccaaatttttggactttttttccaaggctattcagtgtgcgagacaagaaaagagctcttcaggtctaaatcatatcttagcagctcttactatcttcctcaagactttggctgtcaactttcgaattcgagtgtgtgaattaggagatgaaattcttcccactttgctttatatttggactcaacataggcttaatgattctttaaaagaagtcattattgaattatttcaactgcaaatttatatccatcatccgaaaggagccaaaacccaagaaaaaggtgcttatgaatcaacaaaatggagaagtattttatacaacttatatgatctgctagtgaatgagataagtcatataggaagtagaggaaagtattcttcaggatttcgtaatattgccgtcaaagaaaatttgattgaattgatggcagatatctgtcaccaggtttttaatgaagataccagatccttggagatttctcaatcttacactactacacaaagagaatctagtgattacagtgtcccttgcaaaaggaagaaaatagaactaggctgggaagtaataaaagatcaccttcagaagtcacagaatgattttgatcttgtgccttggctacagattgcaacccaattaatatcaaagtatcctgcaagtttacctaactgtgagctgtctccattactgatgatactatctcagcttctaccccaacagcgacatggggaacgtacaccatatgtgttacgatgccttacggaagttgcattgtgtcaagacaagaggtcaaacctagaaagctcacaaaagtcagatttattaaaactctggaataaaatttggtgtattacctttcgtggtataagttctgagcaaatacaagctgaaaactttggcttacttggagccataattcagggtagtttagttgaggttgacagagaattctggaagttatttactgggtcagcctgcagaccttcatgtcctgcagtatgctgtttgactttggcactgaccaccagtatagttccaggancggtaaaaatgggaatagagcaaaatatgtgtgaagtaaatagaagcttttctttaaaggaatcaataatgaaatggctcttattctatcagttagagggtgacttagaaaatagcacagaagtgcctccaattcttcacagtaattttcctcatcttgtactggagaaaattcttgtgagtctcactatgaaaaactgtaaagctgcaatgaattttttccaaagcgtgccagaatgtgaacaccaccaaaaagataaagaagaactttcattctcagaagtagaagaactatttcttcagacaacttttgacaagatggactttttaaccattgtgagagaatgtggtatagaaaagcaccagtccagtattggcttctctgtccaccagaatctcaaggaatcactggatcgctgtcttctgggattatcagaacagcttctgaataattactcatctgagattacaaattcagaaactcttgtccggtgttcacgtcttttggtgggtgtccttggctgctactgttacatgggtgtaatagctgaagaggaagcatataagtcagaattattccagaaagccaantctctaatgcaatgtgcaggagaaagtatcactctgtttaaaaataagacaaatgaggaattcagaattggttccttgagaaatatgatgcagctatgtacacgttgcttgagcaactgtaccaagaagagtccaaataagattgcatctggctttttcctgcgattgttaacatcaaagctaatgaatgacattgcagatatttgtaaaagtttagcatccttcatcaaaaagccatttgaccgtggagaagtagaatcaatggaagatgatactaatggaaatctaatggaggtggaggatcagtcatccatgaatctatttaacgattaccctgatagtagtgttagtgatgcaaacgaacctggagagagccaaagtaccataggtgccattaatcctttagctgaagaatatctgtcaaagcaagatctacttttcttagacatgctcaagttcttgtgtttgtgtgtaactactgctcagaccaatactgtgtcctttagggcagctgatattcggaggaaattgttaatgttaattgattctagcacgctagaacctaccaaatccctccacctgcatatgtatctaatgcttttaaaggagcttcctggagaagagtaccccttgccaatggaagatgttcttgaacttctgaaaccactatccaatgtgtgttctttgtatcgtcgtgaccaagatgtttgtaaaactattttaaaccatgtccttcatgtagtgaaaaacctaggtcaaagcaatatggactctgagaacacaagggatgctcaaggacagtttcttacagtaattggagcattttggcatctaacaaaggagaggaaatatatattctctgtaagaatggccctagtaaattgccttaaaactttgcttgaggctgatccttattcaaaatgggccattcttaatgtaatgggaaaagactttcctgtaaatgaagtatttacacaatttcttgctgacaatcatcaccaagttcgcatgttggctgcagagtcaatcaatagattgttccaggacacgaagggagattcttccaggttactgaaagcacttcctttgaagcttcagcaaacagcttttgaaaatgcatacttgaaagctcaggaaggaatgagagaaatgtcccatagtgctgagaaccctgaaactttggatgaaatttataatagaaaatctgttttactgacgttgatagctgtggttttatcctgtagccctatctgcgaaaaacaggctttgtttgccctgtgtaaatctgtgaaagagaatggattagaacctcaccttgtgaaaaaggttttagagaaagtttctgaaacttttggatatagacgtttagaagactttatggcatctcatttagattatctggttttggaatggctaaatcttcaagatactgaatacaacttatcttcttttccttttattttattaaactacacaaatattgaggatttctatagatcttgttataaggttttgattccacatctggtgattagaagtcattttgatgaggtgaagtccattgctaatcagattcaagaggactggaaaagtcttctaacagactgctttccaaagattcttgtaaatattcttccttattttgcctatgagggtaccagagacagtgggatggcacagcaaagagagactgctaccaaggtctatgatatgcttaaaagtgaaaacttattgggaaaacagattgatcacttattcattagtaatttaccagagattgtggtggagttattgatgacgttacatgagccagcaaattctagtgccagtcagagcactgacctctgtgacttttcaggggatttggatcctgctcctaatccacctcattttccatcgcatgtgattaaagcaacatttgcctatatcagcaattgtcataaaaccaagttaaaaagcattttagaaattctttccaaaagccctgattcctatcagaaaattcttcttgccatatgtgagcaagcagctgaaacaaataatgtttataagaagcacagaattcttaaaatatatcacctgtttgttagtttattactgaaagatataaaaagtggcttaggaggagcttgggcctttgttcttcgagacgttatttatactttgattcactatatcaaccaaaggaaattaaccattttctctcagtaagtgtttatgatgcacttccattgacaagacttgaaggactaaaggatcttcgaagacaactggaactacataaagatcagatggtggacattatgagagcttctcagggtgctaattttaaatgacatgggctatttctacctgtttctttttgaaagaatattttgcaaagtcttgctcttggtttcattgtcacagacttagttcagactctcatcatttagttcagaccctcatttctcatctaactgtaaaactggtcctaactggtcttctcaccctgaactcttcctgttttattcatcctctgccagatgatttctctaaacccaaatatgatcatgtttttctactgcctaaattttttttttaagagacagagtttttttttttttttaagagtctcactctgtcacctaggctggagtgtagtggcaccatcataacttactatgaccttgaattcctgggtacaaggaattctcctgtctcagccttctgaatagctggaacaacaggcacacaccactacacctagctactttatttattttttttattttttgtagggacaggggtcccactatgttgcctaggttggtctcgaattcttggcctcaagtgatcctcctgccttagcctcacaaagcattgggattagaggtgtgagccacggcatctagccatgcttaaacatttttcatttctttttctttttttttaagacggagtttcgctcttgttgcccaggctggaatgcagtggcactatcttagctcactgcaacctccacctcctgagctcagattctcgtgcctcagccttcctagtagctaggattacaggcacctgccaccatgcctggctaattttttgtattttttttagtagagacggggtttcaccatgttggccagggtggtctcaaactcctgagctcaggcaatccgcccacctcagcctcccaaagtgctgggattacaggcatgagccaccgcggctggcccatgcttaaacatttttaacaccttccaaccatgt

SEQ ID NO: 279237 - DNA, 7584 bp, Homo sapiens
  misc_feature (340)..(340): n is a, c, g, or t
  misc_feature (2393)..(2393): n is a, c, g, or t
  misc_feature (2983)..(2983): n is a, c, g, or t
ccgcgtccgcgcttacccaatacaagccgggctacgtccgagggtaacaacatgatcaaaaccacagcaggaaccacaataaggaacaagactcaggttaaagcaaacacagcgacagctcctgcgccgcatctcctggttccagtggcggcactgaactcgcggcaatttgtcccgcctctttcgcttcacggcagccaatcgcttccgccagagaaagaaaggcgccgaaatgaaacccgcctccgttcgccttcggaactgtcgtcacttccgtcctcagacttggaggggcggggatgaggagggcggggaggacgacgagggcgaagagggtggntgagagccccggagcccgagccgaagggcgagccgcaaacgctaagtcgctggccattggtggacatggcgcaggcgcgtttgctccgacgggccgaatgttttggggcagtgttttgagcgcggagaccgcgtgatactggatgcgcatgggcataccgtgctctgcggctgcttggcgttgcttcttcctccagaagtgggcgctgggcagtcacgcagggtttgaaccggaagcgggagtaggtagctgcgtggctaacggagaaaagaagccgtggccacgggaggaggcgagaggagtcgggatctgcgctgcagccaccgccgcggttgatactactttgaccttccgagtgcagtgacagtgatgtgtgttctgaaattgtgaaccatgagtctagtacttaatgatctgcttatctgctgccgtcaactagaacatgatagagctacagaacgaaagaaagaagttgagaaatttaagcgcctgattcgagatcctgaaacaattaaacatctagatcggcattcagattccaaacaaggaaaatatttgaattgggatgctgtttttagatttttacagaaatatattcagaaagaaacagaatgtctgagaatagcaaaaccaaatgtatcagcctcaacacaagcctccaggcagaaaaagatgcaggaaatcagtagtttggtcaaatacttcatcaaatgtgcaaacagaagagcacctaggctaaaatgtcaagaactcttaaattatatcatggatacagtgaaagattcatctaatggtgctatttacggagctgattgtagcaacatactactcaaagacattctttctgtgagaaaatactggtgtgaaatatctcagcaacagtggttagaattgttctctgtgtacttcaggctctatctgaaaccttcacaagatgttcatagagttttagtggctagaataattcatgctgttaccaaaggatgctgttctcagactgacggattaaattccaaatttttggactttttttccaaggctattcagtgtgcgagacaagaaaagagctcttcaggtctaaatcatatcttagcagctcttactatcttcctcaagactttggctgtcaactttcgaattcgagtgtgtgaattaggagatgaaattcttcccactttgctttatatttggactcaacataggcttaatgattctttaaaagaagtcattattgaattatttcaactgcaaatttatatccatcatccgaaaggagccaaaacccaagaaaaaggtgcttatgaatcaacaaaatggagaagtattttatacaacttatatgatctgctagtgaatgagataagtcatataggaagtagaggaaagtattcttcaggatttcgtaatattgccgtcaaagaaaatttgattgaattgatggcagatatctgtcaccaggtttttaatgaagataccagatccttggagatttctcaatcttacactactacacaaagagaatctagtgattacagtgtcccttgcaaaaggaagaaaatagaactaggctgggaagtaataaaagatcaccttcagaagtcacagaatgattttgatcttgtgccttggctacagattgcaacccaattaatatcaaagtatcctgcaagtttacctaactgtgagctgtctccattactgatgatactatctcagcttctaccccaacagcgacatggggaacgtacaccatatgtgttacgatgccttacggaagttgcattgtgtcaagacaagaggtcaaacctagaaagctcacaaaagtcagatttattaaaactctggaataaaatttggtgtattacctttcgtggtataagttctgagcaaatacaagctgaaaactttggcttacttggagccataattcagggtagtttagttgaggttgacagagaattctggaagttatttactgggtcagcctgcagaccttcatgtcctgcagtatgctgtttgactttggcactgaccaccagtatagttccaggancggtaaaaatgggaatagagcaaaatatgtgtgaagtaaatagaagcttttctttaaaggaatcaataatgaaatggctcttattctatcagttagagggtgacttagaaaatagcacagaagtgcctccaattcttcacagtaattttcctcatcttgtactggagaaaattcttgtgagtctcactatgaaaaactgtaaagctgcaatgaattttttccaaagcgtgccagaatgtgaacaccaccaaaaagataaagaagaactttcattctcagaagtagaagaactatttcttcagacaacttttgacaagatggactttttaaccattgtgagagaatgtggtatagaaaagcaccagtccagtattggcttctctgtccaccagaatctcaaggaatcactggatcgctgtcttctgggattatcagaacagcttctgaataattactcatctgagattacaaattcagaaactcttgtccggtgttcacgtcttttggtgggtgtccttggctgctactgttacatgggtgtaatagctgaagaggaagcatataagtcagaattattccagaaagccaantctctaatgcaatgtgcaggagaaagtatcactctgtttaaaaataagacaaatgaggaattcagaattggttccttgagaaatatgatgcagctatgtacacgttgcttgagcaactgtaccaagaagagtccaaataagattgcatctggctttttcctgcgattgttaacatcaaagctaatgaatgacattgcagatatttgtaaaagtttagcatccttcatcaaaaagccatttgaccgtggagaagtagaatcaatggaagatgatactaatggaaatctaatggaggtggaggatcagtcatccatgaatctatttaacgattaccctgatagtagtgttagtgatgcaaacgaacctggagagagccaaagtaccataggtgccattaatcctttagctgaagaatatctgtcaaagcaagatctacttttcttagacatgctcaagttcttgtgtttgtgtgtaactactgctcagaccaatactgtgtcctttagggcagctgatattcggaggaaattgttaatgttaattgattctagcacgctagaacctaccaaatccctccacctgcatatgtatctaatgcttttaaaggagcttcctggagaagagtaccccttgccaatggaagatgttcttgaacttctgaaaccactatccaatgtgtgttctttgtatcgtcgtgaccaagatgtttgtaaaactattttaaaccatgtccttcatgtagtgaaaaacctaggtcaaagcaatatggactctgagaacacaagggatgctcaaggacagtttcttacagtaattggagcattttggcatctaacaaaggagaggaaatatatattctctgtaagaatggccctagtaaattgccttaaaactttgcttgaggctgatccttattcaaaatgggccattcttaatgtaatgggaaaagactttcctgtaaatgaagtatttacacaatttcttgctgacaatcatcaccaagttcgcatgttggctgcagagtcaatcaatagattgttccaggacacgaagggagattcttccaggttactgaaagcacttcctttgaagcttcagcaaacagcttttgaaaatgcatacttgaaagctcaggaaggaatgagagaaatgtcccatagtgctgagaaccctgaaactttggatgaaatttataatagaaaatctgttttactgacgttgatagctgtggttttatcctgtagccctatctgcgaaaaacaggctttgtttgccctgtgtaaatctgtgaaagagaatggattagaacctcaccttgtgaaaaaggttttagagaaagtttctgaaacttttggatatagacgtttagaagactttatggcatctcatttagattatctggttttggaatggctaaatcttcaagatactgaatacaacttatcttcttttccttttattttattaaactacacaaatattgaggatttctatagatcttgttataaggttttgattccacatctggtgattagaagtcattttgatgaggtgaagtccattgctaatcagattcaagaggactggaaaagtcttctaacagactgctttccaaagattcttgtaaatattcttccttattttgcctatgagggtaccagagacagtgggatggcacagcaaagagagactgctaccaaggtctatgatatgcttaaaagtgaaaacttattgggaaaacagattgatcacttattcattagtaatttaccagagattgtggtggagttattgatgacgttacatgagccagcaaattctagtgccagtcagagcactgacctctgtgacttttcaggggatttggatcctgctcctaatccacctcattttccatcgcatgtgattaaagcaacatttgcctatatcagcaattgtcataaaaccaagttaaaaagcattttagaaattctttccaaaagccctgattcctatcagaaaattcttcttgccatatgtgagcaagcagctgaaacaaataatgtttataagaagcacagaattcttaaaatatatcacctgtttgttagtttattactgaaagatataaaaagtggcttaggaggagcttgggcctttgttcttcgagacgttatttatactttgattcactatatcaaccaaaggccttcttgtatcatggatgtgtcattacgtagcttctccctttgttgtgacttattaagtcaggtttgccagacagccgtgacttactgtaaggatgctctagaaaaccatcttcatgttattgttggtacacttataccccttgtgtatgagcaggtggaggttcagaaacaggtattggacttgttgaaatacttagtgatagataacaaggataatgaaaacctctatatcacgattaagcttttagatccttttcctgaccatgttgtttttaaggatttgcgtattactcagcaaaaaatcaaatacagtagaggacccttttcactcttggaggaaattaaccattttctctcagtaagtgtttatgatgcacttccattgacaagacttgaaggactaaaggatcttcgaagacaactggaactacataaagatcagatggtggacattatgagagcttctcaggataatccgcaagatgggattatggtgaaactagttgtcaatttgttgcagttatccaagatggcaataaaccacactggtgaaaaagaagttctagaggctgttggaagctgcttgggagaagtgggtcctatagatttctctaccatagctatacaacatagtaaagatgcatcttataccaaggcccttaagttatttgaagataaagaacttcagtggaccttcataatgctgacctacctgaataacacactggtagaagattgtgtcaaagttcgatcagcagctgttacctgtttgaaaaacattttagccacaaagactggacatagtttctgggagatttataagatgacaacagatccaatgctggcctatctacagccttttagaacatcaagaaaaaagtttttagaagtacccagatttgacaaagaaaacccttttgaaggcctggatgatataaatctgtggattcctctaagtgaaaatcatgacatttggataaagacactgacttgtgcttttttggacagtggaggcacaaaatgtgaaattcttcaattattaaagccaatgtgtgaagtgaaaactgacttttgtcagactgtacttccatacttgattcatgatattttactccaagatacaaatgaatcatggagaaatctgctttctacacatgttcagggatttttcaccagctgtcttcgacacttctcgcaaacgagccgatccacaacccctgcaaacttggattcagaccttcttcaggaacaatttttaatgatgctttctggctggatttaaattatctagaagttgccaaggtagctcagtcttgtgctgctcactttacagctttactctatgcagaaatctatgcagataagaaaagtatggatgatcaagagaaaagaagtcttgcatttgaagaaggaagccagagtacaactatttctagcttgagtgaaaaaagtaaagaagaaactggaataagtttacaggatcttctcttagaaatctacagaagtataggggagccagatagtttgtatggctgtggtggagggaagatgttacaacccattactaggtaaattgcatttttctaaacaacggtatagtaattctgtttatgaaggagttatgtgtgtgtaaaacccaaagctattttcacaatcttttcttatagactacgaacatatgaacacgaagcaatgtggggcaaagccctagtaacatatgacctcgaaacagcaatcccctcatcaacacgccaggcaggaatcattcaggtacattttttcccagatttggtaaagccatcactagtgtagtgctgaggttatttcagtatgttggtggatatttacacagccagataaactctagagataagactagaacttatctgtttttcagaggattaggctaaacattcagggatactcctgaagcagagggatgcaaaaaaaagagaaaaaattcagggagacacaggaaagtcagacaggtcattgacctaaaagatagtgtagatttcttgatcatagtgttgttggataacaacagaagacattgctcgagcatatacaatgtgccaggtagtgtacttactgcttcacatggaaaatcttatgtaaactatttctcatagtttgcaacagagttggtcccagaacctgttgtttctattactggctaatactccttagccattcttccatgaaatattagagccctttgagctctatttttgtgttttttgggaaacattaaacgatattttgggattaaaaaaatgtttttggccaggcgtggtggcttgcgcctgtaatcccagcactttgggaggccgaggcgagcagatcacgaggtcaggaggtccagaccatcctggctaacacggtgaaaccccgtctctactaaaaatacaa

SEQ ID NO: 279238 - DNA, 2138 bp, Homo sapiens
ctgaaagtgggagcggccgcacttttttttgaccgtaaggatttcccctttcttgtaagttctgctatgtatttaaaagaatgttttctacattttatccagcatttctctgtgttctgttggaagggaagggcttaggtatctagtttgatacataggtagaagtggaacatttctctgtcccccagctgtcatcatataagataaacatcagataaaaagccacctgaaagtaaaactactgactcgtgtattagtgagtataatctcttctccatccttaggaaaatgttcatcccagctgcggagattaacaaatgggtgattgagctttctcctcgtatttggaccttgaaggttatataaatttttttcttatgaagagttggcatttctttttattgccaatggcaggcactcattcatatttgatctcctcaccttcccctcccctaaaaccaatctccagaactttttggactataaatttcttggtttgacttctggagaactgttcagaatattactttgcatttcaaattacaaacttaccttggtgtatctttttcttacaagctgcctaaatgaatatttggtatatattggtagttttattactatagtaaatcaaggaaatgcagtaaacttaaaatgtctttaagaaagccctgaaatcttcatgggtgaaattagaaattatcaactagataatagtatagataaatgaatttgtagctaattcttgctagttgttgcatccagagagctttgaataacatcattaatctactctttagccttgcatggtatgctatgaggctcctgttctgttcaagtattctaatcaatggctttgaaaagtttatcaaatttacatacagatcacaagcctaggagaaataactaattcacagatgacagaattaagattataaaagattttttttttgtaattttagtagagacagggttgccattgtattccagccttggcgacagagcaagactctgcctcaaaaaaaaaaaaaaaaaggttttggcaagctggaactctttctgcaaatgactaagatagaaaactgccaaggacaaatgaggagtagttagattttgaaaatattaatcatagaatagttgttgtatgctaagtcactgacccatattatgtacagcatttctgatctttactttgcaagattagtgatactatcccaatacactgctggagaaatcagaatttggagaaataagttgtccaaggcaagaagatagtaaattataagtacaagtgtaatatggacagtatctaacttgaaaagatttcaggcgaaaagaatctggggtttgccagtcagttgctcaaaaggtcaatgaaaaccaaatagtgaagctatcagagaagctaataaattatagactgcttgaacagttgtgtccagattaagggagataatagctttcccaccctactttgtgcaggtcatacctccccaaagtgtttacctaatcagtaggttcacaaactcttggtcattatagtatatgcctaaaatgtatgcacttaggaatgctaaaaatttaaatatggtctaaagcaaataaaagcaaagaggaaaaactttggacatcgtaaagactagaatagtcttttaaaaagaaagccagtatattggtttgaaatatagagatgtgtcccaatttcaagtattttaattgcaccttaatgaaattatctattttctatagattttagtactattgaatgtattactttactgttacctgaatttattataaagtgtttttgaataaataattctaaaagcatatactaagactcattcactttattcaaatatttgtgtgttctgtgtgccaggcatgggactcgttctaaggagaaagcagtgagcaaggcaggcatagtctgcctatataaagctcccaatctgaggaggataggcaactgaccacgcagtgtgaaccggggagcctattgcacaaccagtctgataatgctgcatctcagtctaaatatcctagtagtgtttcttagtcgcctcctgacaaaaaggcaaatatgaatgttctttctttgggcctagaaagtgatctagttgacatttctagcctaaaag

SEQ ID NO: 279239 - DNA, 771 bp, Homo sapiens
actactgtcgcatatactactgtcgcatatactactgtcgcatatactataatgaccaagagttgtgtccagattaagggagataatagctttcccaccctactttgtgcaggtcatacctccccaaagtgtttacctaatcagtaggttcacaaactcttggtcattatagtatatgcctaaaatgtatgcacttaggaatgctaaaaatttaaatatggtctaaagcaaataaaagcaaagaggaaaaactttggacatcgtaaagactagaatagtcttttaaaaagaaagccagtatattggtttgaaatatagagatgtgtcccaatttcaagtattttaattgcaccttaatgaaattatctattttctatagattttagtactattgaatgtattactttactgttacctgaatttattataaagtgtttttgaataaataattctaaaagcatatactaagactcattcactttattcaaatatttgtgtgttctgtgtgccaggcatgggactcgttctaaggagaaagcagtgagcaaggcaggcatagtctgcctatataaagctcccaatctgaggaggataggcaactgaccacgcagtgtgaaccggggagcctattgcacaaccagtctgataatgctgcatctcagtctaaatatcctagtagtgtttcttagtcgcctcctgacaaaaaggcaaatatgaatgttctttctttgggcctagaaagtgatctagttgacatttctagcctaaaag

SEQ ID NO: 279240 - DNA, 1931 bp, Homo sapiens
  misc_feature (340)..(340): n is a, c, g, or t
ccgcgtccgcgcttacccaatacaagccgggctacgtccgagggtaacaacatgatcaaaaccacagcaggaaccacaataaggaacaagactcaggttaaagcaaacacagcgacagctcctgcgccgcatctcctggttccagtggcggcactgaactcgcggcaatttgtcccgcctctttcgcttcacggcagccaatcgcttccgccagagaaagaaaggcgccgaaatgaaacccgcctccgttcgccttcggaactgtcgtcacttccgtcctcagacttggaggggcggggatgaggagggcggggaggacgacgagggcgaagagggtggntgagagccccggagcccgagccgaagggcgagccgcaaacgctaagtcgctggccattggtggacatggcgcaggcgcgtttgctccgacgggccgaatgttttggggcagtgttttgagcgcggagaccgcgtgatactggatgcgcatgggcataccgtgctctgcggctgcttggcgttgcttcttcctccagaagtgggcgctgggcagtcacgcagggtttgaaccggaagcgggagtaggtagctgcgtggctaacggagaaaagaagccgtggccacgggaggaggcgagaggagtcgggatctgcgctgcagccaccgccgcggttgatactactttgaccttccgagtgcagtgacagtgatgtgtgttctgaaattgtgaaccatgagtctagtacttaatgatctgcttatctgctgccgtcaactagaacatgatagagctacagaacgaaagaaagaagttgagaaatttaagcgcctgattcgagatcctgaaacaattaaacatctagatcggcattcagattccaaacaaggaaaatatttgaattgggatgctgtttttagatttttacagaaatatattcagaaagaaacagaatgtctgagaatagcaaaaccaaatgtatcagcctcaacacaagcctccaggcagaaaaagatgcaggaaatcagtagtttggtcaaatacttcatcaaatgtgcaaacagaagagcacctaggctaaaatgtcaagaactcttaaattatatcatggatacagtgaaagattcatctaatggtgctatttacggagctgattgtagcaacatactactcaaagacattctttctgtgagaaaatactggtgtgaaatatctcagcaacagtggttaggtatgttttgaaggttgttgtttgtgaatttttcctcatgaaatgaaacttcaccaaagaaagcactctgtctgtatctgtctatatcccccaagtgacctgacagtttaacagtactttagtaaaattatatggttatcgaactgacccttaatttttatttattatgtagcttttgaataaagtcatgaataatatatcaggtgcctgatatcagagccggaattacagttgaaaaataccatctccatcgtcaaggagttgacagtggcagaagaaaacccaagtaaaccagagttcataatgtgctgtgatacagacatatttgggttcagtaggtatacaaaacaatgacacctaaactcaaccatgatttaagtagaaagggagaaaaccaagagagggaagtaccataaaagtgaaagcaggcagggtgcagtggctcacgcctgtaatcctagcactttgggaggccaaggccggtggattgcttgagctcaggagttcaagaccagcctgggcaacatggtgaaactctgtctttaaaaaaatagcggaggtaatggctcttgcttgtagtcccagttacttgggaggctgaggcaggaggatcacctgagccctggaggttaaggctgcagtgagctgtgatcacactgcactccggcctccatgacagagtgagaccctgtttccatttaa

SEQ ID NO: 279241 - DNA, 1371 bp, Homo sapiens
  misc_feature (340)..(340): n is a, c, g, or t
ccgcgtccgcgcttacccaatacaagccgggctacgtccgagggtaacaacatgatcaaaaccacagcaggaaccacaataaggaacaagactcaggttaaagcaaacacagcgacagctcctgcgccgcatctcctggttccagtggcggcactgaactcgcggcaatttgtcccgcctctttcgcttcacggcagccaatcgcttccgccagagaaagaaaggcgccgaaatgaaacccgcctccgttcgccttcggaactgtcgtcacttccgtcctcagacttggaggggcggggatgaggagggcggggaggacgacgagggcgaagagggtggntgagagccccggagcccgagccgaagggcgagccgcaaacgctaagtcgctggccattggtggacatggcgcaggcgcgtttgctccgacgggccgaatgttttggggcagtgttttgagcgcggagaccgcgtgatactggatgcgcatgggcataccgtgctctgcggctgcttggcgttgcttcttcctccagaagtgggcgctgggcagtcacgcagggtttgaaccggaagcgggagtaggtagctgcgtggctaacggagaaaagaagccgtggccacgggaggaggcgagaggagtcgggatctgcgctgcagccaccgccgcggttgatactactttgaccttccgagtgcagtgacagtgatgtgtgttctgaaattgtgaaccatgagtctagtacttaatgatctgcttatctgctgccgtcaactagaacatgatagagctacagaacgaaagaaagaagttgagaaatttaagcgcctgattcgagatcctgaaacaattaaacatctagatcggcattcagattccaaacaaggaaaatatttgaattgggatgctgtttttagatttttacagaaatatattcagaaagaaacagaatgtctgagaatagcaaaaccaaatgtatcagcctcaacacaagcctccaggcagaaaaagatgcaggaaatcagtagtttggtcaaatacttcatcaaatgtgcaaacagaagagcacctaggctaaaatgtcaagaactcttaaattatatcatggatacagtgaaagattcatctaatggtgctatttacggagctgattgtagcaacatactactcaaagacattctttctgtgagaaaatactggtgtgaaatatctcagcaacagtggttaggtatgttttgaaggttgttgtttgtgaatttttcctcatgaaatgaaacttcaccaaagaaagcactctgtctgtatctgtctatatcccccaagtgacctgacagtttaacagtactttagtaaaattatatggttatcga

SEQ ID NO: 279242 - DNA, 407 bp, Homo sapiens
atttgctgacgagctctttgggtcctactggggagtggtggaaagacacagtgctgttttactcaggtgtttgcagtatgccttcctaggggggacttccagttaatctaattacagaagtagcgaggggaaactttctaaatcagtgtaaatgttgtagcttattctaaatgaaagaatggcagtaggtatttaattatttgggagactgtcaagaggtgcacagatgctcagattggtttgagtgccctttgctattctcagatgactctgtgtttttataataaaataaactgtacttgtttattcatgcttaattattctgaagggccgtgatgacctgagacaagatgctgtcatgcaacaggtcttccagatgtgtaatacattactgcagagaaacacgg

SEQ ID NO: 279243 - DNA, 373 bp, Homo sapiens
gatctgtgtcttataaaaaatggatgaaggaattgacttagtggaaagctcacatttgtttttaaacatgtcagtgcttgtgatttagcaaaggtattggtccttactctttcttgtaccaaaagacagaactaggattagtgagtaggaggtttctgaaatgtgtatagcttgtcaaaaaatctggagttcagttgggattttataattgattgttaaacatttacattttacattacattttttttttaatttctttttaagtcccatagtgctgagaaccctgaaactttggatgaaatttataatagaaaatctgttttactgacgttgatagctgtggttttatcctgtagccctatctgcgaaaaac

SEQ ID NO: 279244 - DNA, 440 bp, Homo sapiens
gcataaatctaatagttcttttcttacagctaatctctagaatttcaatggatcacccccatcacactttgtttattatactggccttagcaaatgcaaacagagatgaatttctgactaaaccagaggtagccagaagaagcagaataactaaaaatgtgcctaaacaaagctctcagcttgatgaggtatttggattaaacatacgtaccttttagaagtgtgatattcagtctttcctagaatatttctttttaaaatcttgtgttattaagatgccatctaaaatcggttcaaggctggcacggtggctcacgcctgtaatcccagcactttgggaggctgaggcgggtggattacttgaggtcagaagttcgagaccatcctggctgaccgacacagcaaaaccctgtctctactaaaaatgcaaaaaacagctg

SEQ ID NO: 279245 - DNA, 13583 bp, Homo sapiens
  misc_feature (340)..(340): n is a, c, g, or t
  misc_feature (2481)..(2481): n is a, c, g, or t
  misc_feature (3071)..(3071): n is a, c, g, or t
  misc_feature (11595)..(11595): n is a, c, g, or t
ccgcgtccgcgcttacccaatacaagccgggctacgtccgagggtaacaacatgatcaaaaccacagcaggaaccacaataaggaacaagactcaggttaaagcaaacacagcgacagctcctgcgccgcatctcctggttccagtggcggcactgaactcgcggcaatttgtcccgcctctttcgcttcacggcagccaatcgcttccgccagagaaagaaaggcgccgaaatgaaacccgcctccgttcgccttcggaactgtcgtcacttccgtcctcagacttggaggggcggggatgaggagggcggggaggacgacgagggcgaagagggtggntgagagccccggagcccgagccgaagggcgagccgcaaacgctaagtcgctggccattggtggacatggcgcaggcgcgtttgctccgacgggccgaatgttttggggcagtgttttgagcgcggagaccgcgtgatactggatgcgcatgggcataccgtgctctgcggctgcttggcgttgcttcttcctccagaagtgggcgctgggcagtcacgcagggtttgaaccggaagcgggagtaggtagctgcgtggctaacggagaaaagaagccgtggccacgggaggaggcgagaggagtcgggatctgcgctgcagccaccgccgcggttgatactactttgaccttccgagtgcagtgaggcatacatcacaatttggaattatgcattggtttatcaatttacttgtttattgtcaccctgctgcccagatatgacttcatgaggacagtgatgtgtgttctgaaattgtgaaccatgagtctagtacttaatgatctgcttatctgctgccgtcaactagaacatgatagagctacagaacgaaagaaagaagttgagaaatttaagcgcctgattcgagatcctgaaacaattaaacatctagatcggcattcagattccaaacaaggaaaatatttgaattgggatgctgtttttagatttttacagaaatatattcagaaagaaacagaatgtctgagaatagcaaaaccaaatgtatcagcctcaacacaagcctccaggcagaaaaagatgcaggaaatcagtagtttggtcaaatacttcatcaaatgtgcaaacagaagagcacctaggctaaaatgtcaagaactcttaaattatatcatggatacagtgaaagattcatctaatggtgctatttacggagctgattgtagcaacatactactcaaagacattctttctgtgagaaaatactggtgtgaaatatctcagcaacagtggttagaattgttctctgtgtacttcaggctctatctgaaaccttcacaagatgttcatagagttttagtggctagaataattcatgctgttaccaaaggatgctgttctcagactgacggattaaattccaaatttttggactttttttccaaggctattcagtgtgcgagacaagaaaagagctcttcaggtctaaatcatatcttagcagctcttactatcttcctcaagactttggctgtcaactttcgaattcgagtgtgtgaattaggagatgaaattcttcccactttgctttatatttggactcaacataggcttaatgattctttaaaagaagtcattattgaattatttcaactgcaaatttatatccatcatccgaaaggagccaaaacccaagaaaaaggtgcttatgaatcaacaaaatggagaagtattttatacaacttatatgatctgctagtgaatgagataagtcatataggaagtagaggaaagtattcttcaggatttcgtaatattgccgtcaaagaaaatttgattgaattgatggcagatatctgtcaccaggtttttaatgaagataccagatccttggagatttctcaatcttacactactacacaaagagaatctagtgattacagtgtcccttgcaaaaggaagaaaatagaactaggctgggaagtaataaaagatcaccttcagaagtcacagaatgattttgatcttgtgccttggctacagattgcaacccaattaatatcaaagtatcctgcaagtttacctaactgtgagctgtctccattactgatgatactatctcagcttctaccccaacagcgacatggggaacgtacaccatatgtgttacgatgccttacggaagttgcattgtgtcaagacaagaggtcaaacctagaaagctcacaaaagtcagatttattaaaactctggaataaaatttggtgtattacctttcgtggtataagttctgagcaaatacaagctgaaaactttggcttacttggagccataattcagggtagtttagttgaggttgacagagaattctggaagttatttactgggtcagcctgcagaccttcatgtcctgcagtatgctgtttgactttggcactgaccaccagtatagttccaggancggtaaaaatgggaatagagcaaaatatgtgtgaagtaaatagaagcttttctttaaaggaatcaataatgaaatggctcttattctatcagttagagggtgacttagaaaatagcacagaagtgcctccaattcttcacagtaattttcctcatcttgtactggagaaaattcttgtgagtctcactatgaaaaactgtaaagctgcaatgaattttttccaaagcgtgccagaatgtgaacaccaccaaaaagataaagaagaactttcattctcagaagtagaagaactatttcttcagacaacttttgacaagatggactttttaaccattgtgagagaatgtggtatagaaaagcaccagtccagtattggcttctctgtccaccagaatctcaaggaatcactggatcgctgtcttctgggattatcagaacagcttctgaataattactcatctgagattacaaattcagaaactcttgtccggtgttcacgtcttttggtgggtgtccttggctgctactgttacatgggtgtaatagctgaagaggaagcatataagtcagaattattccagaaagccaantctctaatgcaatgtgcaggagaaagtatcactctgtttaaaaataagacaaatgaggaattcagaattggttccttgagaaatatgatgcagctatgtacacgttgcttgagcaactgtaccaagaagagtccaaataagattgcatctggctttttcctgcgattgttaacatcaaagctaatgaatgacattgcagatatttgtaaaagtttagcatccttcatcaaaaagccatttgaccgtggagaagtagaatcaatggaagatgatactaatggaaatctaatggaggtggaggatcagtcatccatgaatctatttaacgattaccctgatagtagtgttagtgatgcaaacgaacctggagagagccaaagtaccataggtgccattaatcctttagctgaagaatatctgtcaaagcaagatctacttttcttagacatgctcaagttcttgtgtttgtgtgtaactactgctcagaccaatactgtgtcctttagggcagctgatattcggaggaaattgttaatgttaattgattctagcacgctagaacctaccaaatccctccacctgcatatgtatctaatgcttttaaaggagcttcctggagaagagtaccccttgccaatggaagatgttcttgaacttctgaaaccactatccaatgtgtgttctttgtatcgtcgtgaccaagatgtttgtaaaactattttaaaccatgtccttcatgtagtgaaaaacctaggtcaaagcaatatggactctgagaacacaagggatgctcaaggacagtttcttacagtaattggagcattttggcatctaacaaaggagaggaaatatatattctctgtaagaatggccctagtaaattgccttaaaactttgcttgaggctgatccttattcaaaatgggccattcttaatgtaatgggaaaagactttcctgtaaatgaagtatttacacaatttcttgctgacaatcatcaccaagttcgcatgttggctgcagagtcaatcaatagattgttccaggacacgaagggagattcttccaggttactgaaagcacttcctttgaagcttcagcaaacagcttttgaaaatgcatacttgaaagctcaggaaggaatgagagaaatgtcccatagtgctgagaaccctgaaactttggatgaaatttataatagaaaatctgttttactgacgttgatagctgtggttttatcctgtagccctatctgcgaaaaacaggctttgtttgccctgtgtaaatctgtgaaagagaatggattagaacctcaccttgtgaaaaaggttttagagaaagtttctgaaacttttggatatagacgtttagaagactttatggcatctcatttagattatctggttttggaatggctaaatcttcaagatactgaatacaacttatcttcttttccttttattttattaaactacacaaatattgaggatttctatagatcttgttataaggttttgattccacatctggtgattagaagtcattttgatgaggtgaagtccattgctaatcagattcaagaggactggaaaagtcttctaacagactgctttccaaagattcttgtaaatattcttccttattttgcctatgagggtaccagagacagtgggatggcacagcaaagagagactgctaccaaggtctatgatatgcttaaaagtgaaaacttattgggaaaacagattgatcacttattcattagtaatttaccagagattgtggtggagttattgatgacgttacatgagccagcaaattctagtgccagtcagagcactgacctctgtgacttttcaggggatttggatcctgctcctaatccacctcattttccatcgcatgtgattaaagcaacatttgcctatatcagcaattgtcataaaaccaagttaaaaagcattttagaaattctttccaaaagccctgattcctatcagaaaattcttcttgccatatgtgagcaagcagctgaaacaaataatgtttataagaagcacagaattcttaaaatatatcacctgtttgttagtttattactgaaagatataaaaagtggcttaggaggagcttgggcctttgttcttcgagacgttatttatactttgattcactatatcaaccaaaggccttcttgtatcatggatgtgtcattacgtagcttctccctttgttgtgacttattaagtcaggtttgccagacagccgtgacttactgtaaggatgctctagaaaaccatcttcatgttattgttggtacacttataccccttgtgtatgagcaggtggaggttcagaaacaggtattggacttgttgaaatacttagtgatagataacaaggataatgaaaacctctatatcacgattaagcttttagatccttttcctgaccatgttgtttttaaggatttgcgtattactcagcaaaaaatcaaatacagtagaggacccttttcactcttggaggaaattaaccattttctctcagtaagtgtttatgatgcacttccattgacaagacttgaaggactaaaggatcttcgaagacaactggaactacataaagatcagatggtggacattatgagagcttctcaggataatccgcaagatgggattatggtgaaactagttgtcaatttgttgcagttatccaagatggcaataaaccacactggtgaaaaagaagttctagaggctgttggaagctgcttgggagaagtgggtcctatagatttctctaccatagctatacaacatagtaaagatgcatcttataccaaggcccttaagttatttgaagataaagaacttcagtggaccttcataatgctgacctacctgaataacacactggtagaagattgtgtcaaagttcgatcagcagctgttacctgtttgaaaaacattttagccacaaagactggacatagtttctgggagatttataagatgacaacagatccaatgctggcctatctacagccttttagaacatcaagaaaaaagtttttagaagtacccagatttgacaaagaaaacccttttgaaggcctggatgatataaatctgtggattcctctaagtgaaaatcatgacatttggataaagacactgacttgtgcttttttggacagtggaggcacaaaatgtgaaattcttcaattattaaagccaatgtgtgaagtgaaaactgacttttgtcagactgtacttccatacttgattcatgatattttactccaagatacaaatgaatcatggagaaatctgctttctacacatgttcagggatttttcaccagctgtcttcgacacttctcgcaaacgagccgatccacaacccctgcaaacttggattcagagtcagagcactttttccgatgctgtttggataaaaaatcacaaagaacaatgcttgctgttgtggactacatgagaagacaaaagagaccttcttcaggaacaatttttaatgatgctttctggctggatttaaattatctagaagttgccaaggtagctcagtcttgtgctgctcactttacagctttactctatgcagaaatctatgcagataagaaaagtatggatgatcaagagaaaagaagtcttgcatttgaagaaggaagccagagtacaactatttctagcttgagtgaaaaaagtaaagaagaaactggaataagtttacaggatcttctcttagaaatctacagaagtataggggagccagatagtttgtatggctgtggtggagggaagatgttacaacccattactagactacgaacatatgaacacgaagcaatgtggggcaaagccctagtaacatatgacctcgaaacagcaatcccctcatcaacacgccaggcaggaatcattcaggccttgcagaatttgggactctgccatattctttccgtctatttaaaaggattggattatgaaaataaagactggtgtcctgaactagaagaacttcattaccaagcagcatggaggaatatgcagtgggaccattgcacttccgtcagcaaagaagtagaaggaaccagttaccatgaatcattgtacaatgctctacaatctctaagagacagagaattctctacattttatgaaagtctcaaatatgccagagtaaaagaagtggaagagatgtgtaagcgcagccttgagtctgtgtattcgctctatcccacacttagcaggttgcaggccattggagagctggaaagcattggggagcttttctcaagatcagtcacacatagacaactctctgaagtatatattaagtggcagaaacactcccagcttctcaaggacagtgattttagttttcaggagcctatcatggctctacgcacagtcattttggagatcctgatggaaaaggaaatggacaactcacaaagagaatgtattaaggacattctcaccaaacaccttgtagaactctctatactggccagaactttcaagaacactcagctccctgaaagggcaatatttcaaattaaacagtacaattcagttagctgtggagtctctgagtggcagctggaagaagcacaagtattctgggcaaaaaaggagcagagtcttgccctgagtattctcaagcaaatgatcaagaagttggatgccagctgtgcagcgaacaatcccagcctaaaacttacatacacagaatgtctgagggtttgtggcaactggttagcagaaacgtgcttagaaaatcctgcggtcatcatgcagacctatctagaaaaggcagtagaagttgctggaaattatgatggagaaagtagtgatgagctaagaaatggaaaaatgaaggcatttctctcattagcccggttttcagatactcaataccaaagaattgaaaactacatgaaatcatcggaatttgaaaacaagcaagctctcctgaaaagagccaaagaggaagtaggtctccttagggaacataaaattcagacaaacagatacacagtaaaggttcagcgagagctggagttggatgaattagccctgcgtgcactgaaagaggatcgtaaacgcttcttatgtaaagcagttgaaaattatatcaactgcttattaagtggagaagaacatgatatgtgggtattccgactttgttccctctggcttgaaaattctggagtttctgaagtcaatggcatgatgaagagagacggaatgaagattccaacatataaatttttgcctcttatgtaccaattggctgctagaatggggaccaagatgatgggaggcctaggatttcatgaagtcctcaataatctaatctctagaatttcaatggatcacccccatcacactttgtttattatactggccttagcaaatgcaaacagagatgaatttctgactaaaccagaggtagccagaagaagcagaataactaaaaatgtgcctaaacaaagctctcagcttgatgaggatcgaacagaggctgcaaatagaataatatgtactatcagaagtaggagacctcagatggtcagaagtgttgaggcactttgtgatgcttatattatattagcaaacttagatgccactcagtggaagactcagagaaaaggcataaatattccagcagaccagccaattactaaacttaagaatttagaagatgttgttgtccctactatggaaattaaggtggaccacacaggagaatatggaaatctggtgactatacagtcatttaaagcagaatttcgcttagcaggaggtgtaaatttaccaaaaataatagattgtgtaggttccgatggcaaggagaggagacagcttgttaagggccgtgatgacctgagacaagatgctgtcatgcaacaggtcttccagatgtgtaatacattactgcagagaaacacggaaactaggaagaggaaattaactatctgtacttataaggtggttcccctctctcagcgaagtggtgttcttgaatggtgcacaggaactgtccccattggtgaatttcttgttaacaatgaagatggtgctcataaaagatacaggccaaatgatttcagtgcctttcagtgccaaaagaaaatgatggaggtgcaaaaaaagtcttttgaagagaaatatgaagtcttcatggatgtttgccaaaattttcaaccagttttccgttacttctgcatggaaaaattcttggatccagctatttggtttgagaagcgattggcttatacgcgcagtgtagctacttcttctattgttggttacatacttggacttggtgatagacatgtacagaatatcttgataaatgagcagtcagcagaacttgtacatatagatctaggtgttgcttttgaacagggcaaaatccttcctactcctgagacagttccttttagactcaccagagatattgtggatggcatgggcattacgggtgttgaaggtgtcttcagaagatgctgtgagaaaaccatggaagtgatgagaaactctcaggaaactctgttaaccattgtagaggtccttctatatgatccactctttgactggaccatgaatcctttgaaagctttgtatttacagcagaggccggaagatgaaactgagcttcaccctactctgaatgcagatgaccaagaatgcaaacgaaatctcagtgatattgaccagagtttcaacaaagtagctgaacgtgtcttaatgagactacaagagaaactgaaaggagtggaagaaggcactgtgctcagtgttggtggacaagtgaatttgctcatacagcaggccatagaccccaaaaatctcagccgacttttcccaggatggaaagcttgggtgtgatcttcagtatatgaattaccctttcattcagcctttagaaattatattttagcctttatttttaacctgccaacatactttaagtagggattaatatttaagtgaactattgtgggtttttttgaatgttggttttaatacttgatttaatcaccactcaaaaatgttttgatggtcttaaggaacatctctgctttcactctttagaaataatggtcattcgggctgggcgcagcggctcacgcctgtaatcccagcactttgggaggccgaggtgagcggatcacaaggtcaggagttcgagaccagcctggccaagagaccagcctggccagtatggtgaaaccctgtctctactaaaaatacaaaaattagccgagcatggtggcgggcacctgtaatcccagctactcgagaggctgaggcaggagaatctcttgaacctgggaggtgaaggttgctgtgggccaaaatcatgccattgcactccagcctgggtgacaagagcgaaactccatctcaaaaaaaaaaaaaaaaaacagaaacttatttggatttttcctagtaagatcactcagtgttactaaataatgaagttgttatggagaacaaatttcaaagacacagttagtgtagttactatttttttaagtgtgtattaaaacttctcattctattctctttatcttttaagcccttctgtactgtccatgtatgttatctttctgtgataacttcatagattgccttctagttcatgaattctcttgtcagatgtatataatctcttttaccctatccattgggcttcttctttcagaaattgtttttcatttctaattatgcatcatttttcagatctctgtttcttgatgtcatttttaatgtttttttaatgttttttatgtcactaattattttaaatgtctgtacttgatagacactgtaatagttctattaaatttagttcctgctgtttatatctgttgatttttgtatttgataggctgttcatccagttttgtctttttgaaaagtgagtttattttcagcaaggctttatctatgggaatcttgagtgtctgtttatgtcatattcccagggctgttgctgcacacaagcccattcttattttaatttcttggctttagggtttccatacctgaagtgtagcataaatactgataggagatttcccaggccaaggcaaacacacttcctcctcatctccttgtgctagtgggcagaatatttgattgatgcctttttcactgagagtataagcttccatgtgtcccacctttatggcaggggtggaaggaggtacatttaattcccactgcctgcctttggcaagccctgggttctttgctccccatatagatgtctaagctaaaagccgtgggttaatgagactggcaaattgttccaggacagctacagcatcagctcacatattcacctctctggtttttcattcccctcatttttttctgagacagagtcttgctctgtcacccaggctggagtgcagtggcatgatctcagctcactgaaacctctgcctcctgggttcaagcaattctcctgcctcagcctccngagtagctgggactacaggcgtgtgccaacacgcccggctaattttttgtatttttattagagacggagtttcaccgtgttagccaggatggtctcgatcgcttgacctcgtgatccaccctcctcggcctcccaaagtgctgggattacaggtgtgagccaccgcgcccggcctcattcccctcatttttgaccgtaaggatttcccctttcttgtaagttctgctatgtatttaaaagaatgttttctacattttatccagcatttctctgtgttctgttggaagggaagggcttaggtatctagtttgatacataggtagaagtggaacatttctctgtcccccagctgtcatcatataagataaacatcagataaaaagccacctgaaagtaaaactactgactcgtgtattagtgagtataatctcttctccatccttaggaaaatgttcatcccagctgcggagattaacaaatgggtgattgagctttctcctcgtatttggaccttgaaggttatataaatttttttcttatgaagagttggcatttctttttattgccaatggcaggcactcattcatatttgatctcctcaccttcccctcccctaaaaccaatctccagaactttttggactataaatttcttggtttgacttctggagaactgttcagaatattactttgcatttcaaattacaaacttaccttggtgtatctttttcttacaagctgcctaaatgaatatttggtatatattggtagttttattactatagtaaatcaaggaaatgcagtaaacttaaaatgtctttaagaaagccctgaaatcttcatgggtgaaattagaaattatcaactagataatagtatagataaatgaatttgtagctaattcttgctagttgttgcatccagagagctttgaataacatcattaatctactctttagccttgcatggtatgctatgaggctcctgttctgttcaagtattctaatcaatggctttgaaaagtttatcaaatttacatacagatcacaagcctaggagaaataactaattcacagatgacagaattaagattataaaagattttttttttgtaattttagtagagacagggttgccattgtattccagccttggcgacagagcaagactctgcctcaaaaaaaaaaaaaaaaaggttttggcaagctggaactctttctgcaaatgactaagatagaaaactgccaaggacaaatgaggagtagttagattttgaaaatattaatcatagaatagttgttgtatgctaagtcactgacccatattatgtacagcatttctgatctttactttgcaagattagtgatactatcccaatacactgctggagaaatcagaatttggagaaataagttgtccaaggcaagaagatagtaaattataagtacaagtgtaatatggacagtatctaacttgaaaagatttcaggcgaaaagaatctggggtttgccagtcagttgctcaaaaggtcaatgaaaaccaaatagtgaagctatcagagaagctaataaattatagactgcttgaacagttgtgtccagattaagggagataatagctttcccaccctactttgtgcaggtcatacctccccaaagtgtttacctaatcagtaggttcacaaactcttggtcattatagtatatgcctaaaatgtatgcacttaggaatgctaaaaatttaaatatggtctaaagcaaataaaagcaaagaggaaaaactttggacatcgtaaagactagaatagtcttttaaaaagaaagccagtatattggtttgaaatatagagatgtgtcccaatttcaagtattttaattgcaccttaatgaaattatctattttctatagattttagtactattgaatgtattactttactgttacctgaatttattataaagtgtttttgaataaataattctaaaagca

SEQ ID NO: 279246 - DNA, 13894 bp, Homo sapiens
  misc_feature (340)..(340): n is a, c, g, or t
  misc_feature (2481)..(2481): n is a, c, g, or t
  misc_feature (3071)..(3071): n is a, c, g, or t
  misc_feature (11595)..(11595): n is a, c, g, or t
ccgcgtccgcgcttacccaatacaagccgggctacgtccgagggtaacaacatgatcaaaaccacagcaggaaccacaataaggaacaagactcaggttaaagcaaacacagcgacagctcctgcgccgcatctcctggttccagtggcggcactgaactcgcggcaatttgtcccgcctctttcgcttcacggcagccaatcgcttccgccagagaaagaaaggcgccgaaatgaaacccgcctccgttcgccttcggaactgtcgtcacttccgtcctcagacttggaggggcggggatgaggagggcggggaggacgacgagggcgaagagggtggntgagagccccggagcccgagccgaagggcgagccgcaaacgctaagtcgctggccattggtggacatggcgcaggcgcgtttgctccgacgggccgaatgttttggggcagtgttttgagcgcggagaccgcgtgatactggatgcgcatgggcataccgtgctctgcggctgcttggcgttgcttcttcctccagaagtgggcgctgggcagtcacgcagggtttgaaccggaagcgggagtaggtagctgcgtggctaacggagaaaagaagccgtggccacgggaggaggcgagaggagtcgggatctgcgctgcagccaccgccgcggttgatactactttgaccttccgagtgcagtgaggcatacatcacaatttggaattatgcattggtttatcaatttacttgtttattgtcaccctgctgcccagatatgacttcatgaggacagtgatgtgtgttctgaaattgtgaaccatgagtctagtacttaatgatctgcttatctgctgccgtcaactagaacatgatagagctacagaacgaaagaaagaagttgagaaatttaagcgcctgattcgagatcctgaaacaattaaacatctagatcggcattcagattccaaacaaggaaaatatttgaattgggatgctgtttttagatttttacagaaatatattcagaaagaaacagaatgtctgagaatagcaaaaccaaatgtatcagcctcaacacaagcctccaggcagaaaaagatgcaggaaatcagtagtttggtcaaatacttcatcaaatgtgcaaacagaagagcacctaggctaaaatgtcaagaactcttaaattatatcatggatacagtgaaagattcatctaatggtgctatttacggagctgattgtagcaacatactactcaaagacattctttctgtgagaaaatactggtgtgaaatatctcagcaacagtggttagaattgttctctgtgtacttcaggctctatctgaaaccttcacaagatgttcatagagttttagtggctagaataattcatgctgttaccaaaggatgctgttctcagactgacggattaaattccaaatttttggactttttttccaaggctattcagtgtgcgagacaagaaaagagctcttcaggtctaaatcatatcttagcagctcttactatcttcctcaagactttggctgtcaactttcgaattcgagtgtgtgaattaggagatgaaattcttcccactttgctttatatttggactcaacataggcttaatgattctttaaaagaagtcattattgaattatttcaactgcaaatttatatccatcatccgaaaggagccaaaacccaagaaaaaggtgcttatgaatcaacaaaatggagaagtattttatacaacttatatgatctgctagtgaatgagataagtcatataggaagtagaggaaagtattcttcaggatttcgtaatattgccgtcaaagaaaatttgattgaattgatggcagatatctgtcaccaggtttttaatgaagataccagatccttggagatttctcaatcttacactactacacaaagagaatctagtgattacagtgtcccttgcaaaaggaagaaaatagaactaggctgggaagtaataaaagatcaccttcagaagtcacagaatgattttgatcttgtgccttggctacagattgcaacccaattaatatcaaagtatcctgcaagtttacctaactgtgagctgtctccattactgatgatactatctcagcttctaccccaacagcgacatggggaacgtacaccatatgtgttacgatgccttacggaagttgcattgtgtcaagacaagaggtcaaacctagaaagctcacaaaagtcagatttattaaaactctggaataaaatttggtgtattacctttcgtggtataagttctgagcaaatacaagctgaaaactttggcttacttggagccataattcagggtagtttagttgaggttgacagagaattctggaagttatttactgggtcagcctgcagaccttcatgtcctgcagtatgctgtttgactttggcactgaccaccagtatagttccaggancggtaaaaatgggaatagagcaaaatatgtgtgaagtaaatagaagcttttctttaaaggaatcaataatgaaatggctcttattctatcagttagagggtgacttagaaaatagcacagaagtgcctccaattcttcacagtaattttcctcatcttgtactggagaaaattcttgtgagtctcactatgaaaaactgtaaagctgcaatgaattttttccaaagcgtgccagaatgtgaacaccaccaaaaagataaagaagaactttcattctcagaagtagaagaactatttcttcagacaacttttgacaagatggactttttaaccattgtgagagaatgtggtatagaaaagcaccagtccagtattggcttctctgtccaccagaatctcaaggaatcactggatcgctgtcttctgggattatcagaacagcttctgaataattactcatctgagattacaaattcagaaactcttgtccggtgttcacgtcttttggtgggtgtccttggctgctactgttacatgggtgtaatagctgaagaggaagcatataagtcagaattattccagaaagccaantctctaatgcaatgtgcaggagaaagtatcactctgtttaaaaataagacaaatgaggaattcagaattggttccttgagaaatatgatgcagctatgtacacgttgcttgagcaactgtaccaagaagagtccaaataagattgcatctggctttttcctgcgattgttaacatcaaagctaatgaatgacattgcagatatttgtaaaagtttagcatccttcatcaaaaagccatttgaccgtggagaagtagaatcaatggaagatgatactaatggaaatctaatggaggtggaggatcagtcatccatgaatctatttaacgattaccctgatagtagtgttagtgatgcaaacgaacctggagagagccaaagtaccataggtgccattaatcctttagctgaagaatatctgtcaaagcaagatctacttttcttagacatgctcaagttcttgtgtttgtgtgtaactactgctcagaccaatactgtgtcctttagggcagctgatattcggaggaaattgttaatgttaattgattctagcacgctagaacctaccaaatccctccacctgcatatgtatctaatgcttttaaaggagcttcctggagaagagtaccccttgccaatggaagatgttcttgaacttctgaaaccactatccaatgtgtgttctttgtatcgtcgtgaccaagatgtttgtaaaactattttaaaccatgtccttcatgtagtgaaaaacctaggtcaaagcaatatggactctgagaacacaagggatgctcaaggacagtttcttacagtaattggagcattttggcatctaacaaaggagaggaaatatatattctctgtaagaatggccctagtaaattgccttaaaactttgcttgaggctgatccttattcaaaatgggccattcttaatgtaatgggaaaagactttcctgtaaatgaagtatttacacaatttcttgctgacaatcatcaccaagttcgcatgttggctgcagagtcaatcaatagattgttccaggacacgaagggagattcttccaggttactgaaagcacttcctttgaagcttcagcaaacagcttttgaaaatgcatacttgaaagctcaggaaggaatgagagaaatgtcccatagtgctgagaaccctgaaactttggatgaaatttataatagaaaatctgttttactgacgttgatagctgtggttttatcctgtagccctatctgcgaaaaacaggctttgtttgccctgtgtaaatctgtgaaagagaatggattagaacctcaccttgtgaaaaaggttttagagaaagtttctgaaacttttggatatagacgtttagaagactttatggcatctcatttagattatctggttttggaatggctaaatcttcaagatactgaatacaacttatcttcttttccttttattttattaaactacacaaatattgaggatttctatagatcttgttataaggttttgattccacatctggtgattagaagtcattttgatgaggtgaagtccattgctaatcagattcaagaggactggaaaagtcttctaacagactgctttccaaagattcttgtaaatattcttccttattttgcctatgagggtaccagagacagtgggatggcacagcaaagagagactgctaccaaggtctatgatatgcttaaaagtgaaaacttattgggaaaacagattgatcacttattcattagtaatttaccagagattgtggtggagttattgatgacgttacatgagccagcaaattctagtgccagtcagagcactgacctctgtgacttttcaggggatttggatcctgctcctaatccacctcattttccatcgcatgtgattaaagcaacatttgcctatatcagcaattgtcataaaaccaagttaaaaagcattttagaaattctttccaaaagccctgattcctatcagaaaattcttcttgccatatgtgagcaagcagctgaaacaaataatgtttataagaagcacagaattcttaaaatatatcacctgtttgttagtttattactgaaagatataaaaagtggcttaggaggagcttgggcctttgttcttcgagacgttatttatactttgattcactatatcaaccaaaggccttcttgtatcatggatgtgtcattacgtagcttctccctttgttgtgacttattaagtcaggtttgccagacagccgtgacttactgtaaggatgctctagaaaaccatcttcatgttattgttggtacacttataccccttgtgtatgagcaggtggaggttcagaaacaggtattggacttgttgaaatacttagtgatagataacaaggataatgaaaacctctatatcacgattaagcttttagatccttttcctgaccatgttgtttttaaggatttgcgtattactcagcaaaaaatcaaatacagtagaggacccttttcactcttggaggaaattaaccattttctctcagtaagtgtttatgatgcacttccattgacaagacttgaaggactaaaggatcttcgaagacaactggaactacataaagatcagatggtggacattatgagagcttctcaggataatccgcaagatgggattatggtgaaactagttgtcaatttgttgcagttatccaagatggcaataaaccacactggtgaaaaagaagttctagaggctgttggaagctgcttgggagaagtgggtcctatagatttctctaccatagctatacaacatagtaaagatgcatcttataccaaggcccttaagttatttgaagataaagaacttcagtggaccttcataatgctgacctacctgaataacacactggtagaagattgtgtcaaagttcgatcagcagctgttacctgtttgaaaaacattttagccacaaagactggacatagtttctgggagatttataagatgacaacagatccaatgctggcctatctacagccttttagaacatcaagaaaaaagtttttagaagtacccagatttgacaaagaaaacccttttgaaggcctggatgatataaatctgtggattcctctaagtgaaaatcatgacatttggataaagacactgacttgtgcttttttggacagtggaggcacaaaatgtgaaattcttcaattattaaagccaatgtgtgaagtgaaaactgacttttgtcagactgtacttccatacttgattcatgatattttactccaagatacaaatgaatcatggagaaatctgctttctacacatgttcagggatttttcaccagctgtcttcgacacttctcgcaaacgagccgatccacaacccctgcaaacttggattcagagtcagagcactttttccgatgctgtttggataaaaaatcacaaagaacaatgcttgctgttgtggactacatgagaagacaaaagagaccttcttcaggaacaatttttaatgatgctttctggctggatttaaattatctagaagttgccaaggtagctcagtcttgtgctgctcactttacagctttactctatgcagaaatctatgcagataagaaaagtatggatgatcaagagaaaagaagtcttgcatttgaagaaggaagccagagtacaactatttctagcttgagtgaaaaaagtaaagaagaaactggaataagtttacaggatcttctcttagaaatctacagaagtataggggagccagatagtttgtatggctgtggtggagggaagatgttacaacccattactagactacgaacatatgaacacgaagcaatgtggggcaaagccctagtaacatatgacctcgaaacagcaatcccctcatcaacacgccaggcaggaatcattcaggccttgcagaatttgggactctgccatattctttccgtctatttaaaaggattggattatgaaaataaagactggtgtcctgaactagaagaacttcattaccaagcagcatggaggaatatgcagtgggaccattgcacttccgtcagcaaagaagtagaaggaaccagttaccatgaatcattgtacaatgctctacaatctctaagagacagagaattctctacattttatgaaagtctcaaatatgccagagtaaaagaagtggaagagatgtgtaagcgcagccttgagtctgtgtattcgctctatcccacacttagcaggttgcaggccattggagagctggaaagcattggggagcttttctcaagatcagtcacacatagacaactctctgaagtatatattaagtggcagaaacactcccagcttctcaaggacagtgattttagttttcaggagcctatcatggctctacgcacagtcattttggagatcctgatggaaaaggaaatggacaactcacaaagagaatgtattaaggacattctcaccaaacaccttgtagaactctctatactggccagaactttcaagaacactcagctccctgaaagggcaatatttcaaattaaacagtacaattcagttagctgtggagtctctgagtggcagctggaagaagcacaagtattctgggcaaaaaaggagcagagtcttgccctgagtattctcaagcaaatgatcaagaagttggatgccagctgtgcagcgaacaatcccagcctaaaacttacatacacagaatgtctgagggtttgtggcaactggttagcagaaacgtgcttagaaaatcctgcggtcatcatgcagacctatctagaaaaggcagtagaagttgctggaaattatgatggagaaagtagtgatgagctaagaaatggaaaaatgaaggcatttctctcattagcccggttttcagatactcaataccaaagaattgaaaactacatgaaatcatcggaatttgaaaacaagcaagctctcctgaaaagagccaaagaggaagtaggtctccttagggaacataaaattcagacaaacagatacacagtaaaggttcagcgagagctggagttggatgaattagccctgcgtgcactgaaagaggatcgtaaacgcttcttatgtaaagcagttgaaaattatatcaactgcttattaagtggagaagaacatgatatgtgggtattccgactttgttccctctggcttgaaaattctggagtttctgaagtcaatggcatgatgaagagagacggaatgaagattccaacatataaatttttgcctcttatgtaccaattggctgctagaatggggaccaagatgatgggaggcctaggatttcatgaagtcctcaataatctaatctctagaatttcaatggatcacccccatcacactttgtttattatactggccttagcaaatgcaaacagagatgaatttctgactaaaccagaggtagccagaagaagcagaataactaaaaatgtgcctaaacaaagctctcagcttgatgaggatcgaacagaggctgcaaatagaataatatgtactatcagaagtaggagacctcagatggtcagaagtgttgaggcactttgtgatgcttatattatattagcaaacttagatgccactcagtggaagactcagagaaaaggcataaatattccagcagaccagccaattactaaacttaagaatttagaagatgttgttgtccctactatggaaattaaggtggaccacacaggagaatatggaaatctggtgactatacagtcatttaaagcagaatttcgcttagcaggaggtgtaaatttaccaaaaataatagattgtgtaggttccgatggcaaggagaggagacagcttgttaagggccgtgatgacctgagacaagatgctgtcatgcaacaggtcttccagatgtgtaatacattactgcagagaaacacggaaactaggaagaggaaattaactatctgtacttataaggtggttcccctctctcagcgaagtggtgttcttgaatggtgcacaggaactgtccccattggtgaatttcttgttaacaatgaagatggtgctcataaaagatacaggccaaatgatttcagtgcctttcagtgccaaaagaaaatgatggaggtgcaaaaaaagtcttttgaagagaaatatgaagtcttcatggatgtttgccaaaattttcaaccagttttccgttacttctgcatggaaaaattcttggatccagctatttggtttgagaagcgattggcttatacgcgcagtgtagctacttcttctattgttggttacatacttggacttggtgatagacatgtacagaatatcttgataaatgagcagtcagcagaacttgtacatatagatctaggtgttgcttttgaacagggcaaaatccttcctactcctgagacagttccttttagactcaccagagatattgtggatggcatgggcattacgggtgttgaaggtgtcttcagaagatgctgtgagaaaaccatggaagtgatgagaaactctcaggaaactctgttaaccattgtagaggtccttctatatgatccactctttgactggaccatgaatcctttgaaagctttgtatttacagcagaggccggaagatgaaactgagcttcaccctactctgaatgcagatgaccaagaatgcaaacgaaatctcagtgatattgaccagagtttcaacaaagtagctgaacgtgtcttaatgagactacaagagaaactgaaaggagtggaagaaggcactgtgctcagtgttggtggacaagtgaatttgctcatacagcaggccatagaccccaaaaatctcagccgacttttcccaggatggaaagcttgggtgtgatcttcagtatatgaattaccctttcattcagcctttagaaattatattttagcctttatttttaacctgccaacatactttaagtagggattaatatttaagtgaactattgtgggtttttttgaatgttggttttaatacttgatttaatcaccactcaaaaatgttttgatggtcttaaggaacatctctgctttcactctttagaaataatggtcattcgggctgggcgcagcggctcacgcctgtaatcccagcactttgggaggccgaggtgagcggatcacaaggtcaggagttcgagaccagcctggccaagagaccagcctggccagtatggtgaaaccctgtctctactaaaaatacaaaaattagccgagcatggtggcgggcacctgtaatcccagctactcgagaggctgaggcaggagaatctcttgaacctgggaggtgaaggttgctgtgggccaaaatcatgccattgcactccagcctgggtgacaagagcgaaactccatctcaaaaaaaaaaaaaaaaaacagaaacttatttggatttttcctagtaagatcactcagtgttactaaataatgaagttgttatggagaacaaatttcaaagacacagttagtgtagttactatttttttaagtgtgtattaaaacttctcattctattctctttatcttttaagcccttctgtactgtccatgtatgttatctttctgtgataacttcatagattgccttctagttcatgaattctcttgtcagatgtatataatctcttttaccctatccattgggcttcttctttcagaaattgtttttcatttctaattatgcatcatttttcagatctctgtttcttgatgtcatttttaatgtttttttaatgttttttatgtcactaattattttaaatgtctgtacttgatagacactgtaatagttctattaaatttagttcctgctgtttatatctgttgatttttgtatttgataggctgttcatccagttttgtctttttgaaaagtgagtttattttcagcaaggctttatctatgggaatcttgagtgtctgtttatgtcatattcccagggctgttgctgcacacaagcccattcttattttaatttcttggctttagggtttccatacctgaagtgtagcataaatactgataggagatttcccaggccaaggcaaacacacttcctcctcatctccttgtgctagtgggcagaatatttgattgatgcctttttcactgagagtataagcttccatgtgtcccacctttatggcaggggtggaaggaggtacatttaattcccactgcctgcctttggcaagccctgggttctttgctccccatatagatgtctaagctaaaagccgtgggttaatgagactggcaaattgttccaggacagctacagcatcagctcacatattcacctctctggtttttcattcccctcatttttttctgagacagagtcttgctctgtcacccaggctggagtgcagtggcatgatctcagctcactgaaacctctgcctcctgggttcaagcaattctcctgcctcagcctccngagtagctgggactacaggcgtgtgccaacacgcccggctaattttttgtatttttattagagacggagtttcaccgtgttagccaggatggtctcgatcgcttgacctcgtgatccaccctcctcggcctcccaaagtgctgggattacaggtgtgagccaccgcgcccggcctcattcccctcatttttgaccgtaaggatttcccctttcttgtaagttctgctatgtatttaaaagaatgttttctacattttatccagcatttctctgtgttctgttggaagggaagggcttaggtatctagtttgatacataggtagaagtggaacatttctctgtcccccagctgtcatcatataagataaacatcagataaaaagccacctgaaagtaaaactactgactcgtgtattagtgagtataatctcttctccatccttaggaaaatgttcatcccagctgcggagattaacaaatgggtgattgagctttctcctcgtatttggaccttgaaggttatataaatttttttcttatgaagagttggcatttctttttattgccaatggcaggcactcattcatatttgatctcctcaccttcccctcccctaaaaccaatctccagaactttttggactataaatttcttggtttgacttctggagaactgttcagaatattactttgcatttcaaattacaaacttaccttggtgtatctttttcttacaagctgcctaaatgaatatttggtatatattggtagttttattactatagtaaatcaaggaaatgcagtaaacttaaaatgtctttaagaaagccctgaaatcttcatgggtgaaattagaaattatcaactagataatagtatagataaatgaatttgtagctaattcttgctagttgttgcatccagagagctttgaataacatcattaatctactctttagccttgcatggtatgctatgaggctcctgttctgttcaagtattctaatcaatggctttgaaaagtttatcaaatttacatacagatcacaagcctaggagaaataactaattcacagatgacagaattaagattataaaagattttttttttgtaattttagtagagacagggttgccattgtattccagccttggcgacagagcaagactctgcctcaaaaaaaaaaaaaaaaaggttttggcaagctggaactctttctgcaaatgactaagatagaaaactgccaaggacaaatgaggagtagttagattttgaaaatattaatcatagaatagttgttgtatgctaagtcactgacccatattatgtacagcatttctgatctttactttgcaagattagtgatactatcccaatacactgctggagaaatcagaatttggagaaataagttgtccaaggcaagaagatagtaaattataagtacaagtgtaatatggacagtatctaacttgaaaagatttcaggcgaaaagaatctggggtttgccagtcagttgctcaaaaggtcaatgaaaaccaaatagtgaagctatcagagaagctaataaattatagactgcttgaacagttgtgtccagattaagggagataatagctttcccaccctactttgtgcaggtcatacctccccaaagtgtttacctaatcagtaggttcacaaactcttggtcattatagtatatgcctaaaatgtatgcacttaggaatgctaaaaatttaaatatggtctaaagcaaataaaagcaaagaggaaaaactttggacatcgtaaagactagaatagtcttttaaaaagaaagccagtatattggtttgaaatatagagatgtgtcccaatttcaagtattttaattgcaccttaatgaaattatctattttctatagattttagtactattgaatgtattactttactgttacctgaatttattataaagtgtttttgaataaataattctaaaagcatatactaagactcattcactttattcaaatatttgtgtgttctgtgtgccaggcatgggactcgttctaaggagaaagcagtgagcaaggcaggcatagtctgcctatataaagctcccaatctgaggaggataggcaactgaccacgcagtgtgaaccggggagcctattgcacaaccagtctgataatgctgcatctcagtctaaatatcctagtagtgtttcttagtcgcctcctgacaaaaaggcaaatatgaatgttctttctttgggcctagaaagtgatctagttgacatttctagcctaaaag

SEQ ID NO: 279247 - DNA, 13840 bp, Homo sapiens
  misc_feature (340)..(340): n is a, c, g, or t
  misc_feature (2481)..(2481): n is a, c, g, or t
  misc_feature (3071)..(3071): n is a, c, g, or t
  misc_feature (11595)..(11595): n is a, c, g, or t
ccgcgtccgcgcttacccaatacaagccgggctacgtccgagggtaacaacatgatcaaaaccacagcaggaaccacaataaggaacaagactcaggttaaagcaaacacagcgacagctcctgcgccgcatctcctggttccagtggcggcactgaactcgcggcaatttgtcccgcctctttcgcttcacggcagccaatcgcttccgccagagaaagaaaggcgccgaaatgaaacccgcctccgttcgccttcggaactgtcgtcacttccgtcctcagacttggaggggcggggatgaggagggcggggaggacgacgagggcgaagagggtggntgagagccccggagcccgagccgaagggcgagccgcaaacgctaagtcgctggccattggtggacatggcgcaggcgcgtttgctccgacgggccgaatgttttggggcagtgttttgagcgcggagaccgcgtgatactggatgcgcatgggcataccgtgctctgcggctgcttggcgttgcttcttcctccagaagtgggcgctgggcagtcacgcagggtttgaaccggaagcgggagtaggtagctgcgtggctaacggagaaaagaagccgtggccacgggaggaggcgagaggagtcgggatctgcgctgcagccaccgccgcggttgatactactttgaccttccgagtgcagtgaggcatacatcacaatttggaattatgcattggtttatcaatttacttgtttattgtcaccctgctgcccagatatgacttcatgaggacagtgatgtgtgttctgaaattgtgaaccatgagtctagtacttaatgatctgcttatctgctgccgtcaactagaacatgatagagctacagaacgaaagaaagaagttgagaaatttaagcgcctgattcgagatcctgaaacaattaaacatctagatcggcattcagattccaaacaaggaaaatatttgaattgggatgctgtttttagatttttacagaaatatattcagaaagaaacagaatgtctgagaatagcaaaaccaaatgtatcagcctcaacacaagcctccaggcagaaaaagatgcaggaaatcagtagtttggtcaaatacttcatcaaatgtgcaaacagaagagcacctaggctaaaatgtcaagaactcttaaattatatcatggatacagtgaaagattcatctaatggtgctatttacggagctgattgtagcaacatactactcaaagacattctttctgtgagaaaatactggtgtgaaatatctcagcaacagtggttagaattgttctctgtgtacttcaggctctatctgaaaccttcacaagatgttcatagagttttagtggctagaataattcatgctgttaccaaaggatgctgttctcagactgacggattaaattccaaatttttggactttttttccaaggctattcagtgtgcgagacaagaaaagagctcttcaggtctaaatcatatcttagcagctcttactatcttcctcaagactttggctgtcaactttcgaattcgagtgtgtgaattaggagatgaaattcttcccactttgctttatatttggactcaacataggcttaatgattctttaaaagaagtcattattgaattatttcaactgcaaatttatatccatcatccgaaaggagccaaaacccaagaaaaaggtgcttatgaatcaacaaaatggagaagtattttatacaacttatatgatctgctagtgaatgagataagtcatataggaagtagaggaaagtattcttcaggatttcgtaatattgccgtcaaagaaaatttgattgaattgatggcagatatctgtcaccaggtttttaatgaagataccagatccttggagatttctcaatcttacactactacacaaagagaatctagtgattacagtgtcccttgcaaaaggaagaaaatagaactaggctgggaagtaataaaagatcaccttcagaagtcacagaatgattttgatcttgtgccttggctacagattgcaacccaattaatatcaaagtatcctgcaagtttacctaactgtgagctgtctccattactgatgatactatctcagcttctaccccaacagcgacatggggaacgtacaccatatgtgttacgatgccttacggaagttgcattgtgtcaagacaagaggtcaaacctagaaagctcacaaaagtcagatttattaaaactctggaataaaatttggtgtattacctttcgtggtataagttctgagcaaatacaagctgaaaactttggcttacttggagccataattcagggtagtttagttgaggttgacagagaattctggaagttatttactgggtcagcctgcagaccttcatgtcctgcagtatgctgtttgactttggcactgaccaccagtatagttccaggancggtaaaaatgggaatagagcaaaatatgtgtgaagtaaatagaagcttttctttaaaggaatcaataatgaaatggctcttattctatcagttagagggtgacttagaaaatagcacagaagtgcctccaattcttcacagtaattttcctcatcttgtactggagaaaattcttgtgagtctcactatgaaaaactgtaaagctgcaatgaattttttccaaagcgtgccagaatgtgaacaccaccaaaaagataaagaagaactttcattctcagaagtagaagaactatttcttcagacaacttttgacaagatggactttttaaccattgtgagagaatgtggtatagaaaagcaccagtccagtattggcttctctgtccaccagaatctcaaggaatcactggatcgctgtcttctgggattatcagaacagcttctgaataattactcatctgagattacaaattcagaaactcttgtccggtgttcacgtcttttggtgggtgtccttggctgctactgttacatgggtgtaatagctgaagaggaagcatataagtcagaattattccagaaagccaantctctaatgcaatgtgcaggagaaagtatcactctgtttaaaaataagacaaatgaggaattcagaattggttccttgagaaatatgatgcagctatgtacacgttgcttgagcaactgtaccaagaagagtccaaataagattgcatctggctttttcctgcgattgttaacatcaaagctaatgaatgacattgcagatatttgtaaaagtttagcatccttcatcaaaaagccatttgaccgtggagaagtagaatcaatggaagatgatactaatggaaatctaatggaggtggaggatcagtcatccatgaatctatttaacgattaccctgatagtagtgttagtgatgcaaacgaacctggagagagccaaagtaccataggtgccattaatcctttagctgaagaatatctgtcaaagcaagatctacttttcttagacatgctcaagttcttgtgtttgtgtgtaactactgctcagaccaatactgtgtcctttagggcagctgatattcggaggaaattgttaatgttaattgattctagcacgctagaacctaccaaatccctccacctgcatatgtatctaatgcttttaaaggagcttcctggagaagagtaccccttgccaatggaagatgttcttgaacttctgaaaccactatccaatgtgtgttctttgtatcgtcgtgaccaagatgtttgtaaaactattttaaaccatgtccttcatgtagtgaaaaacctaggtcaaagcaatatggactctgagaacacaagggatgctcaaggacagtttcttacagtaattggagcattttggcatctaacaaaggagaggaaatatatattctctgtaagaatggccctagtaaattgccttaaaactttgcttgaggctgatccttattcaaaatgggccattcttaatgtaatgggaaaagactttcctgtaaatgaagtatttacacaatttcttgctgacaatcatcaccaagttcgcatgttggctgcagagtcaatcaatagattgttccaggacacgaagggagattcttccaggttactgaaagcacttcctttgaagcttcagcaaacagcttttgaaaatgcatacttgaaagctcaggaaggaatgagagaaatgtcccatagtgctgagaaccctgaaactttggatgaaatttataatagaaaatctgttttactgacgttgatagctgtggttttatcctgtagccctatctgcgaaaaacaggctttgtttgccctgtgtaaatctgtgaaagagaatggattagaacctcaccttgtgaaaaaggttttagagaaagtttctgaaacttttggatatagacgtttagaagactttatggcatctcatttagattatctggttttggaatggctaaatcttcaagatactgaatacaacttatcttcttttccttttattttattaaactacacaaatattgaggatttctatagatcttgttataaggttttgattccacatctggtgattagaagtcattttgatgaggtgaagtccattgctaatcagattcaagaggactggaaaagtcttctaacagactgctttccaaagattcttgtaaatattcttccttattttgcctatgagggtaccagagacagtgggatggcacagcaaagagagactgctaccaaggtctatgatatgcttaaaagtgaaaacttattgggaaaacagattgatcacttattcattagtaatttaccagagattgtggtggagttattgatgacgttacatgagccagcaaattctagtgccagtcagagcactgacctctgtgacttttcaggggatttggatcctgctcctaatccacctcattttccatcgcatgtgattaaagcaacatttgcctatatcagcaattgtcataaaaccaagttaaaaagcattttagaaattctttccaaaagccctgattcctatcagaaaattcttcttgccatatgtgagcaagcagctgaaacaaataatgtttataagaagcacagaattcttaaaatatatcacctgtttgttagtttattactgaaagatataaaaagtggcttaggaggagcttgggcctttgttcttcgagacgttatttatactttgattcactatatcaaccaaaggccttcttgtatcatggatgtgtcattacgtagcttctccctttgttgtgacttattaagtcaggtttgccagacagccgtgacttactgtaaggatgctctagaaaaccatcttcatgttattgttggtacacttataccccttgtgtatgagcaggtggaggttcagaaacaggtattggacttgttgaaatacttagtgatagataacaaggataatgaaaacctctatatcacgattaagcttttagatccttttcctgaccatgttgtttttaaggatttgcgtattactcagcaaaaaatcaaatacagtagaggacccttttcactcttggaggaaattaaccattttctctcagtaagtgtttatgatgcacttccattgacaagacttgaaggactaaaggatcttcgaagacaactggaactacataaagatcagatggtggacattatgagagcttctcaggataatccgcaagatgggattatggtgaaactagttgtcaatttgttgcagttatccaagatggcaataaaccacactggtgaaaaagaagttctagaggctgttggaagctgcttgggagaagtgggtcctatagatttctctaccatagctatacaacatagtaaagatgcatcttataccaaggcccttaagttatttgaagataaagaacttcagtggaccttcataatgctgacctacctgaataacacactggtagaagattgtgtcaaagttcgatcagcagctgttacctgtttgaaaaacattttagccacaaagactggacatagtttctgggagatttataagatgacaacagatccaatgctggcctatctacagccttttagaacatcaagaaaaaagtttttagaagtacccagatttgacaaagaaaacccttttgaaggcctggatgatataaatctgtggattcctctaagtgaaaatcatgacatttggataaagacactgacttgtgcttttttggacagtggaggcacaaaatgtgaaattcttcaattattaaagccaatgtgtgaagtgaaaactgacttttgtcagactgtacttccatacttgattcatgatattttactccaagatacaaatgaatcatggagaaatctgctttctacacatgttcagggatttttcaccagctgtcttcgacacttctcgcaaacgagccgatccacaacccctgcaaacttggattcagagtcagagcactttttccgatgctgtttggataaaaaatcacaaagaacaatgcttgctgttgtggactacatgagaagacaaaagagaccttcttcaggaacaatttttaatgatgctttctggctggatttaaattatctagaagttgccaaggtagctcagtcttgtgctgctcactttacagctttactctatgcagaaatctatgcagataagaaaagtatggatgatcaagagaaaagaagtcttgcatttgaagaaggaagccagagtacaactatttctagcttgagtgaaaaaagtaaagaagaaactggaataagtttacaggatcttctcttagaaatctacagaagtataggggagccagatagtttgtatggctgtggtggagggaagatgttacaacccattactagactacgaacatatgaacacgaagcaatgtggggcaaagccctagtaacatatgacctcgaaacagcaatcccctcatcaacacgccaggcaggaatcattcaggccttgcagaatttgggactctgccatattctttccgtctatttaaaaggattggattatgaaaataaagactggtgtcctgaactagaagaacttcattaccaagcagcatggaggaatatgcagtgggaccattgcacttccgtcagcaaagaagtagaaggaaccagttaccatgaatcattgtacaatgctctacaatctctaagagacagagaattctctacattttatgaaagtctcaaatatgccagagtaaaagaagtggaagagatgtgtaagcgcagccttgagtctgtgtattcgctctatcccacacttagcaggttgcaggccattggagagctggaaagcattggggagcttttctcaagatcagtcacacatagacaactctctgaagtatatattaagtggcagaaacactcccagcttctcaaggacagtgattttagttttcaggagcctatcatggctctacgcacagtcattttggagatcctgatggaaaaggaaatggacaactcacaaagagaatgtattaaggacattctcaccaaacaccttgtagaactctctatactggccagaactttcaagaacactcagctccctgaaagggcaatatttcaaattaaacagtacaattcagttagctgtggagtctctgagtggcagctggaagaagcacaagtattctgggcaaaaaaggagcagagtcttgccctgagtattctcaagcaaatgatcaagaagttggatgccagctgtgcagcgaacaatcccagcctaaaacttacatacacagaatgtctgagggtttgtggcaactggttagcagaaacgtgcttagaaaatcctgcggtcatcatgcagacctatctagaaaaggcagtagaagttgctggaaattatgatggagaaagtagtgatgagctaagaaatggaaaaatgaaggcatttctctcattagcccggttttcagatactcaataccaaagaattgaaaactacatgaaatcatcggaatttgaaaacaagcaagctctcctgaaaagagccaaagaggaagtaggtctccttagggaacataaaattcagacaaacagatacacagtaaaggttcagcgagagctggagttggatgaattagccctgcgtgcactgaaagaggatcgtaaacgcttcttatgtaaagcagttgaaaattatatcaactgcttattaagtggagaagaacatgatatgtgggtattccgactttgttccctctggcttgaaaattctggagtttctgaagtcaatggcatgatgaagagagacggaatgaagattccaacatataaatttttgcctcttatgtaccaattggctgctagaatggggaccaagatgatgggaggcctaggatttcatgaagtcctcaataatctaatctctagaatttcaatggatcacccccatcacactttgtttattatactggccttagcaaatgcaaacagagatgaatttctgactaaaccagaggtagccagaagaagcagaataactaaaaatgtgcctaaacaaagctctcagcttgatgaggatcgaacagaggctgcaaatagaataatatgtactatcagaagtaggagacctcagatggtcagaagtgttgaggcactttgtgatgcttatattatattagcaaacttagatgccactcagtggaagactcagagaaaaggcataaatattccagcagaccagccaattactaaacttaagaatttagaagatgttgttgtccctactatggaaattaaggtggaccacacaggagaatatggaaatctggtgactatacagtcatttaaagcagaatttcgcttagcaggaggtgtaaatttaccaaaaataatagattgtgtaggttccgatggcaaggagaggagacagcttgttaagggccgtgatgacctgagacaagatgctgtcatgcaacaggtcttccagatgtgtaatacattactgcagagaaacacggaaactaggaagaggaaattaactatctgtacttataaggtggttcccctctctcagcgaagtggtgttcttgaatggtgcacaggaactgtccccattggtgaatttcttgttaacaatgaagatggtgctcataaaagatacaggccaaatgatttcagtgcctttcagtgccaaaagaaaatgatggaggtgcaaaaaaagtcttttgaagagaaatatgaagtcttcatggatgtttgccaaaattttcaaccagttttccgttacttctgcatggaaaaattcttggatccagctatttggtttgagaagcgattggcttatacgcgcagtgtagctacttcttctattgttggttacatacttggacttggtgatagacatgtacagaatatcttgataaatgagcagtcagcagaacttgtacatatagatctaggtgttgcttttgaacagggcaaaatccttcctactcctgagacagttccttttagactcaccagagatattgtggatggcatgggcattacgggtgttgaaggtgtcttcagaagatgctgtgagaaaaccatggaagtgatgagaaactctcaggaaactctgttaaccattgtagaggtccttctatatgatccactctttgactggaccatgaatcctttgaaagctttgtatttacagcagaggccggaagatgaaactgagcttcaccctactctgaatgcagatgaccaagaatgcaaacgaaatctcagtgatattgaccagagtttcaacaaagtagctgaacgtgtcttaatgagactacaagagaaactgaaaggagtggaagaaggcactgtgctcagtgttggtggacaagtgaatttgctcatacagcaggccatagaccccaaaaatctcagccgacttttcccaggatggaaagcttgggtgtgatcttcagtatatgaattaccctttcattcagcctttagaaattatattttagcctttatttttaacctgccaacatactttaagtagggattaatatttaagtgaactattgtgggtttttttgaatgttggttttaatacttgatttaatcaccactcaaaaatgttttgatggtcttaaggaacatctctgctttcactctttagaaataatggtcattcgggctgggcgcagcggctcacgcctgtaatcccagcactttgggaggccgaggtgagcggatcacaaggtcaggagttcgagaccagcctggccaagagaccagcctggccagtatggtgaaaccctgtctctactaaaaatacaaaaattagccgagcatggtggcgggcacctgtaatcccagctactcgagaggctgaggcaggagaatctcttgaacctgggaggtgaaggttgctgtgggccaaaatcatgccattgcactccagcctgggtgacaagagcgaaactccatctcaaaaaaaaaaaaaaaaaacagaaacttatttggatttttcctagtaagatcactcagtgttactaaataatgaagttgttatggagaacaaatttcaaagacacagttagtgtagttactatttttttaagtgtgtattaaaacttctcattctattctctttatcttttaagcccttctgtactgtccatgtatgttatctttctgtgataacttcatagattgccttctagttcatgaattctcttgtcagatgtatataatctcttttaccctatccattgggcttcttctttcagaaattgtttttcatttctaattatgcatcatttttcagatctctgtttcttgatgtcatttttaatgtttttttaatgttttttatgtcactaattattttaaatgtctgtacttgatagacactgtaatagttctattaaatttagttcctgctgtttatatctgttgatttttgtatttgataggctgttcatccagttttgtctttttgaaaagtgagtttattttcagcaaggctttatctatgggaatcttgagtgtctgtttatgtcatattcccagggctgttgctgcacacaagcccattcttattttaatttcttggctttagggtttccatacctgaagtgtagcataaatactgataggagatttcccaggccaaggcaaacacacttcctcctcatctccttgtgctagtgggcagaatatttgattgatgcctttttcactgagagtataagcttccatgtgtcccacctttatggcaggggtggaaggaggtacatttaattcccactgcctgcctttggcaagccctgggttctttgctccccatatagatgtctaagctaaaagccgtgggttaatgagactggcaaattgttccaggacagctacagcatcagctcacatattcacctctctggtttttcattcccctcatttttttctgagacagagtcttgctctgtcacccaggctggagtgcagtggcatgatctcagctcactgaaacctctgcctcctgggttcaagcaattctcctgcctcagcctccngagtagctgggactacaggcgtgtgccaacacgcccggctaattttttgtatttttattagagacggagtttcaccgtgttagccaggatggtctcgatcgcttgacctcgtgatccaccctcctcggcctcccaaagtgctgggattacaggtgtgagccaccgcgcccggcctcattcccctcatttttgaccgtaaggatttcccctttcttgtaagttctgctatgtatttaaaagaatgttttctacattttatccagcatttctctgtgttctgttggaagggaagggcttaggtatctagtttgatacataggtagaagtggaacatttctctgtcccccagctgtcatcatataagataaacatcagataaaaagccacctgaaagtaaaactactgactcgtgtattagtgagtataatctcttctccatccttaggaaaatgttcatcccagctgcggagattaacaaatgggtgattgagctttctcctcgtatttggaccttgaaggttatataaatttttttcttatgaagagttggcatttctttttattgccaatggcaggcactcattcatatttgatctcctcaccttcccctcccctaaaaccaatctccagaactttttggactataaatttcttggtttgacttctggagaactgttcagaatattactttgcatttcaaattacaaacttaccttggtgtatctttttcttacaagctgcctaaatgaatatttggtatatattggtagttttattactatagtaaatcaaggaaatgcagtaaacttaatagataatagtatagataaatgaatttgtagctaattcttgctagttgttgcatccagagagctttgaataacatcattaatctactctttagccttgcatggtatgctatgaggctcctgttctgttcaagtattctaatcaatggctttgaaaagtttatcaaatttacatacagatcacaagcctaggagaaataactaattcacagatgacagaattaagattataaaagattttttttttgtaattttagtagagacagggttgccattgtattccagccttggcgacagagcaagactctgcctcaaaaaaaaaaaaaaaaaggttttggcaagctggaactctttctgcaaatgactaagatagaaaactgccaaggacaaatgaggagtagttagattttgaaaatattaatcatagaatagttgttgtatgctaagtcactgacccatattatgtacagcatttctgatctttactttgcaagattagtgatactatcccaatacactgctggagaaatcagaatttggagaaataagttgtccaaggcaagaagatagtaaattataagtacaagtgtaatatggacagtatctaacttgaaaagatttcaggcgaaaagaatctggggtttgccagtcagttgctcaaaaggtcaatgaaaaccaaatagtgaagctatcagagaagctaataaattatagactgcttgaacagttgtgtccagattaagggagataatagctttcccaccctactttgtgcaggtcatacctccccaaagtgtttacctaatcagtaggttcacaaactcttggtcattatagtatatgcctaaaatgtatgcacttaggaatgctaaaaatttaaatatggtctaaagcaaataaaagcaaagaggaaaaactttggacatcgtaaagactagaatagtcttttaaaaagaaagccagtatattggtttgaaatatagagatgtgtcccaatttcaagtattttaattgcaccttaatgaaattatctattttctatagattttagtactattgaatgtattactttactgttacctgaatttattataaagtgtttttgaataaataattctaaaagcatatactaagactcattcactttattcaaatatttgtgtgttctgtgtgccaggcatgggactcgttctaaggagaaagcagtgagcaaggcaggcatagtctgcctatataaagctcccaatctgaggaggataggcaactgaccacgcagtgtgaaccggggagcctattgcacaaccagtctgataatgctgcatctcagtctaaatatcctagtagtgtttcttagtcgcctcctgacaaaaaggcaaatatgaatgttctttctttgggcctagaaagtgatctagttgacatttctagcctaaaag

SEQ ID NO: 279248 - DNA, 11573 bp, Homo sapiens
  misc_feature (340)..(340): n is a, c, g, or t
  misc_feature (2481)..(2481): n is a, c, g, or t
  misc_feature (3071)..(3071): n is a, c, g, or t
ccgcgtccgcgcttacccaatacaagccgggctacgtccgagggtaacaacatgatcaaaaccacagcaggaaccacaataaggaacaagactcaggttaaagcaaacacagcgacagctcctgcgccgcatctcctggttccagtggcggcactgaactcgcggcaatttgtcccgcctctttcgcttcacggcagccaatcgcttccgccagagaaagaaaggcgccgaaatgaaacccgcctccgttcgccttcggaactgtcgtcacttccgtcctcagacttggaggggcggggatgaggagggcggggaggacgacgagggcgaagagggtggntgagagccccggagcccgagccgaagggcgagccgcaaacgctaagtcgctggccattggtggacatggcgcaggcgcgtttgctccgacgggccgaatgttttggggcagtgttttgagcgcggagaccgcgtgatactggatgcgcatgggcataccgtgctctgcggctgcttggcgttgcttcttcctccagaagtgggcgctgggcagtcacgcagggtttgaaccggaagcgggagtaggtagctgcgtggctaacggagaaaagaagccgtggccacgggaggaggcgagaggagtcgggatctgcgctgcagccaccgccgcggttgatactactttgaccttccgagtgcagtgaggcatacatcacaatttggaattatgcattggtttatcaatttacttgtttattgtcaccctgctgcccagatatgacttcatgaggacagtgatgtgtgttctgaaattgtgaaccatgagtctagtacttaatgatctgcttatctgctgccgtcaactagaacatgatagagctacagaacgaaagaaagaagttgagaaatttaagcgcctgattcgagatcctgaaacaattaaacatctagatcggcattcagattccaaacaaggaaaatatttgaattgggatgctgtttttagatttttacagaaatatattcagaaagaaacagaatgtctgagaatagcaaaaccaaatgtatcagcctcaacacaagcctccaggcagaaaaagatgcaggaaatcagtagtttggtcaaatacttcatcaaatgtgcaaacagaagagcacctaggctaaaatgtcaagaactcttaaattatatcatggatacagtgaaagattcatctaatggtgctatttacggagctgattgtagcaacatactactcaaagacattctttctgtgagaaaatactggtgtgaaatatctcagcaacagtggttagaattgttctctgtgtacttcaggctctatctgaaaccttcacaagatgttcatagagttttagtggctagaataattcatgctgttaccaaaggatgctgttctcagactgacggattaaattccaaatttttggactttttttccaaggctattcagtgtgcgagacaagaaaagagctcttcaggtctaaatcatatcttagcagctcttactatcttcctcaagactttggctgtcaactttcgaattcgagtgtgtgaattaggagatgaaattcttcccactttgctttatatttggactcaacataggcttaatgattctttaaaagaagtcattattgaattatttcaactgcaaatttatatccatcatccgaaaggagccaaaacccaagaaaaaggtgcttatgaatcaacaaaatggagaagtattttatacaacttatatgatctgctagtgaatgagataagtcatataggaagtagaggaaagtattcttcaggatttcgtaatattgccgtcaaagaaaatttgattgaattgatggcagatatctgtcaccaggtttttaatgaagataccagatccttggagatttctcaatcttacactactacacaaagagaatctagtgattacagtgtcccttgcaaaaggaagaaaatagaactaggctgggaagtaataaaagatcaccttcagaagtcacagaatgattttgatcttgtgccttggctacagattgcaacccaattaatatcaaagtatcctgcaagtttacctaactgtgagctgtctccattactgatgatactatctcagcttctaccccaacagcgacatggggaacgtacaccatatgtgttacgatgccttacggaagttgcattgtgtcaagacaagaggtcaaacctagaaagctcacaaaagtcagatttattaaaactctggaataaaatttggtgtattacctttcgtggtataagttctgagcaaatacaagctgaaaactttggcttacttggagccataattcagggtagtttagttgaggttgacagagaattctggaagttatttactgggtcagcctgcagaccttcatgtcctgcagtatgctgtttgactttggcactgaccaccagtatagttccaggancggtaaaaatgggaatagagcaaaatatgtgtgaagtaaatagaagcttttctttaaaggaatcaataatgaaatggctcttattctatcagttagagggtgacttagaaaatagcacagaagtgcctccaattcttcacagtaattttcctcatcttgtactggagaaaattcttgtgagtctcactatgaaaaactgtaaagctgcaatgaattttttccaaagcgtgccagaatgtgaacaccaccaaaaagataaagaagaactttcattctcagaagtagaagaactatttcttcagacaacttttgacaagatggactttttaaccattgtgagagaatgtggtatagaaaagcaccagtccagtattggcttctctgtccaccagaatctcaaggaatcactggatcgctgtcttctgggattatcagaacagcttctgaataattactcatctgagattacaaattcagaaactcttgtccggtgttcacgtcttttggtgggtgtccttggctgctactgttacatgggtgtaatagctgaagaggaagcatataagtcagaattattccagaaagccaantctctaatgcaatgtgcaggagaaagtatcactctgtttaaaaataagacaaatgaggaattcagaattggttccttgagaaatatgatgcagctatgtacacgttgcttgagcaactgtaccaagaagagtccaaataagattgcatctggctttttcctgcgattgttaacatcaaagctaatgaatgacattgcagatatttgtaaaagtttagcatccttcatcaaaaagccatttgaccgtggagaagtagaatcaatggaagatgatactaatggaaatctaatggaggtggaggatcagtcatccatgaatctatttaacgattaccctgatagtagtgttagtgatgcaaacgaacctggagagagccaaagtaccataggtgccattaatcctttagctgaagaatatctgtcaaagcaagatctacttttcttagacatgctcaagttcttgtgtttgtgtgtaactactgctcagaccaatactgtgtcctttagggcagctgatattcggaggaaattgttaatgttaattgattctagcacgctagaacctaccaaatccctccacctgcatatgtatctaatgcttttaaaggagcttcctggagaagagtaccccttgccaatggaagatgttcttgaacttctgaaaccactatccaatgtgtgttctttgtatcgtcgtgaccaagatgtttgtaaaactattttaaaccatgtccttcatgtagtgaaaaacctaggtcaaagcaatatggactctgagaacacaagggatgctcaaggacagtttcttacagtaattggagcattttggcatctaacaaaggagaggaaatatatattctctgtaagaatggccctagtaaattgccttaaaactttgcttgaggctgatccttattcaaaatgggccattcttaatgtaatgggaaaagactttcctgtaaatgaagtatttacacaatttcttgctgacaatcatcaccaagttcgcatgttggctgcagagtcaatcaatagattgttccaggacacgaagggagattcttccaggttactgaaagcacttcctttgaagcttcagcaaacagcttttgaaaatgcatacttgaaagctcaggaaggaatgagagaaatgtcccatagtgctgagaaccctgaaactttggatgaaatttataatagaaaatctgttttactgacgttgatagctgtggttttatcctgtagccctatctgcgaaaaacaggctttgtttgccctgtgtaaatctgtgaaagagaatggattagaacctcaccttgtgaaaaaggttttagagaaagtttctgaaacttttggatatagacgtttagaagactttatggcatctcatttagattatctggttttggaatggctaaatcttcaagatactgaatacaacttatcttcttttccttttattttattaaactacacaaatattgaggatttctatagatcttgttataaggttttgattccacatctggtgattagaagtcattttgatgaggtgaagtccattgctaatcagattcaagaggactggaaaagtcttctaacagactgctttccaaagattcttgtaaatattcttccttattttgcctatgagggtaccagagacagtgggatggcacagcaaagagagactgctaccaaggtctatgatatgcttaaaagtgaaaacttattgggaaaacagattgatcacttattcattagtaatttaccagagattgtggtggagttattgatgacgttacatgagccagcaaattctagtgccagtcagagcactgacctctgtgacttttcaggggatttggatcctgctcctaatccacctcattttccatcgcatgtgattaaagcaacatttgcctatatcagcaattgtcataaaaccaagttaaaaagcattttagaaattctttccaaaagccctgattcctatcagaaaattcttcttgccatatgtgagcaagcagctgaaacaaataatgtttataagaagcacagaattcttaaaatatatcacctgtttgttagtttattactgaaagatataaaaagtggcttaggaggagcttgggcctttgttcttcgagacgttatttatactttgattcactatatcaaccaaaggccttcttgtatcatggatgtgtcattacgtagcttctccctttgttgtgacttattaagtcaggtttgccagacagccgtgacttactgtaaggatgctctagaaaaccatcttcatgttattgttggtacacttataccccttgtgtatgagcaggtggaggttcagaaacaggtattggacttgttgaaatacttagtgatagataacaaggataatgaaaacctctatatcacgattaagcttttagatccttttcctgaccatgttgtttttaaggatttgcgtattactcagcaaaaaatcaaatacagtagaggacccttttcactcttggaggaaattaaccattttctctcagtaagtgtttatgatgcacttccattgacaagacttgaaggactaaaggatcttcgaagacaactggaactacataaagatcagatggtggacattatgagagcttctcaggataatccgcaagatgggattatggtgaaactagttgtcaatttgttgcagttatccaagatggcaataaaccacactggtgaaaaagaagttctagaggctgttggaagctgcttgggagaagtgggtcctatagatttctctaccatagctatacaacatagtaaagatgcatcttataccaaggcccttaagttatttgaagataaagaacttcagtggaccttcataatgctgacctacctgaataacacactggtagaagattgtgtcaaagttcgatcagcagctgttacctgtttgaaaaacattttagccacaaagactggacatagtttctgggagatttataagatgacaacagatccaatgctggcctatctacagccttttagaacatcaagaaaaaagtttttagaagtacccagatttgacaaagaaaacccttttgaaggcctggatgatataaatctgtggattcctctaagtgaaaatcatgacatttggataaagacactgacttgtgcttttttggacagtggaggcacaaaatgtgaaattcttcaattattaaagccaatgtgtgaagtgaaaactgacttttgtcagactgtacttccatacttgattcatgatattttactccaagatacaaatgaatcatggagaaatctgctttctacacatgttcagggatttttcaccagctgtcttcgacacttctcgcaaacgagccgatccacaacccctgcaaacttggattcagagtcagagcactttttccgatgctgtttggataaaaaatcacaaagaacaatgcttgctgttgtggactacatgagaagacaaaagagaccttcttcaggaacaatttttaatgatgctttctggctggatttaaattatctagaagttgccaaggtagctcagtcttgtgctgctcactttacagctttactctatgcagaaatctatgcagataagaaaagtatggatgatcaagagaaaagaagtcttgcatttgaagaaggaagccagagtacaactatttctagcttgagtgaaaaaagtaaagaagaaactggaataagtttacaggatcttctcttagaaatctacagaagtataggggagccagatagtttgtatggctgtggtggagggaagatgttacaacccattactagactacgaacatatgaacacgaagcaatgtggggcaaagccctagtaacatatgacctcgaaacagcaatcccctcatcaacacgccaggcaggaatcattcaggccttgcagaatttgggactctgccatattctttccgtctatttaaaaggattggattatgaaaataaagactggtgtcctgaactagaagaacttcattaccaagcagcatggaggaatatgcagtgggaccattgcacttccgtcagcaaagaagtagaaggaaccagttaccatgaatcattgtacaatgctctacaatctctaagagacagagaattctctacattttatgaaagtctcaaatatgccagagtaaaagaagtggaagagatgtgtaagcgcagccttgagtctgtgtattcgctctatcccacacttagcaggttgcaggccattggagagctggaaagcattggggagcttttctcaagatcagtcacacatagacaactctctgaagtatatattaagtggcagaaacactcccagcttctcaaggacagtgattttagttttcaggagcctatcatggctctacgcacagtcattttggagatcctgatggaaaaggaaatggacaactcacaaagagaatgtattaaggacattctcaccaaacaccttgtagaactctctatactggccagaactttcaagaacactcagctccctgaaagggcaatatttcaaattaaacagtacaattcagttagctgtggagtctctgagtggcagctggaagaagcacaagtattctgggcaaaaaaggagcagagtcttgccctgagtattctcaagcaaatgatcaagaagttggatgccagctgtgcagcgaacaatcccagcctaaaacttacatacacagaatgtctgagggtttgtggcaactggttagcagaaacgtgcttagaaaatcctgcggtcatcatgcagacctatctagaaaaggcagtagaagttgctggaaattatgatggagaaagtagtgatgagctaagaaatggaaaaatgaaggcatttctctcattagcccggttttcagatactcaataccaaagaattgaaaactacatgaaatcatcggaatttgaaaacaagcaagctctcctgaaaagagccaaagaggaagtaggtctccttagggaacataaaattcagacaaacagatacacagtaaaggttcagcgagagctggagttggatgaattagccctgcgtgcactgaaagaggatcgtaaacgcttcttatgtaaagcagttgaaaattatatcaactgcttattaagtggagaagaacatgatatgtgggtattccgactttgttccctctggcttgaaaattctggagtttctgaagtcaatggcatgatgaagagagacggaatgaagattccaacatataaatttttgcctcttatgtaccaattggctgctagaatggggaccaagatgatgggaggcctaggatttcatgaagtcctcaataatctaatctctagaatttcaatggatcacccccatcacactttgtttattatactggccttagcaaatgcaaacagagatgaatttctgactaaaccagaggtagccagaagaagcagaataactaaaaatgtgcctaaacaaagctctcagcttgatgaggatcgaacagaggctgcaaatagaataatatgtactatcagaagtaggagacctcagatggtcagaagtgttgaggcactttgtgatgcttatattatattagcaaacttagatgccactcagtggaagactcagagaaaaggcataaatattccagcagaccagccaattactaaacttaagaatttagaagatgttgttgtccctactatggaaattaaggtggaccacacaggagaatatggaaatctggtgactatacagtcatttaaagcagaatttcgcttagcaggaggtgtaaatttaccaaaaataatagattgtgtaggttccgatggcaaggagaggagacagcttgttaagggccgtgatgacctgagacaagatgctgtcatgcaacaggtcttccagatgtgtaatacattactgcagagaaacacggaaactaggaagaggaaattaactatctgtacttataaggtggttcccctctctcagcgaagtggtgttcttgaatggtgcacaggaactgtccccattggtgaatttcttgttaacaatgaagatggtgctcataaaagatacaggccaaatgatttcagtgcctttcagtgccaaaagaaaatgatggaggtgcaaaaaaagtcttttgaagagaaatatgaagtcttcatggatgtttgccaaaattttcaaccagttttccgttacttctgcatggaaaaattcttggatccagctatttggtttgagaagcgattggcttatacgcgcagtgtagctacttcttctattgttggttacatacttggacttggtgatagacatgtacagaatatcttgataaatgagcagtcagcagaacttgtacatatagatctaggtgttgcttttgaacagggcaaaatccttcctactcctgagacagttccttttagactcaccagagatattgtggatggcatgggcattacgggtgttgaaggtgtcttcagaagatgctgtgagaaaaccatggaagtgatgagaaactctcaggaaactctgttaaccattgtagaggtccttctatatgatccactctttgactggaccatgaatcctttgaaagctttgtatttacagcagaggccggaagatgaaactgagcttcaccctactctgaatgcagatgaccaagaatgcaaacgaaatctcagtgatattgaccagagtttcaacaaagtagctgaacgtgtcttaatgagactacaagagaaactgaaaggagtggaagaaggcactgtgctcagtgttggtggacaagtgaatttgctcatacagcaggccatagaccccaaaaatctcagccgacttttcccaggatggaaagcttgggtgtgatcttcagtatatgaattaccctttcattcagcctttagaaattatattttagcctttatttttaacctgccaacatactttaagtagggattaatatttaagtgaactattgtgggtttttttgaatgttggttttaatacttgatttaatcaccactcaaaaatgttttgatggtcttaaggaacatctctgctttcactctttagaaataatggtcattcgggctgggcgcagcggctcacgcctgtaatcccagcactttgggaggccgaggtgagcggatcacaaggtcaggagttcgagaccagcctggccaagagaccagcctggccagtatggtgaaaccctgtctctactaaaaatacaaaaattagccgagcatggtggcgggcacctgtaatcccagctactcgagaggctgaggcaggagaatctcttgaacctgggaggtgaaggttgctgtgggccaaaatcatgccattgcactccagcctgggtgacaagagcgaaactccatctcaaaaaaaaaaaaaaaaaacagaaacttatttggatttttcctagtaagatcactcagtgttactaaataatgaagttgttatggagaacaaatttcaaagacacagttagtgtagttactatttttttaagtgtgtattaaaacttctcattctattctctttatcttttaagcccttctgtactgtccatgtatgttatctttctgtgataacttcatagattgccttctagttcatgaattctcttgtcagatgtatataatctcttttaccctatccattgggcttcttctttcagaaattgtttttcatttctaattatgcatcatttttcagatctctgtttcttgatgtcatttttaatgtttttttaatgttttttatgtcactaattattttaaatgtctgtacttgatagacactgtaatagttctattaaatttagttcctgctgtttatatctgttgatttttgtatttgataggctgttcatccagttttgtctttttgaaaagtgagtttattttcagcaaggctttatctatgggaatcttgagtgtctgtttatgtcatattcccagggctgttgctgcacacaagcccattcttattttaatttcttggctttagggtttccatacctgaagtgtagcataaatactgataggagatttcccaggccaaggcaaacacacttcctcctcatctccttgtgctagtgggcagaatatttgattgatgcctttttcactgagagtataagcttccatgtgtcccacctttatggcaggggtggaaggaggtacatttaattcccactgcctgcctttggcaagccctgggttctttgactccagcctgggcgacagagcaagactccatctcaaaaaaaaaaaaaaaaaaacagaacccgttttggatttttcctaataagatcactcaggggtactaaataatgaaagttgttatgggaacaaatttcaaagacacagctagggtaggttctattttttttaagtgggggattaaaaacttctaattctattctctttattcttt

SEQ ID NO: 279249 - DNA, 13407 bp, Homo sapiens
  misc_feature (340)..(340): n is a, c, g, or t
  misc_feature (2393)..(2393): n is a, c, g, or t
  misc_feature (2983)..(2983): n is a, c, g, or t
  misc_feature (11419)..(11419): n is a, c, g, or t
ccgcgtccgcgcttacccaatacaagccgggctacgtccgagggtaacaacatgatcaaaaccacagcaggaaccacaataaggaacaagactcaggttaaagcaaacacagcgacagctcctgcgccgcatctcctggttccagtggcggcactgaactcgcggcaatttgtcccgcctctttcgcttcacggcagccaatcgcttccgccagagaaagaaaggcgccgaaatgaaacccgcctccgttcgccttcggaactgtcgtcacttccgtcctcagacttggaggggcggggatgaggagggcggggaggacgacgagggcgaagagggtggntgagagccccggagcccgagccgaagggcgagccgcaaacgctaagtcgctggccattggtggacatggcgcaggcgcgtttgctccgacgggccgaatgttttggggcagtgttttgagcgcggagaccgcgtgatactggatgcgcatgggcataccgtgctctgcggctgcttggcgttgcttcttcctccagaagtgggcgctgggcagtcacgcagggtttgaaccggaagcgggagtaggtagctgcgtggctaacggagaaaagaagccgtggccacgggaggaggcgagaggagtcgggatctgcgctgcagccaccgccgcggttgatactactttgaccttccgagtgcagtgacagtgatgtgtgttctgaaattgtgaaccatgagtctagtacttaatgatctgcttatctgctgccgtcaactagaacatgatagagctacagaacgaaagaaagaagttgagaaatttaagcgcctgattcgagatcctgaaacaattaaacatctagatcggcattcagattccaaacaaggaaaatatttgaattgggatgctgtttttagatttttacagaaatatattcagaaagaaacagaatgtctgagaatagcaaaaccaaatgtatcagcctcaacacaagcctccaggcagaaaaagatgcaggaaatcagtagtttggtcaaatacttcatcaaatgtgcaaacagaagagcacctaggctaaaatgtcaagaactcttaaattatatcatggatacagtgaaagattcatctaatggtgctatttacggagctgattgtagcaacatactactcaaagacattctttctgtgagaaaatactggtgtgaaatatctcagcaacagtggttagaattgttctctgtgtacttcaggctctatctgaaaccttcacaagatgttcatagagttttagtggctagaataattcatgctgttaccaaaggatgctgttctcagactgacggattaaattccaaatttttggactttttttccaaggctattcagtgtgcgagacaagaaaagagctcttcaggtctaaatcatatcttagcagctcttactatcttcctcaagactttggctgtcaactttcgaattcgagtgtgtgaattaggagatgaaattcttcccactttgctttatatttggactcaacataggcttaatgattctttaaaagaagtcattattgaattatttcaactgcaaatttatatccatcatccgaaaggagccaaaacccaagaaaaaggtgcttatgaatcaacaaaatggagaagtattttatacaacttatatgatctgctagtgaatgagataagtcatataggaagtagaggaaagtattcttcaggatttcgtaatattgccgtcaaagaaaatttgattgaattgatggcagatatctgtcaccaggtttttaatgaagataccagatccttggagatttctcaatcttacactactacacaaagagaatctagtgattacagtgtcccttgcaaaaggaagaaaatagaactaggctgggaagtaataaaagatcaccttcagaagtcacagaatgattttgatcttgtgccttggctacagattgcaacccaattaatatcaaagtatcctgcaagtttacctaactgtgagctgtctccattactgatgatactatctcagcttctaccccaacagcgacatggggaacgtacaccatatgtgttacgatgccttacggaagttgcattgtgtcaagacaagaggtcaaacctagaaagctcacaaaagtcagatttattaaaactctggaataaaatttggtgtattacctttcgtggtataagttctgagcaaatacaagctgaaaactttggcttacttggagccataattcagggtagtttagttgaggttgacagagaattctggaagttatttactgggtcagcctgcagaccttcatgtcctgcagtatgctgtttgactttggcactgaccaccagtatagttccaggancggtaaaaatgggaatagagcaaaatatgtgtgaagtaaatagaagcttttctttaaaggaatcaataatgaaatggctcttattctatcagttagagggtgacttagaaaatagcacagaagtgcctccaattcttcacagtaattttcctcatcttgtactggagaaaattcttgtgagtctcactatgaaaaactgtaaagctgcaatgaattttttccaaagcgtgccagaatgtgaacaccaccaaaaagataaagaagaactttcattctcagaagtagaagaactatttcttcagacaacttttgacaagatggactttttaaccattgtgagagaatgtggtatagaaaagcaccagtccagtattggcttctctgtccaccagaatctcaaggaatcactggatcgctgtcttctgggattatcagaacagcttctgaataattactcatctgagattacaaattcagaaactcttgtccggtgttcacgtcttttggtgggtgtccttggctgctactgttacatgggtgtaatagctgaagaggaagcatataagtcagaattattccagaaagccaantctctaatgcaatgtgcaggagaaagtatcactctgtttaaaaataagacaaatgaggaattcagaattggttccttgagaaatatgatgcagctatgtacacgttgcttgagcaactgtaccaagaagagtccaaataagattgcatctggctttttcctgcgattgttaacatcaaagctaatgaatgacattgcagatatttgtaaaagtttagcatccttcatcaaaaagccatttgaccgtggagaagtagaatcaatggaagatgatactaatggaaatctaatggaggtggaggatcagtcatccatgaatctatttaacgattaccctgatagtagtgttagtgatgcaaacgaacctggagagagccaaagtaccataggtgccattaatcctttagctgaagaatatctgtcaaagcaagatctacttttcttagacatgctcaagttcttgtgtttgtgtgtaactactgctcagaccaatactgtgtcctttagggcagctgatattcggaggaaattgttaatgttaattgattctagcacgctagaacctaccaaatccctccacctgcatatgtatctaatgcttttaaaggagcttcctggagaagagtaccccttgccaatggaagatgttcttgaacttctgaaaccactatccaatgtgtgttctttgtatcgtcgtgaccaagatgtttgtaaaactattttaaaccatgtccttcatgtagtgaaaaacctaggtcaaagcaatatggactctgagaacacaagggatgctcaaggacagtttcttacagtaattggagcattttggcatctaacaaaggagaggaaatatatattctctgtaagaatggccctagtaaattgccttaaaactttgcttgaggctgatccttattcaaaatgggccattcttaatgtaatgggaaaagactttcctgtaaatgaagtatttacacaatttcttgctgacaatcatcaccaagttcgcatgttggctgcagagtcaatcaatagattgttccaggacacgaagggagattcttccaggttactgaaagcacttcctttgaagcttcagcaaacagcttttgaaaatgcatacttgaaagctcaggaaggaatgagagaaatgtcccatagtgctgagaaccctgaaactttggatgaaatttataatagaaaatctgttttactgacgttgatagctgtggttttatcctgtagccctatctgcgaaaaacaggctttgtttgccctgtgtaaatctgtgaaagagaatggattagaacctcaccttgtgaaaaaggttttagagaaagtttctgaaacttttggatatagacgtttagaagactttatggcatctcatttagattatctggttttggaatggctaaatcttcaagatactgaatacaacttatcttcttttccttttattttattaaactacacaaatattgaggatttctatagatcttgttataaggttttgattccacatctggtgattagaagtcattttgatgaggtgaagtccattgctaatcagattcaagaggactggaaaagtcttctaacagactgctttccaaagattcttgtaaatattcttccttattttgcctatgagggtaccagagacagtgggatggcacagcaaagagagactgctaccaaggtctatgatatgcttaaaagtgaaaacttattgggaaaacagattgatcacttattcattagtaatttaccagagattgtggtggagttattgatgacgttacatgagccagcaaattctagtgccagtcagagcactgacctctgtgacttttcaggggatttggatcctgctcctaatccacctcattttccatcgcatgtgattaaagcaacatttgcctatatcagcaattgtcataaaaccaagttaaaaagcattttagaaattctttccaaaagccctgattcctatcagaaaattcttcttgccatatgtgagcaagcagctgaaacaaataatgtttataagaagcacagaattcttaaaatatatcacctgtttgttagtttattactgaaagatataaaaagtggcttaggaggagcttgggcctttgttcttcgagacgttatttatactttgattcactatatcaaccaaaggccttcttgtatcatggatgtgtcattacgtagcttctccctttgttgtgacttattaagtcaggtttgccagacagccgtgacttactgtaaggatgctctagaaaaccatcttcatgttattgttggtacacttataccccttgtgtatgagcaggtggaggttcagaaacaggtattggacttgttgaaatacttagtgatagataacaaggataatgaaaacctctatatcacgattaagcttttagatccttttcctgaccatgttgtttttaaggatttgcgtattactcagcaaaaaatcaaatacagtagaggacccttttcactcttggaggaaattaaccattttctctcagtaagtgtttatgatgcacttccattgacaagacttgaaggactaaaggatcttcgaagacaactggaactacataaagatcagatggtggacattatgagagcttctcaggataatccgcaagatgggattatggtgaaactagttgtcaatttgttgcagttatccaagatggcaataaaccacactggtgaaaaagaagttctagaggctgttggaagctgcttgggagaagtgggtcctatagatttctctaccatagctatacaacatagtaaagatgcatcttataccaaggcccttaagttatttgaagataaagaacttcagtggaccttcataatgctgacctacctgaataacacactggtagaagattgtgtcaaagttcgatcagcagctgttacctgtttgaaaaacattttagccacaaagactggacatagtttctgggagatttataagatgacaacagatccaatgctggcctatctacagccttttagaacatcaagaaaaaagtttttagaagtacccagatttgacaaagaaaacccttttgaaggcctggatgatataaatctgtggattcctctaagtgaaaatcatgacatttggataaagacactgacttgtgcttttttggacagtggaggcacaaaatgtgaaattcttcaattattaaagccaatgtgtgaagtgaaaactgacttttgtcagactgtacttccatacttgattcatgatattttactccaagatacaaatgaatcatggagaaatctgctttctacacatgttcagggatttttcaccagctgtcttcgacacttctcgcaaacgagccgatccacaacccctgcaaacttggattcagaccttcttcaggaacaatttttaatgatgctttctggctggatttaaattatctagaagttgccaaggtagctcagtcttgtgctgctcactttacagctttactctatgcagaaatctatgcagataagaaaagtatggatgatcaagagaaaagaagtcttgcatttgaagaaggaagccagagtacaactatttctagcttgagtgaaaaaagtaaagaagaaactggaataagtttacaggatcttctcttagaaatctacagaagtataggggagccagatagtttgtatggctgtggtggagggaagatgttacaacccattactagactacgaacatatgaacacgaagcaatgtggggcaaagccctagtaacatatgacctcgaaacagcaatcccctcatcaacacgccaggcaggaatcattcaggccttgcagaatttgggactctgccatattctttccgtctatttaaaaggattggattatgaaaataaagactggtgtcctgaactagaagaacttcattaccaagcagcatggaggaatatgcagtgggaccattgcacttccgtcagcaaagaagtagaaggaaccagttaccatgaatcattgtacaatgctctacaatctctaagagacagagaattctctacattttatgaaagtctcaaatatgccagagtaaaagaagtggaagagatgtgtaagcgcagccttgagtctgtgtattcgctctatcccacacttagcaggttgcaggccattggagagctggaaagcattggggagcttttctcaagatcagtcacacatagacaactctctgaagtatatattaagtggcagaaacactcccagcttctcaaggacagtgattttagttttcaggagcctatcatggctctacgcacagtcattttggagatcctgatggaaaaggaaatggacaactcacaaagagaatgtattaaggacattctcaccaaacaccttgtagaactctctatactggccagaactttcaagaacactcagctccctgaaagggcaatatttcaaattaaacagtacaattcagttagctgtggagtctctgagtggcagctggaagaagcacaagtattctgggcaaaaaaggagcagagtcttgccctgagtattctcaagcaaatgatcaagaagttggatgccagctgtgcagcgaacaatcccagcctaaaacttacatacacagaatgtctgagggtttgtggcaactggttagcagaaacgtgcttagaaaatcctgcggtcatcatgcagacctatctagaaaaggcagtagaagttgctggaaattatgatggagaaagtagtgatgagctaagaaatggaaaaatgaaggcatttctctcattagcccggttttcagatactcaataccaaagaattgaaaactacatgaaatcatcggaatttgaaaacaagcaagctctcctgaaaagagccaaagaggaagtaggtctccttagggaacataaaattcagacaaacagatacacagtaaaggttcagcgagagctggagttggatgaattagccctgcgtgcactgaaagaggatcgtaaacgcttcttatgtaaagcagttgaaaattatatcaactgcttattaagtggagaagaacatgatatgtgggtattccgactttgttccctctggcttgaaaattctggagtttctgaagtcaatggcatgatgaagagagacggaatgaagattccaacatataaatttttgcctcttatgtaccaattggctgctagaatggggaccaagatgatgggaggcctaggatttcatgaagtcctcaataatctaatctctagaatttcaatggatcacccccatcacactttgtttattatactggccttagcaaatgcaaacagagatgaatttctgactaaaccagaggtagccagaagaagcagaataactaaaaatgtgcctaaacaaagctctcagcttgatgaggatcgaacagaggctgcaaatagaataatatgtactatcagaagtaggagacctcagatggtcagaagtgttgaggcactttgtgatgcttatattatattagcaaacttagatgccactcagtggaagactcagagaaaaggcataaatattccagcagaccagccaattactaaacttaagaatttagaagatgttgttgtccctactatggaaattaaggtggaccacacaggagaatatggaaatctggtgactatacagtcatttaaagcagaatttcgcttagcaggaggtgtaaatttaccaaaaataatagattgtgtaggttccgatggcaaggagaggagacagcttgttaagggccgtgatgacctgagacaagatgctgtcatgcaacaggtcttccagatgtgtaatacattactgcagagaaacacggaaactaggaagaggaaattaactatctgtacttataaggtggttcccctctctcagcgaagtggtgttcttgaatggtgcacaggaactgtccccattggtgaatttcttgttaacaatgaagatggtgctcataaaagatacaggccaaatgatttcagtgcctttcagtgccaaaagaaaatgatggaggtgcaaaaaaagtcttttgaagagaaatatgaagtcttcatggatgtttgccaaaattttcaaccagttttccgttacttctgcatggaaaaattcttggatccagctatttggtttgagaagcgattggcttatacgcgcagtgtagctacttcttctattgttggttacatacttggacttggtgatagacatgtacagaatatcttgataaatgagcagtcagcagaacttgtacatatagatctaggtgttgcttttgaacagggcaaaatccttcctactcctgagacagttccttttagactcaccagagatattgtggatggcatgggcattacgggtgttgaaggtgtcttcagaagatgctgtgagaaaaccatggaagtgatgagaaactctcaggaaactctgttaaccattgtagaggtccttctatatgatccactctttgactggaccatgaatcctttgaaagctttgtatttacagcagaggccggaagatgaaactgagcttcaccctactctgaatgcagatgaccaagaatgcaaacgaaatctcagtgatattgaccagagtttcaacaaagtagctgaacgtgtcttaatgagactacaagagaaactgaaaggagtggaagaaggcactgtgctcagtgttggtggacaagtgaatttgctcatacagcaggccatagaccccaaaaatctcagccgacttttcccaggatggaaagcttgggtgtgatcttcagtatatgaattaccctttcattcagcctttagaaattatattttagcctttatttttaacctgccaacatactttaagtagggattaatatttaagtgaactattgtgggtttttttgaatgttggttttaatacttgatttaatcaccactcaaaaatgttttgatggtcttaaggaacatctctgctttcactctttagaaataatggtcattcgggctgggcgcagcggctcacgcctgtaatcccagcactttgggaggccgaggtgagcggatcacaaggtcaggagttcgagaccagcctggccaagagaccagcctggccagtatggtgaaaccctgtctctactaaaaatacaaaaattagccgagcatggtggcgggcacctgtaatcccagctactcgagaggctgaggcaggagaatctcttgaacctgggaggtgaaggttgctgtgggccaaaatcatgccattgcactccagcctgggtgacaagagcgaaactccatctcaaaaaaaaaaaaaaaaaacagaaacttatttggatttttcctagtaagatcactcagtgttactaaataatgaagttgttatggagaacaaatttcaaagacacagttagtgtagttactatttttttaagtgtgtattaaaacttctcattctattctctttatcttttaagcccttctgtactgtccatgtatgttatctttctgtgataacttcatagattgccttctagttcatgaattctcttgtcagatgtatataatctcttttaccctatccattgggcttcttctttcagaaattgtttttcatttctaattatgcatcatttttcagatctctgtttcttgatgtcatttttaatgtttttttaatgttttttatgtcactaattattttaaatgtctgtacttgatagacactgtaatagttctattaaatttagttcctgctgtttatatctgttgatttttgtatttgataggctgttcatccagttttgtctttttgaaaagtgagtttattttcagcaaggctttatctatgggaatcttgagtgtctgtttatgtcatattcccagggctgttgctgcacacaagcccattcttattttaatttcttggctttagggtttccatacctgaagtgtagcataaatactgataggagatttcccaggccaaggcaaacacacttcctcctcatctccttgtgctagtgggcagaatatttgattgatgcctttttcactgagagtataagcttccatgtgtcccacctttatggcaggggtggaaggaggtacatttaattcccactgcctgcctttggcaagccctgggttctttgctccccatatagatgtctaagctaaaagccgtgggttaatgagactggcaaattgttccaggacagctacagcatcagctcacatattcacctctctggtttttcattcccctcatttttttctgagacagagtcttgctctgtcacccaggctggagtgcagtggcatgatctcagctcactgaaacctctgcctcctgggttcaagcaattctcctgcctcagcctccngagtagctgggactacaggcgtgtgccaacacgcccggctaattttttgtatttttattagagacggagtttcaccgtgttagccaggatggtctcgatcgcttgacctcgtgatccaccctcctcggcctcccaaagtgctgggattacaggtgtgagccaccgcgcccggcctcattcccctcatttttgaccgtaaggatttcccctttcttgtaagttctgctatgtatttaaaagaatgttttctacattttatccagcatttctctgtgttctgttggaagggaagggcttaggtatctagtttgatacataggtagaagtggaacatttctctgtcccccagctgtcatcatataagataaacatcagataaaaagccacctgaaagtaaaactactgactcgtgtattagtgagtataatctcttctccatccttaggaaaatgttcatcccagctgcggagattaacaaatgggtgattgagctttctcctcgtatttggaccttgaaggttatataaatttttttcttatgaagagttggcatttctttttattgccaatggcaggcactcattcatatttgatctcctcaccttcccctcccctaaaaccaatctccagaactttttggactataaatttcttggtttgacttctggagaactgttcagaatattactttgcatttcaaattacaaacttaccttggtgtatctttttcttacaagctgcctaaatgaatatttggtatatattggtagttttattactatagtaaatcaaggaaatgcagtaaacttaaaatgtctttaagaaagccctgaaatcttcatgggtgaaattagaaattatcaactagataatagtatagataaatgaatttgtagctaattcttgctagttgttgcatccagagagctttgaataacatcattaatctactctttagccttgcatggtatgctatgaggctcctgttctgttcaagtattctaatcaatggctttgaaaagtttatcaaatttacatacagatcacaagcctaggagaaataactaattcacagatgacagaattaagattataaaagattttttttttgtaattttagtagagacagggttgccattgtattccagccttggcgacagagcaagactctgcctcaaaaaaaaaaaaaaaaaggttttggcaagctggaactctttctgcaaatgactaagatagaaaactgccaaggacaaatgaggagtagttagattttgaaaatattaatcatagaatagttgttgtatgctaagtcactgacccatattatgtacagcatttctgatctttactttgcaagattagtgatactatcccaatacactgctggagaaatcagaatttggagaaataagttgtccaaggcaagaagatagtaaattataagtacaagtgtaatatggacagtatctaacttgaaaagatttcaggcgaaaagaatctggggtttgccagtcagttgctcaaaaggtcaatgaaaaccaaatagtgaagctatcagagaagctaataaattatagactgcttgaacagttgtgtccagattaagggagataatagctttcccaccctactttgtgcaggtcatacctccccaaagtgtttacctaatcagtaggttcacaaactcttggtcattatagtatatgcctaaaatgtatgcacttaggaatgctaaaaatttaaatatggtctaaagcaaataaaagcaaagaggaaaaactttggacatcgtaaagactagaatagtcttttaaaaagaaagccagtatattggtttgaaatatagagatgtgtcccaatttcaagtattttaattgcaccttaatgaaattatctattttctatagattttagtactattgaatgtattactttactgttacctgaatttattataaagtgtttttgaataaataattctaaaagca

SEQ ID NO: 279250 - DNA, 9613 bp, Homo sapiens
  misc_feature (340)..(340): n is a, c, g, or t
  misc_feature (2393)..(2393): n is a, c, g, or t
  misc_feature (2983)..(2983): n is a, c, g, or t
  misc_feature (7314)..(7314): n is a, c, g, or t
ccgcgtccgcgcttacccaatacaagccgggctacgtccgagggtaacaacatgatcaaaaccacagcaggaaccacaataaggaacaagactcaggttaaagcaaacacagcgacagctcctgcgccgcatctcctggttccagtggcggcactgaactcgcggcaatttgtcccgcctctttcgcttcacggcagccaatcgcttccgccagagaaagaaaggcgccgaaatgaaacccgcctccgttcgccttcggaactgtcgtcacttccgtcctcagacttggaggggcggggatgaggagggcggggaggacgacgagggcgaagagggtggntgagagccccggagcccgagccgaagggcgagccgcaaacgctaagtcgctggccattggtggacatggcgcaggcgcgtttgctccgacgggccgaatgttttggggcagtgttttgagcgcggagaccgcgtgatactggatgcgcatgggcataccgtgctctgcggctgcttggcgttgcttcttcctccagaagtgggcgctgggcagtcacgcagggtttgaaccggaagcgggagtaggtagctgcgtggctaacggagaaaagaagccgtggccacgggaggaggcgagaggagtcgggatctgcgctgcagccaccgccgcggttgatactactttgaccttccgagtgcagtgacagtgatgtgtgttctgaaattgtgaaccatgagtctagtacttaatgatctgcttatctgctgccgtcaactagaacatgatagagctacagaacgaaagaaagaagttgagaaatttaagcgcctgattcgagatcctgaaacaattaaacatctagatcggcattcagattccaaacaaggaaaatatttgaattgggatgctgtttttagatttttacagaaatatattcagaaagaaacagaatgtctgagaatagcaaaaccaaatgtatcagcctcaacacaagcctccaggcagaaaaagatgcaggaaatcagtagtttggtcaaatacttcatcaaatgtgcaaacagaagagcacctaggctaaaatgtcaagaactcttaaattatatcatggatacagtgaaagattcatctaatggtgctatttacggagctgattgtagcaacatactactcaaagacattctttctgtgagaaaatactggtgtgaaatatctcagcaacagtggttagaattgttctctgtgtacttcaggctctatctgaaaccttcacaagatgttcatagagttttagtggctagaataattcatgctgttaccaaaggatgctgttctcagactgacggattaaattccaaatttttggactttttttccaaggctattcagtgtgcgagacaagaaaagagctcttcaggtctaaatcatatcttagcagctcttactatcttcctcaagactttggctgtcaactttcgaattcgagtgtgtgaattaggagatgaaattcttcccactttgctttatatttggactcaacataggcttaatgattctttaaaagaagtcattattgaattatttcaactgcaaatttatatccatcatccgaaaggagccaaaacccaagaaaaaggtgcttatgaatcaacaaaatggagaagtattttatacaacttatatgatctgctagtgaatgagataagtcatataggaagtagaggaaagtattcttcaggatttcgtaatattgccgtcaaagaaaatttgattgaattgatggcagatatctgtcaccaggtttttaatgaagataccagatccttggagatttctcaatcttacactactacacaaagagaatctagtgattacagtgtcccttgcaaaaggaagaaaatagaactaggctgggaagtaataaaagatcaccttcagaagtcacagaatgattttgatcttgtgccttggctacagattgcaacccaattaatatcaaagtatcctgcaagtttacctaactgtgagctgtctccattactgatgatactatctcagcttctaccccaacagcgacatggggaacgtacaccatatgtgttacgatgccttacggaagttgcattgtgtcaagacaagaggtcaaacctagaaagctcacaaaagtcagatttattaaaactctggaataaaatttggtgtattacctttcgtggtataagttctgagcaaatacaagctgaaaactttggcttacttggagccataattcagggtagtttagttgaggttgacagagaattctggaagttatttactgggtcagcctgcagaccttcatgtcctgcagtatgctgtttgactttggcactgaccaccagtatagttccaggancggtaaaaatgggaatagagcaaaatatgtgtgaagtaaatagaagcttttctttaaaggaatcaataatgaaatggctcttattctatcagttagagggtgacttagaaaatagcacagaagtgcctccaattcttcacagtaattttcctcatcttgtactggagaaaattcttgtgagtctcactatgaaaaactgtaaagctgcaatgaattttttccaaagcgtgccagaatgtgaacaccaccaaaaagataaagaagaactttcattctcagaagtagaagaactatttcttcagacaacttttgacaagatggactttttaaccattgtgagagaatgtggtatagaaaagcaccagtccagtattggcttctctgtccaccagaatctcaaggaatcactggatcgctgtcttctgggattatcagaacagcttctgaataattactcatctgagattacaaattcagaaactcttgtccggtgttcacgtcttttggtgggtgtccttggctgctactgttacatgggtgtaatagctgaagaggaagcatataagtcagaattattccagaaagccaantctctaatgcaatgtgcaggagaaagtatcactctgtttaaaaataagacaaatgaggaattcagaattggttccttgagaaatatgatgcagctatgtacacgttgcttgagcaactgtaccaagaagagtccaaataagattgcatctggctttttcctgcgattgttaacatcaaagctaatgaatgacattgcagatatttgtaaaagtttagcatccttcatcaaaaagccatttgaccgtggagaagtagaatcaatggaagatgatactaatggaaatctaatggaggtggaggatcagtcatccatgaatctatttaacgattaccctgatagtagtgttagtgatgcaaacgaacctggagagagccaaagtaccataggtgccattaatcctttagctgaagaatatctgtcaaagcaagatctacttttcttagacatgctcaagttcttgtgtttgtgtgtaactactgctcagaccaatactgtgtcctttagggcagctgatattcggaggaaattgttaatgttaattgattctagcacgctagaacctaccaaatccctccacctgcatatgtatctaatgcttttaaaggagcttcctggagaagagtaccccttgccaatggaagatgttcttgaacttctgaaaccactatccaatgtgtgttctttgtatcgtcgtgaccaagatgtttgtaaaactattttaaaccatgtccttcatgtagtgaaaaacctaggtcaaagcaatatggactctgagaacacaagggatgctcaaggacagtttcttacagtaattggagcattttggcatctaacaaaggagaggaaatatatattctctgtaagaatggccctagtaaattgccttaaaactttgcttgaggctgatccttattcaaaatgggccattcttaatgtaatgggaaaagactttcctgtaaatgaagtatttacacaatttcttgctgacaatcatcaccaagttcgcatgttggctgcagagtcaatcaatagattgttccaggacacgaagggagattcttccaggttactgaaagcacttcctttgaagcttcagcaaacagcttttgaaaatgcatacttgaaagctcaggaaggaatgagagaaatgtcccatagtgctgagaaccctgaaactttggatgaaatttataatagaaaatctgttttactgacgttgatagctgtggttttatcctgtagccctatctgcgaaaaacaggctttgtttgccctgtgtaaatctgtgaaagagaatggattagaacctcaccttgtgaaaaaggttttagagaaagtttctgaaacttttggatatagacgtttagaagactttatggcatctcatttagattatctggttttggaatggctaaatcttcaagatactgaatacaacttatcttcttttccttttattttattaaactacacaaatattgaggatttctatagatcttgttataaggttttgattccacatctggtgattagaagtcattttgatgaggtgaagtccattgctaatcagattcaagaggactggaaaagtcttctaacagactgctttccaaagattcttgtaaatattcttccttattttgcctatgagggtaccagagacagtgggatggcacagcaaagagagactgctaccaaggtctatgatatgcttaaaagtgaaaacttattgggaaaacagattgatcacttattcattagtaatttaccagagattgtggtggagttattgatgacgttacatgagccagcaaattctagtgccagtcagagcactgacctctgtgacttttcaggggatttggatcctgctcctaatccacctcattttccatcgcatgtgattaaagcaacatttgcctatatcagcaattgtcataaaaccaagttaaaaagcattttagaaattctttccaaaagccctgattcctatcagaaaattcttcttgccatatgtgagcaagcagctgaaacaaataatgtttataagaagcacagaattcttaaaatatatcacctgtttgttagtttattactgaaagatataaaaagtggcttaggaggagcttgggcctttgttcttcgagacgttatttatactttgattcactatatcaaccaaaggccttcttgtatcatggatgtgtcattacgtagcttctccctttgttgtgacttattaagtcaggtttgccagacagccgtgacttactgtaaggatgctctagaaaaccatcttcatgttattgttggtacacttataccccttgtgtatgagcaggtggaggttcagaaacaggtattggacttgttgaaatacttagtgatagataacaaggataatgaaaacctctatatcacgattaagcttttagatccttttcctgaccatgttgtttttaaggatttgcgtattactcagcaaaaaatcaaatacagtagaggacccttttcactcttggaggaaattaaccattttctctcagtaagtgtttatgatgcacttccattgacaagacttgaaggactaaaggatcttcgaagacaactggaactacataaagatcagatggtggacattatgagagcttctcagggtgctaattttaaatgacatgggctatttctacctgtttctttttgaaagaatattttgcaaagtcttgctcttggtttcattgtcacagacttagttcagactctcatcatttagttcagaccctcatttctcatctaactgtaaaactggtcctaactggtcttctcaccctgaactcttcctgttttattcatcctctgccagatgatttctctaaacccaaatatgatcatgtttttctactgcctaaattttttttttaagagacagagtttttttttttttttaagagtctcactctgtcacctaggctggagtgtagtggcaccatcataacttactatgaccttgaattcctgggtacaaggaattctcctgtctcagccttctgaatagctggaacaacaggcacacaccactacacctagctactttatttattttttttattttttgtagggacaggggtcccactatgttgcctaggttggtctcgaattcttggcctcaagtgatcctcctgccttagcctcacaaagcattgggattagaggtgtgacctgggtgacaagagcgaaactccatctcaaaaaaaaaaaaaaaaaacagaaacttatttggatttttcctagtaagatcactcagtgttactaaataatgaagttgttatggagaacaaatttcaaagacacagttagtgtagttactatttttttaagtgtgtattaaaacttctcattctattctctttatcttttaagcccttctgtactgtccatgtatgttatctttctgtgataacttcatagattgccttctagttcatgaattctcttgtcagatgtatataatctcttttaccctatccattgggcttcttctttcagaaattgtttttcatttctaattatgcatcatttttcagatctctgtttcttgatgtcatttttaatgtttttttaatgttttttatgtcactaattattttaaatgtctgtacttgatagacactgtaatagttctattaaatttagttcctgctgtttatatctgttgatttttgtatttgataggctgttcatccagttttgtctttttgaaaagtgagtttattttcagcaaggctttatctatgggaatcttgagtgtctgtttatgtcatattcccagggctgttgctgcacacaagcccattcttattttaatttcttggctttagggtttccatacctgaagtgtagcataaatactgataggagatttcccaggccaaggcaaacacacttcctcctcatctccttgtgctagtgggcagaatatttgattgatgcctttttcactgagagtataagcttccatgtgtcccacctttatggcaggggtggaaggaggtacatttaattcccactgcctgcctttggcaagccctgggttctttgctccccatatagatgtctaagctaaaagccgtgggttaatgagactggcaaattgttccaggacagctacagcatcagctcacatattcacctctctggtttttcattcccctcatttttttctgagacagagtcttgctctgtcacccaggctggagtgcagtggcatgatctcagctcactgaaacctctgcctcctgggttcaagcaattctcctgcctcagcctccngagtagctgggactacaggcgtgtgccaacacgcccggctaattttttgtatttttattagagacggagtttcaccgtgttagccaggatggtctcgatcgcttgacctcgtgatccaccctcctcggcctcccaaagtgctgggattacaggtgtgagccaccgcgcccggcctcattcccctcatttttgaccgtaaggatttcccctttcttgtaagttctgctatgtatttaaaagaatgttttctacattttatccagcatttctctgtgttctgttggaagggaagggcttaggtatctagtttgatacataggtagaagtggaacatttctctgtcccccagctgtcatcatataagataaacatcagataaaaagccacctgaaagtaaaactactgactcgtgtattagtgagtataatctcttctccatccttaggaaaatgttcatcccagctgcggagattaacaaatgggtgattgagctttctcctcgtatttggaccttgaaggttatataaatttttttcttatgaagagttggcatttctttttattgccaatggcaggcactcattcatatttgatctcctcaccttcccctcccctaaaaccaatctccagaactttttggactataaatttcttggtttgacttctggagaactgttcagaatattactttgcatttcaaattacaaacttaccttggtgtatctttttcttacaagctgcctaaatgaatatttggtatatattggtagttttattactatagtaaatcaaggaaatgcagtaaacttaaaatgtctttaagaaagccctgaaatcttcatgggtgaaattagaaattatcaactagataatagtatagataaatgaatttgtagctaattcttgctagttgttgcatccagagagctttgaataacatcattaatctactctttagccttgcatggtatgctatgaggctcctgttctgttcaagtattctaatcaatggctttgaaaagtttatcaaatttacatacagatcacaagcctaggagaaataactaattcacagatgacagaattaagattataaaagattttttttttgtaattttagtagagacagggttgccattgtattccagccttggcgacagagcaagactctgcctcaaaaaaaaaaaaaaaaaggttttggcaagctggaactctttctgcaaatgactaagatagaaaactgccaaggacaaatgaggagtagttagattttgaaaatattaatcatagaatagttgttgtatgctaagtcactgacccatattatgtacagcatttctgatctttactttgcaagattagtgatactatcccaatacactgctggagaaatcagaatttggagaaataagttgtccaaggcaagaagatagtaaattataagtacaagtgtaatatggacagtatctaacttgaaaagatttcaggcgaaaagaatctggggtttgccagtcagttgctcaaaaggtcaatgaaaaccaaatagtgaagctatcagagaagctaataaattatagactgcttgaacagttgtgtccagattaagggagataatagctttcccaccctactttgtgcaggtcatacctccccaaagtgtttacctaatcagtaggttcacaaactcttggtcattatagtatatgcctaaaatgtatgcacttaggaatgctaaaaatttaaatatggtctaaagcaaataaaagcaaagaggaaaaactttggacatcgtaaagactagaatagtcttttaaaaagaaagccagtatattggtttgaaatatagagatgtgtcccaatttcaagtattttaattgcaccttaatgaaattatctattttctatagattttagtactattgaatgtattactttactgttacctgaatttattataaagtgtttttgaataaataattctaaaagcatatactaagactcattcactttattcaaatatttgtgtgttctgtgtgccaggcatgggactcgttctaaggagaaagcagtgagcaaggcaggcatagtctgcctatataaagctcccaatctgaggaggataggcaactgaccacgcagtgtgaaccggggagcctattgcacaaccagtctgataatgctgcatctcagtctaaatatcctagtagtgtttcttagtcgcctcctgacaaaaaggcaaatatgaatgttctttctttgggcctagaaagtgatctagttgacatttctagcctaaaag

SEQ ID NO: 279251 - DNA, 9784 bp, Homo sapiens
  misc_feature (340)..(340): n is a, c, g, or t
  misc_feature (2393)..(2393): n is a, c, g, or t
  misc_feature (2983)..(2983): n is a, c, g, or t
ccgcgtccgcgcttacccaatacaagccgggctacgtccgagggtaacaacatgatcaaaaccacagcaggaaccacaataaggaacaagactcaggttaaagcaaacacagcgacagctcctgcgccgcatctcctggttccagtggcggcactgaactcgcggcaatttgtcccgcctctttcgcttcacggcagccaatcgcttccgccagagaaagaaaggcgccgaaatgaaacccgcctccgttcgccttcggaactgtcgtcacttccgtcctcagacttggaggggcggggatgaggagggcggggaggacgacgagggcgaagagggtggntgagagccccggagcccgagccgaagggcgagccgcaaacgctaagtcgctggccattggtggacatggcgcaggcgcgtttgctccgacgggccgaatgttttggggcagtgttttgagcgcggagaccgcgtgatactggatgcgcatgggcataccgtgctctgcggctgcttggcgttgcttcttcctccagaagtgggcgctgggcagtcacgcagggtttgaaccggaagcgggagtaggtagctgcgtggctaacggagaaaagaagccgtggccacgggaggaggcgagaggagtcgggatctgcgctgcagccaccgccgcggttgatactactttgaccttccgagtgcagtgacagtgatgtgtgttctgaaattgtgaaccatgagtctagtacttaatgatctgcttatctgctgccgtcaactagaacatgatagagctacagaacgaaagaaagaagttgagaaatttaagcgcctgattcgagatcctgaaacaattaaacatctagatcggcattcagattccaaacaaggaaaatatttgaattgggatgctgtttttagatttttacagaaatatattcagaaagaaacagaatgtctgagaatagcaaaaccaaatgtatcagcctcaacacaagcctccaggcagaaaaagatgcaggaaatcagtagtttggtcaaatacttcatcaaatgtgcaaacagaagagcacctaggctaaaatgtcaagaactcttaaattatatcatggatacagtgaaagattcatctaatggtgctatttacggagctgattgtagcaacatactactcaaagacattctttctgtgagaaaatactggtgtgaaatatctcagcaacagtggttagaattgttctctgtgtacttcaggctctatctgaaaccttcacaagatgttcatagagttttagtggctagaataattcatgctgttaccaaaggatgctgttctcagactgacggattaaattccaaatttttggactttttttccaaggctattcagtgtgcgagacaagaaaagagctcttcaggtctaaatcatatcttagcagctcttactatcttcctcaagactttggctgtcaactttcgaattcgagtgtgtgaattaggagatgaaattcttcccactttgctttatatttggactcaacataggcttaatgattctttaaaagaagtcattattgaattatttcaactgcaaatttatatccatcatccgaaaggagccaaaacccaagaaaaaggtgcttatgaatcaacaaaatggagaagtattttatacaacttatatgatctgctagtgaatgagataagtcatataggaagtagaggaaagtattcttcaggatttcgtaatattgccgtcaaagaaaatttgattgaattgatggcagatatctgtcaccaggtttttaatgaagataccagatccttggagatttctcaatcttacactactacacaaagagaatctagtgattacagtgtcccttgcaaaaggaagaaaatagaactaggctgggaagtaataaaagatcaccttcagaagtcacagaatgattttgatcttgtgccttggctacagattgcaacccaattaatatcaaagtatcctgcaagtttacctaactgtgagctgtctccattactgatgatactatctcagcttctaccccaacagcgacatggggaacgtacaccatatgtgttacgatgccttacggaagttgcattgtgtcaagacaagaggtcaaacctagaaagctcacaaaagtcagatttattaaaactctggaataaaatttggtgtattacctttcgtggtataagttctgagcaaatacaagctgaaaactttggcttacttggagccataattcagggtagtttagttgaggttgacagagaattctggaagttatttactgggtcagcctgcagaccttcatgtcctgcagtatgctgtttgactttggcactgaccaccagtatagttccaggancggtaaaaatgggaatagagcaaaatatgtgtgaagtaaatagaagcttttctttaaaggaatcaataatgaaatggctcttattctatcagttagagggtgacttagaaaatagcacagaagtgcctccaattcttcacagtaattttcctcatcttgtactggagaaaattcttgtgagtctcactatgaaaaactgtaaagctgcaatgaattttttccaaagcgtgccagaatgtgaacaccaccaaaaagataaagaagaactttcattctcagaagtagaagaactatttcttcagacaacttttgacaagatggactttttaaccattgtgagagaatgtggtatagaaaagcaccagtccagtattggcttctctgtccaccagaatctcaaggaatcactggatcgctgtcttctgggattatcagaacagcttctgaataattactcatctgagattacaaattcagaaactcttgtccggtgttcacgtcttttggtgggtgtccttggctgctactgttacatgggtgtaatagctgaagaggaagcatataagtcagaattattccagaaagccaantctctaatgcaatgtgcaggagaaagtatcactctgtttaaaaataagacaaatgaggaattcagaattggttccttgagaaatatgatgcagctatgtacacgttgcttgagcaactgtaccaagaagagtccaaataagattgcatctggctttttcctgcgattgttaacatcaaagctaatgaatgacattgcagatatttgtaaaagtttagcatccttcatcaaaaagccatttgaccgtggagaagtagaatcaatggaagatgatactaatggaaatctaatggaggtggaggatcagtcatccatgaatctatttaacgattaccctgatagtagtgttagtgatgcaaacgaacctggagagagccaaagtaccataggtgccattaatcctttagctgaagaatatctgtcaaagcaagatctacttttcttagacatgctcaagttcttgtgtttgtgtgtaactactgctcagaccaatactgtgtcctttagggcagctgatattcggaggaaattgttaatgttaattgattctagcacgctagaacctaccaaatccctccacctgcatatgtatctaatgcttttaaaggagcttcctggagaagagtaccccttgccaatggaagatgttcttgaacttctgaaaccactatccaatgtgtgttctttgtatcgtcgtgaccaagatgtttgtaaaactattttaaaccatgtccttcatgtagtgaaaaacctaggtcaaagcaatatggactctgagaacacaagggatgctcaaggacagtttcttacagtaattggagcattttggcatctaacaaaggagaggaaatatatattctctgtaagaatggccctagtaaattgccttaaaactttgcttgaggctgatccttattcaaaatgggccattcttaatgtaatgggaaaagactttcctgtaaatgaagtatttacacaatttcttgctgacaatcatcaccaagttcgcatgttggctgcagagtcaatcaatagattgttccaggacacgaagggagattcttccaggttactgaaagcacttcctttgaagcttcagcaaacagcttttgaaaatgcatacttgaaagctcaggaaggaatgagagaaatgtcccatagtgctgagaaccctgaaactttggatgaaatttataatagaaaatctgttttactgacgttgatagctgtggttttatcctgtagccctatctgcgaaaaacaggctttgtttgccctgtgtaaatctgtgaaagagaatggattagaacctcaccttgtgaaaaaggttttagagaaagtttctgaaacttttggatatagacgtttagaagactttatggcatctcatttagattatctggttttggaatggctaaatcttcaagatactgaatacaacttatcttcttttccttttattttattaaactacacaaatattgaggatttctatagatcttgttataaggttttgattccacatctggtgattagaagtcattttgatgaggtgaagtccattgctaatcagattcaagaggactggaaaagtcttctaacagactgctttccaaagattcttgtaaatattcttccttattttgcctatgagggtaccagagacagtgggatggcacagcaaagagagactgctaccaaggtctatgatatgcttaaaagtgaaaacttattgggaaaacagattgatcacttattcattagtaatttaccagagattgtggtggagttattgatgacgttacatgagccagcaaattctagtgccagtcagagcactgacctctgtgacttttcaggggatttggatcctgctcctaatccacctcattttccatcgcatgtgattaaagcaacatttgcctatatcagcaattgtcataaaaccaagttaaaaagcattttagaaattctttccaaaagccctgattcctatcagaaaattcttcttgccatatgtgagcaagcagctgaaacaaataatgtttataagaagcacagaattcttaaaatatatcacctgtttgttagtttattactgaaagatataaaaagtggcttaggaggagcttgggcctttgttcttcgagacgttatttatactttgattcactatatcaaccaaaggccttcttgtatcatggatgtgtcattacgtagcttctccctttgttgtgacttattaagtcaggtttgccagacagccgtgacttactgtaaggatgctctagaaaaccatcttcatgttattgttggtacacttataccccttgtgtatgagcaggtggaggttcagaaacaggtattggacttgttgaaatacttagtgatagataacaaggataatgaaaacctctatatcacgattaagcttttagatccttttcctgaccatgttgtttttaaggatttgcgtattactcagcaaaaaatcaaatacagtagaggacccttttcactcttggaggaaattaaccattttctctcagtaagtgtttatgatgcacttccattgacaagacttgaaggactaaaggatcttcgaagacaactggaactacataaagatcagatggtggacattatgagagcttctcaggataatccgcaagatgggattatggtgaaactagttgtcaatttgttgcagttatccaagatggcaataaaccacactggtgaaaaagaagttctagaggctgttggaagctgcttgggagaagtgggtcctatagatttctctaccatagctatacaacatagtaaagatgcatcttataccaaggcccttaagttatttgaagataaagaacttcagtggaccttcataatgctgacctacctgaataacacactggtagaagattgtgtcaaagttcgatcagcagctgttacctgtttgaaaaacattttagccacaaagactggacatagtttctgggagatttataagatgacaacagatccaatgctggcctatctacagccttttagaacatcaagaaaaaagtttttagaagtacccagatttgacaaagaaaacccttttgaaggcctggatgatataaatctgtggattcctctaagtgaaaatcatgacatttggataaagacactgacttgtgcttttttggacagtggaggcacaaaatgtgaaattcttcaattattaaagccaatgtgtgaagtgaaaactgacttttgtcagactgtacttccatacttgattcatgatattttactccaagatacaaatgaatcatggagaaatctgctttctacacatgttcagggatttttcaccagctgtcttcgacacttctcgcaaacgagccgatccacaacccctgcaaacttggattcagaccttcttcaggaacaatttttaatgatgctttctggctggatttaaattatctagaagttgccaaggtagctcagtcttgtgctgctcactttacagctttactctatgcagaaatctatgcagataagaaaagtatggatgatcaagagaaaagaagtcttgcatttgaagaaggaagccagagtacaactatttctagcttgagtgaaaaaagtaaagaagaaactggaataagtttacaggatcttctcttagaaatctacagaagtataggggagccagatagtttgtatggctgtggtggagggaagatgttacaacccattactagactacgaacatatgaacacgaagcaatgtggggcaaagccctagtaacatatgacctcgaaacagcaatcccctcatcaacacgccaggcaggaatcattcaggccttgcagaatttgggactctgccatattctttccgtctatttaaaaggattggattatgaaaataaagactggtgtcctgaactagaagaacttcattaccaagcagcatggaggaatatgcagtgggaccattgcacttccgtcagcaaagaagtagaaggaaccagttaccatgaatcattgtacaatgctctacaatctctaagagacagagaattctctacattttatgaaagtctcaaatatgccagagtaaaagaagtggaagagatgtgtaagcgcagccttgagtctgtgtattcgctctatcccacacttagcaggttgcaggccattggagagctggaaagcattggggagcttttctcaagatcagtcacacatagacaactctctgaagtatatattaagtggcagaaacactcccagcttctcaaggacagtgattttagttttcaggagcctatcatggctctacgcacagtcattttggagatcctgatggaaaaggaaatggacaactcacaaagagaatgtattaaggacattctcaccaaacaccttgtagaactctctatactggccagaactttcaagaacactcagctccctgaaagggcaatatttcaaattaaacagtacaattcagttagctgtggagtctctgagtggcagctggaagaagcacaagtattctgggcaaaaaaggagcagagtcttgccctgagtattctcaagcaaatgatcaagaagttggatgccagctgtgcagcgaacaatcccagcctaaaacttacatacacagaatgtctgagggtttgtggcaactggttagcagaaacgtgcttagaaaatcctgcggtcatcatgcagacctatctagaaaaggcagtagaagttgctggaaattatgatggagaaagtagtgatgagctaagaaatggaaaaatgaaggcatttctctcattagcccggttttcagatactcaataccaaagaattgaaaactacatgaaatcatcggaatttgaaaacaagcaagctctcctgaaaagagccaaagaggaagtaggtctccttagggaacataaaattcagacaaacagatacacagtaaaggttcagcgagagctggagttggatgaattagccctgcgtgcactgaaagaggatcgtaaacgcttcttatgtaaagcagttgaaaattatatcaactgcttattaagtggagaagaacatgatatgtgggtattccgactttgttccctctggcttgaaaattctggagtttctgaagtcaatggcatgatgaagagagacggaatgaagattccaacatataaatttttgcctcttatgtaccaattggctgctagaatggggaccaagatgatgggaggcctaggatttcatgaagtcctcaataatctaatctctagaatttcaatggatcacccccatcacactttgtttattatactggccttagcaaatgcaaacagagatgaatttctgactaaaccagaggtagccagaagaagcagaataactaaaaatgtgcctaaacaaagctctcagcttgatgaggatcgaacagaggctgcaaatagaataatatgtactatcagaagtaggagacctcagatggtcagaagtgttgaggcactttgtgatgcttatattatattagcaaacttagatgccactcagtggaagactcagagaaaaggcataaatattccagcagaccagccaattactaaacttaagaatttagaagatgttgttgtccctactatggaaattaaggtggaccacacaggagaatatggaaatctggtgactatacagtcatttaaagcagaatttcgcttagcaggaggtgtaaatttaccaaaaataatagattgtgtaggttccgatggcaaggagaggagacagcttgttaagggccgtgatgacctgagacaagatgctgtcatgcaacaggtcttccagatgtgtaatacattactgcagagaaacacggaaactaggaagaggaaattaactatctgtacttataaggtggttcccctctctcagcgaagtggtgttcttgaatggtgcacaggaactgtccccattggtgaatttcttgttaacaatgaagatggtgctcataaaagatacaggccaaatgatttcagtgcctttcagtgccaaaagaaaatgatggaggtgcaaaaaaagtcttttgaagagaaatatgaagtcttcatggatgtttgccaaaattttcaaccagttttccgttacttctgcatggaaaaattcttggatccagctatttggtttgagaagcgattggcttatacgcgcagtgtagctacttcttctattgttggttacatacttggacttggtgatagacatgtacagaatatcttgataaatgagcagtcagcagaacttgtacatatagatctaggtgttgcttttgaacagggcaaaatccttcctactcctgagacagttccttttagactcaccagagatattgtggatggcatgggcattacgggtgttgaaggtgtcttcagaagatgctgtgagaaaaccatggaagtgatgagaaactctcaggaaactctgttaaccattgtagaggtccttctatatgatccactctttgactggaccatgaatcctttgaaagctttgtatttacagcagaggccggaagatgaaactgagcttcaccctactctgaatgcagatgaccaagaatgcaaacgaaatctcagtgatattgaccagagtttcaacaaagtagctgaacgtgtcttaatgagactacaagagaaactgaaaggagtggaagaaggcactgtgctcagtgttggtggacaagtgaatttgctcatacagcagacgcccgttactttacatttggcat

SEQ ID NO: 279252 - DNA, 9364 bp, Homo sapiens
  misc_feature (340)..(340): n is a, c, g, or t
  misc_feature (2393)..(2393): n is a, c, g, or t
  misc_feature (2983)..(2983): n is a, c, g, or t
ccgcgtccgcgcttacccaatacaagccgggctacgtccgagggtaacaacatgatcaaaaccacagcaggaaccacaataaggaacaagactcaggttaaagcaaacacagcgacagctcctgcgccgcatctcctggttccagtggcggcactgaactcgcggcaatttgtcccgcctctttcgcttcacggcagccaatcgcttccgccagagaaagaaaggcgccgaaatgaaacccgcctccgttcgccttcggaactgtcgtcacttccgtcctcagacttggaggggcggggatgaggagggcggggaggacgacgagggcgaagagggtggntgagagccccggagcccgagccgaagggcgagccgcaaacgctaagtcgctggccattggtggacatggcgcaggcgcgtttgctccgacgggccgaatgttttggggcagtgttttgagcgcggagaccgcgtgatactggatgcgcatgggcataccgtgctctgcggctgcttggcgttgcttcttcctccagaagtgggcgctgggcagtcacgcagggtttgaaccggaagcgggagtaggtagctgcgtggctaacggagaaaagaagccgtggccacgggaggaggcgagaggagtcgggatctgcgctgcagccaccgccgcggttgatactactttgaccttccgagtgcagtgacagtgatgtgtgttctgaaattgtgaaccatgagtctagtacttaatgatctgcttatctgctgccgtcaactagaacatgatagagctacagaacgaaagaaagaagttgagaaatttaagcgcctgattcgagatcctgaaacaattaaacatctagatcggcattcagattccaaacaaggaaaatatttgaattgggatgctgtttttagatttttacagaaatatattcagaaagaaacagaatgtctgagaatagcaaaaccaaatgtatcagcctcaacacaagcctccaggcagaaaaagatgcaggaaatcagtagtttggtcaaatacttcatcaaatgtgcaaacagaagagcacctaggctaaaatgtcaagaactcttaaattatatcatggatacagtgaaagattcatctaatggtgctatttacggagctgattgtagcaacatactactcaaagacattctttctgtgagaaaatactggtgtgaaatatctcagcaacagtggttagaattgttctctgtgtacttcaggctctatctgaaaccttcacaagatgttcatagagttttagtggctagaataattcatgctgttaccaaaggatgctgttctcagactgacggattaaattccaaatttttggactttttttccaaggctattcagtgtgcgagacaagaaaagagctcttcaggtctaaatcatatcttagcagctcttactatcttcctcaagactttggctgtcaactttcgaattcgagtgtgtgaattaggagatgaaattcttcccactttgctttatatttggactcaacataggcttaatgattctttaaaagaagtcattattgaattatttcaactgcaaatttatatccatcatccgaaaggagccaaaacccaagaaaaaggtgcttatgaatcaacaaaatggagaagtattttatacaacttatatgatctgctagtgaatgagataagtcatataggaagtagaggaaagtattcttcaggatttcgtaatattgccgtcaaagaaaatttgattgaattgatggcagatatctgtcaccaggtttttaatgaagataccagatccttggagatttctcaatcttacactactacacaaagagaatctagtgattacagtgtcccttgcaaaaggaagaaaatagaactaggctgggaagtaataaaagatcaccttcagaagtcacagaatgattttgatcttgtgccttggctacagattgcaacccaattaatatcaaagtatcctgcaagtttacctaactgtgagctgtctccattactgatgatactatctcagcttctaccccaacagcgacatggggaacgtacaccatatgtgttacgatgccttacggaagttgcattgtgtcaagacaagaggtcaaacctagaaagctcacaaaagtcagatttattaaaactctggaataaaatttggtgtattacctttcgtggtataagttctgagcaaatacaagctgaaaactttggcttacttggagccataattcagggtagtttagttgaggttgacagagaattctggaagttatttactgggtcagcctgcagaccttcatgtcctgcagtatgctgtttgactttggcactgaccaccagtatagttccaggancggtaaaaatgggaatagagcaaaatatgtgtgaagtaaatagaagcttttctttaaaggaatcaataatgaaatggctcttattctatcagttagagggtgacttagaaaatagcacagaagtgcctccaattcttcacagtaattttcctcatcttgtactggagaaaattcttgtgagtctcactatgaaaaactgtaaagctgcaatgaattttttccaaagcgtgccagaatgtgaacaccaccaaaaagataaagaagaactttcattctcagaagtagaagaactatttcttcagacaacttttgacaagatggactttttaaccattgtgagagaatgtggtatagaaaagcaccagtccagtattggcttctctgtccaccagaatctcaaggaatcactggatcgctgtcttctgggattatcagaacagcttctgaataattactcatctgagattacaaattcagaaactcttgtccggtgttcacgtcttttggtgggtgtccttggctgctactgttacatgggtgtaatagctgaagaggaagcatataagtcagaattattccagaaagccaantctctaatgcaatgtgcaggagaaagtatcactctgtttaaaaataagacaaatgaggaattcagaattggttccttgagaaatatgatgcagctatgtacacgttgcttgagcaactgtaccaagaagagtccaaataagattgcatctggctttttcctgcgattgttaacatcaaagctaatgaatgacattgcagatatttgtaaaagtttagcatccttcatcaaaaagccatttgaccgtggagaagtagaatcaatggaagatgatactaatggaaatctaatggaggtggaggatcagtcatccatgaatctatttaacgattaccctgatagtagtgttagtgatgcaaacgaacctggagagagccaaagtaccataggtgccattaatcctttagctgaagaatatctgtcaaagcaagatctacttttcttagacatgctcaagttcttgtgtttgtgtgtaactactgctcagaccaatactgtgtcctttagggcagctgatattcggaggaaattgttaatgttaattgattctagcacgctagaacctaccaaatccctccacctgcatatgtatctaatgcttttaaaggagcttcctggagaagagtaccccttgccaatggaagatgttcttgaacttctgaaaccactatccaatgtgtgttctttgtatcgtcgtgaccaagatgtttgtaaaactattttaaaccatgtccttcatgtagtgaaaaacctaggtcaaagcaatatggactctgagaacacaagggatgctcaaggacagtttcttacagtaattggagcattttggcatctaacaaaggagaggaaatatatattctctgtaagaatggccctagtaaattgccttaaaactttgcttgaggctgatccttattcaaaatgggccattcttaatgtaatgggaaaagactttcctgtaaatgaagtatttacacaatttcttgctgacaatcatcaccaagttcgcatgttggctgcagagtcaatcaatagattgttccaggacacgaagggagattcttccaggttactgaaagcacttcctttgaagcttcagcaaacagcttttgaaaatgcatacttgaaagctcaggaaggaatgagagaaatgtcccatagtgctgagaaccctgaaactttggatgaaatttataatagaaaatctgttttactgacgttgatagctgtggttttatcctgtagccctatctgcgaaaaacaggctttgtttgccctgtgtaaatctgtgaaagagaatggattagaacctcaccttgtgaaaaaggttttagagaaagtttctgaaacttttggatatagacgtttagaagactttatggcatctcatttagattatctggttttggaatggctaaatcttcaagatactgaatacaacttatcttcttttccttttattttattaaactacacaaatattgaggatttctatagatcttgttataaggttttgattccacatctggtgattagaagtcattttgatgaggtgaagtccattgctaatcagattcaagaggactggaaaagtcttctaacagactgctttccaaagattcttgtaaatattcttccttattttgcctatgagggtaccagagacagtgggatggcacagcaaagagagactgctaccaaggtctatgatatgcttaaaagtgaaaacttattgggaaaacagattgatcacttattcattagtaatttaccagagattgtggtggagttattgatgacgttacatgagccagcaaattctagtgccagtcagagcactgacctctgtgacttttcaggggatttggatcctgctcctaatccacctcattttccatcgcatgtgattaaagcaacatttgcctatatcagcaattgtcataaaaccaagttaaaaagcattttagaaattctttccaaaagccctgattcctatcagaaaattcttcttgccatatgtgagcaagcagctgaaacaaataatgtttataagaagcacagaattcttaaaatatatcacctgtttgttagtttattactgaaagatataaaaagtggcttaggaggagcttgggcctttgttcttcgagacgttatttatactttgattcactatatcaaccaaaggccttcttgtatcatggatgtgtcattacgtagcttctccctttgttgtgacttattaagtcaggtttgccagacagccgtgacttactgtaaggatgctctagaaaaccatcttcatgttattgttggtacacttataccccttgtgtatgagcaggtggaggttcagaaacaggtattggacttgttgaaatacttagtgatagataacaaggataatgaaaacctctatatcacgattaagcttttagatccttttcctgaccatgttgtttttaaggatttgcgtattactcagcaaaaaatcaaatacagtagaggacccttttcactcttggaggaaattaaccattttctctcagtaagtgtttatgatgcacttccattgacaagacttgaaggactaaaggatcttcgaagacaactggaactacataaagatcagatggtggacattatgagagcttctcaggataatccgcaagatgggattatggtgaaactagttgtcaatttgttgcagttatccaagatggcaataaaccacactggtgaaaaagaagttctagaggctgttggaagctgcttgggagaagtgggtcctatagatttctctaccatagctatacaacatagtaaagatgcatcttataccaaggcccttaagttatttgaagataaagaacttcagtggaccttcataatgctgacctacctgaataacacactggtagaagattgtgtcaaagttcgatcagcagctgttacctgtttgaaaaacattttagccacaaagactggacatagtttctgggagatttataagatgacaacagatccaatgctggcctatctacagccttttagaacatcaagaaaaaagtttttagaagtacccagatttgacaaagaaaacccttttgaaggcctggatgatataaatctgtggattcctctaagtgaaaatcatgacatttggataaagacactgacttgtgcttttttggacagtggaggcacaaaatgtgaaattcttcaattattaaagccaatgtgtgaagtgaaaactgacttttgtcagactgtacttccatacttgattcatgatattttactccaagatacaaatgaatcatggagaaatctgctttctacacatgttcagggatttttcaccagctgtcttcgacacttctcgcaaacgagccgatccacaacccctgcaaacttggattcagaccttcttcaggaacaatttttaatgatgctttctggctggatttaaattatctagaagttgccaaggtagctcagtcttgtgctgctcactttacagctttactctatgcagaaatctatgcagataagaaaagtatggatgatcaagagaaaagaagtcttgcatttgaagaaggaagccagagtacaactatttctagcttgagtgaaaaaagtaaagaagaaactggaataagtttacaggatcttctcttagaaatctacagaagtataggggagccagatagtttgtatggctgtggtggagggaagatgttacaacccattactagactacgaacatatgaacacgaagcaatgtggggcaaagccctagtaacatatgacctcgaaacagcaatcccctcatcaacacgccaggcaggaatcattcaggccttgcagaatttgggactctgccatattctttccgtctatttaaaaggattggattatgaaaataaagactggtgtcctgaactagaagaacttcattaccaagcagcatggaggaatatgcagtgggaccattgcacttccgtcagcaaagaagtagaaggaaccagttaccatgaatcattgtacaatgctctacaatctctaagagacagagaattctctacattttatgaaagtctcaaatatgccagagtaaaagaagtggaagagatgtgtaagcgcagccttgagtctgtgtattcgctctatcccacacttagcaggttgcaggccattggagagctggaaagcattggggagcttttctcaagatcagtcacacatagacaactctctgaagtatatattaagtggcagaaacactcccagcttctcaaggacagtgattttagttttcaggagcctatcatggctctacgcacagtcattttggagatcctgatggaaaaggaaatggacaactcacaaagagaatgtattaaggacattctcaccaaacaccttgtagaactctctatactggccagaactttcaagaacactcagctccctgaaagggcaatatttcaaattaaacagtacaattcagttagctgtggagtctctgagtggcagctggaagaagcacaagtattctgggcaaaaaaggagcagagtcttgccctgagtattctcaagcaaatgatcaagaagttggatgccagctgtgcagcgaacaatcccagcctaaaacttacatacacagaatgtctgagggtttgtggcaactggttagcagaaacgtgcttagaaaatcctgcggtcatcatgcagacctatctagaaaaggcagtagaagttgctggaaattatgatggagaaagtagtgatgagctaagaaatggaaaaatgaaggcatttctctcattagcccggttttcagatactcaataccaaagaattgaaaactacatgaaatcatcggaatttgaaaacaagcaagctctcctgaaaagagccaaagaggaagtaggtctccttagggaacataaaattcagacaaacagatacacagtaaaggttcagcgagagctggagttggatgaattagccctgcgtgcactgaaagaggatcgtaaacgcttcttatgtaaagcagttgaaaattatatcaactgcttattaagtggagaagaacatgatatgtgggtattccgactttgttccctctggcttgaaaattctggagtttctgaagtcaatggcatgatgaagagagacggaatgaagattccaacatataaatttttgcctcttatgtaccaattggctgctagaatggggaccaagatgatgggaggcctaggatttcatgaagtcctcaataatctaatctctagaatttcaatggatcacccccatcacactttgtttattatactggccttagcaaatgcaaacagagatgaatttctgactaaaccagaggtagccagaagaagcagaataactaaaaatgtgcctaaacaaagctctcagcttgatgaggatcgaacagaggctgcaaatagaataatatgtactatcagaagtaggagacctcagatggtcagaagtgttgaggcactttgtgatgcttatattatattagcaaacttagatgccactcagtggaagactcagagaaaaggcataaatattccagcagaccagccaattactaaacttaagaatttagaagatgttgttgtccctactatggaaattaaggtggaccacacaggagaatatggaaatctggtgactatacagtcatttaaagcagaatttcgcttagcaggaggtgtaaatttaccaaaaataatagattgtgtaggttccgatggcaaggagaggagacagcttgttaagggccgtgatgacctgagacaagatgctgtcatgcaacaggtcttccagatgtgtaatacattactgcagagaaacacggaaactaggaagaggaaattaactatctgtacttataaggtaactatttgtacttctgttagttcaccaaaaacatataaaagatgccatttggttgggtgaagtggctcatgcccatattcataatgctttgggaggccaaggtgggaggattgcttgaggccaggagttcgagaccagcctcagcaacatagtgagaccccatcttgacaaaaagttaaaaaaaaaaaaaaagccagagatgatggcatgtgcttgtagtcccttagctacatgggaggctgaggtgggaggatcacttgagtccaggagtttgaggctgcagtgagctcaaactctgcagtgagccccagtccagcctgagcaacacagcaagatcccgtttaaaaaagaagaagaagaagaagatgccattatttggaccaggagtctacaaatgttttctgtgaaggaccaaataataaagatttattttctttgtaaaaagtat

SEQ ID NO: 279253 - DNA, 8021 bp, Homo sapiens
  misc_feature (340)..(340): n is a, c, g, or t
  misc_feature (2393)..(2393): n is a, c, g, or t
  misc_feature (2983)..(2983): n is a, c, g, or t
ccgcgtccgcgcttacccaatacaagccgggctacgtccgagggtaacaacatgatcaaaaccacagcaggaaccacaataaggaacaagactcaggttaaagcaaacacagcgacagctcctgcgccgcatctcctggttccagtggcggcactgaactcgcggcaatttgtcccgcctctttcgcttcacggcagccaatcgcttccgccagagaaagaaaggcgccgaaatgaaacccgcctccgttcgccttcggaactgtcgtcacttccgtcctcagacttggaggggcggggatgaggagggcggggaggacgacgagggcgaagagggtggntgagagccccggagcccgagccgaagggcgagccgcaaacgctaagtcgctggccattggtggacatggcgcaggcgcgtttgctccgacgggccgaatgttttggggcagtgttttgagcgcggagaccgcgtgatactggatgcgcatgggcataccgtgctctgcggctgcttggcgttgcttcttcctccagaagtgggcgctgggcagtcacgcagggtttgaaccggaagcgggagtaggtagctgcgtggctaacggagaaaagaagccgtggccacgggaggaggcgagaggagtcgggatctgcgctgcagccaccgccgcggttgatactactttgaccttccgagtgcagtgacagtgatgtgtgttctgaaattgtgaaccatgagtctagtacttaatgatctgcttatctgctgccgtcaactagaacatgatagagctacagaacgaaagaaagaagttgagaaatttaagcgcctgattcgagatcctgaaacaattaaacatctagatcggcattcagattccaaacaaggaaaatatttgaattgggatgctgtttttagatttttacagaaatatattcagaaagaaacagaatgtctgagaatagcaaaaccaaatgtatcagcctcaacacaagcctccaggcagaaaaagatgcaggaaatcagtagtttggtcaaatacttcatcaaatgtgcaaacagaagagcacctaggctaaaatgtcaagaactcttaaattatatcatggatacagtgaaagattcatctaatggtgctatttacggagctgattgtagcaacatactactcaaagacattctttctgtgagaaaatactggtgtgaaatatctcagcaacagtggttagaattgttctctgtgtacttcaggctctatctgaaaccttcacaagatgttcatagagttttagtggctagaataattcatgctgttaccaaaggatgctgttctcagactgacggattaaattccaaatttttggactttttttccaaggctattcagtgtgcgagacaagaaaagagctcttcaggtctaaatcatatcttagcagctcttactatcttcctcaagactttggctgtcaactttcgaattcgagtgtgtgaattaggagatgaaattcttcccactttgctttatatttggactcaacataggcttaatgattctttaaaagaagtcattattgaattatttcaactgcaaatttatatccatcatccgaaaggagccaaaacccaagaaaaaggtgcttatgaatcaacaaaatggagaagtattttatacaacttatatgatctgctagtgaatgagataagtcatataggaagtagaggaaagtattcttcaggatttcgtaatattgccgtcaaagaaaatttgattgaattgatggcagatatctgtcaccaggtttttaatgaagataccagatccttggagatttctcaatcttacactactacacaaagagaatctagtgattacagtgtcccttgcaaaaggaagaaaatagaactaggctgggaagtaataaaagatcaccttcagaagtcacagaatgattttgatcttgtgccttggctacagattgcaacccaattaatatcaaagtatcctgcaagtttacctaactgtgagctgtctccattactgatgatactatctcagcttctaccccaacagcgacatggggaacgtacaccatatgtgttacgatgccttacggaagttgcattgtgtcaagacaagaggtcaaacctagaaagctcacaaaagtcagatttattaaaactctggaataaaatttggtgtattacctttcgtggtataagttctgagcaaatacaagctgaaaactttggcttacttggagccataattcagggtagtttagttgaggttgacagagaattctggaagttatttactgggtcagcctgcagaccttcatgtcctgcagtatgctgtttgactttggcactgaccaccagtatagttccaggancggtaaaaatgggaatagagcaaaatatgtgtgaagtaaatagaagcttttctttaaaggaatcaataatgaaatggctcttattctatcagttagagggtgacttagaaaatagcacagaagtgcctccaattcttcacagtaattttcctcatcttgtactggagaaaattcttgtgagtctcactatgaaaaactgtaaagctgcaatgaattttttccaaagcgtgccagaatgtgaacaccaccaaaaagataaagaagaactttcattctcagaagtagaagaactatttcttcagacaacttttgacaagatggactttttaaccattgtgagagaatgtggtatagaaaagcaccagtccagtattggcttctctgtccaccagaatctcaaggaatcactggatcgctgtcttctgggattatcagaacagcttctgaataattactcatctgagattacaaattcagaaactcttgtccggtgttcacgtcttttggtgggtgtccttggctgctactgttacatgggtgtaatagctgaagaggaagcatataagtcagaattattccagaaagccaantctctaatgcaatgtgcaggagaaagtatcactctgtttaaaaataagacaaatgaggaattcagaattggttccttgagaaatatgatgcagctatgtacacgttgcttgagcaactgtaccaagaagagtccaaataagattgcatctggctttttcctgcgattgttaacatcaaagctaatgaatgacattgcagatatttgtaaaagtttagcatccttcatcaaaaagccatttgaccgtggagaagtagaatcaatggaagatgatactaatggaaatctaatggaggtggaggatcagtcatccatgaatctatttaacgattaccctgatagtagtgttagtgatgcaaacgaacctggagagagccaaagtaccataggtgccattaatcctttagctgaagaatatctgtcaaagcaagatctacttttcttagacatgctcaagttcttgtgtttgtgtgtaactactgctcagaccaatactgtgtcctttagggcagctgatattcggaggaaattgttaatgttaattgattctagcacgctagaacctaccaaatccctccacctgcatatgtatctaatgcttttaaaggagcttcctggagaagagtaccccttgccaatggaagatgttcttgaacttctgaaaccactatccaatgtgtgttctttgtatcgtcgtgaccaagatgtttgtaaaactattttaaaccatgtccttcatgtagtgaaaaacctaggtcaaagcaatatggactctgagaacacaagggatgctcaaggacagtttcttacagtaattggagcattttggcatctaacaaaggagaggaaatatatattctctgtaagaatggccctagtaaattgccttaaaactttgcttgaggctgatccttattcaaaatgggccattcttaatgtaatgggaaaagactttcctgtaaatgaagtatttacacaatttcttgctgacaatcatcaccaagttcgcatgttggctgcagagtcaatcaatagattgttccaggacacgaagggagattcttccaggttactgaaagcacttcctttgaagcttcagcaaacagcttttgaaaatgcatacttgaaagctcaggaaggaatgagagaaatgtcccatagtgctgagaaccctgaaactttggatgaaatttataatagaaaatctgttttactgacgttgatagctgtggttttatcctgtagccctatctgcgaaaaacaggctttgtttgccctgtgtaaatctgtgaaagagaatggattagaacctcaccttgtgaaaaaggttttagagaaagtttctgaaacttttggatatagacgtttagaagactttatggcatctcatttagattatctggttttggaatggctaaatcttcaagatactgaatacaacttatcttcttttccttttattttattaaactacacaaatattgaggatttctatagatcttgttataaggttttgattccacatctggtgattagaagtcattttgatgaggtgaagtccattgctaatcagattcaagaggactggaaaagtcttctaacagactgctttccaaagattcttgtaaatattcttccttattttgcctatgagggtaccagagacagtgggatggcacagcaaagagagactgctaccaaggtctatgatatgcttaaaagtgaaaacttattgggaaaacagattgatcacttattcattagtaatttaccagagattgtggtggagttattgatgacgttacatgagccagcaaattctagtgccagtcagagcactgacctctgtgacttttcaggggatttggatcctgctcctaatccacctcattttccatcgcatgtgattaaagcaacatttgcctatatcagcaattgtcataaaaccaagttaaaaagcattttagaaattctttccaaaagccctgattcctatcagaaaattcttcttgccatatgtgagcaagcagctgaaacaaataatgtttataagaagcacagaattcttaaaatatatcacctgtttgttagtttattactgaaagatataaaaagtggcttaggaggagcttgggcctttgttcttcgagacgttatttatactttgattcactatatcaaccaaaggccttcttgtatcatggatgtgtcattacgtagcttctccctttgttgtgacttattaagtcaggtttgccagacagccgtgacttactgtaaggatgctctagaaaaccatcttcatgttattgttggtacacttataccccttgtgtatgagcaggtggaggttcagaaacaggtattggacttgttgaaatacttagtgatagataacaaggataatgaaaacctctatatcacgattaagcttttagatccttttcctgaccatgttgtttttaaggatttgcgtattactcagcaaaaaatcaaatacagtagaggacccttttcactcttggaggaaattaaccattttctctcagtaagtgtttatgatgcacttccattgacaagacttgaaggactaaaggatcttcgaagacaactggaactacataaagatcagatggtggacattatgagagcttctcaggataatccgcaagatgggattatggtgaaactagttgtcaatttgttgcagttatccaagatggcaataaaccacactggtgaaaaagaagttctagaggctgttggaagctgcttgggagaagtgggtcctatagatttctctaccatagctatacaacatagtaaagatgcatcttataccaaggcccttaagttatttgaagataaagaacttcagtggaccttcataatgctgacctacctgaataacacactggtagaagattgtgtcaaagttcgatcagcagctgttacctgtttgaaaaacattttagccacaaagactggacatagtttctgggagatttataagatgacaacagatccaatgctggcctatctacagccttttagaacatcaagaaaaaagtttttagaagtacccagatttgacaaagaaaacccttttgaaggcctggatgatataaatctgtggattcctctaagtgaaaatcatgacatttggataaagacactgacttgtgcttttttggacagtggaggcacaaaatgtgaaattcttcaattattaaagccaatgtgtgaagtgaaaactgacttttgtcagactgtacttccatacttgattcatgatattttactccaagatacaaatgaatcatggagaaatctgctttctacacatgttcagggatttttcaccagctgtcttcgacacttctcgcaaacgagccgatccacaacccctgcaaacttggattcagaccttcttcaggaacaatttttaatgatgctttctggctggatttaaattatctagaagttgccaaggtagctcagtcttgtgctgctcactttacagctttactctatgcagaaatctatgcagataagaaaagtatggatgatcaagagaaaagaagtcttgcatttgaagaaggaagccagagtacaactatttctagcttgagtgaaaaaagtaaagaagaaactggaataagtttacaggatcttctcttagaaatctacagaagtataggggagccagatagtttgtatggctgtggtggagggaagatgttacaacccattactagactacgaacatatgaacacgaagcaatgtggggcaaagccctagtaacatatgacctcgaaacagcaatcccctcatcaacacgccaggcaggaatcattcaggccttgcagaatttgggactctgccatattctttccgtctatttaaaaggattggattatgaaaataaagactggtgtcctgaactagaagaacttcattaccaagcagcatggaggaatatgcagtgggaccattgcacttccgtcagcaaagaagtagaaggaaccagttaccatgaatcattgtacaatgctctacaatctctaagagacagagaattctctacattttatgaaagtctcaaatatgccagagtaaaagaagtggaagagatgtgtaagcgcagccttgagtctgtgtattcgctctatcccacacttagcaggttgcaggccattggagagctggaaagcattggggagcttttctcaagatcagtcacacatagacaactctctgaagtatatattaagtggcagaaacactcccagcttctcaaggacagtgattttagttttcaggagcctatcatggctctacgcacagtcattttggagatcctgatggaaaaggaaatggacaactcacaaagagaatgtattaaggacattctcaccaaacaccttgtagaactctctatactggccagaactttcaagaacactcagctccctgaaagggcaatatttcaaattaaacagtacaattcagttagctgtggagtctctgagtggcagctggaagaagcacaagtattctgggcaaaaaaggagcagagtcttgccctgagtattctcaagcaaatgatcaagaagttggatgccagctgtgcagcgaacaatcccagcctaaaacttacatacacagaatgtctgagggtttgtggcaactggttagcagaaacgtgcttagaaaatcctgcggtcatcatgcagacctatctagaaaaggcagtagaagttgctggaaattatgatggagaaagtagtgatgagctaagaaatggaaaaatgaaggcatttctctcattagcccggttttcagatactcaataccaaagaattgaaaactacatgaaatcatcggaatttgaaaacaagcaagctctcctgaaaagagccaaagaggaagtaggtctccttagggaacataaaattcagacaaacaggtaactaggtttctacaagtgacaattttatgttcaccagttaactgagtgagtgtttttgcatagaaa

SEQ ID NO: 279254 - DNA, 5161 bp, Homo sapiens
  misc_feature (340)..(340): n is a, c, g, or t
  misc_feature (2393)..(2393): n is a, c, g, or t
  misc_feature (2983)..(2983): n is a, c, g, or t
ccgcgtccgcgcttacccaatacaagccgggctacgtccgagggtaacaacatgatcaaaaccacagcaggaaccacaataaggaacaagactcaggttaaagcaaacacagcgacagctcctgcgccgcatctcctggttccagtggcggcactgaactcgcggcaatttgtcccgcctctttcgcttcacggcagccaatcgcttccgccagagaaagaaaggcgccgaaatgaaacccgcctccgttcgccttcggaactgtcgtcacttccgtcctcagacttggaggggcggggatgaggagggcggggaggacgacgagggcgaagagggtggntgagagccccggagcccgagccgaagggcgagccgcaaacgctaagtcgctggccattggtggacatggcgcaggcgcgtttgctccgacgggccgaatgttttggggcagtgttttgagcgcggagaccgcgtgatactggatgcgcatgggcataccgtgctctgcggctgcttggcgttgcttcttcctccagaagtgggcgctgggcagtcacgcagggtttgaaccggaagcgggagtaggtagctgcgtggctaacggagaaaagaagccgtggccacgggaggaggcgagaggagtcgggatctgcgctgcagccaccgccgcggttgatactactttgaccttccgagtgcagtgacagtgatgtgtgttctgaaattgtgaaccatgagtctagtacttaatgatctgcttatctgctgccgtcaactagaacatgatagagctacagaacgaaagaaagaagttgagaaatttaagcgcctgattcgagatcctgaaacaattaaacatctagatcggcattcagattccaaacaaggaaaatatttgaattgggatgctgtttttagatttttacagaaatatattcagaaagaaacagaatgtctgagaatagcaaaaccaaatgtatcagcctcaacacaagcctccaggcagaaaaagatgcaggaaatcagtagtttggtcaaatacttcatcaaatgtgcaaacagaagagcacctaggctaaaatgtcaagaactcttaaattatatcatggatacagtgaaagattcatctaatggtgctatttacggagctgattgtagcaacatactactcaaagacattctttctgtgagaaaatactggtgtgaaatatctcagcaacagtggttagaattgttctctgtgtacttcaggctctatctgaaaccttcacaagatgttcatagagttttagtggctagaataattcatgctgttaccaaaggatgctgttctcagactgacggattaaattccaaatttttggactttttttccaaggctattcagtgtgcgagacaagaaaagagctcttcaggtctaaatcatatcttagcagctcttactatcttcctcaagactttggctgtcaactttcgaattcgagtgtgtgaattaggagatgaaattcttcccactttgctttatatttggactcaacataggcttaatgattctttaaaagaagtcattattgaattatttcaactgcaaatttatatccatcatccgaaaggagccaaaacccaagaaaaaggtgcttatgaatcaacaaaatggagaagtattttatacaacttatatgatctgctagtgaatgagataagtcatataggaagtagaggaaagtattcttcaggatttcgtaatattgccgtcaaagaaaatttgattgaattgatggcagatatctgtcaccaggtttttaatgaagataccagatccttggagatttctcaatcttacactactacacaaagagaatctagtgattacagtgtcccttgcaaaaggaagaaaatagaactaggctgggaagtaataaaagatcaccttcagaagtcacagaatgattttgatcttgtgccttggctacagattgcaacccaattaatatcaaagtatcctgcaagtttacctaactgtgagctgtctccattactgatgatactatctcagcttctaccccaacagcgacatggggaacgtacaccatatgtgttacgatgccttacggaagttgcattgtgtcaagacaagaggtcaaacctagaaagctcacaaaagtcagatttattaaaactctggaataaaatttggtgtattacctttcgtggtataagttctgagcaaatacaagctgaaaactttggcttacttggagccataattcagggtagtttagttgaggttgacagagaattctggaagttatttactgggtcagcctgcagaccttcatgtcctgcagtatgctgtttgactttggcactgaccaccagtatagttccaggancggtaaaaatgggaatagagcaaaatatgtgtgaagtaaatagaagcttttctttaaaggaatcaataatgaaatggctcttattctatcagttagagggtgacttagaaaatagcacagaagtgcctccaattcttcacagtaattttcctcatcttgtactggagaaaattcttgtgagtctcactatgaaaaactgtaaagctgcaatgaattttttccaaagcgtgccagaatgtgaacaccaccaaaaagataaagaagaactttcattctcagaagtagaagaactatttcttcagacaacttttgacaagatggactttttaaccattgtgagagaatgtggtatagaaaagcaccagtccagtattggcttctctgtccaccagaatctcaaggaatcactggatcgctgtcttctgggattatcagaacagcttctgaataattactcatctgagattacaaattcagaaactcttgtccggtgttcacgtcttttggtgggtgtccttggctgctactgttacatgggtgtaatagctgaagaggaagcatataagtcagaattattccagaaagccaantctctaatgcaatgtgcaggagaaagtatcactctgtttaaaaataagacaaatgaggaattcagaattggttccttgagaaatatgatgcagctatgtacacgttgcttgagcaactgtaccaagaagagtccaaataagattgcatctggctttttcctgcgattgttaacatcaaagctaatgaatgacattgcagatatttgtaaaagtttagcatccttcatcaaaaagccatttgaccgtggagaagtagaatcaatggaagatgatactaatggaaatctaatggaggtggaggatcagtcatccatgaatctatttaacgattaccctgatagtagtgttagtgatgcaaacgaacctggagagagccaaagtaccataggtgccattaatcctttagctgaagaatatctgtcaaagcaagatctacttttcttagacatgctcaagttcttgtgtttgtgtgtaactactgctcagaccaatactgtgtcctttagggcagctgatattcggaggaaattgttaatgttaattgattctagcacgctagaacctaccaaatccctccacctgcatatgtatctaatgcttttaaaggagcttcctggagaagagtaccccttgccaatggaagatgttcttgaacttctgaaaccactatccaatgtgtgttctttgtatcgtcgtgaccaagatgtttgtaaaactattttaaaccatgtccttcatgtagtgaaaaacctaggtcaaagcaatatggactctgagaacacaagggatgctcaaggacagtttcttacagtaattggagcattttggcatctaacaaaggagaggaaatatatattctctgtaagaatggccctagtaaattgccttaaaactttgcttgaggctgatccttattcaaaatgggccattcttaatgtaatgggaaaagactttcctgtaaatgaagtatttacacaatttcttgctgacaatcatcaccaagttcgcatgttggctgcagagtcaatcaatagattgttccaggacacgaagggagattcttccaggttactgaaagcacttcctttgaagcttcagcaaacagcttttgaaaatgcatacttgaaagctcaggaaggaatgagagaaatgtcccatagtgctgagaaccctgaaactttggatgaaatttataatagaaaatctgttttactgacgttgatagctgtggttttatcctgtagccctatctgcgaaaaacaggctttgtttgccctgtgtaaatctgtgaaagagaatggattagaacctcaccttgtgaaaaaggttttagagaaagtttctgaaacttttggatatagacgtttagaagactttatggcatctcatttagattatctggttttggaatggctaaatcttcaagatactgaatacaacttatcttcttttccttttattttattaaactacacaaatattgaggatttctatagatcttgttataaggttttgattccacatctggtgattagaagtcattttgatgaggtgaagtccattgctaatcagattcaagaggactggaaaagtcttctaacagactgctttccaaagattcttgtaaatattcttccttattttgcctatgagggtaccagagacagtgggatggcacagcaaagagagactgctaccaaggtctatgatatgcttaaaagtgaaaacttattgggaaaacaggtatggcttcaatttttatgtacttttcattccctgaatgatatgagatataacctttaagttttaaggctatttattcgatttattcgtatttatatattgaaacttagcttgtggtaatcattatctagcatagccaacccatgaatttttttggttatgtcgtgttgtctccctctgattggcttttaactaagtagaaatgttttaaattagaaataatccaaaaaaccatttgaataattttcttctgccatttaaaaatttattttaactgttgtaatacacgaatgcaaactggttgttaaagtcaaggaatactaaacagtgtacagaaaaccttcactccctcttcaatctcaccaagctttccacttttcaagaaaaacaaccgtccctcattcctatagttctcataccctgctgtttgttttt

SEQ ID NO: 279255 - DNA, 1646 bp, Homo sapiens
acaaagcggttggttgcggcagggactacaccggtgtatcatgggagcggcccgggctacacgttaaaaacactaaggggagcgcgcgaagctgaacttggcgctcgatgggggccgttagccgccctagagcgcgcggagccgcagaggcgtagctggactacaacgcagtgcatctcgggaggccaactcgactggactgggtgagaggacagaggtggctcgatgggcggcccgaaggccggggatcatggcgggaaggcgggcccagccaggttcagccccgccccgacccgccgctccccacccccggccggcctcgcgtgccttcccgcagcactgccgtccccgggatgctgagcgcccaccgtctccccgcagccccctcatgcccggctgcgagctgcccgtgggcacctgcccggacatgtgcccggccgccgagcgcgcccagcgcgaaagggagcaccgcctgcaccgcttggaggtggtgccgggttgccgccaggacccgccccgcgcggatccgcagcgcgcggtgaaggagtacagccgacccgccgccggcaagccccggcccccgcccagccagttgcgtccgccctccgtgctgctggccaccgtgcgctacctggccggtgaggtggcggagagcgccgacatcgcccgcgccgaggtggccagcttcgtggcagaccgcttgcgagctgtgcgcctggacctggcgctgcagggagcgggcgacgccgaggcagcggtggtgctggaggcggcgctggccacgctgctggccgtagtggcgcggctcgggcccgacgcggcgcggggacccgcggacccggtgctgctgcaggcccaggtgcaggagggcttcggctcgctgcggcgctgctacgcgcggggcgccgggccgcacccccgccaacccgccttccagggcctctttctgctctataacctgggtgagtcgggatcctggcggctgggcagagcgtggggacaggagcccaccatgacagtggaggctcggtggaagccctgcatgaggttctacagctgcctgctgccctgcgcgcctgcccgcccctccgcaaggccttggcggtagatgctgccttccgagagggcaatgctgcccgcctgttccgtctgctccagaccctgccctacctgccaagttgcgctgtgcagtgccatgtgggccatgcccgccgggaagccctggcccgcttcgctcgtgcctttagcacccccaagggccagaccttgcctctgggcttcatggtcaacctcttggccctggatggactcagggaagcacgggacctgtgccaggcccacgggctgcccttggacggagaggagagagttgtgttcctgaggggtcgctacgtggaggaagggctaccgcctgccagtacgtgcaaggtgttagtggagagcaaacttcgaggacgtaccctggaggaggtggtcatggcagaggaggaagatgagggcacggacagacctgggtccccagcctgaggagggagcgtgagcctcccagagccccaggactgggccagagcacttaggtttctttttccatggtttccaggtaataaaaggaacttgttttgttggtaccaaaaacaagatgtgat

SEQ ID NO: 279256 - DNA, 1584 bp, Homo sapiens
acaaagcggttggttgcggcagggactacaccggtgtatcatgggagcggcccgggctacacgttaaaaacactaaggggagcgcgcgaagctgaacttggcgctcgatgggggccgttagccgccctagagcgcgcggagccgcagaggcgtagctggactacaacgcagtgcatctcgggaggccaactcgactggactgggtgagaggacagaggtggctcgatgggcggcccgaaggccggggatcatggcgggaaggcgggcccagccaggttcagccccgccccgacccgccgctccccacccccggccggcctcgcgtgccttcccgcagcactgccgtccccgggatgctgagcgcccaccgtctccccgcagccccctcatgcccggctgcgagctgcccgtgggcacctgcccggacatgtgcccggccgccgagcgcgcccagcgcgaaagggagcaccgcctgcaccgcttggaggtggtgccgggttgccgccaggacccgccccgcgcggatccgcagcgcgcggtgaaggagtacagccgacccgccgccggcaagccccggcccccgcccagccagttgcgtccgccctccgtgctgctggccaccgtgcgctacctggccggtgaggtggcggagagcgccgacatcgcccgcgccgaggtggccagcttcgtggcagaccgcttgcgagctgtgcgcctggacctggcgctgcagggagcgggcgacgccgaggcagcggtggtgctggaggcggcgctggccacgctgctggccgtagtggcgcggctcgggcccgacgcggcgcggggacccgcggacccggtgctgctgcaggcccaggtgcaggagggcttcggctcgctgcggcgctgctacgcgcggggcgccgggccgcacccccgccaacccgccttccagggcctctttctgctctataacctgggctcggtggaagccctgcatgaggttctacagctgcctgctgccctgcgcgcctgcccgcccctccgcaaggccttggcggtagatgctgccttccgagagggcaatgctgcccgcctgttccgtctgctccagaccctgccctacctgccaagttgcgctgtgcagtgccatgtgggccatgcccgccgggaagccctggcccgcttcgctcgtgcctttagcacccccaagggccagaccttgcctctgggcttcatggtcaacctcttggccctggatggactcagggaagcacgggacctgtgccaggcccacgggctgcccttggacggagaggagagagttgtgttcctgaggggtcgctacgtggaggaagggctaccgcctgccagtacgtgcaaggtgttagtggagagcaaacttcgaggacgtaccctggaggaggtggtcatggcagaggaggaagatgagggcacggacagacctgggtccccagcctgaggagggagcgtgagcctcccagagccccaggactgggccagagcacttaggtttctttttccatggtttccaggtaataaaaggaacttgttttgttggtaccaaaaacaagatgtgat

SEQ ID NO: 279257 - DNA, 1268 bp, Homo sapiens
taggctggtcgaggcctggttgtaatcggccgaggggatgctgagcgcccaccgtctccccgcagccccctcatgcccggctgcgagctgcccgtgggcacctgcccggacatgtgcccggccgccgagcgcgcccagcgcgaaagggagcaccgcctgcaccgcttggaggtggtgccgggttgccgccaggacccgccccgcgcggatccgcagcgcgcggtgaaggagtacagccgacccgccgccggcaagccccggcccccgcccagccagttgcgtccgccctccgtgctgctggccaccgtgcgctacctggccggtgaggtggcggagagcgccgacatcgcccgcgccgaggtggccagcttcgtggcagaccgcttgcgagctgtgcgcctggacctggcgctgcagggagcgggcgacgccgaggcagcggtggtgctggaggcggcgctggccacgctgctggccgtagtggcgcggctcgggcccgacgcggcgcggggacccgcggacccggtgctgctgcaggcccaggtgcaggagggcttcggctcgctgcggcgctgctacgcgcggggcgccgggccgcacccccgccaacccgccttccagggcctctttctgctctataacctgggctcggtggaagccctgcatgaggttctacagctgcctgctgccctgcgcgcctgcccgcccctccgcaaggccttggcggtagatgctgccttccgagagggcaatgctgcccgcctgttccgtctgctccagaccctgccctacctgccaagttgcgctgtgcagtgccatgtgggccatgcccgccgggaagccctggcccgcttcgctcgtgcctttagcacccccaagggccagaccttgcctctgggcttcatggtcaacctcttggccctggatggactcagggaagcacgggacctgtgccaggcccacgggctgcccttggacggagaggagagagttgtgttcctgaggggtcgctacgtggaggaagggctaccgcctgccagtacgtgcaaggtgttagtggagagcaaacttcgaggacgtaccctggaggaggtggtcatggcagaggaggaagatgagggcacggacagacctgggtccccagcctgaggagggagcgtgagcctcccagagccccaggactgggccagagcacttaggtttctttttccatggtttccaggtaataaaaggaacttgttttgttggtaccaaaaacaagatgtgat

SEQ ID NO: 279258 - DNA, 1409 bp, Homo sapiens
acaaagcggttggttgcggcagggactacaccggtgtatcatgggagcggcccgggctacacgttaaaaacactaaggggagcgcgcgaagctgaacttggcgctcgatgggggccgttagccgccctagagcgcgcggagccgcagaggcgtagctggactacaacgcagtgcatctcgggaggccaactcgactggactgggtgagaggacagaggtggctcgatgggcggcccgaaggccggggatcatggcgggaaggcgggcccagccaggttcagccccgccccgacccgccgctccccacccccggccggcctcgcgtgccttcccgcagcactgccgtccccgggatgctgagcgcccaccgtctccccgcagccccctcatgcccggctgcgagctgcccgtgggcacctgcccggacatgtgcccggccgccgagcgcgcccagcgcgaaagggagcaccgcctgcaccgcttggaggtggtgccgggttgccgccaggacccgccccgcgcggatccgcagcgcgcggtgaaggagtacagccgacccgccgccggcaagccccggcccccgcccagccagttgcgtccgccctccgtgctgctggccaccgtgcgctacctggccggtgaggtggcggagagcgccgacatcgcccgcgccgaggtggccagcttcgtggcagaccgcttgcgagctgtgcgcctggacctggcgctgcagggagcgggccccgccaacccgccttccagggcctctttctgctctataacctgggctcggtggaagccctgcatgaggttctacagctgcctgctgccctgcgcgcctgcccgcccctccgcaaggccttggcggtagatgctgccttccgagagggcaatgctgcccgcctgttccgtctgctccagaccctgccctacctgccaagttgcgctgtgcagtgccatgtgggccatgcccgccgggaagccctggcccgcttcgctcgtgcctttagcacccccaagggccagaccttgcctctgggcttcatggtcaacctcttggccctggatggactcagggaagcacgggacctgtgccaggcccacgggctgcccttggacggagaggagagagttgtgttcctgaggggtcgctacgtggaggaagggctaccgcctgccagtacgtgcaaggtgttagtggagagcaaacttcgaggacgtaccctggaggaggtggtcatggcagaggaggaagatgagggcacggacagacctgggtccccagcctgaggagggagcgtgagcctcccagagccccaggactgggccagagcacttaggtttctttttccatggtttccaggtaataaaaggaacttgttttgttggtaccaaaaacaagatgtgat

SEQ ID NO: 279259 - DNA, 1527 bp, Homo sapiens
acaaagcggttggttgcggcagggactacaccggtgtatcatgggagcggcccgggctacacgttaaaaacactaaggggagcgcgcgaagctgaacttggcgctcgatgggggccgttagccgccctagagcgcgcggagccgcagaggcgtagctggactacaacgcagtgcatctcgggaggccaactcgactggactgggtgagaggacagaggtggctcgatgggcggcccgaaggccggggatcatggcgggaaggcgggcccagccaggttcagccccgccccgacccgccgctccccacccccggccggcctcgcgtgccttcccgcagcactgccgtccccgggatgctgagcgcccaccgtctccccgcagccccctcatgcccggctgcgagctgcccgtgggcacctgcccggacatgtgcccggccgccgagcgcgcccagcgcgaaagggagcaccgcctgcaccgcttggaggtggtgccgggttgccgccaggacccgccccgcgcggatccgcagcgcgcggtgaaggagtacagccgacccgccgccggcaagccccggcccccgcccagccagttgcgtccgccctccgtgctgctggccaccgtgcgctacctggccggtgaggtggcggagagcgccgacatcgcccgcgccgaggtggccagcttcgtggcagaccgcttgcgagctgtgcgcctggacctggcgctgcagggagcgggcgacgccgaggcagcggtggtgctggaggcggcgctggccacgctgctggccgtagtggcgcggctcgggcccgacgcggcgcggggacccgcggacccggtgctgctgcaggcccaggtgcaggagggcttcggctcgctgcggcgctgctacgcgcggggcgccgggccgcacccccgccaacccgccttccagggcctctttctgctctataacctgggctcggtggaagccctgcatgaggttctacagctgcctgctgccctgcgcgctgcccgcctgttccgtctgctccagaccctgccctacctgccaagttgcgctgtgcagtgccatgtgggccatgcccgccgggaagccctggcccgcttcgctcgtgcctttagcacccccaagggccagaccttgcctctgggcttcatggtcaacctcttggccctggatggactcagggaagcacgggacctgtgccaggcccacgggctgcccttggacggagaggagagagttgtgttcctgaggggtcgctacgtggaggaagggctaccgcctgccagtacgtgcaaggtgttagtggagagcaaacttcgaggacgtaccctggaggaggtggtcatggcagaggaggaagatgagggcacggacagacctgggtccccagcctgaggagggagcgtgagcctcccagagccccaggactgggccagagcacttaggtttctttttccatggtttccaggtaataaaaggaacttgttttgttggtaccaaaaacaagatgtgat

SEQ ID NO: 279260 - DNA, 965 bp, Homo sapiens
acaaagcggttggttgcggcagggactacaccggtgtatcatgggagcggcccgggctacacgttaaaaacactaaggggagcgcgcgaagctgaacttggcgctcgatgggggccgttagccgccctagagcgcgcggagccgcagaggcgtagctggactacaacgcagtgcatctcgggaggccaactcgactggactggagatgggatctcgcatgttgccactcgaattcctgggctcaagtgatcctcctgccccaccctcccaagtagccgggtgtggccatcatgcccagtgaatggtttatttttgtccacactgttcctctgaagaaggcatggctcggtggaagccctgcatgaggttctacagctgcctgctgccctgcgcgcctgcccgcccctccgcaaggccttggcggtagatgctgccttccgagagggcaatgctgcccgcctgttccgtctgctccagaccctgccctacctgccaagttgcgctgtgcagtgccatgtgggccatgcccgccgggaagccctggcccgcttcgctcgtgcctttagcacccccaagggccagaccttgcctctgggcttcatggtcaacctcttggccctggatggactcagggaagcacgggacctgtgccaggcccacgggctgcccttggacggagaggagagagttgtgttcctgaggggtcgctacgtggaggaagggctaccgcctgccagtacgtgcaaggtgttagtggagagcaaacttcgaggacgtaccctggaggaggtggtcatggcagaggaggaagatgagggcacggacagacctgggtccccagcctgaggagggagcgtgagcctcccagagccccaggactgggccagagcacttaggtttctttttccatggtttccaggtaataaaaggaacttgttttgttggtaccaaaaacaagatgtgat

SEQ ID NO: 279261 - DNA, 1724 bp, Homo sapiens
acaaagcggttggttgcggcagggactacaccggtgtatcatgggagcggcccgggctacacgttaaaaacactaaggggagcgcgcgaagctgaacttggcgctcgatgggggccgttagccgccctagagcgcgcggagccgcagaggcgtagctggactacaacgcagtgcatctcgggaggccaactcgactggactgggtgagaggacagaggtggctcgatgggcggcccgaaggccggggatcatggcgggaaggcgggcccagccaggttcagccccgccccgacccgccgctccccacccccggccggcctcgcgtgccttcccgcagcactgccgtccccgggatgctgagcgcccaccgtctccccgcagccccctcatgcccggctgcgagctgcccgtgggcacctgcccggacatgtgcccggccgccgagcgcgcccagcgcgaaagggagcaccgcctgcaccgcttggaggtggtgccgggttgccgccaggacccgccccgcgcggatccgcagcgcgcggtgaaggagtacagccgacccgccgccggcaagccccggcccccgcccagccagttgcgtccgccctccgtgctgctggccaccgtgcgctacctggccggtgaggtggcggagagcgccgacatcgcccgcgccgaggtggccagcttcgtggcagaccgcttgcgagctgtgcgcctggacctggcgctgcagggagcgggcgacgccgaggcagcggtggtgctggaggcggcgctggccacgctgctggccgtagtggcgcggctcgggcccgacgcggcgcggggacccgcggacccggtgctgctgcaggcccaggtgcaggagggcttcggctcgctgcggcgctgctacgcgcggggcgccgggccgcacccccgccaacccgccttccagggcctctttctgctctataacctggagatgggatctcgcatgttgccactcgaattcctgggctcaagtgatcctcctgccccaccctcccaagtagccgggtgtggccatcatgcccagtgaatggtttatttttgtccacactgttcctctgaagaaggcatggctcggtggaagccctgcatgaggttctacagctgcctgctgccctgcgcgcctgcccgcccctccgcaaggccttggcggtagatgctgccttccgagagggcaatgctgcccgcctgttccgtctgctccagaccctgccctacctgccaagttgcgctgtgcagtgccatgtgggccatgcccgccgggaagccctggcccgcttcgctcgtgcctttagcacccccaagggccagaccttgcctctgggcttcatggtcaacctcttggccctggatggactcagggaagcacgggacctgtgccaggcccacgggctgcccttggacggagaggagagagttgtgttcctgaggggtcgctacgtggaggaagggctaccgcctgccagtacgtgcaaggtgttagtggagagcaaacttcgaggacgtaccctggaggaggtggtcatggcagaggaggaagatgagggcacggacagacctgggtccccagcctgaggagggagcgtgagcctcccagagccccaggactgggccagagcacttaggtttctttttccatggtttccaggtaataaaaggaacttgttttgttggtaccaaaaacaagatgtgat

SEQ ID NO: 279262 - DNA, 1406 bp, Homo sapiens
acaaagcggttggttgcggcagggactacaccggtgtatcatgggagcggcccgggctacacgttaaaaacactaaggggagcgcgcgaagctgaacttggcgctcgatgggggccgttagccgccctagagcgcgcggagccgcagaggcgtagctggactacaacgcagtgcatctcgggaggccaactcgactggactggccccctcatgcccggctgcgagctgcccgtgggcacctgcccggacatgtgcccggccgccgagcgcgcccagcgcgaaagggagcaccgcctgcaccgcttggaggtggtgccgggttgccgccaggacccgccccgcgcggatccgcagcgcgcggtgaaggagtacagccgacccgccgccggcaagccccggcccccgcccagccagttgcgtccgccctccgtgctgctggccaccgtgcgctacctggccggtgaggtggcggagagcgccgacatcgcccgcgccgaggtggccagcttcgtggcagaccgcttgcgagctgtgcgcctggacctggcgctgcagggagcgggcgacgccgaggcagcggtggtgctggaggcggcgctggccacgctgctggccgtagtggcgcggctcgggcccgacgcggcgcggggacccgcggacccggtgctgctgcaggcccaggtgcaggagggcttcggctcgctgcggcgctgctacgcgcggggcgccgggccgcacccccgccaacccgccttccagggcctctttctgctctataacctgggctcggtggaagccctgcatgaggttctacagctgcctgctgccctgcgcgcctgcccgcccctccgcaaggccttggcggtagatgctgccttccgagagggcaatgctgcccgcctgttccgtctgctccagaccctgccctacctgccaagttgcgctgtgcagtgccatgtgggccatgcccgccgggaagccctggcccgcttcgctcgtgcctttagcacccccaagggccagaccttgcctctgggcttcatggtcaacctcttggccctggatggactcagggaagcacgggacctgtgccaggcccacgggctgcccttggacggagaggagagagttgtgttcctgaggggtcgctacgtggaggaagggctaccgcctgccagtacgtgcaaggtgttagtggagagcaaacttcgaggacgtaccctggaggaggtggtcatggcagaggaggaagatgagggcacggacagacctgggtccccagcctgaggagggagcgtgagcctcccagagccccaggactgggccagagcacttaggtttctttttccatggtttccaggtaataaaaggaacttgttttgttggtaccaaaaacaagatgtgat

SEQ ID NO: 279263 - DNA, 1211 bp, Homo sapiens
taggctggtcgaggcctggttgtaatcggccgaggggatgctgagcgcccaccgtctccccgcagccccctcatgcccggctgcgagctgcccgtgggcacctgcccggacatgtgcccggccgccgagcgcgcccagcgcgaaagggagcaccgcctgcaccgcttggaggtggtgccgggttgccgccaggacccgccccgcgcggatccgcagcgcgcggtgaaggagtacagccgacccgccgccggcaagccccggcccccgcccagccagttgcgtccgccctccgtgctgctggccaccgtgcgctacctggccggtgaggtggcggagagcgccgacatcgcccgcgccgaggtggccagcttcgtggcagaccgcttgcgagctgtgcgcctggacctggcgctgcagggagcgggcgacgccgaggcagcggtggtgctggaggcggcgctggccacgctgctggccgtagtggcgcggctcgggcccgacgcggcgcggggacccgcggacccggtgctgctgcaggcccaggtgcaggagggcttcggctcgctgcggcgctgctacgcgcggggcgccgggccgcacccccgccaacccgccttccagggcctctttctgctctataacctgggctcggtggaagccctgcatgaggttctacagctgcctgctgccctgcgcgctgcccgcctgttccgtctgctccagaccctgccctacctgccaagttgcgctgtgcagtgccatgtgggccatgcccgccgggaagccctggcccgcttcgctcgtgcctttagcacccccaagggccagaccttgcctctgggcttcatggtcaacctcttggccctggatggactcagggaagcacgggacctgtgccaggcccacgggctgcccttggacggagaggagagagttgtgttcctgaggggtcgctacgtggaggaagggctaccgcctgccagtacgtgcaaggtgttagtggagagcaaacttcgaggacgtaccctggaggaggtggtcatggcagaggaggaagatgagggcacggacagacctgggtccccagcctgaggagggagcgtgagcctcccagagccccaggactgggccagagcacttaggtttctttttccatggtttccaggtaataaaaggaacttgttttgttggtaccaaaaacaagatgtgat

SEQ ID NO: 279264 - DNA, 749 bp, Homo sapiens
gcctcctgagtagctgagactacaagcatgttgccaacacgcctgtctcattttggcattataatatttttagtggagatgaggtttcgccatgttggccaggctggtctcaaactcctggcctcaaaattgagttttatttattagattgccaaattttatgacaaatggtcacacccactgttggagagggtacaaagatatgagcactcatataatggaggaattgaagccatttaaatgacattagtgaagaatgttggtggcataaatttttaaatgagtgaccttttttgattttcttttttaaatttatatatacacagaaaagagtgaataaataaacaccagaaatgtagaaattattgctgggtgattaagtgtggttttgtttttggtttcaatataatggccatgtatttgaggattggggtaacaaggtaggaggagatacttctttttacgtaaaatttggcaagtttttaatctaatttactagttatataaactgtaattttcatttagaaagaaaaaaaaaaacaaaggaaacaagtgcatcatcatgctcagcctgagtcagaaagcagcagcacggattggcttcttgtagccttgagatgggaacacagagtggtcttcagtctactcggaataactttcttcattgaaatattttcattgacttacttttttcatttcctcataatattgtctctttataaattatcccaaaattaaattaacatctg

SEQ ID NO: 279265 - DNA, 313 bp, Homo sapiens
cggacgcgtgggaaacactgtagatgtacaggaggtctccttttttctggacaatttaaaaggaaacactgtagatgtacagaaaaaaggtgtgttcttcataagcttcagtgcaggatttttcaaagacgagctgttgtgcaatttgctgtatttaatgcatgttctgaaaggattcacttttgactttatatgacagttgatcaagaacaggtactacccctttttttcatttcaaacttgaaactgtgaataaggtaagaaaactattttgaataaataaactatttatttaaaatgtcaaaaaaaaatt

SEQ ID NO: 279266 - DNA, 2806 bp, Homo sapiens
gatgaaagttatagtgaagaggaggaagagatgcccgacagtgatgaaaatggatcctatagcaccagctctgatccatcagatgatagcaaagcagtagctataatcaagtctgttggagaactatcagtaccagaaaaatacaaatctattcatcaaatcagacccagttgtgcatttccagtttgccatgacacagaagagcgctgtagacttgtgcttagctatgttctagagggtttaaaatctgtcgatagcagcatcaaaaaagaaagcgaccttccagcagctgaccccagcactccaatcccgttaaaatatgaagatgaatcctcaagagggggtcccgaggggctagagaagcagatggccttgtttttggacaaaatgggctcccttcagaagggcaattattccagtcaatctggaatgatccctggctcttggcaacataaaatgaaacttcagctgattctcaagtcatcaaaggcctattatgttttgtccgatgctgccatgagtcttcagaaatacggaagagcattacgatacattaaattagctttgcaaagccatgatacttattgctgcctctgcaccaatatgctttccgaagtgctgttgtttctctctcaatatttgacactttgtggtgatatccaactaatgctggcccagaatgcaaataatagagcagcacaccttgaagagtttcattaccaaacaaaagaagaccaggagatcctgcatagccttcacagagagtccagttgccaaggatttgcatgggcaactgatttgtctacagacttagaaagtcaactctctgttagttgtaaatgttatgaggctgctaatgaaatcttgcagtttagtgacttgaaaagccaaaatccagaacactatgtacaagtattaaagagaatgggtaacattagaaatgaaattggtgtgttttacatgaatcaggctgctgcattacagagtgagagactagtgagcaaatctgtgtctgctgccgagcaacagttgtggaaaaaaagcttttcttgttttgaaaagggaattcacaactttgaatcaattgaggatgccaccaatgccgcccttttattatgtaacacgggaaggctcatgcggatttgtgcgcaggcccactgtggtgcaggggatgaactgaaacgtgaattttcaccagaagaaggcttgtattataataaggctattgattactatttgaaagcgctaaggtcattgggaacacgagacatacacccagctgtttgggattcagtgaactgggaattgtccactacttactttactatggcaactctacagcaagattatgctccgttatctagaaaagctcaggagcagattgagaaagaagtcagtgaggccatgatgaagtccctaaaatactgcgatgtggattcagtgtctgctcgacagcccctttgtcagtatcgagctgcaaccatccatcacaggctggcctccatgtaccacagctgtctgaggaatcaggttggtgatgaacaccttaggaaacaacaccgggtgctggcagatcttcattacagcaaggccgcaaagctgtttcagctgctgaaagatgctccctgcgaactgcttagagtacagctagagagagtagcatttgctgaatttcagatgaccagtcagaatagcaatgttggaaagttgaaaacactatctggggctcttgatataatggtgagaactgagcacgcattccagcttatccagaaggagcttatagaagaatttggccagcctaagagtggtgacgccgctgcagctgctgatgcttctcctagtctcaatcgagaagaagtgatgaaactcctcagtatatttgagtctcggttgtcatttcttctccttcagtccattaaactgctatcttcaactaaaaagaaaacaagcaataacatcgaagatgacacaattctcaaaaccaacaagcacatttactcccagcttttgagagcaactgcaaataaaaccgcgactcttctggaaagaatcaacgttatcgtccacctgctgggccagcttgccgccggcagtgcagcgagcagcaatgccgttcagtgactgcacagagccgtgtcccagacacgctgtcagtgccttcaacacggagccggtttgttcattcggtgctttgtttcattaaataatagggaaatatccatttaaaacaggtatatcagtggaaacacagagttattttaagtgacagacaaattacggttgagttctgtggcttcttcacttgaagtgctaacatcagaatcaaacttaaagcttccactatttatgtctttgagaagtatgtagtacctcggtattaacagacctgctgtgatgcagttacactttcacgtatttttgaagtatgtcaagctacacgggtctaagatatgattattttggataaaatgttactttggtcaagagaacttttatccagatgacattacaggttcaagtgggttaaggagacctcctgtacatctacagtgtttccttttaaattgtccagaaaaaaggtgtgttcttcataagcttcagtgcaggatttttcaaagacgagctgttgtgcaatttgctgtatttaatgcatgttctgaaaggattcacttttgactttatatgacagttgatcaagaacaggtactacccctttttttcatttcaaacttgaaactgtgaataaggtaagaaaactattttgaataaataaactatttatttaaaatgtcaaaaaaaaatt

SEQ ID NO: 279267 - DNA, 1406 bp, Homo sapiens
ctaaatataaaagctaaaactaataagacctagtaagacccacagtgggggaaaaataactaagaagcacttagtgaagcctgaagtagttaccgtgaaggatttgttgcttgttttggtttggttctaggttggtgatgaacaccttaggaaacaacaccgggtgctggcagatcttcattacagcaaggccgcaaagctgtttcagctgctgaaagatgctccctgcgaactgcttagagtacagctagagagagtagcatttgctgaatttcagatgaccagtcagaatagcaatgttggaaagttgaaaacactatctggggctcttgatataatggtgagaactgagcacgcattccagcttatccagaaggagcttatagaagaatttggccagcctaagagtggtgacgccgctgcagctgctgatgcttctcctagtctcaatcgagaagaagtgatgaaactcctcagtatatttgagtctcggttgtcatttcttctccttcagtccattaaactgctatcttcaactaaaaagaaaacaagcaataacatcgaagatgacacaattctcaaaaccaacaagcacatttactcccagcttttgagagcaactgcaaataaaaccgcgactcttctggaaagaatcaacgttatcgtccacctgctgggccagcttgccgccggcagtgcagcgagcagcaatgccgttcagtgactgcacagagccgtgtcccagacacgctgtcagtgccttcaacacggagccggtttgttcattcggtgctttgtttcattaaataatagggaaatatccatttaaaacaggtatatcagtggaaacacagagttattttaagtgacagacaaattacggttgagttctgtggcttcttcacttgaagtgctaacatcagaatcaaacttaaagcttccactatttatgtctttgagaagtatgtagtacctcggtattaacagacctgctgtgatgcagttacactttcacgtatttttgaagtatgtcaagctacacgggtctaagatatgattattttggataaaatgttactttggtcaagagaacttttatccagatgacattacaggttcaagtgggttaaggagacctcctgtacatctacagtgtttccttttaaattgtccagaaaaaaggtgtgttcttcataagcttcagtgcaggatttttcaaagacgagctgttgtgcaatttgctgtatttaatgcatgttctgaaaggattcacttttgactttatatgacagttgatcaagaacaggtactacccctttttttcatttcaaacttgaaactgtgaataaggtaagaaaactattttgaataaataaactatttatttaaaatgtcaaaaaaaaatt

SEQ ID NO: 279268 - DNA, 2290 bp, Homo sapiens
gatgaaagttatagtgaagaggaggaagagatgcccgacagtgatgaaaatggatcctatagcaccagctctgatccatcagatgatagcaaagcagtagctataatcaagtctgttggagaactatcagtaccagaaaaatacaaatctattcatcaaatcagacccagttgtgcatttccagtttgccatgacacagaagagcgctgtagacttgtgcttagctatgttctagagggtttaaaatctgtcgatagcagcatcaaaaaagaaagcgaccttccagcagctgaccccagcactccaatcccgttaaaatatgaagatgaatcctcaagagggggtcccgaggggctagagaagcagatggccttgtttttggacaaaatgggctcccttcagaagggcaattattccagtcaatctggaatgatccctggctcttggcaacataaaatgaaacttcagctgattctcaagtcatcaaaggcctattatgttttgtccgatgctgccatgagtcttcagaaatacggaagagcattacgatacattaaattagctttgcaaagccatgatacttattgctgcctctgcaccaatatgctttccgaagtgctgttgtttctctctcaatatttgacactttgtggtgatatccaactaatgctggcccagaatgcaaataatagagcagcacaccttgaagagtttcattaccaaacaaaagaagaccaggagatcctgcatagccttcacagagagtccagttgccaaggatttgcatgggcaactgatttgtctacagacttagaaagtcaactctctgttagttgtaaatgttatgaggctgctaatgaaatcttgcagtttagtgacttgaaaagccaaaatccagaacactatgtacaagtattaaagagaatgggtaacattagaaatgaaattggtgtgttttacatgaatcaggctgctgcattacagagtgagagactagtgagcaaatctgtgtctgctgccgagcaacagttgtggaaaaaaagcttttcttgttttgaaaagggaattcacaactttgaatcaattgaggatgccaccaatgccgcccttttattatgtaacacgggaaggctcatgcggatttgtgcgcaggcccactgtggtgcaggggatgaactgaaacgtgaattttcaccagaagaaggcttgtattataataaggctattgattactatttgaaagcgctaaggtcattgggaacacgagacatacacccagctgtttgggattcagtgaactgggaattgtccactacttactttactatggcaactctacagcaagattatgctccgttatctagaaaagctcaggagcagattgagaaagaagtcagtgaggccatgatgaagtccctaaaatactgcgatgtggattcagtgtctgctcgacagcccctttgtcagtatcgagctgcaaccatccatcacaggctggcctccatgtaccacagctgtctgaggaatcaggttggtgatgaacaccttaggaaacaacaccgggtgctggcagatcttcattacagcaaggccgcaaagctgtttcagctgctgaaagatgctccctgcgaactgcttagagtacagctagagagagtagcatttgctgaatttcagatgaccagtcagaatagcaatgttggaaagttgaaaacactatctggggctcttgatataatggtgagaactgagcacgcattccagcttatccagaaggagcttatagaagaatttggccagcctaagagtggtgacgccgctgcagctgctgatgcttctcctagtctcaatcgagaagaagtgatgaaactcctcagtatatttgagtctcggttgtcatttcttctccttcagtccattaaactgctatcttcaactaaaaagaaaacaagcaataacatcgaagatgacacaattctcaaaaccaacaagcacatttactcccagcttttgagagcaactgcaaataaaaccgcgactcttctggaaagaatcaacgttatcgtccacctgctgggccagcttgccgccggcagtgcagcgagcagcaatgccgttcagtgactgcacagagccgtgtcccagacacgctgtcagtgccttcaacacggagccgttgatcaagaacaggtactacccctttttttcatttcaaacttgaaactgtgaataaggtaagaaaactattttgaataaataaactatttatttaaaatgtcaaaaaaaaatt

SEQ ID NO: 279269 - DNA, 1445 bp, Homo sapiens
gatgaaagttatagtgaagaggaggaagagatgcccgacagtgatgaaaatggatcctatagcaccagctctgatccatcagatgatagcaaagcagtagctataatcaagtctgttggagaactatcagtaccagaaaaatacaaatctattcatcaaatcagacccagttgtgcatttccagtttgccatgacacagaagagcgctgtagacttgtgcttagctatgttctagagggtttaaaatctgtcgatagcagcatcaaaaaagaaagcgaccttccagcagctgaccccagcactccaatcccgttaaaatatgaagatgaatcctcaagagggggtcccgaggggctagagaagcagatggccttgtttttggacaaaatgggctcccttcagaagggcaattattccagtcaatctggaatgatccctggctcttggcaacataaaatgaaacttcagctgattctcaagtcatcaaaggcctattatgttttgtccgatgctgccatgagtcttcagaaatacggaagagcattacgatacattaaattagctttgcaaagccatgatacttattgctgcctctgcaccaatatgctttccgaagtgctgttgtttctctctcaatatttgacactttgtggtgatatccaactaatgctggcccagaatgcaaataatagagcagcacaccttgaagagtttcattaccaaacaaaagaagaccaggagatcctgcatagccttcacagagagtccagttgccaaggatttgcatgggcaactgatttgtctacagacttagaaagtcaactctctgttagttgtaaatgttatgaggctgctaatgaaatcttgcagtttagtgacttgaaaagccaaaatccagaacactatgtacaagtattaaagagaatgggtaacattagaaatgaaattggtgtgttttacatgaatcaggctgctgcattacagagtgagagactagtgagcaaatctgtgtctgctgccgagcaacagttgtggaaaaaaagcttttcttgttttgaaaagggaattcacaactttgaatcaattgaggatgccaccaatgccgcccttttattatgtaacacgggaaggctcatgcggatttgtgcgcaggcccactgtggtgcaggggatgaactgaaacgtgaattttcaccagaagaaggcttgtattataataagaaagaaaaaaaaaaacaaaggaaacaagtgcatcatcatgctcagcctgagtcagaaagcagcagcacggattggcttcttgtagccttgagatgggaacacagagtggtcttcagtctactcggaataactttcttcattgaaatattttcattgacttacttttttcatttcctcataatattgtctctttataaattatcccaaaattaaattaacatctg

SEQ ID NO: 279270 - DNA, 497 bp, Homo sapiens
cccggctccactgcattttcttcatggccgtccgtctgtcactctcttgtttactatggtttcccccagtgcctcccctcccctcccccaaactcctacctcaataggatgcaaattccataaggcaggggcttctttttgcctgttttgttctctgtcaagagcaattcctagtacataataggcattcaaatatttataaaaggaatgagtactggatttcattgatgtattgaaataaatgtgtagaaacaggcccatgagcaatatgtaaaagaaggcaggtctgaacccggcaggagaggaatgcctgctgctctgtgaagagtgactgttgggctgtcactgtccggttttctggacctctgaattgtcggtaggcattgctggtcccttacctgtctctttttcttttttaaccctagcaataacatcgaagatgacacaattctcaaaaccaacaagcacatttactcccagcttttgagagcaactgc

SEQ ID NO: 279271 - DNA, 1253 bp, Homo sapiens
gatgaaagttatagtgaagaggaggaagagatgcccgacagtgatgaaaatggatcctatagcaccagctctgatccatcagatgatagcaaagcagtagctataatcaagtctgttggagaactatcagtaccagaaaaatacaaatctattcatcaaatcagacccagttgtgcatttccagtttgccatgacacagaagagcgctgtagacttgtgcttagctatgttctagagggtttaaaatctgtcgatagcagcatcaaaaaagaaagcgaccttccagcagctgaccccagcactccaatcccgttaaaatatgaagatgaatcctcaagagggggtcccgaggggctagagaagcagatggccttgtttttggacaaaatgggctcccttcagaagggcaattattccagtcaatctggaatgatccctggctcttggcaacataaaatgaaacttcagctgattctcaagtcatcaaaggcctattatgttttgtccgatgctgccatgagtcttcagaaatacggaagagcattacgatacattaaattagctttgcaaagccatgatacttattgctgcctctgcaccaatatgctttccgaagtgctgttgtttctctctcaatatttgacactttgtggtgatatccaactaatgctggcccagaatgcaaataatagagcagcacaccttgaagagtttcattaccaaacaaaagaagaccaggagatcctgcatagccttcacagagagtccagttgccaaggtgtgccacaggcttggaccacgtggttcacagtgggactgtgcagtctagctcatgcttatttgagtattcagaaaaggggtagaaatattagagttttgatatttgctctgtatttatttatttattttttgagacggagtttcgctcttgttgcccaagctggagtgcaatggtgcaatcttggctcactgaaacctccgcctcccgggttcaagcaattctcctgcctcagcctcccaagtagctggaattacaggcatgcgccaccatgcccggctagcccaccttggcctcccaaggtgctgggattacaggtgtgagccaccacgcctggcctgctgttttattcatttcctaattttaagattaagcatgatcttgtgtatttgtataaaatggtttttaagtattttataattactgtttatataactagaactaaatataaagtaagatatgaagacagttgtgt

SEQ ID NO: 279272 - DNA, 2733 bp, Homo sapiens
taatgcttacagtaatttaatcttcaacaaaaacaatatgttgaccttaatacattggtagtgtattaataattttatgtttgttcctcaagcccagttgtgcatttccagtttgccatgacacagaagagcgctgtagacttgtgcttagctatgttctagagggtttaaaatctgtcgatagcagcatcaaaaaagaaagcgaccttccagcagctgaccccagcactccaatcccgttaaaatatgaagatgaatcctcaagagggggtcccgaggggctagagaagcagatggccttgtttttggacaaaatgggctcccttcagaagggcaattattccagtcaatctggaatgatccctggctcttggcaacataaaatgaaacttcagctgattctcaagtcatcaaaggcctattatgttttgtccgatgctgccatgagtcttcagaaatacggaagagcattacgatacattaaattagctttgcaaagccatgatacttattgctgcctctgcaccaatatgctttccgaagtgctgttgtttctctctcaatatttgacactttgtggtgatatccaactaatgctggcccagaatgcaaataatagagcagcacaccttgaagagtttcattaccaaacaaaagaagaccaggagatcctgcatagccttcacagagagtccagttgccaaggatttgcatgggcaactgatttgtctacagacttagaaagtcaactctctgttagttgtaaatgttatgaggctgctaatgaaatcttgcagtttagtgacttgaaaagccaaaatccagaacactatgtacaagtattaaagagaatgggtaacattagaaatgaaattggtgtgttttacatgaatcaggctgctgcattacagagtgagagactagtgagcaaatctgtgtctgctgccgagcaacagttgtggaaaaaaagcttttcttgttttgaaaagggaattcacaactttgaatcaattgaggatgccaccaatgccgcccttttattatgtaacacgggaaggctcatgcggatttgtgcgcaggcccactgtggtgcaggggatgaactgaaacgtgaattttcaccagaagaaggcttgtattataataaggctattgattactatttgaaagcgctaaggtcattgggaacacgagacatacacccagctgtttgggattcagtgaactgggaattgtccactacttactttactatggcaactctacagcaagattatgctccgttatctagaaaagctcaggagcagattgagaaagaagtcagtgaggccatgatgaagtccctaaaatactgcgatgtggattcagtgtctgctcgacagcccctttgtcagtatcgagctgcaaccatccatcacaggctggcctccatgtaccacagctgtctgaggaatcaggttggtgatgaacaccttaggaaacaacaccgggtgctggcagatcttcattacagcaaggccgcaaagctgtttcagctgctgaaagatgctccctgcgaactgcttagagtacagctagagagagtagcatttgctgaatttcagatgaccagtcagaatagcaatgttggaaagttgaaaacactatctggggctcttgatataatggtgagaactgagcacgcattccagcttatccagaaggagcttatagaagaatttggccagcctaagagtggtgacgccgctgcagctgctgatgcttctcctagtctcaatcgagaagaagtgatgaaactcctcagtatatttgagtctcggttgtcatttcttctccttcagtccattaaactgctatcttcaactaaaaagaaaacaagcaataacatcgaagatgacacaattctcaaaaccaacaagcacatttactcccagcttttgagagcaactgcaaataaaaccgcgactcttctggaaagaatcaacgttatcgtccacctgctgggccagcttgccgccggcagtgcagcgagcagcaatgccgttcagtgactgcacagagccgtgtcccagacacgctgtcagtgccttcaacacggagccggtttgttcattcggtgctttgtttcattaaataatagggaaatatccatttaaaacaggtatatcagtggaaacacagagttattttaagtgacagacaaattacggttgagttctgtggcttcttcacttgaagtgctaacatcagaatcaaacttaaagcttccactatttatgtctttgagaagtatgtagtacctcggtattaacagacctgctgtgatgcagttacactttcacgtatttttgaagtatgtcaagctacacgggtctaagatatgattattttggataaaatgttactttggtcaagagaacttttatccagatgacattacaggttcaagtgggttaaggagacctcctgtacatctacagtgtttccttttaaattgtccagaaaaaaggtgtgttcttcataagcttcagtgcaggatttttcaaagacgagctgttgtgcaatttgctgtatttaatgcatgttctgaaaggattcacttttgactttatatgacagttgatcaagaacaggtactacccctttttttcatttcaaacttgaaactgtgaataaggtaagaaaactattttgaataaataaactatttatttaaaatgtcaaaaaaaaatt

SEQ ID NO: 279273 - DNA, 1932 bp, Homo sapiens
gatgaaagttatagtgaagaggaggaagagatgcccgacagtgatgaaaatggatcctatagcaccagctctgatccatcagatgatagcaaagcagtagctataatcaagtctgttggagaactatcagtaccagaaaaatacaaatctattcatcaaatcagacccagttgtgcatttccagtttgccatgacacagaagagcgctgtagacttgtgcttagctatgttctagagggtttaaaatctgtcgatagcagcatcaaaaaagaaagcgaccttccagcagctgaccccagcactccaatcccgttaaaatatgaagatgaatcctcaagagggggtcccgaggggctagagaagcagatggccttgtttttggacaaaatgggctcccttcagaagggcaattattccagtcaatctggaatgatccctggctcttggcaacataaaatgaaacttcagctgattctcaagtcatcaaaggcctattatgttttgtccgatgctgccatgagtcttcagaaatacggaagagcattacgatacattaaattagctttgcaaagccatgatacttattgctgcctctgcaccaatatgctttccgaagtgctgttgtttctctctcaatatttgacactttgtggtgatatccaactaatgctggcccagaatgcaaataatagagcagcacaccttgaagagtttcattaccaaacaaaagaagaccaggagatcctgcatagccttcacagagagtccagttgccaaggatttgcatgggcaactgatttgtctacagacttagaaagtcaactctctgttagttgtaaatgttatgaggctgctaatgaaatcttgcagtttagtgacttgaaaagccaaaatccagaacactatgtacaagtattaaagagaatgggtaacattagaaatgaaattggtgtgttttacatgaatcaggctgctgcattacagagtgagagactagtgagcaaatctgtgtctgctgccgagcaacagttgtggaaaaaaagcttttcttgttttgaaaagggaattcacaactttgaatcaattgaggatgccaccaatgccgcccttttattatgtaacacgggaaggctcatgcggatttgtgcgcaggcccactgtggtgcaggggatgaactgaaacgtgaattttcaccagaagaaggcttgtattataataaggctattgattactatttgaaagcgctaaggtcattgggaacacgagacatacacccagctgtttgggattcagtgaactgggaattgtccactacttactttactatggcaactctacagcaagattatgctccgttatctagaaaagctcaggagcagattgagaaagaagtcagtgaggccatgatgaagtccctaaaatactgcgatgtggattcagtgtctgctcgacagcccctttgtcagtatcgagctgcaaccatccatcacaggctggcctccatgtaccacagctgtctgaggaatcaggttggtgatgaacaccttaggaaacaacaccgggtgctggcagatcttcattacagcaaggccgcaaagctgtttcagctgctgaaagatgctccctgcgaactgcttagagtacagctagagagagtagcatttgctgaatttcagatgaccagtaagtcttaattttcatttctcagatatgtatgcattggcttagtgctggattgtcttagagtaaggcaggcctgtgaatctaaataatactattttctttttaatttgccccatagttaatgacttcgggtagagagggtgagaaatcactacatgttttgaagtgctttttaaaacttagaggaatgtattagattatgttcagtgactagaaatactgagatatggcccatgacccctagtttg

SEQ ID NO: 279274 - DNA, 725 bp, Homo sapiens
ggctgatggtttcagctagataagactggaagacagcaaggacttggaaatgtactcacagaccctcctacccgtgataactgacttcagagcacaccttcattcccacctttctatattttaacatgggattgagactgggacagaggttaacaaggcatctcaagccaatcaagaactagatgcacataactgcatttgatggggaagtaaaaattactacaaatttaaaaaaaagtgtatatacgttcaccaagtagctataattctagggtcttatttttaaggaaaaaaaaatgcattaaaggtagaaaaggagaaacataggtggagggagaggaagaaagctggagaggaaggcattttgaacatctatcactattatattaggaacttcacatgaaccatctcatttacctctcacaaaatctatgagattgagacaatgctgcttattatggcatcgttaatcatagtgaaaaattgaaaacagccttcttgtatactgctaagaaaactggggccttaagtgggtgcaaatgtttgtctaaaccaatacattgactgctctacaagaaaatgctggtgtggtccttcagatattctgccagggttctccactgagtgaactcaaccagaagccaaaggacatggaaacccattgatgtccctcccaggacaaggtggatgaacagaaattgatctgaaaggacaaatggaagaaa

SEQ ID NO: 279275 - DNA, 661 bp, Homo sapiens
tggttttgaaaaactaagagtcctcggagcaggggtctgcagtctggtgaaagcaggttgcatcctggcgccttgggctgtccagaccgtgtctctcggtactctctcataaataacaatagaataattacgaaggcgagagagctttcggaactggaatggcctgagcatggcgcttgttctggaaccagacgcggatgacccgcgggctcaggccggtcatctccaccagctgctccttcatgagagcgtcgggccgcgggttggcggcgtagcaggtccgcagagtgtgcagctgcttctcgttcagcacagtccgcacgcgggtcgtcttctccgtctgcttgtgcacgtgcgggcgcaacgcgggctgccggcccgacccagcgtctgccaggacaggtcgcaggaccctcggaacgagcgaagccctccggaagaagtcggagtttcagaggaagaggaaagaggcttgcccaggactctggagagggaaagggaccgacgtggacccagggcgaggcgctgcccagggactgggtgggaggtgcgaatatgccgggggcctacgagggcccttcccctccttcagagcccatttggacagggccaggccacatgtgtagaagactcatccacggttatggacgggcctccaggg

SEQ ID NO: 279276 - DNA, 427 bp, Homo sapiens
ttcagaagctgttcgatggcaacgtggcggacatggagctgtgaggccaaagaatctttttcttgcacttggttgtcccagcatcagctattgaggctgataagcaaaagggagctgctatgcaatttcaggattggtgccgacatcttcacctgtgctcacactgtctgcttccactcactcataatcctgttctctctcttgaaagaaaggctaattaggataaatatgctagtctgccttacttggatggtggaagaacagagagcagtgttagaatcactgtttcattaccagctgacatctgcatggttcttctgggtaaggaccagcaacaagactgtcttgtgtgtgtcctttttcttcctagctcctcccatctctctgattaacaccaatccaataaaaatttctcaaaactatatta

SEQ ID NO: 279277 - DNA, 388 bp, Homo sapiens
agtgacttctcacaagatatggttgtttaaaagttgtcccagcatcagctattgaggctgataagcaaaagggagctgctatgcaatttcaggattggtgccgacatcttcacctgtgctcacactgtctgcttccactcactcataatcctgttctctctcttgaaagaaaggctaattaggataaatatgctagtctgccttacttggatggtggaagaacagagagcagtgttagaatcactgtttcattaccagctgacatctgcatggttcttctgggtaaggaccagcaacaagactgtcttgtgtgtgtcctttttcttcctagctcctcccatctctctgattaacaccaatccaataaaaatttctcaaaactatatta

SEQ ID NO: 279278 - DNA, 2201 bp, Homo sapiens
ccccaaaccttacccgggaagcaggagaaccagatgaggcgttacgcaaggcctggtgtttacctcccgtgggagcctcctccctccctataaagcctgatgtggtggagagatttgacgagactgagactctggttgaagagagaggcaatcccaggagaggggcggaaagcggcaaaagttaatgcgggagtcggagagaagggcatctacacagcaagcagcaggggcggcccgccatctgcgcgctcgaaggcggtcacggtggtcgcggaaggggcggcgtccagatcctggctttccatggatgcgcccgagctgggcccggggctggtggagcgtctggagcagctggcgacgtgtcctctgtgcgggggctccttcgaggacccggtgcttctggcgtgcgagcacagcttctgccgcgcgtgtctggcccgccgctgggggactccgccggcgaccggcaccgaggcttcccccaccgcctgtccctgctgcggcctgccgtgtccccgccgcagcctgaggtctaatgtgcggctggcggtggaggtgcgaatcagccgcgagctgcgagagaagctggctgagcctggggcccgtgcggggagacgccgaggggggcgcatccccaccatgggctgcctggacctgcccggagaggatatgaggaagacatggagacgatttgaagtcccaacatccaagtcatctaattcagaggatgatctccctgaagattatccagtggtcaaaaaaatgcttcatagactgacagccgacctgaccctggaccctgggaccgcacaccgccgcctgctcatctccgccgaccgccgcagcgtacaactggccccaccagggacgcccgcgccccctgacggccccaagcgcttcaatcagctcccagctgtgctgggtgcgcagggcttcggggccggccgccactgctgggaggtggagactgcggacgccgcctcctgcagagactcttctggggaggatgcggacgacgaggagagccactatgcagtgggcgcggccggggaatcagtgcaacgcaagggctgcgtaaggctgtgccctgcgggggccgtgtgggccgtggagggccgcggcggccgcctgtgggccctcacggcacccgaacccaccctgctgggcggtgttgagcccccgccgcggcgcattcgcgtggacctggactgggagcggggccgcgtggccttctacgacggccgctcactcgacctgctttacgccttccaggcgcctggccccctgggggagcgcatcttcccgctgttctgcacctgcgaccctcgtgctccgctccgcattgtaccagcggaaagctgagtctcgtctccaactagaagtttggcccggccactggccctgcagctgctttttgggggtggaattccccactcatttctgggaacacattcacacgcccattgcaggagtattaatagcaacccacattttcgccccaaaataatgagacctcacctggtctccacgtttccacgtccctgctcaaaaccaaatccattcctgccttctggctctcagaatcttctctcccctacagctactacagtacttcctgacttctcccattcaaaccattctagctgcaatggggaacaggccctccccatcagtattggtaaagtgaccatgattcctacatagaggctctgctggtcaaatacttgactcccactcttgccactcctagctccagaagggctcagggccttccccacagatctaaggactgggctaccctgcctgtccactgaggtttctcctaaaacaagaggcttgactctggtctgggccctgtggccctctgggaagctttgtacctcttttgcaggatctgggggtggggagggacaagctagttccccaacctcctatgactgctttctatgctcacagccttttttccataagaaccttcttgaaacttctccccgcacatactcacggaaaggaaccaatggtgctatttcccctctctcctcctcaacctgggaatacttcagacatctccaaactcatccttgtgtatagtctcacacccttccccataagtataaatgggcccatatttaacacattttgtgattttgggttatttattttgtgcatctgtggcaataaatgagatctcagtggtggta

SEQ ID NO: 279279 - DNA, 2064 bp, Homo sapiens
tattgcaagaggggaagcagctttattgtaaggcttttatataccaactcttagcccgagggctctgggtgtgtgtttggtctgtgtgatggagggaggaagggacagatgtttttctgggatgcactggggaaggtagataaggatggggccgctgaaagagacagagaatgggactgaggaggcagcaaggaaggcaagggctctgaggacaagaaacagtcatggacgagcctgggaaaagagaattgagaacccttggggagtggaaagggagaggacagtggggatggagttaggaggatgagggaaaagtgatggggtgagaggaaggagggatcatgaaaggtgaaggaggagaatgagagggaaaggagcacagtgtgtaaagaggtgagatcactctgaaaggtgaggagggacactgctaactcagacagaactcacctgaggaggggagagatagggaaggatgccccagggaatgaagcccagagctcacatccatgtttgtttctgcccatcctaggatatgaggaagacatggagacgatttgaagtcccaacatccaagtcatctaattcagaggatgatctccctgaagattatccagtggtcaaaaaaatgcttcatagactgacagccgacctgaccctggaccctgggaccgcacaccgccgcctgctcatctccgccgaccgccgcagcgtacaactggccccaccagggacgcccgcgccccctgacggccccaagcgcttcaatcagctcccagctgtgctgggtgcgcagggcttcggggccggccgccactgctgggaggtggagactgcggacgccgcctcctgcagagactcttctggggaggatgcggacgacgaggagagccactatgcagtgggcgcggccggggaatcagtgcaacgcaagggctgcgtaaggctgtgccctgcgggggccgtgtgggccgtggagggccgcggcggccgcctgtgggccctcacggcacccgaacccaccctgctgggcggtgttgagcccccgccgcggcgcattcgcgtggacctggactgggagcggggccgcgtggccttctacgacggccgctcactcgacctgctttacgccttccaggcgcctggccccctgggggagcgcatcttcccgctgttctgcacctgcgaccctcgtgctccgctccgcattgtaccagcggaaagctgagtctcgtctccaactagaagtttggcccggccactggccctgcagctgctttttgggggtggaattccccactcatttctgggaacacattcacacgcccattgcaggagtattaatagcaacccacattttcgccccaaaataatgagacctcacctggtctccacgtttccacgtccctgctcaaaaccaaatccattcctgccttctggctctcagaatcttctctcccctacagctactacagtacttcctgacttctcccattcaaaccattctagctgcaatggggaacaggccctccccatcagtattggtaaagtgaccatgattcctacatagaggctctgctggtcaaatacttgactcccactcttgccactcctagctccagaagggctcagggccttccccacagatctaaggactgggctaccctgcctgtccactgaggtttctcctaaaacaagaggcttgactctggtctgggccctgtggccctctgggaagctttgtacctcttttgcaggatctgggggtggggagggacaagctagttccccaacctcctatgactgctttctatgctcacagccttttttccataagaaccttcttgaaacttctccccgcacatactcacggaaaggaaccaatggtgctatttcccctctctcctcctcaacctgggaatacttcagacatctccaaactcatccttgtgtatagtctcacacccttccccataagtataaatgggcccatatttaacacattttgtgattttgggttatttattttgtgcatctgtggcaataaatgagatctcagtggtggta

SEQ ID NO: 279280 - DNA, 949 bp, Homo sapiens
tattgcaagaggggaagcagctttattgtaaggcttttatataccaactcttagcccgagggctctgggtgtgtgtttggtctgtgtgatggagggaggaagggacagatgtttttctgggatgcactggggaaggtagataaggatggggccgctgaaagagacagagaatgggactgaggaggcagcaaggaaggcaagggctctgaggacaagaaacagtcatggacgagcctgggaaaagagaattgagaacccttggggagtggaaagggagaggacagtggggatggagttaggaggatgagggaaaagtgatggggtgagaggaaggagggatcatgaaaggtgaaggaggagaatgagagggaaaggagcacagtgtgtaaagaggtgagatcactctgaaaggtgaggagggacactgctaactcagacagaactcacctgaggaggggagagatagggaaggatgccccagggaatgaagcccagagctcacatccatgtttgtttctgcccatcctaggatatgaggaagacatggagacggtgagttccacttttctgttccctccttttctcaccagctgccatagccatcacgttctcactgggcccacacctttgttcccattaataggcaggttttctggggtatagtctcatcccttcttcctccagagatgtgagtggggtatgcgtgggggcattaggatcagagggctgatttcctgacccttcccctcatctgtgtagatttgaagtcccaacatccaagtcatctaattcagaggatgatctccctgaagattatccagtggtcaaaaaaatgcttcatagactgacaggtaaggaaagaagaagggagggaagggaattgaatgaaagtctgtgttagattttcttccttttagccctaaaaagtgatcaggtcctttttgatgtc

SEQ ID NO: 279281 - DNA, 1549 bp, Homo sapiens
ttttgagctgttgtgtggtcactagctctcagtcttttacgtgatcttcgttgactattctccaccctaccccgcctgtgatttagaaaactctctcatgaggtcctctccctgcctccccgtctccagccgacctgaccctggaccctgggaccgcacaccgccgcctgctcatctccgccgaccgccgcagcgtacaactggccccaccagggacgcccgcgccccctgacggccccaagcgcttcaatcagctcccagctgtgctgggtgcgcagggcttcggggccggccgccactgctgggaggtggagactgcggacgccgcctcctgcagagactcttctggggaggatgcggacgacgaggagagccactatgcagtgggcgcggccggggaatcagtgcaacgcaagggctgcgtaaggctgtgccctgcgggggccgtgtgggccgtggagggccgcggcggccgcctgtgggccctcacggcacccgaacccaccctgctgggcggtgttgagcccccgccgcggcgcattcgcgtggacctggactgggagcggggccgcgtggccttctacgacggccgctcactcgacctgctttacgccttccaggcgcctggccccctgggggagcgcatcttcccgctgttctgcacctgcgaccctcgtgctccgctccgcattgtaccagcggaaagctgagtctcgtctccaactagaagtttggcccggccactggccctgcagctgctttttgggggtggaattccccactcatttctgggaacacattcacacgcccattgcaggagtattaatagcaacccacattttcgccccaaaataatgagacctcacctggtctccacgtttccacgtccctgctcaaaaccaaatccattcctgccttctggctctcagaatcttctctcccctacagctactacagtacttcctgacttctcccattcaaaccattctagctgcaatggggaacaggccctccccatcagtattggtaaagtgaccatgattcctacatagaggctctgctggtcaaatacttgactcccactcttgccactcctagctccagaagggctcagggccttccccacagatctaaggactgggctaccctgcctgtccactgaggtttctcctaaaacaagaggcttgactctggtctgggccctgtggccctctgggaagctttgtacctcttttgcaggatctgggggtggggagggacaagctagttccccaacctcctatgactgctttctatgctcacagccttttttccataagaaccttcttgaaacttctccccgcacatactcacggaaaggaaccaatggtgctatttcccctctctcctcctcaacctgggaatacttcagacatctccaaactcatccttgtgtatagtctcacacccttccccataagtataaatgggcccatatttaacacattttgtgattttgggttatttattttgtgcatctgtggcaataaatgagatctcagtggtggta

SEQ ID NO: 279282 - DNA, 2003 bp, Homo sapiens
ccccaaaccttacccgggaagcaggagaaccagatgaggcgttacgcaaggcctggtgtttacctcccgtgggagcctcctccctccctataaagcctgatgtggtggagagatttgacgagactgagactctggttgaagagagaggcaatcccaggagaggggcggaaagcggcaaaagttaatgcgggagtcggagagaagggcatctacacagcaagcagcaggggcggcccgccatctgcgcgctcgaaggcggtcacggtggtcgcggaaggggcggcgtccagatcctggctttccatggatgcgcccgagctgggcccggggctggtggagcgtctggagcagctggcgacgtgtcctctgtgcgggggctccttcgaggacccggtgcttctggcgtgcgagcacagcttctgccgcgcgtgtctggcccgccgctgggggactccgccggcgaccggcaccgaggcttcccccaccgcctgtccctgctgcggcctgccgtgtccccgccgcagcctgaggtctaatgtgcggctggcggtggaggtgcgaatcagccgcgagctgcgagagaagctggctgagcctggggcccgtgcggggagacgccgaggggggcgcatccccaccatgggctgcctggacctgcccggagaggatatgaggaagacatggagacgatttgaagtcccaacatccaagtcatctaattcagaggatgatctccctgaagattatccagtggtcaaaaaaatgcttcatagactgacagccgacctgaccctggaccctgggaccgcacaccgccgcctgctcatctccgccgaccgccgcagcgtacaactggccccaccagggacgcccgcgccccctgacggccccaagcgcttcaatcagctcccagctgtgctgggtgcgcagggcttcggggccggccgccactgctgggaggtggagactgcggacgccgcctcctgcagagactcttctggggaggatgcggacgacgaggagagccactatgcagtgggcgcggccggggaatcagtgcaacgcaagggctgcgcgcctggccccctgggggagcgcatcttcccgctgttctgcacctgcgaccctcgtgctccgctccgcattgtaccagcggaaagctgagtctcgtctccaactagaagtttggcccggccactggccctgcagctgctttttgggggtggaattccccactcatttctgggaacacattcacacgcccattgcaggagtattaatagcaacccacattttcgccccaaaataatgagacctcacctggtctccacgtttccacgtccctgctcaaaaccaaatccattcctgccttctggctctcagaatcttctctcccctacagctactacagtacttcctgacttctcccattcaaaccattctagctgcaatggggaacaggccctccccatcagtattggtaaagtgaccatgattcctacatagaggctctgctggtcaaatacttgactcccactcttgccactcctagctccagaagggctcagggccttccccacagatctaaggactgggctaccctgcctgtccactgaggtttctcctaaaacaagaggcttgactctggtctgggccctgtggccctctgggaagctttgtacctcttttgcaggatctgggggtggggagggacaagctagttccccaacctcctatgactgctttctatgctcacagccttttttccataagaaccttcttgaaacttctccccgcacatactcacggaaaggaaccaatggtgctatttcccctctctcctcctcaacctgggaatacttcagacatctccaaactcatccttgtgtatagtctcacacccttccccataagtataaatgggcccatatttaacacattttgtgattttgggttatttattttgtgcatctgtggcaataaatgagatctcagtggtggta

SEQ ID NO: 279283 - DNA, 2063 bp, Homo sapiens
tattgcaagaggggaagcagctttattgtaaggcttttatataccaactcttagcccgagggctctgggtgtgtgtttggtctgtgtgatggaggatgagggaaaagtgatggggtgagaggaaggagggatcatgaaaggtgaaggaggagaatgagagggaaaggagcacagtgtgtaaagaggtgagatcactctgaaaggtgaggagggacactgctaactcagacagaactcacctgaggaggggagagatagggaaggatgccccagggaatgaagcccagagctcacatccatgtttgtttctgcccatcctaggatatgaggaagacatggagacggtgagttccacttttctgttccctccttttctcaccagctgccatagccatcacgttctcactgggcccacacctttgttcccattaataggcaggttttctggggtatagtctcatcccttcttcctccagagatgtgagtggggtatgcgtgggggcattaggatcagagggctgatttcctgacccttcccctcatctgtgtagatttgaagtcccaacatccaagtcatctaattcagaggatgatctccctgaagattatccagtggtcaaaaaaatgcttcatagactgacagccgacctgaccctggaccctgggaccgcacaccgccgcctgctcatctccgccgaccgccgcagcgtacaactggccccaccagggacgcccgcgccccctgacggccccaagcgcttcaatcagctcccagctgtgctgggtgcgcagggcttcggggccggccgccactgctgggaggtggagactgcggacgccgcctcctgcagagactcttctggggaggatgcggacgacgaggagagccactatgcagtgggcgcggccggggaatcagtgcaacgcaagggctgcgtaaggctgtgccctgcgggggccgtgtgggccgtggagggccgcggcggccgcctgtgggccctcacggcacccgaacccaccctgctgggcggtgttgagcccccgccgcggcgcattcgcgtggacctggactgggagcggggccgcgtggccttctacgacggccgctcactcgacctgctttacgccttccaggcgcctggccccctgggggagcgcatcttcccgctgttctgcacctgcgaccctcgtgctccgctccgcattgtaccagcggaaagctgagtctcgtctccaactagaagtttggcccggccactggccctgcagctgctttttgggggtggaattccccactcatttctgggaacacattcacacgcccattgcaggagtattaatagcaacccacattttcgccccaaaataatgagacctcacctggtctccacgtttccacgtccctgctcaaaaccaaatccattcctgccttctggctctcagaatcttctctcccctacagctactacagtacttcctgacttctcccattcaaaccattctagctgcaatggggaacaggccctccccatcagtattggtaaagtgaccatgattcctacatagaggctctgctggtcaaatacttgactcccactcttgccactcctagctccagaagggctcagggccttccccacagatctaaggactgggctaccctgcctgtccactgaggtttctcctaaaacaagaggcttgactctggtctgggccctgtggccctctgggaagctttgtacctcttttgcaggatctgggggtggggagggacaagctagttccccaacctcctatgactgctttctatgctcacagccttttttccataagaaccttcttgaaacttctccccgcacatactcacggaaaggaaccaatggtgctatttcccctctctcctcctcaacctgggaatacttcagacatctccaaactcatccttgtgtatagtctcacacccttccccataagtataaatgggcccatatttaacacattttgtgattttgggttatttattttgtgcatctgtggcaataaatgagatctcagtggtggta

SEQ ID NO: 279284 - DNA, 1484 bp, Homo sapiens
gcgacttccggcagctggacttggaaaagcaaggagtgtcgggaatggcgaccaagcggctcgcgcggcagcttggattaattaggagaaagtcaattgcgccagcaaatggaaatctcggaagaagcaaatccaagcagttgtttgactacttaattgtcattgattttgaatcgacatgctggaatgatgggaagcaccaccatagccaggaaataattgagtttccagcagtgttgctgaacacatcaactggacagattgactctgagttccaggcttatgttcaacctcaggaacatccaattctttcagaattttgcatggaattgacaggcataaagcaggctcaagttgatgaaggagtccctctgaagatttgcttatctcagttctgtaaatggattcataagattcagcaacagaagaacattatttttgctactgggatttcagagccttctgcttctgaagtaaaattatgtgcatttgttacttggtcagactgggacttgggggtttgcctggagtatgagtgtaaaagaaaacagctgttaaaacctgtgtttttaaattcttggattgatctcagagcaacttacaagcttttctataggagaaaaccaaaaggactaagtggtgccttgcaggaagtaggaatagaattctcaggacgagaacattctgggttggacgattctcggaatactgcccttcttgcttggaaaatgatcagagatggttgtgtaatgaaaattacaaggtcgttgaacaagggtcccttcctcttgccttcgtggacctggaacagtgatctggcctcaggggaccagcatgcttttcttcagcaagaatttggctgtggaacctacagaaccttacttcagaagcccaatatgagtaaacaggaaaaggggaatattctctggttgacaatggtgtggctgtcactggcatgtctgcaaaggaaaaactacaatgactgcatgttaaacacagcatcacagactgttaccactgaaaaattttgagaagctctccacttgaacctcttcatgtcatgaatcaggtgccagtggcttagcttgaattacagggtaaaagccatcactttctctatccttttaggtgctttctagaatcaaaactaaactttgtcatcaaaggcccatttataatagctgctttcctagctttttattctatgataaagaaggattgaagcatttttaaaacttgagatttttatcatacctccagcagagtaaggagtctgtgtgatcttgcaatcatggataaggaagaattttccccttccctcccctatggatgctttaaaatgtgattttttaaaaatgagtatgttaatacaatacatgttagtaaaagccatgggtactgatgggccaacacactacagcctactggcaaaatctgacttgcctcttgtttctgtaaataaaatgttattgcccattcattga
